United States Patent 9,061,059 (MODIFIED POLYNUCLEOTIDES FOR TREATING PROTEIN DEFICIENCY) - sequence listing, part 92

SEQ ID NO: 180466 - DNA, 3489 bp, Artificial Sequence
  Description of Artificial Sequence: Synthetic coding sequence
atggagcccaacgacagcaccagcaccgccgtggaggagcccgactctcttgaagttttagtgaagaccctcgatagccagacccggacttttattgtcggcgctcagatgaacgttaaggaattcaaagaacatatcgctgcttctgtgtcaattccctctgaaaaacagaggctcatttaccagggtagggtcctccaggatgacaagaagttacaggagtacaatgtgggagggaaagttatacaccttgtagagcgggccccaccccagacacatctgccctctggtgccagttctggtacagggtcagcgagcgcaacccatggaggtggcagcccgcccgggacccgtggaccgggggcgtctgtccatgatcgcaatgctaattcctatgtgatggtggggaccttcaacctcccctccgatggtagcgcggtcgatgtccatatcaacatggaacaggctcccatccagagcgagccccgggttagactggtcatggcacagcatatgatccgggacatccagactctcctgagccgcatggaatgtcgcggtggaccccagcctcagcacagccaaccaccccctcaaccgccagctgtgacacctgagcccgtcgctttgtctagccagacctctgagccagtagagtccgaggcccctcccagagagccgatggaagcagaggaagtcgaggagcgagcacccgcccagaaccctgaactcacacccggcccggctcccgcaggccctaccccagctccagagaccaatgccccaaatcacccatcgccagcagaatacgtcgaggtactgcaggaattgcagcggctggagtcccggctccagccctttctgcaaagatactatgaggtcctgggcgcggcagcgactactgactacaataacaatcacgaaggcagggaggaggatcagcgccttatcaacctggtgggggagtcactgagactgctgggcaatacctttgtagccctgtctgatctgcgctgtaatctagcttgcactccacctaggcatctgcatgtggtcagacccatgagccactatacaacaccaatggttctgcaacaggcagctatccccatccagatcaacgttggcaccaccgtaacaatgacgggtaacgggacgagaccgcccccaactcccaacgcagaggcaccccctccaggacccggccaggcttctagtgtagccccgtcctccacgaatgtggaaagctccgcagagggagcaccacctcccggcccggcaccacctccagcaacctcccatccccgggtgatacggatctcccatcagtctgtcgaaccggtcgttatgatgcacatgaacatccaggacagcgggacccagcccggcggagtaccctccgcccccacgggcccattagggcctccggggcatggacagaccttagggagtaccctaatccagcttccatccctgccgccagagttcatgcacgcagtggcccaccagatcacacatcaggccatggtcgccgccgtcgcaagcgccgccgccggacagcaggtgcctgggtttccaacagcacctaccagggtggtgatcgcacgcccaacccccccgcaggctagaccttctcacccgggtggcccccccgtaagtgggactctgcagggcgccggcctgggcacaaatgcttctctggctcagatggtttcaggactggtcggtcagctgcttatgcagcctgtactcgtcgcccagggtactcccggtatggcgccccccccggcacctgccacagccagcgcgtcggcggggaccactaacaccgcgaccactgctggcccggctcccggcggccctgcccagcccccacctacaccccaacccagtatggccgacttgcaatttagccaattactggggaacttactgggtccagcgggccctggagctggtggctctggagtcgcctctccaactatcaccgttgcgatgcccggcgtccctgcattcctgcagggtatgacagattttctgcaggcaacacagacagctcctccccccccccccccaccccctcctccgcctcccgcaccagagcagcagacaatgcctccgcctggaagcccgtctgggggggcgggttcaccagggggcctaggtctcgaatccctgtcacctgaattcttcacaagtgtggttcagggcgtgctatcttccctactgggatctctgggggctagagcggggagtagcgagagtattgcagcgttcatccagcgcctctccggcagctcaaatattttcgaaccaggagccgatggggcgctgggtttcttcggcgctctgctctcactactgtgccagaatttctccatggtggatgtcgttatgttacttcatggccattttcaacccttgcagcgactccagcctcaacttaggtccttttttcatcagcactacctggggggacaggagcctaccccatctaacatccggatggcaacacacacactaatcaccggactcgaagagtacgtgagggagagttttagcctcgttcaggttcagccaggagtcgacataatcaggacaaatctggaatttctacaggagcagtttaactccattgccgcccatgtgctccactgtaccgatagtggcttcggcgctagacttctggagctctgtaaccaagggctgttcgaatgtctggccctcaacttgcactgtttgggggggcagcaaatggagctggccgcggtgatcaacggccgtatacgaaggatgtcgcggggcgtgaatcctagtttggtgtcatggctgactaccatgatgggccttcgattgcaggtcgtccttgagcatatgcccgtaggcccagatgccattcttcgatatgtgcgaagggttggcgaccctcctcagccccttcctgaggagcctatggaggtccagggagccgagagggccagcccagagccacagcgggagaacgcctccccagccccaggcaccaccgccgaggaagcaatgtcacgaggccccccccccgcccccgagggcggcagtcgagatgagcaggacggcgctagcgccgagactgagccatgggccgcagccgtgcctcctgaatgggtgccaatcattcagcaggacatccagagtcaaagaaaggtgaaacctcagcctcctctgtccgacgcctacctgagcggaatgcctgcaaaacgccgtaagacaatgcagggggaaggccctcagctgctgctctcagaagcagtgagcagggctgccaaggcggctggggccaggccgttgacatctcccgaatccttatctcgggacttggaggcccccgaagtccaggagagctacaggcagcagttgcgatcagatattcagaagcgccttcaagaggatcctaactactcacctcagcgtttccctaacgcgcagcgtgccttcgccgatgacccatag

SEQ ID NO: 180467 - DNA, 3489 bp, Artificial Sequence
  Description of Artificial Sequence: Synthetic coding sequence
atggagcccaacgacagcaccagcaccgccgtggaggagcccgactctctcgaggtgctcgtcaagacgctggatagccagactaggacctttattgtgggggcccagatgaacgtcaaggagttcaaggagcacatcgctgcttcggttagcattccttccgaaaaacagcggctgatctaccagggccgagtcctgcaggacgataagaagcttcaggaatacaacgtgggtggcaaagtcattcatctggtcgaacgagcccctcctcagactcacttgccgtctggggcgtcgagcggcaccgggagtgcctccgcaacacatggaggcggcagtccacccggcacacgaggccccggggcctcagttcatgatcgcaatgccaactcatacgttatggtgggaacttttaatttgccgagcgacggttctgctgtggacgtccacatcaacatggagcaggccccaatccaaagcgaaccacgggtacgcttagtgatggcccagcacatgatacgcgatattcagaccttactgtcacgcatggagtgccggggcggcccgcaaccccagcactctcagccaccgccacagccgccggctgtcactccagagcccgtcgcactgagcagtcaaacaagcgagccagtggagtctgaggcccctcccagggaacccatggaggctgaggaagttgaagagagggcacctgcacaaaaccccgagctcacccctggtcccgccccagccgggccaaccccagctcccgagacgaacgccccaaaccacccctcaccagccgaatatgtggaggtacttcaggagctacagcggttggagtcacggttacagccgttcctgcagcggtattatgaggtgctgggagccgcggccacaacggactacaataataatcacgaaggacgggaagaagaccagcgactaataaacttggtcggggagagcctcaggctgcttggaaacacttttgtcgctttgtctgacctcaggtgcaatctggcatgcacacctcctagacacctccacgtcgtgcgcccaatgagtcattatacaacacctatggttctgcagcaagctgctatacctatccagattaacgtcggcactacagtcaccatgacagggaacggtaccagacccccaccaactcccaatgccgaggccccacccccaggacctggacaagccagttctgttgctccctcatcgaccaatgttgagagctctgccgagggagcacctccccccggtcctgccccaccacctgctaccagtcacccccgggtgatccgtatttcccaccagagcgttgagccagttgtgatgatgcacatgaatattcaagattccggaacccaacctggaggcgtaccttccgccccaaccggtccgctcgggcctcctggccacggccagacccttgggtctaccttaatccagctcccttctctccctccagagtttatgcacgctgttgcccatcagatcacacaccaggcaatggtcgccgcggtggcctctgctgctgctggccaacaagttcccgggtttcctactgcacctactcgcgttgttatcgcacgacccacaccgcctcaggctcggccgtctcaccccgggggccccccggtctcaggaacattgcagggagcaggtttgggaacgaatgcctctcttgctcagatggtgagcgggctggttggccagctgctcatgcagcccgttctcgtggctcagggcaccccagggatggctccaccccccgcccccgctacggctagcgccagcgccggcaccaccaacacagccaccacagccgggcctgctcctggcgggcccgcacagcccccccccacaccccagcccagtatggccgatctgcagttttctcagctgctgggcaatctgctcggtcccgctggtcctggggccggtggccccggggtcgcaagccccacaatcacagtggcaatgccgggagtgcccgcctttttacaggggatgactgacttcctacaggctacccaaactgcgccacccccaccccctccgccgcctcctccaccccctgccccggaacagcagactatgcccccacctggctcgccgtctggaggggccggcagtcctggaggcttaggcctagagagcctgtctccagagttctttacgtccgttgttcagggcgttcttagctctcttctcggtagccttggtgctagagcaggcagctctgagagcattgccgcatttatccaacgcctgtccggatcctcgaacatatttgagcccggagctgacggggcgctcggtttttttggagcacttttatctctcttgtgtcagaatttttccatggtcgatgtggtgatgcttctgcatgggcacttccaaccgttgcagcggctccaaccccaacttcgctcattctttcatcagcattacctggggggacaagaaccaacaccatctaatattagaatggctacccacacgcttattacaggcctggaggaatacgttcgcgagtcatttagtttggtgcaagtacagcctggggtggacatcatccggactaacttagagttcctacaggaacagtttaactctatcgctgcacatgtgctccattgtaccgattcgggctttggtgcccggttgcttgagctgtgtaaccagggattattcgaatgcttggctctcaacctgcactgcctaggagggcagcagatggagctcgcggctgtgatcaatggtcgaattagacgtatgagccgcggcgtgaacccttccctggtcagttggcttaccacgatgatgggactgcgcctgcaagtggtgctggagcacatgccagtgggtccagacgcaatcctccgttatgttagaagagtcggggacccgcctcagcctctgccagaggagccaatggaagtccagggcgctgagcgcgcttccccagaacctcaacgagaaaacgcctctcccgcacccggcactactgctgaagaggccatgtctcgcgggccaccaccggcccctgagggaggttcccgggacgaacaggacggcgcttcagctgagacagaaccttgggctgccgccgtgcccccagagtgggtgccaatcattcagcaagacatccagagccagaggaaggttaagccacagcccccgctgtctgatgcctacctctccgggatgcctgccaaacggagaaagacgatgcaaggggagggacctcagctgctcctaagtgaggctgtaagcagagctgccaaggccgcgggggctcgaccacttactagcccagagtctttgtcgagagatttggaagcccccgaagtccaagagtcatacaggcagcagctgcggagcgatatccagaaacgccttcaggaagaccccaactactcaccgcaacgtttcccgaacgcacaaagggcctttgctgatgatccgtag

SEQ ID NO: 180468 - DNA, 3489 bp, Artificial Sequence
  Description of Artificial Sequence: Synthetic coding sequence
atggagcccaacgacagcaccagcaccgccgtggaggagcccgactcccttgaagtccttgtgaaaactctcgactctcagactcggaccttcattgttggggcccagatgaatgtcaaggagtttaaagaacatatcgcggcctcagtgagcatacctagtgagaagcagcgtctgatctaccaggggagagtgttgcaggatgataaaaagctccaagagtataatgtcgggggaaaagttatccatcttgtcgagcgggctcccccacagactcacttgccatccggagcatctagcgggaccggcagcgctagtgcaacgcatggaggcggatccccacctggcacccgcgggcccggagcctctgtacatgatcggaatgccaatagctacgtgatggttggtacctttaatctgccctcagacgggtctgctgtggatgtacatattaacatggaacaggctccgatccagagcgaaccccgggtccgcttagtcatggcgcagcatatgatccgtgacattcagactttattgagccgcatggagtgtcgcggcggtccacagccacaacacagccagccgccaccacaaccacccgctgtcactccagagcctgtagcactgagctcccagacgtccgagcccgttgagagcgaagcacctccgcgggagcccatggaggcagaagaggtcgaagagcgcgcacccgcccagaacccagagctgacccctggtcctgctcccgcagggccaaccccagcaccggaaactaacgcacccaatcatccatctcctgctgaatacgttgaggtgctgcaggaactccagcggcttgagtctcgactccaaccctttctacagaggtactacgaggtactcggggctgcagcaaccaccgattataacaataaccacgagggacgcgaggaggaccaaaggctgatcaatctagtaggcgaaagcctccggttactaggaaatacttttgttgctctgtccgatttgcgctgtaacctcgcctgtactccaccacgccatctacacgttgtgcgccccatgagtcactacaccaccccaatggttctgcagcaggctgccatacctattcagattaacgtgggaacgacagtgacaatgacaggaaatggtaccagacctcctccaacaccaaatgctgaagcacccccccccggaccgggacaggcatcatcagtggctccatcctcaacaaacgttgaatccagtgcagagggggccccgccccccggcccagctccaccgcccgccacctcccatccccgtgtcatacgcatcagtcatcagtcggtggagcccgtggtcatgatgcacatgaatattcaggacagcggcacacagcctggcggcgtgcccagcgcaccgacaggccctcttggccccccaggacacggacagactcttggctccacactcattcagctcccctccctccctcccgaattcatgcacgccgttgcccaccagatcacacatcaggcgatggtagctgccgtcgcatccgcagcagccggccagcaggtcccggggttccccacagcccccactagagtggtcatcgcccggcctacacctccacaagcccggccatctcaccccgggggaccacccgtatctggcactttacagggcgcaggcttaggaaccaacgcctctctggcacagatggtttccggcttggttgggcagcttttaatgcagcccgtgctggtcgcccaaggtactcccgggatggccccaccaccagcccccgccacagcatccgcctccgctggaactactaacactgccaccaccgccggtcctgctcccggaggacccgctcagccaccaccgactcctcagccaagtatggccgacttacagttctcacagctgctcgggaaccttctgggccccgctggtccaggggctgggggctctggggttgcctccccaacaattacggtcgccatgccaggcgtgcctgcatttctgcagggaatgaccgacttccttcaggcaactcaaacagccccgccacctcctccccccccccccccacccccccctgcccctgagcaacagacgatgcctccacctggttctcctagtggtggtgcaggcagcccggggggattgggactcgaatctttaagccccgaatttttcacgtccgtggtccagggtgtactttccagtttactgggatcattgggggctcgggccggatctagcgagagcattgctgcttttatacagagactgagcggcagtagcaatatatttgagccgggagccgacggagcactcggcttcttcggagcactgctgtccctgctgtgccagaacttctcaatggtggacgtcgtcatgctcctccatggacatttccagccccttcagcgactccaaccacagctcagaagcttctttcaccagcactatctgggcggacaggagcctacaccatccaacatcagaatggcaacacacactctgattactggattagaagaatacgtgcgcgagtccttctccctcgtacaggtacagcctggtgtagatatcatcagaaccaacttggaatttctacaagaacagtttaatagcatcgctgcacatgtgctacactgcactgattccggcttcggtgccagactactggagctgtgcaaccaagggctgtttgagtgtctcgccctgaatctgcattgcttaggagggcagcaaatggaattggcggccgtgataaacggcaggattagacggatgtctcggggagtgaatccatctctcgtgtcctggcttacgaccatgatgggacttcgactgcaggtagttctcgaacacatgcctgtgggtccagacgccatcctgagatacgtgcgaagggtgggtgacccgccacaaccactgcctgaagagccaatggaagtgcagggagctgagcgcgcctcccctgagccacagcgcgagaatgccagtcctgcacctgggactacagccgaagaagctatgtcgagggggccgcctcctgcgcctgagggtggctccagagatgagcaagacggagctagtgctgaaaccgagccctgggccgcagctgtcccacccgaatgggtaccaatcattcagcaggacatccaaagtcagcggaaggtcaagccccaacccccactcagtgatgcctatctgtccggaatgcccgccaagagaagaaagactatgcaaggagaagggccccagctgcttctttcagaggctgtgtctcgggctgccaaggcggccggggcacgacctctgacgtcccctgagtctctgtcacgcgacctcgaggctcccgaagtgcaggaatcctacaggcagcagctgaggtccgatattcagaaacgcctgcaggaggatcctaattactcgcctcagcgttttcccaacgcccagcgggcatttgctgatgacccctag

SEQ ID NO: 180469 - DNA, 3234 bp, Artificial Sequence
  Description of Artificial Sequence: Synthetic coding sequence
atggagcccaacgacagcaccagcaccgccgtggaggagcccgactctctcgaagtactcgtgaagactctggatagccagactagaaccttcattgtgggagcccagatgaatgtgaaggaattcaaggaacatatcgccgcttccgtatcaattccctctgaaaagcaaagattgatttaccaggggcgcgttctgcaggacgacaagaagttacaggagtataatgtgggaggcaaggttatacatctggtggagcgcgctcctccgcagacccatctcccatccggtgctagtagtggcacaggctccgcctccgcaacccacggaggtggaagcccccctggaacaaggggcccgggggccagcgttcacgaccggaacgctaactcctacgtgatggtgggcacctttaatctgccaagtgatgggtccgccgtcgacgtccacataaatatggagcaagcccctattcagagcgagccgcgcgtacggttggtaatggcacagcacatgataagggacatacagaccttactcagccgaatggaatgccggggcggcccacaaccacaacattctcagccccctccccagccccccgctgtcacacctgagccagttgccctgtcaagtcagacatcggaaccggtcgaaagtgaagcccctcccagggaacccatggaggcggaggaggtggaagagcgcgctccagctcaaaaccctgagctgacaccaggccctgctccagctggccctacacctgcgccggaaacgaatgcccctaatcacccttcaccagccgagtacgttgaagtgcttcaggagctgcagagactagagtcaaggctacagccgtttctccagagatattatgaggtgctaggtgcagccgcaacaacagactataataacaaccatgagggacgcgaagaagatcaaaggctaattaaccttgtcggggagagcctgcgcctcctaggaaacacatttgtggccctgtctgatcttaggtgcaatctcgcttgtacccctcctcgtcacctgcatgtggtgagaccgatgagccattataccacaccaatggttctccagcaagccgctattcccatccagatcaacgtagggaccactgtgacgatgactggtaatgggacaaggcccccacctaccccaaacgcggaggcccctccacccggacctggccaggcgtcttccgtggccccttcgagcaccaacgtcgagtcaagtgcagagggggctcccccaccagggcccgctcccccgcctgccacgtcccatcctagggttattcgcatatcacatcaatcggttgagcccgtggtgatgatgcatatgaatatacaggattcaggtactcaacctggaggtgtgccaagtgcccccaccggacccctcggtcctcccggacacggacagacgctgggacagcaggtacccggctttccgacagcacctacgagggtggtgatcgctaggcccacacctccccaagcccggccctcgcacccaggtggcccccccgtctcaggcacactacaaggagctggactgggcacgaacgcttctctcgcccaaatggtatctgggttggttgggcagctgctgatgcagcccgtactcgtggcccagggaactcctggcatggctccgcccccggcgccggccactgccagcgcctctgcaggcacaacaaacactgcaaccacagctggcccagcacctggcgggccagcccagcccccacctacgccccagccatctatggctgatctccagttcagccagctccttggaaatctcctgggacccgccgggcccggcgctggaggtccgggcgtcgcctcgccaaccattacagtggctatgccaggcgtgccggccttcctacaggggatgactgatttcctccaagccacgcagactgcccccccgccgcccccccccccaccaccacccccacctgcccctgaacagcagactatgccaccccctggttcaccgtctgggggggcaggctctcccggagggcttggccttgaatcactttcgcctgagttttttacgtctgtcgtgcagggcgttctgagttctctcctgggatcacttggagctcgcgctggttctagtgagtcaatagccgccttcatccaaagattgtccggctccagtaacatcttcgagcctggggcagacggagcgctggggttcttcggagctcttctgtcactgctgtgccagaatttttcaatggtggatgtggttatgttgctgcacgggcatttccagccccttcagcgcctgcaaccacagctccgatccttcttccatcagcactacctcggcggtcaggaacctacaccttctaacatacgaatggccacccatactctgatcaccgggttagaagaatacgtcagggagagtttttcccttgtgcaggtccaaccaggggtggatattatacgcactaatcttgagtttctgcaggaacagttcaattcaattgcggcacatgtgctgcactgcacagactcaggcttcggagcacggctgttggagttgtgtaatcagggcctgtttgagtgcctggcactcaatttacactgcctaggcggccagcaaatggaattagccgctgtaatcaatggacgcattcgacgcatgagtcggggagtcaaccctagcctcgtatcctggcttactactatgatgggccttcgactgcaggtcgttttggaacacatgcccgtcgggccagacgctattctgaggtatgtgcggcgagttggagacccaccccagcccctgcccgaagagccaatggaggtacagggcgctgaacgcgcaagcccagagcctcagagggaaaacgcctcaccagcacccggaaccaccgccgaggaggccatgagccgtggacctccacccgcccccgaagggggttccagggacgagcaggatggtgcctctgctgaaactgagccctgggccgccgcggtgccaccagagtgggtgccgatcatccagcaagacattcagtcccagaggaaggtcaaacctcaaccacctctctccgatgcatatctatccggaatgccagccaagaggcggaaactcaggtccgacatccagaagcgtctccaggaggaccccaattactctccccagagatttccaaacgctcagcgcgcctttgcagatgatccatag

SEQ ID NO: 180470 - DNA, 3234 bp, Artificial Sequence
  Description of Artificial Sequence: Synthetic coding sequence
atggagcccaacgacagcaccagcaccgccgtggaggagcccgactctctcgaggtgcttgtgaaaacattggattcacaaacacgcacttttattgtcggagcacagatgaacgtcaaagagtttaaggagcatattgccgccagcgtctccatacccagtgaaaaacaaaggctaatttaccagggccgcgtcctccaggacgacaaaaagctccaggagtacaacgtgggcggaaaggtcattcatttggtggaacgggcaccgccccaaacccatctgccctcaggagctagctcgggtaccgggagcgccagcgcaacccacggaggcggatcccctcctggcactaggggtccgggggctagtgtacatgacagaaatgccaattcctacgtcatggtgggcaccttcaatctgcctagcgatggttccgcagtggacgtccatatcaacatggaacaagcacccatacagtcagagccccgggtcaggttagtgatggcccagcacatgatcagagatatccagactcttctttcgcggatggagtgccgcgggggcccccaaccccagcacagccagccccccccccaaccccctgctgtgacacctgagccagtggccctgagttcacagaccagcgagcccgtcgaaagcgaagcccctccaagagaaccaatggaggccgaagaggtggaggaaagggcgccagcacagaatccagagctcacccccggaccagcccctgcaggcccaacaccggctcccgagaccaatgcacccaaccaccccagcccagccgagtacgtcgaggttttacaggagctgcagaggttggagtcacggctccagccatttctgcagcgctactatgaggttctgggtgccgctgcaactactgactacaataacaaccacgagggaagagaagaggatcagaggctgattaatcttgtgggcgagtcactgcggctgctgggaaatacatttgtcgctctgagcgacctgcgttgcaacttggcttgcacgccacctaggcacttacacgtggtgcggcccatgtcccattacacaaccccaatggtcctccagcaggctgcaatccccatccagatcaacgtcggcacaacagttaccatgacaggaaacggtaccagacctccacccacacccaacgccgaagctcctccaccaggacccggacaggctagtagtgtcgccccctcctcaacaaacgtggaaagcagtgctgagggagcaccgccacccggacctgcccccccccctgcaacttctcaccccagagtgattcgaatttcccatcagtcagtcgaaccagttgtgatgatgcacatgaatattcaagactcgggaacacagcctgggggagtacccagtgcccccacaggacccctgggcccgcctgggcacggtcagacactggggcagcaagttcccggttttcctactgcacctacacgcgtggtcatcgctagacccacaccgccgcaggcaagacctagccacccgggcggcccccccgtgagtggaacgcttcagggggccggactgggcactaacgcttccttggctcaaatggtcagtggtctcgtcgggcaactcctcatgcagccagtcctcgtggcacaaggtactccaggtatggctcctcccccggccccagcaaccgccagcgcctccgctggcacaaccaatacagccacaacagctggaccagctcctggaggacccgcacagcccccacctaccccccagccgagtatggccgacttacagttctcgcagctcctcggtaatttactgggccctgccggcccgggcgccggcgggtctggcgtggcatctccgaccattaccgtagccatgcctggcgtgcccgccttcttacagggaatgacagatttcctgcaggccacccagacagcaccccccccaccaccccctcccccacccccacccccggcccccgagcaacagaccatgcctcctccgggtagcccttcgggcggagccggttcacccgggggcctggggcttgagagcctctccccagaattcttcacatcagtggtgcaaggggtcttgtccagtctgttgggaagcttaggggcccgcgccggcagttctgagagcatagccgctttcatccaaagactctcgggctcgtccaacatcttcgagcccggggcggatggggctcttgggttttttggcgcgttgctgtcgcttttatgtcagaatttctcaatggtggacgtggtaatgctgctgcatggtcacttccaacctctccagaggctccagcctcaactgaggtccttctttcaccagcactacttaggcggccaggagcctactcctagcaatatccggatggctacacacaccctgattacaggcctagaggaatacgtgcgcgagagtttctcattagtgcaggtgcagcccggagttgatattataagaacgaaccttgagtttttgcaggagcaattcaacagtattgccgctcatgttttacactgcacagacagcggatttggcgcccggctcctagaactgtgcaaccaaggcctattcgagtgtctggctctgaaccttcactgtttgggcgggcagcagatggagctggccgcagtgattaatggtaggataagacggatgagtaggggtgtgaacccatcgctggtgtcttggttgaccactatgatgggcctgcggctgcaggtggtgttggaacacatgccggttgggccggatgcgatactccggtacgtgagaagggtgggcgaccctccgcagcccctgccagaggaaccgatggaggtgcagggagccgaacgcgccagccctgagccccagagagagaatgccagccccgcccccgggaccaccgccgaagaggccatgtctcggggacctcctccagctcccgagggcgggtcacgggatgaacaagacggtgccagcgcggaaaccgagccatgggccgccgccgtgccgcctgagtgggtgcctattatacagcaggatatccagagtcagaggaaggtgaagccccagcctcctttgtcagacgcttatctgtcaggaatgcccgcaaagcgtcgtaagctccgcagcgacatacaaaaaagactgcaggaagatccaaactactccccgcagcgttttcctaacgcacaaagagcgtttgctgatgatccctag

SEQ ID NO: 180471 - DNA, 2712 bp, Artificial Sequence
  Description of Artificial Sequence: Synthetic coding sequence
atggagcccaacgacagcaccagcaccgccgtggaggagcccgactcgctagaggtgctcgtgaagacacttgattcccaaactcgtacattcatagttggggcccagatgaacgtgaaggaatttaaagaacacattgccgcctccgtgtctatacccagcgaaaaacagagactgatataccagggccgggtactgcaagacgacaaaaagctgcaggagtataacgttggaggcaaggttattcaccttgtggagagagccccaccccagactcacctaccttctggcgcctctagtggcacaggtagcgcaagcgccacacacgggggaggctctcccccaggaacacggggccccggagcatctgtccacgaccgcaatgccaactcatacgtgatggtcgggacatttaacctacccagcgacggcagtgccgtggacgtgcatatcaatatggagcaggctcctatccagagtgagcccagggtccggttggtgatggcccaacacatgatccgagacattcaaaccctgctatcccgcatggagtgtcgtggcggcccacagccccagcatagtcagccacctcctcaacccccggccgtgacgcccgagcccgtcgctttaagttctcagacgagcgaaccagtggaatccgaggctcctccccgggagcctatggaggcagaggaagtggaagagcgggcacctgctcagaacccagaactgacgcccggtccagcccctgccggaccaacccccgcaccagaaaccaacgctcccaatcacccttcacctgctgaatacgtggaggttctccaggagcttcaaaggctggagtcgcgccttcagcccttcctacaacggtactacgaagttctcggggccgccgctacgacagattacaataacaaccacgaaggaagagaggaggaccaacgcctaatcaatctggtgggcgaatctctacgcctgttggggaacaccttcgtcgcactctccgacctgcggtgcaacttggcttgtacacctccgcggcatctacacgtggtgcggccgatgtcccactatacaactcctatggtgttgcaacaagcagccattcccattcagattaacgtgggaacaaccgtgactatgactggcaacgggactaggcctccacctacacctaatgcggaggcacccccgcccgggcccggacaggcttcgtctgtcgccccctcctcaacaaatgtggaaagctcagccgagggcgcacctccaccagggcctgctcctcctcctgcaaccagccacccaagagtgatcagaatttcgcaccaatcagtggagccggtcgtgatgatgcacatgaacattcaagactccggcacccagcctgggggagtgccttccgcaccaactgggccgctcggcccacccggccacggccaaacgctcggccagcaggtgccaggatttccaactgcccccactcgggtggtgatcgcgagacctacaccacctcaggctcggccctcccatcctgggggccctcctgtgtcaggaacactgggcgcaggcttaggcactaacgcatctctggctcagatggtcagtgggctggtagggcagttgttgatgcagccagtcctggtggctcagggcaccccagggtccccaggaggtctgggtctggagtccctcagcccagagttctttacaagtgtcgtacagggcgtgctgtcaagcctcctgggcagcctcggagcccgggccggatcctctgaatccatcgccgcattcatacagcggctgagtggcagcagtaatatattcgagccgggcgccgatggagcactggggttttttggcgcactgttgtctctactgtgtcagaatttctccatggtggacgtggttatgctattgcacggacactttcaacctctgcaacggctgcagcctcagctgcgcagcttcttccaccagcactacctgggcggacaagagcctactcccagtaatatcaggatggcaacacacactttgattaccggcctggaagagtacgtcagagaatcattttccctcgtgcaggtgcaaccaggggtagacattatcagaaccaaccttgaattcctgcaggaacagttcaatagtatcgccgcacacgtcctccactgcactgactctgggtttggagccaggcttctcgagctgtgtaaccagggtctcttcgagtgcctggccctgaacttgcactgcctgggaggccaacagatggagttggccgccgtcattaacggtagaatccgcagaatgtctagaggagtaaacccttctcttgtctcatggcttacaacgatgatgggacttagacttcaagtggtcctcgaacacatgccggtaggtccagacgctatcctgcgttatgtgcgccgcgttggagacccgcctcagccattgcccgaggaacccatggaggtccagggtgctgagcgcgcctcacctgagccccaggaatgggtaccaattatacagcaggacattcagagccagcggaaagtaaagccacagcctccgctgtccgacgcatacttaagcggcatgcctgctaaaaggagaaaactgcgcagcgatatacagaaacggctgcaggaagaccccaattattcacctcagcggtttcccaacgctcagcgggcttttgccgacgacccctag

SEQ ID NO: 180472 - DNA, 417 bp, Artificial Sequence
  Description of Artificial Sequence: Synthetic coding sequence
atgaaggagtacagcggcttcgccggcgtgagccggccccggggcacgttctttcgcattcggggaagaggtcgagcacgaggggtcttcgccggcaccaataccggccctaacaactctaataccactttccagaagaggcctaaagaagaggagtgggatccagaatatacgccaaagtccaagaagtattttcttcatgatgatagagacgatggtgtggattattgggcaaagaggggaagaggcagggggaccttccagcgtgggcggggccgatttaactttaagaagtccggtagctcccctaaatggacccacgacaagtatcagggcgacggcatcgtagaagacgaagaagagacaatggaaaacaatgaggagaagaaggaccgtcgcaaggaggagaaggaatag

SEQ ID NO: 180473 - DNA, 2610 bp, Artificial Sequence
  Description of Artificial Sequence: Synthetic coding sequence
atgggccggagcaacagccggagccacagcagccggagcaagagcaggtcacaaagcagtagcaggtcacgctctaggtcccactcaaggaaaaaaaggtacagatccagatcccggacctactcccggtctcgtagccgcgacagaatgtactcacgcgactatcggcgggactacagaaataatcggggcatgcggaggccatacggctaccgaggccgcggtcgtgggtactaccagggaggcggaggccgataccatcggggcggatatagacccgtctggaaccgccgacatagtaggtcacccaggcggggccgatctcggagccgttcacccaaacggcggtcagtctcttcccaacggtctcggagtcgcagccggcggagttaccggtcctcaaggagcccacgctcttcctcatcccgctcatcctctccatactctaaaagcccagtctctaaacggagaggcagtcaagaaaaacagacaaaaaaggccgagggcgagccgcaggaagaatcaccgctaaagagtaaatcccaagaggagccaaaagatacgtttgaacacgatcccagcgaatcgatcgatgagttcaataagtcatctgcaacctccggggatatctggcctggtctctcggcctacgacaacagcccacgcagcccacatagcccatctccaatagcaacacctccttctcaatcctcttcctgctcagacgcgcccatgctcagtaccgtccactcagcaaagaacacaccctcacagcacagccattcaatccagcattcccctgaaaggagtgggtctgggtcggtcgggaatggctccagccgctattctccttcccaaaattcacccattcatcacattccctcccgacggagtcctgcgaagactatcgccccccagaacgcccctagagatgaaagcagaggacgttcatctttttaccccgatggcggcgatcaggagacggccaaaaccggtaagtttctgaaaaggttcaccgatgaagagagtcgggtctttctgctcgaccggggtaacaccagggacaaggaggcatcaaaggagaagggtagcgagaagggtagagccgagggggaatgggaggatcaggaagctctcgactacttctcagataaggaatctggcaagcagaaatttaacgactccgagggagacgacaccgaggaaaccgaagactatcgtcaattcagaaagtcagtgcttgctgatcagggaaagtcgttcgccaccgcttcccaccgcaacacagaagaggaaggattgaaatacaagtccaaagtttcattgaagggtaatagagaatcagatggctttagagaggagaagaattacaagctcaaggagaccggatacgtcgttgaaagaccttcaaccactaaagataagcacaaagaggaagataagaatagtgaaaggatcaccgtcaaaaaggagactcagtcccccgagcaggttaagtccgagaagctgaaggatttattcgattactctcccccgctgcacaaaaacctggacgcccgggaaaaatccacgttcagagaggagtctccgctcagaatcaaaatgattgcctctgactcccaccgcccagaggttaaattgaagatggctcctgtccccctggacgattccaaccggccagcgtccctgactaaggacaggctcctggcaagtaccctcgttcactcggtcaagaaggaacaggaatttcgttctatctttgaccatatcaagttaccacaagcgagcaagagtacatcagaaagcttcatacaacacattgtctctcttgtgcatcacgtaaaggagcagtacttcaaaagcgctgccatgactctcaatgaaagattcacctcgtaccagaaggccaccgaggaacactccactaggcagaagtccccagaaattcataggcgcatcgacatatccccctctacattgaggaaacacacccgccttgccggggaagagcgggtattcaaggaagagaaccagaaaggggataaaaaattgaggtgcgacagcgcggacctccgccatgacattgacagacggcgtaaggagagatccaaggagagaggcgacagtaaagggagccgcgagtcatcggggtcacggaaacaggagaaaacaccaaaggactacaaggagtataaatcttataaagacgattcaaaacataagcgggagcaggatcactctcggtccagttccagctctgcctccccctcgtcccctagctcccgggaagaaaaagagagcaagaaggagagggaggaagaatttaaaactcatcacgagatgaaagaatactctggtttcgcaggggtgagtaggccccgggggacgttccacgatgatcgcgatgacggcgtggattactgggctaaacggggcaggggccgtggcacatttcagagaggcaggggcagattcaattttaagaagtccggcagttcccccaagtggacgcatgacaaataccaaggcgatggcattgtcgaggacgaagaggaaacaatggagaacaatgaagagaagaaggacaggcgtaaagaggagaaggagtag

SEQ ID NO: 180474 - DNA, 2610 bp, Artificial Sequence
  Description of Artificial Sequence: Synthetic coding sequence
atgggccggagcaacagccggagccacagcagccggagcaagagcagaagccagtcctctagccggtcgcggtcaagaagccatagccgcaagaaacgctaccgaagtaggagccgcacctacagtaggagccgaagtagagaccggatgtacagccgcgattatagacgcgattaccgaaataatcgagggatgcggcgaccctatgggtacagaggcagggggcgaggatactaccagggaggaggcggtagatatcaccgcgggggctataggcctgtctggaacagaagacactcccggtcccctcgccggggccgatcaagatcgcgcagtcccaagagaaggagcgtctctagccagcgctctaggtcaagaagtcgcaggtcttaccggagttcgcgctctccccgctcaagtagttctcgctcttctagcccttattcaaaaagccccgtttccaaacgaagaggctcccaggagaagcagaccaaaaaggctgaaggggaacctcaggaagaatctccgcttaagtcaaaatcgcaagaggaacctaaagacactttcgagcatgacccctcagagtccatagacgagttcaacaaatcctcggcaacttcaggcgatatctggcctggattaagcgcctatgataactcaccgcgcagtccacactctcctagcccaatcgctactcctccatcacagagtagcagttgcagtgacgctcctatgctatctaccgtgcactcggccaaaaatacccccagccagcatagccatagcattcaacacagtccagagcgctctggatccgggagtgtcggaaatgggtcttcaagatattcgccctcccagaatagtcccattcaccacataccttctcggcggtcccccgcgaagacaatagcaccgcagaacgctcctcgcgacgagagtcgggggagaagttctttctatccagatggcggcgatcaagagactgccaagacaggcaagttcctcaaacgctttacagatgaggaatcaagggttttcttgctcgataggggcaacactagagataaggaagccagtaaagaaaaggggtccgagaagggacgagctgaaggtgaatgggaagatcaggaggcattagattacttctcagataaggaaagcgggaaacagaagtttaatgattccgaaggagatgatacggaggagactgaggattacagacaatttcgcaagtctgtgctagctgatcaaggaaaaagcttcgcaaccgcctctcaccgtaacaccgaagaggagggtctgaaatacaagtcaaaggtgtcgctgaaaggaaaccgggagtcagacggatttagggaggaaaagaactacaaattgaaagaaactggttacgttgtggagagaccctcgacaacgaaggataagcataaggaggaggacaaaaactcagaacgcatcaccgttaagaaggaaacgcagtctcctgagcaggtcaaaagtgagaaactgaaggacctattcgactactctcccccactgcacaaaaatctcgacgccagggagaaatcaacttttcgggaagaaagcccactaagaataaaaatgatcgccagtgacagtcatcggcctgaggtcaagctgaagatggcacccgtaccactcgacgattcaaataggcctgccagcttgacgaaggatcggcttctggcgagtactttggtgcactctgtgaagaaagaacaggagttcaggagcatcttcgaccacattaagctcccacaggcatctaaatctacatccgagtccttcatacagcacatcgtaagcctggtgcaccatgtgaaggaacagtactttaaaagtgccgccatgaccctcaacgaacgcttcacctcataccagaaggcgaccgaagagcactccacgaggcaaaaatcccctgaaatccaccgacggattgacatctctccgtcaacgcttcggaagcacaccagactggcaggggaagaacgcgtgttcaaggaagagaatcagaaaggggataagaaattgaggtgtgattccgctgacctgaggcatgatattgataggcgtaggaaagaacggagtaaggagaggggagattcaaagggctcaagggagtcttctggtagtagaaaacaagagaagacacccaaagattacaaggagtacaagtcctacaaagatgactcaaagcacaagagagaacaggatcatagccggtcttcctcatcctccgcttcaccatctagtccctcaagccgagaggaaaaagagtcgaaaaaagagcgggaggaagagtttaagacccatcacgaaatgaaggagtactccggatttgccggcgtgtcaagaccccgtggaacctttcacgatgatcgtgatgatggggtcgactattgggccaagcgtggcagaggtagaggaacatttcagcggggccgcggccgcttcaactttaagaagagcggaagctctccaaaatggacgcatgacaagtatcagggagacgggattgtggaggacgaggaagagacaatggaaaataatgaagagaaaaaagacagaaggaaggaagaaaaggaatag

SEQ ID NO: 180475 - DNA, 2757 bp, Artificial Sequence
  Description of Artificial Sequence: Synthetic coding sequence
atgggccggagcaacagccggagccacagcagccggagcaagagccggtctcagtcttcttcccgctctcgcagcagatctcattcacggaagaagaggtaccgctccagatcacgcacctactccagatctaggtcacgcgacagaatgtacagcagagactaccgaagggactacaggaataataggggcatgcgaaggccgtatgggtatcggggtcgaggcagagggtattaccagggcgggggcggccggtaccatcgaggcggttatagacctgtatggaacagacgccatagtaggtcccccaggagaggccgatcaagatcccggtctccaaagaggcggtccgtgtcctcacaaaggagcaggtctcgaagccgacggagctatagatcaagccgtagcccccgctcctctagctccaggtcttcctctccttactccaagtcccccgtgtcaaaacgcagaggcagtcaagagaaacagactaagaaggccgaaggcgagcctcaggaggagtcccctcttaaatctaagtctcaggaagaacccaaggataccttcgagcatgacccatcagaatctatcgacgagtttaacaagtcgagcgcgacctcaggtgatatctggcccggcctcagtgcatatgataatagtcccaggtctcctcattctcctagccctattgccacaccccccagccaatcatctagctgtagcgatgcgcctatgctgtcaaccgtccacagcgccaagaacaccccatcacagcattcgcactcaattcaacactctcctgagagaagtggatccggctctgtggggaatggttcgagtaggtattccccttcccagaattcaccaattcatcacataccatccagaaggagcccagccaagacaatagcaccccagaacgcaccccgggacgagagcagggggcggtccagcttctatcctgatggcggggatcaagagacagctaaaacgggaaagtttctgaagagattcactgacgaggagagccgggtgttcctgctggacagggggaatacacgggacaaggaagcctctaaggagaagggatcagaaaaaggaagagctgagggtgagtgggaggatcaggaagcattggactatttcagcgacaaagagtctggtaagcagaaattcaacgatagcgaaggcgacgataccgaagaaaccgaggattatcgacagttccgcaagtccgtgttggctgaccaaggcaagtcatttgccactgcttcccacagaaacactgaggaggagggcctgaaatataagtccaaggtgagcctgaaaggaaatagggaaagcgacggcttcagagaggagaagaactataagcttaaagagacaggatatgtagtcgaacggccgagtaccactaaggataaacacaaggaggaagacaagaacagcgagcggataaccgtgaagaaggagacacaatctcctgaacaggtgaagagcgaaaaactaaaggatctttttgactactccccccctctgcacaagaatctggacgccagagagaagagcacctttagggaggagtcccctttgcgcatcaagatgatcgcttccgactcccaccgacctgaggtcaagctcaagatggctccagttcctctggatgacagtaatagacccgcatctttgacgaaggatagattgcttgcctctaccctggtccacagtgttaagaaagagcaagagtttagatccattttcgatcacattaagctccctcaagcaagtaagagtaccagcgagagttttattcagcacattgtatcactggtccaccacgtgaaggagcagtacttcaagtccgcggccatgacgttaaacgagaggttcacctcttaccaaaaggccactgaggagcacagcaccaggcagaagtctcctgaaatccaccgacggatagatataagtccgtctactcttcgcaagcacactcggctcgccggcgaggaaagagtgtttaaggaggaaaaccagaagggagacaagaaactgcgatgtgacagcgccgatctcaggcatgatatcgaccggcgacgcaaggaacgcagcaaggagagaggcgattcaaaaggtagccgcgagtctagcgggagcagaaaacaggaaaaaactcccaaggactataaggaatataaatcctataaagatgacagcaagcacaaacgtgaacaggaccattcacgcagcagtagctcctcagctagccccagtagcccaagcagccgggaagagaaagagtcgaagaaggaacgagaggaagagttcaagactcatcacgagatgaaagaatacagcgggttcgccggcgtaagcaggccccgaggtaccttttttagaatcagaggacggggcagagcacgcggcgtgttcgcagggacgaataccggacctaacaacagcaataccacattccaaaaaagaccaaaagaagaggagtgggaccctgagtacacaccaaagagcaagaaatacttcttgcatgatgacagagacgatggcgtcgactattgggctaagaggggccgcggtagagggacgttccagcgtggccggggtcgttttaacttcaagaagtccggctccagcccgaaatggacacacgacaagtaccagggcgatggaatcgtggaagatgaggaagagactatggagaataatgaggagaagaaggacaggcggaaggaggagaaagagtag

SEQ ID NO: 180476 - DNA, 2244 bp, Artificial Sequence
  Description of Artificial Sequence: Synthetic coding sequence
atgggccggagcaacagccggagccacagcagccggagcaagagccgcagtcagtcaagctctagatctaggtcacgcagtcactccaggaagaaaagatatagttcaagatctcgcagccggacctacagtcgctctcggtctcgcgataggatgtactcccgagactaccgccgcgactatagaaataatcgtggaatgcggcggccctatggctatagaggcaggggacgtggttactatcagggcggcggcggccgatatcacagaggaggctaccgcccagtgtggaatcgacgtcacagccgatcccccagaaggggacgctctaggtctagatcccccaaaaggaggagtgtttccagccagcgctcccggtctcgcagtcggcgctcatatcgatccagccggagcccacgcagctcctcttcaaggagttcatcgccatactctaagagtcctgtaagcaaaagaagaggaagccaggagaagcaaaccaaaaaagctgagggcgaacctcaggaagaatcacctctcaaatctaagtcccaagaagagccaaaggataccttcgagcacgatccttcagagagcatcgacgagttcaacaagtccagtgcaacaagtggggatatatggcccggattgagcgcctatgataacagtccccgttctcctcactctccgtctcccatcgcaactccaccctctcaaagctctagctgttcagatgctcccatgttaagcacggtgcactccgcaaaaaacactccgtctcagcacagccatagcattcagcactcaccagaacggtctggatcggggtcagtggggaatggctccagcagatattccccatcccagaactcccccatccatcatattccctcacgccggagcccggcaaagacaattgctccgcagaacgctcctcgcgatgagtctcgcggtaggagttccttttatcctgatggcggcgaccaggaaacagccaagacagggaagttccttaaatccccccccctgcataaaaacttagacgctcgcgagaaatctacgttccgcgaagagtctcccctccgaatcaagatgattgctagtgactcgcataggcccgaagtgaaactaaagatggctccggtgccactggatgattcaaaccgccctgcctctctgaccaaggaccgactcctcgcctcgaccctcgttcactccgtgaagaaagagcaggaattcaggtccatcttcgatcacatcaagctgccacaggcatccaaaagtacaagtgagtctttcatccagcatattgtttccttggtgcatcatgttaaggaacagtattttaaatcagcagccatgaccttgaacgaaaggtttacctcctatcagaaggctacagaagagcatagtactcgacagaagtcccccgaaatacatcgaaggatcgacatatcccctagcaccctgcgtaagcacactcggctcgccggtgaggagcgagtcttcaaggaggagaaccagaagggcgacaagaagttaaggtgtgactccgctgatttacgccacgacattgaccgaaggcgaaaggagcgctctaaggagaggggagacagcaaagggagccgcgagtcgtccggctccagaaaacaagaaaaaactcctaaagattacaaggaatacaaatcttacaaggacgactctaaacataaacgggaacaggaccactcccgcagctccagtagcagcgcatcaccgtcctcacccagcagtagagaagagaaagagtccaaaaaggaaagagaggaggagtttaagacccaccatgagatgaaggagtacagcggtttcgctggtgtcagtaggccacggggcactttcttcagaatccgcggaagaggacgggcaaggggtgtgtttgcaggcaccaacactggccctaataacagcaacacaacatttcaaaagcgacctaaagaggaggagtgggatccagaatacacacctaaaagcaagaaatatttccttcatgacgatcgagatgacggcgtcgattactgggcaaagagagggagagggcggggcactttccagcgcggaaggggacggtttaattttaagaaatctggctccagccccaaatggacccacgacaagtaccagggggacggcattgtggaggatgaggaagaaacgatggaaaataacgaggaaaagaaggatcgccggaaggaagaaaaggagtag

SEQ ID NO: 180477 - DNA, 2763 bp, Artificial Sequence
  Description of Artificial Sequence: Synthetic coding sequence
atgggccggagcaacagccggagccacagcagccggagcaagagcaggagccagagctcaagccgcagccgcagtagatcgcactcacgcaaaaagcgttactcaagtagatctaggtcacggacttattcacggtcccgttctcgggaccgcatgtacagtcgagactatagacgtgattaccggaacaaccgcggcatgaggcggccatacggctacaggggccgcggccgaggatactatcagggcggcggcgggaggtatcatagaggtggctatcgccccgtatggaataggcgacactcacgcagtcctcggcgcggccgcagccgcagtcggtctcccaagagacgttctgtctctagccagaggagccgctcgcgcagtaggcgcagctaccgctctagtcgatcaccaagatcctcgtccagccgtagcagctctccgtatagtaaaagccccgtgagtaaaagacggggatcacaggaaaaacagaccaaaaaagcggagggggagccacaggaggaatccccactcaagtcaaaaagccaggaagagccaaaggacaccttcgaacatgacccgagcgagagcatcgatgaatttaataaatcatccgctactagcggggatatctggccaggcctttccgcatatgacaactcccccagatctcctcacagtcccagtccaatcgccactcccccttcccagtcatcttcctgcagcgacgctcccatgttgagtacagttcattccgcaaagaatactccctctcaacacagtcattctatccagcacagccctgaacggtccggctccggttccgtgggcaatggttcttccaggtattctccatctcagaattcacccatccaccatatcccctcgagacgctcaccagccaagacgatcgccccacagaacgccccaagggacgagtctagggggcgctcaagcttctaccctgacggaggagatcaagagacggccaagacaggtaagttcctgaaacggttcactgatgaggagagccgggttttcctgcttgatagagggaacactcgggacaaagaggcttccaaggagaagggcagcgagaagggccgcgccgaaggcgaatgggaagatcaggaagcactggattatttctccgacaaggaatctggaaagcagaaatttaacgattccgaaggagatgatactgaagaaacagaagactaccggcagtttagaaaatcagtgcttgctgaccaggggaaaagcttcgcaacagcttctcaccggaacaccgaggaggaaggcctgaagtacaagtctaaagtgtccctcaaaggtaaccgcgaatccgatgggtttagagaggagaagaactataagctgaaggaaaccggctatgtggtggagaggccatccactaccaaggataaacataaagaagaggacaagaactcagagcggattacggtgaagaaagagacccagagcccagagcaggtgaaaagcgagaaattaaaagacctttttgactactctcccccattacacaaaaatctcgatgccagagagaagagtaccttcagagaagaaagcccactgaggatcaaaatgattgccagtgacagccaccgcccagaggtcaaactgaagatggcgccagtaccactcgacgactctaatagacctgccagcctgacgaaggatcgcctcttagcaagcaccctggtgcactctgtaaagaaagaacaagagttccgtagtatcttcgaccatataaaactgccccaggccagcaaatctacgtccgaatcttttattcagcatatcgtgagtctcgtgcatcacgtgaaggaacagtactttaagtccgcagcaatgacccttaatgaaagattcacaagctatcagaaggccacagaggaacactctacccggcagaagagccccgagatccacagaagaatcgacatttctccttctacactgaggaagcacacaagattggcgggggaggagagagtatttaaggaagagaatcagaagggagacaaaaaactacgctgcgattccgcagacctgcggcatgacatcgaccgacgccgcaaggagcgctcaaaggaaagaggagactcgaagggtagtagggagtcctccggatcccggaagcaggaaaagacccctaaagactataaggagtacaaatcctacaaggatgactccaaacataagcgggaacaagaccactcaaggagttcctctagcagcgcctcccctagttctccttcttctcgcgaagagaaagagtcaaaaaaggaaagagaggaggaattcaagacacaccacgagatgaaggaatatagtgggtttgcgggcgtttcacggccaagaggtactttcttccggatccgcggccgcgggagggccagaggggtgtttgccggcacaaatactggtccaaataattctaataccacatttcagaaacggcctaaggaggaagaatgggaccccgaatacacacccaaaagcaagaagtactttttgcacgatgacagggacgacggcgtcgactactgggccaaaaggggaagagggcgcggcacgttccagagaggccgtggccgcttcaattttaagaaatccggcagctctcccaaatggacccatgataaataccagggcgatggcatcgttgaggacgaggaagaaaccatggagaacaatgaggagaagaaggaccgcagaaaggaggagaaggaatag

SEQ ID NO: 180478 - DNA, 531 bp, Artificial Sequence
  Description of Artificial Sequence: Synthetic coding sequence
atgggccggcccgccggcctgttcccccccctgtgccccttcctgggatttagacctgaagcgtgctgggaacgtcatatgcagatcgagagggccccctccgtgcccccttttcttcgctgggccgggtatagacccggcccagtgcggcgacgcggaaaggtagagctgataaagttcgtccgagtgcagtggaggagaccacaagtagaatggaggagacgacgatggggacccggccccggggcatccatggcgggatccgaggagctcggcctgcgcgaagacactctaagggtgctggcggcctttctgaggcgtggtgaagctgcggggagcccggtgccgaccccgccgcgcccttcatattctcgtcttctttgtttcggaggacctgctgctgggacagcaggtcctcgcgccgccgagatatccgctcagccacgaatcacaggctccccgattgaccgggagggctcacacaccgctgaagcgggcgggccggccggtggcggaggccgaagccactag

SEQ ID NO: 180479 - DNA, 1005 bp, Artificial Sequence
  Description of Artificial Sequence: Synthetic coding sequence
atgggccggcccgccggcctgttcccccccctgtgccccttcctgggctttcgccccgaagcatgctgggagcggcatatgcagattgagagggcccccagtgtgccacctttcctccggtgggcaggctacagacccgggccagtcaggagacgtggcaaggtggagttgattaaattcgttagggttcaatggagacggcctcaggtagagtggcgccgcagaagatggggccccggacctggtgcatctatggccggcagtgaggaactcggtctgcgagaggatacgttgcgggtccttgcagcgttcttgcgaaggggggaggctgcaggatctccggtgcccacaccacctagaagtcctgcccaagaggaacctacagattttttaagccgcttgcggagatgtttaccttgttctctcgggcgtggtgccgcaccaagcgagtctcctcgcccttgtagcctacctatccggccttgctatgggctggaacccggtcctgcaacccccgacttttatgcacttgtggctcagcgccttgaacagttagtgcaggaacagttaaaatctccgccaagccccgagctgcaagggcctcccagtaccgaaaaagaggcaatattgcgccgcttagtcgcactgcttgaggaggaagctgaggtcattaaccagaaactggcttctgacccggcattgagaagcaaactggtgcggctttccagtgactcattcgctcggctggtggaactgttctgttccagggatgactcatctcgccccagtcgcgcttgcccaggccctcctccaccttcccctgaacctctagctcggctggccctcgccatggaactttcgcgaagagtggctggtttaggggggaccctagcagggctgagcgtcgagcacgtccactctttcacaccttggatccaggcccatggagggtgggaaggcatactggccgtttctcctgtcgatctgaacctgcctttggactag

SEQ ID NO: 180480 - DNA, 1002 bp, Artificial Sequence
  Description of Artificial Sequence: Synthetic coding sequence
atgggccggcccgccggcctgttcccccccctgtgccccttcctgggtttccggccagaggcttgctgggagaggcatatgcaaatcgaacgcgcccctagcgtgcccccgttcttacggtgggccggttatagaccgggtccggtcaggagaagaggtaaggtggaactcatcaagtttgttcgagtccagtggcggcggccccaggtggagtggcgcagaaggagatggggcccaggcccgggcgccagcatggcaggctcggaagagctaggcctacgggaagatacactgagagtgttggcagccttcctaagaagaggggaggctgccggaagccctgtccccacacccccatctccagctcaggaggaacctaccgactttttgagcagattgaggcgctgcctcccatgttctctgggacggggcgccgcgcctagcgagagtccccgcccatgttcacttccgatacgtccatgctatggactggagccgggacccgcgacccccgatttttatgccctcgtagcacagaggctggagcagttggtccaagaacagttaaaaagtccaccctctcctgagctccaaggaccacccagtaccgagaaggaggccatactgagacggctagtggccctgctggaggaagaagccgaggtcattaatcagaagttggctagcgacccagccctgagatccaagctcgtgagattgtcttccgactctttcgcacggttggtggagctgttctgctctcgggacgattcatctaggccatccagagcctgcccaggaccgccgcctccatcccccgagccactcgcccgactagcactggccatggagttaagccgtagagtcgcagggttgggcggtaccctcgcagggttgtcagtggaacatgtgcacagctttacaccctggatccaggctcacgggggctgggaggggatcctggctgtgtctcctgttgatctcaatttacccctagattag

SEQ ID NO: 180481 - DNA, 5166 bp, Artificial Sequence
  Description of Artificial Sequence: Synthetic coding sequence
atgctgagcgccacccccctgtacggcaacgtgcacagctggatgaattcagaacgcgtccggatgtgtggggcaagtgaggataggaagattttggtaaacgacggcgacgcctccaaggcccgcctcgaactgagggaagagaaccctctcaatcataacgtggtcgatgccagcacagctcaccgcatcgatgggcttgccgcattgagcatggatcgaaccggcctgattagagagggactgagagtgccggggaacatcgtgtactctagcctttgcggcctgggcagcgagaaaggtcgggaggctgcaacatctacattaggtggtttggggttctcaagcgaacgcaaccctgaaatgcagtttaagcctaacacccccgaaactgtggaagctagtgctgtctccggcaaaccgccgaatggcttctctgctatttacaagacacccccaggcattcagaagagtgccgtggctacagcagaggcgctcggcctggatcgccctgcgtcagataagcagagtccactcaacattaatggggctagctacctaaggctgccctgggtgaatccctacatggaaggcgcaacgcctgcgatctacccgttcctggacagccctaacaaatacagcctgaatatgtacaaggcacttctgccgcagcagtcctattctctcgctcagccactgtacagtccggtgtgcaccaacggtgagcggttcttgtatctgccacccccccactatgtcggccctcacattccctcctcgttggcctcaccaatgcggctcagcacgccctcagcctctcccgcaattcctcctcttgtccactgcgccgataaatccctgccctggaagatgggcgtctctccgggtaatcccgtggacagtcatgcatatcctcacattcaaaacagtaagcaacccagagttccatcggcgaaggctgtgaccagtggcctgcccggcgacacagcactgctactgcccccctcacctaggcctagtcctcgagtgcatctcccaacgcagcctgcggcggacacctacagcgagtttcacaagcactacgctcgtattagcacttccccatccgtggcattatcaaagccctatatgactgtgtcttccgagtttcccgctgcccggctttcaaatggcaagtaccccaaagccccggagggaggagaaggtgctcaacctgtccccgggcatgcccgcaaaactgctgtacaggaccggaaagatgggagcagccctccattgttggagaaacagacagtgacaaaggacgtaacagacaagcccctcgatctgtcaagtaaagtggtagatgtggatgcatctaaggccgatcacatgaagaaaatggcgccaaccgtgctcgtccatagccgggccggctcggggttggtccttagcggtagtgagatacccaaagagactttgagtccgccaggcaacggctgtgccatctaccggtcagagatcatatccaccgccccaagctcttgggtggtgccagggccttcacccaatgaggaaaacaacggaaagagtatgtcacttaaaaataaagccctcgactgggctatcccgcagcagaggtctagttcttgccctaggatgggaggtacagatgcagtgatcactaacgtttctggctctgtcagctccgcaggtcgcccagcctccgccagcccggcccccaatgctaacgctgacggaactaagacctcgcgttcttctgtggaaaccaccccctcagtgattcaacacgtcggacagcctccagcaaccccagcaaagcacagttccagcaccagctccaaaggtgccaaagcatccaaccctgaacccagcttcaaggcgaatgagaatgggttgccaccctctagcattttcctttcgcctaatgaggcattcagaagcccccccatcccctatcctcgctcttatctcccatacccagctcccgagggaatcgctgtctcccccctgagccttcacggaaagggacctgtgtacccccatcccgttctcctacccaacgggagcctgttccctggccatctggctcccaagcccggattgccctacggcctgcctactggaagacccgaattcgtaacataccaggatgcgctagggttaggaatggtccaccccatgctgattcctcatactccaattgagattacaaaagaggaaaagcccgagcgacggtctcgttcacacgaacgggcgaggtacgaagatcctacattgcggaataggttcagcgagattttagagacttcatctactaagctccaccccgatgtgccaactgacaagaacctgaaacctaatccaaactggaatcaaggaaagaccgtggtcaagtccgataaattggtttatgtcgatttgctccgtgaagagcccgacgcaaaaacagacactaatgtatctaaacccagctttgctgcggaaagtgtcggtcagtccgccgagccgccaaagccttctgtggaaccggccctgcagcagcatcgagactttatcgcactgagggaggaactgggcagaattagcgactttcacgaaacatacacatttaaacagcccgtgtttaccgtgtccaaagacagcgtgttggccggcacaaacaaggagaatctggggctgccagtgtctaccccgttcctcgaacctcccttggggtcagatggacctgccgtgacgttcgggaaaacacaggaagaccctaaacccttctgtgtgggcagcgcaccaccatcagttgatgtcactcctacttacaccaaggacggggcggacgaagctgaatccaatgatggtaaggttttgaaaccaaagccctcaaagctagcaaagcgcattgccaacagcgctggatacgtcggggataggttcaagtgcgttactacggagttgtatgctgactcttctcagctctcacgagagcagcgggcattgcagatggaagggttgcaagaggattcaatactgtgtcttccggcagcctactgtgaaagagccatgatgcgatttagtgagttagagatgaaagagcgggagggcggccatccagcaactaaagactcagagatgtgtaagttttcgcccgccgattgggagagacttaagggcaaccaggataaaaagcccaaaagcgttaccctggaggaagctatagctgaacagaatgagagcgaacgatgcgaatactcagtgggaaataaacatagagaccccttcgaagccccagaggacaaagacttgcctgtggagaagtacttcgtcgaacgccagcctgtcagtgagcctcctgcagatcaggttgcctccgatatgcctcatagccccaccctgcgcgtggaccgcaaaagaaaggtgtccggcgattcctctcacaccgaaacgaccgccgaagaggtccccgaagaccccttgctcaaggccaaacgaagacgagtatccaaggggcttcaccctaaaaaacagcgccacctcctgcatctgcgggagcgctgggagcagcaggtgagtgccgccgacggtaagcccgggcgccagtcaagaaaggaagtgactcaggcaacacaaccagaggccattccccagggtactaacatcacagaagagaagcctggccggaaaagggccgaggcaaaagggaatcgatcatggagtgaggagagtctaaagccatctgacaacgagcaggggttgccagtcttctctgggtcacctcctatgaaaagcctgtcctccacgagcgccggcggcaaaaagcaggctcagcccagctgcgcaccagctagtcgcccgcccgccaagcagcagaagattaaggagaaccagaagacagacgttctttgcgcagatgaggaggaggattgtcaggccgcttcattactccagaagtatactgacaactcagagaagccttcaggcaagcggctgtgtaagaccaaacaccttattccccaagaatcacggaggggcctccctctcactggagaatattatgtggaaaacgctgacggcaaggtgaccgtcagaaggttcagaaagaggccagagccttcttccgattatgatttgtcccccgccaagcaggagcccaagccctttgaccgtctgcagcaactgctacccgcttcacagtcgacacagctgccttgttcctctagcccccaggagaccactcagagcaggcctatgcctcccgaagcaagaaggctgatagtgaacaaaaatgctggcgaaactctgctccagagagccgctcgcctgggctatgaggaagtggtgttgtactgccttgaaaataaaatctgtgatgtgaaccaccgggacaatgcagggtattgtgccttacatgaagcctgcgcaagaggttggctaaacatcgtgcgccatcttcttgagtacggcgccgacgtgaattgctcggcacaggatgggacaaggcctcttcatgatgcggttgaaaatgatcacctcgagatcgtacggctgctgctctcgtatggcgccgatcccaccctggcaacatacagcgggcgtaccattatgaaaatgacccatagcgagttgatggagaaatttctcactgactacttaaatgacctccagggcagaaatgatgatgatgctagcggtacatgggatttctacggcagtagtgtgtgcgagcccgatgacgaatccggatatgacgtgctggccaacccacccggcccagaggaccaggatgatgatgatgacgcctactcagacgtcttcgagttcgagttttctgagactcctctcctgccctgctataacattcaggtatcagtggcacaggggcccagaaactggctccttctgtctgacgttttgaagaagttaaaaatgtctagtaggatcttccggtgtaactttcctaacgtggagatagtgactatagccgaagcagaattctatcgtcaggtgtcagcttctctgctcttcagctgcagcaaggatctagaagcttttaacccagagtccaaagaattgctggacctcgtcgagtttaccaatgaaatccagactttgctaggaagtagtgtagagtggttacatccctctgacctggcctccgacaattattggtag

SEQ ID NO: 180482 - DNA, 5268 bp, Artificial Sequence
  Description of Artificial Sequence: Synthetic coding sequence
atgctgagcgccacccccctgtacggcaacgtgcacagctggatgaattccgagagagtgaggatgtgcggagcatccgaagatagaaagatactagttaatgacggagatgcgtccaaggctcgtctggaactgcgcgaagagaaccccctgaatcacaacgtcgtggatgcttccacagcccatagaatagacggcttggccgcgctgagcatggacaggaccgggttgattcgagaagggttaagggtcccaggaaatatcgtttattcctcgctctgcgggctgggaagcgaaaaagggagggaagctgccacttccaccctcggcggacttggcttctcatctgagcgcaatcccgaaatgcagttcaaacctaatacgccggagactgtcgaggccagcgccgtgagcgggaagcccccaaatgggttttcagccatttataaaacgcctcccggcatccaaaagtccgccgtggcaaccgccgaagctttgggactcgaccgaccagcatctgataagcagtcccctttgaacataaatggcgcatcttacctgcgactgccctgggtgaacccttacatggagggagctacacccgccatttatcctttcctggactcacccaacaagtattcactcaatatgtacaaagccctgctccctcagcagagttatagcctggcccagcctctctatagccctgtgtgtacaaatggagaaaggttcttatacttaccaccacctcactatgtgggcccccacatccccagctcattggcaagccctatgaggctgagcacgccaagcgccagtccagccataccccctctggtgcattgtgccgataagtccctaccatggaaaatgggtgtaagtcccggcaaccccgtggacagccatgcatatccacacattcaaaattctaagcagcctagggtccccagtgccaaggcagtgacgtctggtttgccaggcgatactgccctcctactccccccatcacctcgccccagtcctcgggtgcacctaccgacccagccagctgccgacacctactcagaatttcataaacattacgctaggatcagtaccagcccctccgttgcactgtcaaagccttacatgacagttagctccgagttccccgcagctcggctgtccaatggcaaatatcccaaggcaccggagggaggcgaaggagcacagcccgttcccgggcacgctaggaaaaccgccgttcaggaccgtaaggacggttccagccctccccttcttgaaaaacagacagtgaccaaggacgtcactgataaacctctggatctctctagtaaggttgtcgatgtggacgcctcaaaggctgaccacatgaagaagatggccccaactgtgctcgtgcactccagagcaggcagtggcctggtcttgtccggcagcgagatccccaaggagacactctccccccccggcaacggctgcgcaatttaccgctccgaaattatttcaaccgcacctagctcctgggttgtgcccggaccctccccgaacgaggagaataacggcaaatcgatgagcctgaagaacaaggctctagactgggccatcccacagcagaggtccagttcttgtcccagaatgggtgggaccgatgcagtgattaccaacgtgtcaggatcggttagtagtgctggaaggccggcctctgccagccccgctcccaatgcaaacgcggacggcacaaaaaccagtcggagctctgtggaaaccacaccctcggtgattcagcacgtgggacagcctcccgctacccccgccaaacattcctcaagcacctcttcaaagggggctaaagcctctaatccagagccctcattcaaggccaatgagaatgggctgcctccctcatcaatattcctgagtcccaatgaggcctttagatcccctcccataccctatcctcggagttaccttccctacccagcaccggaagggattgcagtgagtccactgagtcttcacggcaaaggtcccgtgtaccctcaccctgtgttgctaccaaacggatccttgtttcccggccatcttgcacctaaaccaggcctcccctatgggctgcctactggaaggcctgagttcgttacgtaccaagatgcccttgggcttgggatggtgcaccccatgttgattcctcacactccgatcgagatcaccaaggaggagaaacccgaacggcggtccaggtcccatgagagggcaagatatgaggatccaacattgagaaataggttcagtgagatcctggagacatcctccactaagttgcaccctgatgtgccaacagacaaaaatctgaagcccaacccgaactggaaccagggcaaaaccgtcgtaaagtcagataagctggtttacgtcgacctgctgcgcgaggaacccgacgccaagactgatactaatgtgtccaagccttcatttgccgcggagagtgtagggcaatccgccgaaccccccaagccatcagttgagcctgccctgcagcagcacagagacttcattgcactgcgggaggaattaggtcgaatctccgatttccacgagacttataccttcaagcaacctgtgtttactgtcagtaaggacagcgtgctggctggcactaataaagaaaatctcggacttccagtatcgacgccctttctggagcctcccctgggatctgatggccccgccgtgaccttcggcaaaacacaggaggatcctaaaccattttgcgtcggctccgccccccccagtgtggacgtaacgcccacgtatactaaggacggagcggacgaagctgagagtaacgacggcaaggtcctgaaacccaagccgtcaaaactcgccaagaggatcgctaattctgcaggatacgtaggggatagatttaaatgcgtcaccactgagttgtatgccgactcttcccagttgagccgagagcagcgggctttgcagatggaaggcctgcaggaggatagtatactgtgtctccccgctgcatactgtgaacgagctatgatgcgcttctctgaactggaaatgaaagagagagaaggcggacaccctgctactaaggattcagagatgtgtaaatttagccccgccgactgggagcgcctgaaaggaaaccaggacaagaagccgaagagcgtgacgctcgaggaagcgatagcggaacagaacgaaagcgagcgctgtgagtactctgtaggcaataagcacagggacccatttgaagcccctgaggacaaggaccttcctgtggaaaaatacttcgtggagcggcaacccgtcagcgaacccccggccgatcaggtggcaagtgacatgccacacagccccactcttcgcgtggataggaagcgcaaagtgagcggagattcatcccataccgagactacagcagaggaagtgcctgaggatcccttgctcaaagcgaagcgaaggcgcgtgagcaaggacgattggccagagagagaaatgactaactcctctagtaaccacctggaggacccgcactattcagaactgaccaacttaaaggtgtgtatcgagcttaccggcctgcaccccaagaaacagaggcatttgctccacttacgcgaaagatgggaacagcaggtttccgccgccgatggcaaacccgggaggcagtcccgcaaggaggttacacaggcgacacagccggaagccataccacagggcactaacattactgaagagaaacccggacgaaagcgggcagaggccaaggggaatagaagctggtctgaagaaagcttaaagcctagcgacaatgaacagggattgccggtcttttcaggctcacctcccatgaagagccttagctccacaagtgctggagggaagaagcaggcccagcctagttgcgctcccgcctcaagacctcctgcaaaacaacagaaaattaaggaaaatcagaagacggatgtgctctgtgccgatgaggaagaagactgtcaggccgcttcactcctccagaagtacaccgacaatagcgagaagccaagcggcaagcggctgtgcaagactaaacatctcataccacaggaatcgcgcagggggctgccactgacaggagagtactacgtcgaaaacgcggatggaaaggtgacagtgagaagatttaggaagcgcccggaacccagcagtgactatgacctgagccctgcgaagcaggaacccaagccatttgatcgactccagcaattgctgccagcttcacagtcaacccaactgccctgctctagctctcctcaggagactacccagtctcggccaatgccgccggaggctcgtcgccttatagtgaataaaaacgccggggaaaccttactccagcgggctgctagattgggatacgaggaggtagtcctgtactgtctcgagaataagatatgcgacgtcaatcaccgggacaatgcaggatactgcgctctgcacgaggcatgtgctcggggttggctcaatattgtccggcatctattagagtacggcgcagacgtgaactgcagtgcacaggacggtactcggccactgcacgacgcagtcgaaaacgatcatctggaaatcgtcaggttactgctgtcttacggtgcagacccaacattggctacatacagtggccgcacgattatgaagatgactcatagtgagcttatggagaagtttttaacagactacctgaacgatttgcagggccgaaacgatgacgacgcatccggcacctgggacttctatggttcaagtgtctgtgaacctgatgatgagagtggttatgacgtgcttgcaaatccacctggcccagaagatcaggatgatgacgatgacgcctatagcgacgtctttgagtttgagttcagtgagactcccctcctcccctgttacaatattcaagtatctgtggcccaaggaccccgtaactggctgcttctgtctgacgttcttaagaaactgaaaatgtcatcccggattttccgttgcaatttccccaatgttgagattgtaacgatcgcggaggccgaattttacaggcaagtttcggcttcactgctgttctcctgctctaaagatctggaggcattcaacccagagtctaaggaactcctcgacttggtcgagtttacaaatgagatacaaaccttactgggaagcagtgtggagtggctgcacccttcggatctcgcaagcgataactattggtag

SEQ ID NO: 180483 - DNA, 5112 bp, Artificial Sequence
  Description of Artificial Sequence: Synthetic coding sequence
atgctgagcgccacccccctgtacggcaacgtgcacagctggatgaattcagagagggtgcgtatgtgtggagccagcgaggaccgtaaaatccttgtgaacgacggggacgcaagtaaggctaggctggagctgcgggaagagaaccccttgaaccacaacgttgttgatgcaagtacggcccaccgcatagacggactagcagccttgtctatggacagaacaggcctaattcgcgaggggctgagggtgccagggaacatcgtgtactcctctctgtgtgggctggggtctgaaaaaggacgcgaggctgctacctctacattgggcgggcttggatttagctccgaacgcaatccagagatgcagttcaagcccaatacccccgaaaccgtggaggctagcgctgtgagcggaaagcctccaaacggcttcagcgctatatacaaaacaccccctggaatacagaaatcggctgtggccactgcagaggccctgggactggatcgcccagctagcgacaagcagtccccactgaacatcaacggtgcatcatatctgaggctgccatgggtgaacccatacatggagggggcaacccctgccatttacccattcttggatagcccaaacaaatactccctaaacatgtacaaggcgctgctgccacaacagagttacagccttgcgcagcctctgtattcacctgtatgcacgaatggtgagagatttctataccttcccccaccacattatgtaggcccccacattccctcttccttagccagtcccatgaggttgagcaccccgtcggcaagtcccgccattcctccactggtgcattgtgctgataagtcactgccttggaagatgggagtgagcccaggtaatcccgtggattcccacgcatacccacacattcaaaacagtaagcagccgagggtgccctctgccaaagcagtcacctctggccttcccggcgacactgcgctcctccttccaccaagcccgaggccatcaccaagagtacaccttcccacccaacctgcggctgacacctattccgagttccacaagcactatgctcgcatttctacctctccttccgtagccctgagtaaaccgtacatgactgtgtctagtgaatttcctgccgccaggttgtcaaacggaaagtacccaaaggcccccgagggcggcgaaggagcgcagccagtccccggccatgccagaaagactgctgtgcaggatcgaaaggacgggagttccccccctctcctggagaagcagaccgtgactaaagacgtaaccgataagcccctcgacctttcctccaaggtggtggacgtggacgctagcaaagctgatcacatgaagaaaatggcccccacggtacttgtgcattcgagggccggaagcggtctggtccttagcggaagcgagatccctaaggagactctgagcccccccgggaatggttgcgccatttaccggtcagagattatctctaccgcccccagctcttgggtggtccccggaccttccccgaacgaggaaaataatggcaagtctatgtccctgaagaacaaagctctggactgggcaataccacagcaacgctctagttcttgcccaagaatgggaggaacggatgccgtaattactaatgtttccggttcggtttctagcgcagggagaccagcttccgcatctccggctcccaatgccaatgcggacggcactaaaacatctcggtcctctgtcgaaaccaccccatctgtgattcagcacgttggccaaccgccagctacgcctgcgaagcatagctcttcaacctcaagcaaaggagcaaaagcaagtaatccagagccctcctttaaagctaatgagaacgggctcccgcccagtagcatcttcctaagccctaacgaagcattccggtcccctcctatcccttatccgcgtagctatctaccttatccggccccggaaggcattgctgtgtcacccctgagtcttcacggtaagggtcctgtctaccctcatccagtactgttgcccaatgggagcctctttcctggtcatctggccccaaagccaggactcccttatggattgccaaccgggagacccgagttcgtgacataccaggatgccttgggcctcggaatggtccatcctatgctcatcccccatactcccattgagataacaaaggaggaaaagcccgagagacgttctaggtcccacgagcgggctcggtacgaagaccctactctccgaaacaggttcagcgaaatcctggaaacatccagcactaaactgcatcccgacgtcccaaccgacaagaacctgaaaccaaacccaaattggaatcaaggaaagacagtggtcaagtctgacaagctcgtatatgtggatctcctgagggaggagccagacgccaaaactgatacaaacgtgtccaagccaagcttcgctgccgaatccgttggccagagtgcggaaccacctaaaccatcggttgagccagctctccaacagcatcgggacttcatagccctacgcgaggaattggggcgcatctccgattttcacgagacctacacattcaagcaaccagtgttcactgtgagcaaggacagtgtgctggcaggcaccaataaagaaaatctgggcctgcctgtgagcacaccctttctcgagcctcccttgggaagcgacgggccggcagtgactttcggaaaaacccaggaagatccgaaaccgttttgtgtcggcagtgccccaccatccgtggacgtaactcctacgtacactaaggatggcgctgacgaagccgagagcaatgatggcaaagtgctgaagccaaaaccttcaaagctggccaagcgaatagctaattctgcgggatacgtgggcgatagatttaaatgcgttactacagagctttacgcggactcaagccagctctcacgggagcagagggccctacagagggcaatgatgcggttctccgagctggaaatgaaggaacgggagggtgggcacccagccactaaggattccgagatgtgtaaattctcaccagccgattgggaacgcctcaaagggaaccaggataaaaagcctaaatccgtgacgctggaggaagcaatcgccgagcaaaatgaatcagagcgctgtgagtatagtgtggggaataagcatcgggacccgttcgaagccccagaggacaaggacctgcctgtggaaaagtattttgtggagaggcaacctgtaagcgaaccaccagccgaccaggtagctagtgacatgcctcacagcccaaccctccgtgtggatcgtaaacggaaagtgtccggagactccagccacactgaaacaactgctgaagaggtacccgaggatcccttgttgaaagccaagcgcagacgagtttctaagggcctccatccgaagaagcagcggcatttgctccaccttcgggaacggtgggaacagcaagtaagcgccgcggacggcaaaccaggacgtcagagccgtaaagaagtcacacaggccactcagcccgaggcaatcccccaaggcactaacattactgaggaaaagccagggcgcaagcgagccgaagccaagggaaatagaagctggtctgaagagagcctcaaaccaagcgacaatgagcagggcctccctgtcttctctggatcccctcctatgaaaagccttagttctacaagcgcaggcgggaagaaacaggcacagccttcctgcgcacccgcctcacgccccccggccaagcaacagaagatcaaagaaaaccagaaaaccgatgttttatgcgcagacgaggaggaggattgtcaagccgctagcctcctccagaagtacactgacaattccgagaagccttccggaaagcgcctctgtaaaacaaagcacctcatacctcaagaaagcaggcgggggctccccctgaccggagagtattacgttgagaacgctgacggaaaggtgaccgtccgccgctttcgaaaacggcctgagccctcaagtgattatgacctgtcacctgctaaacaagaacctaagcctttcgacagactccaacagctgctgcccgcttcccagtctacgcagctgccctgctcatcatctccccaggagaccacccaatccagaccaatgccccctgaagcccggcggctaatcgtgaataaaaacgctggcgagacacttttgcagcgcgcggcccgcctcgggtatgaggaggttgtgctgtattgtctggagaacaagatctgtgatgtaaaccatcgtgacaatgcagggtactgcgctctccacgaggcgtgcgccaggggttggttgaacatagttaggcatctcctggagtatggggcagacgtgaattgctcagcccaggacggcaccaggccactgcatgacgctgttgaaaatgatcatttagaaattgtgcgactgttgttgtcctacggagcagatcccactcttgccacctacagcgggcggaccatcatgaagatgacacactccgagttgatggagaagtttctcacagactatctgaatgacttgcagggccgtaacgatgatgacgcttctgggacttgggacttttacggatccagcgtttgcgagcccgacgacgaaagcggttacgacgtcctggccaatcccccagggcccgaggatcaggacgacgatgatgacgcgtattccgatgtctttgaattcgagttttccgagacgcccctgctgccttgttacaatatccaggtatcggttgcccagggccctagaaactggctccttctctcggacgtattaaaaaagctgaagatgtcctcccgcatttttcgctgtaatttccctaatgtggaaatcgtcaccattgctgaggccgagttctaccggcaggtgtctgctagcctgctgttctcctgcagtaaagacctggaagcgttcaaccctgaatcaaaagaactgcttgatctggtagaattcacaaacgagattcaaacccttctaggctcctcagtggagtggctgcatccatccgatttggctagcgacaattactggtag

SEQ ID NO: 180484 - DNA, 1869 bp, Artificial Sequence
  Description of Artificial Sequence: Synthetic coding sequence
atgccccacagccccaccctgcgggtggaccggaagcggaaggtgagtggagatagcagccacacagaaaccacagctgaggaggtgccagaggatccacttctgaaagccaaacgtagaagggtatcaaaagggttgcaccctaaaaagcagaggcacctcctgcacttgcgagaacgatgggaacaacaagtctccgctgccgatgggaaaccgggacgtcaatcccgtaaggaggtcacccaagccacccagcccgaagcgatcccacaggggactaatattactgaggagaagcccggacgcaagcgagccgaggctaagggaaacagatcttggagcgaggagtccctcaagccttcagacaacgaacaaggactgcccgtcttcagtggctcccctcctatgaaaagtctgtcgtcaaccagtgctggtgggaagaagcaggcgcaaccttcatgcgccccggcatcacgtcctcccgctaagcaacaaaaaataaaggagaatcagaagacggacgttctttgcgccgacgaggaggaagactgtcaggcggcctctctgctccagaagtatactgataactctgaaaagccctccggcaaacgactgtgtaagacgaaacacttaatcccacaggaatcacgccggggccttccgttgaccggcgaatattacgtggaaaacgccgatgggaaggttaccgtgcgccgcttccgcaagcggcctgagcccagttccgactacgacttgtctcctgccaaacaagagcctaagccttttgatcgccttcaacagctgttgccggcatcacagtctacgcagttaccatgtagttcatcaccacaggagacaactcagtcaaggcctatgccgccagaggcccgccggcttattgtgaataagaatgctggagagacccttctgcagcgcgctgccaggctagggtacgaggaggtagtgctgtattgtcttgaaaacaaaatctgcgacgtcaatcatcgggataatgcagggtactgcgccctgcacgaagcctgtgccaggggatggctgaacatagttcgtcatctgctcgagtatggagccgatgtcaactgtagcgcccaggacggtacccggccacttcacgacgctgtcgagaacgatcatctcgagatcgtgcgattattgctcagctatggtgccgatccgaccctggcgacttactccgggcgaaccattatgaaaatgactcattcagaactcatggagaagttcctcactgactatctcaacgacctccaggggaggaacgacgacgacgctagtgggacctgggatttctacggctccagcgtgtgcgaaccagacgatgagagcgggtacgatgtgctcgcaaacccccccggtcctgaagaccaggacgacgacgacgacgcttacagcgacgtcttcgaattcgagttctccgaaacccctctcctaccgtgctataacatccaggtcagcgtggcccagggaccacgcaattggttgctgttgtcagacgtcctgaagaagcttaagatgtcatcacggatcttcaggtgtaactttccgaacgtcgaaatagttacaattgcagaagctgaattctaccggcaagtcagcgcatccctactgttttcctgttctaaagatcttgaggctttcaatccagagtccaaggagctccttgatctcgtggagttcacaaacgaaatccagaccctgctcgggtcttccgtagagtggttgcatccctccgatttggccagcgacaactactggaagtctccacagatcgcccgcggctcagttgaaggaaaaaaaactgacgataagaccagtaaaactgatctatag

SEQ ID NO: 180485 - DNA, 5166 bp, Artificial Sequence
  Description of Artificial Sequence: Synthetic coding sequence
atgctgagcgccacccccctgtacggcaacgtgcacagctggatgaacagcgaacgggtgaggatgtgcggtgcctctgaagatcgtaagatcctggtaaacgatggggatgcttccaaggcccgacttgagctccgagaggaaaatcctctcaatcataatgtagtggatgcttccaccgcccacaggatagatggtctggccgcactgtcaatggaccgtacaggcctgatccgagagggattgagagtgcccggcaacatcgtatacagctccctgtgcgggctgggttccgaaaagggtcgggaggcggcgacctcaacgctgggaggcctgggattctcttctgaaagaaaccctgagatgcagttcaaaccaaatacaccggaaacagtggaagctagcgcggtgtccgggaaacccccaaacgggttttcagctatctacaagacacccccgggaattcagaaatctgccgtcgctaccgccgaggccctgggactagacagaccagccagcgacaaacaaagccccttgaatatcaacggagccagctacttgagactcccatgggtcaatccttatatggagggggctacgccagccatctacccttttctggactccccaaacaagtactcccttaatatgtacaaagctttattgccgcaacagagctactctctggcacagcccctctatagtccggtctgtactaatggagagagattcctctatctgcccccccctcactacgtgggaccacacatccctagctctcttgccagtcctatgcgtctgagcacacccagcgcaagtccagcaattccaccactggttcactgtgctgacaagagtctgccatggaagatgggggtttcgcctgggaaccctgttgactctcacgcctatccccacattcagaactcaaaacaaccacgcgtcccctctgctaaagccgtgacctccggactcccaggggatacagcactgctcctcccaccctccccccgtccctctccaagggttcacttgccgacccaacctgcggcagacacatacagtgaatttcataaacattatgcccgcatctctactagccctagtgtagctctgagcaagccctatatgacggtgtcctcagagttcccagccgcaaggcttagcaacggaaagtaccctaaggctccggagggaggggagggtgcacaaccggttcccggccacgcccgtaagaccgccgtgcaggatcggaaagacgggagctcccccccgctgctggagaaacagaccgttaccaaagacgtgaccgacaagccactggacctgtcatctaaagtggtcgacgtggatgcatctaaggcagatcacatgaagaagatggcacccacagtgcttgtacattccagagccggatccggacttgtcctgagcggaagtgagatacccaaggagactctgtccccacctggtaacgggtgtgccatatatcgctccgaaatcattagcaccgccccttcaagttgggtggtaccaggtccgtctccaaacgaggagaataacggaaagtctatgtcactcaagaacaaagccctagattgggccatcccccagcagcgatcttcttcatgcccccgcatgggaggcactgacgctgttatcaccaatgtctctggctccgtgagttctgcagggcggcccgccagtgcctctccagctcccaacgctaatgctgacggcacaaaaacatctcgctcgtcggtagagaccaccccctccgttattcagcatgtcgggcagcccccagccacaccagccaagcattcctcctctacatccagcaagggtgcaaaagcttccaatccggagccttcctttaaagcaaacgagaatggcctgccccctagcagcatattcctcagtccaaatgaggccttccggagcccccccatcccatatccaaggagttatctaccgtacccggcgccggaagggatcgctgtgtctccgctgtcactgcacggcaaaggtccagtgtaccctcaccctgtgctgctgccaaatggtagcctgtttcctggacatctcgcacccaaaccgggactaccttacggactgcctacagggcgtccagagttcgttacctaccaagatgcattagggttggggatggtgcacccaatgttaattcctcacactcctatagaaatcaccaaagaagagaaaccagagaggagaagtagaagtcatgaaagagcccggtacgaggatcccactctaaggaaccgattctcggagattctggaaacctcctctactaagctgcaccccgatgtgcccaccgacaagaatctcaagcccaaccccaactggaatcagggtaagaccgtcgtgaaatctgataagctggtgtatgtggacttgctgagggaagagccagacgcaaaaaccgacaccaacgtttcaaagccgtccttcgccgcggaatctgtcggacagtccgccgaaccgcccaaaccgagtgtagagcccgcccttcagcaacatcgcgatttcattgctctgagagaggaattgggacggatatccgactttcatgaaacatatactttcaagcagcccgtcttcaccgtttctaaagactctgtactagccggtaccaacaaggaaaatcttggattaccagtgtccacaccctttctggagcctccgcttggtagtgatggtccggccgtgacattcggaaaaacgcaggaagaccctaaacccttttgcgtgggctctgccccacccagtgtggatgtgacacccacgtatacaaaggacggggctgatgaggctgaatccaacgacgggaaggtgctgaaaccaaaaccctcaaaactcgcgaagcgaattgctaacagcgctgggtacgtcggcgaccgctttaaatgcgtgactacagagctgtacgctgactcctcacaactgtctagagagcagcgggccctgcagatggagggcctgcaagaagacagcatcttatgtctgccagcagcctattgtgaaagggcgatgatgcggttctctgaattagaaatgaaggagcgagagggggggcaccccgccaccaaagatagtgaaatgtgcaagttttcacccgctgactgggaaagattgaaggggaaccaggacaagaaacccaaatctgtgacgctggaagaagctatagccgaacagaacgagagcgaacggtgtgaatacagcgttggcaataaacaccgggacccattcgaggcccccgaagacaaggaccttcctgtcgaaaaatactttgtggaaaggcagccagtgtcagagccaccagccgaccaggtcgcgtcagacatgccacactcccccaccttacgcgtggaccgcaaacgcaaagtcagcggagactcttcgcatacggaaaccactgctgaagaagttcccgaggacccgctattaaaagctaaacgtagacgtgtgtccaagggcttgcaccccaagaagcagcggcatctgttgcacttaagagagcgctgggagcagcaagtgagcgcagctgacggaaagccaggtcggcagtccagaaaagaagtgacacaggccacccagcctgaagcaatcccccagggcactaacattaccgaagagaagccaggcagaaaaagagctgaagcaaaaggaaacagatcttggagcgaagagtccttaaagccttcagacaatgaacagggactgcccgtcttttctggttcccctccaatgaagagtttaagctccacatccgctggaggaaaaaagcaagcccagccgagctgcgcccctgcctcccgcccaccagccaaacaacaaaagattaaggagaaccagaaaactgatgtgctttgcgccgacgaagaggaggactgccaggccgcttccctgctccagaagtacaccgataactctgagaaaccaagcgggaaacggttgtgcaaaaccaagcatctgatacctcaggaaagccggagaggcttgccacttactggcgagtattacgtagagaatgccgatgggaaggtgacagttcgtaggttccgcaaaaggccggagccatcctccgactacgatctgtctccggccaagcaggaaccgaagccttttgaccggctgcaacagctgctacccgcgagccaatcaacccagcttccatgctcctcgagcccacaagagactacacagtccaggcctatgcctcctgaagccagacggctgatcgtgaacaagaatgcaggagaaaccctgctacagcgcgcagcccgcctgggttacgaagaagtcgtgctgtactgtctggaaaacaaaatttgtgacgtgaatcaccgcgacaatgccgggtactgcgctttgcatgaggcctgcgcgagaggctggctaaacatcgtaagacatttacttgaatacggagcagatgtgaactgttctgctcaggacggcacacgtcccctccatgacgccgtcgaaaacgatcacctcgagattgtaagactattattatcgtacggcgccgacccaacactggccacatactccggccgcactattatgaaaatgacccacagcgaactgatggagaagtttctgactgattacctgaacgatctgcaaggaaggaatgatgacgatgccagcggcacctgggatttttatgggtcctctgtctgtgaacctgacgatgagagtggatatgacgtgttagctaatccgcctggcccagaagatcaggatgatgacgatgatgcgtattccgacgtgtttgaatttgagtttagtgagaccccactgctcccctgttacaatattcaggtgagcgtagcccaaggaccccgaaactggcttctgttaagtgacgtcctcaagaagttgaaaatgtcctctaggattttccggtgcaattttcctaatgtggagattgtgaccatcgccgaggccgaattctatagacaggtgagtgccagtttactgttctcttgttcaaaagatctggaggcctttaaccctgagtcaaaggagttactcgatctagtcgaattcacaaatgagattcagaccttgctgggcagtagcgtggaatggctgcatccatctgatctggcgtcagacaattattggtag

SEQ ID NO: 180486 - DNA, 87 bp, Artificial Sequence
  Description of Artificial Sequence: Synthetic coding sequence
atgctgagcgccacccccctgtacggcaacgtgcacagctggatgaattctgaaagagtacgtatgtgtggggcctctgaggactag

SEQ ID NO: 180487 - DNA, 1236 bp, Artificial Sequence
  Description of Artificial Sequence: Synthetic coding sequence
atgacccggcccgccttccagccccccgccacccccgccaagcacagctccagcacgagctctaagggcgcaaaggcctcaaaccccgaacctagcttcaaagcaaacgagaacgggctaccccccagcagcatattcctcagccccaatgaggccttcagatcccctcctataccttacccccggagttatctgccctatccagctcctgagggaatagccgtgagccctctctcactgcacgggaaaggccctgtgtaccctcaccccgttctattacccaacgggtcactcttccccggccacctggcccccaaacctggcctcccctatggactccccacaggtagacctgagttcgtgacttatcaagatgctcttggcctcggcatggtccaccccatgttaataccacacactcctatcgagattaccaaagaggaaaagcccgagcgcaggtctagatcacacgagcgggccagatatgaagatcccacactccgcaacaggttctctgaaattctggagacgtcatcaacaaagctccatcccgatgtccccacagacaagaaccttaaacccaatcccaattggaatcaggggaagacggttgtcaaatccgataagctagtctacgtagatttattacgggaagaaccagacgcgaagacagacactaacgttagcaaaccttcctttgcagccgaatcggtcggtcagagcgccgagccacctaaaccatctgtggaaccagcacttcagcagcaccgcgacttcatcgctctgcgcgaagaactcgggcggatttcagatttccacgaaacgtatactttcaaacagcccgtctttaccgtgtctaaggattccgtgctcgcaggcacaaataaggagaatctgggactgcccgtttctaccccgtttttagagccacctcttgggtctgacggtcccgccgtgaccttcggaaagactcaggaggacccaaaacccttttgcgtggggtctgctccacccagcgtggatgtcacgccgacttatactaaggacggcgcggatgaagcagagtctaacgacggtaaggtcctgaagcctaagcccagcaagctggccaagcgtatagcgaattcagctgggtatgtcggggaccgttttaagtgcgtaactacggagttgtatgctgactcaagccagctttcccgggaacagagggctttacaagttagtccacccacctag

SEQ ID NO: 180488 - DNA, 2238 bp, Artificial Sequence
  Description of Artificial Sequence: Synthetic coding sequence
atgcccgtgctgagccggccccggccctggcggggcaacaccctgaaacggaccgccgtcctgttggcccttgctgcctatggggcgcacaaggtttacccgctcgtacgtcagtgcctggcaccagccaggggcctgcaggcaccagcgggcgaacccacccaagaagcatccggggtggccgccgctaaggccggaatgaatcgcgtatttctgcagcgtctgttatggttgctccggctcttattccctcgcgtcctgtgcagggagaccggattattggccctgcacagtgccgcactggtctcaaggacgttcctgtctgtgtatgtagcaaggctggacgggagactagcaaggtgcattgtcagaaaggatccacgggcttttgggtggcaactgcttcagtggctgctcattgcactgccagccacctttgtgaattcggccatacggtaccttgaaggtcagctagctctgtcattcaggtctaggctggtagcacacgcctaccggctgtatttttctcagcagacctactaccgcgtttccaacatggatggcagactgaggaaccctgatcagagtctgacggaggacgtagtggcatttgccgccagcgtcgcccacctgtattctaatctcacaaagcctctcctggatgttgctgtcaccagttatacactgctgagggcagccagatctagaggcgccggtacggcctggcctagtgctatagcaggcctcgtcgtttttcttactgctaatgtcctgagggctttcagtcccaagttcggtgagttggtggctgaggaggctcgccgcaaaggggagctgagatacatgcactctcgggtcgttgccaattcagaagagattgccttctatggaggacacgaggtggaattggcgctgttgcagcgctcttaccaagacttggctagtcagattaacttaatcctgctcgagcgactgtggtacgtcatgcttgagcaattcttgatgaaatatgtgtggagtgcgagcgggttgctcatggttgccgtaccaatcatcacggctacgggttacagtgagtcagatgctgaggccgtcaaaaaagcagcactcgaaaagaaggaagaagaactggtgtccgagcgcaccgaggccttcacaattgcccgcaatcttcttactgcagccgccgacgccattgaaagaataatgagttcatacaaggaagttactgagctcgccggctacactgccagagtccatgagatgttccaggtgtttgaggacgtacagaggtgtcattttaagcggcctagggagcttgaagacgctcaggccggaagcggcacaatcggcagaagcggcgtgcgtgtcgaggggccactaaagatccgcggccaggtggtggacgtggaacagggaattatttgcgagaacattcctatcgtgacacccagtggcgaagtagtggtcgcttccttaaatatccgtgttgaagagggcatgcacctgttaattacagggcccaatggatgcggcaagagtagcctgtttcggattttaggtggactttggcccacttacggcggagtgctgtacaaaccgcccccccagcgcatgttttatattccccagagaccctatatgtccgttggatcactcagggatcaggtaatttaccctgacagtgtggaggacatgcagcgtaagggctattcggaacaggacctcgaggctatactcgatgtggttcacctgcatcacattctgcagcgcgaaggcggctgggaggctatgtgcgactggaaggacgttcttagcggcggcgagaaacagcggattgggatggcaagaatgttttaccatcgccccaagtatgcccttctggatgagtgcacatccgccgtgtccattgacgtggaaggaaaaatttttcaggccgcaaaagatgccggaattgccctgctgtcaattacacataggccctccctctggaagtatcatactcatcttctccagtttgatggcgaaggcggctggaagtttgagaagctggattccgcggcgcggttgtctctgacagaggagaagcagcgcctcgagcagcagttggctgggatccccaaaatgcaacgaagactccaagagctatgtcagatcctcggtgaggccgtggcaccagcacacgttcccgcaccctcaccacagggtcctggcggcttgcagggcgcttcaacctag

SEQ ID NO: 180489 - DNA, 5358 bp, Artificial Sequence
  Description of Artificial Sequence: Synthetic coding sequence
atgatcagcaccgcccccctgtacagcggcgtgcacaactggacctccagcgatcggattcggatgtgcgggatcaacgaggaacgcagggcacccttgagcgatgaggagtctaccactggggactgtcaacactttggcagccaagagttctgtgtatcgtctagcttctccaaagtcgaactgacggccgtgggttccggatctaacgcacgcggtgccgaccccgatggaagcgcaacagaaaagttagggcacaagtcagaggataagccggacgatccccagccaaaaatggactatgccggaaacgtggcggaggccgaaggctttctggtgccgctcagcagcccgggggatggcttaaaactgccagcatcagatagcgctgaggccagcaattccagagcagattgtagctggacccctcttaatactcaaatgagcaagcaggtggattgcagccccgctggtgttaaggcccttgattcacgacagggtgttggagagaagaatacatttatcctagccactcttgggacaggagttccagttgagggtacactgcccctcgtgactacaaactttagtcctcttcccgcaccaatatgtccacccgcgccagggtctgcctccgtgccgcatagcgttcctgacgctttccaggtgccactgtctgtccccgccccagtgccacattcaggactcgtgcccgtccaggtcgccacttctgtcccggccccaagtcctccacttgcgcctgtgcctgcactggccccggcccctccttcggtgcctaccttgatatctgactcaaatcccctgagcgtgtccgccagtgtgttggtgcccgtgcctgcctctgctcccccctctggcccggtgcccctgtctgcccccgctcccgctccactcagtgttcccgttagcgcaccaccactggccctgattcaggctcccgtacccccctctgcacctaccttggtcctggctcctgtgcctactccagtgctggcccctatgccagcgtctactccaccagccgccccggcaccgccaagcgttcctatgcccactccaacaccatcatcaggccctccatccacccccactctcatccccgcattcgctcccaccccggtgccggcaccaactcccgcccctatctttacacctgcacccacacctatgccagcggctacgcccgctgcaatacctacatctgccccaattccagcaagcttcagcctgagcagggtctgttttcccgccgcacaggcccctgcaatgcagaaggttcctctgagctttcaaccaggcaccgtcctgaccccatcgcaacccttggtctacatcccacccccatcgtgcggtcaacctctgtccgtagctactctgcccacaacattaggagtgtcatccacccttaccttgccagtgctcccaagctaccttcaggaccggtgcttaccaggagtcctagcaagccctgagctacggtcctatccctatgcattcagcgtggctagacccctgacgtcagattccaaactcgtgtccctcgaagttaacagattaccctgtacgagccccagcggaagcacaacaacacaacccgcccctgacggggtgccgggaccactcgccgatacatctctggtgacagcttccgcgaaagtgttaccaaccccccagcccttgctgcctgctccatcagggtcctctgcgccgccacatcctgctaaaatgccgagtggaactgagcagcagaccgagggaacctctgttacgtttagtcccctgaaaagcccgcctcagctggaacgtgaaatggcctcccctccggagtgctccgagatgccgctcgacctgtccagcaagagcaacagacagaagcttcccctgcccaatcagcggaaaacaccacccatgcccgttttaactcctgttcatactagtagtaaagccctgctcagcaccgtcttgtctcggtcacagagaacaacccaggcggcaggcgggaacgttacctcgtgtttggggtccacaagttctccatttgttatctttcctgagatcgtcaggaatggcgatcctagcacatgggtgaaaaattcaactgccctgattagcaccatacctggaacttacgtcggggttgctaatccagttccagccagcctgctcctgaataaggatcctaacctcggccttaatcgcgatcctaggcatttacctaaacaggaacctatctccatcatcgatcagggggaaccgaaaggcaccggcgctacctgtggaaaaaagggcagtcaggccggggctgaaggccagccttcaactgtcaagcggtatacaccagcccgcatcgcacctgggctccccggttgtcaaacaaaggaactatcactgtggaagcccactggcccagccaacatttaccccaggtgtagtgtgaatggcaagccgacttccacacaagtacttcccgtcggatggagtccctatcatcaagcctctcttttgagcatagggattagtagtgccggacagctcacgccatcccagggagccccaattcgaccaaccagtgtagtgtccgagttcagcggcgttccaagcctttcctcctctgaggctgtgcacggcctgcccgagggtcagcccaggcccgggggtagcttcgtgcccgagcaagacccagtaactaaaaacaagacatgtcgaattgccgccaagccatatgaggagcaggtaaatcctgtgctgttgactctgagtccacaaaccggcaccctcgccctctcagtccagccgagcggtggcgacatccgcatgaaccaggggccagaggagagcgagtcccacttatgtagtgatagcacccctaagatggagggaccacagggcgcctgcggcctcaagctcgccggcgacaccaaacccaaaaatcaggtcctggcgacatacatgagccacgaacttgtcttggctacaccccagaacttgcctaagatgcccgaattacctctgctgcctcatgatagtcacccaaaggagctgattctagacgtggtgccatctagccgcagaggcagcagtacggaacggccacagttgggtagccaggttgatctaggcagagtgaaaatggagaaagtagatggagatgtggtgtttaacttggcaacatgcttccgtgctgatggcctgcctgtagcaccacagcgcggccaggccgaagttagggccaaagcggggcaggcaagggtaaagcaggagtcagtaggtgtttttgcctgtaaaaataagtggcagccagacgacgtgacggagtcactaccacccaagaagatgaagtgtgggaaggagaaggattctgaagaacaacaactccagcctcaagccaaggcagtagtcagatccagccacaggccgaaatgcaggaagttacctagtgatccccaggagtccactaagaagagtcccagaggggcctctgattctggtaaggagcacaacggtgtccgcggtaaacacaagcatcgcaagccaaccaagcctgagagccagtcgcctggaaaaagagccgattctcacgaggaaggaagcttagagaagaaggccaagtcaagctttagggacttcattcccgtcgtgctatcaacccggaccagaagccagtctgggagtatatgctccagttttgcagggatggccgacagcgatatggggagtcaagaagttttcccaaccgaagaggaggaggaagtcactccgactcccgctaaacgccgcaaagtcagaaagacacaaagagacacgcagtataggtcacatcatgcacaggataaatctctattatcccagggacgtaggcatttgtggcgtgcgagagagatgccctggaggaccgaggctgcgaggcagatgtgggacaccaatgaggaggaggaagaggaggaagaggagggactgctcaagcgtaagaaacggagaagacaaaagagccgcaagtaccaaacaggggagtatttgacagaacaagaggacgagcagagaagaaaggggcgggctgatctcaaggcgcgaaaacaaaagacctcttccagtcaaagcctagaacatagactgaggaatcgcaacttactgctaccaaacaaggtccaaggcatctctgattcccctaacgggtttctgcccaataacctggaggaaccggcctgcctggaaaactccgagaaacccagcgggaaaaggaagtgtaagaccaagcacatggccactgtttctgaggaagccaagggtaaaggacggtggagccagcagaaaacccggtccccgaaatcacccactcccgtcaaaccaacggaaccctgtactccttctaagagtaggagtgcctcttcagaagaagcctccgagtcccccacggcacggcagatcccacctgaagccaggcgactcattgtgaataagaacgcaggggagacgctgctccagcgcgccgcccgcttaggatacaaagatgtcgttctgtactgcctgcagaaggactcagaagacgtcaaccatcgggataatgccgggtataccgctttgcatgaggcatgctcacggggatggacagacatattgaacattctccttgagcacggggccaatgtcaattgtagtgcccaggacggtactcggcccgtacacgatgccgtagttaatgataacctggaaactatctggctcctcctttcttatggggctgacccaaccctggctacatattctggccaaacagctatgaagctggcctccagcgatacaatgaaaagattcctctcggatcacctgagcgatctccagggacgagcagaaggcgacccaggagtgtcatgggatttttattcctctagtgttttggaagagaaagatgggtttgcctgtgacctcttgcacaacccgccaggaagctccgatcaggagggggacgacccaatggaagaagatgatttcatgttcgaactcagtgacaagccccttctaccatgttacaacttgcaggtgagcgtcagccgcgggccatgcaactggttcctgttttccgacgtactgaagcgattaaagttatctagtcgtatttttcaagcccgattcccccattttgagatcaccaccatgccaaaggccgagttttacaggcaagtcgcctctagccaactgctgactccagccgagcggccaggcggacttgacgatcgatcacccccaggcagttccgaaaccgtagaattggtccgctacgaacccgatctacttcggctgttgggatctgaggtcgagtttcagtcctgcaattcgtag

SEQ ID NO: 180490 - DNA, 4746 bp, Artificial Sequence
  Description of Artificial Sequence: Synthetic coding sequence
atgatcagcaccgcccccctgtacagcggcgtgcacaactggacctcttctgatagaatacgcatgtgcggaatcaacgaggaacggcgggcccccctttccgacgaagagtccacaaccggcgattgtcagcatttcggatctcaggaattctgtgtctcctcctcgttttctaaggtagaattgaccgcagttgggagcgggagtaacgcccgaggcgccgaccccgatgggagcgctaccgagaagctggggcacaagtccgaggataaaccagacgacccccagccaaaaatggactatgccggcaatgttgcggaagcagaagggtttctggtccctctttctagtccaggcgacggactcaaattgcctgcctcagacagtgctgaagcttcaaatagccgggccgattgtagttggacacccctaaacactcaaatgagcaaacaggtggattgcagtcccgctggtgtgaaggcactcgacagcagacagggcgtgggcgaaaaaaatacctttatactagcaacactcgggaccggggtacccgttgagggtactctgcctcttgttacaactaatttttctcctttgcccgctcccatttgtccaccggccccgggatctgccagcgtgcctcactccgttcccgatgcttttcaggtgccactgtctgtcccggcccccgtgccgcacagtgggcttgtccctgttcaggtggccaccagcgtgccagctccttccccacccctggctcccgttccggccctcgcccctgcccccccctctgtgccaaccttaatatcagatagtaaccccctgtcggtttcagcatctgtcctggtaccagtcccggcatccgctcctccctccgggcccgtaccactgtcggcaccggcgcctgcccccctcagtgtcccagtctctgctccgcctctggcccttatccaggcccccgtgcccccgtctgcccccacactggtgctggccccagtgccaacgcccgttttggcaccaatgccggcctccacacctcccgctgctccagccccacctagcgtgcctatgcccacccctacaccttctagcgggccacccagtacaccaaccctaattccagccttcgctccaacacctgtccctgccccgactccggcaccaatttttaccccagcccctacccccatgcctgctgctactccagcagccatccctacgagcgctccgattccagcatccttttccctgtcccgggtgtgttttcctgccgcacaggctcccgccatgcaaaaagtgccgctgtcttttcagccaggaaccgtgctgaccccctctcagcccctggtgtacatacctccccctagctgcggacagccactgagcgtggccacgctccccactacactcggggtttcttcaacacttaccctgcctgttttgccctcgtacctacaggaccgctgcctacccggagttctcgctagtcccgagctgcgttcttatccctatgccttctcggtggcccgccccctcaccagtgacagtaagcttgtgtcactcgaggtgaaccgactgccctgcaccagtcccagcgggtccacaaccacccagcctgccccagatggtgttcccggccccctggctgatacgagtctggtgacggcaagcgctaaagtgctgccaacaccccagcctcttttgccagcccctagtggaagttcagctcccccacatcccgccaagatgcctagcggtacggagcagcagaccgaaggaacctccgtaaccttctcacctttgaagagccctccccagctggaaagagagatggctagcccccccgagtgttctgagatgcccttggatctgtcttccaagagcaaccggcagaaactccctctgcccaatcagcggaaaacccccccaatgcctgttctcacccccgtccataccagcagcaaggccttactgtctacagtcttatcccggagtcagcgaactacccaagcagccggcgggaatgtgaccagttgcctgggctctactagcagtccctttgtgatctttcctgaaattgtgaggaatggcgatccttctacgtgggtaaaaaactccaccgcgctgatctctaccattcctggcacctatgtgggggttgccaatcccgtccctgcgtcattgcttctgaacaaggatcccaacctcggtctgaacagagacccacgccacttaccaaagcaggagccaattagtattattgaccagggtgagcccaagggcaccggtgcgacttgcggcaagaaaggcagtcaggcaggtgcagaagggcaacctagcactgtcaagaggtatacccccgctcgaatcgcccccggactgcctggctgccaaacaaaagagctgagcctatggaaaccaaccggccccgccaatatataccccaggtgcagcgtgaacggtaagcccaccagtactcaagtcctgcccgtcgggtggtcaccctatcatcaggcctcactgctaagcatcggaatttccagcgccgggcaacttacaccctcacagggcgcccccatcaggcctacatccgttgtatccgagttctcgggagtgccgagtttaagctccagcgaggccgtccatggacttcccgagggacaacctcgaccgggtgggagcttcgtacccgagcaggaccctgtgactaaaaacaagacttgcagaatagccgcgaaaccctacgaggagcaagtcaatccggtactgctcactctttcacctcagactggaaccctggccttgtccgttcagccatcagggggagatattaggatgaatcagggtcccgaagagtctgagagtcacttatgcagcgattccacaccaaaaatggaagggccacagggggcctgtggactcaaactcgctggcgatactaagccaaagaaccaagtgctggccacctatatgagtcacgagttggtgctcgcgactcctcagaacctgcctaagatgcctgaactaccactccttccccacgactcccacccaaaagaactgatcctcgatgtagtgccaagtagcaggcgaggctcctccactgagcgcccgcaacttgggagccaggttgacctggggagggtgaaaatggagaaggtagatggggatgtagtgttcaacttagctacctgttttcgcgccgatggcttgcccgtggcccctcagcgggggcaggctgaggtgagggcaaaggcaggccaggccagggtcaaacaggagagcgtcggagtatttgcgtgcaagaataaatggcagccggatgacgtgaccgaatccctcccccccaaaaagatgaagtgtggtaaggaaaaggattctgaggagcagcagcttcagccccaggccaaggctgttgtgcgaagctctcatcggcctaaatgcagaaagctacctagtgacccacaggagagtaccaaaaaaagtccacgaggggcatctgactccggtaaagagcacaacggagtgagaggtaagcacaaacacaggaaaccaacaaagcccgagagccagtcccccggaaaacgggcggatagccacgaggagggcagtctcgagaaaaaggccaaatcgagcttcagggattttattccagtggtgttgagcacaaggacccgatcacagagcgatttaaaagcgcgaaaacagaaaacctcttcctcccagagtctggaacacagattacgtaacagaaatcttttgctgccgaataaggtgcaggggatttctgatagccccaatggcttccttccaaataatctcgaggaaccggcctgtctcgaaaatagcgagaagccctccggtaaaaggaaatgcaagacaaaacacatggctaccgtcagcgaggaagctaaagatgtggtgttatattgtctgcagaaggattcagaagacgtcaaccacagagataacgccggatacactgctctgcacgaagcctgttcccgcggatggactgacattctaaatatacttctggaacacggagccaacgttaactgctctgcacaggatgggacgaggccagtgcatgacgccgtggttaacgacaacctggagaccatctggctccttctgagttacggggccgaccctacacttgcaacctacagcggccagacagccatgaaactcgcttccagtgacacgatgaagcgcttcctcagtgatcacctgagtgacttacaggggcgagctgaaggagaccctggcgttagctgggatttttattcttctagcgttctcgaggagaaggacgggttcgcttgcgaccttctacacaaccctcctggctcatctgaccaagaaggtgacgatcccatggaggaggatgactttatgttcgaacttagcgacaagcctttgctgccctgctacaacctgcaggtatccgtgagccgcgggccttgtaactggttcctgttctccgacgtgttgaagcgcctgaaactctcttccaggatcttccaagctagatttccacattttgagattaccacaatgcccaaggccgagttttacaggcaggtggcctcatcccagttgcttaccccagccgaacggccaggcggcctggacgaccgctcaccaccaggatcaagcgagaccgtagagttggttcggtacgagcccgatttgcttcgactcctgggatcagaagtcgagtttcagagctgcaattcctag

SEQ ID NO: 180491 - DNA, 2226 bp, Artificial Sequence
  Description of Artificial Sequence: Synthetic coding sequence
tgacccctgctgcccgcccccagcggcagcagcgcccccccccacccagctaagatgccaagtgggaccgaacagcagacagaggggacaagtgtcacctttagccccttgaaatcccctccccagctggagagagaaatggcgtcccctccagaatgcagtgaaatgcctctcgacctgagctcgaaatctaaccgacagaaattgccactgcccaatcagcgcaagactcccccaatgccagtgctcaccccagtacacaccagttctaaagcactattgagcactgttctgtctcgaagccagaggaccacacaggcggccggtggaaacgttacttcatgcctagggtctactagctcccccttcgtcattttccccgaaatcgtgaggaacggagatccaagtacgtgggtgaaaaacagcaccgcactaatcagcacgattccaggaacctatgtgggggtggccaatcctgtgccagcctccctgctgctgaataaggatccaaacctcggactaaaccgcgatccacggcacttaccaaagcaggagccgatctctattattgatcagggagaacctaaggggacgggggccacatgtggaaagaagggatcccaggcaggtgctgaaggacagccttcgactgttaagaggtacactcctgcccgcattgcacctggactcccaggatgtcagacgaaagagctctctctgtggaaaccaaccggtcccgccaatatctatccccggtgctctgtgaacgggaagcccacatctacccaagtgctgccggtgggctggagtccttaccaccaggcctcactcctatcaatcggtatctcaagtgcaggtcagctcactccttctcagggtgctcctataagaccaacttccgtcgtctctgagtttagcggagttccctccctgagcagcagtgaggcagttcatgggcttccagagggccagccaaggccgggtggcagttttgtgcctgaacaggatcctgttacaaaaaataaaacctgtaggattgctgcaaaaccttatgaggaacaagtgaatcccgtgctgttgactctcagcccacagaccgggactctggctttgtccgtccagccctctggcggggacattaggatgaaccagggaccggaggagagcgagtcgcacctgtgcagcgacagcacgccaaaaatggaggggccgcagggcgcctgcggtcttaagctggcaggagacaccaaacctaagaaccaggtcctcgcaacctatatgagccatgagctcgtcctcgccactcctcagaatctcccaaagatgcctgagcttcccctcttgcctcacgactcacatcccaaggagttgatcctggacgtggtcccgtcatcgaggcggggctcctctacagagcgccctcaattggggtcacaggtggatctgggccgtgtgaagatggaaaaggtggacggagacgtggtcttcaatctggctacttgtttcagagctgacggcttgcctgttgcccctcagagggggcaagctgaggtgagggccaaggctgggcaagctcgggtaaagcaggagtcggtaggagtgttcgcatgcaagaacaagtggcagccagatgatgtgactgaaagcctgcctcccaagaagatgaaatgcggcaaagagaaggactcggaagagcagcagctccaaccacaggctaaggcggtagtacggagttcccatcgccctaaatgccgaaaactgccctccgatcctcaggagtccacgaagaagtccccacgaggtgcctctgacagtggcaaggaacacaacggtgtaagagggaaacataagcatagaaagccaactaaacccgagtcccaatctcctggcaagagggcagatagccacgaggaaggatctctggaaaaaaaggccaagagctcctttagagacttcattcctgtcgtgctgagcacccggacacgttcccaatcagacctgaaagctcgtaaacagaaaacatcttcaagccagtccctggagcaccggctgagaaatagaaacctcctgttacctaataaggtccaggggatttctgacagccccaacggatttctccctaataacctcgaagagccagcatgcctggagaattccgagaaaccctcggggaagcgcaaatgcaagaccaagcatatggcaaccgtttcagaggaagctaagtag

SEQ ID NO: 180492 - DNA, 4158 bp, Artificial Sequence
  Description of Artificial Sequence: Synthetic coding sequence
acccccgccgccatccccaccagcgcccccatccccgccagcttcagcttatcgagagtctgtttccccgccgcccaagcgcctgcgatgcagaaagtccctttgagcttccaaccaggcactgtgctgactcccagtcaaccattggtgtatatcccgcccccctcgtgtggacagccattgtccgtcgcaacactgcccaccacattgggcgtcagttccaccctcacactgcccgtcctcccttcttacctgcaggacagatgccttccaggcgtgttggccagccctgaactgcggtcctatccttacgcattttcagtcgctagacctctgactagcgattccaagctggtctcgttggaagtgaatagactgccttgtacatcacctagcggatctactaccacccagcccgctcccgacggcgttcctggacccttggctgatacctccctggtgacagcctcggctaaggtgctgcccacaccacaacccctgttgccagcaccatctggaagcagcgctccacctcacccggccaagatgccttccgggacagaacaacagaccgaaggtacatctgtcaccttttcacctctgaagtcacctcctcaattggagcgggaaatggcatcaccaccagagtgcagcgagatgcccttggaccttagtagcaagtccaatcgccaaaagctgccactaccaaatcagagaaaaacgccaccgatgccagtgctcacaccggttcacacttctagtaaagcactgctgtccactgtcctcagtagatcccagcgtaccacccaggccgctggcggcaatgtaacgtcttgtctgggaagtacttccagtccatttgtaattttcccagagatagtccgtaacggggatccaagtacgtgggtgaaaaactcaactgccctgatctcaaccatacctgggacatatgtgggcgtcgctaacccggtccccgccagcctcctgctaaacaaggacccaaatctgggtctgaatagggatccccggcatctcccaaaacaagaacctatctctatcatcgaccagggcgagcccaagggcacaggcgctacatgtggtaagaaggggtcacaagcgggggccgagggacagccatccaccgtaaaaagatacaccccagccagaatcgctcctggacttcctggttgtcagacaaaggaactctcactatggaagcctacaggtccagccaatatatacccccgctgcagtgtgaacggaaagcccacaagcactcaggtgctgccagtcggatggagcccttaccatcaggcctcgctcctgtcaatagggatatccagcgctggccagctgacccctagccagggagccccaattcgccccacatcagtggtgtccgagttttcaggagtcccatctctctctagcagtgaagccgtgcacggcttgccagagggccagccccgaccaggtggatcattcgtgcctgagcaggatcctgtaacaaagaataaaacgtgtagaattgcggccaaaccttacgaggagcaggtaaatcctgtgctattgacactctctccacaaacgggcacattagcactgagtgtgcaaccgtctggtggagatattagaatgaatcaagggccggaggaaagtgagtcccatctgtgctcagacagcacccccaagatggaaggcccacagggagcttgcggcctgaaacttgcaggagacacaaagcccaaaaatcaagtgctcgccacctacatgtcacacgagttggtgctggctacaccacagaatctgcccaaaatgcctgagctgcccctccttccccacgactcacaccctaaggagctgatcctcgacgttgtacctagcagtcggaggggatcgagtacagaaaggcctcagctgggctcccaggttgaccttgggcgagtgaagatggagaaagtcgatggtgacgtcgtgtttaacctcgccacatgcttccgagccgatggcctgcccgtggcccctcagagggggcaggcagaggtccgtgccaaggccggacaggctcgggtgaagcaggagagtgtgggcgtatttgcctgcaaaaataaatggcagcctgatgatgtgactgaaagcctgcctccaaagaaaatgaaatgcggcaaagaaaaggactctgaggaacaacagttacaaccacaggctaaggcagtcgtgcgatccagtcatcgaccgaagtgtaggaaactgccaagcgacccgcaggagagcaccaaaaaaagtccaagaggcgcatcagactcagggaaggagcataacggggtgaggggcaaacacaagcatcggaaaccgactaaacccgagtcccagtctccgggcaagagggctgacagccacgaggagggaagcttggagaagaaggcaaagtcctccttcagagattttatccctgttgttctttctactagaacaaggtctcagtccggcagtatctgctctagctttgccggcatggccgattcagacatgggctcacaggaagtgttccccactgaggaagaggaagaagttactcctacccctgcgaagcggagaaaggtgagaaagactcagcgggacacacagtaccgcagccatcatgcccaggacaagagtcttctgtcgcagggacggcgacacctttggcgcgcccgcgaaatgccttggcggactgaagctgcccggcagatgtgggatacgaacgaggaggaggaagaggaagaggaggaaggattgctgaagcggaagaagcgccgccggcagaagtcgaggaagtatcagacaggggagtatcttaccgagcaggaggacgagcagcgcagaaagggccgggccgaccttaaggccaggaagcaaaagaccagttcatctcaaagcttggagcacagactccgcaatcggaacttgctgttgccaaataaggttcagggaattagtgacagcccgaacggatttctgcctaacaacctggaggagcctgcatgtttagaaaattctgagaaaccatcagggaaacggaagtgtaagaccaaacacatggcgacagtttctgaggaggcgaaaggtaaaggacgatggtcacagcagaagacaagatctccaaagagccccactccggttaaacccaccgaaccctgcacccccagcaaatcccgcagtgcatcgagcgaggaggccagtgaatcgccgacagcaagacaaattccgccagaggctcggcgcctcatcgtcaataaaaatgcaggagaaacgttgctccagcgcgccgcaagactggggtataaggatgtggtgctttattgcctgcaaaaggattcggaggatgtgaatcatcgtgataacgcggggtacacagccctccacgaagcatgttcccgggggtggaccgatatcttgaatattctcctggagcacggtgctaatgtgaactgttctgcccaggatgggacgcgcccagtacatgatgctgtcgtgaacgataaccttgagacaatctggttactgcttagctacggtgctgatccgaccctcgctacatattccggccagacggccatgaagctcgcttcaagtgacaccatgaagcgctttctgagtgaccatttgtctgatctccagggtcgggccgaaggagaccccggggtctcatgggacttctacagcagctctgtgctggaagagaaggacggttttgcatgcgatttgctgcacaaccctcctggttcctccgatcaggaaggcgacgatcctatggaagaggatgactttatgtttgagcttagtgacaagccattactcccgtgctataacctccaagtttctgttagcagaggcccttgcaactggtttctgttttccgatgtgttaaaacggttaaagctgtcatctcgcatttttcaggcgcgcttcccacatttcgagattactaccatgcctaaggcagaattctatagacaggtagcctctagccagctgctgacgcctgcagagaggcccgggggcctggacgaccgctccccccccgggtcttccgagaccgtcgagctcgtgaggtacgagcctgacctgctgcgactattgggttccgaggttgaatttcagagctgtaattcatag

SEQ ID NO: 180493 - DNA, 5136 bp, Artificial Sequence
  Description of Artificial Sequence: Synthetic coding sequence
atgatcagcaccgcccccctgtacagcggcgtgcacaactggacctcctcagaccggatccgtatgtgcgggattaatgaggagaggcgcgcccccctgtccgatgaggaaagcactacaggcgattgccagcatttcggcagccaggagttttgtgtaagctcaagcttttccaaggttgagttgacggctgtgggatccggcagcaatgctcgcggagcagaccctgacggttctgctactgagaagctcggccataagtctgaggataagcctgacgaccctcagccgaagatggactatgccgggaacgtcgctgaggcagaaggctttctggtgcccctgtcttcccccggagatggactcaagctgcctgcctcagactcagcagaggcttccaatagcagagctgactgttcttggacaccgctgaacactcaaatgagtaagcaagtcgactgttcacccgccggggtaaaggccctggactctaggcagggggtcggcgagaagaacaccttcatactggctactctgggcaccggagtgcccgtcgagggtacccttcctcttgttaccacaaactttagcccactgccagcccccatatgcccccccgccccaggatctgccagtgtcccacactccgttccagacgcttttcaagtaccgctaagtgtccctgcgccagtgccccatagcgggcttgtgcctgttcaggtggctacaagtgtccctgcaccatccccgcctttagcccccgtccctgccttggccccagcccccccatcagtgcccacactaatctcggatagcaaccctttgagtgtctctgcctccgtgctggtacccgtcccggcgtcagcccccccttccggccccgtgcctcttagcgctcccgcacccgccccactgtccgtgcccgtgtctgcccctcctctggctctgatccaggcaccggtcccaccgagtgcaccaaccctggtactggcccccgtccccaccccagtcctggccccaatgccggcctccacacctcctgccgccccggcacctccttccgtgccaatgcctacacctaccccatcttctggacccccgtcaactcctaccctcatccccgccttcgcccctacgcccgttcctgcccccactccagcaccgatcttcacccctgcgccgactccgatgcccgccgccaccccggcggctattcccaccagcgcccccatccctgcttctttctccttatcaagggtgtgtttccctgccgcccaggctcctgcaatgcagaaggtgcccctctcctttcaacctggaacagtgctgaccccaagtcagccacttgtgtacattccccctccaagctgcggccaacccctttctgttgccaccctccctacgacactgggcgtgagcagcacccttaccttaccggttctccctagctatctacaggacaggtgcttgccaggtgtcttagcgagtcccgagctcaggagctacccctacgcattctcagtcgcaaggcccttgacaagcgattctaagctggtgtccctggaagtcaaccggctgccctgtacttcacctagcggatcgaccactactcaacccgcacccgacggcgtgccaggacctcttgcggatacatccctggtgaccgcgagcgctaaggtccttcctacacctcagcccctccttccagcacccagcggcagcagtgccccaccccacccagctaaaatgccatcagggaccgaacaacagacagagggcacctccgtgacattctccccactcaagagcccacctcagcttgaaagggaaatggcatcaccacccgagtgctctgaaatgcctttagacctgtcgtccaagtcaaacaggcaaaagttacctttacccaatcagcggaagactcctcccatgccggttttgactcctgtccatacatcatccaaagccctcctatcaactgtgctgtcgaggtcacaacggacgacccaggcggccggcggaaacgtaacttcatgccttggtagcacaagttcgccttttgtgatcttcccagaaattgtgaggaatggggacccaagcacctgggtgaaaaatagcacagcccttatctcaactatccctgggacgtacgtgggggttgccaatccagtaccagcatctcttctccttaataaagatccaaacctcgggctgaaccgtgaccctagacatctgccaaaacaggagcctattagtattatcgaccagggcgaaccgaaagggaccggcgcgacatgtggcaagaaagggtctcaagctggtgccgagggtcaacccagtacagtgaaacggtatacccctgctcgaatcgcaccaggcctgcccggatgccagacgaaagaactgtccctctggaaacctacaggacccgcaaacatctatcccagatgcagcgtgaacggcaaacctacctcaacccaagttttgccagtgggttggagtccataccaccaagcaagcctgctctccatcggcatctccagcgctggccagctgacaccaagccagggggcccctatccggcctacgagtgttgtctccgagttcagtggggtcccaagcctctctagtagcgaagcagtgcatggcctgccagagggacagccccgcccaggggggtcctttgtgcctgagcaagatcctgtcaccaagaataaaacatgccgcattgccgcaaagccttacgaagagcaggtgaacccagtgctactcacgcttagcccccagacaggcactttggctcttagtgtccaaccaagcggaggcgacatccgaatgaatcagggaccagaggaatcagaatcacatctgtgcagtgattcaacgcctaaaatggaggggccgcagggagcgtgcggccttaaacttgccggggacacaaaacctaagaaccaggtgctggctacctacatgagccacgagctggtgttggcaactccacaaaacctgccaaaaatgcctgagctgccccttcttcctcacgattctcatcctaaagaacttattcttgacgtggtaccttccagccgccggggatcatctacagaaaggccacagcttgggtcgcaggtcgacctgggacgagtgaagatggagaaagtcgacggggatgtagtgttcaaccttgctacctgtttcagagcagacggcctccccgtggcgccgcaacgcggtcaggctgaggtaagggcgaaagcaggccaggcgcgcgtgaaacaggagtctgtgggggtcttcgcctgcaaaaacaaatggcagccagacgatgtcactgagtcgttgccccccaagaagatgaagtgtggaaaggagaaggactcagaggaacagcaacttcagccccaggccaaggccgtggtaaggagctcccacaggcctaagtgtcggaaactgccatccgatccacaggagagcacgaagaaatctcctcggggcgcctctgattcgggcaaggagcacaatggggtcagaggaaaacacaaacataggaagcccacgaagccagagtctcagagtcccgggaaacgggcggactctcatgaggaaggaagcttagaaaagaaggccaagtctagctttagggatttcatccccgtcgtgctgtctacccgaacaaggtcacagtctggatctatctgttctagctttgcgggaatggccgattccgacatgggatcgcaggaggtttttcccacagaagaggaggaggaggtgacaccaacccctgcaaagagaaggaaggtgcggaagacccagagggatactcagtacagatcccaccatgcccaggataagtcactcctcagccaggggaggcgacacttgtggcgcgctagagagatgccttggaggacagaagcagccaggcagatgtgggataccaacgaagaggaggaggaagaggaagaggaggggttgctgaagcggaagaagcggaggcgccaaaaatctaggaaataccagacgggagagtatcttacagagcaggaggacgagcagcgcaggaagggacgagctgacttgaaagcccggaagcaaaagacctcttccagtcagtccttagagcataggttgagaaaccgcaacctcctcctgcctaacaaagtccaaggcatttctgattcccccaacggttttttgcccaacaatctggaggaacccgcttgccttgagaattccgagaaaccttcaggcaagagaaagtgcaagactaaacatatggctaccgtatccgaggaggctaaggacgttgttctgtactgcctgcagaaggatagtgaagatgtgaaccaccgggacaacgcaggctacaccgctttgcatgaggcctgcagtcggggatggacagacattctgaacatcttgctcgagcacggcgcgaacgtgaattgttccgctcaggacggaacacgaccagtgcatgatgccgtggttaatgacaatttggagactatttggctgctgctgagttacggggctgaccccactctcgctacatatagcgggcaaaccgccatgaaactggcctcatctgacacaatgaaacgttttttatccgatcatctcagtgacctgcaggggcgagccgagggcgatccaggagtcagctgggacttttactccagttctgttttggaagagaaggacggattcgcctgcgaccttttgcataatccgcccggttctagcgatcaggaaggcgatgatcccatggaggaggatgatttcatgttcgagctatctgacaagccactgctcccctgttataacctgcaagtatctgtcagccggggtccatgtaactggtttctattttcagacgtcctgaaacggcttaagctctcttcacgaatttttcaggcgcgctttccacacttcgaaataaccaccatgccaaaagccgagttctataggcaagttgcatcaagccagctgctgactcccgccgagcggcctggcggcctcgacgacagatcacccccaggttcttcagagacggtggagttagtgcgctatgagcccgaccttctgaggttattgggatctgaggtggaattccagagctgcaattcttag

SEQ ID NO: 180494 - DNA, 1260 bp, Artificial Sequence
  Description of Artificial Sequence: Synthetic coding sequence
atgcccctgagcgacttcatcctggccctgaaggacaacccctactttggagctggtttcggactcgttggagtgggcaccgctctggcccttgctcgtaagggcgttcaactcggcctggtagcatttcgtagacactatatgataaccttggaggttcctgctagggaccggtcctacgcctggcttctgtcctggttgactaggcactccacacgcacccaacacttgagcgtggaaacatcctatctccagcatgagtccggtagaatcagcacgaagttcgagtttgtccctagtcccggaaatcactttatctggtaccgcggaaagtggattcgtgtagaacgaagccgggaaatgcagatgatcgatttacagacgggtaccccttgggagtccgtgactttcacagctctgggaactgaccgaaaagtgtttttcaatatcctagaagaggcccgcgaattggccctccaacaggaggaaggcaagacagtgatgtataccgctgtgggctccgagtggcgcccctttggctaccccaggcgccgacgtcccttgaattcagtggtgctgcaacaggggctcgccgatagaattgtcagggacgtacaggagttcatcgataatccaaaatggtatacagatcggggaattccttatagaaggggctacctgttatacggcccaccaggctgtggcaaaagctctttcatcactgctctcgcaggagagctggaacactcgatctgtttgctgagtctcactgacagctccctctccgacgatcgcctgaatcacctcctgtccgtggcaccccaacagtcactcgtgctcttagaagatgttgatgccgcctttttgagccgggacctggccgtggagaaccccgtgaaataccagggcctaggcagattgacattttcggggttactgaatgccctggatggagtggcctccaccgaggctcgtatcgtcttcatgacaaccaaccatgtggataggctggaccctgccctgattcgcccaggcagggttgatcttaaggaatatgtaggatattgttcccactggcagctgacacagatgtttcagagattctacccgggacaagctccgtcgctggctgagaatttcgccgaacacgtcctcagggccactaatcagatttcacctgcacaagtccagggctacttcatgctctataagaacgaccctgtgggcgctatccacaacgccgagagcctgcggcggtag

SEQ ID NO: 180495 - DNA, 1260 bp, Artificial Sequence
  Description of Artificial Sequence: Synthetic coding sequence
atgcccctgagcgacttcatcctggccctgaaggacaacccctacttcggagctggcttcggcctcgtgggtgttgggactgctctggccctggcccgcaagggcgtgcaactaggtctcgtggccttccgaagacattatatgatcaccctggaggtcccggccagggaccggagctacgcctggctgctgagctggctgactcgacattctaccagaacccagcacctctccgtagagacctcatacctccagcacgagtctggccgtatttctactaaattcgaattcgttccctcgccagggaaccattttatctggtacaggggtaagtggatcagggttgagagatcccgagagatgcagatgattgatctccaaacagggaccccatgggaatcagtaaccttcacagcactgggcaccgatagaaaggtatttttcaatatccttgaggaggcccgtgaactagcactccagcaggaggaagggaagacagtgatgtataccgcagtaggctctgagtggcgcccattcgggtacccgagacgaagaagacccctgaatagcgtggtccttcagcagggtctggcagacaggattgtccgcgacgtacaggaatttatcgacaatcccaagtggtataccgatcgagggataccttacagaagaggatatcttctctacggcccccctgggtgcggcaagtcaagcttcattacggcactagcaggagaacttgagcatagtatatgtctcctctcgttgaccgatagttctctctctgacgatcgcctgaaccatcttttatctgtagcaccacagcagtctctcgtgctcctcgaggatgtggatgctgctttcttatctcgcgacctggccgtggagaacccagtaaaatatcagggtctaggccgattgacattctcagggctacttaacgctctggatggggtggcctccaccgaagccaggattgtcttcatgactactaaccacgtggataggcttgaccctgctctgatcagaccggggcgcgtggaccttaaggaatacgttgggtactgtagtcattggcaattgactcagatgttccaacgattctatcccggccaggccccatctttagctgaaaattttgccgagcatgtgctgcgcgccacaaaccaaatttcccccgctcaggtgcaggggtatttcatgctatataaaaatgaccccgttggcgccatccacaatgctgagagcttgaggcgctag

SEQ ID NO: 180496 - DNA, 1260 bp, Artificial Sequence
  Description of Artificial Sequence: Synthetic coding sequence
atgcccctgagcgacttcatcctggccctgaaggacaacccctactttggcgccggattcgggttggtgggagtggggaccgccctggctctcgcccggaagggcgtgcagctgggcctagtggcctttaggcggcattacatgatcacactcgaagtgccggctagggaccgttcttatgcatggctcctgtcttggctcactcgccatagtaccaggactcagcatctctctgtagagacgtcctatctgcagcatgaaagtggccgaatctctacaaaattcgaatttgtccccagccccggcaatcattttatttggtacagagggaagtggatcagggttgagcgaagtagagaaatgcagatgatagacctgcagacaggaacgccatgggaatctgtgacattcacagcgttaggtactgacagaaaagtattctttaatatcctggaggaagctcgcgagctcgccctccagcaggaggagggcaaaaccgtgatgtatacggcggtggggtccgaatggcgcccttttggataccccaggcgcagaaggcctctcaacagcgtggtgctccaacagggactggcggataggatcgtgcgggacgtccaggaattcatcgacaaccccaagtggtatactgacagggggattccgtacagacgaggctacctgttgtacggtcctccagggtgcgggaaatccagtttcatcaccgccctcgctggcgaactcgaacacagcatttgtctgctttctcttacagactcgagcttaagcgatgaccgcctgaatcatctcctcagtgtcgctccacaacagtcactggttctgctggaggacgtggatgcggccttcttgagtcgtgatctggccgtagaaaacccagtgaagtatcaggggttaggacgattaaccttctccggcctgctgaatgcactcgacggtgtggcctccactgaggcccggattgttttcatgaccacaaatcacgttgatcggctggatccagcactcatccggcccgggagagtagacctgaaagagtatgtgggttactgctcccattggcaactaacgcagatgttccagcggttttacccggggcaagcaccaagccttgccgagaattttgctgaacacgttctgcgcgctacgaaccagataagtccggcacaggtccaggggtactttatgctgtataagaatgatccagtgggagctatccacaatgctgaatccctgcggcggtag

SEQ ID NO: 180497 - DNA, 1260 bp, Artificial Sequence
  Description of Artificial Sequence: Synthetic coding sequence
atgcccctgagcgacttcatcctggccctgaaggacaacccctactttggcgccggctttggattagtcggggtaggcactgcgctggcgttggcccgcaagggcgtgcagctcggtctcgtcgcttttcgcaggcattacatgattacgttggaggtgcctgcccgcgacaggtcctatgcttggctgcttagctggttaactcggcacagcacccgaacacagcacctgtccgtcgagacatcttacttgcaacacgaatctggacgcatttcaacaaagtttgagtttgtgccctcccctggtaatcattttatctggtaccgcggtaagtggatccgcgttgagaggagtcgagagatgcaaatgatcgacctgcagaccggtacaccatgggagtcagttacttttacggctctcggcaccgatcgcaaggtgtttttcaacatcctggaagaggccagagagttagccctccagcaggaagagggcaagactgtaatgtacacggccgtagggagcgagtggcgtccctttggatatccacgaaggcgcagacccttgaactccgtggtgctgcagcaaggcctggcagaccgaatagtccgcgacgttcaagaattcattgacaaccccaagtggtacactgatcggggcattccatatagaaggggctatctgctgtacggccccccgggatgtggcaagagctccttcatcactgcattggctggtgagctagagcactccatttgtcttctcagcctgacagactccagcctttcagacgacagactaaaccacctcctgtccgtagcgcctcagcagtctttggttctcctggaagacgtggacgccgcgtttctatcacgtgacctggccgtcgaaaaccctgtcaaatatcaaggattgggcagactgaccttcagtggcttattaaacgctctggatggagtcgcctccacagaggccagaattgttttcatgactactaaccacgttgacaggctggaccccgctcttattaggccagggagggtggatttgaaagaatatgtgggatattgctcccattggcagctcactcagatgtttcaaaggttttacccagggcaggcccccagtttggctgagaactttgcagaacacgttcttcgcgctaccaaccagatctcgcccgcccaggtccaagggtatttcatgctctataaaaacgaccccgtaggggccatccacaacgcggagtccttgcgccgatag

SEQ ID NO: 180498 - DNA, 1260 bp, Artificial Sequence
  Description of Artificial Sequence: Synthetic coding sequence
atgcccctgagcgacttcatcctggccctgaaggacaacccctacttcggcgctggatttggccttgtcggggttggcacggccttggcattagcccgcaaaggcgtgcagctggggctggtggctttccgtcggcattatatgatcaccttggaagttcctgctcgagatcgctcctatgcttggctgctaagctggttgacgcggcactcaacccgtactcagcatttgtccgtggaaacttcttatctgcagcacgaatcagggcggattagcactaaatttgagttcgtccccagcccagggaaccactttatatggtaccggggtaagtggatcagggtcgaaaggtcacgggaaatgcagatgatcgatcttcagaccgggaccccctgggaaagtgttacttttacagctttgggaactgacaggaaggtcttctttaacatcctcgaagaggctcgggagttggctctgcagcaggaagaaggaaagactgtgatgtatacggccgttgggagtgagtggagaccattcggctatccaaggcggcgccgaccacttaacagcgtggttctgcagcaggggctcgctgaccgcatcgtgcgcgacgtccaagaattcattgataaccccaagtggtacacagatcggggcattccctaccgacgcggttacctcctttacggcccgccagggtgcggcaagtcaagcttcatcacagctttggctggagaattagagcactcaatttgtcttctttccctcactgactcaagtctgagcgatgatcggcttaatcatctcctgtctgtggctcctcagcagagtttggttctgttggaggacgttgatgccgcgtttctgagcagagatcttgctgtcgagaatcctgtcaaatatcagggcctaggaaggttgacttttagcggtctgttgaatgcccttgacggggttgcctccactgaagcgagaatcgtgttcatgactacaaatcacgtcgacaggctggaccccgctctcatcaggccaggccgggtcgaccttaaggagtatgtcggctactgttcacattggcagttgacccaaatgttccagcgcttctaccccgggcaagcaccgagcttagccgagaacttcgctgaacacgtcctgagggccacaaatcaaatcagcccggcacaggtgcagggctacttcatgctttataagaatgaccctgttggcgcaatccacaacgccgaatctttgcggagatag

SEQ ID NO: 180499 - DNA, 333 bp, Artificial Sequence
  Description of Artificial Sequence: Synthetic coding sequence
atgcccctgagcgacttcatcctggccctgaaggacaacccctacttcggagccggatttggcctagtgggggttggcacagcgcttgctctcgctcggaaaggagtccagttgggactggtcgcctttagacggcactacatgattacactcgaagtgcccgcacgcgatcgatcctatgcctggttactgagctggttaaccagacacagcacacgaacccaacacctgagtgtcgaaacatcctatctgcagcacgagagcggtcgcatttccaccaaattcgaatttgttccgagccccgggaatcatttcatatggtatcgtgggtag

SEQ ID NO: 180500 - DNA, 234 bp, Artificial Sequence
  Description of Artificial Sequence: Synthetic coding sequence
atgcccctgagcgacttcatcctggccctgaaggacaacccctacttcggtgccggcttcggcctcgtcggggtgggaacggccctagcactagctcggaagggcgttcaattgggactcgtggcattccgtcgacattatatgattacactcgaggtgccggcccgagaccggtcttacgcttggttattgtcttggttgaccagacactcaaccagaacccagcacctttag

SEQ ID NO: 180501 - DNA, 621 bp, Artificial Sequence
  Description of Artificial Sequence: Synthetic coding sequence
atgcccctgagcgacttcatcctggccctgaaggacaacccctactttggtgccggcttcggccttgtaggggtgggtaccgcactggcattagcccgaaaaggcgtgcagctgggcctcgtcgctttcaggaggcactacatgattaccctggaagtacccgcaagggaccggagttacgcttggcttctatcttggctcacaagacactctacccggacgcagcacctctctgtggaaacctcatatctgcagcacgaaagcggaaggatcagcactaaatttgaattcgtccccagtccaggtaatcacttcatctggtatagaggcaagtggatcagagtggagcggagccgggagatgcagatgatcgacttgcagaccggcactccatgggagtctgtgactttcacagccttgggaactgaccgcaaagtgtttttcaatatcctggaggaggccagagagttagctctgcagcaggaagaaggaaaaacggtcatgtacaccgccgtgggaagcgagtggaggccttttggctaccctcgccggaggcgccccctcaatagcgtcgtcctgcagcagggactggccgatcggatagttagggatgttcaatag

SEQ ID NO: 180502 - DNA, 1260 bp, Artificial Sequence
  Description of Artificial Sequence: Synthetic coding sequence
atgcccctgagcgacttcatcctggccctgaaggacaacccctactttggggcgggcttcggcctggtaggcgtggggactgctctggcactagctagaaagggtgtgcagcttggattagtggcctttagacgacactatatgatcaccctggaggtgccagcacgcgatcgatcttatgcttggctgctgtcctggctgacccgccatagtaccaggacacagcatttgagcgttgaaacctcatacctccagcatgagtcaggcaggatttcaactaaatttgaattcgtgccaagccccggtaatcattttatttggtacagggggaaatggattagggtggaacggagtcgggagatgcagatgatagatcttcagactggcacgccttgggagagtgttaccttcactgcactcggcacagatcggaaggttttcttcaatattctggaggaggcaagagagctggcactgcagcaggaagaggggaagactgtgatgtacacagccgtgggatccgaatggcggcccttcggttacccacggaggcggcgtccactcaattccgtggttcttcaacaagggctcgccgacagaatcgtcagggacgtgcaggagtttatcgataatccaaaatggtacaccgatcggggtatcccatacaggaggggttacctgctatatggaccaccggggtgcggcaaatcatcttttattactgctttggctggcgagctggagcacagcatctgcctgctctctcttacagattccagcttgtctgatgaccggctgaatcacctgctgtccgttgcaccacagcagtccttagtcctcctcgaagacgtggatgcggcgtttctgagccgcgacctggcggtggaaaatccggtgaagtatcaaggccttggaagattgaccttcagcgggctactcaatgcgttagatggggtcgccagcactgaagcaaggattgtgttcatgaccaccaaccatgttgatcgcttagaccctgccttgattcgccctggacgggtggaccttaaggagtatgtaggatattgcagtcattggcaactgacacagatgtttcaacgcttctaccccggacaagccccaagcctcgcagagaatttcgccgagcatgtactcagggccaccaaccagatttcaccggctcaagtgcagggatattttatgttgtacaaaaacgacccagtgggcgccatccacaacgcggagtctcttcgtcggtag

SEQ ID NO: 180503 - DNA, 1260 bp, Artificial Sequence
  Description of Artificial Sequence: Synthetic coding sequence
atgcccctgagcgacttcatcctggccctgaaggacaacccctacttcggtgcaggcttcggccttgtaggtgtcggtactgctttggcactggcaaggaagggagttcagctgggactggtggccttccgcagacactacatgatcactctagaggttcctgcccgtgaccggagttacgcctggttactctcttggctgacacgccactcaacccggacccagcatctaagtgtggagacttcttacctccagcacgagagcggacgtatttctacaaagtttgagttcgtgccatcgccggggaaccacttcatctggtaccggggcaagtggatcagggtcgaacggtcacgggagatgcagatgattgatcttcaaacaggaactccatgggaatcagttacatttactgctctgggtactgatcggaaagtgttctttaacatcctcgaagaagcgcgcgaactcgccttgcagcaggaggaaggcaagaccgtgatgtacaccgctgtgggaagcgaatggcggccattcggataccctagacgtaggaggcctctgaacagtgtggtcctgcagcagggcctagccgaccggatagtccgagacgttcaggaattcatagataacccaaaatggtacaccgatcggggaatcccatatcgcagaggctatttactgtatggacctcctggctgcggaaagagctccttcataacagcccttgccggggagctggagcactcgatttgcctcctgagccttactgattcttcactgagcgatgaccggctcaatcacctgctttcggtggccccacagcagtccctggtgcttcttgaggacgtagacgctgcatttttgagcagagacttggccgtggagaaccccgttaaatatcagggcttgggccggcttaccttcagtggattgctcaatgctttggacggcgtcgcctccaccgaagcaagaatagtgttcatgaccaccaaccatgtggatcgtcttgatcccgccttgattcgtcccggacgcgtcgacttaaaagaatatgtggggtactgctcacactggcagcttacccagatgttccagaggttctaccctggccaggctccgtctctggcagaaaactttgcagagcacgttctcagagccacgaaccaaattagtccagcacaggttcaggggtacttcatgctgtacaaaaacgatcctgtgggcgctatccataacgcggagtccctccggagatag

SEQ ID NO: 180504 - DNA, 621 bp, Artificial Sequence
  Description of Artificial Sequence: Synthetic coding sequence
atgcccctgagcgacttcatcctggccctgaaggacaacccctactttggcgcaggcttcggcttggtcggcgttggtactgcgctggcacttgccaggaaaggcgtccagctcggcctagtcgccttcagaagacattacatgattacccttgaagtgcccgcgcgcgatagatcgtacgcatggcttctaagctggctcacccgccacagcacaagaacccaacatctctcggttgagactagttaccttcaacatgagtcaggtcggatttccactaaattcgagttcgtgcccagtccaggaaaccatttcatatggtacagggggaagtggattcgagttgagcggagccgtgaaatgcagatgattgacttacagactggaacaccctgggagtcagttacattcacagcgctgggtactgaccgaaaagtattcttcaatattctcgaggaggctagggaactggcgctgcagcaggaagaaggcaagacagtgatgtacacagccgtgggctccgagtggagaccattcggctatcctagaaggcgaaggccacttaatagcgtcgtacttcagcaggggctggcagatcggatagttagggatgtccagtag

SEQ ID NO: 180505 - DNA, 1623 bp, Artificial Sequence
  Description of Artificial Sequence: Synthetic coding sequence
atgtacgagaacgagtgcgagtgccagctgctgctgaaggagatgctcgaaaggctgaataaggaggccgacgaggcgctactgcataacttaaggttgcagttggaagctcagtttctccaagacgatataagcgccgcgaaagacagacacaagaagaacctgcttgaagtccagacatacatcagtatcttgcaacaaattatccacacgacccccccagcctccatagtaacatccggcatgagagaagagaagctgttaacagaacgggaggtggccgctctgaggagccagttggaggaaggcagagaagtgctgtctcatctgcaggcgcaacgcgtcgaattgcaagcccaaactactactctagaacaggctatcaagtctgcacacgagtgttacgatgacgaaattcagctttacaacgaacagattgaaacccttagaaaggagatcgaagaaacagaaagggtgctggagaaaagctcatatgactgccggcagctggctgtagcgcaacaaacactcaagaatgaattggatagatatcatcgaattattgagattgaaggcaaccgactcacttccgcattcattgagacgcctatccccttatttacacagagccatggcgtctcgctctccactggcagcggaggcaaggatcttacccgggccttgcaagacatcacagcggccaagccgagacagaaagccctcccaaaaaatgtgccgcggaggaaagaaattatcactaaagataagacaaacggtgcacttgaagacgcccccctgaagggactggaggataccaaactggtgcaggtggtgcttaaggaagagtccgagtcaaagtttgagtcagaaagcaaagaagtaagtcctttgacccaggaaggagcccccgaagacgtacccgatggaggccagatttcgaaggggttcggcaagctctaccggaaagtgaaagagaaggtcaggtcccccaaggagcccgagactcccactgagctgtacaccaaggaacgccacgttctggttacgggtgacgcgaactacgtggacccaagattttacgtatcctccatcaccgcaaagggtggagtggccgtttcagtggcagaggactccgtgctttatgacggccaagtcgaaccaagtccggagtctccaaagccccctttggagaacggtcaagtgggcctccaggagaaggaagatggccaacctatagatcagcagcccattgacaaggaaatcgagcctgatggggcggagctggaaggacccgaggagaaacgcgagggggaggagcgggacgaagagagccgcaggccatgcgccatggtgacaccaggagctgaggaaccttcgattccagagccaccaaaacctgccgccgaccaggatggcgcagaagtattaggcaccaggtctaggtccctgccagagaaggggccgccaaaggccctagcctataagactgtggaggtggtcgaatctatagaaaagatcagcactgaatccattcaaacttatgaggagaccgccgtgatcgtggagactatgatcggaaaaactaagagtgacaaaaagaagagtggggagaagtcctcttag

SEQ ID NO: 180506 - DNA, 1998 bp, Artificial Sequence
  Description of Artificial Sequence: Synthetic coding sequence
atgtaccggcggagctacgtgttccagacccggaaggagcagtacgagcacgccgatgaggcaagtcgcgccgcggagcccgagagacccgcagatgaagggtgggcgggagctacctctctggcggcactgcaaggacttggggaacgggtggccgcccatgtgcaaagagctcgtgccctggaacaacgacatgccgggctgcgccgtcagctggatgcgtttcagcgactgggcgaactggcaggccccgaggacgccctcgccagacaggtcgaatcgaacaggcagcgcgtcagagatctcgaagctgagcgcgcccgcctggagcgtcaggggacagaagcccagagagctcttgacgagtttcggtctaagtatgaaaatgagtgtgaatgccagctcctcctgaaagagatgctcgaaagactcaacaaggaggccgacgaagctctacttcacaacctccgtctccagctggaagctcagttcctgcaggatgatatttctgccgccaaggatcggcataaaaaaaacttgctcgaagtgcaaacgtatatttcaattctgcaacagataattcacaccacaccccccgcctctattgttacgtccgggatgcgcgaagagaaactgctgaccgagagggaggtcgccgcactaagatcccagcttgaggagggccgcgaagtgctgtctcatttgcaggcccagagagttgaactccaggcacagacaacgaccctggagcaggctattaagtcagcacatgaatgttacgacgatgagattcaactctataacgagcagatcgaaaccctgcgcaaagagattgaggagaccgaacgcgtactcgagaaatctagctatgactgtaggcagctagctgttgctcagcagacattgaaaaacgagcttgaccgttatcatagaattatcgagattgagggtaaccggctcacgtccgctttcatcgaaacacccataccactgttcactcagtcgcacggcgttagcctttcaaccggcagcggtggtaaagacctcaccagggcattgcaggatataacagccgccaaacctcgacaaaaggctctgccaaagaacgtgcctcgccgcaaggagatcatcacgaaggataagaccaacggcgctctggaggatgcgcctctgaagggcctcgaggatacaaaattggtgcaagtcgttctgaaagaggaatctgagtcaaagttcgagtctgagagtaaagaggtatcacctttaacccaagagggtgctcctgaggacgtcccagacggaggccagatctccaagggatttggtaagttatataggaaggtgaaggaaaaagtaaggagtcctaaggagcccgagacacctacagaactctatactaaagaacgacatgtgcttgtgactggtgatgccaactacgtcgaccccaggttctacgtcagtagcatcactgctaaaggaggagtggctgtgtctgttgccgaggatagcgtcctttacgacggccaagtcgaaccctccccggagagcccaaagcctccgctggaaaatgggcaggtggggctgcaggagaaggaggacggacagcccatcgatcagcaacctattgacaaggagatcgagccagacggcgcggagctcgaaggccctgaggaaaaacgggagggggaggagcgtgatgaggagtcacgtcgaccctgcgccatggtaacgcctggtgctgaggagcccagcatacctgaacctccaaaacccgccgccgaccaggatggcgccgaagtcctgggcactagatccagaagtttgcccgagaagggcccacctaaagcactcgcatacaagacagtggaagttgtggagtctatcgagaaaatcagcacagagtctattcagacatacgaggagacagccgttatcgtcgaaaccatgatcggaaagacgaaaagcgacaaaaagaagagcggcgagaagtcttcgtag

SEQ ID NO: 180507 - DNA, 1581 bp, Artificial Sequence
  Description of Artificial Sequence: Synthetic coding sequence
atgctggagcggctgaacaaggaggccgacgaggccctgctgcacaatttgcggctccagctggaagctcagttcttgcaggatgatatatccgctgccaaggaccgccacaaaaagaacctgcttgaggtccagacctacatctcaatactccagcagattatccatactactccgcctgcttctattgtgactagtgggatgcgggaagaaaagctgctgaccgagagggaagtggctgctctgaggagtcaactcgaagaaggcagagaagttctgagtcatttgcaggcgcaacgggtcgagctacaagcccagaccaccacactggaacaagccattaagtctgcccacgagtgttatgatgacgaaattcaactttacaacgagcaaatcgagacattgcggaaagagatagaagaaaccgaacgggtcctagaaaagagctcctacgattgtagacagttggctgtggcccagcagacattaaagaacgaacttgaccgatatcaccggatcatcgaaattgagggcaaccgacttaccagcgcattcatcgagacacccatcccgctgttcacccaatcgcatggggtgtctctatcgacaggaagcggaggcaaggacttgacccgggctttgcaagacatcacggccgcaaagccacgacaaaaagccctgcctaagaatgtgcccaggcgaaaagagattatcaccaaagacaaaactaatggcgcgctggaagacgctcctctgaagggcctggaggacactaaactcgtgcaggttgtgcttaaagaggagagcgagtctaagttcgaatccgaaagcaaggaagtcagccctttaacgcaggagggtgcacccgaagatgttcccgatggcggccagatatccaaaggattcggcaagctatataggaaagtcaaggagaaagtcagatcccctaaagaaccggagaccccaactgaattgtacaccaaagaacggcatgtcctggtcactggagacgcgaactatgtggatccacggttttacgtatcaagcattacggccaagggtggggtggcggtatccgtggcagaagactcagtcttatatgatgggcaggttgaaccaagccctgaatcccccaagcccccgctggagaacggccaggtcggactccaggaaaaggaggacggacagcccattgatcagcagcccatcgacaaggagatcgaacctgacggtgccgagctcgagggacccgaagagaaaagggagggggaggaaagggacgaggaatcccgccgaccgtgcgccatggtaaccccaggggccgaggagcccagcatacctgagcctccaaagccggccgctgaccaagatggagcggaggtgctcggaactaggagcaggtctctgccggagaaggggcctccgaaagcgctagcttacaaaacggtagaagtcgtcgaaagcatcgaaaagatttccaccgagagcattcagacctacgaagagacagcggtgatcgtggagactatgattggcaaaacaaagagtgataagaaaaagtccggggaaaaatcttcgtag

SEQ ID NO: 180508 - DNA, 1581 bp, Artificial Sequence
  Description of Artificial Sequence: Synthetic coding sequence
atgctggagcggctgaacaaggaggccgacgaggccctgctgcacaatcttagattacagctggaagcgcagtttttgcaggacgatattagtgctgccaaggatagacacaagaagaatctgctggaggttcagacttatatcagtattctgcagcaaattatccataccacgcctcccgctagcatcgtcacctccggcatgagagaagaaaaactgttaacagagcgagaggttgccgcactgagatcacaactagaagaagggcgcgaggtcctgagccatctgcaagcacaacgggtcgagcttcaggctcaaactactacgttagaacaggccattaaatctgcgcacgagtgctacgacgacgagattcagctgtacaatgaacagatcgagacactgcggaaggagatagaggagaccgagcgcgtactcgaaaaatcaagttacgactgcaggcagctggcagtagctcaacagaccttaaagaacgagctggaccggtaccacagaattattgagattgagggaaatcgcctcacttccgcttttattgagactccaatccctctgtttactcagagccacggagtctctctttccactggcagtggggggaaggatttaaccagagcactccaagatataacagccgcgaagcccagacagaaggcactccccaaaaatgtaccccgccgtaaggagatcatcaccaaagacaagacaaacggcgctcttgaagatgcgcctctgaaaggtctggaggacactaagcttgtgcaagtcgttctgaaagaggagtccgagtccaagtttgagagcgaaagcaaggaggtttccccgctaacccaggaaggagcccccgaggacgttccagacggcggacagatttctaaagggtttggaaagttgtatcggaaggtcaaagagaaggttagaagccccaaggagcccgaaaccccgacagagctctatactaaagagcgacacgtactggtcacaggggacgccaactatgtcgacccacgcttctacgtgtccagcataaccgccaaaggaggagtcgcagtcagcgtggcagaggacagtgtactgtatgatggtcaggtggagccttcaccagaatctccaaagcctcctctcgaaaatggccaggtgggactccaggaaaaagaggatggccaaccaattgatcagcagcccatcgacaaagaaattgaacccgacggcgcagagttggaaggaccagaggagaagcgggagggcgaggaaagggatgaggagagccgcaggccatgtgcgatggtgactccaggcgctgaagagcctagtatacccgagcccccaaaacccgccgctgatcaagatggggccgaggtcttgggcacgcgaagtcgctcgttacctgaaaaagggcctccaaaggccctggcatacaagacagttgaagtcgtggagtctattgaaaaaatatctacggagagcattcaaacatacgaagagacagcagtgattgtagagactatgatcggcaaaactaagtctgacaaaaagaaaagcggcgaaaagtcaagctag

SEQ ID NO: 180509 - DNA, 1248 bp, Artificial Sequence
  Description of Artificial Sequence: Synthetic coding sequence
atgagcgagcggcgggtggtggtggacctgcccaccagcgccagctcctcaatgcctctccagaggcgaagggccagcttccgcggaccgaggtcatctagttccctcgaatctccacccgccagtaggacgaacgcaatgagcggactcgtccgggcgcctggagtttacgtggggaccgcccccagcgggtgtatcggcgggcttggggcgcgagtcacgcgccgcgccctcggaatctctagcgtatttctgcaaggtctcaggagttccggtctcgccacagtacccgcaccaggtctggagcgagaccacggagccgtagaggacttaggagggtgcctagtcgagtacatggccaaagtgcacgcgctggagcaggtgtctcaggagctggagactcagctcaggatgcatctggaatctaaagcaactcgaagcggtaactggggtgctctgagggccagttgggcctcttcttgtcagcaagtgggggaagccgtcctggaaaacgctcgactgatgttacagacggaaaccatccaggcgggcgccgacgacttcaaagaacgctatgaaaacgaacagccgttccggaaggcagcggaagaggaaatcaactcgctatataaagtgattgacgaagcgaatttaactaagatggacctcgaatcacagattgagagcctgaaggaagaactgggatcattgagcagaaactacgaggaagacgtcaaactgctgcacaagcagttagccggatgcgagctcgagcagatggacgccccaatcggaaccggcctggacgatatcctggaaactataagaatccaatgggagcgggacgtggaaaagaatcgcgttgaggccggcgcattgttgcaggctaaacagcaggccgaagttgctcacatgtctcagacccaggaggaaaaattggctgctgctctcagagtggagctacataacacctcttgccaggtgcagtccctacaagcggaaacagagagtctcagagccctgaagaggggccttgagaacaccctgcacgacgccaaacactggcatgatatggaactccaaaatctcggcgccgtggtcgggaggctcgaagctgaacttagggagattcgcgctgaggcggagcagcagcagcaggaacgggcccacctgctcgcccgcaaatgtcagctccagaaggacgttgcgtcttatcacgccctgcttgatcgggaggaatccggttag

SEQ ID NO: 180510 - DNA, 1353 bp, Artificial Sequence
  Description of Artificial Sequence: Synthetic coding sequence
atggagggcagcaagaccagcaacaacagcaccatgcaggtgagctttgtgtgtcagaggtgtagtcagccactcaaacttgatacgagctttaaaatactggacagagtcactattcaggaactgacagctccgctgctgaccaccgcacaagccaagcccggtgagacccaggaggaagaaacaaattcgggagaggagccttttatcgaaacgcccaggcaggacggagttagccggcgattcatccctcctgctcgcatgatgagcaccgagtccgcaaactctttcaccctcataggggaggcaagtgacggagggaccatggagaacctaagccggaggttgaaggtgactggtgacttgtttgatatcatgtccggtcagaccgacgtggaccaccctttgtgcgaggagtgcactgacacactcttggaccaactggacacgcagctgaacgtcactgaaaatgagtgccagaactacaaaaggtgccttgagattttggagcagatgaatgaagacgattccgagcaattgcagatggagctgaaggagctcgcactcgaagaggagcggctgatccaggagttggaggacgtggaaaagaatcgcaagatcgtcgccgaaaatctggaaaaggtgcaggcagaggcagagcggctggaccaggaggaagctcaatatcaacgcgaatatagtgaattcaagcgacagcagctggagctggatgatgaattaaagagcgtcgagaatcagatgcgctatgcccagactcaattagacaaactgaaaaagaccaacgtgttcaatgcaaccttccatatctggcactctgggcaatttgggaccattaataatttccgactcgggagacttccatctgtgcctgtggagtggaacgagattaacgctgcctggggccagacagtgcttctgctgcatgctcttgcaaataaaatggggcttaagttccagagatacaggctggtgccctatgggaatcattcatacttagagagtctaaccgacaagagcaaggagctgccactgtactgtagcggcgggttgcgctttttttgggacaataaattcgatcatgcaatggtggcctttctcgattgtgtgcagcagtttaaggaagaagtagagaagggcgaaacccgtttttgtctaccttaccgcatggatgtggagaagggaaaaatagaggatacagggggatccgggggatcttactctatcaagacccagttcaactcagaggagcagtggacaaaggctctcaagtttatgttgactaacttgaagtggggcctggcttgggtttctagccagttctataacaaatag

SEQ ID NO: 180511 - DNA, 840 bp, Artificial Sequence
  Description of Artificial Sequence: Synthetic coding sequence
atggagggcagcaagaccagcaacaacagcaccatgcaggtgagcttcgtgtgccagcgttgttcccagccactcaaactggataccagttttaaaatattagaccgggtaacaatccaggaactcaccgcgcccctcttgaccaccgcccaagctaagccaggagaaacccaggaggaagagaccaacagtggtgaggagcccttcattgagacaccccgccaagacggagtgtcccgacgattcattccacctgcccgccgatgcctcgagatattggagcagatgaacgaggacgactctgagcagcttcagatggagctcaaggagcttgccctggaggaagaacgcctgatccaggaattagaggatgtcgaaaaaaaccgtaagatcgtggccgaaaaccttgagaaggtgcaggcagaggctgaaagattggatcaggaagaggcccagtatcagagggagtattccgagtttaagagacagcagttggagttagatgacgagctcaaatccgtggaaaatcagatgcggtatgcccagacacagctcgacaagctcaagaagaccaatgtcttcaatgctacttttcacatctggcattccggccagttcggaactataaacaattttaggttgggcagacttccttctgtgcccgttgaatggaatgaaatcaatgccgcctggggacaaactgtgcttctgctgcatgctttagcaaacaaaatgggcctgaagttccaacggtacaggctcgtaccctatggaaatcactcttacttagagagcctgacagacaagagcaaggatgggtgtggcgagcgccaggactag

SEQ ID NO: 180512 - DNA, 1092 bp, Artificial Sequence
  Description of Artificial Sequence: Synthetic coding sequence
atgatgagcaccgagagcgccaacagcttcaccctgatcggcgaggccagtgacggcggtaccatggagaacctgtccaggcgcctgaaggttaccggggacctgtttgacattatgtctggacagacagatgtagatcacccactttgtgaagagtgtaccgacacgctgctcgatcagctcgatactcagctcaacgtgacggaaaacgagtgccagaattataagcgctgcctcgaaattttggagcagatgaacgaggacgacagcgagcagctacaaatggagctgaaggaactcgcccttgaagaagagcgcctgatccaggaactggaggatgtcgagaaaaatcgtaaaattgtggctgaaaacttagagaaggttcaggctgaagcagagaggctcgatcaagaagaagcccaatatcagagggaatactcagagtttaagcggcagcagctggaattggacgacgagctcaagtccgtagagaaccagatgcgctacgcgcagacacagttagataaactcaaaaagacaaacgtgtttaatgctacattccacatctggcatagtggacaatttggaaccatcaataatttcagactaggccggttgccctctgttcccgtcgagtggaatgagatcaatgccgcctggggccagactgtccttttactgcacgctctagcaaataagatgggcctgaaatttcagcgctaccgtctcgtgccttatggaaaccacagctacctggagtctcttaccgacaagtcaaaagagctgcctctatactgctccggggggcttcggtttttttgggacaataaatttgatcatgccatggtcgccttcctggattgcgtgcagcagttcaaggaagaggtagaaaaaggcgaaacccggttttgtctcccctaccggatggacgtggaaaagggtaagatagaagacacgggcggttccggtgggagctactcaattaaaacccagtttaattccgaagaacagtggactaaggctcttaaattcatgctgaccaacttgaagtggggtcttgcatgggtctccagccaattctacaacaagtag

SEQ ID NO: 180513 - DNA, 5394 bp, Artificial Sequence
  Description of Artificial Sequence: Synthetic coding sequence
atggagcagctgaccaccctgccccggcccggcgaccccggcgccatggaaccttgggccctgccaacttggcactcttggactcctggcaggggtggcgaacccagcagcgccgcccctagcattgctgacaccccccccgctgctctgcagctgcaagagcttaggagtgaggaatctagcaagccaaagggggacggatcctcacgacccgtcggcggcactgacccagagggtgcagaagcttgtctgccttcgcttggccagcaggcgtcatccagtgggcctgcttgccagcgccctgaggatgaggaagtcgaagcctttctcaaagcaaagttaaatatgtcattcggggatcgacctaatctcgagttactgcgagccctgggagaactgcggcagcgctgcgccatcctgaaggaggagaatcagatgttgcgcaaatctagttttccagaaaccgaggagaaggtccggagattgaaaaggaaaaacgcggaattggctgtgatcgcaaagcggttggaagagcgtgcgcggaagctgcaagagactaacctgcgagtcgaagggccacagtggctgcacgttagagacttcgaccgactgctgagagagtctcagcgggaggtgctcaggctgcagaggcagatagctcttaggaaccagcgcgaaacactccctcttcccccctcctggccccctggtcctgcgctgcaagcgcgcgctggcgcacctgccccaggggcgccaggggaagcaaccccccaggaggatgccgacaatctgcccgttattctgggcgaaccggagaaggaacagcgcgtccagcaactcgagagcgaattgtcgaaaaagaggaagaagtgcgagtctctagaacaggaggcccggaaaaaacaacggagatgcgaggagctggagctccagctgcgccaggcccagaacgagaacgctaggctggtggaagagaactccaggcttagtggtagggctactgagaaagaacaggtagaatgggagaacgcggaactcaggggacagctgctgggcgttacacaggagagggacagcgctctccgcaagagtcaggggctccagagcaaactggagagtctggagcaggtcctgaagcacatgcgcgaagtggcacagagacgccagcagctggaagtggagcacgaacaggcccggctctctctgcgtgaaaaacaggaagaagtcaggcggctgcagcaggcccaagctgaggctcagcgggagcacgaaggtgcagttcagctgctcgaatctacactggatagcatgcaggcacgggtgagagagctggaggagcaatgtagatcccagacggaacagttctccctgctggcacaagagctgcaagcctttcgccttcaccccgggccgctggatttactgaccagcgcactagattgcggctctctcggagactgtccacctcccccttgctgctgcagtattccccagccgtgtagaggtagcggccccaaagatctcgacctccccccggggagtcctggccgctgcacgcccaagtcctccgagcctgctcctgccaccctaactggcgtaccccgccgtaccgcgaaaaaagctgagtcgctgtctaactcctcccattccgagtccatccacaatagtcctaagtcttgtccgacgcctgaggttgacacagcaagcgaagtggaggagcttgaagctgacagcgtgtccctgctgcctgccgctccggagggttctaggggtggtgccagaatccaagttttcctagcgcggtactcatacaatcccttcgaaggccccaacgagaacccggaggcagagctccctctgaccgcgggtgaatatatatacatctatggaaatatggacgaggacggcttctttgaaggtgaactgatggatggccgccgcggactggtgccatctaactttgtagagagagtttccgacgatgacctcttgactagtctgcctcctgaattggccgacttgagccacagctctggacctgagctaagtttccttagtgtcggcggcggaggctcgagttctgggggacagtcttccgtgggcaggtctcagccccgacctgaagaggaggacgccggggacgagctttccctcagcccctctccggaaggcctcggcgaaccaccggcagtgccctatccgcgcaggttggtggtactaaaacagcttgcacatagcgtcgttcttgcgtgggaacctccacctgaacaggtggagctgcacggtttccacatctgtgtgaatggagagctccgccaggccctcggtcctggcgcacctccaaaagcagtactggaaaatctcgatctgtgggccgggccgctgcacatctctgtccaagccttaacttcaagaggcagttccgatcccctgcggtgctgcctggccgttggagcacgggcaggggtcgtgccttcacaactccgggtccacaggctgacagctacctctgcagagatcacctgggtgcccggaaacagtaatctggcccacgccatttatttgaacggggaagaatgtccccccgcctcgccgagcacttattgggcgaccttttgccacctccgacctggcactccttaccaagctcaggtcgaagcccagctgccaccccaaggaccctgggagcctggatgggagcgcctggaacagcgggcagctacactgcagttcacgactttgccggccgggcctccggacgcaccactggacgtgcaaatagagccaggcccatcccccggaatcctgatcataagctggcttccagtgacaatagacgcggcaggtacctcaaatggagtgcgagtcaccggatacgctatctatgctgacggacaaaagatcatggaggttgctagcccaactgccggatccgtgctggttgaactgtcccaacttcagctgttgcaggtttgccgggaggtggtggtgagaactatgtcgccacacggcgagtctgcagattccattccagcccccatcaccccagcactggccccagcctctctccccgccagagtatcctgtccgtctccccacccctctcctgaagctagggcgcccctggctagcgcatcccctggtcctggcgatccctcatcacctctccagcatccggctcctttgggaacccaggaacctccgggagccccccctgcatctcccagccgggaaatggccaaaggtagtcacgaagacccccctgcaccttgctctcaggaagaggcaggggcagccgtcctgggaacctctgaagagcgtactgcctctaccagtaccttgggcgagaaagatccaggacctgccgcacccagcctggcaaagcaggaggccgaatggacagccggagaagcttgtcccgcctcctcctctacacagggggcgcgggctcagcaggctccaaacaccgaaatgtgtcaggggggtgaccctgggtctggcctgaggcccagggcggagaaggaggacactgcagagctgggcgtgcatctggtcaattccctggtggaccacggccggaactctgacttgtctgatatccaggaggaagaagaggaagaagaggaggaggaggaggaggagttaggcagtaggacttgttcattccagaagcaggtggctggaaattctatcagagaaaacggagcaaagtcccaacccgatcctttttgtgagaccgacagcgacgaagagatcttagagcaaatcttggaactgcccctgcagcagttttgtagcaagaaactcttcagcatcccagaggaagaagaggaagaggaagaggacgaggaggaagaaaagtcaggagctggctgtagttctcgggatccaggcccccctgagcctgccctgctcggactggggtgcgatagcgggcagccgcgtcgccccgggcagtgtccactctcccctgagagctctagagcaggggactgcctggaggatatgcctggcctggtgggcggaagctctcgcaggagaggcggagggagcccagaaaaaccccccagtcgtcgtcggcctcccgaccctcgggagcactgctcgcgcctgctatctaacaatggcccgcaagcctccggtagactcggcccaacccgcgagagaggaggccttccggtgatcgaaggcccccgcaccgggctagaggctagcgggcggggacggcttgggcctagcagaaggtgcagtaggggaagggctctggaaccaggtctcgccagctgcctgtctccgaagtgtctcgagataagcatcgagtacgattccgaagacgagcaggaagccggatctgggggcattagtatcacgagcagctgttaccctggcgacggggaagcctggggcaccgccacggttggaaggccaagaggaccccctaaagcaaattccggcccaaagccttacccaaggctgccggcttgggaaaagggggagccagagcgcagaggaagaagtgctactgggagagcgaaagagcctctgtccagagctactgagaccggagaggcgcgagggcaggatggtagtggaagaagggggcctcagaagaggggtgtgcgtgtgctccggcccagcactgcagagctagtgcctgcgaggagtccaagcgagaccctcgcatatcagcacctgcccgttcgcatcttcgtggctttattcgactacgaccctgtcagcatgagtcccaatccggacgcaggcgaggaggaactccccttcagggagggacagatcttgaaggtttttggcgacaaggacgccgatggattttaccagggcgaaggaggtgggaggaccggctacataccttgcaatatggtggctgaggtagctgtggacagccctgcggggcggcagcagctgctgcagcggggctatctgagtcccgatatcctgctggagggcagtggaaatggcccattcgtgtacagcacagcgcacaccactggaccaccccctaaacctcggcgctccaaaaaggcagaaagcgaaggaccggctcagccttgtcccggccctcctaagctggtcccatcagcagacctgaaggccccccattcaatggtcgctgcattcgactacaatccgcaggaatccagccccaatatggacgtcgaggcagaactgccattccgtgccggggacgtcataactgtcttcggcggaatggacgatgacgggttttactatggggaactgaacggacagcgtggcctggtcccatctaactttttagaaggacccggtcctgaggctggcggtctagaccgcgagcctcggaccccacaggctgaatctcagcggacccgtcgacgccgtgtccagtgctag

SEQ ID NO: 180514 - DNA, 5574 bp, Artificial Sequence
  Description of Artificial Sequence: Synthetic coding sequence
atggagcagctgaccaccctgccccggcccggcgaccccggcgccatggagccctgggccctgccaacctggcacagttggactcccggccgaggtggggagccatctagcgcagccccgagtatcgcggatacccctcccgcggcattacagcttcaggagctaagatcggaggagagttctaagccgaagggagatggtagctctcgcccagtgggcgggacagacccggagggcgccgaggcttgcctgccctccctgggacagcaagcttcgtcctcaggacccgcctgccagaggcctgaagacgaagaagtggaggcctttctgaaggcaaagctgaacatgagcttcggggatagacccaacctcgagcttcttcgggccttgggcgagctgcgccagcgctgcgctatcctgaaagaggaaaatcaaatgttgcggaaatcgtctttccctgaaaccgaagagaaggttagaagactcaaacgcaagaacgcggagctcgctgttatcgcgaagcggctcgaagaaagggcacgcaagctgcaagaaactaaccttcgggtagtcagcgcacccctgcctaggcccggaacctctcttgaactgtgcaggaaagccttggccaggcagagggcccgggatctttccgagaccgcatctgcattactcgccaaagataagcagatcgccgctttacagcgagagtgccgcgagctccaggcacggctaacccttgttggcaaagagggccctcagtggctgcacgtgagagacttcgacagattactcagggaatcacaacgggaagttctgcgactgcagagacagatagcgctcagaaatcaacgcgaaaccctgcccctgccaccttcatggccccccggccctgcattgcaggcacgtgctggcgcaccggccccaggcgcaccaggggaggctacgcctcaggaagatgctgataacttgcctgttattctcggcgagccagaaaaagagcagcgagtacagcaactagaaagtgagctgtccaaaaagcgaaagaagtgcgagtccctcgagcaggaggctcgcaagaagcaaagacgatgcgaggagcttgagttgcaattgagacaggcacagaatgaaaatgctcgcctcgtcgaggaaaactcgagacttagcggcagggcaacagagaaggagcaggtagagtgggaaaacgccgagctcaggggacagcttttaggcgttacccaggagagagactcagctctacgtaaatcacagggacttcagtctaaactggaatcattggagcaagtattaaaacatatgagagaagttgcccagaggcggcagcagctggaggtggagcatgagcaagcccggctttccctgcgggagaaacaggaggaagtgagaaggctgcagcaggcccaggccgaagcccaacgagagcacgagggcgccgtgcaactacttgaatcgacccttgatagcatgcaggctagggtgcgtgagctggaggaacagtgcaggtcccagacggaacagtttagcctgctggcacaagaattgcaggcatttagactgcaccctgggcctctagaccttttaacaagcgcgttggattgtggaagtttgggagattgccctccaccaccatgctgttgctccatcccccagccctgcagaggttcaggaccgaaggacttggacctaccccctgggtctcccgggagatgcacacccaagagcagtgagcccgcccccgccaccctgaccggggtaccacgccggactgcaaagaaggctgagtcattgtccaatagtagccactcagagagtatccataactcacccaagtcatgtcccactcctgaggtggataccgcaagcgaagtggaggagctcgaagcagattcagttagccttctccccgcagctccagaaggcagcagagggggagcccgcatccaggtgttcttggctcggtacagctacaatccttttgagggacccaatgaaaatcccgaggcggaactgccactgaccgcaggtgagtacatctacatatatgggaatatggatgaagatggctttttcgagggcgagcttatggacggcaggaggggcctggtgccttccaacttcgtcgagcgggtctctgacgacgacctgcttaccagtctgccgcccgaactagcggatttatcacactcttccggccctgagcttagctttctgtctgtgggaggcggagggtcttcctccgggggtcagagttcagtgggtaggagtcagccccgaccagaagaagaagacgcaggagatgagctctcccttagtcccagccctgaggggctgggtgagccacctgcagttccctatccccggcgtctggtggtgctcaaacagcttgctcacagtgtggtactcgcttgggaacccccgcccgagcaagttgaattacacggcttccacatctgcgtgaacggcgagttgcgccaagcacttggtcccggcgcccctccaaaagccgtgttagagaatctagatctgtgggccgggcccctgcatatctcagttcaggctctaaccagtcggggtagctctgatcctctgaggtgttgcctggccgtaggcgctagagctggcgttgtaccaagccaactgcgtgttcatcgcctaaccgctacaagcgcggaaatcacttgggttcctgggaactctaatcttgcgcatgctatttaccttaatggcgaagaatgccctccggcatcgccttccacctattgggccaccttctgtcatctgaggcccggcaccccataccaggctcaagtggaagcacagctgcctccacagggcccatgggaacccgggtgggaacgattggaacagagggccgccacccttcagttcacaaccctcccagcgggcccacccgacgctccactcgatgtccagatcgagcccggcccctcccctgggattctgatcatttcatggctgccagtaactattgatgccgccggaacgagtaatggcgttcgcgtgaccggatacgccatctacgcagacggacagaagatcatggaggtcgctagccccactgccggatcagtccttgtcgaattaagccagttgcagcttttgcaggtgtgccgggaggtggtggtcagaacaatgtcccctcacggagagtccgccgactctattcctgcacccattacaccggccctcgcccccgcgtctctcccagcgagagtttcttgccccagcccccacccatcaccagaagcccgagctccactcgctagcgcctctccgggccctggtgacccttcatcaccacttcagcacccggccccactaggcacccaggagccgcccggagctccgccagccagtcctagtcgggagatggccaagggtagccatgaggacccacccgccccctgctcccaggaggaagcgggcgctgccgtactgggcacaagcgaggagaggactgcaagcacttccactctcggtgagaaggaccctggacctgccgccccttcactggcaaagcaggaggccgagtggacagccggtgaggcctgtccggccagctcctccacccagggagctcgagctcagcaggctccaaatacagaaatgtgccagggcggagacccagggagtgggttgagacctcgcgcagaaaaggaagacaccgctgagctgggggtgcatcttgtcaatagtctggtggatcatgggcggaattccgatctatctgacatccaagaggaggaggaagaagaggaagaggaggaagaggaagaactgggaagccgcacctgttcattccagaagcaagttgctggcaattccattagagaaaacggagccaagagccagccggacccattctgcgaaaccgatagcgatgaggaaatacttgaacagattctggagctgcccttgcagcaattttgctccaagaagttgtttagtattcccgaggaagaggaagaggaagaggaggatgaagaggaagagaaaagtggcgctggatgttcttcccgtgacccgggcccacccgaaccagcactgctgggcctcggctgcgactcagggcagccacggagaccaggacaatgtcctttaagccctgagtcgagccgcgccggcgactgccttgaagatatgccaggactggtcggcgggtcttctcggaggcggggaggcggtagtccagagaagcccccaagcagaaggcgcccacctgatcccagggaacactgctccaggcttctatcgaacaatggaccccaagcttcgggccgacttgggccgacccgggagcgcggtggcctgcccgttatcgagggcccccggacggggctggaggcatcgggccgtgggcggctgggccccagtaggaggtgctcccggggccgggcccttgaacccgggctggcaagttgcctgagccccaaatgcctcgagatcagcatcgaatatgactccgaggatgagcaggaggcgggttccggcggcatcagcatcacaagttcttgttatcccggtgatggtgaggcttggggcactgcgacagtcgggcggcccaggggtcctcctaaagctaattccggacctaagccctatccacgacttcctgcttgggagaagggcgaaccagagaggcgcggacggtcagccacaggccgtgccaaggaacccctatcccgcgctaccgaaactggtgaggccaggggacaagacggctcaggccggagaggcccgcagaagcggggcgtccgagtgttgaggccttctaccgctgagctggtacctgcgcgatccccatccgaaacgctcgcttatcagcatctccctgtgcggatctttgtggcactgtttgactatgatcccgtgagcatgagcccaaacccggatgccggcgaggaggagctgccctttcgtgaagggcagattttaaaggtcttcggggataaagatgcagatggtttttatcaaggagagggcggcggccgaaccgggtatattccatgtaacatggttgcagaggtcgcggtggattcccccgccggccgacagcagcttctccagagggggtatctgtcacccgatatactcttggaaggcagtgggaatggccccttcgtgtattccacagcacatacaactggccccccacccaagccaagacggagcaagaaggctgagagtgagggccccgcacagccctgccccgggccacctaagctggtacccagtgccgatctaaaagccccacatagcatggtggcagcattcgattataacccacaggaatcgtctccaaacatggatgtggaagctgaactaccttttcgagcaggagatgtcatcacagtattcgggggtatggatgatgatggtttttattatggtgaactcaacggtcagcggggcctcgtgccaagcaactttctcgagggccccggtcctgaggctgggggattagatcgcgaacccaggaccccccaggccgagtctcagcgcactaggcgccgtagggtgcagtgctag

SEQ ID NO: 180515 - DNA, 5724 bp, Artificial Sequence
  Description of Artificial Sequence: Synthetic coding sequence
atggagcagctgaccaccctgccccggcccggcgaccccggcgccatggagccctgggcccttcctacctggcattcatggactcctggcagagggggcgaaccatcgtcagccgcaccgagcatcgcagacacaccacccgctgctttacaactgcaggagctcagatctgaagaaagctctaagccaaagggggatggctccagcagacctgtaggtgggaccgacccggaaggtgcagaggcatgtctgccttccttggggcagcaggcttcatcctcagggcctgcctgtcagcgcccggaggacgaagaggttgaggctttcctgaaagcgaagctgaatatgtcgtttggtgaccgcccgaacctggagctcctgagagcgctgggggaactgcgccagcggtgcgccattctgaaagaggagaatcagatgctgcgcaaaagctccttcccagagacagaggagaaagtccggcgcttaaagagaaaaaacgcagagctggccgtaattgccaaacggttagaagagagagctcgcaagctacaggagaccaacttgagggtggtgtcggccccacttcctcgtcccggcacttcgctggagttgtgtcgtaaagctcttgcccggcagcgggcacgagacctgagcgagactgcatcagccctactggcgaaagacaagcagatcgcagcactgcagcgcgaatgtcgcgagttgcaggctcggttgactcttgtgggcaaagaaggcccccaatggctgcacgttcgggacttcgatcgattattgcgcgaatcccaacgggaagttctcaggctgcagcggcagatcgccctgcgcaatcaaagagaaactttgcctctgcccccaagttggcctccgggcccagcactgcaggcacgggctggcgcacctgcacctggagctccaggggaagcaactccacaggaggacgctgacaatttaccggttatattgggagaacctgaaaaggaacaacgtgtacagcagctcgaatcagagttaagcaagaagaggaagaagtgcgaatcgctggagcaggaggccaggaaaaagcagcgtcggtgcgaggaactcgagctgcaactacggcaggcgcaaaacgaaaatgccaggctggtggaggagaactcacggctttcgggacgggctacagagaaggagcaggtggaatgggagaatgcggaacttcgcggtcagcttctgggtgttacccaggagcgggattctgctctcagaaaatctcaggggctgcagtcaaagctggagtctcttgagcaagtactcaagcacatgagggaggttgctcagaggcgccagcagcttgaggtagagcacgaacaggcacggctgtccttgagggagaagcaggaggaagtgaggcggctacagcaagcccaagcggaggcccagcgggagcacgaaggggctgtccagctcctcgagtccacccttgacagcatgcaggcacgtgtcagagaattagaggagcaatgccggtcacaaactgaacagttttctctgttggcccaggagctgcaggccttccggctccacccagggccgcttgatctactgactagtgcactggactgcggctctctgggcgattgcccccctcctccgtgctgttgctctattccacagccttgtagggggtccggcccaaaagatcttgaccttccacctgggtctcctggccgatgtacccctaaatccagtgagccagcgcccgccaccctgacaggtgtgcctcgccgaactgcaaagaaagctgagtctctatctaactcgtctcactctgagtcaatccacaactctccgaagtcctgtcctactcctgaggtcgacacagcgtccgaggtggaggagctggaggcggacagtgtctctttgttgccagccgctccagaaggatccagggggggcgcaagaatacaggtgttcctggcaaggtactcatacaacccgtttgaggggccaaacgaaaaccccgaagcggagcttcccctgactgctggagaatatatttacatttatggcaacatggacgaggatgggttctttgagggtgaacttatggacgggcggaggggtctggtgccctccaacttcgttgagcgggttagcgacgacgacctgctgacttcccttcccccagaactggccgacctgagccacagctccggccctgaactttcatttctttcggtcggtggtgggggaagcagttcaggaggacagagtagcgttgggagatcgcaaccccggcctgaagaggaggacgcaggtgacgagctgagcctttcaccatcgcctgagggcctcggcgaacctcccgccgtgccctatccccgccgactagtcgtgctgaagcagcttgctcacagtgtagtgctggcttgggagcctcctccagaacaagtcgagcttcatggatttcatatctgcgtcaatggagagttgcgccaggcattaggcccgggggccccccccaaagccgtgctggagaatctggacctgtgggccggcccgctgcatatttctgtacaggccctcacgtcccgaggttcttccgaccccttgcgctgctgcctcgctgtaggcgcccgtgcaggagtggtgccttctcagctccgcgtgcacagattgaccgctacctcggctgagattacctgggtgccagggaactcaaacctcgcacatgccatttatctaaacggcgaagagtgtccacccgcctccccctccacatactgggctactttttgccatttgcgacctggtactccttaccaggcgcaggtagaggcccagttgcctccacaggggccatgggagcccggttgggagcggctggagcagagagcggcaacccttcagtttacaaccctcccagccgggcccccagacgcaccactagacgtgcagattgagcctgggccaagccccggaatcctgattatctcttggttgccggtgacaattgacgccgccggcactagcaatggcgtacgggttactgggtatgctatttacgcggacggacagaagattatggaagttgcttcacccactgccggaagtgttcttgtggagctgagtcaattgcagctccttcaggtgtgcagagaggtcgtcgtccgcacaatgagtccacacggggaatctgcagattcgattccggccccgatcacgcctgctctggcccctgcaagtctgccagctagagtgtcatgtccttcccctcacccatccccagaggccagagcccctctcgctagcgcgagtccgggacctggtgatccttcttctccgcttcagcatcctgcccctttggggacacaggagccgcctggcgccccacctgcctcgccttcccgggaaatggccaagggctcccacgaggacccccccgcaccttgttcccaggaggaagcaggagccgctgtgttggggacttccgaagagcgtacggccagcacttctacactaggcgagaaggaccctggtcctgcagccccttcgcttgctaaacaggaagccgaatggaccgctggggaagcatgcccagctagctcctctacacagggggcccgggcgcaacaggcccctaacactgaaatgtgtcagggcggcgatccaggctcaggcttgagacctagggctgaaaaagaggacacagccgagctgggagtacatctggttaatagcctggtcgaccacggacggaatagcgatcttagtgatatccaggaggaggaggaagaagaggaggaggaggaggaagaggagttgggatcccggacctgtagctttcagaaacaggtcgctggcaactcaatacgtgaaaacggtgccaagtcacaaccggatcccttttgcgagacggatagcgacgaggagattctggagcagattcttgaattgcctctacagcagttctgttctaaaaaactattcagtattcccgaagaagaggaggaggaggaagaggacgaagaagaagagaaatctggagcaggttgcagctcccgcgaccctggtccccccgagcctgccttgctcggactcggctgcgattcgggtcagcctcgcaggcccggtcagtgtccactttcaccggagagctccagagccggtgactgtctggaagacatgccgggtttagtggggggatcttctcgcagaagaggcggaggtagccctgagaaacccccatcacgcaggcgtccccctgaccctcgggagcactgttcacggctcttaagcaacaatgggccccaagcctccggacggttaggccccacgagggagaggggaggactgccagtgatcgaagggccacgaacaggccttgaggcctcaggtcgaggccggctgggacctagcaggcgatgcagcagaggcagagccctggagccaggacttgcttcctgtctgagccctaaatgcttagaaatttctattgaatacgattcagaggatgagcaggaggcaggttcaggggggatctccataacatcttcttgctacccaggtgacggcgaggcttggggcaccgctacggtgggccgtcctcgaggacctcccaaggccaacagtggccctaagccttacccccgcttgcctgcatgggagaagggcgaaccggagcggcgcggccgatccgctaccggtagggcaaaagagcccctctcccgcgccactgagacaggggaggctcgtggtcaggatgggtcaggccggcgagggcctcagaagcgcggagtcagagtgctaaggccctccactgccgagctggtgccagctagatccccctcggaaacgctggcctaccagcatctgcctgtccgcatttttgtggccttattcgactacgatccagtttccatgtctccaaatcctgatgccggtgaggaagaattaccattccgtgaagggcaaattctgaaggtatttggggataaagatgcagacggcttctaccagggagaaggcggcggacggacaggatatataccttgcaacatggtcgctgaggtcgccgtggacagtccagcgggcaggcagcagctcctgcagaggggctacttgtcacccgatatccttctggaagggtcaggtaacggcccttttgtgtactccacagctcatactaccggacctccacccaaacctagacgtagcaaaaaagccgagtccgagggtcccgcacaaccttgccctggaccccctaagctggtcccctctgctgatcttaaagcccctcatagcatggttgcggcatttgattataatccccaggaatcttcccccaatatggatgtggaggctgagttgccctttcgggctggcgatgtcatcacggtttttggaggtatggatgatgacggattctactacggcgagctcaatggccagagggggctagtaccctctaacttcctcgaggggcccggtcctgaagcgggaggactggaccgagagcccagaaccccacaggcggaatctcaggactggggatgtacaacacagggttctcccggcccaccaggtgggccatgtaccccatcaagtgggagtgcgccacgaattgagcgcggggagccccaggggcgcagtgaaaaagtgtgggggttcttctcaaaaggaaagcaacttttacggcgcctcgggtccggtaagaaagagtag

SEQ ID NO: 180516 - DNA, 864 bp, Artificial Sequence
  Description of Artificial Sequence: Synthetic coding sequence
atggtgaacgacccccccgtgcccgccctgctgtgggcccaggaggtcggccaggtgctggccggccgcgcacgccgacttctcctgcaattcggggtgctattctgtacaattttgcttctgctttgggtgtcagtattcctttacggctctttttactactcttatatgcctactgtctctcatttgtctccagtgcatttttattatagaaccgactgcgatagttccacaacctctctttgctcattccccgtcgctaatgtgtcactgaccaagggggggagagatagggtcctaatgtacggccagccataccgagtcacactcgaactggagttgccagagagtccggtgaaccaagatcttggcatgttcctggtgactattagctgttatactcgcggtggaaggattatctctaccagctctagatctgtcatgttgcactataggtcagatctactccagatgctcgataccttggtattttcctccctgctgttgtttggctttgccgagcaaaaacagctgctggaggtagagctgtatgctgactaccgggaaaattcatacgttccaacaacaggtgctattatcgagatccattccaaaagaattcagctttatggtgcgtatttgcggatccacgcccattttactggcctgcgactgacatcagagaaggaaacaatcccaggccgcaaatccaacgaggggtctttgctgatctctcagggtttaaaagccagacgctctcaacttcggaaccagatgctacagagaatggtgagagccctgaaaattcctcagggacagcgcgtcagctgtccaagaagaaggaatcaaatttcatccccatag

SEQ ID NO: 180517 - DNA, 1389 bp, Artificial Sequence
  Description of Artificial Sequence: Synthetic coding sequence
atgagcaccgagaaggtggaccagaaggaggaggccggcgagaaggaagtctgtggagatcagattaagggacccgacaaagaggaagagcctccagccgccgcctcccacggccagggatggcggcccggcggccgggccgcaagaaacgcccgaccagagcccggggctcgccacccagccctccccgccatggtgaacgaccctcctgttcccgccctgctttgggctcaggaggtcgggcaggttctggcaggaagagccaggcggctgttattacagttcggtgtgctcttttgtaccatcttactcttgttgtgggtttccgtttttctttacggatccttttactattcatatatgcccaccgtatctcacctttctcccgttcatttctactaccgaactgattgtgattctagtacgacgagcttgtgcagttttccggtagcgaacgtaagcttgaccaaaggcgggagggaccgggtactgatgtacggacagccttatcgcgtcacactcgagctcgagctccccgagtcccctgtgaatcaagacctgggaatgtttctagtcaccatttcctgctacacgcgcgggggccgaataattagtacctcatcaaggtcagtcatgctgcactataggtccgacctattgcagatgctggacacacttgtgtttagcagtcttttgctgttcgggtttgccgaacagaaacaactcctggaggtcgagctctacgctgactaccgggaaaacagctacgtccctaccaccggggccataatcgagattcacagcaaacgtatccagctgtatggggcttacctgaggatccatgctcacttcaccggtctgcgttatctgttgtacaacttccctatgacatgcgcctttatcggggtggcaagtaactttacctttttgtctgtgattgtcttgtttagctatatgcagtgggtgtggggtgggatctggcctaggcatcggttctcactccaggtcaacattagaaaacgcgataattcccgaaaagaagtccagagaaggatctccgctcatcagccgggtcccgaaggccaggaagaaagcacccctcagtcagacgtcacagaggacggggaatcaccagaagacccctccggaaccgaggggcagctctccgaagaagagaaacccgaccagcagccgctttctggagaagaagagctcgaaccagaggcctcagacggctccggcagttgggaagacgctgctcttcttacggaagccaaccttcctgcccccgccccagcttccgctagtgcacctgtgctggagactttgggctcttctgaaccagcaggaggggccttgaggcaacgacccacttgctcctcctcctag

SEQ ID NO: 180518 - DNA, 1197 bp, Artificial Sequence
  Description of Artificial Sequence: Synthetic coding sequence
atggtgaacgacccccccgtgcccgccctgctgtgggcccaggaggtcggacaggtattagcaggaagggccagacggttgctgctccagtttggagtcctgttttgcacaatcctactcctattatgggtgagtgtgtttctctatggcagcttctactactcctatatgccaacggtctctcatcttagcccagtgcacttctattaccgcactgattgtgacagctctaccaccagtttgtgttcattccccgtggctaacgtctccctcactaagggcgggagggacagagtgctgatgtatggacagccttatagagtgaccctggaattggagctgcccgagtcaccagtcaaccaggacctgggcatgttccttgttaccattagttgctatacgcgtggaggaaggatcatctccacttcctcaaggtccgtgatgctgcactataggtccgacctgctacagatgttggataccctggtgttttccagtctactgctgtttggattcgcagaacagaaacagctcctcgaagttgaactgtacgcagactatcgagagaattcctatgtgcccacgaccggcgcaatcattgagatccattcaaagagaatccagttatacggggcttatctgcggatccacgcccacttcacaggtttgcgatatcttttgtacaattttcctatgacgtgtgctttcatcggtgtagccagcaattttacgttccttagcgttattgttcttttttcttatatgcaatgggtttggggcggcatctggccaaggcaccggttcagcttacaggtcaatattaggaaaagagataactccaggaaagaggtacagagaaggatcagcgcgcatcagcctggccctgaggggcaggaagaatccactccacagagcgacgtgaccgaagacggagagtcgcccgaagatcccagtggaactgagggacagctcagcgaggaggaaaaacccgatcaacagcctctgtccggcgaggaggagctggagcctgaggccagcgacgggtctggctcatgggaagatgccgctctgctgacagaagcgaacttaccagcccccgcaccggcaagcgcaagcgcacctgtcctcgaaacactgggctcctccgagccggccgggggggctctgcgtcagagacctacttgctcttcctcatag

SEQ ID NO: 180519 - DNA, 1197 bp, Artificial Sequence
  Description of Artificial Sequence: Synthetic coding sequence
atggtgaacgacccccccgtgcccgccctgctgtgggcccaggaggtgggtcaggtgctggctggtcgggcacgccgactgctcctccaattcggcgttcttttttgcaccatactgctgttgctgtgggtcagtgtgttcctctatggtagcttttactactcctatatgcccaccgtgtcacatctgtcacccgtccatttttattataggactgattgtgacagtagcaccactagcttgtgtagtttcccggttgcaaatgtgagcctcactaaaggcgggcgagaccgggttttaatgtacggccagccctaccgcgtcacacttgagctcgaattacctgagtcacccgtgaaccaggatctgggtatgtttctggtaactataagttgttacacaagaggagggagaatcattagtacgtcgtcccgtagtgtcatgctccattatcgatctgatcttctacaaatgctcgacaccttagtattcagtagcctgctgctctttgggttcgccgaacaaaagcagctgctcgaggtggagttgtatgccgattatcgggaaaactcatacgtccccacaacaggcgccatcatcgagatccattccaaaagaattcagctctacggcgcttatcttaggattcacgctcacttcacggggctgagatacctcctgtataatttcccaatgacctgcgcttttattggcgttgcgagtaacttcacgtttctcagcgtgatcgtactcttttcttacatgcagtgggtgtggggcgggatttggccaagacatagattttcccttcaagtcaatattcggaagcgcgacaactcacgcaaagaggtgcagcggcggattagcgcccaccagccgggcccagaaggacaggaggaatccaccccgcagtcggatgttaccgaagatggagagagccctgaggatccatctgggaccgagggacaactctctgaagaagagaagccagatcaacaacccctgagcggagaggaggaactggagcctgaggctagtgacggatcaggatcctgggaggatgctgcactcctcacagaggctaacctacctgcacctgccccggcaagtgcttccgctccggtgctggaaacactgggttccagtgagccggccggcggtgctctgcgacaaagaccaacatgctcatctagttag

SEQ ID NO: 180520 - DNA, 1197 bp, Artificial Sequence
  Description of Artificial Sequence: Synthetic coding sequence
atggtgaacgacccccccgtgcccgccctgctgtgggcccaggaggtagggcaggtactggcaggtcgggctaggagactgctgttacagtttggcgttctgttctgcaccatcctccttcttctgtgggtctctgtgttcctttatggaagtttctattactcatacatgcccaccgtttcccatctgagccccgtgcacttttactacaggaccgactgcgattcttccacaacgtccctgtgcagtttccccgtggccaatgtgtcactaacgaagggtggaagggacagagtcttgatgtatggacagccataccgcgttaccctggaactggagctgccagagagccccgtgaaccaagatctcggtatgttcctcgtgacgatcagctgttacactagggggggacgaatcatctccaccagtagcagaagcgtgatgcttcactaccgctcagacctgctccagatgttggatacgttggtgttttcctcactgttattgttcggcttcgccgagcagaaacagctgctcgaagttgagctctatgcagactacagggaaaactcatacgtgccaacaacaggcgcgatcatcgagatccattccaagagaatacaactttacggtgcgtatctgagaattcacgcacactttactggtttgaggtatctgttatacaatttccctatgacatgcgcattcattggggtggcctcaaattttacattcctgagtgttatcgtgctgttctcatacatgcagtgggtatgggggggaatctggccccgacatagattttctctgcaggttaacatcagaaagagggacaattcacggaaggaggtgcaacggaggatctccgctcatcagccaggcccagagggacaggaggagtccacgcctcagagcgatgttacggaagacggggagtcacctgaggatccgagcggcactgagggccagttgagcgaagaggaaaagcccgatcagcagccgctgtcgggagaggaggagctcgagccagaagcctcagacggctcaggatcttgggaagatgccgcgctgttgaccgaggccaatctgccggcaccagcccctgcgtcggcctctgccccggtcctcgagactctcggcagcagcgagcccgccgggggcgccctgcgccagagacctacgtgctcctctagctag

SEQ ID NO: 180521 - DNA, 1389 bp, Artificial Sequence
  Description of Artificial Sequence: Synthetic coding sequence
atgagcaccgagaaggtggaccagaaggaggaggccggcgagaaggaggtgtgtggggaccagatcaaaggccctgacaaggaagaagagcctcctgcagccgctagccatgggcaggggtggcgccctggcggcagggcagcaagaaatgcacggccagagccaggggcaagacacccagccctgcccgcaatggttaacgatccaccagtccccgccctgctgtgggctcaggaggttggtcaggttctggccggccgagctcgcaggctgctgctgcaattcggggtgcttttctgcaccatcttactgctgttgtgggtctctgtctttctctatgggtctttctattactcatatatgcccaccgtttcccacctttccccggtgcatttctactaccgtacggactgtgattcctctacaacctctttgtgttcattcccagtagcaaatgtgtccctgacaaagggcggcagagaccgcgttctgatgtacgggcagccttatagggttacgcttgaactagagctcccagaatctcctgtgaaccaggacctagggatgtttctggtcacgatctcttgctacacccgtggtggacgtatcatatccacatccagtcgcagcgttatgctccactataggtccgatctcctccagatgctagatacattggtgttcagttctcttctgctgtttggcttcgccgagcagaagcagctgctggaggtggagctgtacgcggactacagggagaatagctatgtgccgacaactggggcaatcatcgagattcacagcaagcgtatccagctttacggggcgtacctccgcatacacgctcatttcaccggattacggtatctcctgtacaacttccccatgacctgcgcattcatcggggtggcctctaattttacgtttttgagtgtgatcgtgcttttctcctatatgcagtgggtttggggaggcatttggcctaggcataggtttagtctccaggtcaatataagaaagagagataacagccgtaaagaggtccagcgacggatcagtgcacaccagccgggcccagaaggccaagaagagtctactcctcaatctgatgtgactgaggacggcgaaagtccagaggatccctccgggaccgaagggcagctttccgaagaggagaaacccgatcagcagccgctgtcgggcgaggaagagctcgagcccgaagctagcgatggaagcggcagttgggaagacgccgctttactgacagaggccaatttgcccgctcctgcacctgctagtgcaagtgcccccgtccttgaaaccctcgggtcttcagaaccggccggcggagctctgagacaaaggcccacctgctcttcgtcttag

SEQ ID NO: 180522 - DNA, 672 bp, Artificial Sequence
  Description of Artificial Sequence: Synthetic coding sequence
atggtgaacgacccccccgtgcccgccctgctgtgggcccaggaggtgggccaggtcctggcgggaagggcacgcaggctgctgctccagttcggggtactattttgcacaatactgctgctactttgggtgtcagtcttcttgtacgggtccttttactattcgtacatgccaactgttagccatttaagcccagttcatttctactaccgaacagactgcgactcttccacaacttcactctgttcattcccagtcgccaatgtgtccctgaccaaagggggccgagaccgcgtgttgatgtatgggcagccttatagagttaccctagaacttgaactaccggagtcccccgtgaaccaagacctgggaatgttcctggtaacgatctcttgttatactagggggggaaggataatctcaactagctcacgcagtgtgatgctccactaccggtctgatctattgcagatgctcgatacattggtgttctcaagcctcctactgtttggatttgccgagcaaaaacaactacttgaggtggaattatatgctgactacagggagaactcatacgtgccgacaactggggccattatcgagatccattctaagagaatccaactttatggagcttatttaagaattcacgcccattttactggactatag

SEQ ID NO: 180523 - DNA, 282 bp, Artificial Sequence
  Description of Artificial Sequence: Synthetic coding sequence
atgagcaccgagaaggtggaccagaaggaggaggccggcgagaaggaggtgtgtggtgaccagataaagggacccgataaggaagaagagcctcccgctgccgccagccatggccaggggtggaggcctggagggcgggcggcgagaaacgcccgccctgagccaggggcgcgtcaccctgctctccctgccatggtgaatgaccctcctgtgcctgcactcctttgggctcaggaagtggggcaggtattggcagggcgcgcgcggagattgctgctatag

SEQ ID NO: 180524 - DNA, 681 bp, Artificial Sequence
  Description of Artificial Sequence: Synthetic coding sequence
atgagcaccgagaaggtggaccagaaggaggaggccggcgagaaggaagtctgtggagatcagatcaagggccccgacaaagaagaggagcccccggcagctgcctcccacggtcagggctggcgccccggcggacgcgcggcgagaaacgctcgtcccgagcccggagcgcgccaccctgccttgcccgcaatggtaaacgacccgccggtccccgccctgctgtgggcccaggaggtgggccaggttttagccggccgggctcgaaggctgctcctgcagtttggcgtgttattttgcacaatactgctgcttttatgggtgagcgttttcctctacgggagcttctattatagctatatgccaaccgtatctcatctctctcccgtgcacttctattacagaacagactgcgactcaagcacaactagcctgtgctcttttcccgtcgccaacgtcagcctgacaaaaggtggtagagaccgagtcctgatgtatggacagccttatcgagtcactctggagctggaactgcccgagagtcccgtgaaccaggatctgggtatgttcttggtgacaatttcatgttacacaagggggggcagaatcattagcacctcctcacggtccgtcatgctgcactaccgctctgacctacttcaaatgctcgatacgctgtag

SEQ ID NO: 180525 - DNA, 72 bp, Artificial Sequence
  Description of Artificial Sequence: Synthetic coding sequence
atgagcaccgagaaggtggaccagaaggaggaggccggcgagaaggaggtatgcggcgatcaaatcaagtag

SEQ ID NO: 180526 - DNA, 87 bp, Artificial Sequence
  Description of Artificial Sequence: Synthetic coding sequence
atgagcaccgagaaggtggaccagaaggaggaggccggcgagaaggaagtttgtggggatcagattaaaggtcctgacaaagagtag

SEQ ID NO: 180527 - DNA, 372 bp, Artificial Sequence
  Description of Artificial Sequence: Synthetic coding sequence
atgagcaccgagaaggtggaccagaaggaggaggccggcgagaaggaagtatgcggagaccagattaaggggccagataaagaagaagaaccccctgccgccgctagccacggacaaggctggagacccgggggaagagcagctcgaaacgccagaccagagcctggtgctagacacccggcgctacctgctatggtcaacgatccccctgtgcctgccctgttgtgggcccaagaggtggggcaggttttggctggaagggcaagaagattgctgttacagtttggtgttctcttctgcaccatcctactcctgctttgggtcagtgtatttttatatgggagtttctattactcatacatgccgacgtag

SEQ ID NO: 180528 - DNA, 300 bp, Artificial Sequence
  Description of Artificial Sequence: Synthetic coding sequence
atggtgaacgacccccccgtgcccgccctgctgtgggcccaggaggtgggtcaagtgctagccgggcgcgctaggaggcttctgctgcaattcggggtgctcttctgcactattctgcttctcctctgggtgagtgtctttctgtatgggtcgttttactattcctatatgccaaccgtgagccacctgtctcccgtccacttctactacagaactgattgtgactcatccactacctctctctgttcttttccagtggccaacgtgagcctcaccaagggaggccgtgaccgggtatag

SEQ ID NO: 180529 - DNA, 879 bp, Artificial Sequence
  Description of Artificial Sequence: Synthetic coding sequence
atggagttccagcccaaccaggaggacgaggaggacgcccacgccggtatcatcgggagatttcttggactacagtcccatgatcatcacccaccccgggccaactcccgcacaaagttgctgtggcccaagagggaaagtctgctgcatgaaggcttacccaagaatcataaggccgcaaaacagaatgttcggggacaagaggacaataaagcctggaaactgaaagcggtggatgccttcaagagtgcccctctgtaccagcgtccaggctattactcagctccccagacacccctgagccccactccaatgttcttccctctggagccgtctgccccaagcaaactgcacagtgtgactggtatagatactaaggacaagagtcttaaaactgtaagtagcggcgctaagaagtcttttgagctcctgtctgagtctgatggtgccttaatggagcaccctgaggtgagtcaggtgaggaggaagacagtcgagtttaatctgacagatatgccagagatacccgagaatcacctcaaggaacctctcgagcagagccctacaaatattcacacaacactgaaagaccacatggacccctactgggcacttgagaaccgatctgttctacatctgaaccagggccactgcatcgcactttgccctacccctgccagcttggccctctcgctgcctttccttcacaatttcctcggtttccaccactgtcaaagcactctcgatctgcgacctgccctcgcttggggtatctacctggcgacattcaccggtatcctcggcaagtgcagtggccctttcctgacttcgccttggtaccatcctgaggactttctaggcccgggagagggcagatag

SEQ ID NO: 180530 - DNA, 1497 bp, Artificial Sequence
  Description of Artificial Sequence: Synthetic coding sequence
atgttcgagaagctgaccctgtactgcgacagctacatccagctgatcccgatctcttttgtgcttgggttctacgtcacgctggtggtcacccgctggtggaaccaatatgaaaatttgccctggccggacaggttgatgtcacttgtaagtggattcgtcgaaggcaaagacgagcagggtaggctcctgcgccggactctgatccgttatgcgaacctgggcaacgtcctgatcttgaggtccgtgtccacagccgtctataagagattcccttccgcccagcacttggtgcaggctgggtttatgacacccgccgagcacaagcagctcgaaaagctctctctgccgcacaacatgttttgggtgccatgggtatggttcgcgaaccttagtatgaaggcatggctaggggggcgaatccgggacccaatcctgttgcagtcgcttttgaatgagatgaacaccctgcgcacccaatgtggacatctgtatgcgtatgactggatatcaattcctctggtgtatacccaggttgtgactgtagccgtgtattccttcttcctgacttgcttggtgggcaggcagttcctcaatccagctaaagcttatcccggacatgagttggaccttgtggtaccagtgtttacgtttctccagttctttttttacgtgggatggctcaaagtgtcattgttggccgtggatgagatgcatcaggatcttccccgtatggagcctgatatgtattggaataaacctgagccacagccgccttatacagccgcgtctgcacagttcaggcgcgcctcatttatgggaagcacattcaatatttcactcaacaaggaggagatggaattccaaccaaaccaagaggacgaggaggacgcacacgctgggattattggcaggtttctcggcctgcagagtcacgaccatcacccgcccagggccaattcccggacaaagctgctttggcccaagagagaaagtctcctgcatgagggactgccgaaaaatcataaggcagccaaacagaacgtacgcggccaagaggacaataaggcatggaagctcaaagcagtggatgctttcaaaagcgccccgctctaccagcgcccaggctactacagcgcaccacaaacaccattgtcgcccacccctatgttctttcctctagagccaagcgcgccatccaagctgcatagcgtgaccggaatcgacaccaaagataaatctctaaagactgtcagctctggtgccaagaaatctttcgagctgctgtcagagtcagacggggccctcatggagcaccctgaagtctcccaggtgagacggaagacagtggaatttaacctgactgacatgccagaaattcccgagaaccacctgaaagagcccctggagcagtcgcccacaaatattcatacaacccttaaggatcatatggacccctattgggctctggaaaatcgtgacgaggcccattcatag

SEQ ID NO: 180531 - DNA, 1758 bp, Artificial Sequence
  Description of Artificial Sequence: Synthetic coding sequence
atgaccatcacctacaccagccaggtggccaacgcccggctgggcagtttttcgagactgctgctctgctggaggggatctatttataagttgctctatggcgagttcctgatcttcctgctttgctattatatcataagatttatctataggctggctctgaccgaggaacagcagctaatgtttgagaagttgaccctttactgcgatagttatattcaattaatccctatatcttttgttttgggtttctacgtgacacttgtcgtgacccggtggtggaaccagtacgaaaatctcccatggcccgacagactgatgtctctggtcagtggattcgtggagggcaaagacgagcaaggcagactactgagaaggaccctcatccggtacgcgaaccttggcaatgtgcttatcctgagaagcgtcagcactgctgtttacaaacgcttcccctctgcccagcacctggttcaagccggctttatgacgcctgcggaacataagcagctagagaaactaagcctaccccataatatgttctgggtgccttgggtatggtttgccaacctgagcatgaaggcctggctcggtggccgcatcagagaccccatcctgttgcagtccctgctgaatgaaatgaatactttgaggacacagtgcggtcatttgtacgcatatgattggattagcatcccactcgtatacacacaggtggttacagtggcagtttacagcttcttccttacctgtctcgtgggccgccagttcctgaatcccgccaaggcgtacccaggccatgagctagatcttgtggtccccgtgttcaccttcctgcagttctttttctacgttgggtggcttaaagtcgcagaacaactgattaacccctttggagaggacgacgacgattttgagactaattggattgttgatcgtaatctccaggtttccctcctcgcggtggacgagatgcatcaggacctccccaggatggagcctgatatgtactggaataaaccagaacctcaacccccttatactgcggcctccgcccagtttcgcagggcttcttttatggggtcgactttcaatatctccctaaacaaagaggagatggagtttcaacccaaccaagaggacgaggaggatgcccatgccggaatcatcggacgctttctgggactgcagagccacgatcatcatccaccccgcgcaaattcccggactaagcttctgtggccgaaaagagaatccttgctccatgaaggccttcctaaaaatcataaagccgcgaaacagaacgtgagagggcaagaggacaacaaagcctggaaactaaaagccgtggacgcattcaaaagcgccccattgtaccagaggcctggctactacagtgccccccagactcccctctcccccacgccgatgttctttcccctagaacccagcgccccgtcaaagctccattccgtcactgggattgacacgaaagacaagtccctcaagactgtctcctccggtgccaagaaatcttttgaactcttgtctgaaagtgatggcgctctcatggagcatcctgaagtaagtcaggtccgacgcaagacagttgagtttaacctgacagatatgcctgaaattccagaaaaccatcttaaggagcccctcgagcagagcccgaccaatatccatactacccttaaggatcacatggatccgtattgggccttggaaaatcgagacgaggctcactcgtag

SEQ ID NO: 180532 - DNA, 813 bp, Artificial Sequence
  Description of Artificial Sequence: Synthetic coding sequence
atgaccatcacctacaccagccaggtggccaacgcccggctgggctccttctctaggctcctgctgtgttggagaggtagcatctacaagctgctctacggtgaattcctgatctttctcctctgctactatattatacgattcatctacaggttagccctgactgaagaacagcagttaatgttcgagaagctcaccctatactgtgacagctacatccagctgatcccaattagttttgtcctgggattttatgtaacactcgtggtgacaagatggtggaaccagtacgaaaatctgccatggcccgatagactgatgagtcttgtcagtggcttcgttgagggtaaagatgaacagggccgcctgctacgacggacacttattaggtatgcaaacctcgggaatgttctcatcctccggtctgtcagcacagccgtttacaagcgtttcccttcagcccagcacctcgtacaggctggattcatgaccccggccgagcacaaacaacttgagaaactttcactgccacacaatatgttctgggtcccatgggtgtggtttgcaaacctgtcaatgaaagcttggcttggcggcagaataagggatcccatcctgctgcagtccctactcaacgagatgaacacactccgtacccagtgcggccatctttacgcctatgactggataagcattcctctcgtctacactcagcccgagcaacggggagatggtgtccctgcccagagtggaggcagggggggatgcagcaggtggcaccattggccactccctcgaccggccgtaccatag

SEQ ID NO: 180533 - DNA, 1815 bp, Artificial Sequence
  Description of Artificial Sequence: Synthetic coding sequence
atgttcgagaagctgaccctgtactgcgacagctacatccagctgatccccatttcgtttgttctcggtttttatgtgacgctcgttgtaacacggtggtggaaccagtatgaaaatctgccttggccggatcgccttatgagtctggtttccgggttcgtcgagggcaaagatgaacagggcagactcctgcggcgaaccctgattcgatacgccaacctgggtaacgttctaatactcagatcggtctccacagctgtgtataagagattcccctccgcccagcacctggtgcaggctggctttatgactcccgccgaacacaagcaactggagaaactttcacttcctcacaatatgttctgggtaccctgggtgtggtttgcaaacctctctatgaaagcctggttgggaggccggattcgggatccaatcttgctccaatctctgctgaacgagatgaatacgctgagaacacagtgcggtcacctgtacgcatacgactggattagcatccccctggtctatacacaggtagttaccgtagcagtgtactcattcttccttacctgcctcgtgggcaggcagtttctgaaccctgctaaggcctaccctggacacgagctggatctcgtagtgccggtcttcacttttttgcagttctttttttatgtaggctggctgaaggtggccgaacagctgatcaacccattcggggaagacgacgatgactttgaaactaactggattgtggaccggaacctccaagtttccctactggccgttgacgaaatgcatcaagacctccctcgcatggaacccgatatgtactggaacaagccagaaccccagccaccctatactgccgcttctgcccagttccgccgcgccagcttcatgggcagcacttttaatattagcctcaacaaagaggaaatggagtttcagcccaaccaagaggatgaggaggatgcccatgccggtataatcggacgattcttgggcctccaatcacatgatcaccatccgcccagggccaatagtagaacgaagttactctggccgaagcgcgagtcccttctgcatgaggggcttcctaaaaatcacaaggcggcaaagcagaatgttagaggccaggaagacaacaaggcgtggaaactgaaagccgttgacgcattcaagagtgcaccgctctaccaacgacctggctattacagcgctcctcaaacccccctgtcacccactcctatgttctttcccctagaaccctctgcacctagcaaactgcacagtgtgacaggcatcgacacaaaagataagtccctgaagaccgtatcttccggcgcgaaaaaaagttttgagttgctgagcgaatccgatggagccctgatggaacaccccgaagtaagtcaggtgcgtcgcaaaactgtcgaattcaacctgaccgacatgccagaaattcctgaaaatcacctcaaagagcccttggagcagtcacccaccaacatccataccacattaaaagatcacatggacccttactgggcactggaaaatcgttctgtgctccacctaaatcagggccactgcatagccctttgtcctacccctgccagtctcgcactgtcccttcctttcttgcacaattttctggggtttcaccactgtcagtccactctggaccttaggcccgcactcgcttgggggatatatctggctacattcaccggcattttgggtaaatgcagcgggccgtttcttacgtccccttggtatcaccccgaggatttcctgggccccggtgaagggcgctag

SEQ ID NO: 180534 - DNA, 1530 bp, Artificial Sequence
  Description of Artificial Sequence: Synthetic coding sequence
atgaccgtgacctacaccgcccgggtggccaacgcccggttcggcggatttagccagctcttactactgtggcgagggagtatctataaattactgtggcgtgagctactgtgttttcttggcttttacatggcactgtccgccgcgtacagatttgtccttaccgagggacagaagcggtactttgagaaactggttatctactgtgaccagtacgcctcgttaatccctgtgtccttcgtgttaggcttctatgttaccctggtcgttaaccggtggtggtcacagtacctatgtatgcccctccccgatgccctgatgtgtgtagtagcaggtactgtacacggacgggacgaccgaggccggctgtataggcggaccctgatgcgctatgcaggcttgtctgcagtcctgatccttcggtccgtgtcgacagctgtgttcaagagatttcccaccatcgaccacgttgtggaggcagggttcatgactagagaggagaggaaaaaattcgaaaatctcaattctagctataacaagtactgggttccatgcgtgtggttttccaatctcgctgctcaggctcggcgagagggtaggataagggacaatagcgcacttaagttgttgcttgaagagttgaacgttttccgtgggaaatgtgggatgctgttccactatgattggattagcgtacccctggtgtatacccaggtggttaccattgctttgtatagttacttccttgcctgccttattggccggcagtttttagaccccgctcaggggtacaaggaccatgacctagacttatgtgtcccaatctttacccttctgcagttttttttttacgccgggtggctgaaagtcgctgaacagttgatcaaccctttcggtgaagatgatgatgactttgaaaccaattttctgattgacagaaactttcaggtgtccatgctggccgttgatgaaatgtacgatgacttagctgtcctcgaaaaggatctgtactgggacgctgccgaggccagggcaccctacacagccgcaacggtctttcagctgcgtcagccatctttccaaggcagcacttttgatatcaccctggcaaaggaggatatgcagttccagagattggatggactggacgggcccatgggcgaggctccaggcgatttcttgcagcggctgctgcccgctggagctggaatggtcgctggcggccctctaggccgacgactctcatttttacttcggaaaaattcttgcgtgtctgaagccagcacaggggctagttgttcctgtgccgtcgtccctgaaggcgcagcacccgaatgctcctgtggggaccctttactggatccaggtctgcctgagccagaggccccccctcctgcaggccctgaaccactcacccttatcccgggcccagtggaaccgttcagtattgtgacgatgccgggaccacgtggacccgcccctccctggttaccatctcctattggagaggaagaggagaatctggcttag

SEQ ID NO: 180535 - DNA, 1530 bp, Artificial Sequence
  Description of Artificial Sequence: Synthetic coding sequence
atgaccgtgacctacaccgcccgggtggccaacgcccggttcggcggtttctcacaacttttgctcctgtggcgtggtagcatctacaagctgctttggcgagagttgctgtgtttcctcgggttctatatggcactgtctgccgcctaccgattcgtcctcaccgaaggacagaagaggtactttgaaaagctggtgatctattgcgaccagtatgccagcctcattccagtgtcattcgtgctcggcttttacgtcacccttgtggtgaatcggtggtggagtcagtatctgtgtatgcccctgccagacgctttgatgtgcgtcgtcgccggcacagtgcacggtcgagacgataggggtcggctataccgacggaccctgatgagatatgccggcttgagcgcagtcctgatactccggagcgtgtccaccgcagtgttcaagcggttccctacgattgaccacgtagtagaagccggctttatgaccagagaagaacgcaaaaaattcgagaatttaaactcctcctacaataagtattgggtaccatgtgtctggttcagcaacctggcggctcaggccagaagggagggccggatcagggataattccgctcttaaactgttgcttgaggagctaaacgtgttccggggtaaatgcgggatgctgtttcattacgactggattagcgttccattggtgtacactcaggtggtgacaatcgccctatattcttattttttggcgtgccttattggtcgacaattcctcgaccctgcccagggttacaaggatcacgacttggatctgtgcgttcccatatttacactgcttcagttttttttttatgccgggtggctaaaggtggctgagcaactcattaatcccttcggcgaggacgatgacgacttcgagacgaactttctaatcgatcgcaactttcaagtgagtatgctggctgttgatgaaatgtacgatgaccttgcggttctggaaaaagacctctactgggatgccgctgaggctagggccccctataccgcggccaccgtgtttcagcttcggcagcctagcttccagggctctactttcgatataactctcgcaaaggaggacatgcagttccagcgtctggacggtttagacggacctatgggggaagcgcctggggattttcttcagcgcttactgccagctggtgccggcatggtggcaggcggccccctgggccgtagactctcgtttctcctgagaaagaactcatgtgtgagcgaagccagcacaggcgctagctgttcatgcgcagtggttccagagggagctgcccccgaatgctcgtgcggggaccctctgctggatcccggattgcctgagcctgaggctcccccgcccgccggtcccgagccattgacactgatccccggccctgtggaacctttcagtattgtgacgatgccaggccccaggggccctgcccctccgtggctcccctcccccattggcgaagaggaagaaaaccttgcttag

SEQ ID NO: 180536 - DNA, 1530 bp, Artificial Sequence
  Description of Artificial Sequence: Synthetic coding sequence
atgaccgtgacctacaccgcccgggtggccaacgcccggttcggcggattcagccagctgctgcttctctggagaggctcaatctataaactgctttggcgtgagttgctctgtttcctcggtttttatatggctctatctgcggcgtaccgttttgtgttgacagagggtcaaaaaagatattttgagaaactggtgatatattgtgaccagtatgccagcctcattccagttagcttcgttctgggattttatgtgaccctcgttgtcaaccgatggtggagccagtatttatgtatgcctctccccgacgctctgatgtgcgttgtggccggcacggttcatgggcgggacgaccgggggaggctgtataggcgcaccttaatgcggtatgcaggactgtcggcagttttgatcttaagaagtgtgagtacggctgtgttcaaacggtttccaaccattgaccacgtggtggaggctggcttcatgacacgagaggagaggaaaaaattcgaaaacctgaattccagctacaacaagtattgggtcccatgcgtgtggtttagcaacctggctgcccaggcgcgccgggaaggcagaataagggataacagtgctctcaagctgctcctggaagagttaaatgtctttagaggaaaatgcgggatgcttttccattatgactggatttctgtcccactggtctatactcaagtggtcaccatcgcactctacagctatttcctggcctgtctgataggaaggcagtttctcgaccctgcgcagggctacaaagatcacgatcttgatctgtgtgtccctatcttcaccttgcttcagtttttcttctatgcagggtggcttaaggtggcagaacaattgatcaacccctttggggaagacgacgatgattttgagacaaacttcctcattgacagaaacttccaggttagcatgctggctgttgatgagatgtacgatgatttggctgttctggaaaaggacctgtactgggatgccgccgaggcccgagctccctataccgccgcaaccgtgtttcagctgcggcagccttcattccagggatccacattcgacattaccctggcaaaggaggacatgcaattccagcgccttgatggccttgacggtccaatgggagaggcaccaggagattttctgcagcggctcctgcctgctggtgccggaatggtggccggcggaccactgggccgcagactctcattcttactccgcaagaatagttgtgtgtcggaggccagcaccggagctagttgcagttgtgccgtggtaccagaaggagcagccccggaatgcagttgcggggacccgcttctcgatccaggcctgcctgaacctgaggcgcctccccccgccggtcccgaaccgctcaccctgatccccgggcccgtcgagcccttttccatagtgactatgcctggccctaggggacctgcccccccttggctgccatccccaattggagaggaagaagaaaatttggcatag

SEQ ID NO: 180537 - DNA, 219 bp, Artificial Sequence
  Description of Artificial Sequence: Synthetic coding sequence
atgttcctgatcagcagcagcgtgcacggcagcgacgagcacggcagactgctgaggcgcaccctgatgcgttacgtcaatcttactagcctgcttatctttaggtctgtgagtacagccgtgtacaagagatttcctaccatggatcacgtcgtggaggcagaacggacaggaatgaaacccatcctgccctccagcttcgaaatgcaatcattttag

SEQ ID NO: 180538 - DNA, 2007 bp, Artificial Sequence
  Description of Artificial Sequence: Synthetic coding sequence
atgaccgtgacctacagcagcaaggtggccaacgccaccttcttcgggttccaccgcctgctcctaaagtggcgcggaagtatctacaagctgctgtaccgcgagtttatcgtgtttgcggtcctctatacagcaatcagcctggtttacagactcctgctcacgggagtgcagaagcgatatttcgagaagctgagcatttactgcgaccgctacgctgagcagattcccgtgacatttgtactgggattctatgtaactttagtggtgaaccgctggtggaaccagtttgttaatcttccttggcctgatagacttatgtttttaatcagttcatccgtccacggcagcgacgagcacggccgacttctgagacgcactctcatgcggtatgtaaatttgacatctttgctgattttccgaagtgtctctaccgcagtttataagaggtttcccacaatggatcacgtggtggaggcaggctttatgacaaccgacgagcggaaattgttcaaccacctcaagtctccgcatttgaaatactgggtcccattcatttggtttggtaatctggcaacaaaggctcggaatgagggacgtattcgagacagtgtagatctccagagcctcatgaccgagatgaaccgctacaggagttggtgctctctgctctttggctacgactgggtgggcattcccctagtctacacacaggtcgtgacactcgcagtgtacaccttctttttcgcctgcctgattgggagacagttcctcgaccccaccaagggctatgcaggccacgatctcgacctctatattcccatatttacactgcttcaatttttcttctacgcagggtggttaaaggtagctgaacagctaattaatcccttcggtgaagatgacgacgacttcgagactaactggtgtatcgatagaaaccttcaagtaagcctgctcgctgtcgacgagatgcatatgagtctcccaaagatgaagaaggacatatactgggacgactcagcagcccggccaccctacaccctggcggctgctgactattgtatcccctcatttctcgggagcacggttcaaatgggactgtcaggcagtgactttcctgacgaggagtggctttgggattacgagaagcacgggcataggcattctatgattaggagggtcaagcgtttcctaagtgcacacgaacacccctcttctccccgccgacgctcttatcgccggcaaaccagcgactctagtatgttcctgcccagggatgacctctcaccagcaagagacctactggacgttccttcccggaacccccctcgcgctagcccgacctggaaaaagtcctgctttcccgagggctctccaacgctccacttttctatgggcgagctgagcactatacgggagacatctcagacgtccacactccagagcttaacaccacagagctctgtgagaactagcccaatcaagatgcccctcgtccctgaggtactgattacagccgctgaagctcccgtccctacatccggcggatatcatcacgactcagcgacttccatcctctcaagcgagttcaccggtgtacaaccttccaagactgagcagcagcagggacctatgggttccattctgagtccttcggagaaggaaactccacccggaggaccaagccctcagacagtgagtgctagtgcagaagaaaacattttcaattgtgaggaggaccccggggacacttttcttaaacggtggagccttcctggattcctcgggtcatcccatacaagcttgggcaacctcagcccagatccaatgagttcccagccagcactgcttatcgataccgagacttcaagtgagatctccggcattaacatcgtggccggttcacgggtgtcctcagacatgctgtacctgatggagaatctggacacgaaagagaccgacataatcgagctgaacaaggagacagaagaaagcccaaaatag

SEQ ID NO: 180539 - DNA, 1197 bp, Artificial Sequence
  Description of Artificial Sequence: Synthetic coding sequence
atgaccgtgacctacagcagcaaggtggccaacgccaccttcttcggctttcaccggctgctcctcaagtggaggggctctatatacaaattgttgtatcgcgaatttatcgtcttcgctgttctctatacggcgatcagcctagtatatcgattactgctgactggtgtgcagaagaggtatttcgaaaaattatcaatatactgcgacaggtacgctgaacagatacctgttacctttgtacttggattctacgtgacactggtggtcaacaggtggtggaatcaatttgtaaatctgccgtggccggacagattgatgttcttgattagcagctccgtgcacgggagcgatgagcatggccgcttactcaggcgcacccttatgcgatacgtgaacctgaccagcctgctgattttccgttctgtcagcactgcagtctataagcgctttcctacgatggatcacgtggtcgaagccggctttatgacgacagatgaacgtaagctgtttaaccacctgaagtctccccatttgaagtactgggttccatttatctggttcggtaatttggccacgaaagctcgaaacgagggacggattcgagactctgtggaccttcagtcgctgatgaccgagatgaatcgctaccggtcgtggtgtagcctgctgtttggttatgattgggttggaattcctctcgtgtatacacaggtggttacgctggcagtatacaccttcttctttgcttgtctgatcggtaggcagttcctcgatcccaccaagggttatgctggtcacgacctggacctgtacatccctatttttactctgcttcagtttttcttctatgctggatggctgaaagttgccgagcagctgatcaatccctttggcgaggatgatgatgatttcgagactaactggtgcatcgaccgtaacttgcaggtgtctctgctcgcagtagacgagatgcacatgagtttgcctaagatgaaaaaagacatatattgggacgattctgctgcgcgcccgccatataccctcgccgcagcagattattgtattccctcctttctggggagcactgtccaaatgggaaagcagatgccgaagaacgaatggaaaatggaggacataaagatccccctgcctcagccacaattccagtgtgccaagagtgacccgggcgggtag

SEQ ID NO: 180540 - DNA, 219 bp, Artificial Sequence
  Description of Artificial Sequence: Synthetic coding sequence
atgttcctgatcagcagcagcgtgcacggcagcgacgagcacggcagactgctgcggagaacattgatgcggtatgttaacctgacctctctgctaatcttcagatccgtgtccacagccgtgtataaacggttccctaccatggaccatgtggtggaggccgaaagaaccggcatgaagcccatacttccctcatccttcgagatgcagtctttctag

SEQ ID NO: 180541 - DNA, 1368 bp, Artificial Sequence
  Description of Artificial Sequence: Synthetic coding sequence
atgaccaccgacgagcggaagctgttcaaccacctgaagagcccccatcttaaatactgggtgccattcatttggttcggtaatctggccactaaggcaagaaatgaaggacgaattcgggactccgtagacctccaatcgctgatgactgagatgaatcggtacaggtcctggtgtagcttgctattcggctatgactgggtcggcatccctttggtctatacgcaggttgctgaacagctgattaaccccttcggcgaagatgacgatgatttcgagaccaactggtgcattgaccgtaaccttcaggtctccctgttagccgtggacgaaatgcatatgagtctgccaaagatgaagaaagacatttattgggatgactccgcagcccgaccaccctataccctcgccgcggccgactattgcattccctcctttctgggaagcactgtacagatggggttgtccgggtcagacttccctgatgaagagtggctgtgggactatgaaaagcacggtcataggcacagcatgatcagacgagttaaacggtttctgtcggctcacgaacatccctcatccccccggagaaggagttaccggagacaaacatccgattccagcatgtttctgcccagggacgacctgtcaccagccagggacctcctggacgtgccatcccgcaacccgccgcgggcctccccgacatggaagaaaagttgttttccggaggggtcccctactttgcattttagcatgggagagctgagcaccattagggagacttcgcagacatccaccctgcagagtcttacacctcagagcagcgtgcgtacctctcctatcaaaatgcctctggtgccagaggtgctgatcacagccgccgaggcgcctgtgcctacctctggcggctaccatcacgattccgcgacttcaattcttagtagcgaatttaccggggtgcagcctagtaaaactgaacagcagcagggacccatgggttcgattctctcacctagtgaaaaggaaactcctcccgggggtccaagccctcagaccgtgtcagccagcgcagaggagaatatatttaactgtgaagaagacccaggggatacgttcctgaagcgctggtctctgcctggcttcttggggagttcccacacttctcttggaaacctgtctcccgatccaatgtcctcccagcctgcgttgctgatcgacaccgagacatccagcgagatctccggaataaatattgtggcaggctctagggtctccagcgatatgctttacctaatggaaaatctggatactaaagagaccgatataattgagctcaacaaagagaccgaggaatcccctaagtag

SEQ ID NO: 180542 - DNA, 219 bp, Artificial Sequence
  Description of Artificial Sequence: Synthetic coding sequence
atgttcctgatcagcagcagcgtgcacggcagcgacgagcacggcaggttactgcggcggaccctcatgaggtacgtcaatttaacaagcctgctgatctttcgcagcgtctccaccgctgtatacaagaggtttcctacaatggaccatgttgttgaagcggagcggacaggaatgaagccgattcttccctcttccttcgaaatgcagagcttctag

SEQ ID NO: 180543 - DNA, 1422 bp, Artificial Sequence
  Description of Artificial Sequence: Synthetic coding sequence
atgaccgtgagctacaccctgaaggtggccgaggcccggttcggcggattttcaggcctgcttctgaggtggagagggagcatttacaagctgctttacaaggagtttcttctttttggcgcgttatacgcagtgctcagtataacttataggctgcttctcacccaggaacagagatatgtttatgctcaggtggccagatattgcaacaggtccgccgatctaatacccctgtcttttgtgctgggcttctatgtcacgcttgttgtgaatcgatggtggtctcagtacactagtatcccactgccagaccagctcatgtgcgtcatttcagcaagtgtgcacggagtggatcagagaggacgtctcctgagaagaaccctgatcaggtacgctaaccttgcttctgtgcttgtcttgcgctcggtctctacacgcgtgcttaaacgtttccccacaatggagcatgtagttgatgccggattcatgtctcaggaggagcgcaaaaagttcgaatctctgaagtccgactttaacaagtactgggtaccttgtgtgtggttcaccaatctagcagctcaggcgagaagggatggacggatcagggacgacatcgcactttgcctcctgctggaggagttgaacaaatatcgggccaagtgttccatgctgttccattacgattggataagcattcctctggtgtatacccaggtcgtaaccatcgcagtctactcattctttgcgctttctctggtgggaagacagttcgtcgaaccagaagcaggagcagccaagccccagaaacttttgaaacccggccaggagcccgcgccggcattgggagatcccgatatgtatgtcccgctgaccactctgctccagtttttcttttatgctgggtggttgaaggtagcagagcaaattattaacccgtttggggaagatgacgatgatttcgaaacgaatcagctgatagatcgaaatttacaggtcagtctcctgagtgtagatgaaatgtaccagaatttaccaccagctgagaaggaccagtactgggacgaggaccagccccagcctccgtacaccgtagctactgctgctgagtctttacggcccagttttctgggaagtacctttaacttgcgtatgtccgacgatcccgaacagtcgctgcaggtggaggcctctccaggttctgggcgaccagcccccgccgcccaaacgccactgttagggcgctttctcggcgtgggagctcctagtcctgcgatctccctgcggaatttcgggcgggtccgcgggaccccccgcccgccccacctcctgcggttcagagcagaggaaggtggggatccagaagccgccgctcgcattgaagaggaatccgcggagtctggggatgaggctctcgaaccctag

SEQ ID NO: 180544 - DNA, 294 bp, Artificial Sequence
  Description of Artificial Sequence: Synthetic coding sequence
atgtacctgggcatcacccccagcgtgacctgcaacaacagcagcaaaaacgaattctcactgattctggagaagaacccattggtggagtttgttgaggagctgcctgccggccggagcagtttatgctactgcaacttactgtgcggtatcattcggggggcactggagatggttcaccttgcggctgatgtgaccttcttgcaggaccgacttaaaggggattcagttacagagatcggtattacctttctcaaaaaacgcgatgagaagaagtatcgtgggaagaaatag

SEQ ID NO: 180545 - DNA, 546 bp, Artificial Sequence
  Description of Artificial Sequence: Synthetic coding sequence
atgagccggcccgcccaccggcggcccgagtaccacaagatcaacaaagacctgtttgtgcttacctacggcgccctcgtcgcccagctgtgcaaagattacgaaaaagacgaggatgtcaaccaataccttgacaaaatgggttatggcattggcaccagactggtagaggactttttggcaagaagttgcgtgggccggtgccactcttattcagaaatcattgatatcatcgcccaagtagcttttaagatgtacttgggcatcaccccatctgtcacttgcaataactcctcaaaaaacgaattctctctcattttagaaaagaatccactagtagagttcgtggaggaactaccggcgggccggtcaagcttgtgttactgcaatttgctttgtggaattatacgaggggccctggagatggtccacttggccgctgatgttacattcctgcaagatcgcctcaaaggagacagtgtaactgagattgggattacttttttgaaaaagcgggacgaaaaaaaatacaggggtaagaagtag

SEQ ID NO: 180546 - DNA, 504 bp, Artificial Sequence
  Description of Artificial Sequence: Synthetic coding sequence
aacaaggacctgttcgtgctgacctacggcgccctggtggcccagctctgtaaggactatgaaaaggatgaagatgtgaaccaatacctcgataaaatgggttatgggattggaacaagattagtggaggactttctggctcgaagctgcgtcggacgatgccactcatatagtgagataatcgacataattgcgcaagtggcattcaagatgtatctcggaataactccctctgtaacatgcaacaattcatcaaaaaacgagttttccctgattctagagaagaaccctctcgttgagtttgtagaggagcttcccgctgggaggtcctcattgtgttactgtaatttgttgtgtggcatcatacgtggagcactggaaatggtgcatctggcagcagatgtgacttttctccaagaccggctgaagggggactcagtgactgagattggaatcacgtttctgaagaagagagacgaaaaaaagtaccgcggtaaaaagtag

SEQ ID NO: 180547 - DNA, 1497 bp, Artificial Sequence
  Description of Artificial Sequence: Synthetic coding sequence
atgcggccccccgcctgctggtggctgctggccccccccgccctgttggcccttcttacctgcagcctggcttttggtttggccagtgaagatacaaagaaggaggtgaagcagagccaagatctagaaaagtccgggatctccaggaagaatgacattgatctgaagggaattgtttttgttattcaatctcaatcgaattcctttcatgcgaagcgggctgagcagcttaaaaagagcattctgaaacaggctgccgacctcacccaggaactcccttcagtcttgcttttacatcagcttgctaaacaggaaggggcgtggacaatcctgccccttctcccgcacttctctgtgacgtattcacgcaactcatcatggatcttcttctgcgaggaggagacaaggatacaaatcccaaaactcctggagacccttaggcgttacgatccaagtaaagagtggttcctggggaaagcactgcatgatgaggaggctacaattattcatcactatgccttctccgagaaccctaccgtcttcaaatacccagattttgctgcgggttgggcactcagcattcccctggtcaacaagctcacaaaacgccttaaatcagaaagtctcaaaagcgatttcaccatcgacttgaagcatgaaattgccttatatatttgggacaaaggcggaggaccacccctgacaccagtacctgaattttgcacgaacgatgtggatttttactgcgcaaccacttttcactctttcctgccgttgtgtcggaaaccggtgaaaaagaaggatatctttgtcgccgtcaaaacttgcaagaagttccacggagatagaattccgatcgtaaaacagacctgggagtcccaggcctcactgatcgaatactactccgactatactgagaattctattccaaccgtggaccttggaattcccaataccgatagaggacactgcggcaaaactttcgccattctggagaggtttctgaatcgcagccaggacaaaacggcttggttagttattgtcgatgacgacacgctcatttccatatcacggcttcagcaccttctttcctgctatgactccggggagccagtctttctgggggagagatatgggtatggcctaggcactgggggatattcatacatcaccgggggcggcgggatggtattttctcgggaagccgtacggcgactccttgcatctaagtgcagatgctatagcaacgatgcaccagacgatatggtactcggtatgtgttttagtggccttgggatccctgtaactcacagtccgcttttccatcaggcaaggcctgttgattatccaaaggattatctgagccatcaggtccccatctcatttcacaaacactggaatatagatcctgtgaaggtctactttacctggcttgctccgtcagacgaagataaggcaagacaggaaacccagaaagggtttagggaagagttgtag

SEQ ID NO: 180548 - DNA, 1005 bp, Artificial Sequence
  Description of Artificial Sequence: Synthetic coding sequence
atgcccaagcggcgggacatcctggccatcgtgctgatcgtgctgccctggactttgctcatcactgtgtggcaccagtcaactctggcaccactcctggctgttcacaaggacgagggctcagacccacgaagagagacgccccctggtgcagatccaagggagtattgcacaagcgaccgggacatagtagaagtggtgagaactgagtatgtttacacacgccccccaccatggagtgatacacttcctacaatacatgttgtaacacctacctattcacgacctgttcagaaagcagagctcacgagaatggctaatacccttcttcatgtgcctaacttacactggctggttgtggaagacgcacctaggagaaccccacttactgcccgcctcctccgggacacgggactcaactacacccacctgcacgtcgagacgcctcgtaattataagctgcgtggtgacgcgcgggaccccaggatccctagggggaccatgcaacgaaacctcgctctccgatggctacgagaaacttttcctaggaattccagccaaccaggggtcgtgtacttcgcagatgacgacaacacatacagtctcgagttgtttgaggagatgcgctccacccgaagggtttcggtttggcctgtggccttcgtgggcggcctccgttatgaagcaccgagggtgaacggcgccgggaaggttgttggctggaaaaccgtttttgacccccatagaccgtttgcgatcgacatggcaggcttcgctgtgaacctacggttaatcttacagcggtcacaggcctacttcaagcttagaggcgtcaagggcgggtaccaagaatcaagcttgcttcgagaattggtgaccctgaatgacctggagcctaaggccgcaaactgcactaaaatccttgtttggcacaccagaaccgaaaaaccagtgctggtgaacgagggcaagaaaggatttacagaccctagcgtcgagatttag

SEQ ID NO: 180549 - DNA, 1005 bp, Artificial Sequence
  Description of Artificial Sequence: Synthetic coding sequence
atgcccaagcggcgggacatcctggccatcgtgctgatcgtgctgccttggactctgctgatcacggtctggcaccagagcacacttgcccctctgttggctgtccacaaagacgagggctctgatcccagaagagagaccccacctggcgctgatcctagagagtactgtactagcgaccgcgatatagtggaagtagtgcgcactgagtatgtgtacaccagacccccgccatggtcagacaccctgcctacgattcacgttgttaccccgacttatagtagacctgtgcagaaggccgagctgacaagaatggctaatactctcctccatgtccctaatctgcattggctggtggtggaagacgcgcctcgcaggacccccctgacggctagactgctgagggacactggtctgaattatacacacttgcacgtagagacgccgaggaactataagctgagaggagatgcaagggatccccggatcccaagggggacaatgcagcggaaccttgccctgcgttggttgcgggaaacctttccccgcaattcctcccagccaggtgtggtatactttgcggatgacgataacacctacagtctagaactcttcgaggaaatgaggtcaacccggcgggtgtccgtttggcccgtggccttcgtcgggggtctgagatacgaggctccaagggtgaacggggccggcaaggtcgtgggctggaaaactgtgttcgacccccatcggccctttgcaatagatatggcggggttcgctgttaacttaagactcatccttcagagaagccaagcctatttcaagcttagaggggtgaaaggggggtatcaggagtcctcgctgcttcgtgagctggtgaccctcaatgacctagagcccaaggctgcaaactgcaccaagatcttagtttggcacactaggactgaaaagcctgtcttagttaacgaggggaagaaggggtttaccgaccctagcgtcgagatctag

SEQ ID NO: 180550 - DNA, 1005 bp, Artificial Sequence
  Description of Artificial Sequence: Synthetic coding sequence
atgcccaagcggcgggacatcctggccatcgtgctgatcgtgctgccttggacccttttgattaccgtatggcaccaaagcacactggctcccttactggcagtgcacaaggacgagggttccgatccaagaagggaaacgccccccggggcagacccgcgcgaatattgtacttcagaccgggatatagtagaggtcgtacgcacagaatacgtgtatacaagaccccccccctggtccgataccctgccaacaatacatgttgttaccccaacttactccaggccggttcagaaggctgaacttacccgcatggctaatacactgctgcacgtacccaacctacactggctggttgtcgaagacgctccacggcggacaccactgaccgcgagattattaagggacacaggcctcaattatacacacctccacgtagagactcccagaaactataaattaaggggcgatgccagagatcctcgtatcccacgcggaactatgcagcgaaatctggcgctgcggtggttaagagaaacattcccaaggaactcgagtcagcccggggtggtatatttcgcagacgacgacaacacctatagtctggaactgtttgaggagatgagatcaactcgtagggtgtcagtctggccggtggctttcgttggcggactgagatacgaagctccccgcgtgaacggcgctgggaaagtggtgggatggaagactgtgttcgaccctcaccgccctttcgccattgacatggccggattcgcagttaatttgcggctcatcttgcagcggtctcaggcttattttaaactgcggggggtaaaaggcggttatcaggaaagtagtctgctccgcgagctggtgaccctcaatgatcttgagcccaaagccgccaactgtaccaagattctggtatggcataccagaactgagaaaccggtccttgtcaacgaagggaagaagggtttcacagatccctccgtcgaaatttag

SEQ ID NO: 180551 - DNA, 1044 bp, Artificial Sequence
  Description of Artificial Sequence: Synthetic coding sequence
atgggcaacgaggagccctgggtgcagcccgccctggagatgcccaagcgacgcgatatcctggctatcgtgctcatcgttcttccatggaccctcctgatcacagtatggcatcaatctacattggctccactgctcgccgtgcacaaggacgagggtagtgacccacggcgcgaaacaccccccggggcagatcccagagagtattgcacgagcgaccgagatatcgtggaagtcgttcggaccgagtatgtctatacgcggcccccaccgtggagcgataccctgccgacaattcacgtggtgactcctacctattccaggccagtgcagaaggctgagctgaccagaatggctaacacattgctgcatgtgcccaatctccactggctcgtggtggaggatgctccacggaggactccacttacggcccggctactgagagatacgggactgaattatacccacctacatgtggaaaccccaagaaactataagctgcgcggagatgcccgcgatccccgtattccccgggggaccatgcagcggaacctcgctttgaggtggcttagggagactttcccccgtaactcaagccagcccggggttgtttatttcgccgacgatgacaacacttatagcctcgagctctttgaggaaatgaggtccaccagaagagtttcggtttggcccgtggcatttgtgggggggctgagatatgaggcgcctcgcgtcaatggagccggtaaagtcgttggatggaaaactgtcttcgaccctcacagacctttcgccatcgatatggccggcttcgccgtaaacttgaggcttattctgcagcgatctcaggcctatttcaagctgagaggagttaaaggtggttaccaggagagctcactgctacgtgagctggttaccctgaacgacctcgaaccaaaggccgctaactgtaccaaaattttggtctggcatacaagaaccgaaaaacccgtgctagttaacgagggcaagaagggattcaccgatccgtctgtcgaaatctag

SEQ ID NO: 180552 - DNA, 1008 bp, Artificial Sequence
  Description of Artificial Sequence: Synthetic coding sequence
atgaagctgaagctgaagaacgtgttcctggcctacttcctggtgtcaatcgcaggcctgctctacgccctggtccaactcggtcaaccttgtgactgcctgccaccactgagggccgccgcggagcagttgagacagaaggacctgaggatatctcagctgcaggctgaactgcggcggccaccacccgcacccgcacagccccctgaaccagaagctctgccaaccatctacgtggtgacgcccacttacgcccgattagttcagaaggcagaactggtgagactgtcccagactttgtcactggtgccgcggttgcattggttgctggttgaggacgccgaggggccgacacctcttgtttccggattactggccgcaagtgggctgctcttcacccacttggtagtcctgacccccaaagcacagcggttgcgagagggcgagccagggtgggtacatccacggggcgtagagcaaagaaataaggcactcgattggttacggggacggggcggcgccgtgggcggcgaaaaggaccccccccctcctggaacgcagggagtcgtctatttcgccgacgacgataacacatattccagggaactgttcgaggagatgaggtggaccagaggagtgtctgtctggccagtaggcctggtgggaggcttgcgttttgagggccctcaagtgcaagacgggagggtggtaggcttccacaccgcctgggaaccctctcggcctttccccgtggacatggccggcttcgccgtggccctcccacttctgcttgataaaccaaacgcacagtttgatagcacggctcccagaggccaccttgagtccagcttgctctcacatttagtcgatcccaaggatctggaacccagagccgcaaattgcacgcgggtcctggtctggcatacgcgcacagagaaaccaaaaatgaagcaggaagagcagttacagcgccagggcagagggtcagacccagctattgaggtgtag

SEQ ID NO: 180553 - DNA, 948 bp, Artificial Sequence
  Description of Artificial Sequence: Synthetic coding sequence
atgaagctgaagctgaagaacgtgttcctggcctacttcctggtgagcatcgccgggcttctgtatgcactcgtccagctaggacaaccttgtgactgcctgccaccgctgcgcgctgccgcagagcagcttcgacaaaaggacctaaggatcagccaacttcaggcagaactccggcggccacccccagccccagcccagccacctgagccagaggccctgccgactatttacgtagtaacgccaacctatgcccgccttgtgcaaaaggctgagctcgtgagattgtctcagacactctcacttgtgcctagactgcactggttgctggtggaggatgctgagggccctactcccttggtctcaggcctgctggcggcttcaggcttactgtttacccacctcgtggtacttactcctaaggctcagcgactgcgggagggagagccaggatgggtccacccacgcggtgtggagcaacggaacaaggctcttgattggctgagaggccgcggcggagcggtcggtggtgagaaggatccaccacctccggggacacagggcgtcgtgtatttcgccgacgatgacaacacgtatagccgagaattgtttgaggaaatgcgatggacacgcggggtgagtgtgtggcctgtggggctcgtgggcggcttaaggtttgagggcccgcaggtccaggacggtcgagtggtggggttccataccgcttgggagccctctaggccatttccggttgacatggcaggtttcgccgtggccctcccactgctgctcgacaaacctaatgctcaattcgactcaacggctcccagaggtcatcttgagtcctccttgttgagtcatctagtagatcccaaggatctcgaaccccgcgccgccaattgtacacggacagagagccgctgcgtgactcaggcaggtgttcaatag

SEQ ID NO: 180554 - DNA, 2997 bp, Artificial Sequence
  Description of Artificial Sequence: Synthetic coding sequence
atgggcagcccccgggccgcccggccccccctgctgctgcggcccgtcaagctactccgacgaagatttcgtctcctgttggccctggctgttgtctcagtgggcctgtggacgctgtacctagaactggttgccagcgcacaggtggggggtaaccccctgaaccgacgctacgggagctggagggaactggccaaggccttggcttctcgcaacatcccagccgtggacccacatctgcagttttaccatccccaaagactttccctagaggaccatgacatcgatcaaggagtgtcttctaattcaagctacctgaagtggaacaagccggttccttggctgagcgagtttcgaggcagggccaatctgcacgtgtttgaagattggtgcggatcgagtattcagcaattaagacggaatttgcactttcccttgtatcctcatatcaggaccaccctccgcaaactggccgtgagccctaagtggaccaactacgggcttcggatcttcggttacctccacccatttacggatggtaagatccaatttgcaatcgccgctgatgacaacgccgaattttggctttccctggacgatcaggtatctgggctccagctgcttgcctctgtgggcaagaccgggaaggagtggacagcccctggggagtttggcaaatttagaagccagatttctaaaccagtaagtttgtccgcctctcacaggtattatttcgaggtattgcacaagcagaacgaagaaggcactgaccacgtagaggtggcgtggagacggaatgatccaggtgcgaagtttacgatcatagactccctgagtctgtcgttgtttactaatgagacatttcttcaaatggacgaggtggggcacataccccagacagctgccagccacgttgatagcagtaacgctctgccaagggacgaacagcctcccgccgatatgctcaggccagacccccgcgataccctctaccgcgtccccctcatacctaagagccacttaaggcatgtcctgccggactgtccttacaagccctcttatctggtagacgggttgccgctgcagcgctaccaggggttaaggtttgtacaccttagctttgtgtacccaaacgattataccagattgtcccacatggaaacccacaataaatgtttttaccaagaaaacgcttactaccaggatcgcttctcctttcaagaatatatcaagattgaccaacctgaaaagcagggcctcgagcaacctggctttgaagaaaaccttttagaggagtcccaatacggggaggtggccgaagagaccccggcttctaacaaccagaacgcgagaatgctggagggcagacagacccccgcgtctaccctggagcaggatgccacggactatagattaaggagtctgaggaaactcctggctcagcctagggagggattactggccccatttagtaagcgtaatagcaccgccagtttcccggggcgcaccagccacataccggtgcaacagccggagaagcgaaaacagaaacctagcccggagccttctcaggatagcccccactcagataagtggccaccgggacacccagtgaaaaatctgccacagatgcgggggccgcggccaaggcccgccggggattctcctaggaaaacccagtggctgaaccaagtggaatcatatatagcagaacagcggagaggagatcgtatgcggccccaggctcccggtcgaggttggcacggagaggaagaggttgttgcagcggcaggacaagagggccaggtcgagggcgaagaggagggggaggaggaggaggaagaggaggacatgtctgaggtctttgagtacgttcccgtgtttgatccggtcgttaactgggatcagacatttagcgcccgcaacctcgactttcaggccttgcgtactgactggatagacctgagttgcaatacatcagggaatctgttgctgccagaacaggaggctctcgaggtcactcgtgtgttcctgaagaagctcaaccagcgctccagagggcggtatcaactgcagagaatcgtgaacgtcgagaaaaggcaggaccaactgcgggggggcagatacctgctcgagcttgaattactggagcaaggccagagagttgtaaggttgtcggagtacgttagcgccagaggatggcagggcattgacccagcaggaggagaagaggtcgaggcgcgaaatcttcagggcctcgtctgggaccctcacaatcgacggcgacaggtgctcaatacaagagcgcaagagccgaagctctgctggcctcagggcttctcctggtctcaccgagcagttgtgcactttgtcgtgccggtcaagaatcaggcgcgctgggttcagcagttcattaaagacatggagaatctgttccaggtaactggagatccccacttcaacattgttattactgactactctagcgaggatatggatgtcgaaatggccctgaagcgttccaagctgaggtcctaccaatatgtgaagcttagtggcaacttcgagaggagcgcaggcctccaagcaggtatcgatctggtcaaagatccccatagcattatttttctctgcgatctgcatattcactttcctgctggcgtgatagacgccatccggaagcactgcgtggaggggaaaatggcctttgcccccatggtcatgcggctccactgtggagcaaccccgcaatggcccgaaggctactgggaagtcaacggctttggtctcctggggatatacaaatcggacctcgaccggattggcggaatgaatacaaaagaattccgcgatcggtgggggggggaggattgggaactgcttgatagaattctgcaggccggactcgatgtggagcgattgagcctacgcaacttcttccaccattttcactctaagcgggggatgtggtctagacgccagatgaagaccttatag

SEQ ID NO: 180555 - DNA, 306 bp, Artificial Sequence
  Description of Artificial Sequence: Synthetic coding sequence
atgagccggagcgtggccctggccgtgctggccctgctgagcctgagtggcctggaagccatacagcgaactccgaagatccaggtttattctcggcaccccgccgagaatgggaaatcaaactttctgaactgctacgtgtccggattccacccgtctgacatcgaggtagacttgttaaaaaacggagaaaggatcgagaaagtagagcactcagatctttctttctctaaagattggtcattttacctgctttactacacagagtttacccctactgaaaaaatgtccatgccagcagtctag

SEQ ID NO: 180556 - DNA, 369 bp, Artificial Sequence
  Description of Artificial Sequence: Synthetic coding sequence
atgagccggagcgtggccctggccgtgctggccctgctgagcctgtcaggactggaagcaatccagcgtactccgaaaatacaggtgtactctaggcaccccgcagaaaatggtaaaagcaacttcctgaactgttacgtgtctggtttccatccatccgacatcgaggttgaccttctgaaaaatggggaaagaattgagaaggtggagcacagcgacctttcattcagcaaagattggtccttttatctgttatactataccgaatttacccctacagaaaaagatgaatacgcttgcagggtcaaccatgtgactctatctcagccaaagattgttaagtggggaaagtcttacattttactgtag

SEQ ID NO: 180557 - DNA, 360 bp, Artificial Sequence
  Description of Artificial Sequence: Synthetic coding sequence
atgagccggagcgtggccctggccgtgctggccctgctgagcctgagcggcctagaggcaattcaacggacaccaaaaatacaagtgtattcccggcatcccgccgaaaatgggaaaagtaattttctgaactgttacgtgtcaggctttcacccaagtgacatcgaagtcgacttgctcaagaatggtgaacggatagaaaaggtggaacatagcgatttaagtttctcaaaggactggagcttttacctgctatactacacagaatttacccctacagaaaaggatgagtacgcatgccgtgttaatcatgtaactctctcccaacctaaaatcgtcaagtgggacagagatatgtag

SEQ ID NO: 180558 - DNA, 369 bp, Artificial Sequence
  Description of Artificial Sequence: Synthetic coding sequence
atgagccggagcgtggccctggccgtgctggccctgctgagcctgtccggacttgaagctatccagcgcactcccaaaatacaggtttatagcaggcacccagcagagaacggaaaatccaattttctcaactgttacgtgagcggctttcacccctccgatatagaagttgacttattaaagaatggggaacggattgagaaagtcgaacatagtgatttatccttttctaaggactggagcttctatctactctactatacagaatttaccccgacagaaaaagacgagtatgcctgtcgggttaaccacgtgacactttcccagcccaagattgtgaaatggggtaagtcctatatactcctgtag

SEQ ID NO: 180559 - DNA, 360 bp, Artificial Sequence
  Description of Artificial Sequence: Synthetic coding sequence
atgagccggagcgtggccctggccgtgctggccctgctgagcctgtcagggctggaagctatccaacggacccccaagatacaggtgtattcacgccatcccgccgaaaacggaaagtccaatttcctgaactgctacgtgtccgggttccacccttccgatatcgaggtcgacctcctgaagaacggcgagcgcattgaaaaagttgaacactctgacctctctttcagcaaagactggtctttctaccttttgtactatacagagttcactcctactgaaaaagacgaatacgcttgtcgggttaatcatgttacacttagccagcccaagatagtgaagtgggacagagacatgtag

SEQ ID NO: 180560 - DNA, 360 bp, Artificial Sequence
  Description of Artificial Sequence: Synthetic coding sequence
atgagccggagcgtggccctggccgtgctggccctgctgagcctgagcgggctagaggccatccagaggacccctaagatacaggtctatagtagacatcctgccgaaaatggcaagtcaaatttcctgaactgttatgtgagcggctttcatcctagtgacattgaggtggacctgctcaagaacggagaacggattgaaaaagtagaacacagcgatctctccttctccaaggactggtccttctacctcctttactacaccgaatttacaccaaccgaaaaggatgagtatgcttgtagagtgaaccacgttactctgtcccaaccaaagatagtcaaatgggacagggacatgtag

SEQ ID NO: 180561 - DNA, 1644 bp, Artificial Sequence
  Description of Artificial Sequence: Synthetic coding sequence
atggacatcatcttcggccggaaccggaaggagcagctggagcccgtcagagctaaggtcaccggaaagatccccgcatggctgcagggcactctgctgagaaacggaccgggaatgcacaccgtcggggaaagtcggtacaatcactggtttgacggtctggcactgctccattctttcaccatccgagacggagaggtgtactatcgatcaaagtacctgcgcagcgacacctacaataccaacatagaagccaataggatagtggtgagtgagttcggaaccatggcgtaccccgacccctgcaaaaacatctttagtaaggccttttcttatctgagccacacaatccctgattttacagacaattgcctcattaatattatgaagtgtggggaggatttctacgcgacatccgaaactaactacatccgaaaaataaacccccaaactcttgaaacattagaaaaagtcgactaccgtaagtacgtggcagtgaatttggccacttcccacccacattatgatgaggctggcaacgtcctgaacatgggaacctctatagtggaaaagggaaagaccaaatacgtgatttttaagatacccgcaaccgtgcccgaaggtaagaaacagggaaagtcaccctggaaacatacagaggtgttctgtagcattcccagtcgctccttgttatccccttcctactaccactcatttggagtaaccgagaattacgtaatcttcctggaacagccctttcgcctggatattctgaaaatggccaccgcatatatccgtagaatgtcctgggcctcctgcctggcttttcatcgcgaggaaaaaacatacatccatatcatcgaccagaggactaggcagcccgtccagaccaaattctatacggacgcaatggtcgtttttcaccacgtgaatgcttatgaggaggatggttgcatcgtgtttgacgtgatcgcatacgaggacaattcactctaccagctgttctatctggctaacctcaatcaggacttcaaagagaacagccgcctgaccagtgttccaactcttaggcgctttgcagtgccgctccatgtagacaaaaacgctgaagtggggaccaacctcattaaggtcgcttctacaactgccacagcattgaaagaagaggacgggcaggtgtactgccaaccggagttcctttacgagggtctcgagctgccaagggtgaactatgcccacaatggaaagcagtaccgttacgtgttcgccaccggggtgcaatggagcccgatccctaccaagatcattaagtacgatatcctgaccaagagctcacttaagtggcgggaagatgattgctggcctgctgagcctctcttcgtgccagctcctggagccaaggatgaggatgatggcgtgatcctatcggctatcgtttctaccgaccctcagaagctcccgttcctacttatcctggacgcaaaatcatttacggagctggcgcgcgcctccgtggatgttgatatgcacatggatctccatgggcttttcattacagatatggactgggatactaagaaacaggccgcaagcgaagaacagcgtgatagagcaagcgattgccacggggcacccctcacctag

SEQ ID NO: 180562 - DNA, 1437 bp, Artificial Sequence
  Description of Artificial Sequence: Synthetic coding sequence
atggccgccggcaaccccgccccccagtgggcctgggacgcccactcttggggtgtgcaaatccagcccctagtgcggcgtccgtgccccgccccacagctccaccatcaacgcagggctttttcctatctgtcccacactattccagatttcaccgacaactgtctgataaacattatgaagtgtggggaagacttttatgcaacatcagagacaaactacattcgtaaaatcaatccccagactctggaaaccctggaaaaggtagattatcgcaaatatgtagcagttaatctcgcaacttctcacccgcactacgatgaagcaggtaacgtgcttaacatggggacaagcattgttgagaaaggcaagaccaaatatgttatctttaagattcccgcaacagtgccggagggaaagaagcagggcaaatccccttggaaacacactgaggttttttgtagcatcccctccagatcgcttctttctccatcctactatcacagtttcggtgtgacggagaactatgttattttccttgagcagccatttagacttgatatattgaagatggccactgcctatatcagacgaatgagttgggcttcatgtctggccttccaccgcgaggagaagacctacatccatatcatagaccaacggacccgccagcctgtccagactaagttctatactgatgctatggtggtgttccaccatgttaacgcttacgaggaagatggatgtatcgtgtttgacgtgattgcttacgaggacaactccctgtatcagctattctatctggcgaatctaaaccaggactttaaggagaactccaggttgacatcagtgcccacgctgaggcgattcgctgttccacttcacgtcgacaaaaacgcagaggtgggaactaacttgatcaaggttgcatccactaccgccacggccctcaaggaagaggacggacaggtttactgtcaaccggagtttctgtacgagggcctcgagcttccacgcgtcaattatgctcataatggaaagcaataccgatatgtcttcgcaactggcgtgcagtggagccccatccccaccaaaattattaagtatgatatcttaactaaatcaagcctaaaatggcgtgaggacgactgctggcctgctgagcccctcttcgtaccagctcctggtgcaaaggatgaagatgatggcgtcatcctttccgccatagtctcaacagacccccaaaaactcccctttctcctgatactggatgccaaaagcttcaccgagttggcacgtgctagcgtcgatgtggacatgcacatggacttgcatgggctgttcataaccgatatggactgggatacaaagaagcaggccgcctcagaggagcagcgggatcgggcctcagattgtcacggcgctccactaacatag

SEQ ID NO: 180563 - DNA, 1740 bp, Artificial Sequence
  Description of Artificial Sequence: Synthetic coding sequence
atgttcttccgggtgttcctgcacttcatccggagccacagcgccacagccgtggatttccttcccgtgatggtgcatcggctgcccgtattcaagcggtatatggggaacaccccacagaagaaggccgtatttggtcagtgccggggtctcccctgcgtagctccgctgttaacaacagtagaagaggcgcctcggggcataagtgcacgggtatggggccatttccctaagtggcttaacggttctctcctccgtataggcccgggtaaatttgagttcggtaaggataaatacaaccactggtttgacggtatggcactgcttcaccagtttaggatggccaaagggaccgtgacctatagaagcaagttcctacagtccgacacatacaaagccaactccgcaaagaacagaatcgtcatttccgagtttggaacgctggctctgcccgacccttgcaaaaacgtattcgagaggtttatgagtaggtttgagctgcctggcaaggccgccgctatgaccgacaataccaacgtcaactatgtgcgctacaaaggagactattatctgtgtacggagacaaactttatgaataaggtggacattgagaccctcgaaaagacggagaaagtggactggagtaagttcatagccgtgaacggagcgactgcacatccacactacgatttggacggcacggcctataatatgggtaacagcttcggcccgtacggcttctcttacaaagtaatccgcgtaccacctgagaaggtggatttaggtgagaccatccatggtgtacaggtgatctgcagtatagcctctaccgaaaaaggcaaaccctcctattaccattcgtttggaatgacccgcaattacatcatatttattgagcagccactcaagatgaatttgtggaagatagcaacatcgaaaattcggggcaaagcgttctctgacgggattagctgggagccgcagtgtaatacgagattccacgtcgtggagaagcggactggtcaactactgcctggaagatactattcgaaaccctttgtaacttttcatcagatcaacgcctttgaggaccaaggctgtgtgatcatcgatctgtgctgccaggataacggacggactctcgaggtttaccagcttcagaacctaaggaaggccggggagggactcgaccaggtccacaactccgcagccaagtcattccctagacggtttgtgctgcccctaaacgtctctctgaatgccccagaaggagacaacctctcccctctttcatatacgagcgcctccgcggtcaaacaggctgatggcacaatctggtgtagtcacgagaacctccaccaggaggacctagaaaaagagggcggcattgagttcccccagatttactacgacagatttagcgggaaaaaatatcactttttttacggttgcggctttcgccacttggtgggtgatagcctaattaaggtggacgtagttaacaaaaccctgaaggtgtggcgcgaggacggattttacccctccgaacctgtgtttgtgcctgctccagggactaacgaggaagatggcggcgtcatcctgtccgtcgttatcacgcctaaccagaacgagtcgaactttatcttggtcctggacgccaagaactttgaggagttaggacgcgccgaggtgcctgtgcagatgccctacggcttccatggcactttcatcccgatctag

SEQ ID NO: 180564 - DNA, 1638 bp, Artificial Sequence
  Description of Artificial Sequence: Synthetic coding sequence
atgggcaacaccccccagaagaaggccgtgttcggccagtgccgggggttaccatgtgtagccccccttctgacaaccgtagaagaggcccctcgaggcatatcagccagggtatggggccacttccctaagtggctgaatggatctctgcttcggattggcccaggaaagtttgaattcggcaaggacaaatacaaccattggttcgacgggatggcgttacttcatcagtttcggatggccaagggcactgtaacatatagaagtaagtttctgcagtctgacacctataaggccaattccgctaagaacaggatcgttatttcggagttcggaaccttggccttacccgacccgtgcaaaaatgtgtttgagaggttcatgagcagattcgagttgcctggaaaggcagctgctatgacagacaacactaacgtgaactacgttcggtacaaaggcgactattatttgtgtacagagacaaatttcatgaacaaggtcgatattgagaccttggaaaaaaccgaaaaggtcgattggtccaagttcattgccgtaaacggcgccactgctcaccctcattatgacttagatgggaccgcttataatatgggcaactcttttggcccttatggcttctcttacaaagtgatccgagtgccacctgagaaggtcgacctaggggagacaatccatggggtgcaggtcatttgcagtatcgcttctaccgagaaggggaagccttcctattatcatagctttggaatgacccgcaattacatcattttcatcgaacagcccctcaaaatgaatctgtggaagatcgcgacgtcaaagatccggggaaaggccttctccgatgggatctcctgggaaccacagtgtaacacacgctttcatgttgtagagaagcgcactggccagctcctacccggaaggtactattccaagccttttgtgacctttcaccagatcaatgctttcgaagatcaagggtgcgtgatcattgacctctgttgccaagacaatggaaggacattggaggtataccaactacagaacttacgaaaggcaggtgaaggattagaccaggtgcacaattcagccgccaaatcttttccacggcggttcgtgctgcccctcaatgtttctctgaatgcccctgaaggtgacaacctctcacccctgtcttacacatccgccagcgcagtgaagcaggccgatggaacaatctggtgctcacacgagaatttgcatcaagaggacttggagaaggaaggcgggatcgaatttcctcagatatactatgaccggttcagcggaaagaagtaccactttttttacggatgcggcttcagacacctcgtgggggactcactcattaaagtggacgtggttaacaaaaccttgaaggtctggcgcgaagatggcttctacccctctgaaccagttttcgtgcccgcacccggcacaaacgaggaggacggtggagtgattctgtcggtggtcatcaccccaaaccagaacgagagcaatttcatcttggtcctagacgctaagaatttcgaggaactgggcagggcagaagtacctgtacagatgccttacggcttccatggcacgtttatacctatttag

SEQ ID NO: 180565 - DNA, 1638 bp, Artificial Sequence
  Description of Artificial Sequence: Synthetic coding sequence
atgggcaacaccccccagaagaaggccgtgttcggccagtgccggggtctgccatgcgtcgcgcctctcctcaccaccgtggaagaggccccccgcgggatcagcgctagggtgtggggacatttccctaagtggctgaatgggagccttctgcgcatcggccccggtaagtttgagtttggcaaggacaagtataatcactggtttgatgggatggccctgctccatcagttcagaatggcaaaagggacagtcacctatcgctccaaatttctgcagagcgacacatataaggccaactctgccaagaatcgaattgtcatctcggagttcgggacgcttgctctccctgacccgtgtaaaaatgtattcgagaggttcatgagcaggttcgagctcccagggaaggcagctgcgatgactgacaatactaatgtcaactacgtgagatacaagggagactactacctctgcacagagaccaatttcatgaacaaggttgatattgagacactcgagaagaccgagaaggttgattggtccaaattcatcgctgtcaacggggctacagctcatccccactatgaccttgacggtactgcctataacatgggaaattccttcggaccttacgggtttagctacaaggtgatcagggtgcctcccgagaaagtcgaccttggagagacaatccacggagtccaggtgatctgtagcattgcttctacagagaaaggaaaaccctcctactatcactcctttgggatgacccgcaattatatcatcttcatagagcaaccgctcaagatgaatttatggaagattgctacctcgaaaatacgcggcaaagctttttctgacggcatctcatgggaacctcagtgcaatacacgcttccacgtggtggaaaaacggactggacaattgctgcccggcagatactattctaaacctttcgtgaccttccaccaaataaacgccttcgaggaccagggatgtgtaattattgatctgtgctgccaagacaatggcagaacactggaagtctaccaactgcagaacttgaggaaagccggggaaggtttggaccaggtgcataattctgcggccaaaagtttcccccggcgtttcgtgctgccactgaacgtcagcctaaacgcacctgaaggagataatctttctcccctttcctacacttcagctagcgcggtgaaacaggctgacggaactatttggtgcagtcatgaaaaccttcatcaggaggacctcgagaaggaaggaggaattgagttcccgcagatctattacgacagattcagcggaaagaaataccactttttttacggttgcggctttcggcatctggtcggtgactcgttaataaaggttgacgtggtgaacaaaaccctcaaggtgtggcgggaggatggcttctacccgagcgagcccgtgttcgttccagctcctgggaccaatgaggaggatggcggcgtcatcctgtccgtcgttatcacgcccaaccaaaatgaatcgaactttatcttggtactggacgccaagaactttgaggagctagggcgcgctgaggtgcccgtgcagatgccttatggcttccacggaacctttatccccatctag

SEQ ID NO: 180566 - DNA, 1620 bp, Artificial Sequence
  Description of Artificial Sequence: Synthetic coding sequence
atgggcaacaccccccagaagaaggccgtgttcggccagtgccggggcctgccttgcgtggcacccttgctgaccacagtggaggaggccccccgcggaatctccgcaagagtgtggggccatttccccaaatggctgaatggctctctcctcaggatcggccccggaaagttcgaatttggcaaggataaatataatcactggtttgatggaatggcattacttcatcagttcaggatggccaagggcaccgtgacctataggtccaaatttctacagagcgatacttataaggcaaatagtgccaaaaaccgtattgttatcagtgaattcgggaccctcgcacttcctgatccgtgtaaaaacgtgttcgagcgatttatgtctagatttgagctgccgggcaaggcggcggccatgacagacaacactaacgtgaattacgtgcgatacaagggggattactacctgtgcaccgaaactaacttcatgaataaagtggacatcgagacgctggagaagaccgagaaggtggactggtccaagttcatcgcagtcaatggggccacagctcacccccattatgatcttgacgggacggcatacaacatgggaaactcttttggaccgtacggtttctcatataaggttatacgagtgcctcctgagaaagtggatctgggagaaactattcatggcgtgcaggtgatctgcagcattgcatcaacagaaaaggggaaacccagctattatcactcatttgggatgacccggaattacattattttcatagaacaacccctcaagatgaacctgtggaagattgccactagcaaaatccggggcaaggcttttagcgacggcatatcctgggagccccagtgcaacacacggttccacgtagtcgagaagcgcacaggccaactcttgccgggcaggtactacagcaaacccttcgtaactttccatcaaatcaacgcctttgaggaccaagggtgcgtgatcatcgacctgtgctgtcaggataacggcaggactctggaggtttaccagcttcagaacctgcgaaaggcaggcgaaggcctggatcaggtgcataactctgccgcaaagtccttccctagacggttcgtcctcccccttaacgtatctttgaacgcccccgagggagacaacctatcccctttgtcttataccagcgcgtcagcagttaagcaggccgacgggaccatttggtgttcacatgaaaatttacaccaagaggacctggaaaaggaaggaggcatcgaatttcctcagatatactatgatcgcttctccggaaaaaagtaccacttcttctacggctgcggttttcggcacttagtgggtgactctctaatcaaggtcgatgtcgtctggagggaagacgggttttacccttctgaaccggtgttcgtgccagctccggggactaatgaagaggacggcggtgttatcttatccgtggtcattacaccaaaccagaatgagagtaatttcatactcgttctggatgccaagaatttcgaagaactaggccgagcggaagtacctgtgcagatgccgtatggattccatgggacctttatcccgatttag

SEQ ID NO: 180567 - DNA, 1638 bp, Artificial Sequence
  Description of Artificial Sequence: Synthetic coding sequence
atgggcaacaccccccagaagaaggccgtgttcggccagtgccggggattaccgtgcgtggcccccctgctcactactgttgaagaagccccgcgagggattagcgccagagtgtgggggcacttccccaaatggctgaacgggtccctgctgcggattgggccaggaaagttcgagttcggaaaagataagtacaaccattggtttgacgggatggcactgcttcatcaatttaggatggctaaggggaccgtcacttatcggtccaaatttctgcagtccgatacctataaggctaactcagctaagaaccggattgtgatttctgaattcggcaccttggccctgccagacccctgcaagaacgttttcgagagattcatgtctcgctttgagctgccaggcaaagcagccgcaatgactgacaacacaaacgtcaattacgtgcgttacaaaggagattattatctgtgcaccgagactaacttcatgaacaaagtggacattgaaactttggagaaaacggaaaaggtcgattggtccaagttcatagccgtgaatggggctaccgcgcatcctcattacgacctggacggcacggcctacaacatgggaaacagctttggcccttatggttttagctacaaggttattagggtccctccagagaaggttgacctgggagaaaccatccacggcgtccaagtgatctgttctattgctagcactgaaaaagggaagcccagctactatcatagctttgggatgaccagaaactacatcatcttcatcgaacagcctctcaagatgaatctatggaaaattgccacgtccaaaataaggggtaaagccttcagcgacgggatctcctgggaacctcaatgtaatacaagatttcatgtggtcgaaaagagaactggccagctgctgccagggcgatattattctaagcctttcgttacgttccatcagatcaacgctttcgaagatcagggctgcgtcattatcgacctgtgctgtcaagacaatggccggacactggaagtataccaactgcagaatctccgcaaagccggcgaagggctagatcaagtgcacaacagtgcagcgaagtcctttcctagaagatttgtgctgcctctgaacgtgagccttaacgcgccagaaggggataaccttagtcccctttcctacacttccgctagcgccgtaaaacaagccgatggcaccatttggtgctcccacgaaaacctgcaccaggaggatctagagaaggaggggggtatcgagtttcctcagatatactatgatcggttttcaggcaagaaatatcacttcttctacggatgtggctttcgccacctcgtgggggactctctgatcaaagttgatgtagtgaacaagactcttaaggtttggcgcgaagatggcttctatccctctgagcctgtgtttgttcccgccccgggcacgaacgaagaggatgggggcgtcatactcagtgtcgttataacgcccaaccagaatgagtcaaacttcatactggtgcttgatgcgaagaacttcgaggaactggggcgtgccgaagttccagtacagatgccgtatgggtttcacggcacgttcattccaatctag

SEQ ID NO: 180568 - DNA, 1221 bp, Artificial Sequence
  Description of Artificial Sequence: Synthetic coding sequence
atgccccccgtgggcggcaagaaggccaagaagggcatcctggagagactgaacgcaggagaaatcgttatcggggacggcggctttgtttttgctttggagaaacgcgggtacgtcaaggccggcccatggacacccgaagccgccgtcgagcatccggaagccgtgaggcaactccatcgtgagtttttgcgagccgggagtaatgttatgcagacttttaccttttacgcgtctgaagacaaattggaaaaccgcgggaactacgtcttggagaaaatcagcggccaggaagtaaatgaggctgcatgcgacattgctcgacaagttgcagatgaaggtgatgcccttgtggcaggaggggtgtctcagaccccctcttacctttcctgcaaaagcgaaacagaagtgaagaaggtctttctgcagcagctggaggtattcatgaagaagaatgtagactttctgatcgccgaatacttcgaacatgtcgaggaagcagtttgggctgtggaaaccctgatcgcttcaggaaaaccagtggcagcaacgatgtgcatcgggcccgagggggacctgcacggcgtccctcccggagaatgcgccgtgcggcttgtgaaggcaggcgccagtataatcggcgtcaattgccatttcgacccgacaatctctctgaagacagtcaaactgatgaaggagggattggaagcagccaggcttaaagcgcacctgatgagccagccactcgcctatcacacccccgactgcaacaagcaaggattcatcgacctgcccgagttcccttttgggctggagccccgcgtggctacccgatgggacatccagaagtatgcccgggaggcctataatctgggggtccgatatattggaggctgctgcggattcgagccttaccacatacgcgcaattgcagaagagctcgcacccgaacgcggatttctgccgccggcatcagagaagcacggatcatggggtagtggcctggacatgcacaccaaaccctgggtgcgtgcaagggccaggaaggagtactgggaaaacctccgcatcgcctcaggccggccgtacaatcctagcatgtctaagcccgacgggtggggcgttactaagggtaccgctgagcttatgcagcagaaggaggcaacgactgagcagcagcttaaggagctttttgagaagcaaaaattcaagtcacaatag

SEQ ID NO: 180569 - DNA, 612 bp, Artificial Sequence
  Description of Artificial Sequence: Synthetic coding sequence
atgccccccgtgggcggcaagaaggccaagaagggcatcctggagcggttaaatgcaggtgagattgtaataggcgacggcggattcgtgtttgcattggagaagcgaggctacgtcaaggccgggccctggactcccgaggccgctgtggagcacccagaagccggcgccagtatcatcggagtgaattgtcattttgatcccaccatatccctgaaaacggttaagctgatgaaggaaggcttggaagctgcgcggttaaaagcccatttgatgtctcagccactggcctatcacacacccgactgtaacaaacagggcttcatcgatttgcccgaattcccattcggcttggaacccgagttgccacccgacggaatcttcaaaaacactcccgaaagaccgacaacatggggatcgggaactctcgcgggcgcggtagacctgtctcccaccacctccgggcaactgcagcgctcatggccacaaaaaggcgcattctgtcaccagctgcagaagaacatggccgccggggaagtggtgtggacatgcaccccaaacccagggcttgaacagggccctggaaggaacacagggaggatctttggatag

SEQ ID NO: 180570 - DNA, 1092 bp, Artificial Sequence
  Description of Artificial Sequence: Synthetic coding sequence
atggcccccgccggccggcccggcgccaagaagggcatcctggagcgtttagagtcaggcgaggtggtcatcggcgacgggagtttcctcattacactcgagaaacgcggttacgttaaagctggcctatggacaccagaggccgtcatagaacatccagacgccgttcgacagcttcacatggagtttctgagagcaggctcgaatgtgatgcaaacattcaccttctccgcttctgaggacaatatggagagcaaatgggaggatgtgaacgccgcagcctgcgacctcgctcgggaggttgcgggcaagggagacgctctagtggctggaggtatttgtcagacatctatttataagtatcagaaggatgaggctagaattaaaaaactgtttcggcagcagctagaagtgtttgcatggaaaaatgtcgactttctcattgcagaatatttcgagcacgtggaggaggcggtatgggctgtagaggtcctgaaagaaagcgatcggccagtcgcagtgaccatgtgcatcggcccagagggggacatgcacgacatcactcccggcgagtgtgctgtgcggcttgttaaagccggggccagtattgttggcgtcaactgtcgctttggacccgatacatcgttgaagaccatggagttaatgaaagaaggcttggagtgggcaggcctgaaggcccatctaatggtgcagccactagggttccatgctcccgattgtggaaaagaggggttcgtcgaccttccagagtatcccttcgggttagagtctcgggtcgctacacggtgggacatccagaaatatgccagagaggcctataatttaggagtgagatacattggaggatgttgcgggtttgaaccctaccacatcagggccatcgctgaagagctcgctcccgaacgcggatttttaccacccgcaagtgagaagcacggttcttggggcagcggcttggatatgcacaccaagccctggattagagccagagcacggcgggagtattgggaaaacctcctgcctgcttctggaagacccttttgccctagcctgtccaagcctgatttttag

SEQ ID NO: 180571 - DNA, 900 bp, Artificial Sequence
  Description of Artificial Sequence: Synthetic coding sequence
atggcccccgccggccggcccggcgccaagaagggcatcctggagaggctcgagtcaggggaggtcgtaatcggcgatggctcattcttaattaccctcgagaaacggggctacgttaaggctgggctgtggactcctgaagccgtgattgaacaccctgatgccgtgaggcagttgcatatggagtttctgagggccgggtccaatgtaatgcagacgttcaccttctcagcctccgaagataacatggagtctaagtactttgaacacgtcgaagaggccgtctgggccgtggaagttctaaaagagtccgatcggcccgtggcagtaacaatgtgtatcggcccagaaggagacatgcatgacattacgccaggcgagtgcgcagtcagattggtgaaggctggagctagtattgtaggagtgaattgccgcttcggtcccgatacatcgttgaagacgatggaacttatgaaagagggtttggagtgggccggcctgaaagcacacctgatggtacaaccactcgggtttcatgcgccagattgtgggaaagaagggttcgtggatcttcctgagtaccccttcggtctggaaagcagggtggctactcggtgggacatccagaaatatgcccgcgaggcctacaatttgggcgtgcgatatattggggggtgttgcggatttgagccatatcatattcgggccattgcagaggaactggcaccggagcgcggcttcctcccccctgccagcgagaaacatggcagctggggaagtggtctggatatgcacacaaagccatggattcgggcgcgcgctaggcgcgagtattgggagaatctgttgcccgcttccggtcgacctttttgtccttctctgtcaaagccagacttctag

SEQ ID NO: 180572 - DNA, 639 bp, Artificial Sequence
  Description of Artificial Sequence: Synthetic coding sequence
atgatcatcggcggcatcgaccacagcctgtacaccggcagcctgtggtatactcccatccgcagggagtggtactatgaggtgataatcgttcgggtcgaaattaatggacaggatctgaagatggattgtaaggagtacaactatgacaagtccatcgtcgacagtggcacaaccaaccttcgtctgcccaaaaaggtgtttgaagctgccgtgaagtcgattaaggccgcgagttctaccgagaagttccccgacggtttctggctgggcgaacagcttgtgtgttggcaggcaggcacaacaccgtggaatatctttccagtcatatctctttacctgatgggcgaggtgacaaaccagtcatttaggattactattctgccacaacagtacttgagatggaaaatgtggccaaggcccaagaccacagtgacctgtcatctcaccgtaatccacggacactgctatggatcgtgctatcacggcggacttctgcttagcctaattggccccgaaaacgaactggccctccttagcgccctggccatgtgtaccatgtccagtgggcggcagcggtggaaggcctgccacctgggccatgggcgtctgtggctgcaacacagtacagaccggtag

SEQ ID NO: 180573 - DNA, 1506 bp, Artificial Sequence
  Description of Artificial Sequence: Synthetic coding sequence
atggcccaggccctgccctggctgctgctgtggatgggcgccggcgtgcttcccgctcatggcactcaacatgggatcaggctgccgttgcgaagtggactgggcggggccccccttggtttgagacttccccgtgaaaccgatgaagagccagaggagcctggcagaagaggttcgttcgtggaaatggtcgataacctacggggaaagtccggccaaggatactacgtcgagatgaccgtcggctccccccctcagaccctgaacatcctcgtagatacaggtagttccaacttcgctgtaggagcagccccccatcctttcttacacagatactaccagagacaactgtcctccacgtaccgggatttgcgtaaaggcgtatatgtgccctacacgcagggcaaatgggaaggggagctcgggacagatctggtttccatccctcatggacctaatgtcaccgtgcgggctaacatcgctgcgataacagagtccgacaaattttttattaatggatctaactgggaaggcattctgggactagcttacgccgaaatcgctaggccagatgactctctggaaccttttttcgactctctggttaagcaaacacacgtgccaaacctcttctccctgcagctgtgcggcgccggatttcctctgaaccaatcggaagtgctcgcgtctgtggggggttcgatgatcattgggggtattgatcactccctgtatacaggttcactctggtatactcctatccggagggagtggtattatgaagtgattattgtgcgcgtcgaaataaatggacaggaccttaagatggactgcaaagagtataattatgataagtcaatcgtggactcaggaaccacaaacctgcggctgccaaagaaggtcttcgaagctgcggtcaagtcaattaaagccgctagctccacagagaaatttcccgacggtttctggctgggcgagcagttagtttgctggcaggccggcactaccccatggaacatattcccagtaatcagtctgtatctgatgggggaggtgacaaatcagagtttccggatcacaatccttccgcagcagtatttgcgccccgtggaagatgtcgcgacctcccaggatgattgctacaaattcgccatcagtcagtcatcaaccggcacggttatgggtgctgtgatcatggagggcttttatgtggtttttgaccgggctcgcaagcggatcggatttgctgtctccgcttgtcacgttcacgacgagttcagaacagctgccgtggagggcccgttcgtgaccctcgatatggaagactgtggctataatattccacagacggatgagtcaacacttatgaccatcgcttacgtcatggcagcaatctgcgcactcttcatgcttcccctgtgtcttatggtgtgccaatggtgttgcctcagatgcctgcgccaacagcacgacgatttcgccgacgatatcagtctgcttaaatag

SEQ ID NO: 180574 - DNA, 1299 bp, Artificial Sequence
  Description of Artificial Sequence: Synthetic coding sequence
atggcccaggccctgccctggctgctgctgtggatgggcgccggcgtactccctgcgcacgggacgcagcatgggattcgacttccgctccggtctggcctgggcggcgcacctctgggactgcggctacccagagagactgacgaggagccagaggagcccggacggaggggctcctttgtggaaatggttgacaatctcagagggaagtcaggacaggggtactacgtggagatgactgtgggatctccaccgcagacccttaatatcctagtcgatacaggctcttccaattttgcagtcggggctgcaccacacccgtttttacacagatactatcaaagacaactgtcctcgacctacagagaccttagaaagggggtttatgtgccttacacacaaggaaagtgggagggggagcttgggactgatctactgtgcggagccgggtttccgcttaaccagtccgaagtactggcatccgtcggcggcagcatgattatcggcggtatcgaccattcactctacactgggagcctatggtacacacctatacggagagaatggtactacgaggtaatcatcgtgcgggtagaaattaatggccaggacctcaaaatggattgtaaagagtataattatgacaaaagtatcgtagactctggaactactaatttacgtctgcccaagaaggtgtttgaagccgctgtgaaatctatcaaagcagcgtcctctaccgaaaaatttcctgacgggttttggctgggcgaacagcttgtgtgctggcaggctggcaccactccttggaatatctttcccgttatttccttgtacctcatgggcgaggtgacaaatcagtctttcaggatcaccattctaccacagcagtaccttcggcccgtggaggacgtggccacaagtcaggacgattgttacaagttcgccattagccagtccagtaccgggacggtaatgggggccgtgattatggaagggttctacgtcgtgtttgacagagctcgaaaacgaatcggcttcgcggtctcagcttgccatgtgcacgatgagtttcggaccgctgctgtcgagggccctttcgtcacattagacatggaagattgtggatacaacataccacagaccgacgagtctaccctgatgacgatcgcctacgtcatggccgctatttgcgcactgtttatgttacctttatgtctcatggtgtgccaatggtgctgtctgcggtgtctgaggcagcaacacgacgacttcgctgatgacatcagcctgttgaaatag

SEQ ID NO: 180575 - DNA, 1374 bp, Artificial Sequence
  Description of Artificial Sequence: Synthetic coding sequence
atggcccaggccctgccctggctgctgctgtggatgggcgccggcgtgctgcccgcccatggcacacagcacggtattagactgcctctcagaagtgggttaggcggagccccactcgggctgcgcctgcctagagaaactgatgaagagccggaagaaccaggccgccggggttcctttgtggagatggtcgacaatctgcgcggaaaaagcggtcagggctattatgtcgagatgaccgtgggatctcccccacagacacttaatattctggtcgacacgggatcctccaactttgcagtgggtgcagccccgcaccccttcctgcaccgatactaccagaggcagctctccagtacctatagggacctgcggaagggcgtctacgtgccctatacccagggaaagtgggagggggaactcgggacagacctgccagacgattcattggagcctttcttcgattccctggttaaacaaacccacgtgccgaacctcttctccctccagctctgcggagccggctttcctctgaatcagagtgaagtgttagcctcagtgggaggttccatgatcatcgggggaattgaccactcactgtacactgggagcctgtggtatactccaatccgacgtgagtggtactatgaggtcatcatcgtgagagtagagataaacgggcaagatctgaagatggactgcaaggagtataattacgataagtctattgtcgatagcggtactacaaacctcaggctgcccaaaaaggtgttcgaggctgcagtgaagtccataaaggccgcaagcagtaccgagaagttccccgatgggttctggctcggagagcagttggtgtgctggcaagccgggaccacaccatggaacatcttcccagtgatcagtctctatttgatgggcgaggtgactaatcagtcgtttcgaatcactattctgcctcagcagtacttacgtcccgtcgaggacgtagccacttcccaggacgattgttataagttcgctatctcccagtcgtctacagggaccgtcatgggagcggtcataatggagggattttacgttgtattcgacagggccaggaagcggatcggcttcgcagtgtccgcttgccacgtccacgatgaattcaggaccgcagcggttgaggggccgtttgtcacactggatatggaggactgtgggtacaatatacctcagacagatgagtcaaccctcatgactatagcttatgtgatggccgctatctgcgctctgttcatgctgcctctgtgtcttatggtctgtcagtggtgctgcttaaggtgtttacgacagcagcacgacgacttcgctgatgacatcagcctgctgaagtag

SEQ ID NO: 180576 - DNA, 1431 bp, Artificial Sequence
  Description of Artificial Sequence: Synthetic coding sequence
atggcccaggccctgccctggctgctgctgtggatgggcgccggcgtactgccagcccacgggacgcagcatggaatcagactgccgctccggtccggtcttggtggagcccctttaggcctgagactgccacgcgagacagatgaagagcccgaggaaccaggcaggcggggaagctttgttgagatggtagacaatctcagagggaaaagcggtcaaggatactacgtcgagatgactgtcggttccccccctcaaacgttgaatatcctggtcgacactgggagcagcaacttcgctgtgggtgccgcaccacaccccttcctgcacagatactatcagagacagctgtcctcgacctaccgggaccttagaaaaggcgtgtacgtcccatacacccagggcaaatgggaaggagagctgggtaccgacctggtgtccatcccgcacggcccaaatgtgacagtccgtgcaaatatcgcagcgattacagagtctgacaagttctttattaacggttcgaactgggaaggcattctcggactggcctatgctgaaatcgcaaggttgtgtggggctggcttccccttgaatcagtcagaagtcctggcgtccgtgggcggtagtatgattatcggcggcattgaccactctctgtacacggggtccctgtggtacacacccatacgcagagaatggtactacgaagtcatcatcgtgagggtcgaaataaatggccaagaccttaagatggattgcaaggaatacaattacgacaaatcaatcgtggattcgggaacaacaaatcttcgactgcccaaaaaagtgtttgaggccgctgtcaagtccattaaagcggcctcctccacagaaaagtttcccgatggcttctggttaggggagcaactggtgtgttggcaggctggcacaacaccctggaacatatttcctgtgattagtctgtatcttatgggggaggtgacaaatcagtcctttagaattacaatcctgccacagcagtatctccgtcccgtcgaggatgtagctaccagccaagacgactgctacaagttcgccatctcacaatcgagcactgggaccgtgatgggcgctgtgataatggaaggattctacgtggtattcgaccgggcacggaagcgcatcggatttgctgtgtctgcatgtcatgtgcacgacgagtttcgcactgccgctgtcgaggggccatttgtgactctggacatggaagattgcggttataacattccccaaacagatgaaagtaccctgatgacgatagcctacgtgatggccgctatctgcgccctgttcatgctgccgctgtgcttaatggtctgccagtggtgttgtctcagatgtctacgtcaacaacatgatgacttcgctgatgatattagtttgctcaaatag

SEQ ID NO: 180577 - DNA, 1131 bp, Artificial Sequence
  Description of Artificial Sequence: Synthetic coding sequence
atggtgcccttcatctacctgcaggcccacttcaccctgtgcagcggttggagcagcacataccgcgaccttcgaaagggcgtgtacgtgccctatacccagggcaaatgggaaggagaactgggcacagatctggtgagcatccctcacgggcctaacgttacagtccgagccaacattgctgccatcacagaatcagataaatttttcattaacgggtccaactgggaaggcatcctcggactggcttacgccgaaattgccaggctatgtggggcgggcttccctctaaaccagagcgaggtgctggcatctgtaggaggctccatgatcattggtgggattgaccactcactgtacactggcagcttgtggtatacgccaatccgcagagagtggtattacgaagtaattatcgtgagagtggagatcaacgggcaggatctgaaaatggattgtaaggaatataattacgataagtccattgttgatagtggcactacaaacctgcggctgccaaaaaaagtattcgaggctgccgtgaagtcaataaaagctgcatccagcactgaaaagtttccagatggcttttggctcggcgagcaactggtctgctggcaagccggtaccactccctggaatatctttcccgtgatctccttgtacctgatgggggaagtcaccaaccagagctttcgcataactatactgccccagcagtacctgcgacccgtggaggatgtggctactagccaggacgactgctataaatttgcaatttcacaatcatcaacaggcacggtgatgggcgccgtgatcatggaggggttttatgtcgtttttgatcgggctcgcaaacggataggttttgccgtctcggcatgccacgtccacgatgaatttcgcacagccgccgtcgaaggaccgttcgtaaccctggacatggaagattgcgggtataacattccgcagacggatgaatcaacattgatgactatcgcttatgtgatggctgccatttgtgcactgtttatgctgcctctgtgcttgatggtgtgtcagtggtgctgtcttaggtgcctcaggcagcagcatgacgatttcgccgacgacatatccctcctgaagtag

SEQ ID NO: 180578 - DNA, 1191 bp, Artificial Sequence
  Description of Artificial Sequence: Synthetic coding sequence
atgggcgccctggcccgggccctgctgctgcccctgctggcccagtggctcctccgggcagccccagagttggcccccgcacctttcacactccccctgcgagtggccgccgccacaaatcgcgtagtcgctcccacccccggcccaggaaccccagctgaacggcacgcagatggcctggcactggccctcgagccagcactggcctcccccgccggagcggccaactttctagccatggtcgataatctccagggggattccggacgtggttattatttagagatgctcatcggaacccccccacagaagctccaaatcttagttgatactggcagttctaattttgccgttgcgggcacccctcactcttatatcgacacgtattttgatacagagaggtccagcacataccgctccaaaggtttcgacgttactgtcaaatatacccagggaagctggactggctttgtcggagaggacctcgtaactatccccaagggattcaacacatcattcttggtcaatatcgccacaattttcgagtctgagaacttctttctgcctggaatcaaatggaatgggattctcggcctggcatacgcaaccctcgcaaaacctagcagtagcttggagacgttcttcgacagtttagtcacccaggccaatattcctaatgtgttctctatgcagatgtgtggggctggccttcctgtagccggcagtggaacaaatggtggttctcttgtgctgggtgggattgaaccttcgctctataagggggacatttggtatacccctattaaagaggaatggtattaccaaattgagattctgaagctggagatcggagggcagagcctcaacctcgactgccgggaatacaacgctgataaagcgatagtggacagtggcacaactttgcttagacttcctcaaaaagtcttcgatgctgtagtggaagctgtggcacgcgcctccctcatacccgagttctccgatggtttttggactggtagccagctggcgtgctggacaaatagtgagacgccctggtcctacttccctaagatatccatttatctcagggacgaaaatagtagcagaagctttcgtattactatccttccccagaaactgcaggttctccagtgcttgaagtttcctggtctgagtcagcagcggatgtag

SEQ ID NO: 180579 - DNA, 1557 bp, Artificial Sequence
  Description of Artificial Sequence: Synthetic coding sequence
atgggcgccctggcccgggccctgctgctgcccctgctggcccagtggttactgcgcgcagcccctgaattggctcccgcaccttttaccctgcccctgcgtgtagctgcggccacaaatcgagtcgtcgcccccactcccggccccggaacacccgcagagcggcatgccgacgggttagcactggcactggaaccggccttggctagccctgccggggccgctaacttcttagccatggtggataacctgcagggtgatagcgggcgcggctactatctggaaatgcttataggcacgccgccacagaaactgcaaattctcgtagatacaggcagttctaacttcgctgtggcgggaacaccgcacagctatatagatacctacttcgatacagaacgatcatctacctataggagcaaagggttcgatgtgactgtgaaatacactcagggctcctggactggatttgtgggcgaggacctcgtgaccattcctaaaggcttcaacacctcttttcttgtgaatatcgctacgattttcgagagcgaaaatttttttctacctggaattaagtggaacggcattcttgggctagcttacgccactctcgccaaacccagctcttcattggagacgtttttcgatagcttagtcacccaggctaatatacctaatgtgttttctatgcagatgtgcggggctggtttgcctgtggccgggagcggaacaaatggtggatccctggtactgggcggtatagaaccgtccctttacaaaggagatatctggtacacgcccatcaaggaagaatggtactaccagatcgagattttaaaactggaaatcggaggccaaagtctgaatctggattgcagggaatataacgcagacaaagcgatcgtggatagcggaactacccttctgcgccttccgcaaaaggtctttgacgcagttgtggaagccgtggctcgggctagtcttattccagagttctcagacggattttggacgggaagccagttagcctgctggactaatagtgagacaccttggagctacttccctaagatctctatttatctgagggatgagaactccagccgttcctttcgaattacaatcctgccgcagttgtacatacagcccatgatgggcgcgggccttaactacgagtgctatagattcggaatctcccccagcaccaatgctctggtgatcggagcaactgtgatggaaggcttttatgtgatcttcgaccgggcacagaagagagtgggatttgcagccagcccttgtgctgagatagccggcgccgccgtgtctgagatcagtggtccctttagcactgaggatgttgctagtaactgtgttcctgcacagtcattaagtgagcccattttatggatcgtgtcatatgctctgatgtccgtctgcggggccattctcctggtgctgattgtgctcttactgctgccgttccgctgccagaggcgcccccgtgatcccgaagtagtgaacgatgaaagtagcctggtccgacatagatggaaatag

SEQ ID NO: 180580 - DNA, 1407 bp, Artificial Sequence
  Description of Artificial Sequence: Synthetic coding sequence
atgggcgccctggcccgggccctgctgctgcccctgctggcccagtggctgcttagggccgccccggaactggcacccgcccccttcaccctccctctgcgcgtagccgctgccacaaatagagtggtggctcccacccccgggcccggtactccagcagagcggcacgcagatggcctcgccctcgctctggagccagcactcgctagtcccgcaggcgcagccaactttctggcaatggtggataatttacagggggactccggtcgaggctactatttggaaatgctcataggcacaccaccgcagaagctgcagatcctggtggacacaggcagcagcaattttgccgtcgccggcacccctcactcctatatcgacacgtactttgatactgagagatcctctacttacagaagcaaaggctttgatgttacagtcaagtatacccaaggctcctggactggctttgtgggagaagacctagttactatccctaaggggttcaatacctccttcctcgtgaatatcgccacaatttttgagtctgagaacttctttttaccaggcatcaaatggaatggaatcctgggtctcgcgtacgcgactctggctaaaccctccagcagcctggaaaccttcttcgatagtctggtgacccaggcgaacatacccaacgtgttttctatgcagatgtgcggagccggactacccgtggctggaagcggcacaaatggagggtcgcttgtattgggagggatcgaaccctctctttataagggcgatatctggtacacccctatcaaagaagaatggtattaccagatcgaaattctcaagttagagatcggtggtcagtcacttaatttggattgcagagaatataatgcggataaagccatcgtcgattctgggacaacactcctgaggctaccccagaaagtgttcgatgcagtcgtcgaagcggtcgccagggcttcactgctgtacatacaaccaatgatgggagctgggctgaactatgagtgctacagattcggaatctctccttctactaatgctctcgttatcggtgcgaccgtcatggaaggcttctatgtgatattcgaccgggctcaaaaaagggtcgggttcgcagctagcccttgtgccgagatcgctggggcagctgtgtcagagatttccgggcctttttccactgaagacgtggcgagtaactgcgtgcctgctcagtcactttccgagcccatattgtggatcgtgagctacgccctcatgagcgtgtgcggggcaatcctgctcgtcctgatcgtcctgttacttttacctttcaggtgccagcggcggccgagggacccagaggtcgtgaacgatgagtcctcgctggttcgacacaggtggaagtag

SEQ ID NO: 180581 - DNA, 1272 bp, Artificial Sequence
  Description of Artificial Sequence: Synthetic coding sequence
atgctgatcggcacccccccccagaagctgcagatcctggtggacactgggagctccaactttgcagtggccggaacacctcatagctatatcgacacctactttgatactgaacgaagctctacttaccgctctaagggatttgacgtgactgtaaaatatactcagggtagctggaccggatttgtaggagaggatctggtgacgatccccaagggcttcaatacctcctttttagtcaatatcgctacaatcttcgaatccgaaaacttcttcctgcccggcattaagtggaacggtatactaggactcgcgtacgcaactcttgctaagccgtcaagttcacttgagacttttttcgattctctcgtaacccaagcaaatatcccaaacgtgtttagcatgcagatgtgcggagcggggcttcctgtagccggcagcggcacaaatggagggagtctagtgctgggcggcatcgaaccctccctgtacaagggtgatatctggtacaccccaattaaggaagagtggtattatcaaatagagattctgaagcttgagattggtggacaatcccttaatcttgactgtcgcgagtacaatgccgataaggcaatcgtcgattcagggacaacactcctgcggttgccgcaaaaggtgttcgacgccgtggtggaagccgtggcacgagcctccttgatacctgagttctcagatgggttttggaccgggtctcagctcgcttgttggactaattctgagactccttggtcatacttcccaaagattagtatttacttgagggatgaaaacagtagtagaagcttccgcataaccatacttccacagctgtatatccagccgatgatgggcgcggggctcaattacgagtgctacagatttgggatctcaccatccactaatgcgctggtaatcggagccaccgtcatggagggcttctatgtgatctttgacagagcgcagaagagggtcggattcgcagcctccccgtgtgctgagatagccggggccgctgttagcgaaatcagtggaccatttagtacagaggacgtggcaagcaattgcgtacccgcgcagagcttgtcagaaccaatcttatggatagtgtcctatgctctgatgtccgtctgtggggcaattttgcttgtcttgatcgtgctgctgttattaccttttagatgccagcggcggcctcgagacccggaggtggtgaatgacgaatcgagtctcgtgaggcacagatggaaatag

SEQ ID NO: 180582 - DNA, 576 bp, Artificial Sequence
  Description of Artificial Sequence: Synthetic coding sequence
atgccccggagcctgtggctgggctgcagcagcctggccgacagcatgcctagccttaggtgcctgtacaaccctgggacgggggccctgactgcgttccagaactcttctgaaagggaggattgcaataacggcgagccccctcgaaagatcatcccagagaagaacagcctcagacagacatacaacagttgtgctaggctctgtttaaatcaggaaacggtctgtttggcgtcgactgctatgaaaaccgaaaattgtgtcgctaaaaccaaactcgcaaacggaacaagctctatgattgtccccaaacagcgtaagctctcagcctcttacgagaaggaaaaagagctttgcgtgaagtatttcgagcagtggtctgagtccgatcaggtcgagtttgtggagcacctgatttcacagatgtgtcactaccagcacgggcatatcaactcatacctcaagcctatgcttcagcgcgattttattacagctctgcccgcacgaggactggatcacattgcagaaaacatcctgtcctatctcgatgcaaaatccttgtgcgccgccgagtag

SEQ ID NO: 180583 - DNA, 1818 bp, Artificial Sequence
  Description of Artificial Sequence: Synthetic coding sequence
atggaccccgccgaggccgtgctgcaggagaaggccctgaagttcatgtgcagcatgccaaggtcattgtggctcggctgcagctcactcgctgacagtatgccgagcttgcgctgcttgtataaccctggcaccggagctctgacagctttccagaactcaagtgagcgcgaggattgcaacaatggcgaaccccctcggaaaatcattcccgaaaagaacagtctgaggcagacctacaacagctgtgccagactgtgtctcaatcaggagacggtttgtctcgcatccacagcgatgaagaccgagaattgcgttgccaagaccaagcttgccaacggcaccagttccatgatcgtcccaaaacagcgcaagttaagtgcttcatatgaaaaggaaaaagaactgtgcgttaagtatttcgaacaatggagtgagagtgatcaggtcgagtttgtcgagcatctgatcagccaaatgtgccactatcagcacgggcatatcaatagttacctgaagccgatgctgcagcgggatttcatcaccgctctgcccgctagaggcctggaccacatcgcagaaaatatcctttcctatctagacgcaaaaagtctgtgcgccgccgagctggtctgcaaagagtggtaccgcgtgaccagtgacggaatgctctggaagaagctgattgagagaatggtcagaactgacagtttgtggaggggcctagccgaacgcaggggatggggtcaatacttgttcaagaataaaccgcccgacggcaacgctcctcccaacagcttctatcgagccctctaccctaaaattatccaggatatagagacaatagagtctaattggcgctgcggcaggcatagtttgcagcggatccactgtaggtctgaaacatctaagggagtttactgtctgcagtacgatgaccagaaaattgtgtccggcctgcgagacaatactattaaaatctgggacaaaaacacacttgagtgtaagagaattctgacgggccacaccgggtccgttctctgccttcagtatgatgagagggtcatcattaccggctctagcgatagcaccgtgagggtgtgggatgttaataccggggaaatgctcaacacccttattcaccattgtgaggcggttttacaccttcgatttaataacggcatgatggttacatgtagtaaggatcggagtatcgctgtgtgggacatggctagccctacagacatcactctgaggcgggtcctagtgggacacagggccgctgtgaatgtcgttgatttcgatgacaagtatatcgtttcagcaagtggagaccggacgattaaggtttggaatacatccacatgtgaatttgtcagaaccctcaacggtcacaagagaggcatcgcatgtttacagtaccgcgacagattggtggtgagcgggagttcggataatactataaggctttgggacatagagtgtggggcttgcctgcgcgttctggagggacacgaagagctggtgcgatgcatccgctttgacaacaaacggatagtctctggcgcctacgatgggaaaatcaaggtctgggatctcgttgccgccctggatccacgggccccggccggaactctgtgtcttcggaccctcgtggaacatagtggaagagtgttcaggttacagtttgatgagtttcagatcgtgagttcgtctcatgacgataccattttaatctgggacttcctgaatgaccctgccgctcaggctgagccaccgcggtctccttctagaacatacacatatattagcaggtag

SEQ ID NO: 180584 - DNA, 1695 bp, Artificial Sequence
  Description of Artificial Sequence: Synthetic coding sequence
atgtgcagcatgccccggagcctgtggctgggctgcagcagcctggctgacagcatgccctcactaaggtgcctctataacccaggaactggcgccctgacagctttccagacatataattcctgcgcacgactctgcctgaaccaggagacagtttgcctcgcgtcaaccgctatgaagactgagaattgcgtggctaagactaaactcgcaaacgggacctcttccatgatcgtgcctaaacagcgtaagctcagcgcttcatacgagaaagagaaggaactgtgtgtcaaatattttgaacaatggagcgagagtgatcaggttgaatttgtggaacatctgattagccagatgtgccactatcaacacggtcacatcaactcttatctgaagcctatgctgcagagagactttataacagccctaccagcccgcgggctggatcacatcgcagaaaatatattgtcttatcttgacgctaaatctttgtgtgctgctgagctggtgtgcaaagagtggtaccgggtcacctcagatggcatgctgtggaagaaacttattgagcgaatggttcgtactgattccctttggagggggttagctgaaagacggggctggggccaatatctttttaagaacaaaccacccgacggaaatgctcctccaaacagtttttatagagccttatatcccaagatcatccaggacatcgaaactatcgaaagcaattggcgttgtggaaggcactccctgcagcgaatacactgtaggtccgagacctctaagggcgtctactgtttacagtacgacgatcagaagatcgtgagcgggctcagggacaataccatcaagatctgggacaagaataccctagaatgcaagaggatcctgacgggccacactggcagcgtactgtgtctccagtatgacgagcgagtaattatcaccggctccagcgacagtaccgttcgggtgtgggatgtaaatacaggtgaaatgttgaacacactcatacaccactgcgaggcagtgctgcatctgaggttcaacaacggaatgatggtgacctgcagtaaagaccggagtatcgccgtgtgggatatggcctctcccaccgacattacactccggagagtgctggtgggccacagagctgccgtaaatgtcgttgactttgatgacaaatatattgtgtctgctagtggggacagaacaattaaagtctggaataccagcacctgcgagttcgtgaggacactgaatggacacaagaggggcattgcatgtctgcaatatcgagacagactggtcgtgagtggcagcagtgacaacacaattcgtttatgggacattgagtgtggggcctgtctgagggtgctcgagggacacgaagagttggtgaggtgtatcagattcgataataaacggattgtttccggggcgtatgatggaaagatcaaggtgtgggacttagtcgcagcactagacccaagggcccccgctggaactctttgcttgcgtactttggtggaacactctggtagggtcttccggttgcaattcgacgaattccagattgtgagcagctcccatgacgacacaatccttatttgggattttcttaatgacccagcggcccaggccgaacctccacgatccccatccagaacttacacctacatatctcgctag

SEQ ID NO: 180585 - DNA, 1710 bp, Artificial Sequence
  Description of Artificial Sequence: Synthetic coding sequence
atggaccccgccgaggccgtgctgcaggagaaggccctgaagttcatgaactcctccgagcgagaggattgcaacaacggcgagcctccgagaaagattatccccgagaaaaactcactgagacagacatataattcatgcgcccgcctctgcctgaatcaggaaacagtgtgtctcgcctctaccgccatgaaaacagaaaactgtgtagccaagacgaagctggcaaacggcaccagctcaatgattgtaccaaagcaacggaagctatcggcatcttacgaaaaagagaaagagctctgcgtaaagtacttcgaacaatggtcagaatccgaccaggtggagttcgtggaacacctgattagccagatgtgtcattaccaacatggccacatcaactcctatctgaagcccatgctgcagcgcgatttcatcactgcactgcctgcaagaggccttgaccatatcgctgagaatattctatcctacctggacgctaagagcttgtgcgcagccgaactggtgtgtaaggagtggtatagggtgaccagcgatgggatgctgtggaagaagctgattgaacgtatggtccgcacagattcgttgtggagaggcctggccgaaagaagaggctggggacagtacctgttcaagaacaagccccccgacggcaatgcccccccgaacagtttttaccgtgcgttgtatcccaagataattcaagacattgaaacaattgagtctaactggagatgtggcagacactccctccagcgcatccattgccgatcagagacctcaaagggcgtgtactgcctgcagtacgacgaccagaagatcgtgtccggactccgcgacaacacaataaagatatgggacaagaacactctagaatgtaagcgcattctaacaggccacactggaagtgtgctctgtctgcaatatgacgagagagttattataacaggctctagtgacagtacagtcagagtgtgggacgttaataccggtgagatgcttaacaccctgatacaccactgcgaagctgtcctgcatctcagattcaacaacggcatgatggtgacatgttccaaagacaggtctatcgccgtgtgggatatggcgagcccgactgacattaccctgcgaagggttctggtgggacacagagcagccgtgaatgtagtggactttgatgataaatacatcgtcagtgcctctggggatcgaactattaaggtgtggaacactagcacttgcgagttcgtgcggaccctgaatggtcacaagagggggattgcatgtctgcagtatcgggatagattagtggtttccggaagctccgacaatactatcaggctgtgggacatcgagtgtggcgcatgtcttagggttctggagggccatgaggaactcgtaaggtgtatacgctttgacaacaagaggatcgtctccggagcatacgatgggaagattaaagtgtgggatttagtggccgccctagacccccgagcacccgctggaactttatgcctgcgcacactcgtagagcactcaggacgcgtttttcgcctccagttcgatgagttccagattgtaagctctagtcacgatgacacaattctcatctgggacttcctcaacgaccccgccgctcaggccgaacctccacgaagtccctctagaacatacacatacatctcgcggtag

SEQ ID NO: 180586 - DNA, 126 bp, Artificial Sequence
  Description of Artificial Sequence: Synthetic coding sequence
atggaccccgccgaggccgtgctgcaggagaaggccctgaagttcatgacttacaactcatgcgcccgactgtgcctgaaccaggagaccgtgtgtttagcttccaccgccatgaaaaccgaatag

SEQ ID NO: 180587 - DNA, 327 bp, Artificial Sequence
  Description of Artificial Sequence: Synthetic coding sequence
atggtgaccctgctgcccatcgagggccaggagatccacttcttcgagatcctggagtcggagtgcgtgttgtacacgggttggatcgagagagctagtggctctagtatttacccagaagcgaaggccagactgccattggaagctttgctcggctccaataaggaaccaatgctgccaaaggagacagtgttgagtctgaaacggtacaacttgggtagcagtgctatgaagagaaatgtgcctgggcatgtcctgcagcggcccagctacctgacaaggatccaggtgacccttctgtgtaactctagcgccgaagcactgtag

SEQ ID NO: 180588 - DNA, 1521 bp, Artificial Sequence
  Description of Artificial Sequence: Synthetic coding sequence
atggagcagctggacgtgttcatcagcatcaagcccaagcccaagcagccctccaaatccgtgatcgtaaagtccgtcgagcgcaacgccctaaatatgtacgaagctagaaagtgtctgctgggcctggagagctccggagtgacaatcgccactagtccgtctccagccagctgcccagccggactcgcatgcccatctttggacatcctcgctagcgccggtcttggtctgacagggctcggtttactcggccccactaccctgagcctgaacaccagtaccacaccgaactctttactgaatgctctgaactcaagcgtgtcccctcttcagagcccgagtagcggtaccccatcccccacactgtgggctccccctttggccaatacttcctcagccacaggcttctctgccattcctcacttaatgatcccttcaaccgcccaggccacgctgacaaatattctgctctctggggtacccacctatggacacaccgcaccatctcctccccctggattgacccccgtcgacgtccacataaattccatgcaaactgaaggcaagaagatttccgccgccttgaatgggcacgcccagtcaccagacatcaagtatggcgccatctctacctcctccctcggagaaaaggtgttaagtgcgaaccatggcgacccttccattcagaccagtgggtccgaacaaacttccccgaagagctcaccaactgagggctgtaacgatgccttcgtagaggttggaatgccgcggagcccctcacactctggtaacgcaggggatctcaagcaaatgatgtgtccctcaaaagtgtcctgcgcgaaacgccagaccgtggagctcttgcaggggacaaagaacagccatctgcattccactgatcgactgctcagtgatcccgagctgtcagcgaccgagtctccgctcgccgataaaaaagcccctggatccgagcgagccgcagagagagccgctgcagcccagcagaattctgaaagggcgcacttggctcctcgctcttcttatgttaatatgcaagccttcgactacgagcagaagaaactgttggctacgaaggccatgctgaaaaagccagtcgtgacagaggtgaggacacctacaaatacatggtctggattagggttcagcaagtctatgcctgcagagactatcaaagaactgaggagggctaaccatgtgagttataaaccaactatgacaacaacttatgaagggagcagtatgagtctcagcaggagcaattcccgagagcacctggggggtgggtccgagagtgacaattggagggatcgcaatgggattgggcctggtagccacagcgagttcgccgcctcaatcggtagtcccaagagaaagcagaacaagagcagcgaacggtgcgtactttgcacattattgggcatcccaaggctggagtgtgtctatcttgggtggagcatcacagactgcggactgagtgatttcaaatgcctggtttag

SEQ ID NO: 180589 - DNA, 2925 bp, Artificial Sequence
  Description of Artificial Sequence: Synthetic coding sequence
atggccgcccagggcgagcccggctacctggccgcccagagcgaccctggaagcaatagtgagcggagtacagattctcccgtccctggcagcgaggatgacctggtggctggggcaaccctgcactcacctgagtggtccgaagaacggttccgcgtcgatagaaaaaagttagaggccatgctccaagcggccgccgaaggaaaaggtcgcagtggcgaggacttcttccagaaaattatggaggaaactaacactcagattgcgtggcccagcaagctgaagataggcgccaaatctaagaaagacccacacattaaagtctctggaaagaaagaggatgtgaaagaagccaaggaaatgattatgtccgtgctggatacaaagtcaaacagggtgactttaaagatggacgtgtcccacacagagcacagccacgtgattggcaaaggtggtaataatattaaaaaagtgatggaagaaaccggttgtcacatacattttcctgattctaaccgcaataaccaagccgaaaagagtaatcaggtttctatcgccggtcaacctgcgggcgtggaaagcgccagagtacgaattcgtgaactgctccccctcgttctgatgtttgaactacctattgctggaatactccagcccgttcccgacccaaattccccgagcatccagcatatttcacagacgtataatatatcagtgtcctttaaacagcggtcaagaatgtatggggccacggtgatagtccgcggatctcagaacaacactagtgcggttaaagaaggcaccgccatgcttctggagcacctggctgggtccttggcaagcgcgatccccgtttccacacagctggacatcgctgcccagcaccacttgttcatgatgggacgtaacggcagtaatataaaacacatcatgcagagaactggcgcacagatacacttccctgatccctctaacccccagaagaaatctacagtgtacttacagggaactatcgagtccgtatgcctggctcgccagtatctgatgggctgtttacccctggtgctgatgttcgacatgaaagaagaaatagaagtggacccacagtttatagcgcagctgatggaacagctcgacgtgttcatttctattaagccaaagcctaaacagccttcaaagagcgttatcgtaaagtctgtggagcggaatgctctgaatatgtatgaagcaagaaaatgcctgcttggacttgagtccagcggggtgactattgccacttcccccagtcctgccagctgcccagccggattggcctgtcctagcctcgatattttggcttcagctgggttaggactcaccggcttgggcctgctcggacccaccaccctttctctgaacacctcaactacacctaacagtcttctgaacgcactgaattcgtcagtgtcacctctgcaatctccatcctcaggaacgcccagtccgacactgtgggcccctcctctggctaatacaagctccgcgaccggcttcagcgcgatccctcacctgatgatccccagcaccgcccaggcgacccttacaaatattcttttgagtggagtaccaacttatggccacacggctccaagcccgccacctggcctgacccctgtggacgtacatatcaactcaatgcaaacggaaggtaagaaaattagtgctgcccttaacgggcatgctcagtcccccgatattaaatacggagctattagcacctcctctttaggtgagaaagtgcttagcgccaaccacggcgatccttcaattcagacttctggtagtgaacagacgtctcccaagtcctctcctacggagggttgcaatgacgcgttcgtggaagtgggcatgccaaggtcaccctctcactctggtaacgccggagacctgaagcaaatgatgtgtccatctaaggtgagttgtgccaaacggcaaacggtggagctccttcagggcaccaagaatagccatctgcactcaactgaccgcttgctttccgaccccgagttgagcgcaaccgaaagccctctcgctgacaaaaaggcacccggatccgagcgggcagcggaacgggccgccgccgctcaacagaactccgaacgggcccacctggccccccggagctcgtatgtcaatatgcaggcattcgattacgagcagaagaaacttctggccaccaaggcaatgctgaagaaaccagtcgtaacagaagttcgcacccccaccaatacgtggtccggcctgggattcagcaagtctatgcccgcggaaactatcaaagagttgcgaagggcaaaccacgtaagctataaacccaccatgacaacaacctatgagggatcaagtatgtccctgagcagatctaacagcagagaacacctgggaggggggagtgagtctgacaattggcgcgaccggaatggcatcggtcctgggtctcattccgaattcgccgcaagtatcggcagcccaaagagaaagcaaaataaaagcaccgaacattacctaagttcaagcaactacatggactgcattagtagtttgacaggttccaacgggtgcaacctgaacagttctttcaaaggctccgatcttccagagctttttagcaagttaggccttgggaaatacactgacgttttccaacagcaggaaatcgacttacagactttcctgaccctgactgaccaggaccttaaggagttgggcatcaccacatttggcgcccgtcgcaagatgctgcttgccatatcagaactgaataaaaaccgacggaagctgtttgagagccccaacgccagaacgtcattcctggagggcggtgcaagtggtaggctgccccgtcaatatcattccgatatcgcgagcgtgtccggacgatggtag

SEQ ID NO: 180590 - DNA, 2928 bp, Artificial Sequence
  Description of Artificial Sequence: Synthetic coding sequence
atggccgccgaggaggtgctgcagaccgtggaccactacaagaccgagatagagagactcacgaaagagttgacggagacaacccacgagaagattcaagccgctgaatacgggctcgtggtgctagaggaaaagctcacgcttaagcagcaatacgatgaactggaggccgagtacgactctctgaaacaggagctggagcagttgaaggaagccttcggccagtcatttagcattcatcgcaaggtggccgaggatggagagacccgcgaagagaccctcctccaggaatcggcaagcaaagaggcatactatttgggtaagatcctcgagatgcagaacgaactgaaacagtcccgggctgttgtgactaacgtccaggcagaaaatgaaagactaacggccgtggtccaggacttgaaagagaacaacgaaatggtggagttgcagagaatcagaatgaaagatgagatccgggagtacaagttccgggaagcccgactcctgcaggattacacagagctggaggaagaaaatattactctgcaaaaactcgttagtaccctcaaacagaatcaagttgaatatgaaggactgaaacatgagattaaaagattcgaagaagaaacagtgctcttaaactctcagcttgaggatgccatacggctgaaggagattgcggagcaccagttggaggaggctctagagactcttaagaacgaacgcgaacagaaaaataacctgcgtaaagagttgagccaatacatctcccttaatgacaatcacatcagcatctctgtcgacggtctaaaattcgccgaagatgggagtgaacctaacaacgatgataaaatgaacgggcacatccatggtccgctggttaaactgaacggagactaccgtacaccgaccctgcggaagggggaaagcctgaaccctgtgtcggacctgttctcagagctgaacattagtgagattcagaagctgaaacaacaactcatgcaggtggagagagagaaagctatcttgcttgctaaccttcaagaatcacagacacagctggagcacacgaagggagcactgacagaacaacacgaacgggtgcaccggttaactgagcatgttaacgctatgcggggcctccagagttctaaggaattgaaggcagagctcgatggtgagaaaggccgcgacagtggcgaggaagcccatgactacgaggtggatatcaacggtctcgagatcctcgagtgtaagtaccgtgtagctgtgactgaggtgattgatctaaaagcagaaattaaggctctgaaggagaagtacaataagtccgtggagaactatacagacgaaaaagccaaatatgagtcgaaaattcagatgtacgacgaacaggtcaccagtcttgagaagacaaccaaggagagtggagagaagatggcacacatggagaaagagctgcagaaaatgactagcatcgccaacgaaaaccactcaacattgaacactgcccaggatgaactggtcacattctcagaggaactggctcagctgtatcaccacgtttgtctgtgcaacaatgagacgccaaatagagtcatgctggattactacagacagagcagagtcaccagatcgggctccctcaaagggcctgatgatcccagaggactgctcagccccaggcttgcaagacgcggcgtgagttcgccagtggagacccgcacatcttccgagcccgtggcaaaggaatcaacagaagcgtccaaggaaccttctccaactaagacccccaccatctccccagtgattacagccccacccagttccccagtactcgatacatccgacattcggaaggagccaatgaacatctacaatttaaacgctatcatcagggatcagatcaaacacctgcagaaagccgtggatcggtctctccagcttagcagacagcgcgctgctgcaagagagctcgcacctatgattgacaaagacaaagaagctctaatggaggagattttaaagctgaagtcactcctatcaacgaagcgcgagcaaattgcaacactcagggctgtcctgaaggcgaacaaacagactgcggaggtggccttggccaacctgaaaaataagtatgagaacgaaaaagctatggtgacggaaaccatgactaagttgcgaaatgaactgaaagctctcaaggaggacgcagccaccttctccagtctgcgtgccatgttcgcgaccaggtgcgacgaatacgtgacacagttagatgagatgcaacgtcagctcgctgcagctgaagatgaaaagaaaaccctcaatacccttctcaggatggctatccagcagaaactcgccttgacacaacgcctcgaagacctggagtttgatcatgagcaaagcagaaggagcaagggaaagttgggcaagtccaagattggctccccaaaggtttccggcgaagcatccgtgacggttcccacgattgatacctacctcctgcactctcaaggcccccagacccccaacattcgtgtgagttctgggacacagcgcaaaaggcaattctcaccttcactttgcgaccagtctagaccaaggacttctggcgcctcgtacctccaaaatctgctcagagtgccacccgatcccacaagcactgaatcttttctgttaaaaggccctccatcaatgtcagagtttatccaggggcataggctaagtaaagagaaacgcctgactgtggcaccgccagattgccagcaacccgctgcaagcgtgccgccacagtgctcgcaactagccggacgtcaagactgtccaaccgttagcccagacaccgccctgccggaagagcagcctcattcatcttcccagtgcgcaccactccattgcctgagcaaaccaccgcacccttag

SEQ ID NO: 180591 - DNA, 2484 bp, Artificial Sequence
  Description of Artificial Sequence: Synthetic coding sequence
atggccgccgaggaggtgctgcagaccgtggaccactacaagaccgaaattgagagattgaccaaggagttgactgaaactacccacgaaaaaattcaggccgccgagtacgggctggtggtcttggaggagaaactcactcttaagcagcagtatgatgagctggaggccgagtacgacagtctgaagcaagagctggagcaactcaaggaagcatttggacagtcattttcaattcataggaaagtcgctgaggatggggagaccagagaggagacactactgcaggagtcggcctctaaggaggcctactaccttggcaagattctggagatgcagaacgagctgaagcagtctcgagcagtggtcacgaacgtgcaagctgagaacgagcgtctgacagccgtagtacaggacctgaaggagaataacgagatggtggagcttcagcgaatccggatgaaagatgagatcagggaatataagtttagggaagcaagattgctgcaggactataccgagctcgaggaggagaatatcactcttcagaagctggtatctacactcaagcagaaccaggtggagtacgagggcttaaagcacgagatcaagaggttcgaagaagagactgttcttttgaattcacagttagaggatgcaattcgactcaaggaaatcgctgagcaccaactggaagaggcgctggaaacactgaaaaacgagcgcgagcaaaagaataacctgagaaaagagttgagccagtacatctccctgaacgacaaccacatttcaatctcggtggatggcttgaagtttgccgaggacggcagcgaacccaacaacgatgataagatgaacgggcacattcatggtccattagtaaaattgaacggtgattatagaaccccgaccttgaggaagggcgagagtctgaacccagtatcagatctgttcagcgagctgaacatctctgagatccagaagttaaaacagcaacttatgcaggtcgagcgcgaaaaagccatcctgctggctaacctgcaggagtcccagactcaactcgagcatactaagggggcactcactgagcagcacgaaagggttcaccgcctaactgaacacgtgaacgccatgcggggactccagagctccaaagaacttaaagccgaactggacggggagaagggtagggatagtggtgaggaagctcacgactatgaagtggatattaatggattggagatacttgaatgcaaatacagagtcgccgtgaccgaagtgatcgatctcaaagccgagattaaggccctcaaagaaaagtacaataagtcagtcgagaattacaccgacgagaaggctaaatatgagtcaaagattcagatgtatgatgagcaagtgacttccttggagaagactaccaaggagagtggcgagaagatggcacatatggagaaggagctacaaaaaatgacctcaattgcaaatgaaaaccactccacactaaatacggcccaggatgaattggtcacattctctgaagagttggcccagctataccaccatgtgtgcctttgcaataacgaaactccaaatcgggtgatgctggactattataggcagtcacgcgtgacaagaagcgggtccctgaagggtccagatgacccaagagggctcttaagccctaggttggcccgccggggtgtgagttctcctgtggagacccggacctcctctgagcctgtagctaaggagtccacagaggcgtcaaaggagccttcacccaccaaaacgccaactatctcccccgtgatcactgctcctccttcttcccccgtcctggacaccagcgacatccgcaaggagccaatgaacatctataatctgaacgcgattattagggaccagattaaacacctccagaaggccgtcgaccgcagcttgcagttgtctagacaaagggcagcagcccgggagctcgccccaatgatcgataaggacaaggaggcactcatggaagagatactcaaacttaaatcccttctctcaaccaagagagagcagattgcaacgctgcgagctgtcttgaaggccaataagcagaccgctgaggtggctctggccaacctgaaaaataagtatgaaaacgagaaagctatggtaacggaaactatgacaaagctgcgcaatgaattaaaagccctaaaagaggacgctgccacgttctcttcactgagggccatgtttgccactagatgcgatgaatacgtcacccagctcgacgaaatgcagcggcagctggccgctgctgaggatgaaaaaaagacactcaacactctcctaagaatggcaatacagcagaaactggctttgactcagcggctcgaggatctggaatttgaccacgaacagtctcgccgctcaaagggcaaactgggtaagtcgaagatcgggagcccaaaaactatctttactttccccctctag

SEQ ID NO: 180592 - DNA, 2508 bp, Artificial Sequence
  Description of Artificial Sequence: Synthetic coding sequence
atggccgccgaggaggtgctgcagaccgtggaccactacaagaccgaaatagaacgtctgacgaaagagcttaccgagaccacacacgagaaaattcaagccgcagaatatggtctagtagtactggaagagaagttgaccctgaaacaacagtacgacgagctggaggccgaatacgattccctgaagcaggagctggagcagttaaaggaggctttcggccagtctttttctatacaccggaaggtggccgaggacggagaaactcgcgaggagacactgctgcaggaaagcgcatccaaagaggcgtattatttaggaaagatcctggagatgcaaaacgaattaaagcagtcgagagccgtggtcacgaatgtacaggcagagaatgaacgactgaccgccgtcgtgcaggatctgaaggagaataatgagatggtggagctgcaacggatccgaatgaaagacgaaatccgcgagtacaagtttcgagaggcacgcctgctccaggactataccgaactcgaggaagagaatattacgctacaaaagctagtgagcactctgaagcaaaaccaagtagaatatgagggactgaaacatgaaatcaaacgcttcgaggaggaaacagttttgctcaacagtcagctggaggacgctatccggctgaaggagattgcagaacaccagctcgaggaggctctcgaaacattgaagaatgaacgggaacagaagaacaatcttcgtaaggagctatcccagtacatcagcctaaatgacaaccacatctctatcagcgtcgatggcttgaagtttgcagaggacgggtcagagcccaataacgacgataagatgaacgggcacatccacggcccactggtgaaactcaacggcgactaccggacccccactctcaggaagggggaatctctgaatccagtgagtgatctgttctctgagctgaacatatctgagatccagaagctcaagcagcagctcatgcaggtagaaagggagaaagcgattcttctggctaatctacaggaatctcagacccaactggagcacactaaaggggctctaactgaacagcacgaacgggtacataggctgacggagcatgttaacgcaatgagaggcctccagagcagcaaagaactgaaggccgaacttgacggcgaaaagggacgggattcaggggaggaggcccatgactacgaggtggacattaacggcctcgagatactggaatgcaagtatagagtagcagtcaccgaagtgattgacctgaaggccgaaatcaaagcgttaaaggagaaatataacaagtcggtcgagaactacactgacgaaaaggcaaagtacgagagtaaaatccagatgtacgacgagcaggttacatcccttgagaagactaccaaagaatctggcgagaaaatggctcatatggaaaaagaactccagaaaatgactagcatagccaatgaaaaccactccaccttaaataccgcccaggacgaactggtgactttctctgaagagctggcccagctgtaccaccatgtctgtctgtgcaacaatgaaactcctaatcgcgtgatgctcgattattatcggcagagcagagtcacacgcagcgggagtctgaaggggcccgacgaccctcggggacttttatcccccaggctggccaggcgtggcgtgtcctctcctgttgaaacgaggacatctagcgaacccgttgccaaggaaagtaccgaagcctccaaggagccttcaccaacaaaaaccccaaccatcagcccggtcatcacagcccccccgagtagccccgtgctggatacttcagacatcaggaaggaaccaatgaacatctacaacctgaacgccatcattcgggatcaaataaagcacttgcagaaggctgttgaccgctcactccagctgagcaggcagagagctgcagcccgggagctagcccccatgatagacaaagataaggaagcgcttatggaggaaatcctcaagctcaaatcactgttgagcacaaagagggagcagatcgccactttaagggctgtgctcaaggcaaataagcagaccgccgaagttgctttggctaacctcaaaaataagtacgagaatgagaaggcaatggtcactgagacaatgacaaagctgagaaatgaacttaaggcacttaaggaggatgccgctacgttcagctcattacgcgccatgtttgcaactcgctgtgacgagtacgtaacacagcttgatgaaatgcagcgccagttggcggccgcagaagacgagaagaagacactgaatacactgcttcgtatggctattcagcagaaactcgccctcactcaaagacttgaagatctggagtttgaccacgagcagtcacgccgttctaagggcaaactgggcaagtccaagattggaagcccaaaaattgtatcatcactgcttcccccttataggcactcagctcataattag

SEQ ID NO: 180593 - DNA, 2568 bp, Artificial Sequence
  Description of Artificial Sequence: Synthetic coding sequence
atgagcgcccccagcgaggaggaggagtacgcccggctggtgatggaggcccagcctgagtggctgcgggcagaagttaagagattatcccatgagctagccgaaacaaccagggagaagatccaggcggcggagtatggcttggcggttctggaagagaaacaccagctaaaattacagttcgaggagttagaagtcgactatgaagccatacgctcagagatggagcaactgaaggaggccttcggtcaggcccataccaaccacaagaaagtggccgctgatggtgaatccagggaagaaagcctgatccaagagagcgccagcaaggaacagtattatgtccggaaggttctcgagctgcaaaccgagctgaagcagctgcggaatgttctaactaacacacaaagcgagaacgaacggctggccagtgtggcgcaggagttgaaagaaattaaccagaatgttgagattcagcgaggccgcctccgtgacgatatcaaagagtataagttccgtgaagctcgcctcctgcaggactacagcgaacttgaggaggaaaacatctcactgcaaaaacaagtctctgtattaaggcaaaatcaagtagaattcgaggggcttaagcacgagatcaaacgattggaggaggaaacagagtatctcaactctcaactagaggacgctattcgcctgaaggagatttctgaacgccaactggaggaggctctcgaaaccctgaagacggaaagggaacaaaagaactctctacggaaagaactttcccactacatgtcaatcaacgactcattctacacaagtcacctccacgtgagcctcgacggtctgaagttttctgacgacgccgcggagcccaacaatgacgctgaggctttggtcaacgggtttgagcacggtggtctggccaaactgcctttggataacaagacgtctactccgaaaaaagaaggcctcgcaccaccaagccctagcctggtgagcgacctgttgagtgagttaaacatctcagaaattcagaagctgaagcaacagcttatgcaaatggagcgcgaaaaagccgggctcctggccacactgcaggatacacagaaacagctggagcacaccagaggcagtctttctgagcagcaggagaaagtgactagattgaccgagaatttatctgcgttgagacggttgcaagcttccaaggagcggcagacggccttagacaatgaaaaggatcgggattcccatgaggatggagactattacgaagtcgatatcaacggtccggagatccttgcctgcaaataccacgtggccgtggccgaagctggtgaacttcgagaacaacttaaggcattgcgcagtacccacgaggctagggaggcccagcacgctgaagaaaaggggcggtacgaggccgaaggccaagcccttacggaaaaggtttctctgctggagaaggcatcccggcaagatagagagctgctcgctagactggaaaaagagctgaaaaaagtgtccgatgtggcaggagaaacccagggatcgttgagcgtcgcgcaggatgagctcgttacgttttctgaggaacttgcgaacctttaccatcacgtttgcatgtgtaacaacgagactcccaatcgtgtgatgctcgactattatcgtgaaggtcaaggaggagcagggcggacatctcctggcggccgaacatcccctgaggcgagaggacggcgctcccccatccttttacccaaggggctgttggcacctgaagctggccgagccgatggcggcacgggagactcctcccccagtcctggctcatctctgccgagcccactctcagacccgagaagagaacctatgaatatatataatctcattgccatcatcagagaccagattaaacatctgcaggctgccgtcgacaggacgactgagctctcgagacagcggatcgcatcccaggagctgggtcctgctgtcgacaaggataaggaggcactgatggaagaaatcctcaaattgaaaagcctcctgagcacaaagcgggaacaaataactactctgcgcacagtcctgaaggctaacaaacaaactgccgaggtggctcttgccaatctcaagtccaagtatgaaaacgaaaaagctatggttactgaaacaatgatgaagctcaggaacgagctgaaagcccttaaagaagacgcagcaacattttcctctctcagggcaatgtttgctacccgatgtgacgagtatatcacccagctggatgaaatgcaaagacaactggcagccgcagaagacgaaaaaaaaacacttaatagcctactgaggatggccattcagcagaaattggctctgacccagcggcttgagctgcttgagcttgatcatgaacaaacccgtcggggcagggctaaggcggctccaaagactaagcctgctaccccctccgtgtcccacacatgtgcttgcgctagcgaccgggctgagggcaccgggctcgccaatcaggtgttctgcagcgagaaacacagcatttactgcgactag

SEQ ID NO: 180594 - DNA, 2475 bp, Artificial Sequence
  Description of Artificial Sequence: Synthetic coding sequence
atgagcgcccccagcgaggaggaggagtacgcccggctggtgatggaagcacagcccgagtggctccgcgcagaagtgaagagactgtcccacgagctggccgaaaccacccgagagaagattcaagctgctgagtacggtctagccgtgctggaagagaagcaccagttgaagttgcagttcgaagagttggaggtagactacgaggctatccgttccgagatggaacagctgaaggaggcctttggccaggcccacactaaccacaaaaaggtcgccgccgatggagagtcacgagaagagtcacttattcaggaatcagctagcaaagaacagtattacgtccgcaaagttctcgaactgcagacagaactcaagcaacttcgaaacgtgctcaccaatacacagtctgagaacgaacgcttagctagcgtcgcccaggaactgaaggaaatcaatcagaacgtcgagatccagaggggtcggctgagggatgacattaaagagtacaagttcagagaagcccgcctcctccaagattattcggagctagaggaagagaacatcagcctgcagaagcaggtgagtgtgctccgacagaaccaggtcgaattcgagggactgaagcacgagattaagaggctcgaggaggagacagagtatctgaactcccaacttgaagacgctattcgactaaaggaaatctccgaaaggcaattagaggaagccctcgaaactctgaagacggaacgggaacaaaaaaactccctgcgaaaagagctgtcccactacatgtccattaatgactcattttatacctcgcacctccatgttagtctcgatgggctgaaattcagtgacgacgccgccgaacctaataacgatgcggaagcgctagtgaatggttttgagcatgggggtctggctaagctgccactggataacaagaccagcactccaaaaaaggaaggcctggctccgccatcaccctccttggtgtccgacttgttatctgaactgaacatttctgaaatccagaagctaaaacagcaactaatgcagatggaaagagaaaaggctggcctcctggccaccctccaagacacgcagaaacaactggagcataccaggggctcactaagtgaacagcaggaaaaggtgacacgtctcacagagaatctgtcagccttgcgtcgcttgcaggcttctaaagaaagacagacagctcttgataacgagaaggatagagacagccatgaagatggtgattattacgaagtcgacattaatgggcccgaaattctggcatgtaagtatcatgtggcggtcgccgaggccggtgagctgcgtgagcagctgaaggccctcaggtcaactcacgaggcacgggaagcccaacacgcggaggagaaaggcagatacgaagccgaaggtcaggccttgaccgaaaaagtgagcctccttgaaaaggccagtcgtcaagatagggaactgttagcccggctggaaaaggagctgaagaaagtgtctgatgttgccggagaaacacagggatccctttctgtggcccaggacgaactggtcacattctccgaagaactcgcgaacctgtaccaccacgtgtgtatgtgcaacaacgaaaccccgaatcgggtcatgctcgattattatcgtgaggggcaaggaggtgcaggacgtacatccccaggtggcaggacctctccggaggcgcggggacggcggagtcctattctgctgcccaaaggactcctcgctcctgaggcgggtagggctgatggcggcacaggggactcttcccccagcccagggagtagcttaccgtcacccttgtcagaccctcggcgggaacctatgaatatctataatcttattgccattatccgggatcagataaaacacctacaggcggccgtcgaccggacaaccgaattaagccggcaaaggatagcaagccaggagttaggaccggccgtggacaaagacaaggaagccttgatggaggagattctgaaattaaagagtctccttagcaccaagagagagcaaattacaaccctgagaaccgttctgaaggctaacaagcagactgcagaggtggccctagccaacctaaagtctaaatacgagaacgaaaaggcaatggtgaccgaaactatgatgaagctgagaaacgaacttaaggcattgaaggaagatgccgccactttctcatccctgcgcgcaatgttcgctactcgttgtgatgagtacattacacagctcgacgaaatgcaacggcagttagctgccgccgaggacgagaagaagaccctgaactcgttgttgagaatggctatccaacagaaactggctctcacacagagactcgaactgcttgagctggatcacgaacagacgaggcgtggacgcgctaaagcagcaccaaagactaagccggctactccttctctgtag

SEQ ID NO: 180595 - DNA, 1107 bp, Artificial Sequence
  Description of Artificial Sequence: Synthetic coding sequence
atgtggcccctgtggcggctggtgagcctgctggccctgagccaggccttacccttcgagcagcgtgggttttgggattttacactggatgacggccctttcatgatgaacgatgaagaggcgagcggagctgatacctccggagttctggatcccgacagcgtgacccctacgtactccgccatgtgtccattcggctgtcactgccaccttcgagtggtgcaatgtagtgacctgggcctgaaatctgtgcccaaggagatttcccctgacacaactctgttagacttgcagaataacgacatttcagagctcaggaaagacgacttcaaggggttgcagcatctgtacgctttagtgctggtcaacaataaaatctcaaagattcatgaaaaagccttctctcctcttagaaagttgcagaaactgtatatatctaaaaaccatctggtagaaattccccccaaccttccgtctagtttggtcgagctgcgcattcatgacaaccggattcgcaaggttccgaagggcgtcttctccgggctccgcaacatgaactgcattgagatgggcggcaaccccttggagaacagcggctttgagcccggtgcctttgatggtctgaagctcaactatctccgaattagcgaagccaagctgacaggcatacctaaagacttacctgaaacattaaacgaactccatctggatcacaataaaatccaagccattgagctggaagatctgctccgctactctaagctgtatcgcctggggcttggccacaaccaaattcggatgatcgagaacgggtctctctcattcctgcctactctgcgcgaacttcacctggataacaacaaactcgcgcgcgtgccctccgggcttcccgacctgaagttgcttcaagtggtgtacctacactcaaataatatcactaaggtcggtgttaacgatttctgtcctatgggatttggcgtgaagcgggcatattataatggtatttcgctgttcaataaccccgttccttactgggaagtccagccagctaccttccggtgcgtgacggatagactagccattcaattcggcaactacaagaagtag

SEQ ID NO: 180596 - DNA, 924 bp, Artificial Sequence
  Description of Artificial Sequence: Synthetic coding sequence
atgtgccccttcggctgccactgccacctgcgggtggtgcagtgctctgatcttgggctgaaatctgtccctaaggaaatcagccctgacacgacccttctcgacctccagaataacgacatcagtgagctgaggaaggacgacttcaagggacttcagcacctatatgctctggtgctcgtgaacaacaagatttcgaagatccacgagaaggctttttctcctcttaggaagctccagaagctgtacatctctaaaaaccatctcgtcgaaatcccgccaaatctgccttccagcctggtggagctgcggattcacgataaccgcatccgcaaggtcccaaaaggggtattttctggccttcgcaacatgaattgcatagagatgggcgggaatccgctcgaaaatagtggctttgaaccaggggctttcgacggactcaagttaaactacttgagaattagcgaggctaagctaaccggaatcccgaaggaccttccagagaccttgaacgagttgcacctggaccacaacaagatacaggccatcgaattggaggacctgctgagatattccaagctgtaccggctagggctgggccacaaccagatcagaatgatagaaaacggtagtctgtcatttctccctactttaagggaactccacctcgataataacaagttggctagagttccatcgggactaccagacctgaaactattgcaggtagtgtacctgcactccaacaacattacaaaggtgggggtgaatgatttctgcccaatgggattcggagtcaaacgggcctattacaatggcatctccctgtttaacaaccccgtcccatactgggaagtccaacccgctacatttaggtgtgtaacagaccgcttggccatacaatttggcaactacaagaaatag

SEQ ID NO: 180597 - DNA, 924 bp, Artificial Sequence
  Description of Artificial Sequence: Synthetic coding sequence
atgtgccccttcggctgccactgccacctgcgggtggtgcagtgcagcgatctaggactgaagagcgttccaaaggagatctcacctgatacaaccctcctcgatctgcagaataatgatatcagtgagctgcgcaaagacgacttcaagggcctgcagcatctctatgcactcgtgctggtgaataataagatcagtaagatacacgaaaaagctttttcgccactgaggaaactgcaaaaactctacatctctaaaaatcacctggttgaaatcccgcctaatttaccctcctccttggttgagctaaggatacatgacaaccggatacgcaaagtgcccaagggcgtgttttcaggcttaaggaacatgaattgtattgagatgggaggaaacccacttgaaaactctggatttgagccaggcgctttcgacggtctaaagcttaattacctccggatcagcgaggccaagcttactgggattcccaaagacttgcccgaaaccttaaatgagttgcatctggaccacaataagattcaggcaatcgaactggaggacctgctacgatactctaagctgtaccgtctgggactgggacacaaccagattaggatgatcgaaaacgggagtctctccttccttcccaccctgcgggagctgcacctcgacaataacaaactcgcccgagtgccatcaggcttgcctgacctgaagttactgcaggtggtgtacctgcacagcaataacattaccaaggtcggggttaatgacttctgccctatgggcttcggcgtgaaacgggcatactataacgggatctctctcttcaataaccctgtgccctactgggaagtgcagccagccactttccgctgcgttaccgataggctcgcgattcaatttggcaactacaagaagtag

SEQ ID NO: 180598 - DNA, 717 bp, Artificial Sequence
  Description of Artificial Sequence: Synthetic coding sequence
atgtggcccctgtggcggctggtgagcctgctggccctgagccaggctctgccatttgagcagaggggattttgggattttacgctggacgatggccccttcatgatgaatgacgaagaagcctcgggcgcagatacatcgggtgtcctggacccagattcagttactcctacatattctgctatgtgtcccttcggctgccactgccacttgagagtggtgcagtgtagcgatctagggctcaagtcagtgccaaaggagatttcccctgacactactctactggacctacagaataacgatatatcagaacttagaaaggacgatttcaaaggtctccagcatctatacgttcggagctgggaggaacctgccggattgcagcagagggctggcgtgcgggctttggtgctcgtcaataataagatctccaagatccacgaaaaggcatttagcccactgcgcaaattacagaagctttacattagcaagaatcatctggtggaaattcctcctaatctgccctcctctctggtggagttgagaattcatgataaccggattcgcaaggtgcccaaaggggtcttttcaggcctgaggaacatgaactgcattgaaatgggcggtaacccattggaaaatagcgggtttgagccaggcgcatttgacggactcaaactcaattacctgagaataagcgaggctaagttaacctag

SEQ ID NO: 180599 - DNA, 1257 bp, Artificial Sequence
  Description of Artificial Sequence: Synthetic coding sequence
atgatccagctgaccgccacccccgtgagcgccctggtggacgagcccgtgcacattcgcgccactgggctcattccatttcaaatggtttcctttcaggcaagcctggaggacgagaacggggacatgttttattctcaagctcattacagagctaacgagttcggagaggttgacttaaatcacgcttccagtctaggcggcgattacatgggggtccacccgatgggcctcttttggtcattgaagcctgaaaaattgttgacacgtctgttaaagcgcgacgtgatgaaccgccccttccaggtgcaagttaaactgtatgacctggaactgatcgtgaataacaaggtcgccagcgctcctaaggccagcctcaccctggagcggtggtacgtcgctcctggtgtgacccggattaaggtgcgggagggtcgtctccgaggagcactgttcttgccacctggggagggattgtttcccggcgtgatcgatttgtttggcggactggggggcctgcttgaatttcgagcaagcctccttgcttctcgtggctttgcttctctcgctctcgcgtatcacaactatgaggaccttcccagaaaaccagaggttacggacctggagtatttcgaggaagccgcaaacttcctgctgcgacatccaaaagttttcggctcaggtgtgggcgtggtgtcggtgtgccagggagtgcagatcggcctgtcgatggctatttatctgaagcaggttactgcaacagttctgatcaacggaacaaactttccatttgggatcccacaggtgtaccatgggcagattcaccaacccctacctcattctgcacagctgataagcactaacgctttaggacttcttgagctgtaccgcacattcgagactacacaggtgggtgccagccagtatctctttccaatcgaagaggcccagggtcaattcttgtttatcgtcggtgagggcgataaaaccatcaacagcaaggcccacgctgaacaggccatcggacagttgaagcggcatggtaagaataattggaccctcttgagttaccccggggctggtcacctaattgaacctccgtatagccccctttgttgtgcttccaccacacatgatctgaggttgcactggggcggggaagtgatcccccatgctgcggcccaggagcatgcatggaaagagattcagagattccttaggaaacacttgattcccgacgtcacatctcagctgtag

SEQ ID NO: 180600 - DNA, 1257 bp, Artificial Sequence
  Description of Artificial Sequence: Synthetic coding sequence
atgatccagctgaccgccacccccgtgagcgccctggtggacgagcccgttcacattcgggccacggggctgatccctttccagatggtctctttccaagccagcctcgaagatgaaaacggtgacatgttctatagccaggcacactacagagctaatgagttcggtgaagtggatcttaatcacgcaagtagccttggcggagactatatgggcgtgcacccaatgggactgttttggtcactgaaaccagagaagctgctcaccagactgctcaaaagagatgtcatgaatcggccctttcaagtgcaggttaagttatacgacctcgaacttattgtaaataataaggtcgcttcagctccaaaagccagtttaacattggagcgttggtatgttgcgcctggcgttactagaatcaaagttcgagagggcaggttacgcggagcattgttcttgcctccaggagagggtctttttcccggtgtcatcgacctttttggtggcttgggcggactccttgagtttagagccagcctgctggcttcccgagggttcgccagtttggccctggcctatcataactacgaggatctgcctaggaaaccggaagtgactgatctggaatacttcgaagaagcagccaacttcttgctgcgccatcccaaagtcttcggaagtggcgtgggggttgtgagtgtgtgtcagggcgtccagatcgggctgtcaatggcaatttatctgaagcaggtgaccgcaacagtgctgattaatggcaccaacttccccttcgggattccacaggtataccacgggcaaatccaccaacccctgcctcatagcgcccagttgatatccacaaacgcactcggattgttggaactgtaccgtacatttgagactacacaagtgggtgcgagtcagtacctgtttccaatcgaagaagcccagggacaatttctctttatcgttggagaaggcgataaaactattaattccaaggcccacgccgagcaggccattgggcagctgaaacgccacggaaagaataactggacccttctgtcctatcctggtgccggtcacctaattgaaccaccttacagccccctgtgttgcgcctctactacccacgatctccggttgcattggggcggcgaggtgatcccgcatgccgctgcacaggagcatgcctggaaggaaatccagaggttcctgcgaaaacacctgatacctgacgtaaccagccaactctag

SEQ ID NO: 180601 - DNA, 891 bp, Artificial Sequence
  Description of Artificial Sequence: Synthetic coding sequence
atgaacgccgagcccgagcggaagttcggcgtggtggtggtgggcgtcggccgggccggatcagtacgcatgagggacttgaggaatccccacccttctagcgcctttctgaatctgatcggatttgtgagcaggcgtgagctgggttccatagacggggtgcaacagatatccctcgaggatgcactgtccagccaagaagtcgaggtagcgtatatctgtagtgagtctagttcccatgaggactatatcaggcagtttttgaatgccgggaagcatgtgctggtggagtaccctatgactctatcccttgccgcggcacaggagctttgggagctcgcggagcagaaaggaaaagtgctgcacgaagagcatgtcgaactgctgatggaggagttcgcctttttaaagaaagaagtcgtcggtaaggacttgttaaaaggctctctgctgtttaccgccggaccactcgaagaggagaggtttgggtttcccgctttttctggcatatcccgactcacatggttggtttctctctttggggagctcagcctagtttctgcaactttggaggagcggaaggaagatcaatacatgaagatgaccgtctgcctggaaacggagaagaaaagtccgctctcctggatcgaggaaaaaggacccggcctaaaaaggaaccggtatctctcattccattttaaatccggctccctagagaacgttcccaacgtgggtgtgaacaagaatatcttccttaaggaccaaaatatctttgtccagaagctgctcggacagttcagcgagaaggagctggccgctgagaaaaaaaggatcctccattgtctcgggctggcggaggagatccagaaatattgttgctcccggaaatag

SEQ ID NO: 180602 - DNA, 891 bp, Artificial Sequence
  Description of Artificial Sequence: Synthetic coding sequence
atgaacgccgagcccgagcggaagttcggcgtggtggtggtgggcgtgggtagagccggctcagtgcgaatgcgggatctgcgtaatccccaccccagcagcgcattcctcaacctgatcggctttgtctcccggcgcgagctcggaagtatcgatggcgtacagcaaattagcttagaggacgcattatcctcgcaggaggtcgaggttgcctacatctgcagtgagtcttcatcccacgaggattatatcaggcaatttcttaatgcggggaaacatgtcctcgttgagtaccctatgactctcagtttggcagcggcccaggagctgtgggagttggccgagcagaaagggaaggtgttgcacgaggagcatgtggagctattgatggaagagttcgccttcctgaagaaggaagtggtcggaaaagatctgctcaaggggtctctgctgtttaccgcaggcccgcttgaggaggaacgttttggttttcccgccttttccggtatctcaagacttacatggctggtgtccctgtttggtgagttgtcacttgttagcgccaccttagaagaaagaaaagaagaccaatatatgaagatgacggtctgtctagagaccgagaaaaagtctcctctttcttggatcgaagaaaaggggcccgggctcaagcgtaaccgctatctctctttccacttcaaaagcgggagcctggagaatgtgcccaacgtgggagtgaacaaaaatattttcttgaaagaccagaatattttcgtgcagaaacttctgggccagttttcagagaaagaattggccgctgagaagaaaaggattctgcattgcttgggactggccgaagagattcagaagtattgctgctcccggaagtag

SEQ ID NO: 180603 - DNA, 309 bp, Artificial Sequence
  Description of Artificial Sequence: Synthetic coding sequence
atgaacgccgagcccgagcggaagttcggcgtggtggtggtgggcgtaggacgcgctgggtctgtgcgcatgcgtgatttgcgaaacccacatccttccagtgccttcctcaatctcatcggctttgtctctcggcgcgaactcggaagcattgacggcgtgcagcagatttcactcgaagatgccctctcttcccaggaggttgaggtggcttatatctgctctgagtcatcaagtcacgaggactatatcagacaatttttgaatgccggcaagcatgtgttagtcgagtaccccatgacactctag

SEQ ID NO: 180604 - DNA, 621 bp, Artificial Sequence
  Description of Artificial Sequence: Synthetic coding sequence
atggccgtgaagaagatcgccatcttcggcgccaccggccagaccgggctcaccactttggcccaggcagttcaggcaggctacgaagttaccgtgcttgttcgcgacagctccaggctcccctccgaggggccccgccccgcccatgttgtggtgggggacgtgctccaggcagctgacgttgacaaaaccgtggctgggcaagatgcagttatcgtgcttcttggcaccagaaacgacctttcaccgaccaccgtgatgtcggagggtgctaggaatatcgtagccgcaatgaaggctcacggtgtggacaaggttgtggcttgcaccagtgctttcttattgtgggacccgacgaaagtcccgcctaggctgcaggccgtgactgacgatcatatacggatgcacaaagtgttgcgggagtccggcctgaagtatgttgcagtcatgccccctcatatcggtgatcagccgctcaccggagcttatacggtgacactcgacggccggggaccaagtcgcgtgataagtaaacatgatctgggacatttcatgctacgttgtctgacaactgacgagtatgacggccatagcacctatccaagccaccagtatcaatag

SEQ ID NO: 180605 - DNA, 399 bp, Artificial Sequence
  Description of Artificial Sequence: Synthetic coding sequence
atgggcagcctgatgctgctgttcgtggagaccacccggaacagcagcgcttgtatttttcctgtgatcctgaacgaactctcaagcaccgtggagacaatcacacattttccagaggtaactgatggtgagtgtgtatttccttttcattataagaacggcacttattatgattgtatcaaaagtaaagcccgacacaagtggtgtagcttgaacaagacgtacgagggctattggaagttttgcagtgccgaagacttcgcaaactgtgtcttccctttctggtatcgcaggcttatctattgggagtgcaccgacgatggagaggcgtttgggaaaaaatggtgtagcctgacaaaaaacttcaataaggatcgcatctggaagtactgcgagtag

SEQ ID NO: 180606 - DNA, 429 bp, Artificial Sequence
  Description of Artificial Sequence: Synthetic coding sequence
atggccgccgccgccgagggcgtgctggccacccggagcgacgagccagcccgtgacgatgccgcagttgagactgccgaggaagctaaagaacctgccgaagctgatatcaccgaactgtgccgtgatatgttctctaaaatggccacctatctgaccggcgaactcactgcaacaagcgaagattacaaattgttggaaaacatgaacaaactcacttcccttaaatatctagaaatgaaagatatcgctattaacatctccaggaacttgaaggacctgaatcagaagtatgccggattgcaaccctatctggatcagatcaatgtaatcgaggaacaggtggccgcgttagagcaggcagcatataagctggatgcctatagtaaaaagttagaggccaagtataaaaaactagagaaacggtag

SEQ ID NO: 180607 - DNA, 225 bp, Artificial Sequence
  Description of Artificial Sequence: Synthetic coding sequence
atgaacaagctgaccagcctgaagtacctggagatgaaggacatcgctattaacatttcaaggaatctcaaagatttgaatcagaagtatgccggccttcagccctatttagatcaaattaatgtaatagaggaacaggtggcagcgctggagcaagcagcttacaaattggacgcttacagcaagaagttagaggccaagtacaagaagctggagaaacgatag

SEQ ID NO: 180608 - DNA, 225 bp, Artificial Sequence
  Description of Artificial Sequence: Synthetic coding sequence
atgaacaagctgaccagcctgaagtacctggagatgaaggacatcgcgatcaacatttcacgaaacctaaaagacctgaatcaaaagtatgctgggctgcagccctacctggatcagatcaacgttatcgaggagcaggtagcggctctggaacaagccgcctacaaactggacgcttattcgaagaaactagaggctaagtataaaaagcttgagaagaggtag

SEQ ID NO: 180609 - DNA, 300 bp, Artificial Sequence
  Description of Artificial Sequence: Synthetic coding sequence
atgttcagcaagatggccacctacctgaccggcgagctgaccgccacaagcgaagactacaaactgctcgagaacatgaacaaacttacaagtctcaagtacctggagatgaaagatatagctataaacatttccagaaatctgaaggatctgaaccagaaatacgcaggcctgcagccctacctggatcagatcaacgttatagaagaacaggtcgccgccttggaacaggctgcctacaaactggatgcctacagtaagaagctggaggccaagtataaaaagttggagaaacggtag

SEQ ID NO: 180610 - DNA, 609 bp, Artificial Sequence
  Description of Artificial Sequence: Synthetic coding sequence
atggccagccagggccggcggcggcggcccctgcggcggcccgagaccgtcgtgcccggtgaagctaccgagaccgacagcgaacgttccgcctcaagcagtgaggaagaggaactgtatcttggcccttccggaccaactaggggccgccccacaggcctcagagttgcaggggaggcggcggagacagactccgaaccagagcccgaacccgagcctactgccgccccacgggatctcccgccacttgtggttcaacgcgaatctgctgaagaggcatgggggacagaggaagcgccagcccctgcacccgcacggtctcttctgcagctccggcttgctgaaagccaggcaaggcttgaccacgatgtggctgccgctgtcagcggcgtttatcggcgggcgggacgcgatgtagcagcacttgccagcagacttgcggccgcacaggcagcggggctggcggcagcacactccgtgcgtctggccaggggggacctgtgcgcgttggccgaacggttagacatagttgctggttgtcggttactgcctgatatccggggcgtccccggtaccgagccggaaaaagatccaggcccccgcgcctag

SEQ ID NO: 180611 - DNA, 1632 bp, Artificial Sequence
  Description of Artificial Sequence: Synthetic coding sequence
atggcccacgcccacatccagggcggccggcgggccaagagccggtttgttgtgtgcattatgtcaggggcacggtctaaactggctctctttctgtgcgggtgctacgtggtggcattaggcgcacatactggggaggaatcagtggctgaccaccacgaagctgaatactacgtggcagcagtgtatgagcacccgagcattctgtcattgaatcctctcgccttgatctcacgacaggaagccctggaacttatgaaccaaaatctggatatctacgagcaacaggtgatgacagccgcccagaaagatgtgcagatcatcgtattccccgaggacggcattcatgggttcaactttaccagaaccagtatctacccttttttagactttatgccatccccccaggtagtcagatggaacccctgccttgaaccacacagatttaacgatacggaggtcctccagcgcctgtcctgcatggctattaggggggatatgttcttggttgcgaatctcggcacgaaggagccctgccacagctctgatccaagatgccccaaggacgggcgatatcagtttaacaccaatgtcgttttttctaataacggtacattggtggatcgatatcgaaaacacaatttgtactttgaggccgccttcgacgtgcccctgaaagtggatctaatcacctttgatacaccctttgctggtcgcttcggaatatttacatgttttgatatccttttttttgaccctgccatccgggttctgagagattacaaggtcaaacatgtggtctaccccacagcctggatgaatcagctgccgctgttagccgctattgaaatccagaaggcctttgcggtagccttcggaattaatgtgctggcagcgaatgtgcatcatccagtgctgggtatgaccggatcgggcatacacacgcctctggaatcgttctggtaccacgacatggagaacccaaagagtcacctgataatcgcccaggtcgctaaaaaccccgtgggattaatcggggccgagaacgccactggcgagacggatccttcacatagtaagtttttgaagattttatctggcgatccctactgcgagaaagatgcccaggaagttcactgcgatgaagcaaccaagtggaatgttaacgcaccccctaccttccactcagagatgatgtatgacaacttcaccctggtgcccgtgtggggcaaggagggatacctccatgtgtgttctaacggactgtgctgctacttgctgtacgaacgacctactctctccaaggagttgtacgcacttggggtttttgacggcctgcacacagtgcacggtacatactacatccaggtgtgtgctctggtccgatgtggagggcttgggtttgacacttgtgggcaggaaatcactgaggctaccgggatattcgagttccacctgtggggaaacttctccacaagttacatctttccactgttccttaccagcggcatgactttagaagtacccgatcaactaggctgggaaaatgatcattacttcctgagaaaatcaagattgtctagcgggcttgtgactgctgccctgtacggccggctgtacgagcgagactag

SEQ ID NO: 180612 - DNA, 1572 bp, Artificial Sequence
  Description of Artificial Sequence: Synthetic coding sequence
atgagcggcgcccggagcaagctggccctgttcctgtgcggctgctatgtggttgctctaggggctcacaccggggaggagtccgtcgccgaccaccacgaggccgaatattacgttgcagctgtgtatgagcacccctccatcctgagcctgaacccattggcgcttatctcacggcaagaagccttggagctcatgaatcagaatctggacatatatgagcagcaggtcatgacggctgcccagaaagacgtgcagatcattgtgttcccagaagacggaattcacggctttaacttcactcgaacttcgatctacccttttctggattttatgccatctccacaagttgtgagatggaacccttgtctagagcctcacaggtttaacgacacagaagtgctgcagaggctttcctgtatggcgatacgtggcgatatgttcctcgtggcgaatttagggacaaaggaaccatgtcactcgagcgatccccgatgccctaaggacggcagatatcaatttaatacaaatgtggtcttcagcaataatggaaccctcgtagatagatatcggaagcataacctgtacttcgaggcagcattcgacgtaccactgaaggtggatttaatcacgtttgataccccatttgcaggacgctttggtatcttcacttgttttgatattctgttttttgaccccgccatcagggtgttgcgggactataaagtgaagcatgtcgtgtaccccaccgcctggatgaaccagcttcccctgctggccgccattgagatccagaaggccttcgctgtcgcgttcggtattaatgttctcgcggctaacgtccaccatcctgtgctcggtatgaccggaagtggaattcatacgcctctagagtccttctggtatcacgacatggagaatcctaagtcgcacctgatcattgcgcaggtggcgaagaatccggtgggtctcataggggctgagaacgctactggggaaactgaccctagtcactctaagtttctgaaaatcctgagcggagatccatactgtgaaaaggatgcccaagaggtacattgcgacgaagccacaaaatggaatgtgaacgcccctcccacattccattctgaaatgatgtacgacaatttcaccctagtaccagtgtggggaaaagagggctacctccacgtttgtagtaatggactgtgttgttacctgctttatgaacgaccgacgttgtctaaggagctttacgctctaggtgtctttgatggactgcacacagttcacggcacctattatatacaagtctgtgcactggtaaggtgcggcggcttaggcttcgacacgtgcgggcaggaaattacagaagccactggtatcttcgaattccatctgtggggaaatttttcaactagctatattttcccacttttcctgacgtctgggatgacccttgaagtgcctgatcaactgggctgggagaacgatcactatttccttcgcaagtccagactgagcagtgggcttgtgacagctgctctgtacggacggctttatgagagggattag

SEQ ID NO: 180613 - DNA, 1638 bp, Artificial Sequence
  Description of Artificial Sequence: Synthetic coding sequence
atggcccggaaggagacccagctgatcatcaagatgaaccacctggccagattcgtggtctgcattatgtcaggggctcgctctaagctggcactattcctgtgtgggtgttatgtggtggctctcggggctcacacgggagaagagagtgttgcggaccaccatgaggcggaatattacgtggcagccgtctatgaacaccccagtattctgagtcttaatcccctggcactgatctcccgccaggaggcactcgaactgatgaatcagaatttagacatctatgagcagcaggtgatgaccgctgcccagaaagatgtgcagattatcgtgtttcccgaggacggaatccatggattcaatttcacaaggactagcatctaccccttccttgatttcatgccctctccgcaagtggtgaggtggaatccctgcttagaaccacatagatttaacgatacggaggtcctgcagagattatcttgtatggccatccgcggggatatgttcttggtggcaaatctgggcaccaaggagccatgtcacagcagtgatcccaggtgtcccaaagacgggcggtaccagttcaacactaatgtggttttttcaaacaatggaacactcgttgacaggtaccggaagcacaacctgtactttgaggcagctttcgacgttccactgaaggttgatttgatcacctttgacactccctttgctggccgatttggcatttttacatgctttgatatcctcttttttgatccagccatccgggtgttaagggattataaagtcaagcacgtcgtgtacccaactgcatggatgaaccagctgccgcttttggctgccatcgaaatccagaaggctttcgcagtggcatttgggataaatgttctggcagccaatgtgcatcatcccgtgctgggaatgaccggaagcgggattcataccccactggagtctttctggtatcatgatatggaaaatcccaagtctcatctgatcatcgctcaggtggcaaaaaatccagtgggcctcatcggcgctgaaaacgccaccggcgagacagacccctctcatagtaagtttctaaagatcctctctggcgatccttactgtgagaaagacgcccaggaggtgcactgtgacgaggccaccaagtggaacgtgaacgccccacctacatttcatagtgaaatgatgtatgacaactttaccttagtacccgtctggggaaaagagggatatctccacgtatgctccaacggattgtgttgttatctgctgtatgagcggccaactctgtcaaaagaactgtacgcattgggggtctttgacggtcttcacacagtgcacggcacatattacattcaggtatgcgctctcgtccggtgtggcgggctgggcttcgatacttgcggacaagagatcaccgaggccaccgggatcttcgagttccatctctggggcaatttctcaacatcctacatctttcccctttttctcaccagtggaatgacgttagaagtgcctgatcagctggggtgggagaatgatcattatttcctgcgtaaatcacgcttaagcagtggcctcgtgactgccgccttgtacggacgactgtatgagcgggactag

SEQ ID NO: 180614 - DNA, 1638 bp, Artificial Sequence
  Description of Artificial Sequence: Synthetic coding sequence
atgcccgagggcggcggcaccagccggcggctgctgcccatgcagagcagattcgtcgtatgcattatgtcaggcgctcgcagtaagctggccctctttttgtgcggatgctacgtcgttgctctgggcgcacacactggcgaggaatctgtggcggaccatcatgaggctgaatactacgttgccgcggtgtatgaacacccatcaattctgagtttgaatcccctggctctgataagtcgccaggaggcgcttgaacttatgaatcagaatctggatatctatgagcagcaagtgatgactgcagcacaaaaggatgtgcagatcatcgttttccccgaggatggcatccacgggttcaactttacccgaacaagtatctacccatttcttgacttcatgcccagcccccaagtggtcagatggaatccatgtctggagccacatagatttaacgacaccgaagtgctccaacgactgtcgtgtatggccatacgcggcgacatgttcctggtggcgaatctgggcacgaaggagccttgccacagtagcgacccccgttgccctaaagacggtaggtatcaattcaacaccaacgtagtattcagtaacaacggaactttggtggaccgatatcgtaaacacaacctctacttcgaagccgcattcgacgtgccacttaaggttgacctgatcactttcgataccccctttgcaggacgattcggtatctttacttgttttgacatcctgtttttcgacccagccattcgtgtcctgagggattataaggttaagcatgtggtgtaccccacagcttggatgaatcagctgccactccttgctgccatcgaaatccagaaggctttcgcggtcgcctttggaatcaacgtactggcggccaatgttcatcaccccgtcttaggtatgactggcagcgggattcacacgccacttgaaagcttctggtaccacgacatggaaaatcctaagtcccatttgattatagcccaagtggcaaaaaatcctgtcggcctaattggggccgaaaatgcgaccggagagacagatccttcccattccaagtttctgaaaattctgtccggagatccttactgcgaaaaagatgcacaggaagtgcactgcgatgaagccacgaaatggaatgtgaatgccccccccacctttcattccgaaatgatgtatgataattttactttagtgcccgtctgggggaaggaggggtatctgcatgtgtgcagcaacgggctatgctgctatttgttatatgagaggcctaccctgtccaaggaactctatgccctgggtgtgttcgatggtctgcacacagtacatggaacctattacatccaagtttgcgctttagtgaggtgcggtggcctcggcttcgatacttgcggtcaggaaatcaccgaagctaccggaatctttgaatttcatttatggggcaacttcagcaccagctatatctttcccctctttctgaccagcggcatgactcttgaggtgcctgatcagctgggctgggaaaatgatcattatttcctgcgtaagagccggctgtcctcaggcctggtcacggcagccctgtacggccggctttacgagagagattag

SEQ ID NO: 180615 - DNA, 585 bp, Artificial Sequence
  Description of Artificial Sequence: Synthetic coding sequence
atgccccggaacctgctgtacagcctgctgagcagccacctgagccctcacttcagtacgagcgtgacctcggccaaggttgctgttaacggggttcaactgcattaccagcagacaggcgaaggtgaccatgccgtgctcctgctaccaggcatgctgggaagcggcgagaccgattttggcccgcagttaaaaaacctcaataaaaagctgtttacggttgtggcctgggaccctcgagggtatgggcattccaggccacccgatagagatttccccgctgattttttcgagagagacgcgaaagatgctgtggacctgatgaaggccctgaagttcaaaaaggttagcctgctgggctggtcagacggcgggataaccgcgctcatcgccgccgcgaagtacccttcctatatacataaaatggtaatctggggagcaaatgcctatgtgacagacgaagatagtatgatttacgaaggcattcgcgacgtgtccaagtggtctgaaagaactaggaaacctctggaggcactgtacggctggagtctgaccctgtctccaggctggaacgctatggcctag

SEQ ID NO: 180616 - DNA, 825 bp, Artificial Sequence
  Description of Artificial Sequence: Synthetic coding sequence
atgccccggaacctgctgtacagcctgctgagcagccacctgagccctcacttttccacatccgtgacttctgccaaagtcgcggtgaacggcgtccagttgcactaccagcagactggcgaaggcgaccacgctgtactgctcctcccaggcatgctaggcagcggcgaaacagatttcggcccgcagctaaaaaacctgaacaaaaaactattcacggttgtggcctgggacccccggggttatggccatagccggcctcccgaccgagactttcctgcagacttttttgaaagagacgccaaagatgcggttgatctgatgaaggcattaaagttcaagaaggtcagcttgctgggatggtccgacggtggaatcacggccctgattgccgctgctaagtaccccagctacattcataaaatggtcatatggggtgcaaatgcctacgttacagacgaggactctatgatctacgagggaattcgcgatgtgtccaagtggtccgaacgcaccagaaaaccacttgaggcgctttatggatatgactactttgccaggacatgcgagaaatgggtggatggcatcaggcaattcaaacacctgcctgatgggaacatttgtcgccacctgcttccgagagtccagtgccccgctttgattgtgcatggcgaaaaggacccattggtgcccagatttcacgccgacttcatacacaagcatgtgaagggctctagactgcacctgatgccagaaggaaagcataatctgcatctgagatttgcagatgagttcaataaactggccgaagatttccttcagtag

SEQ ID NO: 180617 - DNA, 876 bp, Artificial Sequence
  Description of Artificial Sequence: Synthetic coding sequence
atggtggccgtgctgggcggccggggcgtgctgcggctgcggctgctcctgtctgccctgaagccgggaatccatgtgcccagggccggtccagcagctgctttcggaacatccgtgactagcgcaaaggtggccgtaaacggggtgcagttgcactaccagcagacaggtgaaggcgaccatgccgttctgctgttgccaggaatgctggggtcaggcgaaacagacttcgggccacaactgaagaacttgaacaagaaactgtttaccgtggtcgcctgggaccctcgcggctatggacacagtcggcccccagatcgggattttcctgccgacttctttgagagggacgctaaggacgctgtcgatctgatgaaagctctcaaattcaagaaagtgtccctgctgggatggtccgacggtggaataactgcactgattgccgccgccaaatacccctcctatattcacaagatggtaatttggggagccaacgcgtacgtgaccgatgaggatagcatgatttatgagggaatccgcgacgtaagcaaatggagcgaacgaacaaggaaaccactggaagctttatatggttatgactacttcgctaggacctgcgagaagtgggtggacggcattaggcaattcaagcacctccccgacgggaatatatgcagacatctgctgccgagagtgcagtgcccagcattgatagtgcacggcgagaaagatcctctcgtgccccgcttccacgccgattttatccacaaacacgttaaggggtctcgactgcaccttatgccagaaggaaagcataacctgcacctgcgcttcgccgatgagttcaacaaattggccgaggacttccttcaatag

SEQ ID NO: 180618 - DNA, 264 bp, Artificial Sequence
  Description of Artificial Sequence: Synthetic coding sequence
atgtactgcctgcagtggctgctgcccgtgctgctgatccccaagccactgaatccagcactgtggttcagccattcaatgtttatggggttctatcttctgtcctttctgctggaacgcaagccttgcactatttgcgcactggtttttctggcggcactgtttttaatctgttattcttgttgggggaattgtttcctttaccattgttccgattctcccctacctgagtccgcccatgaccctggtgtcgtaggcacctag

SEQ ID NO: 180619 - DNA, 264 bp, Artificial Sequence
  Description of Artificial Sequence: Synthetic coding sequence
atgtactgcctgcagtggctgctgcccgtgctgctgatccccaagcctctgaatccagcgctgtggttctctcacagtatgttcatgggcttctatctgctttccttcctcctcgagcgtaagccctgtaccatctgcgcactcgtgtttctggctgccctcttcctgatatgctactcttgttggggcaactgctttctgtaccactgctcagactcaccccttccggaatcagctcacgatccaggagttgttggtacttag

SEQ ID NO: 180620 - DNA, 264 bp, Artificial Sequence
  Description of Artificial Sequence: Synthetic coding sequence
atgtactgcctgcagtggctgctgcccgtgctgctgatccccaagcccctcaatcccgccctgtggttctcacattccatgtttatgggtttttatctgctgagtttcctcctggagaggaaaccctgcacaatatgcgcgctggtcttcctcgccgcactatttcttatctgttactcatgttggggcaactgtttcctttaccattgtagcgatagccccttgcccgaatctgcccatgatcccggagtggttggcacctag

SEQ ID NO: 180621 - DNA, 264 bp, Artificial Sequence
  Description of Artificial Sequence: Synthetic coding sequence
atgtactgcctgcagtggctgctgcccgtgctgctgatccccaagccattgaatcccgcgctgtggttcagccacagcatgttcatgggcttctacctgctcagctttctgctggagcgcaaaccttgtaccatttgtgcattggttttccttgctgcgctgttcctgatctgttattcctgctggggaaattgcttcttatatcattgctctgattccccacttccggaatccgcccacgaccccggcgtagtggggacttag

SEQ ID NO: 180622 - DNA, 264 bp, Artificial Sequence
  Description of Artificial Sequence: Synthetic coding sequence
atgtactgcctgcagtggctgctgcccgtgctgctgatccccaagcctttgaacccggcactatggttttcccatagcatgttcatgggtttctatctgttgagcttccttcttgagcggaaaccctgtactatctgcgctttggtgttcttggcagctttgttccttatttgttattcatgttgggggaattgctttctgtaccactgcagcgatagccccctccccgaatccgctcacgatcctggcgtagtggggacatag

SEQ ID NO: 180623 - DNA, 189 bp, Artificial Sequence
  Description of Artificial Sequence: Synthetic coding sequence
atgtactgcctgcagtggctgctgcccgtgctgctgatccccaagcccctgaaccccgccttatggttctcacatagcatgttcatgggtttttacttgcttagtttcctgttagaaagaaaaccatgtactatatgtgctttagtatttttggccgccctctttctgatctgctattcttgctggtag

SEQ ID NO: 180624 - DNA, 264 bp, Artificial Sequence
  Description of Artificial Sequence: Synthetic coding sequence
atgtactgcctgcagtggctgctgcccgtgctgctgatccccaagcctctcaaccccgccctgtggttttcacactcgatgtttatggggttctacctgctgagtttccttctcgagaggaaaccttgtacaatttgcgcccttgtatttctggctgccctgtttctcatttgctattcatgctggggaaattgcttcctctatcattgttccgactctccgttgccagaatcagcccatgaccccggtgttgttggaacttag

SEQ ID NO: 180625 - DNA, 264 bp, Artificial Sequence
  Description of Artificial Sequence: Synthetic coding sequence
atgtactgcctgcagtggctgctgcccgtgctgctgatccccaagcctcttaatcctgccttgtggttcagccatagcatgtttatgggtttctacttactcagctttctgctggaacgaaagccctgtaccatctgtgccttggtattcttagctgctttatttctcatctgttactcatgctggggcaactgttttttgtatcactgtagcgattctcccctgccggagtcagcccacgatcccggagtcgtgggtacctag

SEQ ID NO: 180626 - DNA, 237 bp, Artificial Sequence
  Description of Artificial Sequence: Synthetic coding sequence
atgtactgcctgcagtggctgctgcccgtgctgctgatccccaagccactcaatcctgccctttggttctctcattcaatgttcatggggttctatctgttaagctttttgttagagcgaaaaccctgtacaatctgcgcgctcgtgttcctagcagctttgtttctgatctgttactcatgctggggaaattgtttcttatatcattgtagcgattcaccgttgccggagtcctag

SEQ ID NO: 180627 - DNA, 24 bp, Artificial Sequence
  Description of Artificial Sequence: Synthetic coding sequence
atgtactgcctgcagtggctgtag

SEQ ID NO: 180628 - DNA, 1368 bp, Artificial Sequence
  Description of Artificial Sequence: Synthetic coding sequence
atgagcagcagcggcctgaacagcgagaaggtggccgccctgatccaaaaactcaactccgatccacagttcgtgctcgcccaaaatgtgggcactacacacgacttacttgacatttgtctcaaacgtgcgacagtccagagggcccaacacgtttttcagcacgccgtgcctcaagagggcaagcctattaccaaccagaaatcttcaggccgatgctggattttctcctgtctgaacgtgatgagactcccattcatgaagaaactaaatattgaagagttcgaattttctcaaagctacctattcttctgggacaaagttgagcgatgttatttttttctgagcgctttcgttgacaccgcccagcgcaaagagcccgaggacggccgcctggtgcaatttctgttgatgaaccctgcaaatgacggcgggcaatgggacatgctagtgaacatcgtggaaaagtacggcgtcatcccaaagaagtgttttcccgagagttatactactgaagccactcggcggatgaacgacattttaaatcacaaaatgagggagttttgcattagactcaggaacctcgtgcactctggggccactaaaggtgaaatctcagcaacccaggatgtcatgatggaggagatcttccgtgtagtgtgtatctgtctggggaatcctcccgagacttttacctgggagtacagagacaaagataaaaactaccagaagataggacctattacacctttggagttctatcgcgagcatgtgaagccattatttaacatggaagacaagatttgcctggtgaatgacccaaggccccagcataagtataataagctttacacggtggagtacctgtctaacatggtcgggggacggaagaccctgtacaataatcagccaatagattttcttaagaagatggtcgccgcctcaataaaagacggcgaggccgtctggttcgggtgcgatgtgggtaagcatttcaacagtaagctgggcttgtccgatatgaatctatatgaccatgagctggtatttggggtctccctaaagaacatgaataaagccgaaagactaacattcggagaatcccttatgacccatgccatgacattcacagccgtaagcgaaaaagatgatcaggacggcgctttcacaaaatggcgagttgaaaatagttggggtgaggaccatgggcacaaggggtacctgtgcatgactgacgagtggtttagcgagtatgtctatgaagtggtggtggatcggaaacacgtacccgaagaagtgctggcagtcttagagcaggaacccattattctgccagcctgggaccccatgggggcgctggcagaatag

SEQ ID NO: 180629 - DNA, 1107 bp, Artificial Sequence
  Description of Artificial Sequence: Synthetic coding sequence
atgtgcagcagcaccccctgcccccggcgggccagccagagccccacccgaagggcccaggttgagagatgctatttttttttatcagccttcgttgataccgcgcaaagaaaagagccagaggacggaagactggtccaattcttgctgatgaaccccgctaatgacgggggccaatgggatatgttggtaaatatagtcgaaaagtatggcgttattcccaaaaaatgttttccagagtcatacaccactgaggccacacggcggatgaacgacattctgaatcacaaaatgcgcgaattctgcataagactgagaaacctggtgcactccggcgccaccaagggggagattagtgctacacaggacgtgatgatggaggagatttttcgcgtcgtatgtatttgccttgggaatcctcctgaaactttcacatgggagtaccgagacaaagacaagaattatcagaaaataggccctatcactcccctggagttctatcgggagcacgtgaagcctcttttcaatatggaagacaagatctgcctggtgaatgatcccaggccacaacacaaatataacaagctttatacggttgaatatctctccaatatggtgggcgggcggaagactctgtacaacaaccagcctatcgacttcctaaagaagatggttgccgcttctatcaaggacggtgaagccgtctggttcggctgtgatgtaggtaaacattttaacagcaaattgggacttagcgatatgaatctgtatgatcacgagttggtgtttggcgtgagcctcaagaacatgaataaagcagaaagattgacattcggcgagtcccttatgactcatgcgatgaccttcactgctgtgtcggaaaaggatgatcaagatggtgccttcaccaagtggcgggtggaaaactcttggggtgaggatcacggccacaaaggatatctgtgcatgactgatgaatggtttagtgagtatgtgtacgaggttgtggtagataggaaacatgtgcccgaagaggttctggccgtgctcgaacaagagcctatcatccttccagcatgggaccccatgggagcactggccgaatag

SEQ ID NO: 180630 - DNA, 2241 bp, Artificial Sequence
  Description of Artificial Sequence: Synthetic coding sequence
atggccggcagccggggcgccggccggaccgccgcccccagcgtgcgcccagaaaagaggcggtccgagccagagttggaacccgagcccgagcccgaaccacctctgctctgcacatccccactctcccatagcaccggatcagactccggtgtttcagatagtgaagagagcgtgtttagtggccttgaggactccggctccgatagctccgaagatgacgacgaaggagacgaggaaggggaagacggtgcactggacgatgagggccacagtgggatcaagaagacaacagaggagcaggtccaggcttcaacgccctgccctaggactgagatggcttcggcaaggattggtgacgaatacgcagaagactcaagcgatgaggaagacatacgtaatacagtgggtaacgttccgctcgaatggtatgatgactttccacacgtcgggtatgatttggatgggcgaaggatttataaacctctgcgcacccgggatgagttagaccagttcctagacaaaatggatgacccagactattggaggacagtgcaagatcctatgaccgggcgagacctgcggttaaccgacgagcaggtcgccttggtccggaggttacagtctggtcagtttggcgacgtcggattcaatccttacgaaccagctgtggatttcttctcaggagatgtgatgatccaccccgtgactaacaggcccgcagataagaggagtttcatcccctccttggtcgagaaggaaaaagtgtccaggatggtacatgccatcaagatgggctggattcagccgcggcgaccaagagatcccactccctcattctacgatctttgggcacaagaggaccccaacgcagtcctgggcaggcacaaaatgcacgtaccagctcctaagctggctcttccaggacatgctgagtcctataatccccctccagaatatctgctttctgaagaagagcgccttgcctgggaacaacaagaacctggtgagcgcaagctcagctttctaccacgaaaatttccgtctctgagagctgtgccagcctacggcagatttattcaggagagatttgagagatgcctcgacctgtatttatgcccgaggcagcggaagatgcgagttaatgtggaccctgaggacctaataccaaaacttccccggcccagggatctccagccctttcccacttgccaggccctggtctatcggggacactctgacctggtcaggtgcctgagtgtgagtcctggcggccaatggctagtcagcgggtcggatgacggttcactccgactatgggaggtagcaacggcccgctgcgtgcggacagtgcctgttgggggcgttgtaaagtcagttgcctggaatcctagcccagccgtgtgccttgtagcagcggccgtggaggacagcgttctcctgctcaaccctgccctgggcgatcgactcgtggccggctctaccgatcaactgctcagtgcttttgtccctccagaggaacctccactccagccggcgcgttggctagaggcttctgaggaggagcgccaagtgggcctacgcctgaggatctgtcatggcaagcctgtaacgcaggtgacatggcatgggcgcggggattaccttgcagtcgtcttagcgactcaaggccatacacaagtactgatccaccaactcagtaggcgccggagccagagcccttttaggaggtcccacggccaagtgcagagggtggcctttcaccctgcccgaccatttctgctggtggcttcacaaagatcagtcaggctctatcacctgctgagacaggagctcaccaagaaactgatgcctaactgtaagtgggttagctctttggcagtacacccagctggggataacgtgatatgcggcagctacgactcaaaacttgtgtggtttgacctcgacctctccaccaagccctaccggatgctccgtcaccacaagaaggctcttcgagcggtggcatttcatcccagatatcctctgtttgccagcggtagcgatgatgggtcggtgatcgtctgccatgggatggtttacaatgacctgctgcagaaccctttgctcgtaccggtgaaagtgttaaaagggcacgttctgactagagatttgggcgtgttggacgtgatcttccaccctacacagccttgggtttttagcagcggggctgacggcacggtccgcctgtttacttag

SEQ ID NO: 180631 - DNA, 1083 bp, Artificial Sequence
  Description of Artificial Sequence: Synthetic coding sequence
atgaactacaccgagagcagccccctgcgggagagcaccgccatcgggtttactcctgaacttgaaagtattatccccgtgccatcaaataagacaacctgtgagaattggcgagaaattcaccatcttgtattccatgtggcgaatatttgcttcgctgtcggtctggtgatcccaactactctgcacctgcacatgatatttctgaggggcatgctgactctgggctgcactctgtacatcgtgtgggctactctctatcgttgtgcgctggatatcatgatctggaatagtgtgtttctgggcgtcaacattctgcatctgtcttatctactctataagaagcgacccgttaaaatagagaaggagctgtcaggcatgtatcggcgactgtttgagcctctgcgagtcccaccagatctgttccgaaggctgactggccagttttgcatgatccagactctgaagaaggggcagacatacgcggccgaggacaagacatccgtggatgatcgcctatctatcctcctgaagggcaaaatgaaggtgtcctatcgtggtcatttcctccacaacatttatccttgtgccttcattgatagcccagagttccgctctacccagatgcacaaaggcgagaaattccaagtaaccattatagcagatgataactgcagattcctctgttggagccgggaaaggttgacctacttccttgagagcgaacctttcctgtacgaaattttccggtacttgatcggaaaggacataacaaacaaactctatagtctcaatgacccaacccttaatgataagaaagccaagaaactggagcaccagctgtctttatgcacccagataagcatgctagaaatgaggaactccatcgccagttcttctgacagtgatgacggattgcaccagtttttacgggggacttcatcaatgtcatctctccacgtatcttccccccaccagagggcatccgcaaaaatgaaacctatagaggagggcgctgaggatgacgatgacgtgttcgaaccagcctctcccaataccctcaaggtccaccagctcccttag

SEQ ID NO: 180632 - DNA, 1083 bp, Artificial Sequence
  Description of Artificial Sequence: Synthetic coding sequence
atgaactacaccgagagcagccccctgcgggagagcaccgccatcggctttactcctgagttagaatccattatcccagtgcccagtaataagaccacctgcgagaattggcgtgagatccatcatctggtcttccacgtagcgaatatttgttttgctgtggggttggtcattcccaccaccttgcatttgcacatgatcttcctaagggggatgttgactcttgggtgcacactctatattgtctgggctaccctgtaccgctgcgccctggatattatgatctggaacagtgtcttcttaggagttaacatccttcacctgtcatacctgttgtataagaaaaggcctgtcaaaattgagaaggagctgtccggaatgtataggcgactcttcgagcctctccgcgtgcctcctgatttgtttcgacgcctgacggggcagttctgtatgattcaaactctaaagaagggacagacatacgctgcagaggataaaacgtccgtggacgacaggctatccatactgcttaaaggaaagatgaaagtgtcatatcgtggtcattttcttcacaatatctatccttgtgcatttattgactcccctgaattcaggtccacccagatgcacaaaggcgaaaagttccaggttaccattattgctgatgacaattgtcgattcctgtgctggtcccgagaacggctgacatatttcttggagtccgagccgtttctatacgaaatattccgctacctaatagggaaggacataacaaataaactctactccctgaatgacccgacccttaacgataagaaggctaagaagctagagcaccaactgagcctgtgcactcaaatttcaatgttggagatgaggaactctattgcctcatcgtccgacagcgacgatgggttacatcaattcctgagagggacatcatccatgtcatcactgcacgtgagttctccccatcagcgcgcaagtgccaaaatgaaacccattgaagaaggggcagaagatgacgatgatgtgttcgaacctgcatctccgaacactcttaaggtgcaccagttaccctag

SEQ ID NO: 180633 - DNA, 1083 bp, Artificial Sequence
  Description of Artificial Sequence: Synthetic coding sequence
atgaactacaccgagagcagccccctgcgggagagcaccgccatcggattcactccggagctggaatccatcatccctgtgcctagcaataagactacttgcgaaaactggagagaaatccatcacttggtgtttcacgtcgcaaacatttgcttcgccgttgggctcgtgataccaactacactgcacttacacatgatattcttgcgcgggatgctcacactgggttgtacgctttacatagtgtgggccaccctgtatcgatgtgcactggatattatgatctggaattccgtgttccttggtgtcaatatcctccacctttcctacctgttgtataagaagcggcccgtgaaaatcgagaaggaactgtcagggatgtatcgacggctctttgaacccttgcgggtacccccagatttgtttagacgcctaacaggacagttttgcatgatacagaccttaaaaaaagggcagacctatgccgctgaagacaaaacgagcgtcgacgatcggctgtcgatcctcctcaagggcaagatgaaggtctcttaccgggggcattttctccataacatttacccatgcgcctttatagattcccctgaattccggtccacacagatgcacaagggcgagaagtttcaggtgactataattgcagacgataactgccgcttcctttgctggagcagggaacgactgacctactttttagagagtgaacccttcctttacgaaatatttagatatctcattggaaaggacattaccaataagctgtattctcttaacgatccaacattgaatgataagaaagcaaaaaagctggagcaccagctctccctgtgcacacagattagcatgctggaaatgagaaattctatcgcatcctcatccgactcagatgatggactacaccaatttctcagaggaaccagctccatgtccagccttcacgtatccagcccacatcagcgggcaagtgctaagatgaagcctattgaggagggagcagaggacgacgatgatgtttttgaaccagcatccccaaatactctcaaagtccaccagctgccatag

SEQ ID NO: 180634 - DNA, 783 bp, Artificial Sequence
  Description of Artificial Sequence: Synthetic coding sequence
atggaccggcacagcagctacatcttcatctggctgcagctggagttgtgcgccatggccgtgttactgacaaagggggaaatcagatgttattgcgacgccgcgcactgtgtagcaacaggctacatgtgtaagtccgagctttccgcatgttttagtagactgctcgacccacagaatagtaactcccctctgacacacgggtgcctagattcactggcctcgactacggatatctgtcaagctaagcaggccagaaatcattccggcacaacgatccctacacttgagtgctgccatgaagatatgtgtaactatcgcggattgcatgatgtgctgtctcccccccgcggcgaagccagcggccaaggcaaccgttaccagcacgatggctctcgcaaccttattacgaaagtacaggaactcaccagcagcaaagaactgtggtttcgagccgccgtgattgcagttcctatagcaggtggactaatattggttctgctgattatgttagcgctgaggatgctcagaagcgagaataaaagattgcaagatcagaggcagcagatgctgagcagactgcactattcattccatggccatcattcaaaaaagggtcaggtagctaagttggaccttgaatgtatggtgccagttagtgggcacgagaactgttgcctcacctgtgataagatgcgccaagccgacctgtccaatgacaagatcctatcccttgtgcactggggtatgtactcaggtcacgggaaacttgaatttgtttag

SEQ ID NO: 180635 - DNA, 744 bp, Artificial Sequence
  Description of Artificial Sequence: Synthetic coding sequence
atggaccggcacagcagctacatcttcatctggctgcagctggagttgtgtgcgatggcagtactcctcacgaaaggggaaatccgctgctactgtgacgccgcacactgcgtggccaccggctatatgtgtaagagcgagctcagcgcatgcttttctcggttattagacccacagaatagtaattcacctcatatatgccaagctaagcaggcccgaaatcattcggggacaacgatccctactctagagtgctgccacgaagacatgtgtaactatcggggcctgcacgacgtgcttagccctcccaggggcgaggcaagcggccaggggaaccgatatcagcatgacgggagtcggaatctgataacaaaagtacaggagttaacatccagcaaagaactgtggttccgcgctgcggtgattgcggtgcctatagctgggggtctgatccttgtgctgcttatcatgctagcattacgtatgctgcgctccgaaaacaaacgcctccaagaccagcggcaacaaatgctgtcccgcctccattattcattccatgggcatcatagtaaaaagggccaagtggcgaagctggatcttgaatgcatggtgcctgtgtcaggtcacgaaaactgctgtctgacctgtgacaagatgaggcaggcagatctcagcaatgataagattctgtccctggttcattggggcatgtattctggccacggcaaactggaattcgtgtag

SEQ ID NO: 180636 - DNA, 2058 bp, Artificial Sequence
  Description of Artificial Sequence: Synthetic coding sequence
atgctgtggttcagcggcgtgggcgccctggccgagcggtactgcaggagaagtcctgggatcacctgctgcgtgctcttgctcctaaattgctcaggcgtccctatgagcctcgcatcttcattcctaaccggaagcgtagccaagtgtgaaaatgagggtgaggtgctccaaataccatttattactgacaatccttgcataatgtgcgtgtgccttaacaaggaagtaacttgtaagcgggaaaagtgccccgtgttgtcacgcgattgtgcgcttgcaatcaagcagcgtggggcctgttgcgaacagtgcaaggggtgcacatacgaaggcaacacctacaattctagtttcaagtggcagagccctgcagagccttgtgtccttaggcagtgtcaggagggtgtggtgacagagtcaggcgtccgatgtgtggttcactgtaaaaatccgctcgagcacctgggcatgtgttgtcctacctgtccaggctgtgtgtttgagggagtgcagtatcaggagggcgaagaatttcaaccagaaggcagcaagtgtacgaaatgtagctgcaccggtgggcgcacccaatgcgtgcgggaggtatgccctattctgtcctgcccccagcatctgtcacatatccctccggggcagtgctgtcctaagtgtctgggtcagaggaaggtgttcgatttgccttttggaagttgcctctttaggtctgatgtctatgacaatgggtcttcctttttatacgataattgtactgcgtgtacatgccgagacagtacggtagtgtgcaagcgaaagtgcagtcacccaggtgggtgtgaccaggggcaggaggggtgttgtgaagagtgtctgttacgggtaccccccgaggatattaaggtctgtaagttcgggaacaagatcttccaggacggagaaatgtggtccagcataaactgcacaatatgcgcctgtgtgaagggccgtacggagtgcaggaataagcagtgcataccgatctcctcctgcccgcaaggcaagatcctgaacaggaaaggctgctgtcccatctgtacagagaaaccaggcgtctgtaccgtctttggggaccctcattataatacattcgacggccgcacctttaacttccagggtacctgtcagtatgtgctgaccaaagattgttccagtcctgcgagcccctttcaggtactcgtaaagaacgacgctagacgcaccagatcattctcttggaccaagagtgttgagctggtgttgggggaatccagagtgtctctgcaacaacatctgacagttcggtggaacggaagccggatcgcccttccatgccgggctccgcactttcacattgatcttgacgggtatttgcttaaagtgacgaccaaagccgggctggagataagttgggacggcgactcttttgtcgaggtgatggcagctccccatctgaaaggtaagctgtgcggactgtgcggtaactataacggccataagcgagacgatttaataggaggagatgggaattttaagttcgacgtcgacgactttgccgagtcatggcgcgtagagtcaaacgagttctgcaatcgcccccagcgaaaacccgtgccagagctttgtcaaggcaccgtcaaggtgaagttgagagcacatcgggaatgccagaagctgaaatcatgggaatttcagacgtgccacagcacagttgattatgctacgttttaccggagctgcgtcactgacatgtgcgagtgtcccgtgcacaagaactgctactgtgaatcgttcttggcgtacacaagagcgtgtcagcgcgagggaataaaggttcactgggaacctcaacaaaactgcgcagcaacgcagtgtaagcatggagcagtttacgacacatgcggccccgggtgtattaagacctgtgacaattggaacgagataggtccttgtaataaaccgtgcgtggcaggttgtcattgtccagcaaacctggttcttcataagggcagatgtattaaaccagtgttgtgtccccagcggtag

SEQ ID NO: 180637 - DNA, 2058 bp, Artificial Sequence
  Description of Artificial Sequence: Synthetic coding sequence
atgctgtggttcagcggcgtgggcgccctggccgagcggtactgccgccggtctccaggcattacatgttgcgtgctgctgcttctgaattgttccggcgtgccaatgagcctggcctcatcattcctgacagggagtgtggctaaatgtgaaaacgagggggaggtactgcaaataccctttattacagataatccctgtatcatgtgtgtgtgtctgaacaaggaagtcacatgcaagcgcgaaaaatgtcccgttctgagccgcgactgtgccttggccattaaacagcgaggggcctgctgtgagcagtgcaagggctgcacctacgagggaaatacttacaacagttcattcaagtggcagagccctgccgagccatgtgttctgcgccagtgtcaggagggggtggttaccgagagcggggtgcgctgtgttgtacactgtaagaatccactcgagcacttgggtatgtgctgccctacttgccctggatgtgtcttcgagggagtgcagtaccaggaaggcgaagagtttcaacccgagggatccaagtgcacaaaatgctcgtgtactggggggcggacgcagtgtgtgcgcgaagtctgcccgattctgtcctgcccccagcacttaagtcacatcccccccggccaatgttgtccaaaatgtctcggacaaagaaaagttttcgatctcccattcggctcctgcctttttcgttcagacgtctatgacaatggctcttccttcctgtacgacaactgtacagcttgtacttgtcgagatagcacagtcgtgtgtaagagaaagtgcagccatccaggagggtgcgaccaaggacaggagggatgctgtgaagaatgtctgctgcgagttcctcctgaagacattaaggtttgcaagttcggtaacaaaattttccaagacggcgagatgtggagtagtattaactgcaccatctgtgcctgcgtaaaggggcggacagaatgccgaaacaagcagtgtattcccatcagttcatgcccacagggaaagattcttaatcggaaaggatgctgtccaatctgtacggaaaagcccggggtctgtacggtatttggtgatccccactataataccttcgacgggcgcactttcaattttcagggaacgtgccaatacgtccttaccaaggattgttctagccccgcttcaccattccaagtccttgtcaaaaacgatgctagacgcacccgcagtttctcttggaccaagtctgtcgaactagtgctgggggagagcagagtgtctctacagcagcacctgacggtgcgatggaacggctcccggatagctctcccctgtagggcgccccacttccatatcgacctcgatggatatctcctcaaagtaacaaccaaggccggccttgagatcagctgggacggcgatagctttgtcgaagtaatggccgctccacatcttaaggggaaactttgcgggctttgcggcaattataatggacataagcgggacgacctcatagggggcgatggcaattttaaatttgacgtcgatgactttgctgagagctggcgtgtggaaagcaacgaattttgcaatagaccacagcgcaagcccgttcctgagctctgccaaggcaccgtgaaagtcaaactgagagcccatcgcgagtgccagaaattgaagtcatgggaattccagacctgtcattcaactgtggactatgcgaccttctaccgatcttgtgtgaccgacatgtgtgagtgcccggtacacaagaattgttactgcgagagctttctggcctatacgagggcgtgccagagggaaggcataaaagtacattgggagccacagcagaattgtgccgcgacacaatgcaaacacggcgccgtgtacgatacgtgcggacccggatgcatcaaaacctgcgataactggaatgaaattggcccatgcaacaagccctgtgtcgccgggtgccactgccctgcaaatctcgtgctgcataaagggcgttgcataaagcctgtcctgtgcccacagcggtag

SEQ ID NO: 180638 - DNA, 2028 bp, Artificial Sequence
  Description of Artificial Sequence: Synthetic coding sequence
atggacaccaagagcatcctggaggagctgctgctgaagcggagccaacaaaagaagaaaatgtcccccaataactataaagagcgactattcgtgttgacaaaaacgaatctgtcatattacgagtacgacaagatgaagaggggatcccggaagggtagcatcgagattaaaaagatccggtgcgtggagaaggttaatttggaggagcagacacctgttgagaggcagtacccctttcagattgtgtacaaggatgggctactttacgtctatgcttccaacgaagaatctagatctcagtggcttaaagccctgcagaaggagataagagggaacccacatctccttgttaagtaccattccggatttttcgtggacggcaaatttttatgctgccagcaaagttgtaaagctgctccaggatgtactctttgggaagcatacgcgaatcttcatacagccgtgaatgaagaaaaacaccgtgtccctacattccctgatagagtattgaaaatcccaagggcagtacccgtgcttaagatggatgctccgtcctccagtaccacgctagcacagtacgataatgagagcaagaagaactatggctcacaacctccctcatcatcaacctccttggcacagtatgactctaactcaaaaaaaatttacgggtctcagcccaatttcaatatgcagtatataccgagggaggattttccagattggtggcaagtgcgcaagctgaagagcagtagctcgtctgaagatgtggcttcctcaaatcagaaagagcggaacgtaaaccataccaccagcaaaattagctgggaattccccgaatcaagcagttcagaggaggaggaaaatttagacgattacgattggttcgccggcaatatttccagatcccagagcgagcagttgctaaggcaaaaaggaaaggagggtgcctttatggttaggaactccagccaagtcggtatgtacactgtttcactgttttccaaggccgtgaacgataaaaagggcacagtgaagcattaccatgtccacactaacgccgaaaataagttgtatctggcagaaaattactgcttcgatagtattcctaagctaatccactaccatcagcataactcagctggaatgattacacggctgagacatccagtgtctacgaaggccaacaaggtacctgactccgtctcactcggaaatggcatctgggaactgaaacgagaggagatcaccctgttaaaagaattgggctctggtcagttcggggttgtccaactggggaagtggaagggccagtacgacgtggctgtcaaaatgatcaaggagggaagcatgtcggaggatgaattcttccaggaggctcagacaatgatgaaattgtcccacccaaagttggtgaagttctatggggtctgcagtaaagagtacccaatttacatcgtgacagaatatattagtaatggatgcctgctcaactatttaaggtcacatggcaaaggcctggagccttcccaacttttggagatgtgctacgatgtgtgtgaggggatggcctttctggagtcacatcagtttattcatcgcgatctggcagctagaaattgtctagtcgatcgggatctgtgcgtaaaagtgtccgatttcgggatgacgcggtacgtcctcgacgatcagtatgttagcagcgtggggacgaaatttcccgtaaagtggagcgccccagaggtgtttcattactttaaatattcaagcaaatcggatgtgtgggcctttgggatcctaatgtgggaagtattcagcctaggaaagcagccctacgacctatacgataattctcaggtggtactcaaggtcagccaggggcaccggctttacaggccacacctggcaagcgacactatttaccagattatgtactcatgttggcatgaactgcccgagaagagaccaacctttcagcagctcctaagcagtatcgagcctctgagggaaaaggacaagcattag

SEQ ID NO: 180639 - DNA, 2028 bp, Artificial Sequence
  Description of Artificial Sequence: Synthetic coding sequence
atggacaccaagagcatcctggaggagctgctgctgaagcggagccagcagaagaaaaaaatgagcccaaacaactacaaggagcggctttttgtcctcactaaaactaacctgagctattatgaatatgacaagatgaagaggggaagtagaaagggttctatcgaaattaaaaaaattagatgcgtcgaaaaagtgaatctggaggaacagactccggtggagagacaatatccattccagatcgtatacaaagacggcctcttatatgtttatgcctcaaacgaagagtcccggagccagtggctgaaggcacttcaaaaagagatcaggggtaatccacatctgctggtgaaataccatagtggcttctttgttgacggaaaattcctctgctgccagcagtcttgcaaggctgccccagggtgcacactgtgggaagcttatgccaaccttcataccgctgtgaacgaggaaaagcaccgggtgcctacattcccagacagggtgctgaagattccacgcgccgtcccagtactgaagatggacgcaccttcatcgtccaccacactggcacaatacgacaatgaatccaaaaagaactacggttcacagcccccaagttccagcacctccctggctcagtatgattccaattctaaaaagatctatggttcccagcctaattttaacatgcagtatattccgcgggaggattttcctgattggtggcaagttagaaaactcaagtcttcttcctccagcgaagatgtggcgtccagtaatcaaaaggaaaggaatgtgaaccataccacttcaaagattagctgggagttcccagagagcagttccagtgaggaggaggagaacttggatgactacgattggttcgccgggaacatatcaaggtctcagtctgagcagcttttgaggcagaagggtaaagaaggagccttcatggtccggaatagttcccaggtcggaatgtacaccgtttctcttttcagcaaggcagtcaatgataagaagggtaccgttaagcactaccacgttcatactaacgccgagaataaactgtatttagcagagaattactgtttcgacagtattccgaagcttatccattatcatcagcacaattcagcaggcatgatcacacggctccgccaccccgtctccacgaaagccaacaaggtgccagatagtgtctctctgggtaacggaatatgggagctgaagagagaggaaatcactttattgaaagagcttggctctggccaatttggagtggtccagctggggaagtggaaagggcaatacgatgtcgccgttaagatgatcaaggaaggatctatgagcgaagacgagttcttccaagaggcacagactatgatgaagctgtctcacccaaaattggtgaagttttacggcgtgtgtagcaaggagtaccccatctatatcgttactgagtatatttctaacggctgcctgctgaactatctgcgaagtcatggcaaaggcctcgaaccatctcagctactcgaaatgtgttatgatgtctgcgaagggatggcatttctggagagtcatcagtttatacatcgagatctggcggcccgcaattgcctggtcgatcgggatctgtgtgtcaaggtgtcagatttcggcatgacccgctacgttctggacgatcagtacgtcagctccgtgggaactaagtttccggtgaaatggagtgcccctgaggtcttccactatttcaaatacagtagtaaaagcgacgtgtgggccttcggcattctgatgtgggaagtgttcagccttggcaagcaaccttacgacctgtatgacaactctcaggtcgtgctgaaagtgtcccaagggcatagactgtataggcctcatctcgctagtgatactatctaccaaattatgtatagctgttggcacgaattacctgagaaaaggcccaccttccagcaattactctcgtccatcgagcccctgcgggaaaaagataagcactag

SEQ ID NO: 180640 - DNA, 2028 bp, Artificial Sequence
  Description of Artificial Sequence: Synthetic coding sequence
atggacaccaagagcatcctggaggagctgctgctgaagcggagccagcagaagaagaaaatgtctcctaataactacaaggaacgtctcttcgtgctgaccaagacgaacctctcttactatgaatacgataaaatgaagagggggagtcggaagggatcgattgagatcaagaagatcaggtgcgttgagaaggtcaacttagaggagcagaccccagtggagagacagtatccttttcagatcgtttacaaagatggattgctgtatgtttatgcgtctaatgaggaaagtcgatctcaatggctcaaggcacttcaaaaggagataaggggcaacccccacctgttagttaaataccacagcgggttcttcgtggacggcaaattcttgtgctgccagcagtcatgtaaggcagcgccaggctgcaccctgtgggaggcatacgctaacctgcacactgccgtgaacgaggaaaagcaccgcgtgccgacttttccggacagagttctcaagatcccccgtgccgtaccggtattgaagatggacgcaccaagctcgagcacaaccttagcccagtacgataatgaatcaaagaagaactacggaagccagccccccagttcatcgacatcccttgcacagtatgactccaacagtaaaaaaatttatggctcccagcccaactttaacatgcaatatattccccgtgaggatttcccagactggtggcaagtaagaaagctcaagagcagctcatcctccgaggacgtggcgtcttctaatcagaaagaaaggaacgttaaccataccaccagcaaaattagctgggaattccctgagtcttccagctccgaagaggaagagaatctggacgactatgattggtttgctggcaacattagcaggtcccagtcagagcagttattaaggcaaaagggcaaggagggcgcattcatggtgcgcaacagctctcaagtggggatgtacaccgtctctttgttcagtaaagccgtgaacgacaaaaaaggcactgtcaagcattatcacgtccacactaatgctgaaaataaactctacctggccgaaaattactgttttgatagcattcctaagctcatacactaccaccagcataattcagccggtatgattacaagactgcggcatccagtatccacaaaggctaataaggtcccagactctgtgagccttggaaatgggatctgggaactgaagcgagaagagataactctgttaaaggagctgggctctgggcagtttggcgtggtgcagctcggtaagtggaagggacagtatgatgtggccgtgaagatgatcaaagagggttcaatgagcgaggacgagttctttcaggaggcccagactatgatgaagttatcccacccaaagctagttaaattctacggagtttgctccaaagaatacccaatctatatagttactgagtatattagcaatggctgcctcctgaattatctgagaagccatggcaaagggttagagcccagtcagctgttggagatgtgttatgatgtctgcgagggaatggcttttctcgagagccaccaattcattcatagagatctggcggcaaggaattgcctcgtcgacagggatctttgcgtgaaggtgagcgatttcgggatgacaaggtatgtcctggatgaccaatacgtgagttcagtggggacaaaattccccgtgaagtggagcgcccccgaagtctttcattattttaaatattcctctaagagcgacgtatgggcatttggaatcctcatgtgggaggtctttagtctgggaaaacagccatatgacctgtacgacaattcacaggtcgtactgaaagtgagtcaaggccacagactgtacagacctcaccttgcctctgatacaatctatcagatcatgtacagttgttggcacgagctgccagaaaagcgccccacgtttcagcagctgctgtccagtattgaacccctccgggagaaagacaaacactag

SEQ ID NO: 180641 - DNA, 525 bp, Artificial Sequence
  Description of Artificial Sequence: Synthetic coding sequence
atgaccgagctggagtaccccaagggcagcagcatcatgcccgccgccggcactatgtacctcactacatcgacaggttacccttacacgtaccataacggagtcgcctactttcacacccccgaagttactagtgtgcctccaccatggccctcccggagcgtctgttcaagccctgtgatggtggcacaacccatataccagcaaccagcttaccattaccaagctaccactcaataccttcctggacagtggcaatggagcgtgccccagccgtcagcctcaagtgctcccttcctgtaccttcaacccagtgaggtgatataccagcctgttgagatcgcccaggatgggggttgcgtacctccacccctctcgctgatggagactagtgttcccgagccctacagcgaccatggcgtgcaggccacataccaccaagtttatgccccatccgcgataacaatgcccgcacctgtgatgcagccagaacccataaagacggtctggagcatccattactag

SEQ ID NO: 180642 - DNA, 888 bp, Artificial Sequence
  Description of Artificial Sequence: Synthetic coding sequence
atggagaccgagagcggcccccagaccagcaaccagatgcagaccgacagtttgtcacctagcccgaatccagtatctcccgttccactgaataatcccacatccgcccctcggtacggcacagtgatccccaatcggattttcgtcggagggatcgactttaaaaccaacgagtcagatctcaggaaatttttttcacagtacggcagcgtcaaggaagttaaaatcgtcaatgatagagccggtgtgagtaaaggctatggattcgtgacgtttgaaacacaggaagacgcgcagaagatattacaggaagcagagaagttaaattacaaagataagaagttgaacatcggccctgctatccggaagcagcaggttggaattccaagaagctctatcatgccagccgccggaaccatgtacctcaccacaagcacagggtatccgtatacataccataatggtgtagcttacttccacacccccgaggtcacatcagtgccccctccctggccttcacgaagtgtgtgcagctctccagttatggttgctcagcccatttaccagcagcccgcttaccactatcaagctaccacgcaatatcttccgggtcagtggcagtggtcagtaccacagccctcagcctcttcagccccctttctgtatctccagccctctgaagtcatctaccagcccgttgagatagctcaggacgggggttgtgtgcccccacctttgtctttgatggagacatctgtgccggagccgtattcagatcacggcgtacaggccacctaccaccaggtttacgctccgtccgctatcactatgccagcccctgtgatgcaaccagagcctattaaaactgtctggtccattcactattag

SEQ ID NO: 180643 - DNA, 852 bp, Artificial Sequence
  Description of Artificial Sequence: Synthetic coding sequence
atgcagaccgacagcctgagccccagccccaaccccgtgagccccgtgcccctgaataacccaacatctgcacctaggtacggcactgtgatcccgaatagaatctttgtggggggcatcgactttaaaacaaatgaatctgatttgagaaagtttttttcacaatatggaagtgtgaaagaggtcaagatcgttaacgacagggccggagtttcgaagggttacgggtttgtcacattcgaaacgcaggaggacgcacaaaagatactgcaggaggcagaaaaactgaactacaaggacaaaaaactaaacataggtcccgctattcggaagcagcaagtgggcatccctaggagcagtattatgcccgccgcaggcaccatgtacctgactacatcaactggctatccttatacgtaccataacggcgtcgcttactttcacacacccgaagttacgtcggttccacctccctggcccagccggtccgtgtgcagttctcccgtcatggttgcccagcctatataccagcagcctgcgtaccactatcaggctactacacaatatcttcctgggcagtggcagtggagcgtaccacagccttccgcctcctcagccccgttcctgtacctgcaaccctcagaagttatttatcaaccagtcgagatcgcacaggacggaggttgtgtcccccctcccttgtcccttatggaaactagcgttcccgaaccttattcagaccatggggtccaggcaacctaccaccaagtgtacgctccctctgccattactatgccagcccccgtgatgcaacccgagcctatcaagaccgtctggtcaattcactactag

SEQ ID NO: 180644 - DNA, 852 bp, Artificial Sequence
  Description of Artificial Sequence: Synthetic coding sequence
atgcagaccgacagcctgagccccagccccaaccccgtgagccccgtgccgttaaacaaccccacgtcagcaccccgatacggcactgtgatccctaatcggatttttgtgggcggtattgacttcaagactaacgaatccgacctccgcaagttcttttctcaatatggttccgtgaaagaggttaaaatcgtgaacgacagggccggtgtctcgaagggctacggctttgtgaccttcgagactcaggaagatgcccagaagatcctgcaagaagctgagaagcttaattacaaagacaagaaactgaatattggaccagcaatcagaaaacaacaggtaggtattcccaggtctagtattatgccagcagccggcaccatgtatctgacgacctccaccggatacccatatacctatcataatggggtcgcatacttccatactcctgaggtgacatcagttcctcccccatggcctagtcgctctgtatgctctagtccagtcatggtggcgcagcctatttaccagcagccagcctatcattaccaagctactacccagtacttaccaggacagtggcagtggagcgtgccgcagcccagcgcctcctccgccccttttctgtacctgcagcccagtgaagttatctatcagccagtcgagatcgctcaggatggtgggtgtgtgccaccacctctctccctgatggagacgagcgtcccagagccgtattcagaccacggtgtccaagccacttaccaccaagtctacgctccaagcgcaattaccatgcccgcccccgtgatgcagcccgaacctattaaaacagtgtggagcatccattattag

SEQ ID NO: 180645 - DNA, 414 bp, Artificial Sequence
  Description of Artificial Sequence: Synthetic coding sequence
atgctgagcggccggctggtgctgggcctggtgagcatggccggccgggtgtgtctctgtcaaggatccgccgggtccggtgcgataggtcctgtggaagctgcaattaggaccaaactggaggaggcactatccccggaagttctggagttaaggaacgaatctgggggtcatgccgtgcccccaggatctgaaacacactttcgggtcgcggttgtgtcttctcggttcgaaggattaagcccgctgcagaggcacagactggtacacgcggccttggcggaagagttaggtgggccggtccacgcgctcgccattcaggcccggacaccggcccagtggagagagaatagtcagttagacacctcgccaccatgcctcggggggaacaaaaagaccttagggaccccgtag

SEQ ID NO: 180646 - DNA, 414 bp, Artificial Sequence
  Description of Artificial Sequence: Synthetic coding sequence
atgctgagcggccggctggtgctgggcctggtgagcatggccggcagggtttgcttgtgtcaggggtctgcaggctcaggggcaataggccccgtagaggctgcaatccggacgaagctggaagaagctctcagtccagaggtcctagagttgcgcaatgagagtggcggacatgccgtgcctccaggtagcgaaacccattttagagtcgccgtggtatcgagcaggtttgaaggcctaagtccgcttcagagacataggttagtccatgccgctctcgccgaagaactggggggccccgtccatgctctggcgattcaagcccgaacacctgcacaatggagggaaaactcacaactggatacctctcctccgtgtctggggggcaacaaaaagacactgggcacgccctag

SEQ ID NO: 180647 - DNA, 414 bp, Artificial Sequence
  Description of Artificial Sequence: Synthetic coding sequence
atgctgagcggccggctggtgctgggcctggtgagcatggccggcagggtctgcctgtgccagggcagcgccggcagcggcgcaatcggacctgttgaggccgcgataagaacgaaactagaggaggccctgtcccccgaagtgcttgaactcagaaacgagtctgggggacatgccgttccgccaggatcagaaacacacttccgagtagccgtagtttccagcagattcgaggggttgagcccacttcagaggcaccgactggttcatgctgccttggctgaggagctgggaggccccgtgcacgccctcgctattcaagctcgaactccagcacagtggcgggaaaactctcagctggatacgtctccgccgtgtttgggcggtaacaaaaagaccctcggcactccctag

SEQ ID NO: 180648 - DNA, 459 bp, Artificial Sequence
  Description of Artificial Sequence: Synthetic coding sequence
atggccagcgccaagagcctggaccggtggaaggcccggctgctggaaggggggtcaactgccctgacttacgccctggtccgtgcggaggtaagttttcctgctgaagtagcacccgtgaggcagcaggggtcagtggcgggcgcccgggcaggcgtcgtgtccctcctgggttgccgctcttcatggaccgctgccatggagctgagcgccgaatacctgagagaaaaactgcagcgggatttggaagcagaacacgtggaggtggaagacactacgttgaataggtgttcgtgttcctttcgggtattggtcgtttctgccaagtttgaaggaaagcccctgttacaacgccaccggctggtgaacgcctgtctcgccgaagaactaccacacattcacgctttcgagcaaaaaactctgactccggatcagtgggcccgagagcgccaaaaatag

SEQ ID NO: 180649 - DNA, 306 bp, Artificial Sequence
  Description of Artificial Sequence: Synthetic coding sequence
atggccgcctggagccccgccgccgccgcccccctgctgcggggcattaggggtttaccactgcaccatcggatgttcgcgactcagacagaaggagagttacgggtcactcagatactgaaagaaaaattccctcgagcaactgctattaaagtcactgacatctccggcacaaagaggagaaatcagagagacgcatggattgctgatatttacctttgtccccaaacattaaccaccccatggcttcacagatgttgctgcttacggccatggatgaatttcacagatatcattctcccatag

SEQ ID NO: 180650 - DNA, 324 bp, Artificial Sequence
  Description of Artificial Sequence: Synthetic coding sequence
atggccgcctggagccccgccgccgccgcccccctgctgcggggcattagggggctccctctccaccacaggatgttcgccacgcagactgaaggggaactccgggttacacagattctgaaggaaaaatttcctcgcgctaccgctataaaagtgaccgacataagcggaggctgcggcgccatgtatgagatcaagattgaatctgaagagttcaaggaaaaaagaacagtgcagcagcatcaaatggtgaatcaggcacttaaggaggagatcaaagagatgcatggcctgaggatattcacctccgtaccgaaaagatag

SEQ ID NO: 180651 - DNA, 1200 bp, Artificial Sequence
  Description of Artificial Sequence: Synthetic coding sequence
atggcccagcggcagccccacagccccaaccagaccctgatcagcattactaacgacacagagtcctccagctctgtggtgtcgaacgacaacactaataaagggtggtccggtgacaactcgccgggtattgaggcgctctgcgcgatttatattacttacgcagtgatcatttccgtggggatcctaggaaacgctatcttgatcaaggtgttcttcaagactaagtctatgcagaccgtccctaacatcttcataacctcattagccttcggagatttgctattacttctgacctgcgtacctgtggacgccactcactacctcgccgagggatggcttttcggaagaattggatgcaaagtcctaagttttatccgcctaaccagcgtgggcgtcagcgtctttacacttacgatcttaagcgccgaccggtataaagctgtcgtgaagcctcttgaacggcagccatctaacgcgatccttaaaacttgcgtgaaagccggctgtgtttggattgtaagcatgatctttgccctgcccgaggctatcttttccaacgtctatacctttcgcgatccaaacaaaaacatgacctttgaatcttgcacttcttatccagtatcaaagaagctactgcaggaaatccatagcctactgtgctttctcgttttctacattatccctctgagtatcatttcagtgtactattctctgatagcaaggactttatataaaagcactctaaatatcccaaccgaagaacagagtcacgcccggaaacagatcgagtcaaggaagcgcatcgcacgaaccgtgctagtccttgtggccctcttcgctttatgctggctcccgaatcacctcctatatttataccatagtttcacaagtcagacatacgttgacccctccgctatgcatttcattttcaccatcttctcaagggtgctggctttttcaaactcatgtgttaacccatttgccctgtattggttgtctaaatctttccaaaagcacttcaaggcccaacttttctgttgcaaggcagaaaggccagagccgcctgtggccgatacatcgttgacgaccctggcagtcatggggaccgtgccgggaactggcagtatccagatgtcagaaatatcagttacctccttcaccgggtgctctgtgaagcaggccgaagatagattctag

SEQ ID NO: 180652 - DNA, 303 bp, Artificial Sequence
  Description of Artificial Sequence: Synthetic coding sequence
atgcgggccctgaccctgctggccctgctggccctggccgccctgtgtatcgctggtcaagccggagctaaaccttccggcgcggaaagcagtaaaggggccgcgtttgtttccaaacaagagggcagcgaggtggtcaagcggccacggaggtatctttaccagtggctgggagcgcctgtgccttaccctgaccctttggagccccgccgggaggtgtgtgagctgaatccagattgcgatgagttggccgaccacatcggattccaggaggcatacaggcggttctacggacctgtgtag

SEQ ID NO: 180653 - DNA, 957 bp, Artificial Sequence
  Description of Artificial Sequence: Synthetic coding sequence
atggccgcccagggctgcgccgccagccggctgctgcagctgctgttgcaactgcttctgctgttgctcctcttagctgccgggggtgcacgggcgcggtggcgcggagaaggcacctcagcccacctccgggatatcttcctgggaagatgtgcagagtacagggccctccttagtcccgagcagcggaataagaactgtaccgctatctgggaagcctttaaggtggccttagacaaggatccctgctccgtcctcccgtccgattacgacctgttcatcaatctatcacgccactcgatccccagagacaagtccctcttttgggagaattcccacttattggttaattcattcgccgacaacactagacgcttcatgcctttgtcagatgttctgtatggtagagtggccgacttcctgtcttggtgtcggcaaaagaatgactcaggccttgactaccagtcctgtcctactagcgaagactgcgagaataaccctgtggattcgttttggaaacgtgcctctatccaatacagcaaagattcctccggggttattcacgttatgcttaatggcagtgagccgaccggagcttaccctattaaaggattcttcgccgattatgaaattcccaatcttcaaaaggagaagattacccgcattgagatctgggtgatgcatgaaatcggcggacctaacgtcgaaagctgtggcgaggggtctatgaaggtcctggagaagagacttaaagatatgggcttccaatactcctgtataaacgactatagaccggtcaagttgctccagtgcgtggatcactctactcacccagactgcgcgctgaagtctgcagccgccgctacacagaggaaagccccatcactgtacactgagcagcgggccgggctgattatacctttgttccttgttctggcttcaaggacccagctttag

SEQ ID NO: 180654 - DNA, 543 bp, Artificial Sequence
  Description of Artificial Sequence: Synthetic coding sequence
atggccagcaccagctacgactactgccgggtgcccatggaggacggcgataagagatgtaagcttctgctcggtattggaatcctggttcttctcataatcgtcattctgggcgttcctctgatcatattcaccataaaagctaactcagaagcatgtagggatggccttagagcagttatggaatgccggaatgttacgcacttattgcagcaagagctcaccgaagcccagaaaggatttcaggatgtcgaggcacaggccgctacatgcaatcatacagttatggctctaatggcttcgcttgatgccgagaaggctcagggtcagaaaaaggtcgaggagctagaaggagagattacaacgctcaaccataagctgcaagacgcatctgctgaggtggaacgtctgcgacgcgagaatcaggtacttagcgtccgtattgcggacaaaaagtattatcctagtagccaggatagctcttccgccgctgctccccagttactaatcgtactgctagggctcagcgcactgctgcaatag

SEQ ID NO: 180655 - DNA, 651 bp, Artificial Sequence
  Description of Artificial Sequence: Synthetic coding sequence
atggccagcaccagctacgactactgccgggtgcccatggaggacggggataagaggtgtaagttgctattggggatcggaatcttagtgcttctgataattgtcatcctgggtgtgcccctgatcatattcaccatcaaggccaattccgaagcatgcagagatgggcttcgggctgtgatggagtgccgcaacgttacgcatcttttgcaacaggagcttacagaggcacagaaaggattccaggacgtcgaggcccaagcagcaacatgcaaccataccgtcatggccctcatggcctccctggatgccgagaaagctcaagggcaaaagaaggtcgaggagctagagggcgagatcacaaccttgaaccataagctacaagacgcaagtgccgaggtggagcgacttcgccgcgagaaccaggtcctgtcagtccgcatcgccgataagaagtattatccatcgtcacattttccctctacaccacagtctcgccttcagacacagctgacaaccctgaaaatagagatggacgaggctaaggctcagggcacacagatgggagccgagaatggggccctgaccggtgcactgggatgcaaaggggtgggacgtgaccgatctggccgctctctgggcgagtcttag

SEQ ID NO: 180656 - DNA, 1179 bp, Artificial Sequence
  Description of Artificial Sequence: Synthetic coding sequence
atggtgctgctgagcatcctgcggatcctgttcctgtgcgagctggttctgttcatggagcatagggcgcagatggccgaaggcggacagagttctatcgctctgctcgctgaggctcccaccttgcccttgatcgaagaactgctggaggaatctcccggagagcagccccgcaagccccgcctgctcggccacagcttgcgttatatgctcgagttgtatcgccgctcggccgactctcacggccatccaagagagaacagaaccattggagcaacaatggtccggttggttaagccactgactaacgtggctaggccccataggggtacatggcacatccagattttgggctttccgcttagacctaacagggggctgtaccaattggtccgggctacagtagtttatcggcaccaccttcaactgactcggttcaatttatcttgccacgtcgaaccctgggttcagaagaaccccactaatcactttcccagctctgaaggggacagttctaagccctctctgatgagcaacgcctggaaggaaatggatataacacagctcgtgcagcagcgtttctggaataataaaggccatcgcatccttcggctgaggttcatgtgtcagcagcagaaggactctggagggctggaactctggcacgggacttcttcgcttgacattgcgtttctcctgttgtactttaatgacacccataagtcaattaggaaggccaaattcttgccccgaggtatggaagaatttatggagcgcgaatccctcctgcgcaggacaaggcaagccgatggtatcagcgcagaggtcaccgctagctcatctaagcactcaggtcccgagaataaccaatgtagtttgcatccatttcagatctcctttagacagctcggctgggatcattggatcatcgcgccccctttttacacccccaactattgtaaggggacctgtttgcgcgtgctgagagatgggctcaatagccctaaccatgcgattatacagaatctgatcaaccagctggtggaccagtctgtcccaaggccttcttgcgtaccctacaagtacgtcccgatttcagtgctcatgatagaagccaatgggagcattctctacaaggaatacgaagggatgattgcagagtcgtgtacctgtcggtag

SEQ ID NO: 180657 - DNA, 1419 bp, Artificial Sequence
  Description of Artificial Sequence: Synthetic coding sequence
atggccggcgccagccggctgctgttcctgtggctgggctgcttctgcgtgtcattggcgcagggagagcgcccgaaaccaccttttccggagcttagaaaggcagtgcccggagataggaccgcaggggggggtccggactcggagcttcagccacaggacaaggtaagcgagcatatgcttcggctttacgatcgctattcaaccgtgcaggcagcccggacaccagggtccctagaaggcggtagccagccctggaggccaagattgctccgggagggaaatactgtccgctcctttcgcgccgcggccgcagaaaccctggagcggaagggactctacatttttaacctcacttccctcactaaatccgagaacatcctgagtgccaccttatatttctgcattggagagctggggaatattagtctaagttgcccagtatccggggggtgctcccaccacgcccagcgcaaacacattcagatagatcttagcgcctggactttaaaattttctcggaaccaaagccagctgctcggtcacctatcagtagacatggccaagagccaccgcgatattatgagttggctgagtaaagatataacgcagttactgagaaaggctaaagaaaatgaggaattccttatcgggtttaatataacctccaagggtaggcagctgccaaaacggagacttccattccccgagccttatatccttgtatacgccaatgacgccgctataagtgagcccgaaagcgtggtgtcttctctgcaaggccatcgcaactttcccaccggcaccgtccccaaatgggattctcacattagggctgctctatccatagagcgccggaagaaacgaagtaccggggtcctcttgccgctccagaataacgagctccctggagctgagtatcaatacaagaaggatgaggtgtgggaagaacgaaaaccctacaagactctgcaagcccaggcccctgaaaagtctaaaaacaagaagaaacagcgcaaaggtccccatcgcaaaagccagacccttcaatttgacgaacagactctgaagaaggctaggcgaaaacagtggatcgaacctaggaattgcgcccgtaggtatctgaaggtggatttcgccgacatcggatggtccgagtggattatctcacccaagagcttcgacgcctattactgttcgggggcctgtcaatttcccatgcctaaatccctgaagccatctaatcacgcaaccatccagagcatcgtcagagcagtcggcgttgtgcccgggattcctgaaccttgctgtgtgccagagaagatgtcttccctgtccatcctatttttcgacgaaaataagaatgtggtcctgaaagtgtatccaaatatgacagtggagtcatgcgcttgcaggtag

SEQ ID NO: 180658 - DNA, 213 bp, Artificial Sequence
  Description of Artificial Sequence: Synthetic coding sequence
tgcttcttctactacctgaagagcctgaagcccagcaaccacgccacaatacaaagtattgtacgcgctgttggagtcgtgcctggaatacctgaaccctgttgtgtaccagaaaaaatgagcagcctctccatcctatttttcgatgagaataaaaacgtagtgcttaaggtgtaccccaacatgactgttgagagctgcgcgtgtagatag

SEQ ID NO: 180659 - DNA, 1227 bp, Artificial Sequence
  Description of Artificial Sequence: Synthetic coding sequence
atgatccccggcaaccggatgctgatggtggtgctgctgtgccaggtgctcctgggaggcgcttcacacgcaagcctcataccagagactggaaagaaaaaagtggcagaaatccagggccatgctggcgggcgccgctcaggccagtctcacgagctgctgagagatttcgaggcaactttgttgcagatgtttgggctgcggcggcgtccacaaccttcgaagtccgcggtgattcctgattatatgcgtgacttgtacaggctgcagtccggcgaagaagaggaggagcagatacattccactgggcttgagtacccagagcgacccgcttcccgagctaacacagtaagaagcttccaccatgaagagcatctggagaatattcctggtactagcgaaaattcagccttccgcttcttgtttaatctgtccagcattcctgaaaatgaagtcatttcatctgcagaattacgactgtttagggaacaggtagaccagggacctgattgggaacgaggattccaccgcattaatatatatgaggttatgaagccccctgcagaagtggtgcctggacatctgatcacgcgcctgctggatacaaggctcgtacatcacaatgtgacacgctgggaaacattcgatgtctcaccagctgtgctgaggtggactcgggaaaagcagcctaattacgggctagcaatagaggtgacccatttgcatcagacccgcacccaccagggccagcatgtccgtattagccgtagcctgcctcaggggtctggcaactgggctcagttgcggccattgttggtgacctttggccacgacggtcggggacatgccctgactcggcggcgcagggctaagcggagtcctaagcaccattctcagagagccaggaagaagaataaaaactgccggcggcatagcctgtatgtagatttctctgacgtcgggtggaacgattggatcgtggctcccccagggtaccaggctttttattgtcatggggattgccccttcccactggcagatcacttaaactcgacgaaccacgctattgtgcagaccctggttaattctgttaacagctccatccccaaagcctgctgcgtcccaacagagctaagcgctatctcaatgctttatttagacgaatatgataaagtcgtcctgaaaaactatcaggagatggtcgtagaggggtgtgggtgccgatag

SEQ ID NO: 180660 - DNA, 1227 bp, Artificial Sequence
  Description of Artificial Sequence: Synthetic coding sequence
atgatccccggcaaccggatgctgatggtggtgctgctgtgccaggtcctcctgggaggggcctctcacgcctcactcattccagaaacaggcaaaaagaaagtcgccgagatccaaggccatgccgggggtagacgttctggacagagccacgagctgctgcgcgacttcgaggccacactgctgcagatgtttggacttcgccgccgcccccaacctagcaagtcagccgttatcccagactacatgagagatctttatagactgcagtctggagaagaggaggaggagcagattcacagtaccggcctagaataccccgagaggccagctagccgtgccaatactgtgcgaagtttccaccatgaagagcacttagaaaacatccccgggacatcagagaatagcgctttccgtttcttgtttaatctttccagcatccccgaaaatgaggtaatctcaagtgctgaattgcgattgtttagagagcaggtggaccaggggcccgactgggaaagagggttccataggatcaacatatacgaggtaatgaagccccctgctgaggttgttcctggccacctgatcacacgactgctggatactcgcctggtccaccataacgtcacaaggtgggaaactttcgacgtttcgcccgccgtcctgcggtggactagggagaagcagcccaattacggcttggccatagaggtaactcacctgcatcagacgcgcactcatcaagggcagcacgtaagaatttcaaggtcccttccccagggttcaggaaactgggcccagctccgacccctcctggtgactttcgggcacgacggtcgggggcacgccctgactcgtagaagacgcgcaaaacgatcacccaagcaccacagccaaagggctcgtaaaaaaaataaaaattgtcggcgccactctttatatgtggactttagcgatgttggttggaacgactggatcgtcgctccgcctggttaccaggctttttattgccatggcgactgtccctttcctctggcagatcatctgaatagcacaaatcacgccatcgtacagacactggttaatagtgtcaacagctctattccgaaggcttgctgcgtgccaacagagctgtccgccatcagcatgctctacttagacgagtacgacaaggtggtcctcaagaactatcaagaaatggtagtggagggttgcggttgcagatag

SEQ ID NO: 180661 - DNA, 1227 bp, Artificial Sequence
  Description of Artificial Sequence: Synthetic coding sequence
atgatccccggcaaccggatgctgatggtggtgctgctgtgccaggtcttactcgggggcgctagtcacgcttctctcattccagaaaccgggaaaaaaaaagttgcagagatacagggacacgccggaggtaggaggtccggacagtcacacgaacttctgcgtgactttgaagccacccttttgcagatgtttggtttgcgtcgcagaccacagcccagcaaatcagcggtaatccccgattacatgcgtgacttgtaccgcctccagtctggagaggaggaggaggaacagatccactcgacaggtctggagtatcccgaaagacccgcctctcgcgccaacaccgtgcggagcttccatcatgaagaacatctcgaaaacatccccggaacgtcagaaaattcagcatttcgcttcctctttaacctatctagcatcccggaaaacgaggttatcagttctgccgaacttcgacttttccgagagcaggtggaccaaggccctgattgggaaagaggcttccatcgcattaacatttacgaggtgatgaagccacctgccgaagtggtgcctggccacctgattacccgcctgctggacactcggcttgttcatcataatgtaactcggtgggagacatttgatgtaagcccagcggtcctccgctggacaagagagaagcagcctaattacggtctcgccatcgaggttacacacttgcatcaaaccaggactcaccagggacaacatgtgcggatttccaggtcactcccacagggcagtggaaactgggcacagcttcggcccctgctcgtcactttcgggcatgatggacgcggccacgctctgacacggcgccgaagggcaaagcggtccccaaaacaccacagccagagagctcgcaagaaaaataaaaactgcaggcgccattccttatacgtggacttttccgatgtcggctggaacgattggatcgtagccccccccgggtaccaggccttttactgccacggcgattgtcccttccctctggctgaccacctgaacagcacaaatcacgcaatcgtacagacacttgtcaacagcgtgaattcgtctatccctaaggcgtgctgcgtgcccaccgagttgtcagctatatctatgctctaccttgatgaatacgacaaggtagtactcaagaactaccaagaaatggtggttgaggggtgtgggtgtcgctag

SEQ ID NO: 180662 - DNA, 1227 bp, Artificial Sequence
  Description of Artificial Sequence: Synthetic coding sequence
atgatccccggcaaccggatgctgatggtggtgctgctgtgccaggtccttcttggcggcgctagtcatgcttccctgattccagagacaggcaaaaagaaggtggctgagatccagggccacgcagggggcagaaggagtggccaaagtcacgagctcctccgcgactttgaagccaccttgctccagatgttcggcctacgtcggcgccctcagccttcgaaaagcgctgtgattccagactacatgagagacttgtatagattgcagtccggagaggaagaggaagaacagattcactccaccggtctggaatatccagagcgccccgccagcagggcaaacaccgtgagatcttttcatcatgaagaacatctggagaatattcctggcacctctgagaattccgcatttaggtttctgtttaatttgtcctcaataccggaaaacgaggttatctcgagcgccgaactgaggcttttcagagagcaggtagaccagggtccagactgggagcgagggtttcaccgcattaacatatacgaggttatgaagcctccggccgaggttgtgccgggacatttgataacaagactgcttgacacccgccttgttcaccacaatgtcacccgttgggaaacctttgatgtaagtcccgccgtgctccggtggacccgtgaaaagcagccaaactacggtctggctattgaggtgacgcatctgcaccaaacccgaacacaccaggggcaacacgtccggatctctagatcattgccccagggcagcgggaattgggcccagctccgcccactcctggttactttcgggcacgacggacgcggccacgcactaactagacgccggagggccaaaaggagtcctaagcaccactcccagagggctaggaagaagaataagaattgcaggcgacatagcttgtatgtggatttttcagacgtgggatggaatgattggatcgtcgcaccgcctggataccaggccttttactgccacggcgactgtcccttccccttggcggatcatctgaatagcaccaatcatgcgattgtgcagacactggtaaattcagtgaactcgtctattcctaaagcatgttgcgtgcccacagaactgagcgccatcagtatgctctacctggacgaatatgataaggtggtgctgaaaaactaccaggaaatggtggtcgagggctgcgggtgtcgctag

SEQ ID NO: 180663 - DNA, 333 bp, Artificial Sequence
  Description of Artificial Sequence: Synthetic coding sequence
atgatccccggcaaccggatgctgatggtggtgctgctgtgccaggtgcttctggggggtgcgagccacgcatcattgatccccgaaaccgggaaaaagaaggttgccgaaattcaagggcatgctggcggccgtcggtccggccagagccacgagctgctgcgagactttgaagctactctattgcagatgttcggcttacgcagacggccccagccctcgaagtcggccgtgatccccgattacatgcgagatctgtatcggctgcagtctggcgaagaggaggaagagcagatacattccacgggactggaatatcctgaaagaccttag

SEQ ID NO: 180664 - DNA, 1365 bp, Artificial Sequence
  Description of Artificial Sequence: Synthetic coding sequence
atgcacctgaccgtgttcctgctgaagggcatcgtgggcttcctgtggagctgctgggtattagtgggttatgcaaaaggaggtctcggagataatcatgtacacagctccttcatttacagacgcctgcggaaccatgagagacgtgaaatccagcgcgagattctcagtatactgggactgcctcaccgacctaggccattttcacctggcaagcaggccagcagcgcccctttgtttatgctggacctgtataatgccatgaccaatgaggagaacccagaagagagcgaatacagtgtaagagcatccctggccgaggagacccgtggagcacgaaagggctacccggccagcccaaacggctatccaaggaggatccagctgagccgtaccactccactaactacacagtcaccacctcttgcttctctccacgatacaaatttcctcaatgacgcagacatggtgatgtctttcgtgaatctggttgagagggataaggacttctctcatcaacgacgccattataaagagtttagattcgacctgacacagatcccccatggagaggccgttactgcagcagagtttcggatttacaaggacagatcaaataaccggttcgaaaatgagaccattaaaatctctatataccaaatcataaaagaatacacaaatcgcgatgctgatttgttcctcctcgacacccggaaggcacaggcgctggacgtggggtggcttgtgtttgacatcaccgtcacttctaatcattgggtaattaatccccagaataatctcggcctgcagctgtgcgctgaaaccggagacggacgcagcataaacgtcaagagcgccggcctcgtgggacgccagggcccacagtctaagcagccctttatggtggcatttttcaaggcatctgaagtgctgctcaggagcgtgagagctgctaacaagaggaagaaccagaaccggaataagagttccagtcatcaggacagtagcagaatgtcgtctgtgggcgactacaacaccagtgaacagaaacaggcatgtaagaagcatgagctatacgtgtctttcagagatcttggatggcaggactggattatagcccctgaaggttacgctgcattttactgtgatggtgagtgttcgttccccttaaacgctcacatgaatgcaacaaaccacgctatcgtccaaacactggtacatttaatgttccctgaccatgtgcccaagccctgctgcgctcccactaaacttaacgcaataagcgtactttatttcgacgatagtagcaatgtgatcctgaagaaatatcggaacatggtggttagaagttgcggttgccattag

SEQ ID NO: 180665 - DNA, 1254 bp, Artificial Sequence
  Description of Artificial Sequence: Synthetic coding sequence
atgcacctgaccgtgttcctgctgaagggcatcgtgggcttcctgtggagctgctgggttctggttggctacgctaagggaggtctgggagataatcatgtgcacagctctttcatttatcgacgtttgcggaaccacgagcgccgggaaattcaaagagagatcctgagtatcctgggccttcctcatcgccccagacccttttctcctggaaagcaggcatcttccgcccccctatttatgctggatctgtacaatgctatgaccaacgaagagaatcctgaggagtctgaatattccgtcagagcatcgctcgcagaggagacccgtggggcgcggaagggatacccagcaagccccaacgggtatcctaggcgcatccagttgagtcgaacaactccacttactacccagagtcctccgctggccagtcttcacgataccaacttcttgaacgatgcggatatggtaatgagctttgtgaatctggtagaacgcgacaaggattttagccaccaaaggcgacactacaaagagtttcggtttgatctgacccagattccgcatggggaggctgtgaccgcagcagaatttcggatctacaaggaccgcagtaataatcggttcgaaaatgaaactatcaaaatttctatttaccaaatcattaaagagtacactaatcgggacgctgacctattcctcttggacacacgaaaggcccaggcgctcgatgtgggctggttggtgttcgacattactgtgacgagtaatcattgggtgatcaatccacagaacaacctggggcttcagctgtgtgccgagaccggggatgggcgatctatcaatgtgaaatccgccggtctcgtaggcaggcaaggaccccagtccaagcagccttttatggttgcctttttcaaagcttcagaggtgctgttgagaagtgtgcgggcagctaataaacggaaaaaccagaatcgcaacaagtctagcagccatcaagacagttctcggatgtcatcagtgggagactataacacgtcagaacagaagcaggcctgtaaaaagcacgaactgtatgtcagcttccgggacctgggatggcaggtgcatttgatgttcccagaccatgtgcccaaaccgtgctgtgcacccacaaaattgaacgccattagtgtcctatattttgatgactcctccaacgttatccttaagaagtatagaaatatggtagtcagatcctgtggatgtcattag

SEQ ID NO: 180666 - DNA, 1542 bp, Artificial Sequence
  Description of Artificial Sequence: Synthetic coding sequence
atgcccggcctgggccggcgggcccagtggctgtgctggtggtggggacttctctgcagttgttgcggcccccccccgctgagaccacccttgcctgcagcagccgccgccgccgcggggggacaattactgggagacggtggttctccaggtcgaaccgaacagccccccccgtcgccccaatcaagttccgggttcctgtacagaagacttaagacccaggagaagagggagatgcagaaagagatcctgtctgtgctagggcttccccaccggccccgccccctacatggtcttcaacagccacagcccccggccttgcgccagcaggaggaacagcagcagcagcagcagctcccaaggggagaaccccccccaggacgacttaaatctgcacccctgtttatgctcgacctttataacgccctgagcgcagacaacgatgaggacggcgcttccgagggtgagcgacagcagagctggccccacgaggccgctagctcttcccagagaagacagcccccgcctggggctgcccacccactcaataggaagtctctgctcgcgccaggcagcggatcgggcggtgcttccccattgacctctgcccaggacagcgccttcttaaacgacgctgatatggtgatgtctttcgtcaacctggtggagtatgataaagaattctctcctcgtcagaggcatcacaaagagtttaagttcaatctgtcacagatccccgaaggagaagtggttacagccgctgagttccgtatatacaaagactgtgtgatgggcagtttcaagaaccagaccttcctgatttcaatctaccaagttctgcaggagcaccagcacagagactccgatcttttccttctcgacacccgagtggtgtgggcttctgaggaaggttggctcgagttcgatattacagcaacgagcaacctgtgggtggtgactcctcagcataacatggggctccagctttcggtggtgacacgggatggagttcatgtccaccctagagccgccggactcgtcggaagggacggaccctatgacaagcagcccttcatggttgcattttttaaggtctctgaagtgcatgtgcgcaccacgagaagcgcctcctctcggagacgccaacaatcaagaaataggtcaactcagagccaggacgtggctcgagtgagctccgcctcagattataatagctctgagctcaaaacagcctgtaggaaacatgagctgtacgtttctttccaggacctgggctggcaggactggataatcgccccgaaagggtatgctgctaattattgcgatggtgaatgtagcttcccgctgaatgcccacatgaatgcaacaaatcacgcaattgtccaaaccttagtgcaccttatgaatccagaatatgtcccaaaaccctgctgcgcacctaccaagctgaacgcgatctctgtcctgtattttgacgacaatagcaacgttatactgaaaaaatatcgcaatatggtggttcgagcctgtggatgccactag

SEQ ID NO: 180667 - DNA, 1308 bp, Artificial Sequence
  Description of Artificial Sequence: Synthetic coding sequence
atgcagaaggagatcctgagcgtgctgggcctgccccaccggccccgaccactccacggcctgcagcagcctcaaccacctgcgttgcgacagcaagaagagcaacagcagcagcagcaactgcctaggggggaaccccctccgggtcggctaaagagtgcccccctgttcatgctcgatttgtataatgcactttccgctgacaacgacgaggacggggcatctgagggggaacgacagcagagctggccgcacgaggcagcaagtagttctcagaggcgtcaacctccccctggcgcggcccaccctctaaacaggaaaagtctcctggcccctggctctggttcaggtggcgcctcccctctcacatccgcacaggattccgccttcctgaacgatgcggacatggtgatgtcttttgtgaatctcgtggagtatgacaaggaattttcccctagacagcgccaccacaaggagtttaaatttaacctcagccagatccctgagggcgaggtggtgacagctgcggaattcaggatctacaaggattgtgtgatgggatccttcaaaaaccaaactttcctcatctcgatctatcaggtattgcaggaacatcagcatcgtgactccgacttatttttgctggacaccagagtggtttgggcaagcgaggaggggtggctggagttcgacatcactgctacctctaacctttgggtggtcaccccacaacataacatgggcttacagctgagcgtggtgaccagggacggcgtgcatgtgcatccgcgggccgcgggcttagtggggagggatggcccctatgacaaacagccctttatggtagcatttttcaaagtatcagaggttcacgtgcgcacgacgcgcagcgcttcctccaggaggcgccagcaatctcggaaccggtcaactcaatcacaggatgtggcccgagtgtcctccgcatcagactacaacagcagtgaactaaaaactgcctgcaggaaacatgaattatacgtgagctttcaggacctgggatggcaggactggattatcgcaccaaaggggtacgcggccaactactgtgacggagagtgttcctttcctctgaatgcccacatgaatgctacaaaccatgctatcgtccagaccttagtgcaccttatgaatcccgagtacgttcccaagccgtgttgtgcacctaccaaactgaatgctattagtgtcttgtacttcgacgataactctaacgttatcctgaagaagtatcgcaacatggtggtgcgcgcttgcgggtgccattag

SEQ ID NO: 180668 - DNA, 1431 bp, Artificial Sequence
  Description of Artificial Sequence: Synthetic coding sequence
gccgccggcggccagctgctgggcgacggcggcagccccggccggactgaacagccccctcccagtccacagtcatcctctggctttctatatcgccggctcaagacccaggagaagcgggaaatgcaaaaagaaatcttatccgtactcggactaccgcatcgcccccggcctttgcacggtctgcagcagccgcaacccccggctctacgccagcaggaggagcaacagcagcagcaacagctgccaagaggggaacccccacctggtcggctcaagagtgcccccctgttcatgctcgatctctataatgcactttccgcagacaacgacgaagacggcgcaagcgaaggcgagcgccagcaatcgtggcctcatgaggccgccagctcttcacagcgccgccagccccctcctggcgctgctcacccccttaatcggaaatcattgttagcgcccggatcaggctcgggcggtgcgagcccactcacctccgcccaggactcagcttttcttaacgacgcagatatggtcatgagtttcgtgaatctggttgagtacgacaaagagttcagcccaagacagcgacaccataaggaattcaaattcaacctttcccagatcccggagggggaggtcgtgactgcggccgagtttcgaatttacaaagattgcgtgatgggatcatttaagaaccagacttttttgatctctatctaccaggtattgcaggagcatcaacaccgggactccgacttgttcttgctggatacaagagttgtatgggctagcgaagagggctggctggagttcgacataaccgcaacatcaaatctctgggtcgtgaccccacaacataacatgggcctgcaattgtccgtcgtgacaagggatggcgtccacgtgcatcctagagctgctgggcttgttgggcgggacggaccatatgacaaacaacctttcatggtagctttcttcaaagtcagtgaagttcacgtgaggactacaagatcggcctcctccagacgcaggcaacaatccagaaatcgctccactcagtctcaggacgtggctagagtttccagcgccagcgattacaacagtagcgagctgaagacagcttgccgaaagcacgaactgtacgttagttttcaggacctgggatggcaggattggatcatagcaccaaagggctacgctgcaaattactgtgatggagagtgctcttttcctctgaatgcccacatgaacgctaccaatcacgctatcgtgcagacattagtccaccttatgaatccagagtacgttccaaagccttgctgcgccccaaccaaactgaacgccattagtgtcctttatttcgatgataacagcaacgtcatcttaaaaaaatatcggaatatggtcgtcagagcttgcgggtgtcactag

SEQ ID NO: 180669 - DNA, 2505 bp, Artificial Sequence
  Description of Artificial Sequence: Synthetic coding sequence
atggaggagaagacccagatcaagaccttcctgggcagcaagctgcccaaatatggtactaagtccgtccgaagcaccctgcagccaatgcccaatgggactcctgtgaatcttctgggcacctctaagaattccaacgtgaaatcttatataaagaataacggatctgactgcccctcctctcactctttcaactggaggaaggccaataaataccagctttgcgcccagggggttgaggagccaaataatactcagaactctcacgataagataatcgacccggagaaaagagtccctacccagggtatgtttgacaaaaacggtataaaaggtgggttaaaaagcgtgtcgctgttcacgtctaaacttgcaaagccctctacaatgtttgtgtcgtccaccgaagagcttaaccagaaaagctttagtggaccctcaaacctcggaaagttcaccaaaggcactctgctaggtcggacatcatacagttctattaatacaccaaaatcacaactgaacgggttttatgggaaccgctcagcaggcagcatgcaacggcccagggcgaatagctgcgcaactcgatcatcgagcggagagtctcttgctcagtctcccgattctagcaagtcaatcaactgcgagaaaatggtgaggtctcagagcttctctcactccattcagaatagctttttgccaccttcctcaatcactcgtagccatagttttaatagagcggtggacctaaccaagccctatcagaaccagcagctgtcaattagagtgccacttcgctcaagcatgctcaccaggaattcacgccagcccgaggtgttgaatgggaacgaacatcttgggtacggtttcaataggccctacgccgcgggcggcaagaaacttgctttaccgaacggtcccggcgtcaccagcaccctcgggtacaggatggtgcacccatccctattgaagtcctcgagaagcccattctcaggcaccatgaccgtcgatggcaacaagaatagcccggcggacacatgcgtagaagaggacgctactgtcttagcaaaggaccgcgccgccaacaaagaccaggagctgatcgaaaacgagtcttatcggactaaaaacaatcaaacaatgaaacatgatgccaagatgaggtacttaagcgatgacgtagacgatatctctttaagctcgctgagctcgtcagataagaacgatctcagcgaagatttcagtgacgacttcattgacattgaggactctaatcggaccagaattacaccagaagaaatgtccttaaaggaagaaaagcacgagaacggcccaccccaagatatgtttgacagtccaaaagaaaatgagaaggccttctctaagaccgacgaatggattgacattagcgtgtccgaccgtagcgagtgcaccaagcatacctccggcaacaatctcgtctccccggatactgattaccgtgccgggtcctccttcgaactaagcccaagtgatagctcggatggtacttatatgtgggatgaagagggcctggaaccgattggcaacgtgcaccctgttggcagttacgagagtagcgaaatgaatagtattgacatactgaataacctggagagctgtgatctagaggacgacgatctaatgctcgatgtcgacctgcctgaggacgcccctctcgagaacgtcgagtgtgataatatgaacaggtttgacaggccggaccgaaacgtgcggcagcctcaagaaggcttttggaaacgcccaccccagagatggagcggacaggaacactaccacctgtcccaccccgaccactaccatcatcatggcaagtctgatctgtctcgtggatctccataccgtgaatcccccctgggacacttcgaatcctacggcggaatgcccttcttccaggcccaaaaaatgttcgtggatgtgcccgaaaatacggtgatactggatgagatgacactgcggcatatggtccaggattgcaccgctgttaaaacacagctgctgaaactgaaacgactgctacaccagcacgacggtagcggctcacttcacgatatccagctgtccctgccgagcagccccgagcccgaggacggtgacaaggtttataagaatgaagacctactgaatgagattaagcagctgaaggacgagatcaagaagaaggacgaaaaaatccaactgttggaactacagctagccacccaacatatttgtcaccagaagtgcaaggaggagaagtgcacttatgcggacaagtacacccaaactccatggaggcgcattcctgggggctactcggcccccagtttttccccttggcagggttccttccagggcattcccaggaccgtgcctcctcataggagacagacaagcagcaccactgcgttccagcagccttctcagacacatcgatctcatccaggaaagactaataaggcaaccacttatagaggacctcagtag

SEQ ID NO: 180670 - DNA, 1599 bp, Artificial Sequence
  Description of Artificial Sequence: Synthetic coding sequence
atgccccagctgtacatctacatccggctgctgggcgcctacctgttcatcatatccagagtgcaaggtcaaaatttggactccatgcttcacggcaccggaatgaaaagcgactctgaccagaaaaaaagcgagaatggtgtcacgctggcccctgaggatacattgcccttccttaagtgctattgctcagggcattgtcccgatgacgcgattaataacacctgcatcactaacgggcattgcttcgccattatcgaagaggatgatcaaggagagacaacgcttgcttcaggatgtatgaaatacgaaggtagcgacttccagtgcaaggactccccaaaagctcagctgcgtcggactattgagtgctgccgcacgaatctctgcaaccagtacctgcaacccacccttccccccgtggtgattggccccttttttgacggaagtatccgctggctggtcctgttgatttcgatggcggtctgtataatcgccatgatcatattctcttcttgcttctgttataaacactactgcaagtcaattagttctaggcggcgctataaccgcgatttggagcaagatgaggcatttatcccagttggcgagagtctgaaggacctcatcgaccagagccagagctccggttcgggctcaggcctgccactattggtccagaggaccatcgcaaaacaaatccagatggtgcggcaggtcgggaaaggaagatacggagaagtgtggatgggcaaatggaggggcgaaaaagttgccgtcaaagtgttttttaccactgaggaagcttcctggtttagggagaccgaaatttaccagaccgtcctgatgagacacgaaaatattttggggtttatcgccgcagacatcaagggcactggctcttggacccaactgtacctcatcacagattatcacgagaacgggtccctgtacgactttctgaaatgcgcgacactggacacacgggccttgttgaagctggcgtattccgccgcctgcggcctatgccatttacatactgaaatttatggtacccaggggaagcctgctattgcacacagggatttaaaaagcaaaaacatactcattaaaaaaaatggcagctgttgcattgccgacctgggcctggcggtgaagtttaattccgataccaatgaagtagatgtgccacttaatacaagagtgggaacaaaaaggtatatggcacccgaggtgctagacgagagtctgaataagaatcattttcaaccctacatcatggctgacatctactcgtttggcctgatcatctgggaaatggcgagacgatgtatcaccggcggcatcgtcgaggagtaccaactgccatattacaatatggttccgtcggacccaagttacgaagacatgcgggaggtagtgtgcgtcaaacgattgcgacccattgtgtctaaccggtggaattccgacgagtgtttaagagcggtgctcaagctcatgtcggaatgctgggcccacaaccccgcctcccgactgactgctcttcgaatcaagaagaccctggctaagatggttgagtcacaggacgtgaagatctag

SEQ ID NO: 180671 - DNA, 3117 bp, Artificial Sequence
  Description of Artificial Sequence: Synthetic coding sequence
atgaccagcagcctgcagcggccctggcgggtgccctggctgccctggaccatactgctggtgtctactgccgcggcctcgcagaaccaggagaggctatgtgccttcaaggacccttaccagcaggacttaggaatcggcgagtctaggatctctcatgagaatggcaccattctctgctcaaaggggtccacttgttacggtttatgggagaagtcgaaaggcgacataaacctggtgaagcaagggtgctggtcacacattggcgacccccaagagtgtcactacgaggagtgtgtagtcaccactacacctccaagcattcaaaatggaacgtatcggttctgttgttgctccaccgatctgtgtaatgtgaattttacggagaacttcccccctcccgacaccacccccttatcacctccacacagtttcaacagagatgagactatcatcatcgcgctcgccagcgtgtcagtcctcgcagttctcatagtggcattgtgttttggctataggatgctcacaggcgacaggaaacagggtttgcatagcatgaatatgatggaggctgcggccagcgagccatccctggacctggacaatctaaagctgctcgagctcattggccgaggcaggtatggagctgtttataagggttctctggacgagaggcctgtggcggtcaaggtctttagctttgccaatcgacagaactttattaatgaaaagaacatttatcgcgtgccgctgatggagcatgataacatagcccgctttatagtgggtgatgagcgcgttactgctgatggtaggatggaatacctactggtgatggagtactacccaaatgggtccttgtgtaagtacctgtcactgcacacatctgactgggtgtccagctgccggcttgcccattcagtgactaggggactggcttatctgcatactgaattgcctcggggcgatcattataaacctgcaataagccatcgcgacttgaattcccgcaatgtcctcgtgaaaaacgacggcacatgcgtcatctctgattttggacttagcatgcgcctgactggcaatcgtctcgtacggcccggggaagaagataatgcagcaatttcagaagtcggtacaataagatacatggccccggaagttttggagggagcagtaaacttaagggactgtgaaagtgcacttaagcaggtagacatgtatgcactggggttaatttattgggagattttcatgcggtgtactgacctgttcccaggggaatctgtgccagagtaccagatggcatttcaaactgaggtgggcaaccaccccaccttcgaagatatgcaggtgctggtgtcgcgtgaaaagcaacggcctaagttcccagaggcgtggaaggagaatagcttggccgtccgatccctgaaagaaaccatagaagactgctgggatcaggacgcagaggccaggctgacggcacagtgcgccgaggaaaggatggctgagctgatgatgatttgggaaagaaataaaagtgtctcccccacagttaaccccatgtccaccgccatgcagaatgagcggaaccttagccacaacagacgggtgccaaaaatcggaccttatcccgactatagctcctcgagctacattgaggactccattcaccacaccgactcaatagtgaaaaatatcagtagcgagcactcaatgtcttctaccccgctaacaatcggagagaagaatcgcaacagcattaattacgaaagacagcaagcccaggcccggattccatcccctgaaacctccgtaactagcctcagtactaataccacaactacaaatactaccggcctgaccccctcaactggcatgactacaatttccgagatgccttacccagacgaaaccaatctgcatacaactaatgttgcccagagtatagggccaaccccagtgtgtctgcaactgactgaggaggaccttgagacgaacaaactggacccgaaagaggtggataagaacctgaaggagtcaagcgatgaaaatttaatggagcactccctcaagcaattctccggcccagatcccctgtccagtacttccagttcccttctgtacccattaattaagctagcagtggaggccacaggacaacaggatttcacgcagacagctaatggccaggcatgtttaatacccgatgttcttcctacccagatttatcccctgccaaagcaacagaatctgccaaagaggcctaccagtctgccactgaataccaagaactcgaccaaggagccccgcttgaaattcggaagcaagcacaagagcaaccttaagcaggtcgagaccggagtggctaagatgaacacaattaacgctgcagaaccacatgtcgttactgtgacaatgaacggcgtggccgggagaaatcactcagttaatagccacgccgcaactactcagtacgcaaatggaaccgttttgagcggccaaaccacgaacatcgtgacacacagagctcaggaaatgctccagaaccaatttataggagaagatacccggcttaacattaatagcagccccgatgagcatgaaccactgctccgtcgggagcagcaggcaggccatgatgaaggcgttctcgatagactcgtcgataggcgcgaaaggcccttagagggcggacgaaccaatagtaacaacaacaactcaaacccgtgttctgagcaggacgttctggcacaaggggttccttcaaccgctgccgaccctggtccttctaaacctagacgagctcagagacccaacagcctggacctcagcgctaccaacgtcctggatgggtccagtatccaaataggggagtctactcaggatgggaaaagcgggagcggcgaaaaaatcaagaagcgcgtgaagacaccctactccctcaagcgctggcggccttctacttgggtgatctcgaccgagagcctggactgcgaggtgaacaacaatggctccaacagagcggtacactccaaatctagcaccgccgtgtacctcgctgaagggggtaccgccactacaatggttagcaaggacatcggtatgaactgcctatag

SEQ ID NO: 180672 - DNA, 2337 bp, Artificial Sequence
  Description of Artificial Sequence: Synthetic coding sequence
atgagcagcggcgccaaggagggcggcggcggcagccccgcctaccaccttccccatcctcacccccaccctccccagcacgcccagtacgttggcccttacaggttggagaagacccttggcaagggccagaccggattggtgaagctgggcgttcactgcatcacaggacagaaagtggcaattaagattgtcaacagggaaaagctgtcagagagcgtgctcatgaaggtcgaacgagagattgcgattctgaagctgatagaacacccgcacgtgcttaagttgcatgacgtctatgaaaacaagaagtatttatatctggtcttagagcacgtttccgggggggaactctttgattacctagtcaaaaagggtcgtttaacccccaaggaagctcgcaaattcttccgccagattgtttctgctttagatttctgccacagctatagcatctgtcacagagatcttaagcctgaaaatttacttcttgacgaaaaaaacaacatccggatagcagacttcggcatggcctccctgcaggtgggtgactccctattggaaacgagctgcgggagtcctcactatgcatgtcccgaagtcattaagggcgaaaagtatgacggcaggagggctgatatgtggtcttgtggtgtcatcttgtttgcactgctggtgggtgcactccctttcgacgatgacaatctccgccagctgctggaaaaggtaaaaaggggcgtctttcacatgcctcatttcattccaccagactgtcagtcccttctgcgaggaatgatagaagtggagcccgagaaacgcctgtcattagaacagattcaaaagcatccgtggtatctaggaggcaaacacgagcccgatccatgcctggagcccgcacccggccgtcgtgtcgctatgaggtccttgccaagcaacggagagctggatccagatgtcttggagagcatggcgagcctggggtgcttccgtgatagagaaaggctgcacagagaactccgctccgaagaggagaaccaggagaagatgatctactatctcctgctggatcgcaaggagcgctacccatcttgcgaggatcaggatctgccgccacgaaacgacgtcgacccacccagaaagcgcgtagattccccaatgttgagccgtcacggtaaaaggcggccagaaagaaagtctatggaggtcctcagtatcacggacgccggcggtggcgggtctcctgttcccacaaggcgagccctggagatggcgcaacactcccagagatcgcggagtgtgagtggggcctccacaggactctcctcaagtccccttagcagtccccggtcccccgtcttttccttcagtcccgagcccggagcgggcgacgaagcgaggggcggcggctcccctacatctaagactcagactcttccaagccggggcccccgcggcggaggggctggtgagcagccacctccaccttccgcgcgctccactccgctgccaggtcctcccgggtcccccagaagctcagggggcacgcccctccattcgccacttcacacgcctcgagcaagtccaactgggactcctggtactacacccccaccttcgcccggtgggggagttgggggggccgcttggaggtcacgactcaattctattcggaacagcttcctcgggtctcctcggtttcatcgacgcaagatgcaggtccctacagctgaggagatgagctctttaaccccagagagttcacccgagctggccaaacgaagttggtttgggaattttattagcctggataaggaggagcaaatcttcttggtgcttaaggacaaaccactgagcagtatcaaggctgatatcgtccacgcattcctgagtattccatcgttgagccacagcgtcctgtctcagacatccttcagagctgagtacaaagcctctgggggtccttccgtgtttcagaagcctgtacgatttcaagttgatatctcttcgagcgaaggaccagagccaagtccccgacgtgacggaagcggaggtggcggaatctacagtgtgactttcacactgatctctggccccagccgccggttcaagcgagtggtggaaacaattcaggcccaactcttgtccactcacgaccagccttcagtgcaggcgctagcggatgaaaagaatggggcccagacaagaccagctggtgcgccacccaggtccctgcagcctccccctggtcggcccgacccagagctgagcagttccccacgacgtggacctcccaaagataagaaactgctggccacaaacgggactcctttgccctag

SEQ ID NO: 180673 - DNA, 1422 bp, Artificial Sequence
  Description of Artificial Sequence: Synthetic coding sequence
atgcggagcctgcccagcaacggcgagctggaccccgacgtgctggaaagcatggcttccctgggatgctttcgtgacagagagcgcctacatagagaactgagaagcgaggaagaaaatcaagaaaagatgatttattatttgctcttggacagaaaggagaggtatcccagctgcgaggaccaggatctgccaccacggaacgatgtcgatccacctcggaagagagtggattccccgatgctcagccgccacggtaaaaggcggcccgagcgaaaaagcatggaggtattgtccataacggacgccggcggaggaggttctcccgtgcccacgcgaagagccctggaaatggcgcaacactctcagaggagtagatccgtatctggtgcatccacaggccttagctcgagcccgctcagtagtccacgctcccccgtgtttagtttttcccccgagcctggagccggcgacgaagcacggggcggaggctccccgacctctaagacacagacccttccatcacgcggcccacgaggggggggtgcaggcgaacagccccctccaccttctgccaggtcaactccactgcccggtccccctggttcaccccgaagctcagggggtacccctttacacagtcctctacacaccccccgagcgtctcccaccggtactcccgggactacgccacctccttctccaggtggcggcgttgggggcgctgcatggcgctccaggttgaattcaatccgcaactcgtttcttggcagtcctcgtttccacagacggaaaatgcaggtgccaaccgctgaagaaatgagttcactgaccccagagtcatcacctgaacttgccaaaaggagttggtttggaaactttatctctctggacaaagaagaacagatttttctggttctgaaggataaacccctgtcttcaattaaggccgatattgtacacgccttcctgagcatccctagcctttcacatagtgttctgtctcagacaagtttcagagctgaatacaaggccagcggcggccccagtgtgtttcagaaaccggtgcgctttcaggtcgacatctccagctcagaaggtcccgaacctagcccccgacgagacgggagcgggggcggtggaatctactctgttacttttacactcattagtggaccatcccgccggtttaaacgagtggtagagacaattcaagcccagttgctcagtactcacgaccagcctagcgtgcaggctctggccgacgagaaaaatggtgcacagactcgacctgcaggcgcgcccccgcgatcactgcagccaccccctggcaggcctgatccggagctaagcagctctcctaggaggggacctccaaaggacaaaaaactgctggcaacgaatggtacaccgctaccgtag

SEQ ID NO: 180674 - DNA, 1422 bp, Artificial Sequence
  Description of Artificial Sequence: Synthetic coding sequence
atgcggagcctgcccagcaacggcgagctggaccccgacgtgctggagagcatggcgtcgctcgggtgttttcgtgaccgggagcgcctgcaccgtgaactcaggtccgaagaagaaaatcaagagaaaatgatctactatctgttactcgataggaaagagagataccctagttgcgaagatcaggacctgccacccagaaacgatgtggacccgccacgtaagagggtcgactcccctatgctaagccgacacggaaagagacgccccgaacggaagagcatggaggtcctcagcattacagacgctggtgggggcggttcgcccgtgcccacacgtagagctctggagatggcccagcacagtcaacggtcacgaagcgtgagtggagcctcaacggggcttagctcgtctccactgtcctcccctagatcacctgtcttctctttctctcctgaacctggcgctggtgatgaggcacggggcggcggttcccccacatccaagactcagactttacctagccgagggcccaggggaggcggtgccggagaacaaccgcctcccccttcagctcggagtacccccctgcccggccccccaggcagtcctagaagcagtggcggtacgccactgcacagccccctgcacactccccgagcctcccctaccggaactcccggaacaactcctcctcctagcccagggggcggtgtgggcggggctgcatggcggtcgcggttgaattctatccggaatagctttctgggctcccctcgattccaccgcaggaagatgcaagtgcccacagcagaggagatgtcttccctgactccagagtcttcacccgaactggccaagaggagctggtttggaaattttattagcctcgataaagaagagcagatttttttggtactcaaagataagccattgagctccatcaaggcagatattgtacatgcttttctgagtatcccatctctgtcccatagcgtgctgtctcaaacttcatttcgtgctgaatataaggcatcaggtggtccgtcagtttttcagaagccagtgaggtttcaagtcgacatttcttcctcagaaggacccgagccttcacctcgcagggacggctcggggggaggtggcatttattctgtgaccttcacactcatcagcggtccctcccggcgattcaaacgggtggtggagaccattcaggcccaactgctctctactcacgatcaacccagcgttcaggctcttgccgacgagaagaacggcgcgcagacaaggccagcgggtgcccccccacgcagtcttcagccaccacctggtcggccagacccggaattatcatcctctccaagaagaggtcctcccaaggacaaaaaattgctggccaccaacggaacccctctcccctag

SEQ ID NO: 180675 - DNA, 2976 bp, Artificial Sequence
  Description of Artificial Sequence: Synthetic coding sequence
atgcggcaccgggtgtgccggggccggagcggccagggccggcggcgctctagcgttattccttggcctgtacccaaacatgtgggctgggtggtactgctggggtgtggggggagtggcacatccatcctggtcgtgtcgatcgtgggatcaggcttaatcaaggcgatggcccccgctgaaattcttaacggaaaagaaatctccgcccagataagagctcgcctgaagaatcaagtgactcagttgaaggagcaggttcccggattcactccgcggttggccatcttgcaggtgggtaatagggacgactccaatctatatatcaacgtgaagctgaaggccgccgaagaaatcggtattaaggcaacccacatcaaactgccaagaaccaccaccgagtcagaggttatgaaatacataactagtttaaacgaagattctacggtccacggatttctcgtgcaattaccactcgattctgagaactccataaacactgaagaggtgatcaatgcaatcgccccggaaaaagatgtggacggactgacctctattaatgccggtaaattagcccgaggcgacttgaacgattgcttcataccctgcacaccaaagggctgcttggagctgattaaggagacaggcgtgccaattgcagggaggcacgctgtggtggtgggccggagcaagatagttggagcgccaatgcacgaccttctgctgtggaacaatgcaaccgtgactacctgccactctaaaactgcccacttggatgaggaggtgaacaagggcgatatcctggtggtagctactggccagcctgagatggtcaaaggggaatggatcaagcccggcgccatcgtgatcgactgtgggattaactatgtgcccgatgacaaaaaaccgaatggtaggaaagtggttggcgacgtggcgtatgacgaagcaaaggagagagcaagttttatcacaccggtgcctggaggtgttggtccgatgaccgttgccatgctaatgcagtcaactgtggaaagcgcgaaacggttcctcgagaagttcaagccaggaaaatggatgatacagtataataatttgaatttaaaaacccccgtgccatccgacattgacatctcacggagctgtaagcctaagcctatcgggaaactggcccgggaaattggattgttgtccgaagaggttgaactctacggcgagacaaaagccaaggtcctgcttagtgctttagaacggctaaaacaccgacctgatggaaaatacgtggtggtcaccggcattacccctactcctctgggggaagggaagagcacaacaacaatcgggcttgtgcaggcactcggagcacatctgtaccaaaatgtgttcgcctgtgttcgccagccaagccaaggcccgacgtttggcataaaaggaggggcagccggtggaggatatagccaggtgattccaatggaggagtttaacttgcacctgaccggcgatattcacgctatcactgcagcaaacaacctagtcgctgctgcaattgatgcccggattttccacgagctgactcaaaccgataaagcacttttcaaccgtctcgttcccagcgtgaacggggtcaggcgcttctccgatattcaaattcggaggcttaaacgcctagggatcgagaaaaccgatccaactactctgactgacgaagaaattaataggttcgcccggttagatatcgatcctgagacaattacttggcagcgtgtgctggatacaaatgatcggtttttgcggaaaatcacaatcggccaagctccaacggaaaagggacacacaaggacagcccagtttgatattagcgtggccagtgaaattatggcagtattagccctcacaacctccctcgaggatatgagggagcgactgggaaagatggtggtagccagtagcaagaaaggcgagccggtcagcgctgaagacctcggcgtgtccggagctctgacagtgttaatgaaggatgcgatcaaacccaatctgatgcagacactcgaaggcacgccagtgtttgtccacgctgggcctttcgctaacatcgcacacgggaacagcagcattatagcagacagaatagccttgaaacttgtcggccctgagggcttcgtagtgaccgaggccggctttggggccgacatcggcatggagaagttctttaatatcaagtgtcgttatagcggactgtgccctcacgtcgtcgtgctggttgctacagtgagggcactcaagatgcacgggggggggcctaccgtcaccgccggtctgccacttcccaaggcttacattcaggaaaacctggagctcgtagaaaaagggttttcaaatcttaaaaaacaaattgagaatgctagaatgtttggtattcccgtcgtagttgcagtgaacgcatttaagacggacacagagtctgagctggacctcatctcccggctttctcgggaacacggggcgtttgatgccgtgaaatgtacacattgggccgagggagggaaaggagctctcgccttagcccaggccgtccagagggctgcacaggccccgagctcgttccagctcctttatgacctgaagttacccgtggaagataagatcaggattattgcccagaaaatctatggagctgatgatatcgagttgttacccgaggctcaacacaaggcagaagtgtataccaaacagggctttgggaatctcccgatttgcatggccaaaacccatcttagcttatcccataaccccgagcaaaagggcgtgcctaccggtttcatactgccaataagagacatccgcgccagtgtgggggctgggttcctctaccctctagtaggaacaatgtccaccatgccggggcttccaactagaccatgcttctatgatatagacctggatcctgaaacagagcaggtcaacggactgttctag

SEQ ID NO: 180676 - DNA, 1176 bp, Artificial Sequence
  Description of Artificial Sequence: Synthetic coding sequence
atgttcagcccctggaagatcagcatgttcctgagcgtgcgggaggacagcgtcccgaccaccgctagcttttccgccgatatgctgaacgtgaccctgcagggtcctactctgaatggaacgtttgcacaaagcaaatgcccacaggtcgagtggctagggtggctcaacacaattcagcctccttttctgtgggtcctgttcgttctagcgacactggagaatattttcgttctctccgtgttctgcctgcataagtcctcgtgcactgtagcagagatttacctaggtaacctggctgctgcggacctgattctcgcctgcggactgccattctgggcgataaccatatctaacaacttcgactggttgttcggcgagaccttgtgccgcgtagtgaatgccattatctccatgaatctgtattcatccatttgttttctgatgctcgtcagcatcgacaggtatctggccctggtgaagactatgagcatgggtcgcatgagaggtgtaaggtgggctaaactgtatagtctggtgatttggggctgcacactgctgctctcttccccgatgctcgtcttcagaactatgaaggaatattccgatgagggtcataacgttacagcctgtgtcattagttaccccagtttgatttgggaggttttcactaacatgcttctcaatgtcgttggctttctgcttcccctatccgtcatcaccttttgcaccatgcagatcatgcaagtgctgcggaataatgaaatgcagaagtttaaagagatccagacagagagaagagccaccgtactggttttggtagtcttactgctcttcattatctgctggctgccattccaaatctcaacgtttctggacactctgcaccgcctgggcatcctgtcaagctgccaggatgagaggattatcgatgtcattacacagatcgcttccttcatggcttattcaaacagctgcttgaatcccctagtgtacgtgattgtcggcaaacggttccggaaaaaatcctgggaggtttatcaaggagtttgccagaaaggtggctgtcgaagtgagccaattcaaatggaaaacagtatgggtacccttaggactagtatatccgtcgagcgacagatacataagctccaggactgggctggatcacggcagtag

SEQ ID NO: 180677 - DNA, 1095 bp, Artificial Sequence
  Description of Artificial Sequence: Synthetic coding sequence
atgctgaacgtgaccctgcagggccccaccctgaacggcaccttcgcacagagcaagtgtccgcaggtcgagtggctgggctggttgaacaccatccaaccccctttcttatgggtgctgttcgttctcgcaacactcgagaatatcttcgtgctcagcgttttctgcctgcacaaatccagttgcacagtggcggagatctacctcggtaatctcgccgccgccgacttaatcttagcatgcggcctgcctttctgggctatcaccatctccaacaactttgactggctgttcggggagaccctgtgtcgcgtggtgaacgctattatctcgatgaacctttactcctcaatctgcttccttatgctggtcagtatcgacaggtatcttgctctggtcaaaactatgtccatgggtaggatgcgtggagtccgatgggccaaactgtatagcttggtcatttgggggtgtactctgttactttcctccccgatgttggtctttcggactatgaaggagtactccgacgagggacacaacgtcacagcctgtgtgatctcgtacccctctctgatttgggaggtgttcaccaatatgctcctgaatgtggtgggattcctgttgcctctctcggtgatcactttctgcacaatgcagattatgcaggtactgaggaacaacgagatgcaaaagtttaaagagatacaaacggagcgtagagccacggtgttggtgctggttgtcctgctactgtttatcatctgttggctgccgtttcaaatctccacatttctggatactcttcacaggctgggcatactctccagctgccaggacgaacggataatcgacgtcattacgcagatagcctcatttatggcatacagtaatagttgccttaacccgctagtctacgtcatcgtcggtaagagatttcgaaagaaaagctgggaagtttaccagggagtgtgccaaaaaggcggctgccgtagcgagcccatccagatggagaattcgatgggaacgctacgtactagtatctcggtggagcggcagatacataaactgcaagattgggcgggaagtaggcagtag

SEQ ID NO: 180678 - DNA, 1095 bp, Artificial Sequence
  Description of Artificial Sequence: Synthetic coding sequence
atgctgaacgtgaccctgcagggccccaccctgaacggcaccttcgcccagtccaaatgtcctcaggtggaatggttaggctggctcaataccattcagccccccttcttgtgggtgttatttgtgctggcgacgttagaaaacatcttcgtcttatccgtattctgtctgcataaatcatcttgtaccgtggccgaaatatatctcggtaacctggctgctgcagatctgattctggcctgtggtctcccattctgggcaataaccatttctaacaacttcgattggctcttcggggaaaccttgtgccgcgtggtgaatgcaatcatatcaatgaatttatatagctctatttgttttctgatgctggtgagtatcgacagatacctggcacttgtcaagaccatgtctatggggaggatgcggggcgtacgttgggccaaactatattccttggtaatttggggatgcacactgctgctctcttcccccatgctggtattcaggactatgaaggaatactcggatgaaggtcataatgtcacggcatgcgtcatcagctatccttcactgatttgggaagtcttcacaaacatgctcctgaacgtggtcgggttccttctgcccctcagcgtcattactttctgcacaatgcagattatgcaggtgctgcgcaataacgagatgcagaagttcaaagagatacaaaccgaaagacgtgcaaccgttttagtccttgtcgtcttgctcctcttcattatctgttggctaccattccagatcagtaccttcctcgacactctgcaccgactcggcatcctctcaagctgtcaagacgaacggataatagatgtgattacacagattgcttcatttatggcctactccaactcctgtttaaaccccctggtgtatgtaatcgtgggcaagagatttcgtaaaaaatcttgggaggtctaccagggcgtgtgtcaaaagggcggatgccgcagcgaaccaattcagatggagaacagcatgggcaccttgcgaacatccatcagtgtggagcgtcagatccacaaacttcaggactgggccgggtcccgtcagtag

SEQ ID NO: 180679 - DNA, 1176 bp, Artificial Sequence
  Description of Artificial Sequence: Synthetic coding sequence
atgttcagcccctggaagatcagcatgttcctgagcgtgcgggaggattcagtgccgacgaccgcctcattcagtgcggacatgctgaacgtcactctgcaagggccgactctaaacggcacatttgcccaatcaaagtgtcctcaggtggaatggctgggctggttgaacaccattcagcccccgttcctttgggtgctttttgtgcttgcaaccctggagaacatcttcgtactgagcgtcttctgccttcacaagagctcatgtaccgtggccgagatctatctgggcaacttggctgccgctgaccttattctggcttgtggtctccctttctgggcaataacgatttctaacaactttgattggctgttcggggagactttgtgtcgggtggtgaatgccatcatttctatgaatctgtacagttctatctgctttctaatgctggtgtctattgacagatacctggctctggtgaaaacaatgagtatgggtcggatgcggggggtgcgctgggccaaactgtacagcctggtaatctgggggtgcacacttttgctgtcttcaccaatgcttgtcttccgtacaatgaaggagtatagtgatgaggggcacaacgtaactgcctgcgttatatcctatccttcactgatctgggaggtctttaccaacatgctcttaaatgtggtgggttttctgctccctctctccgtgatcacattctgtacaatgcagatcatgcaagtacttcggaataatgaaatgcagaaattcaaggagatccagactgaacggcgcgccacagttctggtgctggtcgtactgctcctgtttatcatctgttggttaccctttcagatcagtacctttctcgacaccctgcatcgacttggaatcctaagctcctgtcaggatgagaggatcattgatgtaatcactcagattgcaagtttcatggcctactcaaacagctgcctaaatcctcttgtgtatgtaatagttggaaagcgctttcggaagaaatcctgggaggtttaccaaggcgtgtgtcaaaaaggtggatgccgaagcgagccaattcagatggagaacagcatgggtactctgagaacatctatatcagtggagcgccagatccacaaactccaggactgggccggctcaagacagtag

SEQ ID NO: 180680 - DNA, 684 bp, Artificial Sequence
  Description of Artificial Sequence: Synthetic coding sequence
atgggcggcaagctgagcaagaagaagaagggctacaacgtgaacgacgaaaaggctaaagagaaggacaaaaaagcagagggggccgcaacagaagaagagggtactcctaaggagagcgagccacaagcagccgctgaaccagcagaagcgaaggagggcaaggaaaaaccagaccaggatgctgagggaaaggcagaggaaaaagagggcgagaaggatgccgcagccgctaaagaagaggcccctaaggctgagcctgaaaagactgaaggcgcagctgaagcaaaggccgagcccccaaaggcaccagaacaggagcaggccgctcctggtcctgcagcgggtggagaagcgccgaaggccgctgaggctgcagcggctcctgccgaaagcgccgcccctgccgccggggaggagcctagtaaagaggaaggcgagcccaagaagacggaggcccccgccgcccctgccgcccaggagacaaagagtgacggcgcaccagcaagcgactccaaaccaggcagctcggaggccgcaccgagcagtaaggagaccccagccgctacggaggccccctcgagtactcccaaggcacaggggcccgcagcgagtgctgaggagcccaagcccgtggaggcccccgcagctaactctgaccagactgtgaccgtcaaggagtag

SEQ ID NO: 180681 - DNA, 522 bp, Artificial Sequence
  Description of Artificial Sequence: Synthetic coding sequence
atgggcggcaagctgagcaagaagaagaagggctacaacgtgaacgacgagaaggcaaaggaaaaggacaaaaaggccgaaggcgccgcaaccgaagaggagggcactccaaaggagtccgagccccaggcagccgcggaaccagccgaggcaaaagagggtaaagagaagcctgaccaggacgccgagggaaaggcagaggaaaaggagggcgaaaaagacgccgcagctgccaaagaagaggctcctaaggccgagccggataaggaggaaggggagcccaagaagacagaggcacccgccgctcccgctgcccaggaaacaaagagtgacggggcgcctgccagcgactcaaagcctggcagtagcgaggccgctccttcctccaaagaaacgcccgcggcaacagaagccccaagtagcacgcccaaagcccagggtcctgcagcctccgccgaagagcccaaacccgtggaagccccagctgccaattccgatcaaaccgttaccgtcaaagagtag

SEQ ID NO: 180682 - DNA, 543 bp, Artificial Sequence
  Description of Artificial Sequence: Synthetic coding sequence
atgggctgcggcggcagccgggccgacgccatcgagccccggtactatgaatcatggacacgagaaactgaatccacctggctgacctatacagactcagatgcaccaccatcggccgccgcacccgactcaggtcccgaagcggggggactccactccgtgctagaagcggaaaagagtaaaatcaaggctccaaccgacagcgtatctgacgaggggctgttctcagcaagcaagatggcaccactggccgtcttctcgcacggcatgcttgaggacggcctaccctctaacggagttccccgctcgactgcccccggaggtatccctaatcctgaaaagaagactaattgcgaaacccagtgcccgaacccccagtcactctcatcaggacctctcacccagaaacagaatggtttacaaacaacggaggccaaaagggacgccaagcggatgcctgccaaagaggtgacgatcaacgtcacagatagcatccagcaaatggacaggagtcgaaggattaccaagaactgcgtcaattag

SEQ ID NO: 180683 - DNA, 438 bp, Artificial Sequence
  Description of Artificial Sequence: Synthetic coding sequence
atgggctgcggcggcagccgggccgacgccatcgagccccggtactacgagagctggacaagagaaacagaatctacttggctgacttatactgatagcgatgcacccccaagcgctgccgcccctgattctggccccgaggcgggagggctgcatagcggcatgttggaggatggtctgccttcaaatggggttccacggtctactgcccctggcgggattcccaatcctgaaaagaagaccaattgcgagacccagtgtcccaaccctcaaagtttatctagcgggccactgacacagaagcagaacgggcttcagactacggaagccaagcgtgatgcaaagcgcatgcccgcaaaagaggtgacaatcaacgtgaccgactcgattcagcagatggatagatccaggcgaataacaaagaattgtgtgaattag

SEQ ID NO: 180684 - DNA, 165 bp, Artificial Sequence
  Description of Artificial Sequence: Synthetic coding sequence
atgggctgcggcggcagccgggccgacgccatcgagccccggtactatgaatcctggactagggagaccgaatcaacatggctgacatacactgactccgacgcccctccctcagctgccgcacctgacagcggccccgaagctgggggcctgcacagtggatag

SEQ ID NO: 180685 - DNA, 387 bp, Artificial Sequence
  Description of Artificial Sequence: Synthetic coding sequence
atggagagcaaggaggagcgggccctgaacaacctgatcgtggagaacgtgaatcaggagaacgacgagaaagacgagaaagaacaggtagctaataaaggagagcccctggccctgccccttaacgtttctgaatactgcgtcccacgcggcaaccgtcgccgattccgggtaaggcaaccaatcctccagtaccgttgggatataatgcaccggctgggcgaaccccaagcgaggatgagagaggagaacatggagcgaatcggcgaggaggttagacaactcatggaaaagctccgggaaaaacaattgtcccactcgcttagagccgtatccacggacccaccacaccatgaccatcacgatgagttttgcctgatgccatag

SEQ ID NO: 180686 - DNA, 387 bp, Artificial Sequence
  Description of Artificial Sequence: Synthetic coding sequence
atggagagcaaggaggagcgggccctgaacaacctgatcgtggagaacgtgaaccaggaaaatgatgagaaggacgagaaagaacaagtggccaataaaggcgaacctctcgccttgcctttgaatgtgtccgaatattgcgtaccccggggcaatcgaaggcgcttccgggtgaggcagcctatcctgcagtatcgatgggacataatgcatcgcctaggggaaccacaagctcggatgcgcgaggaaaacatggagcggatcggcgaagaggtgcggcaactgatggaaaagttacgcgaaaagcaattgagccacagcttaagggcagtgtcaactgatccacctcatcacgaccatcatgacgagttttgtctgatgccctag

SEQ ID NO: 180687 - DNA, 306 bp, Artificial Sequence
  Description of Artificial Sequence: Synthetic coding sequence
atggagagcaaggaggagcgggccctgaacaacctgatcgtggagaatgtgaaccaagaaaacgacgagaaggacgaaaaggagcaggtagctaataagggcgagcctcttgctctacctcttaacgtgtctgaatactgtgtccctagggggaacaggcgcaggttccgagtgaggcagcccatacttcagtatcgctgggacattatgcataggttgggcgagccccaggctcgcatgcgcgaagagaacatggagcgtatcggggaagaggtccggcagctgatggagaaactgcgcgagtag

SEQ ID NO: 180688 - DNA, 483 bp, Artificial Sequence
  Description of Artificial Sequence: Synthetic coding sequence
atgcagaagatggtggtgtgcggcgccaagtgctgcggcgacgccccccatgtcgagaatagggaggaagagaccgcacggatcggtcccggagttatggagtcaaaggaggagcgcgcactgaacaacctgatcgtcgagaacgtgaatcaggagaacgatgaaaaggacgaaaaggagcaggtggctaataaaggggagcccctcgcattgccacttaacgtgagtgagtattgtgtaccacgggggaaccgccggagattccgcgttcgccagccaatcctccagtaccgatgggatattatgcaccggttgggcgagccccaggccaggatgcgcgaagagaatatggagaggattggggaagaggttagacagttaatggagaaactgcgagagaagcagctctcccactcactaagagccgtctctaccgacccacctcaccatgaccatcatgacgagttctgccttatgccttag

SEQ ID NO: 180689 - DNA, 378 bp, Artificial Sequence
  Description of Artificial Sequence: Synthetic coding sequence
atggagagcaaggagaagcgggccgtgaacagcctgagcatggagaatgctaaccaggaaaatgaagaaaaggagcaagtagctaacaagggcgagccactagccttgccattggatgccggtgaatattgcgtgcctagaggtaatagaaggcgcttccgggttcgccagcctatcctgcagtatagatgggacatgatgcatcggctgggcgaaccacaggcaagaatgcgcgaggagaacatggaaagaatcggggaggaggtgcggcagcttatggaaaagctgcgcgaaaagcagttatcccactccctgagagcagtctctactgatccgccccaccacgaccatcatgatgagttttgcctcatgccatag

SEQ ID NO: 180690 - DNA, 363 bp, Artificial Sequence
  Description of Artificial Sequence: Synthetic coding sequence
atggagagcaaggaggagctggccgccaacaacctgaacggcgagaatgcgcaacaagagaatgagggaggagagcaggctcccacgcagaatgaggaagagtcccgacacctcggaggcggcgaagggcagaaacccggagggaacattagacgcggcagggtgagaagactggtaccaaatttcagatgggctatccccaaccggcatattgagcataatgaagccagagacgacgttgagaggttcgtgggacagatgatggagattaaacgcaaaacgcgggagcaacagatgaggcactacatgaggtttcagacgcctgaacccgacaaccactacgatttctgtctgattccgtag

SEQ ID NO: 180691 - DNA, 363 bp, Artificial Sequence
  Description of Artificial Sequence: Synthetic coding sequence
atggagagcaaggaggagctggccgccaacaacctgaacggcgagaacgctcagcaggaaaatgagggaggcgaacaggccccaacccaaaacgaggaagagtctagacacctcggaggcggagagggccagaagccagggggaaacatcaggcgaggcagagtgcgccggctggtgccaaattttcgatgggctatcccaaataggcatattgaacacaatgaagcccgcgatgacgtcgaacgcttcgttggccaaatgatggaaatcaaaaggaaaactcgggaacagcagatgaggcattatatgaggttccagactcctgagccggataatcactatgacttctgcttgatcccctag

SEQ ID NO: 180692 - DNA, 336 bp, Artificial Sequence
  Description of Artificial Sequence: Synthetic coding sequence
atggagaacgtgcccaaggagaacaaggtggtggagaaggcccccgtccaaaatgaggcaccagccctgggtggtggggagtaccaggaacctgggggtaatgtgaaaggagtgtgggccccgccagcccctggcttcggcgaggatgtgcctaataggctggttgataatattgacatgatcgacggcgacggcgacgatatggagagattcatggaagagatgagagagttacgaagaaagatacgggaattacagctgcgatacagcttacgaatcttaatcggtgaccccccacaccacgaccaccatgacgaattctgccttatgccatag

SEQ ID NO: 180693 - DNA, 336 bp, Artificial Sequence
  Description of Artificial Sequence: Synthetic coding sequence
atggagaacgtgcccaaggagaacaaggtggtggagaaggcccccgtgcagaacgaggcacccgctctcgggggtggcgaatatcaagaacccggcggcaacgtcaagggagtatgggccccccccgctccaggatttggagaagacgtcccaaacaggctggtggacaacatcgacatgatcgatggtgatggcgacgatatggaacgcttcatggaggagatgcgcgagttgcgccgcaagattcgggagcttcagttgcgatatagcctgaggatactgatcggtgatccccctcaccatgatcaccacgacgagttctgcctgatgccctag

SEQ ID NO: 180694 - DNA, 378 bp, Artificial Sequence
  Description of Artificial Sequence: Synthetic coding sequence
atggaccacaagcccctgctgcaggagcggccccccgcctacaacctagaagcggggcagggggactacgcttgcggccctcacgggtatggagccatcccagcggctccgcctccccctccttatccttacctggtgacaggaatacctacacatcacccccgggtctacaatatccatagccggacggtcactagatatccggctaatagtatcgtggtcgtcggaggttgcccggtttgccgggtaggcgtcctggaagactgttttacgttcctcgggatatttcttgccattattctctttccgttcggatttatctgctgcttcgcattgcggaagagacgctgtccaaactgtggggccacctttgcctag

SEQ ID NO: 180695 - DNA, 297 bp, Artificial Sequence
  Description of Artificial Sequence: Synthetic coding sequence
atggaccacaagcccctgctgcaggagcggccccccgcctacaacctggaggcgggccagggagactatgcctgcggccctcacgggtacggggccatccctgccgcgccgcctcctccgccatacccgtacctcgtgaccggcattccaacacaccacccaagggtttataatatccactctaggactgtgacacggtatcctgctaatagcatcgtggtggtgggaggttgcccggtctgcagacaccagagatcctcctggctgtacacttatcccctgcgcgtttgtacctag

SEQ ID NO: 180696 - DNA, 1536 bp, Artificial Sequence
  Description of Artificial Sequence: Synthetic coding sequence
atgagccggggccccgaggaggtgaaccggctgaccgagagcacctaccggaacgtgatggaacagttcaacccaggtctacgcaatctgatcaacctggggaaaaattatgaaaaagccgttaatgccatgattctggctggcaaggcttactacgatggcgtcgctaagattggggagatcgccaccggtagtcccgtctccaccgagctgggtcacgttctgatcgaaatttcatccacacataagaagctgaatgaatccctggacgagaacttcaagaagtttcacaaggagattattcatgagctggagaaaaaaattgaactggacgtgaagtatatgaacgccaccctgaaacgatatcagaccgagcacaaaaacaagctggagtctcttgagaaaagccaggctgagttgaagaagattcgacggaaatcacaaggttcccgcaatgccctgaagtatgagcataaggaaatcgaatatgtggaaacagtgaccagtaggcagtcggagattcaaaagtttatcgcggatggctgtaaagaagccctactcgaggaaaagcggcgtttctgctttcttgtggataaacactgcggtttcgccaaccatattcattattaccacctgcaaagcgctgagctgctgaattctaagctgcccaggtggcaggaaacctgtgtggacgctataaaagtcccggagaagattatgaatatgatcgaggagataaaaaccccagcatccactcctgtcagcgggaccccacaggcctcccctatgatcgagcgctcaaacgtagtccgtaaggattacgataccctcagtaaatgcagtcccaagatgccccccgccccaagcggcagggcctataccagccccctcatcgacatgttcaataacccagccacggctgcacctaactctcaaagagtcaacaattccaccggcacttctgaggacccaagtctacagcgctccgttagtgtggccacaggtctgaatatgatgaaaaagcagaaggtaaagactatcttcccgcacacggcgggctccaacaaaaccctcctttcctttgcccagggtgacgtgataactctgctgattccagaggagaaggatggctggctgtacggtgagcatgacgtgtccaaggcccgtgggtggttcccgagctcatataccaaactcctggaggaaaacgaaacagaagctgtgacagtgcctaccccttcccccacgcccgtcaggtccatttcaaccgtcaatttatcagagaattcctccgtcgtgatcccgccacccgactacctcgagtgcctaagtatgggagctgcagccgaccggcgagctgatagtgctcgaacaacctcgacctttaaggcccctgcatctaagcccgaaactgccgcccctaacgacgctaacgggaccgctaaaccaccatttttgagtggagaaaacccctttgcaacagtgaaactcaggcccaccgtgactaacgaccggtcagcccctattattagatag

SEQ ID NO: 180697 - DNA, 4656 bp, Artificial Sequence
  Description of Artificial Sequence: Synthetic coding sequence
atggagaacaccggctggatgggcaagggccaccggatgacccccgcctgcccccttctcctgtctgtgattctgtcgttgcgcctggcgactgcctttgaccccgcgccttcagcctgctccgcgcttgcttcaggagtactgtatggtgcgttcagcctgcaagaccttttcccaacgatcgcgtcaggttgctcttggacactggaaaaccctgaccctaccaagtactccctgtatttacgttttaacagacaggagcaggtgtgtgcacactttgctccacgcctgctccctctggatcattacttagtcaatttcacctgtcttcgaccctctcccgaggaagcagtggctcaggcagaaagcgaggtcgggcggcccgaagaggaggaagcggaagcagccgcaggtctcgaattgtgctcagggtcaggaccgttcacctttcttcacttcgacaagaatttcgtccaactctgtctgagcgcagagccctcagaggccccaaggctgcttgctccagcagcgttggcttttcggttcgtggaggttctgctgatcaacaacaataacagctctcagtttacctgtggagttctttgcaggtggtccgaagagtgtgggcgtgctgctggccgcgcatgtggctttgcccagccaggatgctcttgccctggggaggccggggctgggagtactacgactacgtccccagggccgccagcagcccataccttaagcaacgccctcgtcccggggggcccggcacccccagcagaagcagacctacattccggatcctccaatgacttatttactacagagatgagatacggcgaggagcctgaggaggagccaaaggtcaagacacagtggcccaggtctgccgacgaaccaggcctgtacatggcacagaccggggacccggccgctgaggagtggagcccctggtcagtttgctctctaacctgtggccagggcctccaggtgcgtacgcgaagctgcgtgagcagcccctacggaactctttgttcgggtccattgagggagactcgcccttgtaacaacagcgccacctgtcctgtacacggcgtgtgggaggagtgggggagctggagtctttgttctagaagctgtgggcgggggtctaggagtcggatgcgcacttgtgtgccacctcagcacggcggaaaggcttgcgaggggccagaattgcaaactaaactatgctccatggcggcttgccctgtggaggggcagtggttagagtggggtccctggggcccatgctctacctcttgcgccaatggtactcagcagagatcacggaaatgttcagttgccggacctgcatgggccacctgtaccggtgcccttaccgacacgagggaatgctccaacctggagtgtcccgcaacagacagtaaatggggtccatggaatgcttggtctctgtgtagtaagacttgtgatactgggtggcagaggaggtttaggatgtgtcaagctaccggtacgcaagggtatccctgcgagggaacgggtgaagaggtgaaaccttgttcagaaaagagatgcccggccttccacgagatgtgtcgtgatgaatacgtcatgcttatgacctggaagaaggcggctgcaggtgagattatttacaacaagtgcccgcctaacgcctccggcagcgcctccagacgctgcttgctctcagcacagggcgtggcatattgggggcttccatccttcgcaagatgtatctcccatgagtacagatacctgtatctctctctgcgcgagcatctggccaaggggcagcggatgcttgctggagaaggtatgagtcaggtggtgcggtctctccaggagttgttagcccggaggacatattattccggggatttgctcttcagcgtggatatactccgaaacgtgacagacacatttaagcgcgccacgtacgtgccttccgcagatgatgtgcagcgcttctttcaagtggtttcgtttatggtggacgctgagaataaggagaaatgggacgacgctcaacaggtctcacccggttctgtccacctgcttagagtggttgaggactttattcatctggtgggagacgccttaaaggcctttcaatcttctttgatcgtcactgacaatctggtgatctcaatacagcgcgaaccagtcagtgctgtaagcagcgacataacatttcctatgcgaggacgacgcggaatgaaagattgggttcgtcatagcgaggatcgcctgttcctgcccaaggaagtactcagcctgagctcccccggaaaacctgcaacttccggggccgccggcagtcccggccgtggccgcggtcctgggaccgtgcccccggggcccggacatagtcatcagagactgttacccgctgaccccgacgagagttcttactttgtcattggagctgttctgtacagaacattgggtctgatcttgcccccaccacgccctcccctcgctgtgacaagcagggtgatgacggtcactgtccgaccgccgacacagccccctgcagaaccactgatcactgttgagctgagctatattatcaatgggaccactgatccccattgcgccagctgggactatagccgcgccgatgcttcctccggcgattgggacactgagaactgccaaacattagaaacccaggcagcccatacaagatgccagtgccaacacctgagtacttttgcagtactagctcagcccccgaaggacctgaccttagagctcgctggtagcccatctgtcccccttgtgatcggttgcgcagtttcctgtatggccctactgacactcttggcaatctatgcagcgttttggcggttcattaagagtgaacggtctataattctgctgaacttctgtctgagtatcctggcgtccaatatcctcattcttgtcggtcaatccagggttttatcaaagggagtttgcactatgaccgccgcgttcttgcactttttttttctgagctctttttgttgggttctgaccgaggcgtggcaaagttacctcgcggtgattggacgcatgcgcaccaggctcgtgcgaaagcggttcctgtgccttggatggggccttccggctctggtagtcgcagtatctgtcggatttacgaggactaaggggtatggcacttcatcctactgttggttaagcctggaaggaggtttgctctacgcatttgtcggccctgcggcagttatcgtccttgtgaacatgttaattggcatcatcgtatttaataagctcatggccagggacgggatcagcgacaagagtaagaaacagcgcgcaggcgcttcactgtggtctagctgcgtggtcctgcccctgctggctctcacatggatgtctgcggtgctggcgatgacggaccggcggtccgtgctgtttcaggccctttttgctgtattcaattcagctcagggttttgttattacagccgtgcactgcttcctgaggagggaggttcaagacgtagtcaagtgccagatgggcgtgtgtcgggccgacgagtctgaggatagtcccgacagttgtaagaatggacagttgcagattttgtccgactttgagaaagatgtggacctggcctgtcagaccgtcctattcaaagaagtgaacacttgtaacccaagcactataactggtacactttcgcggctttccctggacgaagacgaggagccaaagagctgtctcgtcggcccagagggctcactgagctttagccctcttccaggaaacatcctggtaccgatggcagctagccctggtttaggagaaccaccgccacctcaggaggcgaaccctgtgtacatgtgtggtgaaggcggtctgagacagctggacttgacatggctcagaccaacagagcccggttctgagggcgactatatggtgttgcctcggcgaacgctcagcctccagccaggaggaggtggaggcggaggtgaagacgctccccgagcgcggcctgagggcactccgagacgagcggccaagacagtggcccatacggaaggatacccttctttcctctcagtggaccactccggacttggacttggacctgcctatggctcactccagaatccctacgggatgaccttccaaccgcctccccccacccccagcgccagacaagtgccagagcccggagagcgaagccgtactatgcctcggaccgtccccggctccacaatgaagatggggtcactggaaaggaaaaagctacgctactctgatcttgacttcgaggtgatgcatacaagaaagcgtcactccgaactatatcacgaactgaaccagaagttccacactttcgatcggtataggtcacagtccacagcgaaacgcgaaaagaggtggagtgtgtcaagcggtggggctgctgagcggagtgtttgcaccgacaaaccaagcccaggagagcggccaagtctgtcccagcacaggcgacaccagagctggagcacgttcaaatctatgaccctggggagcctgcctcctaagccccgggagagactgaccctgcacagagccgccgcctgggagcccaccgagccaccggacggcgatttccagaccgaggtctag

SEQ ID NO: 180698 - DNA, 4755 bp, Artificial Sequence
  Description of Artificial Sequence: Synthetic coding sequence
atggagaacaccggctggatgggcaagggccaccggatgacccccgcctgccccctgcttctttcggtgattctgagtctgagactggccacagcattcgaccccgccccatctgcctgcagtgccctggcctctggcgtactgtacggcgctttcagcttgcaggacctgtttcccacaattgccagtggatgttcctggactctggagaaccccgaccctactaagtacagcctgtacctgcggttcaatcggcaagagcaggtgtgcgctcatttcgccccgcggctgctacctctggatcattatctggttaactttacttgtctgcggccttcaccggaggaggccgtcgcacaggcagaaagcgaggtgggacggccagaggaggaggaagccgaagcagcggcaggcttggagctttgcagtgggtctggccctttcaccttccttcactttgataagaattttgtacagctgtgtttaagtgccgagccttcggaggctccgcgattgctcgcccctgcagccctcgccttccggttcgttgaggtgttattgatcaataataacaacagcagccagttcacctgcggggttctttgcaggtggagcgaagaatgtgggcgggctgccgggagggcatgcggctttgcccagcctggctgctcatgtcctggagaagccggggctgggtccactaccaccaccagccctggccctcccgcagcacacacactgtccaacgccctggtacctggaggtccagctccccccgcggaggcagaccttcattctggttcaagcaatgatttatttaccactgagatgcgttacggcgaggagcccgaggaagagcctaaggtcaaaactcaatggccacgttcagccgacgaaccaggactgtatatggcccagaccggagacccggctgccgaagagtggtctccatggagcgtttgcagcctgacttgcggccaaggactccaggtgaggacccgtagctgcgtctccagtccatatggaacgctgtgttctggacccctcagagagacccgaccttgcaacaacagtgccacctgccccgtgcacggagtttgggaggagtggggcagttggagtctctgctcaaggtcatgtgggagagggtctaggagccgcatgcgcacatgtgtgcccccccaacatggcgggaaagcatgtgagggcccagaactccagactaaactgtgcagtatggccgcatgtccggtggagggccagtggctggaatggggaccgtggggcccatgttccaccagctgtgccaacggaactcagcagaggagccgcaaatgctcggtggctgggcctgcctgggctacctgcactggggcgttgaccgatacacgggagtgctcgaatctggaatgccctgcaaccgattcaaagtggggcccatggaacgcttggagtctatgctcaaagacctgcgataccgggtggcagcggcggttcaggatgtgccaggccaccggaacccagggctacccctgtgagggaacaggtgaggaggtcaaaccttgcagcgaaaaaagatgtcctgccttccacgagatgtgcagagacgagtacgtgatgttaatgacatggaagaaggcagcagccggcgagattatttataacaagtgtccacctaatgcatccggctctgccagccgccggtgcctgttgagcgcccagggggttgcttattggggcttacccagtttcgcccgctgtatttcacatgagtaccgctacctgtatctgagcctgcgagagcacctggctaaggggcaaaggatgctggcaggggagggcatgagccaggtcgtgcgcagtcttcaggagttgctggcgcgccggacctactactcaggggatctgctcttctctgtggatattttaagaaacgtcacagacaccttcaaacgggctacttacgttccatctgctgatgacgtgcaaagatttttccaagtcgtttcctttatggtcgatgcggaaaacaaggagaaatgggatgacgcacaacaggtcagccctgggtcggttcacctcctccgggtggtcgaggactttatccacctggtgggggatgcattgaaggcgttccagagtagcctgatcgtgacagataatctggtaatctccattcagcgcgagcctgtgagcgccgtgagttccgatataactttcccaatgcgaggcagacgggggatgaaagactgggtacgccattcagaagacagattatttttaccaaaggaggtacttagtctttctagccctgggaagccagcaactagtggggctgctggcagcccaggacgcggtcggggtcctggtactgtgcccccgggaccaggtcactcgcaccaaaggttactacctgccgaccctgatgaatctagttacttcgtaatcggagccgtattatacaggactttaggactcatcctgcctccaccaaggcccccgctggcagtcacaagtcgcgtaatgacagtcactgtcagaccacctacgcagccccctgctgaaccactgatcactgtcgaactcagctacattatcaatggaaccaccgatccacattgtgcgagctgggattacagtcgtgctgatgcatccagtggagactgggacactgagaactgccagaccctggagactcaggccgcccatactagatgccagtgccagcatctgagcacttttgcagtcctagcccagccaccgaaagacctgaccctcgaactggcaggatccccctcagtcccactcgtgattggctgcgccgtgtcatgtatggccctgttaaccctcttagctatatacgcagcattctggagatttattaaatcagagagatcaatcatcttgctgaatttttgtttatccatcctcgctagtaacattctgatccttgtgggacaatcacgagtgctatccaagggcgtctgtaccatgacagcagctttcctgcattttttttttctcagcagcttctgttgggtgcttacagaggcttggcagagttatctggccgtaatcggtcgcatgcggacacggttggtgcgcaaaagattcctctgccttggctggggcctgcccgccctggtagtcgcggttagcgtgggcttcacccgcactaagggttacggtactagctcctattgctggctgagtttagaaggaggtctgctgtatgccttcgtgggtccagctgcggtcatagtgttagtgaacatgctcattgggataattgtgtttaacaaattaatggcaagggatggcatctccgacaagtctaagaagcagagagcaggctccgagagatgcccgtgggccagcctgctcctaccttgcagcgcatgcggggccgtcccatcgcctcttctcagttctgccagcgctcgaaatgccatggccagcttgtggtccagctgtgtggtgcttcctttactggctctaacttggatgtccgctgtgcttgcgatgaccgacagaaggtctgtgttgttccaagcactgtttgccgtcttcaactctgcccagggcttcgtaataacagctgtgcactgctttctgcgccgtgaggtgcaggatgtcgttaaatgtcagatgggcgtatgtagagctgatgagagtgaggatagccccgactcctgtaaaaacggacagttgcagatcctgtctgactttgagaaggatgtggacttagcctgtcaaacagtgctattcaaggaagtgaatacgtgcaacccaagcacaatcaccggaaccttgagccgcttatcattggatgaagacgaggaaccaaaaagctgcttagtgggccctgaagggtctctgtcctttagcccactgcccggtaatattttggtgccgatggccgccagtcctggtctaggagagccacctccccctcaggaagccaaccctgtttacatgtgcggggaggggggactaaggcagttggatctgacctggttacgccccaccgaacccggatctgaaggcgattatatggttcttccccgccgaacgctcagcttgcaacctggaggcgggggtggaggcggtgaggacgccccccgtgctagacccgagggcaccccccgtcgcgccgctaaaaccgtcgctcatactgaggggtatccatcttttctgtcagtagatcattctggattaggcctgggtccagcatatggaagccttcagaacccatacgggatgactttccagccccctccccctactccatcagcccgccaagtcccggaaccaggtgaacggagccgcactatgcctagaaccgtgcccggctctactatgaagatgggctcgctggaaagaaagaagctgcgctattcagatctggactttgaagtgatgcatacaagaaagagacatagcgagttatatcacgagctcaatcagaagttccataccttcgaccggtatagatcacaatcgacagccaagagggagaagcgctggagcgtgtcaagcggaggcgccgccgagaggagcgtgtgtactgataagccttctcccggcgagcgcccatcactctctcaacaccggcggcatcaaagctggagcacgtttaaaagcatgactctaggctcgttaccccctaagccaagagagaggttgactctgcaccgggccgccgcttgggaaccgaccgaaccacctgacggggattttcaaactgaagtgtag

SEQ ID NO: 180699 - DNA, 4758 bp, Artificial Sequence
  Description of Artificial Sequence: Synthetic coding sequence
atggagaacaccggctggatgggcaagggccaccggatgacccccgcttgtcccttgctccttagcgtcattctcagcctaagactggctacagcgttcgatccggccccgtcagcttgtagcgccctagccagcggcgttttgtacggagctttttctctccaggacctgtttcctacgattgcctccggctgttcatggacactagagaatcccgacccaaccaaatactccctgtatcttcgatttaatcggcaggagcaggtgtgtgctcattttgctcccagactgcttccacttgaccactatctggtgaacttcacatgtctgagacccagcccagaagaggctgttgctcaagcggagtcagaagtcggacgacccgaagaagaagaggctgaagctgcagctggattagagctgtgcagcggctctgggccatttaccttcctgcactttgataagaattttgtccagctgtgcctgagcgctgagccaagcgaagcacctcgccttctggcgccagcagcgctcgctttccggttcgtggaggtcctgctgattaataataacaacagcagtcaattcacctgtggcgtcctctgccggtggagcgaggagtgcgggcgtgcagcagggcgcgcgtgtgggtttgcccagccagggtgttcctgtccgggggaagccggggccggaagcacaacaaccaccagtcctggtccaccagccgcccacactctgagtaacgccctggtccccgggggaccagctcctcccgcagaagccgacttgcacagcggctctagtaatgatctgttcacaaccgagatgcgctatggtgaagaaccagaagaggaacctaaagtaaaaacccagtggcctcggagtgccgacgagcccggactatacatggcccagactggggacccagccgctgaggagtggagtccatggagtgtgtgcagtttgacatgcgggcagggactgcaggtgaggacccgatcctgcgtgtcgtcgccatacgggaccctgtgctcaggccctcttcgggagactcgcccctgtaataactcagcaacatgccctgtgcatggggtatgggaggaatggggatcgtggtccctgtgctcgaggtcctgtggaagagggtccaggtctaggatgaggacgtgtgtgccaccgcaacatgggggcaaggcctgcgagggcccagagctgcaaacaaaactgtgcagtatggccgcgtgccctgtggaagggcagtggctcgagtggggaccttggggcccatgttctacttcatgtgcaaatggcactcagcagcgttctcgcaagtgcagtgtggccggccctgcttgggctacctgcacaggcgccctcacagatacaagggaatgctctaatctggagtgtcccgccactgactcaaagtggggtccctggaacgcgtggtccctgtgtagtaagacttgcgacactggctggcagagaagattcagaatgtgccaggccacagggactcaaggctatccatgcgaaggtacaggggaggaggtgaaaccttgtagcgaaaagagatgccccgcattccacgaaatgtgtcgagatgagtatgttatgctgatgacatggaagaaggcggctgccggtgaaatcatctacaacaagtgtcccccaaacgcatccggaagcgccagtcgtcggtgcctcttgtcggcccaaggcgtggcatattggggactccccagcttcgcccgatgcatcagccacgaataccgttacttgtatctgagccttagagagcacctagcgaaagggcagaggatgctggccggagagggcatgtcccaagttgtgcgctcccttcaggagctgttagcacggcgcacttactactctggggatttgctgttctcagtagacatcctgcgcaacgtaacggatacattcaagcgggccacctacgtgccgtcagccgacgacgtacagaggttctttcaggtggtgtcgttcatggtcgatgctgagaacaaggaaaaatgggatgacgctcagcaggtctcccccggatctgtgcatcttctccgggtcgttgaagatttcattcacttggtgggcgacgctcttaaggcctttcagtccagccttatagtcacagacaacctggttattagcattcagcgggagcccgtctcagctgttagttctgacatcaccttccccatgcgcgggaggagggggatgaaggactgggtcaggcactccgaggataggctttttctacccaaggaagtccttagcctatcctcccccggaaagccggctaccagtggcgccgctggcagcccggggcggggcagaggacctggtacagttcctcccggaccaggtcattcccatcagcgcttgctgccagctgatccagatgagagctcttattttgtgatcggagccgttttgtaccggacactgggtctgatattaccgcccccaagacctccactcgcggtcacatctagggtcatgacagtgacagtgcgacctccgacccaaccccctgccgagcctttgattaccgtggagctgagttatattatcaatggaaccactgacccgcactgcgcaagctgggactatagtcgcgccgacgccagctccggcgattgggatacagaaaattgtcaaaccctagagacgcaggcagcccacacaaggtgccagtgccagcacttatctactttcgcagtgctggcacagccgcccaaagacttaacattggagctggccggttctccctccgtgccacttgtgattgggtgcgccgtatcttgcatggccttgctgaccttgctggcaatatacgccgccttctggagattcatcaagtcagaacgatccatcatcctgcttaacttctgtctgtcaattctagctagcaatatcttaattctggttggtcaatcacgggtcctgagcaaaggagtatgtaccatgacagccgcctttcttcacttcttttttctgagcagcttttgttgggtgctcaccgaagcctggcagagctatctggcagtcatcgggcgcatgagaacccgcctcgttaggaagaggttcctgtgcttaggctgggggctgcccgcgctagttgtggctgtgtcggtggggttcactaggacgaaaggatacggtacatccagctactgctggttgtctctcgagggagggctactgtatgcatttgtcggcccagccgcggtgatagtgctggtgaacatgttgatcggcatcattgtattcaataaacttatggcgcgggatgggattagcgataaaagcaaaaagcaaagggccgggagtgagcgctgcccgtgggcttctctcctgctgccttgtagcgcctgcggtgccgtgcccagtccactcctgagttccgcaagtgcaagaaatgctatggcaagcctctggagttcatgtgtggtgcttccactgttggctctgacctggatgagtgctgtattggctatgacagatcgcaggtccgtgctcttccaggctctgttcgctgtgtttaacagcgcccagggctttgttataacggccgtgcactgttttttaagacgtgaggtgcaggatgtggtgaagtgccaaatgggagtatgcagagctgatgaaagtgaagattcaccagatagctgtaagaacggccagcttcagatcctgagcgattttgaaaaggatgtggaccttgcttgccaaacggttctgtttaaggaggtgaacacctgcaatcccagcactatcaccggtaccctgtccagactttccttagacgaggatgaggaacccaagtcttgtctggttggccccgagggaagcctctcgttttcaccccttccaggtaatatcttggtgcccatggccgcttcaccaggtctaggcgaacctcctcctcctcaggaagccaaccctgtgtacatgtgtggcgaaggagggctgcggcagctggacctgacatggctgcggccaacagaacctggcagtgagggcgactatatggtgctgcccaggcgaactctgtcgttgcagcctgggggcggcggggggggcggagaggacgcacctcgagcccggcctgaaggcacccctcggagggccgcgaagaccgtggcacacaccgagggatacccatcattcctgagcgtggaccactctgggctcgggctgggacctgcctatgggagcctccagaacccctatgggatgacattccaaccaccccctccaacaccatcagccagacaggtccccgaaccaggggagcgctcaaggacgatgccacgcacagtgcccggcagtacaatgaaaatggggagcttggagcgtaaaaaattacgctatagtgacttggacttcgagaaggtgatgcatacccgcaaaaggcactccgaactctatcacgaattgaatcagaaattccacaccttcgaccgctatcgttcgcagtccactgcgaaaagggagaaaagatggtccgtttccagcgggggcgctgccgagcggagcgtttgtaccgacaaaccgtcccctggcgagcgccccagcctcagccagcaccgtcgacaccagagctggtccacctttaagtccatgacacttggaagtttgccacccaaaccccgcgagcggttaacccttcaccgcgccgccgcctgggaacccacagaacctccggatggagattttcagactgaagtatag

SEQ ID NO: 180700 - DNA, 4665 bp, Artificial Sequence
  Description of Artificial Sequence: Synthetic coding sequence
atgacccccgcctgccccctgctgctgagcgtgatcctgagcctgcgcctggccaccgcatttgaccccgccccgagtgcctgttccgccctcgcatcaggggtgctgtatggggcattctcactccaggacctcttcccgactattgcctcaggatgttcttggacactggaaaatccggaccccacgaagtattccctgtacttgcgatttaatcgccaggagcaggtttgtgctcacttcgccccccggctgctgcctctcgaccactatctggttaatttcacctgcctccgcccttctcccgaagaagctgtcgcccaggccgaatccgaggtgggccggcctgaagaggaagaagcagaagccgcagccggcctggagttgtgcagcggatctggaccctttacgtttttgcatttcgataagaatttcgtgcagttatgcctgagcgctgagcccagtgaggccccacgactgttggccccagctgccctcgcctttcgtttcgtggaagtgctgctgatcaataacaacaacagcagccaatttacatgcggggtgctctgccgctggtcagaggaatgcggtcgcgcagccggaagagcttgtggctttgcacaacctggctgtagctgtccaggcgaggctggcgctggatccaccactactacttcgcctggtccacccgcagcacacactctctccaacgcacttgtgcccggtggccctgcaccgccagccgaggcagatctgcacagcgggtcctcgaatgatctgttcacgacagaaatgaggtacggggaggaaccagaggaggagcccaaggttaagacgcaatggccgcggtcagctgacgagcctggcttatacatggcccagacaggggatcctgccgcggaagaatggagtccctggtccgtgtgctcacttacgtgtggccaaggcctccaagtcagaacaaggtcctgcgtttcaagtccctatggcaccctgtgcagcggcccattacgcgagaccaggccttgcaacaactccgctacctgtcccgtgcatggcgtgtgggaggagtggggttcgtggtccctgtgttccagatcatgtggccgcggcagtcggagcaggatgcggacatgcgtgccccctcagcatggaggtaaggcttgcgaggggccggaattacaaacaaaactgtgctctatggccgcgtgtcctgtggagggtcaatggcttgagtggggaccctgggggccatgcagcaccagctgtgctaatggaacacaacagcggtccaggaaatgctcggtagctggaccagcctgggcaacctgcaccggcgcccttactgataccagagagtgctccaacctggagtgtccagccaccgacagtaagtggggtccctggaacgcctggtcgctctgctccaagacctgtgatactgggtggcaacgccgctttcgtatgtgtcaggcgactggaacccagggttacccctgcgaagggacgggcgaggaggtaaagccttgttccgaaaagcggtgtcccgcatttcacgaaatgtgccgcgatgagtatgtgatgctaatgacatggaaaaaagcagccgccggcgagataatctacaataagtgcccccccaatgcatccggttcagccagcagacgctgtttgctttccgcccagggggtggcatactggggactgccaagtttcgctagatgcatctcacatgagtacagatacttatatctctctctccgggaacacttggccaagggccagcgcatgttggctggagagggtatgtcgcaagtggtgaggagcctgcaagaactcttagcaagacgcacctactattcgggcgatctgctcttttccgtggacatcctgcgcaacgttaccgacaccttcaaaagagctacgtatgttccctccgctgatgatgttcagagattctttcaagtggtcagtttcatggtggacgcagagaataaggagaaatgggacgatgcacagcaagtgtcccccgggtcggtacacctgcttagagtggtcgaagatttcatacatctcgtcggggacgcactcaaggccttccaatctagtctcatcgtgaccgacaatttagtgatctccattcagcgggaaccggtcagtgcagtgtcttccgacatcacattccctatgcggggcagaagagggatgaaagactgggtcagacacagtgaggaccggcttttcctaccaaaggaggtgctgtccctctcgtcacctggcaaacctgccacatcaggagccgcaggctcaccagggagaggaagaggcccaggcacagtcccaccagggccggggcatagtcaccagaggttactgcctgccgatccggacgaatccagctactttgtgattggtgccgtgttatatcggacactcggcctgattcttcccccacctcggcccccccttgctgtgacatcgcgagttatgacagtaacggtacgacctcccactcagccaccagctgagccattaatcacagttgagctctcatatatcatcaacgggaccaccgacccccattgtgcttcctgggactacagtagagccgatgcctcctccggggattgggacactgagaactgtcagactctcgaaactcaggccgcccacacgaggtgtcaatgtcagcatctttcaaccttcgccgtgctggcccaacccccaaaagatctcacacttgagctggccggcagtccctcagtacctctggttatcggttgtgcagtctcatgcatggcgctactgaccctcctcgccatttatgctgcattctggaggttcattaagtccgagaggtccattatattactgaatttctgcttgtctattttggcgtccaatattctgatcttggtcggtcaaagcagggtgctttctaaaggtgtttgtacaatgaccgctgcatttctgcacttcttctttctcagcagtttctgctgggtgctaactgaggcttggcagtcatacttggccgtcattggccgaatgcgtacgcgtcttgttaggaaaagattcctatgtctgggatggggactccctgctcttgttgtcgcagtcagtgtcgggttcactcgcactaaaggctatggcacctccagctattgctggctctcgctggaggggggactgttgtatgccttcgtgggcccagccgcagtcatagtgttagtgaacatgctcatcgggatcatcgtgtttaacaagctgatggcacgggatggtatttcagacaaatccaagaagcagagggccgggagtgaacggtgtccatgggcttctctcttactgccctgcagcgcctgtggggcggtgccatcgccactgttatccagtgccagtgcccggaatgcaatggccagcttgtggagtagttgcgtcgtgctccccttactggctctcacgtggatgagtgccgtgttggccatgacggaccgccgctccgtcctgttccaggctctgtttgcagtatttaacagtgctcagggcttcgtcataacggccgtgcattgctttttgaggcgcgaagtgcaggacgttgtgaagtgccagatgggcgtttgtagggcggacgagtccgaggactcccctgattcatgtaaaaacggtcagctccagatcctcagcgacttcgaaaaagacgttgacctagcttgtcagaccgttctgtttaaagaggtgaacacctgtaatccaagcactatcacaggtactctttctcggctgtctctggatgaggacgaggaaccaaaaagctgcctggttggtccagagggttcactcagcttctcgcccctgccgggcaatattctggtgccaatggcagcaagtcccggactcggggagcccccccccccccaggaggccaaccccgtctacatgtgcggcgagggcggtctccgccaactggacctcacttggttgcgtcctactgaaccaggcagtgaaggcgattacatggtgctgcctcggcgcaccctgtcactgcagcctggtggcggggggggtgggggggaagacgccccaagagccaggcccgaaggcaccccaagaagggcggctaagacggtagcccacacagaaggctacccaagcttccttagtgtggaccatagcgggctcggtctggggccggcctatgggtcccttcaaaatccatacggcatgacgtttcagcccccccctcctacgccaagtgccaggcaagtccctgaacctggagaaagatctcggaccatgccacgaaccgtccctgggagcaccatgaagatgggcagtcttgaacggaagaagctcaggtactccgacctcgacttcgaaaaggtcatgcacacaagaaaacggcatagcgagctataccacgaactcaaccagaaatttcatacattcgaccgctataggtcccagtcgactgccaaggacaagccatcccctggagagaggccaagcctctcccagcaccggcgccatcagtcatggtcaacattcaagtccatgaccctggggagtttgccccccaaacctcgcgaaaggctgactctccaccgcgcggccgcctgggagccgactgaacctcctgatggtgactttcagactgaggtatag

SEQ ID NO: 180701 - DNA, 4401 bp, Artificial Sequence
  Description of Artificial Sequence: Synthetic coding sequence
atgacccccgcctgccccctgctgctgagcgtgatcctgagcctgcggctcgccactgccttcgaccctgccccatccgcatgtagtgcgttggccagcggagttctatacggggccttcagtctgcaagacctatttccaacaatcgcttcaggatgttcctggaccctggagaatcccgaccctacaaaatacagcctgtacctacgatttaaccgccaggagcaagtctgcgcccatttcgccccgagactgctgcccctggatcattatttggtgaacttcacatgcttgcgaccatctcctgaagaggcggtggcccaggctgagagcgaagttggaaggcccgaggaagaggaagccgaagctgctgccgggctggaactatgcagtgggagtggaccctttacttttctccacttcgataagaactttgtgcagctatgcctgtccgccgaacccagtgaggcgccacgactgctggcccccgcagctcttgcctttcggttcgtcgaagttctgctgatcaacaacaataattcaagccagttcacatgtggcgttctctgccgctggagtgaggagtgtgggcgagctgccgggagggcttgtggcttcgcgcagccggggtgcagctgcccaggcgaggccggcgcagggtccaccactacaacttctcccggacccccggccgcccatacactttcgaatgccctcgtgcccggcgggcctgccccccctgctgaggcagatctccattctggatctagtaacgatctcttcacaaccgagatgcggtatggggaggagcctgaggaagagcccaaggtgaagacacagtggccacggtccgcagatgaacccgggctctacatggcacagacaggggaccccgcagccgaagagtggagcccctggtcggtgtgctctctaacgtgcggacagggtctgcaggtgcgtacgaggtcatgtgtgagtagcccgtacggtactttgtgcagcggtccactcagagaaaccaggccatgcaacaactcggcaacctgtcccgtggagggacaatggctggaatggggtccatggggcccttgttccaccagctgcgctaacggcacccagcagagatcccggaagtgctcagtggccggccctgcgtgggcaacatgcaccggcgccctgaccgacactagggagtgctctaacttagagtgtcccgccaccgattcgaagtgggggccatggaacgcctggagtctatgtagcaagacctgcgatactggctggcagaggaggtttaggatgtgtcaggccaccggtactcaaggttatccatgtgagggaactggagaggaggttaagccttgtagcgagaagcggtgccccgcctttcacgaaatgtgtcgggacgaatatgttatgctgatgacctggaagaaggccgccgccggcgaaatcatctacaataaatgccctcctaatgcttcgggctccgcttcccggcgatgcctgctgagtgcacagggcgtggcctactggggtctcccgtccttcgcacggtgcatcagccacgagtatcgctatctttacttgagtcttagggaacacctggcaaaggggcagcgtatgctcgccggggaggggatgtctcaggtggtccgtagccttcaggaactgctggcgcgcagaacatactatagtggagatctactattcagtgtggatattcttcggaatgttactgacacctttaaacgcgctacatacgtgccctctgctgatgacgtgcagaggttcttccaggtggtgtcatttatggtggatgccgagaacaaagagaagtgggacgacgcacagcaggtgtccccaggctctgttcatttacttcgcgtcgtagaggacttcattcacctggtgggggacgcgctgaaagcattccagtcttccctcattgttaccgacaacctggtgatctccatccaacgagagcccgttagcgctgtctcttcagatattacgttccctatgcgtggtcgcagagggatgaaggattgggttaggcacagtgaggaccggctctttttgccgaaggaggtgctttcgctcagctcgccaggaaaacctgccacctccggggccgccggctcaccgggccggggccgcggcccagggactgtgcctccaggccccgggcattcccaccagcgacttctgcctgctgaccctgatgaatcttcctattttgttataggagccgtcctgtatcggacactgggcctgatcctaccgccccctagaccaccactcgccgtcacaagccgggtcatgactgtgacagtgcggccacctacgcagccaccagccgagcccctcatcaccgtggagctgagctatattatcaatggaacaaccgacccacattgtgctagctgggactattctcgcgctgatgctagtagtggtgactgggacaccgagaattgccagacgctggagacccaagcagcccacacacgttgccaatgtcagcacctgtcaactttcgcggtgctagcccagcctcccaaggacctaacactggaactggctggatcccccagcgtgcccttagtaattggctgtgctgtgtcgtgtatggcgctactgacactcctggccatctacgctgccttctggcgtttcattaagagtgaaaggtctataatccttcttaacttttgcctctctatcttggcatcaaacatccttattctagttggtcagagccgggtcttatctaagggagtgtgcaccatgacagccgcattccttcacttcttcttcttgtctagtttctgttgggtgttaaccgaggcttggcagtcctatctagctgtgattggaagaatgaggacccgactcgtccggaagcgatttctctgcctgggatggggcctcccagctttagtggttgccgtgtcagtggggtttacccgcacaaagggctacggaacctcctcatattgctggctgagccttgagggaggactgctgtatgcctttgttggacctgccgcagtcatcgtcctggtgaatatgctcataggcataatcgtgtttaataagttgatggccagggacggcataagcgataagtccaaaaaacagagagctggggcctcactctggagtagttgtgtagtgctgcccttactggctctgacctggatgtcagccgtgctggctatgacagacaggaggtccgtgctgtttcaggccctttttgccgtcttcaatagcgctcagggtttcgtgattacagctgttcactgctttttgagaagagaagtacaggatgtcgtcaaatgtcagatgggagtatgtagagccgacgagtccgaagacagcccggactcgtgcaaaaatggccagctgcaaatcctctccgacttcgagaaagatgtggacctagcttgccagacagtactttttaaggaggtcaacacatgtaatccctctacgattaccgggaccttatctaggttgtctctggatgaagacgaggagccaaaatcatgccttgtcgggccggaagggagcctttcctttagcccattgccaggaaacatactagttccaatggctgctagcccaggactgggcgagccacctccaccacaagaggctaacccagtgtatatgtgtggggaaggcggactcaggcagcttgatctcacgtggttgaggcctacagagccaggctcagaaggagactatatggtgttgccaaggagaaccctgagcctgcagccaggcgggggtggcggtggaggcgaggatgcacctcgcgcacgacccgagggaacccccaggagggctgccaaaacagttgctcacacggagggataccctagtttcctatcggtcgatcactcaggcctcggtcttggcccagcctatggctccctgcagaacccatacggtatgaccttccagccacctcctccgacccccagcgctcgacaggtgcccgagccaggcgagagatcaagaactatgccgcggaccgtccctggaagtacgatgaaaatggggagcctggaaagaaaaaagctgaggtattccgatctggattttgagaaagttatgcacacccgcaagcggcattccgagctgtaccacgagctgaatcaaaagtttcatacctttgatagatatagaagtcaatcaacggcaaaggataaaccctccccgggggagaggccatctctttcgcaacacaggcgccatcaaagctggagcactttcaaatcgatgactctgggatctttaccaccaaaaccaagagaacgccttacactgcacagagctgccgcttgggaacccaccgaaccgcccgacggggacttccagacggaagtctag

SEQ ID NO: 180702 - DNA, 4500 bp, Artificial Sequence
  Description of Artificial Sequence: Synthetic coding sequence
atgacccccgcctgccccctgctgctgagcgtgatcctgagcctgagactggccactgccttcgaccctgcaccatcagcttgtagcgcactggccagtggggtcctatacggggccttcagtctgcaagacctcttcccaacgatagcctcaggttgctcttggaccctggaaaatcccgaccccacaaaatattctctgtacttgagattcaatagacaggaacaggtgtgcgctcatttcgctccaaggctcttacccctggatcattatctagtgaactttacttgcttgaggccttcccctgaggaagcagtcgctcaggcagaatcagaagtagggcggccggaggaggaggaagctgaagccgcagccggtcttgagctgtgttcggggagcgggcctttcaccttcctccatttcgataagaacttcgttcagctatgtctttccgccgagccatccgaagctcctcgattgcttgcccctgccgccctcgcctttcggttcgtggaggtgctgctgatcaataataataactcatcccagtttacctgtggagtgctgtgtcggtggagtgaagaatgcggcagggccgctggacgggcatgtggatttgcccagcctggctgcagttgcccaggggaggccggtgctggttctacaaccaccacttcccccggccccccagccgcccacacgttgtctaacgcactggtccccggcggacctgcacctccggctgaagctgacctgcatagtggcagtagcaatgacctgttcacaaccgaaatgaggtatggcgaggaaccagaagaggagccgaaggtgaagacgcaatggccacgtagcgccgatgagcccggcctctacatggcccagaccgtgcatggagtgtgggaagaatggggctcatggtcactttgcagccgttcctgtggtagaggctccaggagtcgcatgcgaacctgtgtgccaccacaacacggaggtaaagcgtgtgagggtcccgagctccagaccaaactatgctccatggctgcctgtccagtcgagggccagtggctggaatggggtccctggggcccttgtagtacctcctgcgctaacggaactcagcagcgctcccggaagtgttccgtagcaggccccgcttgggccacatgtaccggcgctttgacggatactagggaatgttcaaacctagaatgccctgctaccgattccaaatggggaccctggaatgcctggtccttatgcagcaagacttgtgacaccggctggcagcgaaggttccgtatgtgtcaggccaccggaacgcaaggatatccatgtgaaggaactggagaggaagtaaaaccatgttccgagaagcgctgtcctgcgtttcacgagatgtgtagagatgaatacgttatgctgatgacctggaaaaaggccgctgcaggcgagatcatttacaataaatgcccacctaacgcgtccggtagtgccagcagacggtgcctgttgagcgctcagggcgtcgcttattggggcttgccctcatttgcccgatgtattagccatgagtaccggtatctctaccttagtctgagggaacatttggcgaaaggccagcgaatgctcgcgggtgaaggcatgagccaagtggtgagatccctgcaagaattgttggctcggcggacatattatagcggcgatctgttattctccgtggatattcttcgcaacgtgacagacacgtttaagagagccacatacgtgccgtctgccgacgatgtacagcggttttttcaagtggtcagctttatggtagatgccgagaacaaagagaaatgggatgatgcgcagcaagtttcccctggatctgtacatctgctgcgggtagtcgaggacttcatccatctcgtgggagatgccctcaaggcatttcaaagttcactgatagttactgacaatctggtcattagcattcaaagggaaccagtctccgccgtgagcagcgatatcacgtttcccatgaggggccggcggggaatgaaggactgggttagacattccgaggaccgattattcttgcccaaggaagtgctgtccctttcatcgcccggaaaacctgccacttctggtgctgctggtagtcccggtaggggaagaggaccaggcactgttccgcctggcccaggtcacagtcaccagcgcctgcttccagctgacccagacgagtcatcatattttgtgattggggccgtcctctatagaacactgggcctgatcttgcccccccctaggccgccactagccgtgacaagcagggtcatgacagtaacagtgcgccctccaacgcagcccccagccgagccactgataaccgtggaattgagttatataatcaacggaaccactgatccccattgcgcctcatgggactattcaagggcagatgcctcatctggggactgggatacagaaaactgtcagacgctcgagacacaggcagctcatacccggtgccagtgccagcatctgagcacttttgcagtgttggcccaacccccaaaggacctcacattggagctcgctgggtcaccctccgtcccgctggtcatcggctgtgctgttagctgcatggccctgctgaccttgctggccatctacgcagctttttggcgatttatcaagtcagaacggtctatcattctcctaaatttctgcctgtctattctcgcttctaatatactcatcctggttggacagagcagagtgctgagcaagggcgtttgtaccatgacagccgccttcctgcacttcttcttcctctcctcattttgttgggtactcactgaggcttggcagtcttatctcgccgtcattggtcgcatgcgtacgaggttggtgcgtaagaggttcttgtgccttggttgggggctgcccgctttagtggtggctgtgtcagtgggctttactaggacaaagggctacggcacgtcctcctattgctggctcagcttagagggaggactcctctacgccttcgtcggacctgcggctgtgattgttctggtcaatatgctgatagggattatcgtcttcaataaactcatggcgcgagatggaatcagcgacaagagcaaaaaacagcgagctgggtccgagcgctgcccttgggcaagtctcttactgccatgctccgcttgcggagccgtacccagcccactgctgtctagcgcgagcgccagaaacgccatggcttctctctggagcagttgtgtggtcctgcccctgttagctctcacttggatgtccgccgtgttagcaatgacggatcggcgctctgtgctcttccaggcgcttttcgcggtttttaattcagcccagggcttcgtgatcaccgcagtgcactgttttctgcggcgagaagtgcaggacgtggtcaaatgccagatgggggtatgccgcgcagatgagtccgaagactcacctgactcgtgtaagaacgggcagctgcagatcctgtccgacttcgaaaaggatgttgatctcgcatgccagactgtgctgttcaaggaagtgaacacatgcaacccgagcacaattaccggaaccctatctagactgagcctggacgaggacgaggagcctaagtcttgcctggtggggccagagggatccttgagtttcagccccctgcctggcaacatcctggtcccaatggctgctagtcctggcctcggcgaaccaccaccaccccaggaggcaaatcccgtttacatgtgtggtgaaggtggcctccgccagcttgatctcacatggctgagaccaacggagccggggtccgaaggagactacatggttctccccaggaggaccctcagcctgcagcccggagggggaggaggcggaggcgaagatgcacctagggcacgtcctgaaggaaccccgaggcgagcagcaaagactgtcgctcacaccgaaggatatcctagcttcctctccgtggaccatagcggcctcgggcttggccctgcgtacggctcactccaaaatccttacggcatgacattccaacctccgccccccacccctagtgcccggcaggtgccagagccaggcgagcggtctcggaccatgccacgcactgtgcccgggtctactatgaaaatgggttccctagagcgtaaaaagctgcgatattccgatctggacttcgagaaagttatgcacacaagaaaacggcattctgagctgtaccacgagttgaaccaaaagtttcatacattcgaccgataccgatcccagtctacagccaaggataagcccagcccaggcgaaaggccatctctatcacagcacagacgccaccagagctggtccacctttaagtctatgaccctaggttcgctgccccctaagccacgcgaacgccttactctgcaccgagccgctgcctgggagcccaccgaaccaccagacggggacttccagaccgaggtctag

SEQ ID NO: 180703 - DNA, 4503 bp, Artificial Sequence
  Description of Artificial Sequence: Synthetic coding sequence
atgctgagcctgcggggccccgacacccacggcaagggccaccggatgacacctgcctgtccccttctactgagcgtgatcttgtcactgcgcttggctacggcttttgaccccgccccctccgcctgctctgcgctggcaagtggcgtgttatacggggccttctcactgcaggacctgttcccgaccatcgccagcgggtgttcctggacgctggaaaacccggatcccacgaagtatagcctatacctgagatttaacaggcaggagcaagtgtgtgcgcacttcgctccccgactgttgcccttagaccattacttagtgaacttcacctgccttagaccatcaccggaagaggccgttgcacaagccgagtcagaggtcggtaggccagaagaggaggaagctgaggccgcagccgggctggaactgtgtagcggctctggcccctttaccttccttcactttgacaagaattttgtgcagctatgcctatcagcagaaccatctgaggccccacgcttgctggcacctgccgctttggcgttccgatttgtggaggttttattaatcaacaacaataactcttctcagtttacctgcggcgtgctctgtaggtggtcagaagaatgcggccgggcggcaggccgggcttgcggatttgctcagcccgggtgcagctgtccaggcgaagctggtgccgggagtaccacgacaacttcccctgggccacctgccgcccatacactaagcaacgccctcgtgcctggcggaccggcacctcctgccgaagccgacctccattccggcagctccaacgacctattcacaacagaaatgagatacggtgaggaacctgaagaagagcccaaggtgaagacacagtggccaaggtccgccgatgagccaggactctatatggctcagactgtacacggcgtgtgggaagagtgggggagttggtccctttgttctcggtcatgcgggcggggatcaaggtcacgcatgagaacatgtgtaccaccacagcatgggggaaaagcatgcgaagggccagagcttcagactaagttatgcagcatggccgcttgtccagttgagggccagtggctggagtggggtccctggggaccttgtagcacatcttgcgccaatggtactcagcaaagaagcaggaagtgctctgtggccggccctgcctgggccacctgcacgggggcactgaccgacacccgcgagtgttccaatctcgagtgtccggccaccgattcaaaatgggggccgtggaatgcttggtctctatgtagtaagacctgtgacacgggatggcaaagaaggttcaggatgtgccaggcaacaggcactcagggctatccatgcgagggaaccggcgaagaggtaaagccctgtagtgaaaagcggtgtcctgccttccatgaaatgtgtcgcgacgaatacgtaatgctaatgacatggaaaaaggcagccgctggcgagatcatatacaataagtgcccacccaatgccagtggcagcgcaagtcggagatgtcttttgtctgcccagggcgtcgcttactggggcctaccttcattcgccagatgtatcagccatgagtaccgctatctctacctgtcactgagggaacatcttgccaaagggcagagaatgctggcaggcgagggtatgagccaagtggtgcgcagcctacaagagttattggctagaagaacatactactctggggaccttctattctcagtggatatcctccggaacgtgacggatacttttaaaagagcaacctatgtgccgagtgctgatgatgtgcagcgcttcttccaggtagtctcattcatggttgacgcagaaaataaggaaaaatgggatgacgcccagcaggtgtcccccggttccgtgcacttactgcgggttgtggaagacttcattcatctcgttggggacgctctcaaggccttccagagctccttgattgtcacagataatttggtaatctccatccagagggagccagttagtgccgtcagtagcgatataactttccctatgcggggacggcgggggatgaaggactgggttcggcactctgaagaccggctgttcctgccaaaggaggtactttctctctccagcccagggaaaccggctacttccggtgcagccgggtccccagggcgcggccgtggcccaggcaccgtccctcctggcccaggacatagccaccagcgtctcctacctgctgacccggacgagtccagctacttcgtgatcggagctgttctctaccgcactttaggcctgatcctgcctccccctaggccacctctggcagtgacctctagagtcatgactgttaccgtccggccgccgacacagccacccgctgaaccgctcattaccgtcgagctgagctacatcataaacggtactaccgacccacactgcgcatcttgggattatagtcgcgctgatgcctcttctggagactgggataccgagaattgtcagactctggagacgcaggcagcacataccagatgtcagtgtcagcacctgtccacattcgccgtactggcccaaccgccgaaggacctgacactagaactagccggtagtccgagtgtgccactggtaataggctgcgccgtgtcttgcatggcattactcactttgttggccatctatgccgctttctggaggtttatcaagtccgagaggtctataatcctcctaaatttctgcttaagcatcttggcatccaatatactcatactcgttggacagtctcgggtgctgagtaaaggcgtatgcacgatgactgcagcctttctgcacttcttttttctgagctccttctgttgggtattgaccgaagcatggcagagttacctagctgtgatcgggcgtatgcggactagattggtcagaaagcgttttctctgcctcggatggggcttgcctgcacttgttgtggcagtgagcgtcggctttacaaggacaaagggatacggcacttcttcatattgttggctttcgctggagggaggcctcctgtatgcgttcgtgggtcctgcagctgtcattgtcctggttaatatgctgattggaataatcgtctttaataagctgatggccagggacgggatttcggacaagtcaaagaagcaacgagcaggcgccagtctgtggtcctcttgtgtcgtcctgccactgctggccttgacttggatgagcgccgttctggcaatgaccgatcgtcgctctgtgctttttcaggccctgttcgctgtgttcaactcagcacaaggattcgtcatcacggccgtccattgctttctcaggagggaggtccaggatgtggtcaagtgccagatgggagtctgccgggcagatgagagcgaagactcacccgatagttgtaagaatggccaattgcagatcctgtcagacttcgaaaaggatgtggacctggcttgccagactgtgctgttcaaagaggtcaacacatgcaatcccagcaccattaccggcacacttagtcgactttcactcgacgaggatgaggagcctaaaagttgcttggtcgggccagaaggatcattgtcgttctctcctttgcctgggaacatcctcgtgccaatggccgccagccccgggctcggcgagccaccacctccccaggaggcaaacccagtttatatgtgtggcgagggagggttacgacagctagatctgacgtggctgcggccgacagaacccggctcagaaggagattacatggtgctcccccggagaaccctctccttgcaaccggggggcggaggcgggggaggagaggacgcgcctagggcaaggccagaaggcacgccaaggcgcgcggccaaaacagttgctcatacagagggctatccatcattcttgagcgtggatcacagcggcctgggcctgggaccagcctacggctcgctccaaaacccatacggtatgacatttcagcccccaccccctacaccttcagcccgccaggtgcccgagccaggagagcggtcaaggaccatgcccaggaccgtgcccggttccactatgaagatgggctctctcgagcggaaaaaacttaggtattcagatctcgatttcgaaaaagtgatgcacactaggaagcgacacagcgagctgtatcatgaactgaaccagaaatttcatacgttcgaccgctatcgaagccagtctaccgcaaaacgcgaaaaaagatggtcggtaagcagcggaggtgccgcagaacgaagtgtctgcactgataaaccttccccaggcgaaagaccaagtctgagccagcacaggcgccatcagagctggtcaactttcaagagcatgacgctaggtagtctcccacctaagcctcgtgagcgcctgacactccaccgggctgcggcctgggagcccacagaaccacccgatggcgactttcagaccgaagtatag

SEQ ID NO: 180704 - DNA, 2544 bp, Artificial Sequence
  Description of Artificial Sequence: Synthetic coding sequence
ggcaagggccaccggatgacccccgcctgccccctgctgctgagcgtcattctatccctgaggctagccactgcctttgatcccgccccctcagcctgtagcgccttggcttccggcgtactgtacggggcctttagtctgcaggacctttttccaactatcgccagcggctgtagttggactttggagaatcccgacccgaccaagtactccctctacctaaggttcaatcgacaggaacaggtttgcgctcacttcgcacctcgcctactcccgctggatcactacctagtgaactttacttgtctgaggccctcacctgaggaagccgttgctcaggctgagtctgaggtagggcggccagaggaggaggaagctgaggcagctgcaggtctggagctgtgtagtggaagtggaccttttaccttcctgcatttcgacaaaaattttgtacaactatgtctgtctgctgagccatccgaagctccacgcctcctggccccagccgccctggcctttagattcgtcgaagtgctccttatcaacaataacaatagctcccaattcacctgcggtgtgctctgccgctggagcgaggagtgcgggcgcgctgctggccgagcttgtggctttgctcagccaggctgtagttgtcctggggaagccggggctggatcgaccacaaccacctcacccggtccacctgccgctcacaccctgtccaacgcacttgttcccggggggccggctccccccgcggaagccgacttgcattcaggctcctccaacgatctcttcactaccgaaatgcggtatggggaggagcctgaggaagagcctaaggtgaaaacacaatggccacgatctgccgacgagcccgggctgtacatggcacagaccggtgatccggctgctgaggagtggtcaccatggagtgtgtgttcattaacatgtggccaaggcctccaggtgcgcacccgaagttgtgtgagttccccttacggcacgctttgtagcggtccacttcgagagacccgaccttgtaataattccgccacatgccctgtcgaaggacagtggttggagtggggaccctgggggccttgtagcacttcctgtgctaacggaactcagcagcgcagcaggaagtgctctgtagccgggcctgcttgggccacctgcacaggggccctcacggatacaagggaatgcagcaacctggagtgtcccgcaacagacagtaagtggggaccctggaacgcctggagtttgtgttctaagacatgcgatactggatggcagcgacggttccgaatgtgtcaggccacaggaactcagggctacccttgtgagggtacgggtgaggaggtcaagccatgctctgagaagcgttgtccagcctttcatgaaatgtgtagggatgagtacgttatgctgatgacctggaagaaggcagctgccggggaaattatctataataagtgcccaccaaacgcatcaggcagcgccagcagaagatgcctccttagtgcccaaggggtcgcctactggggtctgccatcgttcgctaggtgcatctcacatgaataccgatacctttacctcagcctgcgggagcatctggctaagggccagaggatgctggccggcgaagggatgtcacaggtggtacgtagcctccaagaactcctagcacgtcggacctactatagtggtgatttgcttttttcggtagacattctccgcaatgtcacagacacattcaaacgcgccacctacgttccatcggccgatgacgtccagcgattcttccaagtggtaagctttatggtggatgctgaaaacaaggaaaaatgggatgatgcacagcaagtctcacccggctccgtgcatcttttgcgcgttgtggaggatttcattcacctggtgggagacgccctcaaagcattccagtcctctctgatcgtgacggataacttagtcatctccatccagcgtgagccagtgtctgccgtcagctcagacatcacattcccaatgcggggcaggcgtgggatgaaggactgggtaaggcatagcgaagacaggttgttcttaccaaaggaggttctgagcctctctagcccgggcaagcccgccacatctggggctgcaggttctcccgggcgagggcggggtccgggaaccgtgccacctggaccggggcacagccaccagaggcttctgcccgccgatccagacgagtcgtcatatttcgtaatcggtgccgtactctatagaactcttggactcatactgcccccacccaggccacctcttgccgtgacaagtcgggttatgacagtgaccgtgagacccccaacccagccgccagctgagcctttgatcacggttgaattaagctacattattaatggaaccacggatccacactgcgccagctgggactacagtagggccgatgcttcctcgggggactgggacaccgaaaattgccagacactagaaacacaagccgcgcacactcgatgtcaatgccagtag

SEQ ID NO: 180705 - DNA, 6 bp, Artificial Sequence
  Description of Artificial Sequence: Synthetic coding sequence
atgtag

SEQ ID NO: 180706 - DNA, 3528 bp, Artificial Sequence
  Description of Artificial Sequence: Synthetic coding sequence
atggcccagaccgtgcacggcgtgtgggaggagtggggcagctggtccctctgctcacggagttgtggcagaggctcacgctctcgcatgcgcacatgcgtccctccgcagcatgggggcaaggcttgcgagggaccagagctccagactaaattgtgctcaatggctgcctgccctgttgagggccagtggttggaatggggtccgtggggtccttgttctacctcatgtgcaaatggtactcagcagcggtcgcggaaatgttctgtagctggacccgcttgggccacctgcacaggagcgcttactgacacgagagagtgtagtaatttggagtgccctgctactgacagcaagtggggtccatggaatgcctggagtttatgttccaaaacatgcgataccggatggcaaagacgtttcagaatgtgccaggctactggcacgcagggctacccttgcgaagggaccggggaggaagtcaaaccttgttctgagaaaaggtgccccgcgttccacgaaatgtgtagggacgagtacgtgatgctgatgacctggaagaaagcagctgcaggcgaaatcatctacaacaaatgtccgcctaacgcatcggggagtgcctccagacggtgcttgctgtccgcccaaggtgtagcttattggggtctgccttcgttcgccaggtgtatttctcacgagtatcgatatttatacctgagtctgcgagagcacctggcaaaggggcagagaatgttagcaggagaaggaatgtctcaggtggtccgctcactgcaggagctgctggctcggcgcacatactacagcggcgacctactctttagtgttgacatcttgagaaatgtgactgatacgtttaagagagcaacctacgttcccagcgctgacgacgtgcagaggttttttcaagttgtgagttttatggtggacgcagagaataaggaaaagtgggacgacgcccagcaggtgagtcccggcagcgttcatctgctccgagtcgtggaggatttcatacacctggttggggatgctctgaaggcgttccagtcaagcttgatcgtaaccgataacctggtcatttctatccagcgagagcctgtttctgccgtgagctcagacataactttccccatgcgcgggcggcggggcatgaaggactgggtgaggcacagtgaggatagattgttccttcccaaggaggtgctttctctgagctcgcccggcaaaccggctacttccggagcagccgggagcccaggcagaggacgcgggcccgggaccgtccccccgggcccagggcactctcaccagaggctcttgccagccgaccctgacgagagctcttacttcgtgataggcgcagtcctgtaccgaaccttgggcctgatccttcccccccctcgtccaccattagcagttacgagtagagttatgacggtaactgtcagacctcctactcagcccccggctgagccgctgatcactgttgaactgagctatatcattaatgggacaacagaccctcactgcgcttcctgggattattcccgagctgatgcatcctctggcgactgggatactgagaactgtcaaacactagagacccaagccgctcacacaaggtgtcaatgtcaacacctgtctacgttcgctgtgttagctcaaccacctaaagatctgaccctagagctggctggcagcccgtcagtgccactagtgattggatgcgctgtttcgtgtatggctctgctaacactccttgccatctacgcagcgttttggcggtttattaagtccgaaaggtccatcattcttctgaacttttgcctatccattctggcctctaacatcctaatcctggtaggacagtctagggtcctgagtaagggagtgtgtactatgaccgctgcctttctacatttcttctttctaagctcattctgctgggtgttaactgaggcgtggcaatcttacttagcggtgattggaagaatgcgcacaaggttagttcgaaaaagatttctgtgcttaggctggggactccccgccctggtggttgcagtctctgttggattcactaggactaaaggatatggtacctcgtcttactgttggctcagcttggagggaggcctgctgtatgcattcgtgggccccgctgccgtgatcgtgcttgtgaatatgctgatcggaatcattgtgtttaataaactgatggcacgcgatggaatttctgacaagtcaaagaagcaaagggctggagcgtccctgtggtcttcatgcgtcgtattgccgttgctggctctgacatggatgtcagccgtcctggctatgactgacaggcgatctgtactttttcaggcactgtttgccgtttttaattctgcccagggctttgtcattacagcagtccactgttttctgcggagagaggttcaggacgttgtgaagtgccagatgggcgtgtgcagagccgatgaaagcgaagattcccccgatagttgtaaaaacgggcaactgcagattctgagcgacttcgagaaggatgtggacctggcttgtcagactgtactatttaaggaagtaaacacctgtaatccatctacgatcaccggcacccttagtcgcctctccctggatgaggatgaagagccaaaatcctgcctggttggccctgagggtagtttgtctttctcacctttgcccggaaacatacttgtcccaatggccgcgtcgccaggacttggcgagccaccgcccccacaggaagccaaccctgtatacatgtgcggtgaggggggactcaggcagctggacctgacctggctgaggccgacggagccgggcagcgagggagattacatggtcctgcctagacggacgcttagtctgcaacccggtggtgggggcgggggcggcgaagatgccccgcgggcgcgccctgagggtacgccccgccgcgcagctaagaccgttgcgcacacggaaggctaccccagctttctttccgtcgaccacagcggactcggactgggtcccgcttacggatctctgcagaacccctatggcatgactttccagcctcctccccctacacctagtgccaggcaggttccagagccgggggaacgatctcgcacaatgccacgcacagtcccaggaagcacaatgaaaatgggcagcctggagcgcaagaagctgcgttattccgatctagatttcgaaaaggtgatgcatactagaaaacgacattcggagctgtaccatgaactaaatcaaaagtttcatacctttgaccgataccggtcacagtcaaccgctaaagataagcccagccccggggaaagaccctccctgagccaacaccgccggcatcagagctggagtacatttaaatctatgaccttgggctcactaccaccgaaacctcgggaacgcctcaccttgcatagggctgccgcgtgggagccaacggaaccccccgatggagacttccagactgaggtgtag

SEQ ID NO: 180707 - DNA, 4656 bp, Artificial Sequence
  Description of Artificial Sequence: Synthetic coding sequence
atggagaacaccggctggatgggcaagggccaccggatgacccccgcatgcccattgttgctgtcagtgatactctctctcagactggcgactgcgtttgatcctgcgcctagcgcgtgtagcgcactagctagcggcgtgctgtacggcgctttcagcctccaggacctgttccccactattgccagtggatgttcttggactctcgagaatccagaccccacaaagtattcgttatacttacggtttaaccggcaggaacaggtgtgtgctcatttcgcacctagactactgccacttgaccattatctcgtcaacttcacatgtctccggccctctcccgaagaagcagttgctcaagccgaatctgaagttgggagaccggaagaagaagaagcagaggccgccgcggggttggaactttgctctggctccgggcctttcaccttcctccacttcgacaagaatttcgtgcagttgtgtctctccgcggagccctcagaagcccctagactcttggcacccgcagcactcgctttccgctttgtggaggtcctgcttattaataacaataatagctcccagtttacgtgtggtgtgctgtgcaggtggtcagaagagtgtggacgggctgccgggcgcgcgtgtgggtttgcacagccgggttgtagctgtccaggagaagcgggggccggatccaccaccacaacgtcgcccggaccgccggccgcccatacactgagcaacgctctagttccgggggggcctgcaccacctgcagaagccgatctccattctggatcatccaacgacctgttcactaccgagatgaggtatggtgaagaacccgaggaagaaccaaaggtcaaaacacagtggccccggtccgcagacgagcctggtctctatatggcgcagacaggtgaccccgccgctgaggagtggtccccttggtccgtctgctctttgacgtgtggccaggggttacaggtccggacccgttcctgcgtgtctagtccctacggcaccctttgctccggcccactgagagagacacgaccgtgtaacaactctgccacctgtccagttcatggagtttgggaagaatggggctcctggtccctgtgctcccggtcctgtggtcgcggaagtaggagtagaatgcggacatgtgtccccccccagcatggcgggaaggcgtgtgaggggcctgagctgcaaactaagctttgcagcatggcagcctgcccagttgagggacagtggctggagtggggaccctgggggccctgcagcacgagctgcgcaaatgggacgcagcagcgcagtcgcaagtgctcagtggcaggcccagcatgggccacatgtacaggcgcccttactgacacccgggagtgcagtaacctcgaatgtcccgctacagactctaagtggggtccatggaacgcctggtctctttgctcaaagacctgcgatactgggtggcagcgccgattccgcatgtgtcaggccactggaacccaaggctacccgtgcgaaggcaccggtgaggaggtgaagccatgttcagagaaacgctgccctgctttccatgagatgtgcagggacgagtacgtgatgctgatgacctggaaaaaggccgccgccggtgaaatcatttacaacaaatgtcctccaaacgcgtccggctccgcaagtcggcgctgcctcctctccgcccagggagtcgcatattggggcctgccttcattcgctcgatgcatttcccatgagtatcgttacttgtacctgagtttgagggagcatcttgccaagggacaaaggatgctggcgggtgagggcatgtcccaggtggtcagatccttacaagagctcctggcgcggagaacttattatagtggagatctgctgttctccgtggacattctgcgtaatgtcacagacacatttaagcgggcaacgtacgtgccttccgccgacgatgtgcaaagattctttcaggttgtcagttttatggttgacgctgaaaacaaggagaagtgggacgacgctcagcaggttagtcctggatcagtccacctgctgagggtggtggaagactttattcatctggtgggcgatgctctgaaagcattccagagcagcctaatcgtcaccgacaatttagttatcagcatccaacgtgaacctgtgtctgcagtgtcctcagacatcacattcccaatgagaggtcgaagaggtatgaaggactgggtgcgccattcagaggaccggttgttccttcccaaggaagttctgtccttgagctcgccagggaagcccgcaacctccggggctgctggctccccaggaagggggcgggggcctggtactgtgccccctggcccagggcattcacatcagcgcttgctgcctgctgatcccgacgagtcatcttatttcgtaataggcgctgttttataccgtaccttaggcctgattctgccaccgccaaggcccccgttggcggtcacgtccagggtgatgactgtgaccgttcgaccgcctacacagccgcctgctgaaccactgataactgtggagctcagctacataataaacggtaccacggatccccactgtgcctcctgggattattctcgagccgatgcatcctccggcgattgggacactgagaattgccagaccctggaaacccaggccgcgcacactcgttgccagtgccagcacctatcgaccttcgccgtgctcgcccagccccccaaggacctcaccctggaactcgcagggtcaccaagcgtcccgctcgtcatagggtgtgcagtttcctgtatggcactgctgaccctcctggcaatctacgcagccttctggcgattcatcaaatccgagcgcagcatcatcctgctcaatttctgcctaagtatcctggcctcgaatattctcatcctggtcgggcagtcccgagtgctgagcaagggggtgtgtaccatgacagctgcgttcctacacttcttcttcctttcgagtttctgttgggtacttactgaggcttggcaatcatatctggctgtaatcggtaggatgagaacccgcttggtgcgcaagcgattcctgtgcctgggatgggggctccctgcgcttgtggtggcggtgtcagtgggcttcacacgaacaaagggctacggcacgagcagctattgttggcttagtttagagggaggtctgttatatgctttcgtgggtcctgccgcggtcattgtgctggtgaatatgttaattggaattattgtttttaataaactgatggcacgggatggtattagcgacaagtcgaaaaaacaacgggccggcgccagtttgtggagtagctgtgtagtcctgcccttgctggccttaacatggatgtctgcagtgctcgcgatgacagaccgacgttccgtcctgtttcaggccctcttcgccgtgtttaactctgctcagggattcgtaataacggccgtccactgtttcctgcgtagagaggtgcaggatgtcgtgaagtgccagatgggcgtgtgtagagccgatgagagcgaggacagcccagattcatgcaaaaatggtcagctccagatcctgagcgattttgagaaagatgtggaccttgcctgtcaaaccgttctttttaaagaagtgaatacatgcaatccctcaacgatcacaggcaccctgagccgactctctcttgacgaagacgaagagcccaaaagttgcctagttggccccgagggatctctctctttcagcccactccccgggaatattctcgtccctatggccgcaagccctggcctcggagaacctccaccccctcaagaagcaaaccctgtttacatgtgtggggaagggggactgaggcagctcgatctaacctggctcaggcccacagaacctgggtctgaaggagattacatggtgctgccacgacggactctgagcctgcagccaggcggtggcggtggggggggagaggatgcacctagggcccgcccagaagggacccctagacgggctgccaagaccgtggcgcacactgaaggctatccctccttcctgtctgtggatcactctggtctgggactggggcccgcttatggatcactgcaaaacccttacggtatgacctttcagccccctccaccgacacccagtgcccgccaggtgcccgagcccggagaacgatccaggactatgcctaggacagtacccggctcgacaatgaagatgggatccttggaaagaaagaaactgcgatattcagacctggatttcgaagtcatgcacactcggaagagacactctgagctttaccacgagctgaaccagaaattccacacttttgaccggtaccgctcccagagcactgcaaaaagggagaagcgatggagcgtctcctccggaggcgccgcagagagaagtgtgtgcacagataagcctagtccaggcgaacggcctagcttgtctcaacaccggcggcaccagtcctggtctaccttcaaaagcatgaccttagggtcgctcccaccgaaacccagggagcgtctgactctgcatcgcgcagccgcctgggagcccacggaacccccagatggggatttccagacggaggtttag

SEQ ID NO: 180708 - DNA, 2187 bp, Artificial Sequence
  Description of Artificial Sequence: Synthetic coding sequence
atgctgctgccccagggcaaggaggccgtggagggcaagaagtgccaggggaggcaacggcgcgcaggcctgtcagaagtatggagtcggaagctgagaaacgagagtctcggcacttggtctacccaaggatgcaagaccgtgctgacagacgcctctcacaccaagtgcttatgcgaccggctctctacattcgcaattctcgcacagcagcccagggagattatcatggaatcatccgggaccccatccgtcacattgatcgtggggagcggcctgtcatgtttggctctgataacactcgccgtggtctacgctgctctttggcgttacattaggtcagaacgatcaatcattttgattaatttctgtttatcaatcattagctctaacatccttattctagtgggccagacccaaacacacaataagagtatctgcaccactacaaccgctttcctgcacttctttttccttgcctctttctgctgggtgctcactgaggcgtggcagagttacatggcagtgacagggaagatacggactcggctgatcagaaaacgcttcttgtgtctgggttggggtttgcctgcactggtggtggctacgagcgtcggcttcactcgaactaagggctacggcaccgaccattattgttggttgagcctagagggcggactcctttacgcttttgtaggtcccgccgccgccgtggtgctcgtgaacatggtgatcggcatccttgtttttaacaaattggttagtcgtgacgggatccttgataaaaaattaaagcacagagccgggcagatgtctgaaccacacagcggattgaccttgaaatgcgccaagtgcggggtggtctccaccactgctttgagtgcaaccaccgcaagcaacgccatggcctccttgtggtcttcttgcgtggtactgcctcttcttgccctgacttggatgtcagccgtgcttgccatgaccgacaaacgaagtattttattccagatcttatttgcggtgtttgacagcctgcagggtttcgtcatcgtaatggtccattgcatcctgaggcgggaagtgcaagacgcatttcggtgtcgactgcggaactgtcaggaccccatcaacgcagatagctcgtcatcattcccgaacggacacgcccagattatgacagacttcgagaaagatgtcgatatcgcgtgcaggagtgtgctgcataaggatatcggaccctgtcgggccgctaccattaccgggaccctgagccgtatctccctgaatgatgatgaggaagaaaagggcaccaatcctgaggggctcagctatagtacattgccgggaaacgtcatttccaaggtgattattcagcagcccacggggctacatatgccaatgtcgatgaacgagctgtcaaatccatgcctcaagaaagagaattccgagctgagaaggacagtctatctctgcaccgatgacaacctccgcggagcggacatggacattgtccacccccaggagagaatgatggaatcggattacatcgttatgccgcgctcctccgttaataatcagccatctatgaaggaggaaagcaaaatgaatattgggatggaaactctacctcatgaacgtctgcttcactataaagtgaaccccgaattcaatatgaatcctcctgtcatggaccaatttaacatgaatttagagcaacacctggctccccaggaacacatgcagaacctgcccttcgagccgagaactgccgtgaaaaacttcatggcaagcgagcttgatgacaacgccggactctcaagatcagaaacagggtcaaccatcagcatgtccagtttagagcggcggaagagtcgctactcagatctggactttgaaaaggtaatgcacactaggaagagacatatggagctgttccaggagctgaatcagaaatttcaaactctggaccggttccgggacatcccgaacacatcctcaatggaaaacccagctcctaacaagaatccttgggatacattcaaaaatccttctgagtacccgcactacacaaccatcaacgttctcgacacagaagcaaaagatgcactcgagctcaggccagcagagtgggagaaatgtctgaacttgccccttgacgtgcaggaaggagattttcagaccgaagtttag

SEQ ID NO: 180709 - DNA, 4569 bp, Artificial Sequence
  Description of Artificial Sequence: Synthetic coding sequence
atgaaggccgtgcggaacctgctgatctacatcttcagcacctacctactggtcatgtttggatttaacgcggcgcaagacttctggtgctccaccctggtcaaaggagtgatttatggatcttattccgtgtctgagatgttcccaaaaaacttcaccaattgcacatggacactggaaaacccagacccgactaagtacagcatttatctgaaattttccaaaaaagaccttagttgctccaatttcagcctcttggcctaccagttcgatcattttagccacgagaaaatcaaggacctgttacggaaaaatcattctataatgcagttgtgcaacagcaaaaacgcctttgtgttcctgcagtacgacaagaactttatccagataaggcgggtgtttcccacaaatttccccggcttacagaagaagggcgaggaagaccagaagagtttttttgaattccttgtgctaaataaagtgtcaccttcacagttcggatgtcacgtgttgtgtacgtggctggagagctgcctgaagagcgagaatgggcgcacagagagttgcggtatcatgtatacgaagtgcacttgccctcaacatttgggggagtggggaatagacgatcagtccctcattcttttgaacaatgtcgtgctgcccttgaacgaacagactgagggatgcctcacccaggagctccaaaccactcaggtgtgtaatctcacaagagaagcaaaaagaccaccgaaggaggagttcgggatgatgggcgatcacacgatcaaaagtcaaaggccaagaagtgtccacgagaagcgcgtcccacaagagcaagcggacgccgctaaattcatggctcagactggggagtctggcgtcgaggaatggagtcaatggtcgacctgttctgtcacatgtggccagggctctcaggtcaggacacgcacctgtgtgtccccctatgggacacactgctcaggcccgctgcgggaaagccgagtgtgcaataacacagccttgtgtcctgtgcacggcgtctgggaggaatggtcgccatggagcctgtgttcctttacttgcggccgggggcaaaggactaggacacgcagctgcacacctcctcagtacggcggaaggccatgtgagggccctgaaactcaccataaaccctgcaatatagccctctgccccgtggatgggcagtggcaagaatggtctagctggtcgcagtgttctgtcacgtgttcaaacgggacccagcagagatcccgtcagtgcaccgctgccgcccacgggggaagcgaatgccgtggaccatgggctgagagtcgcgaatgttacaaccctgaatgcaccgccaatggccagtggaaccagtggggccattggtctggctgttccaagtcgtgtgatggtgggtgggaacggcggataagaacctgccagggggcagtgatcacaggacagcagtgtgagggtacaggggaagaggtcagacggtgtaatgagcaaagatgcccagcaccttatgaaatctgccctgaggattacctgatgtcaatggtctggaaaagaactcctgccggcgacttggcctttaaccagtgcccactgaacgccaccggtacaacatcccgtaggtgctctctgagcttgcacggtgtcgccttttgggaacaacctagttttgcaagatgcatctcaaatgagtacaggcaccttcagcactccattaaggaacacctggctaagggacagcggatgcttgctggggacggaatgtcgcaggtgactaagaccctgctcgacctcacccagcgaaagaacttttacgctggcgatcttttgatgtccgtcgagatcttgcgcaacgttacagacacgtttaagagagccagttatatcccagcatcagacggtgtgcagaattttttccagatagtgtccaacctgttggacgaagaaaacaaagagaaatgggaggatgctcagcagatttaccctggatcaatagagttaatgcaggtgattgaggactttattcacatcgtgggaatgggaatgatggactttcaaaactcttatttgatgaccgggaatgtcgttgcttcgatacagaaattacctgctgcctctgtgctcacagatattaatttccctatgaagggcaggaaagggatggtggactgggcccgcaacagtgaagaccgcgtggtaatcccgaagtctatttttactccggtgagtagcaaagagctcgatgagagcagtgtctttgtacttggtgcagtgctgtataagaacctggatttgatcctgcccacgcttagaaactacacagtgattaattccaagatcatcgtggtgaccatccgacccgagcctaagaccactgatagcttcttagagatcgagctggcacacctagctaatgggacactgaacccttactgtgttttgtgggacgacagtaagacaaatgagagtttgggtacctggtcgactcagggctgtaaaaccgtgctcactgacgccagccatacaaagtgcctttgcgacagactgagtacatttgctatactggcacagcaacctagggaaatcataatggaatcttccgggacaccatccgttaccctgatcgtcggctcaggactgagttgtctggccttgattacactggccgtggtgtatgctgccctatggaggtacatcagatccgaaaggagcattatcctgatcaacttctgtctgtcaatcatttcttccaacatcttgatcctcgtcggacaaactcagactcataataagagcatctgtacgacgactacagcttttctgcatttcttttttttggcatcattttgttgggtgctcaccgaggcgtggcagtcctacatggcagtaacgggtaagattagaacacgcctgatccgcaagcggttcctttgcctaggttggggattacctgctttggtggtggcgacgagcgtgggctttacccgcacgaaaggttatggcactgaccattactgctggctctcactggagggtggattgctgtatgctttcgtgggcccagcagctgcggttgtgctcgtgaatatggtcattggaatcctcgtctttaataaactcgtgtcgcgtgacggtatcttggacaaaaaactaaagcatcgggctggtcagatgagcgaacctcactctggcctcactttaaagtgcgcgaaatgcggcgtggtcagtacaacggctctgagtgctaccacagccagtaatgccatggccagcctgtggtcctcgtgtgtcgtgcttccgctgctcgccctgacctggatgtccgctgtgctggcgatgaccgacaagcggagtattctgttccaaatactgttcgcagttttcgacagcctccaaggtttcgtgatcgtaatggtccactgtatcctccggcgcgaagtacaggatgctttccgatgcaggcttcgtaactgccaagatcccattaacgctgatagttccagttcatttcccaatgggcacgcgcagattatgaccgactttgagaaggatgtggatatagcatgtaggtccgtgctccacaaggatatcggaccttgcagggctgcgacaatcaccggtaccttgagccgaattagcctcaatgacgatgaggaggaaaagggtacgaaccctgagggcttatcatacagcacactgcccggcaacgtgatatctaaggtcatcatacagcagccaactgggttgcacatgccaatgtcgatgaacgaactgagcaacccatgccttaaaaaagagaactccgagctgcgcaggaccgtttacctgtgcactgatgacaacttgaggggggctgatatggacattgtgcatcctcaggaacgtatgatggaatcggactacatcgtcatgccccgttcctccgtcaataaccagccctccatgaaagaggagtctaagatgaacatcggcatggagaccctacctcacgagagactgctccattacaaggtgaatcccgagtttaatatgaacccccctgttatggatcagtttaacatgaatctcgagcagcacctggctccacaggaacacatgcaaaatctccctttcgagccccggactgctgtgaagaattttatggcatccgagctggacgacaatgctggcctgtccagatctgagaccgggagtacgattagcatgtcttctttggagcggcggaagtctcggtactcggaccttgacttcgagaaggtgatgcacactcgcaagcgacacatggaattgtttcaggagctgaaccaaaagttccagaccctcgacagattccgggatattcctaatacgagcagtatggaaaaccctgcaccaaataaaaacccctgggatacgtttaaaaaccctagcgaataccctcattacacaaccatcaatgtactagacacagaagcaaaagacgctctggagctgcgccccgccgagtgggaaaaatgcctgaaccttccattggacgttcaggaaggagatttccagactgaggtgtag

SEQ ID NO: 180710 - DNA, 1461 bp, Artificial Sequence
  Description of Artificial Sequence: Synthetic coding sequence
atggtgatcggcatcctggtgttcaacaagctggtgagccgggacggcattttagacaagaaacttaagcatagagccgggcagatgagcgaaccacactcaggattaaccttgaagtgtgcgaagtgcggcgtggtgagtactacggccctgagcgcaacaaccgcctcgaatgcaatggccagcctgtggtcatcttgtgtcgttctgccgctgctagctctgacttggatgagcgccgtcttggccatgaccgataagcgatctatactgtttcagatcttgtttgcggtctttgactccctgcaaggcttcgtcatcgtgatggtgcattgtatcctaaggagagaagttcaagacgcatttcggtgtcgcctgaggaactgccaagatcccattaacgcggactcttccagttcattccctaacggacatgcacaaattatgaccgatttcgaaaaggacgtggatattgcgtgtcgtagcgtcctgcacaaggatattggtccctgcagggccgctactattaccggcaccttgagccgtatctcactgaatgacgatgaggaagaaaaaggcacaaacccagaagggctatcgtattccacactgcctggtaacgtcataagtaaagtgattatccagcagccaacaggcctccatatgcccatgagcatgaatgaattgagcaatccctgcttaaaaaaggaaaatagtgagctacggagaaccgtgtatctttgcacagatgataacctgcgcggcgcagatatggacatcgtgcaccctcaggagcgcatgatggaatccgattacattgtcatgccccggtctagcgttaacaaccagccgtccatgaaggaggagagcaagatgaatatagggatggaaacccttccacacgagagactcctgcattataaagtgaaccccgagttcaatatgaaccccccagtaatggaccaattcaacatgaatctcgagcagcaccttgccccacaagagcacatgcagaatcttcctttcgaaccccgcaccgccgtgaaaaactttatggccagtgaacttgatgataacgctggcttgagccggtccgaaaccggtagcacgatttcaatgagcagcctcgagcgtagaaaatctaggtattctgatctggatttcgaaaaggtgatgcacacccggaaaaggcacatggaactctttcaggagctcaaccagaagttccagaccctcgacagattcagggacattcccaatactagtagcatggagaatccagctcccaataagaatccttgggataccttcaagaatccctcagagtacccacattatacaacgataaatgtgctcgacacagaggcaaaggacgctttagaactgcgaccagctgagtgggaaaaatgcctgaacctgccactagacgtccaggagggtgactttcagacagaggtttag

SEQ ID NO: 180711 - DNA, 978 bp, Artificial Sequence
  Description of Artificial Sequence: Synthetic coding sequence
atgaaggccaaggacctgatcgtgacccccgccaccatcctgaaggagaagcctgacccaaacaacttggttttcggcacagtctttaccgaccatatgctgacggtggaatggagcagcgagtttgggtgggaaaaaccgcacatcaagccgcttcagaatctgtcactgcatccagggagtagtgcactgcactacgctgtggaagtgtttgacaaggaagagcttctggagtgcatacagcagctggtaaaactggaccaggagtgggtaccgtactccacgtccgccagcctatacatacgtcccaccttcatcggtacagagccatctctgggtgtcaagaagccaacgaaggccctcctgttcgtgctgctaagtccagtcgggccttatttctcgtcaggcacctttaatcctgtcagtctatgggccaaccctaagtatgtccgcgcctggaagggcgggactggtgactgtaaaatggggggcaattatggcagttccttgttcgcgcagtgtgaggccgttgataacgggtgccaacaggtattgtggctttacggcgaggaccaccagattacggaagtaggcactatgaatcttttcctgtactggatcaacgaagacggcgaggaggaactcgctactccacccctagacggaattatcctaccgggtgtgactcgcaggtgtatcttagatctggcccaccagtggggcgaatttaaagtgtcggagagatatctcacaatggacgacttgacaactgccttggagggaaaccgggttcgagaaatgtttgggtctggaacagcttgtgtcgtgtgtcctgtttcggacatattatataaaggggaaaccatccatattcctactatggaaaacgggccgaagctggctagccgaatactgagcaagcttacagatatacagtacgggcgcgaggagagtgactggaccattgtcttgtcttag

SEQ ID NO: 180712 - DNA, 1158 bp, Artificial Sequence
  Description of Artificial Sequence: Synthetic coding sequence
atggactgcagcaacggctgcagcgccgagtgcaccggcgagggcggctccaaggaagtcgtcggtacatttaaggccaaagatctgattgtgacgccggcgactatcctcaaagaaaagccagatcccaacaatctcgtgtttggcacggtttttaccgaccacatgctgaccgtcgaatggagtagcgaattcgggtgggaaaaaccacacataaagccactgcagaacctgtccctgcatccaggcagttccgctctgcattacgccgtggagctctttgaaggcctcaaggcgtttagaggggtggataacaaaatacgactgttccaacctaatctgaatatggatcgcatgtacagaagtgctgttcgcgcaacactcccagtgtttgataaagaggaattactcgagtgcatccagcaactcgtgaagctagatcaggaatgggtcccatatagcacgtccgcctcactatacattcgacccacctttataggaacggaaccatcattgggcgtgaagaagcctaccaaagcattgctgtttgtgctgttgagccccgttgggccttacttcagctcaggcacctttaatccggtgtctctgtgggccaatccaaagtatgtgagagcgtggaaaggcgggactggcgattgcaagatggggggtaattatggctcatccctttttgcacagtgtgaggcagtagataacggatgccaacaagtgctgtggctctatggcgaagatcatcagattaccgaggtgggcaccatgaacttgtttctatattggatcaatgaagacggagaagaggagctcgctacacctcccctcgacggtatcatcttgccaggggtcacgcggcggtgcatacttgaccttgctcaccagtggggcgaattcaaagtttcggagcgatacctcaccatggatgacttgacgacagccctggaaggcaatcgagtgcgcgagatgtttggctcagggactgcatgtgtcgtttgcccagtgagtgacattctgtataagggagagaccatccacatacctactatggagaatggacctaaactggcctccagaattctttctaagctgaccgatattcagtacgggagggaagaatcagactggacaattgtgctgtcttag

SEQ ID NO: 180713 - DNA, 1197 bp, Artificial Sequence
  Description of Artificial Sequence: Synthetic coding sequence
atggccagccccctgcggagcgccgccgccctggcccggcaggactgttcaaatggatgctctgccgaatgtaccggggagggcggatctaaagaggtggtcggcaccttcaaggctaaggatctaatcgtaacccccgcaacaatcctcaaggagaaacccgatcctaataatttagtgtttgggacagttttcaccgaccatatgctgacagtagagtggagctctgaattcggctgggaaaagccccatattaagcccctgcagaatttgagtctgcaccctggatctagcgctcttcactatgccgttgagttgttcgaaggcctgaaggcttttcgaggagttgataacaagattaggctgttccagcccaacctaaatatggatcgtatgtatcggagcgcggtgcgtgctactctccccgttttcgataaagaggaactgctggagtgcatccagcagctcgtcaagctcgaccaggaatgggtcccatatagcactagtgcctcgctttacataaggcccactttcatcgggaccgaaccctctcttggcgtcaaaaagcctacaaaggccctcctgttcgtcctgctgagccctgtcggcccttatttcagttccgggacatttaatccggtctccctgtgggctaacccaaagtacgtgcgagcctggaaaggcggaacgggcgactgcaaaatgggagggaactacggtagcagtctctttgctcaatgcgaggccgttgacaacggctgccagcaggtgctttggctgtatggggaagaccatcagattacggaagtggggacgatgaacctcttcttatactggattaatgaggatggggaagaggaattggccacccctccactcgatggcattatattgccgggtgtaacaagacggtgcattttggatctggcccaccagtggggggagttcaaagttagtgagcgctacttaactatggatgatctgactacagcactggaagggaaccgggtacgggaaatgtttggctcaggaacagcttgtgtggtgtgccccgtctcggatatcctgtacaagggggagactatccacattcccacaatggaaaacgggcctaaactcgctagtagaatcctcagtaaacttaccgacattcagtatggccgggaggagtctgactggactattgttcttagctag

SEQ ID NO: 180714 - DNA, 1050 bp, Artificial Sequence
  Description of Artificial Sequence: Synthetic coding sequence
atgaaggactgcagcaacggctgcagcgccgagtgcaccggcgagggaggttccaaggaggtggtaggtacattcaaggctaaggacttaatcgtgacacccgccaccatcttgaaggagaagccagaccctaataaccttgtctttggcaccgtcttcaccgaccacatgctgacggttgaatggagcagcgaattcggatgggagaagcctcatatcaaacccctgcaaaatctgtctctgcatccaggctcaagtgcgttgcactacgccgttgaggtgttcgataaggaggagttgctggagtgcatccagcagctggtgaaactcgaccaggagtgggtcccttatagcacctcagcctctttatacatccgaccaacattcattggaacagagccctctctaggagtgaaaaaacccactaaggccctgctctttgtcttgctctctccagtaggaccctacttctcatcggggacctttaatcccgtgtcactctgggccaacccgaagtacgtacgggcctggaagggagggacaggggattgcaaaatgggcggtaactacgggtcttcgctgtttgcgcagtgtgaagcggtggacaatggctgccagcaggtgctgtggctgtatggagaggatcatcaaatcacagaggttgggacgatgaatttgttcctgtattggatcaatgaggacggtgaggaagaactcgcgacacccccactggatgggatcatcctcccaggcgtgaccagacggtgtattctggacctggctcatcaatggggggagtttaaggtctctgaacggtacctgacaatggacgatcttactaccgctctcgagggaaatcgcgtgagggaaatgtttggcagcgggaccgcctgtgtcgtgtgccccgtgtctgacattctctacaagggggaaactatccatattccaacgatggaaaatgggccaaagctggcctcacgaatactgtcgaagctgaccgacatccaatatggccgcgaggagagtgactggaccatcgtgctcagctag

SEQ ID NO: 180715 - DNA, 1161 bp, Artificial Sequence
  Description of Artificial Sequence: Synthetic coding sequence
atgaaggactgcagcaacggctgcagcgccgagtgcaccggcgagggtggttccaaggaggtggtgggaactttcaaggcgaaggatcttattgtgactcctgctacaattctcaaagagaagcccgaccctaataacctagtattcggcacggtgttcaccgaccacatgctgactgtcgagtggtcttcggaattcggatgggaaaagccccacataaagccgttgcagaaccttagtctccatccaggttccagtgcgcttcactacgcggtagagctgtttgagggactgaaggcatttaggggggtggataacaaaattcgcctatttcaaccaaacttgaatatggaccgcatgtacagaagcgcggtcagggccactttgcccgtatttgataaagaggaactcctcgagtgcatccagcagctggtcaagctagaccaggagtgggtaccctacagtacttccgcctccttgtacattcgacccacctttatcggtacagagccaagtctgggagttaagaagccgaccaaggccctgctgtttgtgttgctgagtcccgttgggccatacttcagctctgggactttcaatccagtatcactctgggctaaccccaagtacgtacgagcctggaaaggggggacgggggactgtaagatgggtgggaactacggatcttcactcttcgctcaatgtgaggctgtagataacggttgccagcaggtattatggctttatggtgaagaccaccagatcaccgaagtcggcactatgaacctttttctctattggatcaatgaggacggcgaggaggaactcgcaaccccccccctggatggcattatcttaccaggagtgacacggaggtgcatactcgacttagcccatcagtggggggaatttaaggtgagcgagcggtatctgactatggatgatcttactactgcacttgaggggaaccgagtacgcgaaatgtttggcagtgggaccgcctgcgtggtgtgccctgtttcggacatcctgtacaagggcgaaacaatccacatcccaaccatggaaaacggccccaagctggcttcgcggattctgagtaagttgactgacattcagtacggtcgcgaagagagcgattggactatcgtcctgtcatag

SEQ ID NO: 180716 - DNA, 1179 bp, Artificial Sequence
  Description of Artificial Sequence: Synthetic coding sequence
atggccgccgccgccctgggccagatctgggcccggaagctgctgtctgtaccctggctgctatgcggacctcgcaggtacgcaagtagtagcttcaaggctgccgaccttcagctcgagatgacccagaaaccgcacaagaagcccgggccgggggagccattggtgttcggcaagaccttcaccgaccacatgctgatggttgagtggaacgacaaaggctgggggcaaccgagaatccagccattccaaaacctcaccctgcatcctgcgagctcctctctccactatagcctacagctgttcgaaggaatgaaggcgttcaagggaaaagaccagcaggtgagactcttcagaccttggttgaatatggatagaatgctccgatctgccatgcggctgtgcctcccctctttcgataaactggaattactggagtgcatcagacgcctgatagaagttgataaagactgggtcccggacgcagccggtacttctctatatgttcgcccggtgctgattggaaacgaaccttccttgggcgtttcccaaccaacgcgggcattgctcttcgtgatcctgtgcccggtcggagcctactttccaggcggcagcgtgactccagtgtcgttgcttgctgacccggccttcattagggcctgggtcgggggagttgggaactataagctggggggcaactacggacctacagtactcgtccagcaggaggcgctcaaacgcggctgtgagcaggtgctatggttgtacggtccagatcaccaactcacggaagttgggacaatgaatatcttcgtctattggacacacgaggacggagtgcttgagctcgttaccccccctctgaatggggtgatcttacccggcgtggtgaggcaaagtctgctcgacatggcccagacctggggcgagtttcgagtagtcgaacgcaccattacaatgaaacagctgctgcgggccctcgaggagggcagagtgcgggaagtgttcggatccggaaccgcatgtcaggtttgccccgtgcatcggattctgtacaaagataggaatctacatatcccaacgatggagaacggacccgaactgattctccggttccagaaagaactcaaggaaatccagtacggaattcgagcacacgaatggatgttccccgtgtag

SEQ ID NO: 180717 - DNA, 1059 bp, Artificial Sequence
  Description of Artificial Sequence: Synthetic coding sequence
atgacccagaagccccacaagaagcccggccccggcgagcccctggtgtttggcaagactttcactgatcacatgctgatggtggagtggaacgacaaaggttgggggcagcctcgcatccagcctttccaaaacctaaccttgcatcccgcctcctcatctcttcattattcccttcaactctttgaaggtatgaaggcctttaagggaaaagatcaacaagtgaggctgttccgaccctggctcaatatggatcgcatgctgcgaagtgccatgagattgtgcctgcctagttttgataaactggagctgctggagtgtattagaaggttgatcgaagtggacaaagactgggtgcctgatgctgccggtacatccttatatgtgcggcctgttctgatcggcaatgaaccatcgctgggggtttctcagcctactcgcgctcttctgttcgtgatcctgtgccctgttggggcctatttccccggcgggtcagtgacccccgtgagccttctggctgaccctgcatttattcgtgcctgggtcgggggggtagggaactacaagctcggtggcaactatggccctacagttctggtgcagcaggaggctcttaaacgggggtgcgagcaggtgttatggttgtacggccctgatcaccagttgaccgaagtcggaactatgaacatcttcgtctactggacccatgaggacggcgtccttgagcttgtgacccctccactaaacggagttattcttccgggtgtcgtgcggcaaagcttgctggacatggcccaaacatggggggagttccgcgtagtagagcggaccattacaatgaaacagctgcttcgggccctagaggaaggcagagtgagagaagtttttggatctggcacagcatgccaggtctgtcccgtgcaccgaatactgtataaagatagaaacctgcacataccgaccatggagaatggtccagaactaattctccgctttcagaaggagttaaaagagatccagtacggcattcgtgcccatgaatggatgtttcctgtctag

SEQ ID NO: 180718 - DNA, 903 bp, Artificial Sequence
  Description of Artificial Sequence: Synthetic coding sequence
atggccgccgccgccctgggccagctgttcgagggcatgaaggccttcaaggggaaggaccagcaggtgaggctctttcggccttggctgaacatggaccgcatgctgaggtcagctatgagactttgtttgccttcgttcgataagctggagctgctggagtgcattcgtcgcctgattgaagttgataaggactgggtgcccgacgctgctggaacgtcactatacgtaagaccggtacttattggcaacgagccgtcgttgggggtgagtcagcccacacgtgcactgctgttcgtgatcctgtgtcccgttggggcctactttccaggggggtccgtcacccccgtgtctttactcgcagaccctgccttcatcagagcttgggtcggcggggtggggaactataaattaggcggaaactatggaccgacggtgctggttcagcaggaagcgttgaagagaggatgcgagcaggtactttggttgtacggtccagatcaccaacttacggaagtcggaaccatgaacattttcgtttattggactcacgaggacggcgtactcgagttggtcaccccacccctgaacggagtgatcctccctggtgtggtaaggcagtccctcctggatatggcccagacatggggggaatttagagtcgttgagcggacgatcaccatgaagcagctgctgcgggccctggaggaggggcgggtgcgagaggtcttcggtagcggcacggcctgtcaagtgtgcccggttcatcggatactgtacaaggatagaaatctgcatattccgactatggagaatggacctgagctcatcctaaggtttcagaaagagctgaaagaaatacagtatggtatacgcgcccacgaatggatgtttcctgtgtag

SEQ ID NO: 180719 - DNA, 1338 bp, Artificial Sequence
  Description of Artificial Sequence: Synthetic coding sequence
atggccgtggccatcgccgccgcccgggtgtggcggctgaaccggggattaagccaggccgcattgcttctgctgcggcagccaggcgctcggggtttggctagatcccatccaccccggcaacagcagcaattcagctcattggacgataagccacagtttccgggagcgtcagctgagttcatagataaactggaattcatccagccaaatgtcatctccgggatacccatctaccgagtgatggacaggcaggggcagattataaacccgtcggaggacccccatctcccaaaggagaaggtgctgaagctttataaatctatgacccttctgaatacaatggacagaatattgtatgaatcacagcggcagggacggatctcgttttacatgacaaattatggggaagaggggacccacgtgggaagcgctgctgccctggacaacaccgaccttgtgttcggtcaataccgggaagctggggtgctcatgtatagggattatccacttgaactgtttatggcccagtgttacggcaatatctcggatctcgggaagggtcgccaaatgccggtgcactatggctgcaaggagagacattttgtgacaatctcaagtcctctggctacacagattccacaagcagtcggagccgcatacgccgcaaagcgagcaaacgcaaaccgtgtggtaatttgttacttcggcgaaggggcagctagtgaaggagacgctcacgccggctttaactttgcagcgacactggagtgtcccatcattttcttctgtcgcaataacggatacgccatcagtactccaacttcggagcagtacagaggtgatggcattgcagcaaggggtccagggtatggcattatgtctattagggtggacggtaatgacgtgttcgcggtatataacgcaacaaaggaagctcggaggagagctgtggccgagaaccaaccctttttaatagaggcaatgacatacagaatcggacatcacagcaccagtgatgattccagcgcctataggagcgtggacgaggttaactattgggacaagcaagatcacccgatatctcgccttaggcactacttgctgagccagggctggtgggacgaagagcaggagaaagcttggaggaaacaaagccgtaggaaggtgatggaagcctttgaacaggccgagcggaagccaaagccgaacccgaatcttctcttttccgatgtctatcaggaaatgcccgcacagctgcgaaagcagcaggaaagcctagccaggcacctgcaaacttatggagagcactaccccctcgaccacttcgacaagtag

SEQ ID NO: 180720 - DNA, 1212 bp, Artificial Sequence
  Description of Artificial Sequence: Synthetic coding sequence
atggccgtggccatcgccgccgcccgggtgtggcggctgaaccggggactgtcacaagccgccctgctcttgctcaggcaacctggtgccagaggactggcccggagtcatcccccacgtcaacaacagcagttcagctccctggatgataaaccacaatttccaggcgctagtgccgagtttatcgataagctggaattcatacaacccaatgtcatctctggtatcccaatctaccgagttatggacagacagggccagataataaaccctagtgaggacccgcacctgcccaaggagaaggtgcttaagctatacaagtcaatgacattgctgaacacgatggacagaattctttacgaatcccagcgccagggcaggatctccttctacatgaccaactatggggaggagggcactcacgttggttctgccgccgcactggataacactgacctcgtgttcggtcagtatagagaagcaggggtgttgatgtatagagattacccactggaactgttcatggctcagtgctacggaaatatttccgacctcggaaaaggcaggcagatgcccgtgcattacggttgtaaggagcggcacttcgtgactatctccagcccccttgctacccagatccctcaggccgtaggcgctgcctacgcagcgaagcgggcaaatgcgaatcgagtcgtcatttgctatttcggagagggagcggcctctgaaggcgatgctcatgcaggcttcaatttcgcagcaaccctggagtgtcccatcattttcttttgtcgaaataatgggtacgctatctcaactccaacctcggaacagtatcgcggggatggaatcgctgcacgtgggcccggatacggtatcatgagtatccgcgtggatggaaatgatgtgtttgccgtctataccgccaccggggggcccaaggcccgagctagcgtcggtcctagtagccctagtaccactggcacttgcgggatcatgatgcctttgcatgccatggggctgtggcaccccgtgagccatcagcaggagctgtccgccgcaccgaagcccaaaggaacgacaaaaccaattctggagtcgtatttgaaaagccacttgctgggacatagcagatatcaactgtatatccatcaggatgccgtgaggagagaaaagccacagagtaatctcaacagagaatctctaatctag

SEQ ID NO: 180721 - DNA, 1179 bp, Artificial Sequence
  Description of Artificial Sequence: Synthetic coding sequence
atggccgtggtggccgccgccgccggctggctgctgcggctgcgggccgctggcgccgagggccactggcgccggctcccaggcgccggactagctaggggctttctgcacccggctgcaaccgtcgaagatgccgctcagcgccggcaggtggcccatttcacgtttcagcccgatcctgaaccgagagagtatggacagactcagaaaatgaacctattccagtcagtgacatcagctttggacaactccctggccaaagatccgacggccgtgatctttggcgaggacgtagcattcggcggagtgtttcgatgcactgtgggactcagggacaaatacggcaaagacagagttttcaacacaccactttgcgaacagggcatcgtgggtttcggcatcggaatagctgtcaccggtgcaactgctatagcagagatccagtttgcggactatatcttccccgcattcgatcaaattgtcaacgaggctgccaaatatcggtatcggtctggcgacctgttcaactgtggctccctgaccattaggagcccttgggggtgcgtcgggcatggggctttgtaccactctcagagtcctgaagcttttttcgcccactgccctgggattaaggtagtgattccccgatcaccttttcaggccaaagggttgctgctatcttgtattgaggataaaaacccctgcattttctttgaaccgaagattttgtacagagcggcagcagaggaagtgcccattgagccctacaacatcccattgagccaggctgaggtgatacaggaaggctccgatgtcaccctggttgcttggggcacacaagtccatgttatccgagaggtcgccagcatggccaaagagaagctgggcgtgtcctgtgaggtgatagacctccgtacaataatcccctgggacgtggatacgatctgcaaatccgtcatcaaaactggtcgtctcctgattagtcacgaggctcctctgaccggtggcttcgcatctgagatcagcagtaccgtgcaggaagagtgtttcctcaacctggaggcaccaatctcacgtgtgtgtggatacgacactccctttcctcatatcttcgagcctttctacattcccgataaatggaagtgttatgacgccctgcgtaagatgattaactactag

SEQ ID NO: 180722 - DNA, 1179 bp, Artificial Sequence
  Description of Artificial Sequence: Synthetic coding sequence
atggccgtggtggccgccgccgccggctggctgctgcggctgcgggccgcgggcgccgagggacactggaggcgtctgcccggagctggtctcgcacggggcttcctgcatcctgccgccactgtagaggatgcagcgcagcggcgacaggtagctcactttacattccagccagatcctgaaccacgcgaatacggccaaacacagaagatgaatctgtttcaaagcgtcacctcagcactggacaactccctggcaaaggacccaacggctgtgatatttggcgaagatgtggcctttggaggagtgtttcgctgcaccgtcggcctgcgggacaaatacggaaaagatagggtgttcaacacaccactctgcgagcaaggtattgtcgggtttggtatcggaatcgccgtgactggggcaaccgccattgcggagatccaatttgcagactacatcttcccggcgttcgaccagatcgtgaacgaagctgccaaatacagataccgaagcggggacctgttcaattgcggatccctcaccatccgcagcccatggggatgcgttggccacggcgctctgtaccactcacagtccccagaggcattctttgctcactgccccggaatcaaagtggtaatccccagaagcccattccaggctaaaggtttactgctgagctgtatcgaagataaaaatccctgcattttctttgaacccaagatcctgtatcgggctgcggccgaggaagtccctatcgagccttataacattccactcagtcaggcagaggtcatacaagaggggagcgatgtaacactagtggcctgggggacccaggttcatgtcatacgtgaggtggcgagcatggccaaggagaagctgggggtgtcttgcgaggttatcgatctgaggacaattatcccatgggacgtcgacacgatctgcaagagtgtgataaagactgggcgcctgcttatctctcacgaggcgccgctgaccggaggatttgccagcgaaatttccagcactgttcaagaggaatgcttcctgaacctcgaagcgcctatatcaagagtttgcgggtatgatactcccttcccacacatctttgagccattttacatccccgacaagtggaaatgctatgacgccctgaggaagatgatcaactactag

SEQ ID NO: 180723 - DNA, 657 bp, Artificial Sequence
  Description of Artificial Sequence: Synthetic coding sequence
atggccgtggtggccgccgccgccggctggctgctgcggctgcgggcagccggagcggagggccactggcgacgccttcctggtgcaggcttggcccgcggcttcctccatcctgcagccacggtggaagacgcagcccaacgacgccaagtggcccatttcacatttcagcccgatcccgaaccacgggagtacggacagacccagaagatgaatctgttccagtctgtgacaagtgcactcgacaatagtctggcgaaggatcccaccgccgtaatttttggcgaagacgtggcgttcggcggggtttttcgatgtacagtaggactcagggataagtacggcaaagatcgagtgttcaacacccccctgtgtgagcaaggcatcgtgggatttggcattggcattgcggttactggcgcgactgctatcgccgagattcagtttgccgattacatcttcccggctttcgaccagattgtcaacgaagcagccaagtatcgatacaggagtggcgacctctttaattgtggttctctgactattaggtcaccatggggctgcgtcggccacggagctctctatcatagtcagagccccgaagcctttttcgcccactgccccggcattaaaatcaaggtgatttctctgagctag

SEQ ID NO: 180724 - DNA, 969 bp, Artificial Sequence
  Description of Artificial Sequence: Synthetic coding sequence
atgaacctgttccagagcgtgaccagcgccctggacaacagcctggccaaagaccccactgcagtaatctttggagaggatgtggcttttggcggagtgttcagatgtactgtggggcttagagacaagtacgggaaggatcgcgttttcaatacgcctctgtgtgagcaggggatcgtgggatttgggatcgggatcgctgtgactggtgccaccgcgatcgccgaaattcagttcgcagactacatctttccagcctttgatcagatcgtgaatgaagctgcgaaatatcgataccggtctggcgacctcttcaattgcggttctcttactattagatctccgtggggatgcgtgggccacggggcgttgtatcatagccagagccccgaggctttctttgctcactgtcccgggataaaggtggtcatccctcggtctcctttccaggccaagggactcctcctgtcatgtattgaagacaaaaatccgtgtattttttttgagcctaagatactgtaccgcgccgcagccgaggaggttccaatcgagccatataacattcctctgagtcaggctgaagttatccaggaagggtctgacgttaccctggtcgcttggggcactcaggttcatgtcatcagagaggtagccagcatggctaaggaaaaactgggtgtgtcatgtgaggtgatagacctgaggactattatcccctgggatgtggacaccatatgcaagagcgtgatcaaaactggcagactcttaatctcccacgaagcccccttgactggaggatttgcttctgagatctcctccaccgtccaagaggaatgttttctgaaccttgaagcacctatttcaagagtgtgtgggtacgatactccctttccgcacattttcgagccattttacattccagataagtggaagtgctatgacgctctgcggaagatgattaattactag

SEQ ID NO: 180725 - DNA, 657 bp, Artificial Sequence
  Description of Artificial Sequence: Synthetic coding sequence
atggccgtggtggccgccgccgccggctggctgctgcggctgcgggccgccggggctgagggacactggcgtcggcttcctggcgccgggcttgccagaggcttcctgcaccccgctgctacggtggaagacgccgctcagagacgccaggtggcccattttaccttccaaccagaccccgagcctcgtgaatatggccagacacagaaaatgaacctcttccaatccgttacaagcgccctggacaattctctagctaaagacccgacagccgtgatcttcggagaagatgtggcattcggcggagtgttccgctgcaccgtgggtcttagagataagtatggaaaagacagagtgttcaacacaccactttgcgagcagggaattgtagggtttgggatcggcatcgctgttacaggggcaacagctattgccgaaatacagtttgcagattatatattccctgcctttgaccagattgtcaacgaagccgcaaaatacaggtaccggtctggagacttgttcaattgtggaagtctgacaattcgtagtccttgggggtgcgtggggcatggtgcgctgtaccatagtcagtctccggaggcttttttcgctcactgtccaggcattaaaatcaaagtgatctcactttcatag

SEQ ID NO: 180726 - DNA, 1779 bp, Artificial Sequence
  Description of Artificial Sequence: Synthetic coding sequence
atgagcgtgagcctggtggtgatccggctggagctggccgagcactctcccgtccccgccgggtttggcttttctgccgctgccggcgaaatgagtgatgaggaaatcaaaaagacaactctcgcaagtgccgttgcctgtcttgagggtaagagcccgggagagaaggtcgcaattatacaccaacatctgggtagacgtgaaatgacagacgtgatcatcgagacaatgaagtccaatcctgatgaactaaaaaccaccgttgaggagcggaagtcgtctgaggcctctccaacagcccagcgcagtaaagatcacagtaaagagtgcattaatgccgcgcccgatagcccaagcaagcaactgcctgatcagatctcctttttctcaggtaatccatctgtggagatagtgcatggcattatgcacctgtataaaaccaataagatgactagcctgaaggaggacgtccggagatctgccatgctctgcattcttacggtccctgcagcaatgacctcacacgacttgatgaagtttgtcgccccttttaatgaggttatcgaacaaatgaaaatcattagagatagcaccccgaatcagtacatggttttgataaaattcagggcccaggccgacgctgactcattctacatgacatgcaatggacggcagttcaactccattgaggacgacgtctgccaactcgtgtatgtggagcgtgcagaggtgctcaagtcagaagatggtgctagcctacctgtcatggatctcaccgaactaccgaagtgcaccgtgtgcctggagagaatggacgagtctgtgaacgggatcctgaccacactgtgtaaccattcattccacagccagtgtctgcagcgctgggacgacaccacgtgtcccgtttgcaggtattgccagacgccagagccggtcgaagagaataaatgctttgagtgtggagtccaggagaatttatggatctgcctaatttgcggacacattgggtgcggtcgctatgttagccgacatgcatataagcactttgaggaaacgcaacacacctatgccatgcagctcactaatcatcgggtatgggattacgcgggcgacaactatgtacacaggctcgtcgccagcaagacagacggcaagatagtccagtacgaatgcgagggagacacctgtcaggaagagaagatcgacgcactacagctggaatacagttacttactgactagccaactagagtcccaacggatctactgggagaacaaaattgtgaggattgagaaggacacagctgaggagatcaataacatgaaaactaaattcaaggagacgatagaaaagtgtgacaacctcgagcacaaactcaatgacctgctaaaagagaagcagtcagtggagaggaaatgtacccagctcaacacaaaagtcgcgaaactgacgaatgaactgaaagaggaacaggaaatgaacaagtgtctgagggcaaatcaggtgttactgcagaacaagctgaaggaagaagagcgtgtcctcaaggagacgtgcgaccaaaaagatcttcaaatcaccgagattcaggaacagttgcgggacgtcatgttctacctcgaaacccagcagaaaattaatcacttacccgctgaaacacgtcaggagatccaagagggacagattaatatcgcgatggccagcgcatcctcgcctgctagctccggagggtccgggaagttgcctagtcgcaaagggagatccaaacgcggcaagtag

SEQ ID NO: 180727 - DNA, 1242 bp, Artificial Sequence
  Description of Artificial Sequence: Synthetic coding sequence
atgcacctgtacaagaccaacaagatgaccagcctgaaggaggacgtgaggaggtccgctatgctttgtatcctgacagtgcctgcagccatgacttcgcacgacctgatgaaattcgtggccccttttaacgaggtgatagagcagatgaagatcatccgggacagcaccccgaatcagtatatggtgctgatcaagttcagagcccagggagcctctctgccagtgatggatttgacagaattgcccaaatgtactgtgtgcctagaaagaatggatgagtcagtgaacggcatactcactacgctgtgtaaccatagcttccattctcagtgcttgcaacgatgggatgatactacttgccccgtctgcagatattgtcagactccggaaccagtcgaggaaaacaaatgttttgaatgcggcgtgcaggaaaacctctggatctgtctaatatgtggtcacattggctgcggccgatatgtgtctcggcatgcgtacaagcactttgaagaaacccagcacacctacgcaatgcaacttacaaatcatagagtgtgggactatgcaggggacaactatgtccaccggttggtcgcctcgaagactgatggcaaaattgtgcagtatgagtgcgagggcgatacgtgtcaggaggaaaagatagacgcccttcagctggagtactcctatttgctgacatcacagttagaaagccagagaatctattgggagaataagatcgtccgaatcgaaaaagataccgcggaggagatcaacaatatgaaaaccaagtttaaggagaccattgagaagtgcgacaatctggagcacaagctaaacgatctgctaaaagaaaagcagtcagtggaacgtaaatgtacgcagctcaataccaaggtggctaagctaactaatgagctgaaagaggaacaggaaatgaacaagtgcctcagagccaaccaggtgcttctccagaataaactcaaggaagaggaaagagtcctaaaagagacttgcgaccaaaaggatcttcaaataacagagattcaggaacagctccgagacgtgatgttttatctggagacacagcaaaaaatcaatcacctccctgcagaaacgagacaggaaatacaggagggccagataaatatagctatggcctccgcctcatcccccgcttctagcggcgggagtggcaagctaccctccagaaaagggagatcaaagaggggaaagtag

SEQ ID NO: 180728 - DNA, 2136 bp, Artificial Sequence
  Description of Artificial Sequence: Synthetic coding sequence
atgaacaagggctggctggagctggagagcgaccccggcctgttcacactcttggtggaagactttggagtcaagggcgtgcaggtggaagaaatctatgacctgcagtccaaatgtcagggtccagtctacggatttatctttttgttcaaatggatcgaggaacggcgaagtaggcgtaaggtttccactttggtcgatgatacctccgtcattgacgacgacattgtgaacaatatgttctttgcccaccagttgatacccaatagctgcgcaacacacgcactgcttagcgtgcttttgaattgcagttctgtcgatctggggcctacgctcagcaggatgaaggatttcaccaaaggatttagccccgaatcgaagggatacgccatagggaacgcgccagagctcgccaaagcccataacagccatgcgcggcccgaaccgcgtcacttaccagagaaacaaaacggcctgtcagccgtgcggacgatggaggcctttcacttcgtaagctatgtacctattaccggccgactgttcgagttagatggcttgaaagtatatccaatagaccacggcccctggggggaggatgaggagtggacagataaggcccgcagagtgatcatggaaagaataggcctcgcaaccgctggaatcaagtatgaagctcggctgcatgtgctgaaggtgaatcgccagacagtgctagaggctctgcaacagctcattcgagtcacccaacctgagctcatccagactcacaaatctcaggagtctcaactgccagaagagagcaaatctgccagcaacaagagtccactggtgctcgaggccaaccgcgcccctgccgccagcgaggggaaccataccgatggagccgaggaagctgcaggatcctgtgcacaggccccctcccattcgccgcccaacaaacctaagctggttgtgaagcccccaggatccagcctcaacggagtgcaccccaatcctacacccatcgtacaaagattgcccgcattcctggacaatcacaattatgccaagagcccaatgcaggaagaggaagatctggctgcgggagtgggcagaagtcgagtacccgtcaggccacctcagcaatattcagatgatgaggatgattatgaagacgatgaggaggacgacgttcagaataccaattcagcccttaggtataagggtaaaggaacaggaaaacctggagctctttccgggagcgccgatgggcagctgagcgttctgcaaccgaatactatcaacgtgcttgctgagaaactcaaggagtcccagaaggacctgagcattcctttatctattaaaacttcttccggagcaggaagcccggctgtcgcagtgcccacccacagtcagccctcaccaacgcctagtaacgagtccactgacactgcgtcagagatagggagcgcttttaattctcccctccgaagccccattaggtcagccaaccccacaaggccatcatcacccgtgacgagccacataagtaaagtgctgttcggagaggatgattcacttttgagggtcgactgcataagatataatcgtgcagtccgagatctgggccctgtcatatcaaccggactcctccatcttgctgaggacggagtactgtcccccctagccttaactgaaggtggcaaaggcagctccccaagcattcggccaattcaagggtcgcaggggagcagtagtcccgtggaaaaagaggtagtggaggctaccgatagcagggagaagacaggaatggtcagacctggagaacccctgagtggagagaaatatagcccgaaggaacttctggcactcctgaagtgcgtcgaagcggagatcgccaattatgaggcttgtctaaaggaggaggtcgaaaagaggaagaaattcaaaatcgatgatcaacgcaggacacacaattatgacgagttcatttgtacctttatcagcatgctggcgcaggaaggaatgttggcaaacttggtcgagcagaacatctccgtgcgcaggcgccaaggagtgtctataggccgattgcacaaacagaggaagcctgaccgtcgcaagaggagtcgaccgtacaaggctaaacgccagtag

SEQ ID NO: 180729 - DNA, 2190 bp, Artificial Sequence
  Description of Artificial Sequence: Synthetic coding sequence
atgaacaagggctggctggagctggagagcgaccccggcctgttcaccctgctggtggaagatttcggggtgaaaggcgtacaggtggaggaaatttacgatttgcagagcaagtgtcagggacctgtctacggcttcatcttcctgttcaaatggattgaggagcgccgctcccgccggaaggtttcgacactcgtagacgacacgagtgtaattgatgatgacatcgtgaacaatatgtttttcgcccaccagctgatcccaaactcctgcgctacccatgcccttttaagtgttttgctgaattgttcctctgtggacctaggccctacactgtctaggatgaaggattttacgaaggggttctcacccgaaagcaagggctacgccataggaaacgcccccgagttagctaaggcccacaactcgcacgcacgccccgagcctcgacacttgcctgaaaaacaaaacggactctcggccgttcggacaatggaggcattccactttgtatcgtacgtgcccatcaccggaagactattcgagttggacggcttaaaggtgtatcccattgaccacgggccttggggagaggacgaggagtggactgacaaggcacggcgtgttatcatggaacgaattggcttggccactgccggggaaccctatcatgacattcgtttcaatctaatggctgtggtgcccgacagaaggattaaatatgaagctagactccatgtgttgaaagtgaaccggcagactgtcctggaggccctgcagcaacttatccgcgtcactcaaccggagctgattcaaacccataaaagccaagagtcccaattgcctgaggaaagcaaatctgcctcaaacaaatcacctttggttctggaggccaatagggctccggctgcttccgaggggaatcacactgatggggccgaggaggcggcagggtcatgcgcccaagcaccttcccacagcccacctaataaacccaaactagtcgtgaagcctcctggatcatcattaaacggagtgcatcctaacccaactcctattgttcaacgcctgcccgcttttttggacaaccataattatgcaaagagcccaatgcaagaagaggaagacctcgctgccggtgtgggaaggtccagggtgcccgtgcgcccaccccagcagtactccgacgatgaagatgattacgaagacgacgaagaagacgatgtgcaaaatacaaacagcgccttacggtacaaaggtaaaggaacaggcaagcccggggcgctgagtgggtccgccgatgggcagctttctgtccttcagcctaacacaattaatgtgcttgcagagaaacttaaggagtcccagaaggacctgtctattccattatcgatcaaaacatcgtcaggcgctgggtctccagcagtggccgttcctacacatagtcagccgagccctacgccatcaaacgagtcgaccgacacggcctcagaaatcggctccgcgtttaattccccactacgaagccccatcaggtccgctaacccaacccgtccctctagtccagtcacaagtcacattagcaaagtgctgtttggtgaggatgactcactgctgcgcgtcgattgcatacgctacaatagagcggtcagagatctgggccccgttatttccactggtctcttgcatctggctgaggacggggtgttgtcgccgctggcccttactgaaggcggcaagggctccagcccttccatccggcctatccaggggtcccaaggttcatcttcaccggtcgaaaaggaggtggtagaagctaccgattcgcgagagaagaccgggatggtgcgaccaggtgagcccctgagcggcgagaagtattcacctaaggagctgctagctttgctgaaatgtgtcgaggctgaaattgccaattacgaggcatgtctcaaggaagaggttgagaagcggaaaaagtttaagattgatgaccagagacgtacccacaattatgacgagtttatctgcacgttcattagtatgctcgcacaggagggaatgctggcaaacctcgtggaacagaatatcagtgtgcgtcgccggcaaggggtttcaatcgggcgtctacataagcagagaaagcccgatcgacggaagcgcagcaggccatataaagccaaacgccagtag

SEQ ID NO: 180730 - DNA, 879 bp, Artificial Sequence
  Description of Artificial Sequence: Synthetic coding sequence
atggccgtgcaggtggtgcaggccgtgcaggccgtgcacctggagtctgacgcatttctggtgtgtctcaatcatgccctctccaccgagaaggaggaggttatgggtctatgcattggcgaactgaatgatgacacctctcgttccgactcaaagttcgcctacactggaacagaaatgcgcaccgtggctgagaaagtagatgctgtccgtatcgtgcacatacattcagtgattatactgcgtcggtcagataaacggaaggaccgcgttgagatctcccccgagcagctttccgctgcttcaacagaggccgagcgactcgccgagctcaccggccgccctatgcgtgtagtcggctggtaccactcacatcctcatataaccgtctggcctagccacgtcgatgttcgcacacaagctatgtatcagatgatggaccagggttttgtgggccttatattttcctgctttatcgaagacaagaacacgaagaccgggcgggtgttgtacacctgcttccagtctattcaggctcaaaaaagcagcgaatacgaaaggatagaaatcccaatccatattgttcctcacgttaccatcggcaaggtctgcttggaaagcgccgttgagctccctaaaatcttgtgtcaggaggaacaagatgcctaccggagaatccactccctgacgcacttggactccgttactaagatccacaacggctccgttttcacaaagaatctctgctctcagatgtccgctgtttctgggcctctattgcaatggctggaagaccgcttggagcagaaccaacagcatctccaagagcttcaacaggaaaaggaggaactaatgcaggagctttcctctcttgagtag

SEQ ID NO: 180731 - DNA, 876 bp, Artificial Sequence
  Description of Artificial Sequence: Synthetic coding sequence
atggccgtgcaggtggtgcaggccgtgcaggccgtgcacctggagtcagacgccttcctggtctgtctgaaccatgccttgtctactgagaaggaagaggtaatgggtctttgtataggcgagctcaatgacgacactcgcagcgacagtaaattcgcctatacaggtaccgagatgcggactgtcgctgagaaagttgatgctgttagaatagtccacatccattctgtcatcatcctacgaagaagcgacaaaagaaaagatagggtggaaattagccctgaacagctgagcgcagcatcaacagaggcggaacggctggctgagttaacagggcggcctatgagagtagtggggtggtaccactcccaccctcacatcaccgtctggccatcgcacgtggatgtgagaactcaggccatgtatcagatgatggaccagggatttgtcgggttgatatttagctgtttcattgaagataaaaatactaaaacaggaagagtgctgtatacctgtttccagagcatccaggcccagaaatcaagcgagtatgagcgaatcgaaatcccaattcacatcgtgccccacgtcacaatcggcaaagtgtgtcttgagagcgccgtagaactgcctaagatactatgccaagaggagcaggatgcttaccgccgtatccattctctcactcatttagattccgtcacaaagatccataacggctcagtctttaccaaaaacctgtgctcacaaatgtccgccgttagcgggccactgctacagtggctggaggatcgattggaacagaaccagcagcatctccaagaactgcaacaggagaaagaagagctgatgcaagagctgagcagcttggagtag

SEQ ID NO: 180732 - DNA, 951 bp, Artificial Sequence
  Description of Artificial Sequence: Synthetic coding sequence
atggccgtgcaggtggtgcaggccgtgcaggccgtgcacctggagagtgatgctttcttagtatgtctgaaccacgccttgagcacagagaaagaagaagtgatgggtctctgtatcggggaactgaacgatgatacccggtcagactctaaatttgcttacaccggcacagagatgcgtacagtggcagagaaggtcgatgcggtgcgcatcgtacatatccactcggttatcattctgagaagaagtgacaaaagaaaggatcgggtggagatcagtcccgagcagctgagcgccgctagtacggaggccgagagacttgcagagctgactggacgcccgatgcgcgtggtgggctggtaccactcccacccccacattactgtttggccatcccacgttgacgttcggacgcaggctatgtatcaaatgatggatcagggtttcgtgggattgatcttctcctgcttcatagaagacaagaatactaagaccggaagggtgctgtacacatgcttccagagcatccaagctcaaaaaagctcagaaagtttgcacggaccccgcgacttctggagtagctctcaacacatttctatagaagggcagaaggaagaggagcgctatgagaggatcgaaattcctatccacatcgtgcctcacgtcacgatcgggaaggtttgtctggagtctgccgtggagctgcccaagattctttgccaggaagaacaggatgcttatcgccgtatccacagtctgacccatcttgacagcgtcaccaaaattcataacggcagcgtgtttacaaaaaatctgtgtagccagatgtcagctgtgtccggccccctccttcaatggctggaagataggctcgagcaaaaccaacagcatttgcaagaactgcaacaagaaaaggaagaactaatgcaggagctcagtagcctcgaatag

SEQ ID NO: 180733 - DNA, 954 bp, Artificial Sequence
  Description of Artificial Sequence: Synthetic coding sequence
atggccgtgcaggtggtgcaggccgtgcaggccgtgcacctggagtcagacgcttttctggtctgtctcaatcacgcactgtcaaccgaaaaggaggaagtgatgggcctctgcattggtgaggtgagttccccctcccgttccgattccaagttcgcgtacacaggaaccgagatgcgaacagtggctgagaaagtcgacgcggtccgcattgtccacattcactcggttataatcctgcgtcgatctgacaaacgaaaagaccgcgttgagatctctcccgagcagctgtcggccgcaagtactgaaactcacaggctggccgaacttacagggcgccccatgcgcgtagtgggctggtaccactcacacccacatattacagtgtggccctcccacgtggacgtgagaacccaagccatgtaccagatgatggatcagggattcgtcggcctgattttctcatgttttatcgaggacaagaatacgaagactgggagagtgctctatacctgcttccagtccattcaggcccagaaatcctctgaatctttgcacgggccgcgggatttttggtcatcttcccaacacataagcatcgaaggccaaaaggaagaggagcggtatgaaagaattgagataccgattcacatcgtgccacacgtgaccataggcaaggtgtgcctggagtccgctgtcgagctcccaaagatcttatgccaggaagaacaggatgcctataggagaatccatagtctcacccacctggactctgttacgaagatccataacggcagcgaggtttttactaaaaatctctgttcacagatgtcggccgtttctggaccactcctgcagtggctcgaggaccgcctcgagcaaaaccagcagcacctgcaggaactccagcaggaaaaggaagagcttatgcaggagctgagctccctagagtag

SEQ ID NO: 180734 - DNA, 747 bp, Artificial Sequence
  Description of Artificial Sequence: Synthetic coding sequence
atggccgtgcaggtggtgcaggccgtgcaggccgtgcacctggagagtgatgcgttcctggtgtgtctaaaccatgccctgagcaccgaaaaagaagaggtgatggggctgtgcataggggaggtatccagtccatcacgcagtgactccaagtttgcatatacagggactgagatgcgaacggttgctgagaaagtggacgcagtgcgtattgttcatatccattccgtcattatcttgagacgcagcgataagaggaaagatagggtggagatttctcccgagcagctctctgccgctagtaccgagacgcatcgactggccgaactgaccggccgacctatgagggtggtcggctggtatcactcccacccacacatcacagtatggcccagtcatgtggacgtacggacccaggctatgtatcagatgatggatcagggctttgtggggcttattttctcctgttttatcgaggacaaaaataccaagaccgggcgggtactgtatacatgcttccaaagtatccaagcccagaaatccagtgatctcactcacttagatagcgtgaccaaaattcacaacggaagcgaggtgtttacaaaaaatttgtgttcccagatgtccgctgtctcaggccccctcctccagtggttggaggatcgcttagagcagaatcagcagcacctgcaggagctgcaacaggaaaaagaagagcttatgcaggagttaagctcgctggagtag

SEQ ID NO: 180735 - DNA, 1845 bp, Artificial Sequence
  Description of Artificial Sequence: Synthetic coding sequence
atgggcaaccagatgagcgtgccccagcgggtggaggaccaggagaacgagcccgaagccgaaacatatcaggacaacgccagtgccttaaacggcgtcccagttgtggtcagcactcacacagtgcagcacctagaagaggtggatttggggatatctgtgaagacagataatgtcgccacaagtagccccgaaaccacagagatctctgctgtagccgatgcgaatggcaaaaacctcgggaaagaggcaaaaccggaggcgcctgccgcaaaatcccggtttttcctgatgctcagtaggcctgtgccggggagaacgggtgaccaagcagccgactcctctctgggcagcgtgaaactggacgtgagcagcaataaagctccagcgaacaaagatccgagtgagtcctggaccctccccgttgccgctggacccggacaggatacagacaagacccctggacacgcccctgcccaggataaagtcctctcggcagcacgagatccgacactgctaccccctgaaactggtggggccggcggggaagccccgtcaaaacccaaggattcttccttctttgataaattcttcaaactggataagggccaggagaaagtgcccggtgattcccagcaggaggcaaaacgtgccgagcaccaggataaggtggatgaagtgcccgggttatctgggcaatccgatgacgttcccgcaggaaaggatatcgtggatggcaaagaaaaggagggccaagagctcggaactgcagattgcagcgttccaggcgaccccgagggactcgagacagccaaggacgactctcaggctgcagctattgcggagaataacaacagcatcatgtcattctttaaaacactggtgtctccaaataaggccgaaaccaaaaaagaccccgaggatacagctagtaaagccgagtctgtctgcgatggccaggccggacaaaaaacgagtgagatacaggcccgaggtacaaaaaagaagcatcttgatagtcctcgcctgggtcttgcctttcgcaagttctttcgacacaagggggcagagaaaagccccactacttcagccgacctgaagagtgacaaggccaatttcacatcacaggagactcaaggtgctggcaagaatagtaaggggtgcaatccgtcagggcacacacaaagcgtcaccacacctgaacccgcgaaagaggggaccaaagagaagagtggtcctacgtcgttgccactcgggaaactattctggaaaaaagtggtttgtgagagtccagtggaaatcatcaaatccaaagaggtagagagtgccctccagactgtcgacctcaatgaaggggatgcagcacccgaacctacagaggctaagctgaaacgcgaggaatccaaaccacggacctctttaatggcattcttgcggcaaatgacgagtgattcaaccgagaagacaatcacacctcctgaaccagagccaacaggtgctccgcaaaaagggaaggaaggctcatctaaggacaaaaaaagcgcggcagaaatgaataaacagaaatcaaacaagcaagaggccaaagaaccggcacagtgcacggaacaggccacagtagacacaaacagcctgcagaatggcgacaagctgcagaagcggccggagaagaggcagcagagcttagggggcttttttaagggtctcggaccgaagagaatgctcgatgcgcaggtgcagaccgatcccgtgtccatcgggcctgttgggaagtccaagtacaccggaaagtgcgtttttagtcacgtgaagaaaaagtggcccttccaggagtggtcatattag

SEQ ID NO: 180736 - DNA, 1755 bp, Artificial Sequence
  Description of Artificial Sequence: Synthetic coding sequence
atgggcaaccagatgagcgtgccccagcgggtggaggaccaggagaatgagcccgaggcagagacttaccaggacaatgcgtctgcattgaatggcgtgccagtagtggtgtcaacacacaccgtgcagcacttagaagaggttgatctggggatttcggttaaaaccgacaatgtggccacctcatcacctgaaactacagagatatccgcagttgcggacgctaacgggaagaacctggggaaggaagctaaacccgaagctccggcggcgaagagcaggttttttctgatgctgtccagaccggtgcccggcaggacgggcgaccaggccgctgacagttccctgggcagcgtcaagctggatgtttcgtcaaataaagccccagccaacaaggaccctagcgagtcttggacactccccgtggctgctggccctggacaggacacagacaagacccctggccatgccccagcccaggacaaggttctttcggcggcccgggaccctactctgttacctcctgaaacggggggggctggaggtgaggctccttcaaagcctaaggatagctccttcttcgacaagttttttaagcttgacaaggggcaggagaaagtgcccggagattcccagcaggaagctaaacgggcagaacaccaggataaggttgacgaggtgcctggacttagcgggcagtcagatgacgtaccagctggaaaagatattgtggatgggaaggaaaaagagggccaggagcttgggactgctgactgctctgtgcctggggacccagagggcctcgagactgccaaagatgactcacaggctgccgccatagcagaaaataataattctatcatgagtttctttaagaccttggtgagtccgaacaaagctgagaccaagaaggacccagaggataccggggccgaaaaatctcccacaacatccgcagacctcaaatccgacaaggccaactttacttctcaggaaacacagggcgcgggtaagaattccaaaggctgcaacccttctggccacacccaatcggtcactactcctgaacccgccaaggaagggaccaaggagaaaagtggacccaccagtctgccccttgggaagctcttctggaagaaatccgtaaaggaagattccgtgccgacaggcgccgaagaaaatgttgtgtgcgagtccccggtggagatcataaaatctaaggaagtcgaatccgctctgcagactgtggaccttaatgagggcgacgcagcaccggaaccaaccgaagccaagctaaagcgggaggagagcaagccgagaacgtcgctcatggcattcctgcgccagatgagcgtgaaaggcgatggagggatcacccactcggaggagattaacgggaaggacagttcctgtcagacttccgactcgactgagaaaacgattactccacctgaacccgagccaacaggggctccacaaaagggaaaggagggctcttccaaagacaagaaaagcgctgcagagatgaataaacagaagagcaataaacaggaagccaaggagcctgcccagtgcaccgaacaggccaccgtcgacacgaacagtctgcagaatggtgacaagctccagaaacgccctgagaagcgccagcaatcgttgggcggattttttaaggggctggggcccaaacgcatgctggacgcacaagtgcagactgacccggtttctatcggaccagttggtaagtctaaatag

SEQ ID NO: 180737 - DNA, 495 bp, Artificial Sequence
  Description of Artificial Sequence: Synthetic coding sequence
atgctgagccggcccgtgcccggccggaccggcgaccaggccgccgattcgtctttgggatctgtgaagcttgatgtgtcgagtaacaaggcccccgccaacaaggacccatccgagagctggacgctccccgtggcggccggacctggccaggataccgacaaaacacctggccatgctcccgcgcaggataaggtgctcagcgctgcacgagaccctaccttactgcctcctgagactggaggcgccgggggtgaagcccctagcaagccgaaggacagcagcttctttgataaatttttcaagttggataagggccaggagaaagtgccaggcgactcacagcaggaagccaagagagccgagcaccaggacaaggtggacgaggtgcctggactcagcggccagtccgatgatgtccctgccggaaaagtgtctgtgcccaggtgtatccacctcgtcctcaacgcctgtagcggtgctctcatgggttag

SEQ ID NO: 180738 - DNA, 753 bp, Artificial Sequence
  Description of Artificial Sequence: Synthetic coding sequence
atgagcttcttcaagaccctggtgagccccaacaaggccgagaccaaaaaggatcctgaggataccgcatctaaggctgagagcgtctgcgatggccaagcaggccagaagacatcagagattcaagccagagggaccaagaagaaacacctggactcaccccgcctcggcttggccttccgcaaattcttccggcacaagggggcggaaaagagtcctaccacaagcgctgatctgaaatctgacaaggccaactttacgagccaggagacacagggcgcaggaaagaattccaaggggtgtaatccttccggccacactcagtcagttaccacccctgaacccgccaaggagggcaccaaggaaaaaagcggcccaacgtcactgcccctgggcaagctcttttggaagaagacttctgatagtaccgagaaaacgatcaccccacccgaacctgagcctactggtgcgccacagaagggaaaagaagggagcagcaaagataagaaaagcgcagcagagatgaacaagcaaaagagcaacaagcaagaggctaaagaacctgcccagtgtacagaacaggcaacagttgacacaaactccctccagaatggggacaaactgcaaaagcggcctgaaaagcggcagcagtcactaggcggatttttcaagggtctgggtccgaagcgaatgctagatgcgcaagtgcagaccgaccctgtttcaattggcccagtcggaaaatctaaatag

SEQ ID NO: 180739 - DNA, 1155 bp, Artificial Sequence
  Description of Artificial Sequence: Synthetic coding sequence
atgagcgcccccatcaagctgcagcggaccaagacccaggtgcgggcaggccatttcagatggcagctggaccgcggcaggacccaaatcaaacctcagggaacacctcgacctaaaactcgctccagccttccccctggaatcccgagattctcacaccttcgtcaaggtgagcaggaagagaaactcccccctagccctcggacacctttttttgataagttttttaaactggataagggacaggagaaggtccctggtgattcacagcaagaagccaaaagggccgaacatcaggacaaagttgatgaggttccaggtttgtcgggacaatctgatgatgtgcccgcaggcaaggatatcgtagatgggaaggaaaaggaggggcaggaactagggactgccgattgctcagtgccaggtgatccagaagggctggagactgcgaaagatgacagccaagcagcggctattgccgagaacaacaactcaattatgtcattttttaagaccttagtgtctccaaataaggctgaaaccaagaaagacccggaggatacgggagctgaaaagtctcctacaacttcagctgacctcaagtcagacaaggctaacttcactagtcaagaaacgcagggcgccggaaaaaactctaagggctgtaatccctcaggccatactcagtccgtgactaccccggaaccagcgaaggaggggactaaagagaagagtgggcccactagcctccccttgggtaagctgttttggaaaaagtcagtgaaagaagactctgtgcctacaggcgccgaagaaaacacaagtgattctacagagaaaacgataacacccccggagccagagcccacgggtgctcctcagaagggcaaggagggatcttcgaaagataaaaagtccgccgcagagatgaacaagcagaagtctaataagcaagaggcgaaagaacccgcacagtgcacggagcaggctactgtggacaccaactccctccaaaatggcgacaagctccagaagaggccggaaaaaagacagcagtcattgggcggattcttcaagggcttagggcccaagcgaatgctagatgctcaggtccaaaccgatcccgtaagcataggcccagtcggaaagagtaagtag

SEQ ID NO: 180740 - DNA, 678 bp, Artificial Sequence
  Description of Artificial Sequence: Synthetic coding sequence
atggccggcaccggcctggtggccggcgaggtggtggtggacgccttaccgtatttcgaccaaggatatgaggctcccggtgtgcgagaagcagccgctgcactcgtcgaggaggagacacggcgctatagacccactaagaattacctaagctacctcacggcccctgattatagcgcatttgaaacagatatcatgcgcaacgagttcgaacggttggctgcgcgccaacctatcgaactgttatctatgaagcggtacgaactgccagccccctccagcggacagaagaacgacatcaccgcttggcaggagtgcgtaaataattccatggcccaactggagcatcaagccgtgcgaatcgaaaatctggaattgatgagccaacacggatgtaatgcgtggaaagtgtacaacgagaaccttgtgcacatgatcgagcatgcccagaaagaactacagaagctcagaaaacatatccaggacttgaactggcagcggaaaaacatgcagttaactgctggatctaagttacgggagatggagagcaactgggtaagcctcgtgagcaaaaattacgaaatcgaacgcacaatcgttcagttagaaaatgaaatctaccaaatcaaacaacaacacggagaagccaataaagagaacatccgccaagatttttag

SEQ ID NO: 180741 - DNA, 477 bp, Artificial Sequence
  Description of Artificial Sequence: Synthetic coding sequence
atgcagcggaccggcggcggcgccccccggcccggccggaaccacggactcccgggatccctgagacaacctgaccccgtggctctacttatgttgttggtcgatgcagatcaacctgagcccatgagatccggggctagggagctggccttattcctgacacctgagccaggagcagaagcgaaagaggtcgaggagactatcgaaggtatgctgttacggctcgaggagttttgctcgctcgcagacttaatccggagcgacactagccagatactcgaggagaacatacccgtactgaaagccaaattgactgagatgcgcggcatttacgccaaagtggataggttggagaaatctccagctccagtacctgttacttacgagctgcccactctctataggactgaggactattttcccgtggacgccggcgaagcacaacatcatccgcgcacatgccccagacctctgtag

SEQ ID NO: 180742 - DNA, 570 bp, Artificial Sequence
  Description of Artificial Sequence: Synthetic coding sequence
atgcagcggaccggcggcggcgccccccggcccggccggaaccacgggttgcccggcagtctgcgacaaccagacccagttgccctgcttatgctgttggtcgacgccgaccaacccgagcccatgagatcaggggccagagagcttgccctgttcctaactccagaaccaggtgccgaagccaaggaagtagaggagactatcgagggaatgctgcttcgtcttgaggagttttgctcactggctgacctgatccgctcggacacttcccaaattctggaggaaaacatacctgtcctgaaagcaaaactgactgaaatgagggggatttacgcgaaagttgataggttggaagccttcgtcaagatggtggggcaccacgttgcctttttagaagccgacgtgctacaggccgaaagggatcacggagcttttccacaggctctgcggcgctggctcggatctgcaggactgccctcgttcaggaacctcgagtgtagcggtgccatcttagcacactgcaacctgaggctctccggctcttcagactctcctgctagcgctagctag

SEQ ID NO: 180743 - DNA, 636 bp, Artificial Sequence
  Description of Artificial Sequence: Synthetic coding sequence
atgcagcggaccggcggcggcgccccccggcccggccggaaccacggcttgcccgggtccctgcggcagcccgatccggttgcgctgttgatgttgttagtcgatgccgatcagcccgagcctatgaggagcggcgctcgcgagcttgccctattcctcacccctgaacccggcgctgaagccaaagaggtcgaagagacaattgaggggatgttactgcggctggaggagttctgctccctggccgatcttatacgatctgataccagtcagatcctggaagagaatattccagtattgaaggccaaattgacggaaatgaggggtatatatgctaaagttgatcgcctggaggcgttcgtcaagatggtggggcaccacgtggcgttcctcgaagctgacgtgctacaagccgagagggaccatggagccttcccacaggccttacggcggtggctgggtagcgcaggacttccaagctttcggaatgtggagtgttcagggactatcccggcaagatgcaacctcaggctgccggggtcctcggactctccggctagtgcatcgcaggtcgctggaattaccgaagtaacctgtaccggtgcaagagatgtgcgcgcagctcataccgtatag

SEQ ID NO: 180744 - DNA, 612 bp, Artificial Sequence
  Description of Artificial Sequence: Synthetic coding sequence
atgcagcggaccggcggcggcgccccccggcccggccggaaccacggcctgccagggtcgctgcgacagccagaccccgtcgctctcctcatgttacttgtggacgccgatcaaccggaaccaatgcgctcaggtgcacgcgaacttgcactgtttctgaccccggagcccggcgccgaagccaaggaggtcgaggagaccattgaaggtatgctcctgagattggaagaattctgtagcctggccgacttaattagaagcgacacaagtcagattctcgaagaaaatatccctgtgctgaaagcaaagctgacggagatgcggggcatctatgcgaaggtggaccgtctggaagcgttcgtcaaaatggtagggcaccatgtcgccttcctagaagccgacgtcctccaggcagagcgcgaccacggagcattccctcaggccctgcggagatggttgggcagcgcgggattaccatcttttcggaataagtctcctgcgccagttcctgtgacatacgaactccccactctgtaccggacagaagattattttcccgtggacgcaggcgaggcccagcaccacccaaggacctgccccaggccactctag

SEQ ID NO: 180745 - DNA, 627 bp, Artificial Sequence
  Description of Artificial Sequence: Synthetic coding sequence
atgaccggccgggtgtgccggggctgcggcggcaccgacatcgagttggatgcagctaggggcgacgcggtgtgcacggcctgtggatccgtgctcgaagacaacattattgtctcagaagtgcaatttgtcgaatcaagcggcggtggaagctcagctgtgggacaattcgtctctctcgatggcgccggtaagactcccaccctgggaggtggcttccatgttaatctgggaaaggagagcagggcgcaaaccttacaaaatggccggagacacatacatcatttgggtaatcaactccaactgaaccagcactgccttgacacagctttcaatttctttaagatggccgtgtcccgtcaccttactcgaggcagaaaaatggcacacgtcattgccgcctgcctgtatctagtttgtcgcaccgaggggaccccacatatgctgcttgatttgtctgacctcctgcaggttgactccctgcgccctgcttcttttccgacctggggctgcgacctaggcgtggtgaccagggtcgttaccggagtatatcccagatgcctgcatgcctctcaatggccggtttgtgcggcttgccctgtcaggaaattctggtctgtgggatag

SEQ ID NO: 180746 - DNA, 1689 bp, Artificial Sequence
  Description of Artificial Sequence: Synthetic coding sequence
atggccgtgagccggcacctgacccggggccggaagatggcccacgttatagccgcgtgtctgtacctggtttgtaggaccgaaggcactccacacatgctgctggatttgtctgacctgctgcaagtgaatgtgtacgtgctcggaaagacctttctgcttctggcgagggagttgtgcattaatgccccagctattgacccatgtctgtatattcctcgtttcgcacacttgcttgaattcggagaaaaaaaccacgaggtttctatgacagccctcaggctattacagagaatgaagcgcgattggatgcacactgggaggcggccttccggcctctgtggcgcagcgttgctggtcgccgcccggatgcacgacttccgcagaaccgtcaaggaggtgatcagtgttgtcaaggtttgtgagtcgacactgcgcaagcggttgaccgagttcgaagatacccctactagtcaattgacaatcgacgagttcatgaagatcgatcttgaagaggaatgcgatcctccctcctataccgccggtcagcgtaagttaagaatgaaacagttagagcaggtgctttccaaaaaactagaggaagtggagggggagatctcctcctatcaggatgctatcgaaatcgagctcgaaaatagccgccctaaggctaaaggcggcctcgcctccctagcaaaagatggaagcactgaagacacagctagttccttatgcggcgaggaggacacagaggacgaagaattagaggccgccgcttctcatctaaataaggacctgtatcgcgagctgcttggaggcgcccctggaagcagcgaggcagctggtagccctgaatggggcgggcgccctccagctttgggcagcttgttagacccactgccaacggctgcgtcattgggcattagtgactccatccgcgaatgcatctcctcacaaagtagtgatcccaaagatgcttcaggtgacggcgagctggatctctccggtattgatgatctggagatcgaccgctatattctgaacgaatccgaggctagggtgaaagccgagctctggatgcgagaaaacgctgaatatctgagagagcagcgcgagaaagaagcgcgtatagctaaagagaaagagctggggatctataaagaacacaagccaaaaaaatcctgtaaaagacgggagcccatccaagccagcactgcacgcgaggcaatcgagaagatgttggaacagaagaagattagctcaaagataaattattccgtcctccggggactttcatcggctgggggtggctcccctcatcgcgaagacgcacagccggagcactctgcttccgccaggaagcttagtagaagaaggaccccagcttcgagatctggggctgatccggtcacttctgtgggtaaacgattgagaccactagtgtcgacccagcccgccaagaaagtggcgaccggcgaggccttacttccgagctcgcccactctcggagccgaaccagctcggccacaggccgttctcgttgagtccgggcctgtctcttatcacgctgatgaagaagccgacgaggaagaacccgacgaggaagatggggaaccatgcgtgtcagccctgcagatgatgggctctaacgattacggctgtgacggcgacgaggacgatggctactag

SEQ ID NO: 180747 - DNA, 408 bp, Artificial Sequence
  Description of Artificial Sequence: Synthetic coding sequence
atgaccgccctgcggctgctgcagcggatgaagcgggactggatgcataccggacgtcgaccatccggattgtgcggagccgctctgttagttgccgctaggatgcacgatttccggagaacagtcaaggaagtcatctcggtggtaaaggtttgtgaatccacactgcgaaagcggctgaccgagtttgaggacacgcctacaagtcagctcaccatcgacgaatttatgaagatcgatctggaagaggaatgtgaccccccacctatcgaggaaggagggcagacagaggcaagggaacctccacaggctagtagctgggaggggcctagcacgactcgccgacggtcccaactgtggcacggatgccccggctgcgggagggggggatttacactgtgcccatag

SEQ ID NO: 180748 - DNA, 723 bp, Artificial Sequence
  Description of Artificial Sequence: Synthetic coding sequence
atgaccggccgggtgtgccggggctgcggcggcaccgacatcgagttagatgccgccagaggtgatgctgtctgcaccgcctgcgggtccgtgttagaggataacatcattgtgtcagaggtacagttcgtggaatctagtggcggtggatcatcagctgtggggcagttcgtgtcgcttgatggagccggtaagacaccaacccttggtggggggttccatgtgaatttgggcaaggaatcacgcgcccagactctccagaatggaaggcgtcatatccatcacttgggcaatcagctgcagctcaatcaacattgtcttgacactgctttcaacttcttcaagatggccgtgtccagacacctgactcggggaaggaaaatggctcatgtcatcgcagcctgtttatacctggtgtgccggaccgaaggtacgccacacatgttactagacctaagcgacctgctccaggtggatagcctcagaccggcatcctttcccacatggggctgtgatctgggagtcgtgactcgagtagtgaccggcgtgtacccaagatgtcctcggatttcggtggccggcctttgctgcctgcccagtcaggaggtgctagtctgcagaatgcgaggcctgcacgatatgggagtcaccgttagggatctgtgggaatgtggcagtccctggcaagaacacttacctatgctgggcactgttggttgttag

SEQ ID NO: 180749 - DNA, 555 bp, Artificial Sequence
  Description of Artificial Sequence: Synthetic coding sequence
atgaccgccctgcggctgctgcagcggatgaagcgggactggatgcatacagggaggagacccagcggcctctgtggcgctgccttgctggtggctgccagaatgcacgattttaggaggaccgttaaggaagtgatctccgtggttaaagtctgtgaatctactctgcggaaacgcctgacggaattcgaagacacccctacatctcagctgacaatcgacgagttcatgaaaattgatctggaagaagaatgcgaccctccaagctacacagcagggcagcgtaagctgcgaatgaagcaactcgaacaagtgctgtcgaagaagctggaagaagtagagggtgagataagctcttatcaggatgccatcgagattgagctcgagaattccccccctagtagacgggagggaagaagacggcccgaaagcctgccccggccattgcgtggcaaggcccccgtccccttggtgggcggccttagctcaggcatggctgctccagatgtcgcggaaggagcctcaccctgcgtcctgcgaaggggttggccgtag

SEQ ID NO: 180750 - DNA, 1953 bp, Artificial Sequence
  Description of Artificial Sequence: Synthetic coding sequence
atgaccggccgggtgtgccggggctgcggcggcaccgacatcgagctggatgccgccagaggcgacgccgtgtgcactgcctgcggatcggtgcttgaagataacatcatcgtaagtgaggtgcaatttgtggagagttctggaggaggatcttctgcagtgggccagtttgtgtccttagacggcaggcgccacattcatcaccttgggaaccagctacagctaaatcaacactgtttggataccgcatttaatttttttaaaatggcagtatccagacatctgacccgcggaagaaagatggcacacgtgatcgcagcctgtctgtacctggtgtgcagaacagagggaacaccacatatgctcctcgatctctctgatttgctccaagtgaacgtttacgttctgggcaagacgttcctgctcctggcaagagaactctgcattaacgctccggcaatcgatccctgcctatatatccccagatttgcccatctgttagagtttggggaaaaaaaccacgaggtaagcatgacagctctccgcctgctccaacggatgaagagggactggatgcatactgggcgtcggccatcagggctgtgtggcgctgcattactcgtggccgcacgaatgcacgactttcgacggaccgtgaaagaagtgatatctgtggtgaaagtttgtgaatccacactgcggaaaagattgacggagttcgaagatacacccacttctcaactgaccatcgatgagttcatgaagatcgatctggaagaggagtgcgacccgccatcttacacggcagggcagcggaagctcaggatgaagcagctggaacaagttctgtctaagaaactcgaggaggtagagggcgaaatatcaagctatcaggacgctatcgagatcgaactggaaaactcacggccaaaggctaaaggcggtctggcctccctcgctaaagatggatcaacagaggacactgccagctcattgtgcggagaggaggatactgaggatgaggagttggaggcagccgcaagccaccttaataaagatctctaccgggaattgctaggcggggctcctggctcttcagaggcggccggctcgccggagtggggaggccgaccacctgcactgggcagcttactagaccctctcccaaccgccgctagcctggggatctccgactctatacgagaatgcatcagttctcagtcttcggaccctaaggacgccagtggggacggcgagctggatctgtctggaatcgatgacctggagatcgatcgctacatcctcaacgaatctgaggctagggtgaaggcagagctttggatgcgggaaaacgccgagtatcttcgtgagcaacgggaaaaggaagccaggatcgcgaaggagaaagaactgggaatctacaaggagcataagccaaagaaatcatgcaagaggagagagccaatccaggcctccaccgcgagggaagccattgagaaaatgttggaacagaagaagatatccagcaagatcaattactccgtgcttagaggtctctcctctgctgggggagggtcaccacaccgggaagatgcccagccagaacacagcgcttcagctagaaaactgtccagaagaaggacacccgctagccgcagcggcgccgacccagttacctcagtggggaaacgtctgagaccgttggtgagcacccagcccgccaaaaaggtcgctactggtgaggccctcctgccaagctcgcctaccttaggcgcggagccggcacgacctcaggccgtgctcgtcgagtctgggcccgtcagctaccacgccgatgaagaggctgacgaggaagagccagacgaggaagatggcgagccctgtgtgtccgccctgcaaatgatgggatccaatgactacggttgcgacggggatgaagatgacggatactag

SEQ ID NO: 180751 - DNA, 1422 bp, Artificial Sequence
  Description of Artificial Sequence: Synthetic coding sequence
atgaccgccctgcggctgctgcagcggatgaagcgggactggatgcatacaggcagaaggccgtcaggcttgtgcggagccgccctgctggtcgcagcccggatgcacgactttcggcgcaccgtcaaagaggtgatttcagtcgtaaaggtgtgcgagagcactctgcgcaagaggctcacggagttcgaggacacacctacttcacagctaacgatcgacgagttcatgaagatcgaccttgaggaggagtgcgatcctccatcatacacagccggacaacggaaactgagaatgaaacagttggaacaggtgttgagtaagaaattggaagaggtcgagggcgagatcagctcctaccaagatgcaatcgaaattgaattggaaaacagcaggcctaaggccaagggaggcctcgcctcactggcaaaggatgggtcaacagaggatacagcttcttctctctgtggtgaggaagataccgaggacgaggagttagaagccgccgcatctcaccttaataaagatttgtacagagaactcctcggtggggcacctgggtcttccgaagccgctgggagtccagaatggggcggtagaccgcctgcgttgggaagcctgctagacccccttcctactgcagcatcactcgggattagtgattcgattcgagaatgtatcagctctcagtcttcagatccaaaggacgcaagcggagacggagagctggacctgtctggcattgatgatctcgagattgatcgctacatattgaatgaaagtgaggctcgcgtgaaagccgagctgtggatgcgcgagaacgcagaatatctccgggagcagagagaaaaagaggcaaggatcgcaaaggaaaaggaactggggatttataaggagcacaaacccaagaagtcctgcaaacggcgggagcctatacaagcttcgactgcgcgcgaagcaattgaaaagatgctggagcagaagaagatcagttctaagatcaattattcagtgttgcgggggctgagctctgcagggggagggtctccccatcgtgaggatgcccagcccgagcattccgctagtgctagaaaactatcccggagacgcacaccagcatccaggtccggggccgatcctgtaaccagcgtgggtaagcggttacgaccactggtgtccacccagcccgctaagaaagtggccaccggcgaagcactgctcccgtccagtccaactctcggcgctgagcccgcccggccccaggccgttttagtagagtccgggccagtgtcataccacgccgatgaagaggccgacgaggaagaacccgacgaagaagatggggagccatgtgtaagtgcactgcagatgatggggtcgaatgattatgggtgtgatggtgacgaggatgatggctattag

SEQ ID NO: 180752 - DNA, 1755 bp, Artificial Sequence
  Description of Artificial Sequence: Synthetic coding sequence
atggccgtgagccggcacctgacccggggccggaagatggcccacgtcatcgcagcctgtctttacctcgtgtgtcgaaccgaaggaacccctcatatgctactcgacttatccgacctcctgcaagtgaacgtctacgttctgggtaaaacgtttttgctgttggccagagaactttgcataaatgcccctgccattgacccatgtctttatattccacgttttgctcatctgttagagtttggtgaaaaaaatcatgaggtatcgatgaccgccctcaggttgctgcagagaatgaaaagagactggatgcacaccgggaggcgcccttctgggctgtgcggggccgctctgctggtggcagcgaggatgcatgacttcaggagaacagtgaaggaggtcatctctgttgtgaaggtatgcgagtctacgctgcgcaaacgattgaccgagttcgaagatactcccaccagccaactgacgatcgacgaatttatgaaaattgatctcgaggaggagtgtgatcccccttcctacaccgccggtcagcgcaaactccggatgaagcagctggagcaggtgctttcgaagaagttggaggaggtcgaaggtgagatctctagctaccaagatgcaatcgagatcgaattagagaactctagacctaaggcgaaaggcggacttgctagtctggcaaaagatgggagcactgaagataccgcctcctcactctgcggcgaagaggatacggaagacgaggagctggaagcggcagcctcccatctcaacaaagacctctatagggagctcctgggcggtgctcctgggtcctccgaggcagcgggttccccagagtggggagggaggcctccagcccttggatcattgcttgacccattgcccaccgctgcctccctcggaatctccgattcaatccgagagtgcatcagcagccagagttctgaccctaaagacgcgtcaggggatggcgaactggatctgagtgggattgatgacctcgagatcgatcgccgtgacttatccatgccccgatgtgcaaaggcaaagtcccagcctcattttccggtcttggcccagtatatcttgaacgagagcgaagcccgggtgaaggccgaattgtggatgcgcgagaacgccgagtacctgagggagcagcgcgaaaaggaagccaggatagcgaaagaaaaagagctaggaatctataaggaacataaacccaaaaaaagctgtaaaaggcgcgaacccattcaggcctcaacagcgagagaagcaatcgagaagatgttagaacagaaaaagatctcctccaagattaactacagtgtcctaagagggctgtccagcgctggaggcggaagtccgcaccgcgaggacgcacagcctgaacattctgctagcgctcggaagctgagcaggagacgtacacctgcaagtaggagcggtgccgatcccgtgacctcagtgggaaagcgactacgccccctggttagtacccaaccagctaagaaagtggcaaccggagaggctttgctgccaagcagtccaaccttgggggctgaacccgcacgccctcaggccgtgctggtggaatccgggcccgtgagctaccacgccgacgaagaagccgatgaggaggaaccggatgaagaagatggtgaaccttgcgtatcagccttgcagatgatgggctcgaatgattacggctgcgacggggatgaggatgacggctattag

SEQ ID NO: 180753 - DNA, 1320 bp, Artificial Sequence
  Description of Artificial Sequence: Synthetic coding sequence
atgcacgacttccggcggaccgtgaaggaggtgatcagcgtggtgaaagtctgtgagtcgaccctccgcaaacggctgaccgaatttgaggacactccaacaagccagctaacgatcgacgagttcatgaagattgaccttgaagaggaatgtgatcccccttcatacactgccggccagaggaaactgcgcatgaagcagcttgaacaggtgctgtcaaagaagctggaggaggtggaaggggaaatttctagctaccaagacgccatcgagatcgagctagaaaattcccgacccaaggcaaagggcggacttgcatccttggctaaagatggatccacagaagatacagctagcagcttatgtggagaggaggatacagaggatgaggaacttgaggccgcggcctcacatttgaacaaagatttatatagagagttgcttggcggcgcaccgggaagctctgaggccgcaggctcccctgagtggggcggcaggccaccagccctgggttctctcctggatccactccctacggcagcatctcttggtatcagcgattctatccgggaatgtatctcttcccagtcatccgatccaaaggatgccagcggagatggcgaactggacctgtctggcattgacgatctcgaaatcgatcggtacatcctgaatgaatcagaggccagagtcaaggccgaactttggatgcgggaaaacgctgagtatttgcgcgagcaacgcgagaaggaggcgagaattgctaaggagaaggagctgggaatatataaagaacataaacctaagaagagttgtaaaaggagggagcccatccaggcatctaccgcacgggaggccattgagaagatgctcgagcaaaagaagatctcctctaagatcaactacagtgtgctgagaggactcagctcggccggaggggggagtccacatagggaagatgctcagcccgagcatagcgcatccgcgcggaagttgtcccggagacgaaccccagcttcgcgatctggtgccgaccctgtgacctcagtgggcaagcgcctccgaccgttagtgtctactcaacctgccaagaaagtggcaaccggagaagcactgttgccatcttcgccgacccttggagccgaaccagcaagaccccaagccgtcctggttgagagtgggccagtatcctaccacgcagatgaagaggctgatgaggaggagcctgacgaagaagatggagaaccgtgtgtgtccgcactgcagatgatgggatctaatgattacggctgcgacggggatgaagacgatggttactag

SEQ ID NO: 180754 - DNA, 2034 bp, Artificial Sequence
  Description of Artificial Sequence: Synthetic coding sequence
atgaccggccgggtgtgccggggctgcggcggcaccgacatcgagctggacgctgctagaggggatgccgtgtgcaccgcatgtggtagcgtgttggaggacaatatcatcgtgtcagaagttcaattcgtcgagagctctggagggggaagttctgccgtcggacagtttgtttcccttgatggcgctggaaaaacccccacactgggcggcggctttcatgttaatctgggcaaagaatcacgggctcagacgctgcaaaacgggaggcgtcatatacaccacctgggcaaccagctccaactcaaccagcactgcctggacaccgcctttaacttcttcaagatggcagttagcaggcatctcacacggggccggaagatggctcacgtaatcgctgcatgtctgtacctggtttgccgtacagaaggcacccctcatatgctcctcgacctgtcagacttgttacaggtgaatgtgtatgtgttgggaaaaaccttcctcctgttggccagagaactctgcataaatgctccagccatcgacccctgcttatacatcccccggttcgcccacctgctagagtttggggagaagaatcacgaggtttcgatgactgccttaaggttactgcagcggatgaagagggattggatgcatacaggcagacgcccatccggcctgtgtggcgccgctctgctggtggcggcaagaatgcatgatttcaggcgcaccgtgaaggaagtcatctctgtggttaaagtgtgcgaaagtacactacgcaaacgcctaacggagttcgaggacaccccaaccagccagttgaccatcgatgagtttatgaagattgaccttgaggaggaatgcgaccctccttcatacactgccgggcaacgcaagcttcgcatgaaacaactcgaacaggtgctctcaaagaagctggaggaggttgaaggtgaaatttcaagttaccaggacgccatcgaaattgaactcgaaaattcaaggccaaaggctaaagggggactggcgtccctcgccaaggatgggtcaaccgaagacactgcctcttccctttgcggcgaagaggataccgaggatgaagagcttgaagctgcagcatcccatctcaacaaagatctgtatagggaactgctgggcggcgcccccggaagctctgaggccgcaggcagtccggaatggggcggccgcccacccgcactcggatcactcttagacccactgccaacggccgcttctctggggatatcagattcaattagggagtgcatctcatcccagagctcagaccctaaggacgcttctggcgatggggagcttgatcttagtggcatcgacgatctcgagatcgaccggtacatcttaaatgaatctgaagcccgggtaaaggcggaactttggatgagggaaaatgcagagtatttaagggagcagagggagaaagaagctcgcattgctaaggagaaagaactgggcatctataaagagcataagcctaaaaagagctgcaaacgcagggagcccatccaagcatcaactgcacgcgaggccatagaaaagatgctggaacagaagaagattagctccaagatcaactactccgtgttgagaggtctgtcatccgctggcggaggatcaccccatagagaggacgcgcagccggaacacagcgcttccgctaggaagttgtcaaggaggagaacccccgccagtaggtctggcgccgaccccgttaccagtgtgggtaaacgacttaggcctctggtgagcactcagccagcgaagaaagtggcgactggtgaggctctattgccatctagcccgaccctgggcgctgagccagccaggccacaagccgtccttgttgaatcagggccagtctcatatcatgccgatgaagaagcagatgaggaagagcctgacgaggaggacggggaaccctgtgttagtgctcttcagatgatgggaagcaatgactatggctgtgatggggatgaagacgatggttattag

SEQ ID NO: 180755 - DNA, 612 bp, Artificial Sequence
  Description of Artificial Sequence: Synthetic coding sequence
atgcgggagaacgccgagtacctgcgggagcagcgggagaaggaggctagaatcgctaaggaaaaggagctggggatttataaggagcacaagccgaagaagagctgcaagcggcgcgagcctattcaggccagcaccgccagggaggcgatcgagaagatgctcgagcagaagaaaatatcatccaaaatcaattattccgtgctgagaggcctgagctcggcaggcggcggtagtccccatcgtgaggatgcacagcccgagcacagcgcctctgcaaggaagctgagccggcggagaaccccggcttctcggtccggagccgatccagtgactagcgtgggaaagaggctgcgaccactcgtctctactcagcctgcgaagaaggtcgctaccggtgaagcgcttctgcccagtagcccgacgctaggcgcggaacccgcgcggccccaagctgttctcgtcgaaagcggaccggtgagctaccacgccgacgaggaggccgatgaagaggagccggacgaagaggacggcgaaccatgcgtaagcgctctgcagatgatgggatccaacgattatggctgtgacggcgatgaggacgatggctactag

SEQ ID NO: 180756 - DNA, 714 bp, Artificial Sequence
  Description of Artificial Sequence: Synthetic coding sequence
atgaccgccctgcggctgctgcagcggatgaagcgggactggatgcatacaggccgcaggccttccggtctctgcggtgccgcactgcttgtcgcagcccggatgcacgacttcagacggaccgtcaaagaagtgataagtgtcgtgaaggtctgtgagagcacccttcggaagaggctgacggagttcgaagacaccccaacttcacagctgacgatcgacgaatttatgaagattgacctcgaggaagaatgcgacccaccctcctacacagctggtcaacggaaattgaggatgaagcagcttgaacaggtgctgagcaaaaagctggaagaagtcgagggtgagatcagttcctatcaggatgccattgagatagagctagagaattcgcgccctaaggcaaaaggtggtctagcctcattggccaaggatgggagcacggaggacactgctagctcactttgcggagaagaggacactgaggacgaagagctggaagcagccgcatcccacctcaataaagacctctatcgtgaactgctgggtggtgctcctgggtcgtcagaagctgccggctcaccagagtggggcggccgcccaccagctttgggaagtctgcttgatccactgccaacggcggcatcgcttggaataagtgatagtatccgtgagtgcatcagtagccaaagcagcgacccgtctgaattctag

SEQ ID NO: 180757 - DNA, 138 bp, Artificial Sequence
  Description of Artificial Sequence: Synthetic coding sequence
atgaccgccctgcggctgctgcagcggatgaagcgggactggatgcacacgggccggcgcccatcgggtctttgtggggccgcacttctcgttgcggctcgcatgcacgatttcagaaggacagttaaggaggtgtag

SEQ ID NO: 180758 - DNA, 45 bp, Artificial Sequence
  Description of Artificial Sequence: Synthetic coding sequence
atgaccgccctgcggctgctgcagcggatgaagcgggactggtag

SEQ ID NO: 180759 - DNA, 468 bp, Artificial Sequence
  Description of Artificial Sequence: Synthetic coding sequence
atgaccgccctgcggctgctgcagcggatgaagcgggactggatgcacacggggaggagacctagtggactgtgtggcgctgccctccttgtggccgctagaatgcatgactttcggcggacagtcaaggaagtgattagcgtcgtaaaagtctgcgagtctaccctccgtaagcggctgaccgagttcgaggacacccccacctcgcagctgacgatcgacgagttcatgaagattgatctggaagaggagtgtgaccccccttcttatacagcagggcagcgaaaactgaggatgaaacaacttgaacaagtcctctctaaaaaattagaggaggtggaaggtgagatttcgtcttatcaggatgcgattgaaatcgaactcgagaattctagacccaaggcaaagggaggacttgccagtctggctaaggacggctcaacagaggacacagcttcgagtctttag

SEQ ID NO: 180760 - DNA, 8307 bp, Artificial Sequence
  Description of Artificial Sequence: Synthetic coding sequence
atggccctggtgctggagatcttcaccctgctggccagcatctgctgggtgtccgccaatatcttcgaatatcaggtggacgctcagccgttgcgcccgtgtgaattacagcgggaaacagcattcttgaagcaggcagattacgtcccccagtgtgcagaggacggatcctttcagacagtgcagtgccaaaacgatggccgatcctgctggtgcgtcggggctaacggttccgaggttttgggttcccggcagccagggcgccctgtggcctgtctcagtttctgccagctccaaaaacagcaaattctattatccggctatattaacagcacagataccagttatctccctcaatgtcaggatagcggtgattacgctcccgtgcagtgtgacgtacagcaggtgcagtgctggtgtgttgacgcggagggaatggaagtatacggcaccaggcagctggggaggccaaagcgttgtccgagatcttgtgaaattcgaaatcgcaggctcctccacggagtgggcgataaaagcccaccacagtgctcagcagaaggcgaattcatgccggttcaatgcaaatttgtcaataccactgacatgatgatcttcgacttggtgcatagttataaccgatttcccgacgccttcgttacgttttcaagctttcagagaagattccctgaggtaagtggttattgtcattgtgctgacagtcaggggcgagaactggccgagactggattagagttactgctggacgagatttatgatacgatcttcgccgggctggacctaccatctactttcactgaaacaaccctctaccggatcctccagcggagattcttagccgttcagagtgttatctccggacgctttagatgccccactaagtgtgaggtcgagaggtttaccgctactagttttggtcacccatatgtacctagttgcaggaggaacggagattaccaggcagtccagtgccagaccgagggtccatgttggtgtgtggatgcccagggtaaggagatgcatggcacacgacagcagggcgaacctccgagctgcgctgaggggcagtcctgcgcgagcgagaggcagcaagccctgagccggctctatttcggcacaagcggctatttctcacagcatgatttatttagctccccagagaaaagatgggcatctccccgtgtagcccggttcgccacctcctgcccaccaactattaaggaattattcgtggatagcgggctcctgcggcccatggtagaaggccagagtcagcaattcagcgtatccgagaacctcctcaaggaggccatccgggcaattttcccttcccgcggccttgcgaggcttgccctgcagttcacgacaaaccctaagagactacagcagaacctgttcggggggaaatttttggtgaacgtgggccagttcaacctgagcggcgcactgggcacaaggggtacctttaacttctctcaattcttccagcaactgggacttgcatctttcttgaacggaggcagacaggaagacctggctaaacctttgagtgtcgggttagactctaactcatccaccggcacaccagaggcggcaaagaaggacgggaccatgaataagccaaccgtgggcagcttcgggtttgaaatcaacttgcaagagaaccaaaacgctctgaagttcttagcctcccttcttgaactgcccgagttccttctgtttctgcaacatgccataagcgtgcctgaggatgtggctagagatctcggcgacgtaatggaaaccgtcctctcatctcagacttgtgaacagaccccagagagactgtttgtcccatcctgcactacggagggaagctatgaggacgtgcagtgtttcagcggagaatgttggtgtgtcaactcgtggggcaaagaactccctgggtcccgggtcaggggaggacagccaagatgcccaactgactgcgagaagcaaagagcaagaatgcaatcactgatgggcagtcagcccgctggttccaccctttttgtgcctgcttgcactagtgaaggacacttcttacccgttcaatgtttcaattctgagtgttactgcgtggatgcggagggccaagctattcctggcactcggagtgctatcggcaagccgaagaaatgcccgaccccctgccagctgcagagcgaacaagcttttctccgtacagtgcaggccctgctcagcaattcctctatgctgcctacgctgtccgacacctatatcccacagtgtagcacagatgggcagtggagacaggtccagtgcaacggacccccagaacaggtgttcgagctctatcagaggtgggaggcccaaaataaaggacaggatcttacgcccgccaagctcctggttaaaattatgagctaccgggaagccgcatccggaaacttctccttatttatacagagtttatacgaagctggccagcaggatgtctttccagtgctgtcgcagtatccttcactgcaggatgtgccactcgccgcattggaaggaaaacgcccccagccacgagaaaacattctgctggagccctatctgttttggcagatccttaatggacagctctctcagtatcctggctcttactctgacttttcgacccccctggcccactttgaccttcgaaattgctggtgcgtagatgaggccgggcaggaactggaaggaatgcggtccgagccttcgaagttgcctacctgccccggttcctgcgaagaggctaaactacgcgtgctacagttcatccgtgaaactgaggagattgtgtctgcgagtaactcaagccgcttccccttaggggagagctttctggtggccaagggaattaggttgagaaacgaagatttaggactgccacccctgtttcccccacgtgaggcattcgcggaacagttcttaagaggaagcgactacgccatacgactggccgcacagtctactctcagcttttatcagcgcagaaggttctctccagacgactcggctggcgcttctgctctgctgcgcagtgggccatatatgccgcagtgtgacgctttcggctcttgggagcctgtgcagtgtcacgccggaaccggccactgctggtgtgtggatgagaagggcggtttcatcccaggaagcctcaccgcacgctcccttcagattccgcagtgtccaacaacatgtgaaaaatcccgtacaagtggcctgctgagcagctggaaacaggccaggtcccaggagaaccccagccccaaggatctctttgtacccgcctgcctcgagaccggtgagtacgccagacttcaagcatctggtgctggaacatggtgcgtggacccggctagcggtgaggagttgcgccctggctccagcagctcagctcagtgcccatcactgtgcaacgttttgaagagtggcgtgttaagccgtcgcgtttcacctggatacgtgcccgcgtgcagagccgaagacggagggttctcacccgtccagtgcgaccaggctcagggcagttgctggtgcgtcatggactccggcgaagaagttccggggactagagtcacggggggtcagcccgcttgtgaaagtcccaggtgtcccctgccgttcaacgcctccgaagtggttggcgggactatcttatgtgaaacgattagcggcccgaccggtagcgccatgcagcagtgccaactgctgtgccggcaaggcagctggtctgtgtttccacctggaccattgatatgctcattagagagtggacgatgggagtctcagctgccacagccaagagcctgtcaacgcccccagctttggcagactatacaaacccagggccatttccagttacagcttccccccggcaagatgtgtagcgccgactatgccgatttgctgcagacgttccaggtgttcatattggatgaactaaccgcccggggtttctgccagatccaagttaagactttcgggacattggtctccatacctgtttgcaataatagctctgttcaggtgggttgtctaacacgcgaacggctgggggtgaacgtcacatggaagtcacggttggaggatatccccgtggcaagcttgcccgatctgcatgatatagaacgggctctggtgggcaaggatctgctgggcaggttcaccgacctcatccagtccggtagttttcagctgcatttggatagtaaaacattcccagccgagaccatccgctttctacagggagaccactttggaacatctcccaggacttggttcgggtgtagcgaaggattctaccaagtactgacctccgaggcttctcaggatggcctgggctgtgtcaagtgtccagaagggtcctactcccaagacgaagagtgtataccttgccccgtcgggttctaccaagaacaggcgggttctctggcctgcgtcccttgtcctgtgggaagaacaaccataagtgctggagccttcagccagactcactgcgtaactgactgccagcggaacgaggcaggactgcagtgcgaccaaaacggacagtatagggctagtcaaaaggacagaggaagcgggaaagccttttgcgtcgacggcgaaggccgaagattaccttggtgggagaccgaggcgcctcttgaagacagtcagtgcctgatgatgcagaaatttgagaaggtcccagaatcaaaagtgatcttcgatgccaatgcgcccgtcgccgtcagatccaaagttccagactccgaattccccgtgatgcagtgcttgacagattgtaccgaggacgaggcgtgttcattcttcacggtgagcacaactgaacccgaaatcagctgtgatttttatgcgtggaccagtgacaacgtggcctgtatgactagcgaccagaaacgggacgcccttggaaatagcaaggctacaagctttggatccctccgatgccaggtgaaagttcggtcgcatggccaggatagccccgccgtctacctcaagaagggccaaggctccactaccactttgcaaaagcgatttgaacccaccggctttcagaacatgctttcgggtctttacaatcctattgtctttagtgcgtccggtgctaacctgactgatgcccacctgttttgcctcttggcgtgtgacagggatctgtgttgtgacggattcgtgctcacacaagtgcaaggaggcgcaataatctgcggcctgttgtcctccccgtcagttctcttgtgtaacgtgaaggattggatggacccatctgaggcctgggcaaatgcaacgtgccccggagtgacctacgatcaagaatctcaccaggtgatactgcgcctgggcgaccaggaatttattaagtcattaacccctttggaaggcacccaggacacctttactaatttccagcaggtgtatctctggaaggacagtgacatgggctccaggccagagtcaatgggctgtagaaaagatacagtgcccagaccggctagtccaacagaagcaggccttacaaccgagctgtttagcccagttgatctgaatcaggtcattgtgaacggtaaccagtcccttagctcccagaagcactggctgttcaagcatttgtttagtgcccagcaggctaatctttggtgcctgtctcgatgtgttcaggaacattctttctgtcagctggctgaaatcacagagtccgcctcgctatattttacctgtacgctgtatcccgaggcccaggtatgtgatgatataatggaaagcaacgcccagggctgtagacttatcctgcctcagatgcccaaggctcttttcagaaaaaaggttatcctggaagacaaggtgaagaatttttacaccaggctgcctttccagaaactgatgggaatatccatccggaacaaagtgccaatgtcagagaaatctatctcaaatggatttttcgagtgcgagcggagatgcgacgccgatccctgctgcactggattcggcttcctcaacgttagccagctgaaaggtggggaggtgacctgcctgactctgaactctctgggtatacagatgtgcagtgaagagaacggcggggcatggagaatcctggactgcgggtccccagacatcgaagtgcacacatacccctttggctggtatcagaagcccatcgcacagaataacgcccctagcttctgtcctcttgtcgtactgccgagtctgacagaaaaagtgtctctcgattcatggcagtcattggctctgtccagcgtagtggtcgaccctagtatcaggcactttgacgtcgcccacgtgtctacagctgcaacaagcaacttctcagccgtgcgcgacctctgcctgtccgagtgtagtcagcatgaggcatgtctgatcacgacgctccagacacaaccgggtgccgtacgttgcatgttctatgccgacacacaaagctgcacccattccctccagggccaaaactgtaggcttctcttgagagaggaggcaacccacatctacagaaaaccgggcatcagtctactgtcttacgaggcgagcgtgccctccgtccctatcagtactcatggaagacttctgggccggtcgcaggcaatccaggtgggcacaagctggaagcaagtggaccagtttttaggcgtgccttatgccgctccaccccttgctgagcgccggtttcaggctcccgagcctctcaactggactggctcctgggacgccagtaagcccagagcaagctgctggcagccgggaaccagaacaagtacctcccctggggtttcagaagactgtctctatttgaacgtcttcattccccagaacgttgctcccaatgccagtgtcctggtcttcttccacaacacaatggatagggaggagagcgagggttggccagccattgacgggagcttcctggctgcggtggggaacctgatcgtggttactgcatcataccgggtgggggtgtttggcttcctctcctccggctccggtgaggtgtccggtaactggggtctgttggatcaggtggcagcactgacttgggtgcagacccacatccgggggttcggtggagacccaaggagggtgagcttagctgcggaccgcggcggagccgatgtcgcctcaatccatctgctcactgctcgcgccaccaattcacagctgtttcgcagagcagtgctcatgggcggttctgccctctcccctgccgctgtcattagtcacgagcgtgctcagcagcaggccatagccctggccaaagaggtgtcttgtcctatgtccagtagccaggaagtggtgagctgcttgcgacagaaaccagctaatgttctgaatgatgcacaaactaagttgttagctgtgtccggaccttttcactattgggggcctgttattgatggccactttctgcgggaaccaccagcccgggctctgaagagatccctctgggtcgaggtggatttacttatcggatcctcccaggacgacggcctgatcaatcgcgccaaagcagtgaaacagttcgaggagagtaggggacgaacctcctctaagacggctttctaccaggcacttcagaacagtctaggcggcgaagactctgatgcccgagtcgaggccgccgctacctggtactatagccttgagcacagcaccgacgactatgcatccttttcacgagccctcgagaacgctactagagactacttcatcatatgcccaatcattgacatggcttccgcatgggcgaagcgcgcccgcggtaatgtgtttatgtaccacgcccccgagaactacggccacgggtcacttgaactgctggccgacgtccaattcgctctggggctgcctttctaccccgcttacgagggccagtttagtctggaggagaagagcctgtcgctcaagatcatgcagtacttctcccactttataagaagtggaaatccgaactacccgtatgagttcagtaggaaggttcccacattcgctacaccttggccagacttcgtgcctcgtgcaggtggcgagaattataaagagttctccgaactacttcccaatcgacagggccttaagaaggcagactgctcgttctggagcaaatacattagcagcctgaagacctccgctgatggagccaaggggggtcagagcgcagagagcgaagaagaagagctgactgccggctccgggctcagggaggacctgctcagcctccaggaacccggcagtaagacctatagcaagtag

SEQ ID NO: 180761 - DNA, 1191 bp, Artificial Sequence
  Description of Artificial Sequence: Synthetic coding sequence
atgcccggccggggccggtgccccgactgcgtggtgaccgagggcgttctcacaacgacattcagtgatgaaggcaacctgcgcgaggttacttactcccgctcaacaggcgagaatgagcaggtttcacgaagtcagcagagaggtttgcgccgcgtgagggatctgtgtagagtgctgcagctgcctcccactttcgaggataccgccgtagcctactatcagcaggcctaccgacattccgggatccgtgccgcgaggttacaaaaaaaggaggtgctagtggggtgttgtgtgcttattacttgcagacagcacaattggcccctaaccatgggcgcaatttgcacacttttgtatgccgatctggatgtattctcctccacatatatgcaaatcgtgaaattgttgggtctggatgtgccctccctgtgcctggctgaattggtgaagacatactgctcatccttcaagctttttcaggcaagcccctccgtccccgcgaagtacgtggaggacaaggaaaagatgctctcacgcacgatgcagcttgtcgaactagcaaacgagacttggctggtcacaggccgtcaccccctgccagttatcactgccgcaaccttccttgcttggcaatccctgcaacccgcagataggctgagctgctcactggcacggttttgcaaactggcaaatgtggatcttccctatcccgcatcatccaggttgcaggagctgctcgctgttttactgaggatggccgaacaactggcatggctcagggtcctacgcctggataaaaggagcgttgtgaaacacattggcgatctgctccaacacaggcagtctctcgtgcgctccgctttccgggacggtacagccgaggtggagacgcgggagaaagaacccccgggctgggggcagggtcagggcgagggcgaagtcgggaataattccctgggactcccacagggtaaaagacctgccagccccgcgctcctcttaccaccatgcatgctcaagtccccaaagcggatttgtcccgtgcccccagtctcgaccgtgacaggagacgagaacatctctgattcagagatcgagcagtacctgaggacacctcaagaggtgcgggattttcagagggcccaagccgctcggcaggcggccacatccgtgcctaacccaccctag

SEQ ID NO: 180762 - DNA, 1698 bp, Artificial Sequence
  Description of Artificial Sequence: Synthetic coding sequence
atggccgagggcaaggccggcggcgccgccggcctgttcgccaagcaggtgcagaagaaattcagccgggctcaggagaaggtgcttcagaagctggggaaagccgtcgagacaaaagatgaacggtttgaacagtccgcctctaatttttatcagcagcaggctgagggccacaagctatataaagacttaaagaactttctctccgctgtcaaggtgatgcatgagtcaagcaagagggtaagtgaaactctccaggagatttatagtagcgaatgggacgggcatgaagagcttaaagctatagtatggaataatgacctgctttgggaagactacgaggagaagctggccgatcaagccgttaggaccatggaaatttatgttgcccagttctccgagataaaggagaggattgccaagcgtgggaggaaactcgtggactatgacagtgctagacaccacctcgaggccgtccagaatgcgaagaaaaaagacgaagcaaagaccgccaaagctgaggaagagtttaataaagcccaaaccgtgttcgaggacctcaaccaggagctgctcgaagagctgcctatcctctataactctagaatcggatgctatgtcacgatcttccagaacatatccaacctccgggatgtcttctaccgagaaatgtcaaagctcaatcataacttgtacgaagtgatgtctaaactcgaaaagcagcacagcaataaggtttttgtggtgaagggcctgtctagttcgtcccgacgcagcctggtgatcagcccccctgtcaggacagccactgtcagctcaccactgactagcccaacatctccctcaacacttagtttaaaatcagaatctgaatccgtgagtgccacggaagatctggctcccgatgcagcccagggggaggacaatagcgaaattaaggagttattggaggaggaggagattgaaaaagaggggtctgaagccagcagtagtgaggaggatgaacctctgcccgcctgtaacggccctgctcaggcccaaccctcccctacaactgagcgagcaaagtcccaagaggaggtactgccctcttctaccaccccgtctcccggaggggcgctgtcaccaagcgggcagcctagcagttccgcgacggaagtggtgttacgcacacgaaccgctagtgaagggagcgaacagccaaaaaaacgtgcctcaatacagcggacttcagcacctcccagtcggccaccccccccgcgcgccacagctagcccgcggccttctagcggcaatattccttcttcaccaacagctagcgggggaggctctcccaccagcccgcgagcgagcctgggaaccggcactgcgtctcctagaacgtctctggaagtttcccccaaccccgagccgcccgagaaaccagttaggaccccggaggccaaagagaacgaaaatatacataatcagaacccagaagagttgtgcacatctccaaccctaatgacgtctcaagttgcctccgaacctggggaagccaaaaaaatggaggacaaggaaaaggacaacaagttgatctcagctaatagctcggaaggtcaggatcagctgcaggtgagcatggtaccagagaacaacaacctgacagcccctgagccacaggaagaagtgtccacaagtgaaaacccacaactatag

SEQ ID NO: 180763 - DNA, 1602 bp, Artificial Sequence
  Description of Artificial Sequence: Synthetic coding sequence
atggccgagggcaaggccggcggcgccgccggcctgttcgccaagcaagtacagaagaaattttccagagcccaggagaaggtgctccaaaagctcggtaaggctgtcgagacgaaggatgagcggttcgagcagtccgcttctaatttttaccaacagcaagcagagggacacaaattgtataaggatctgaaaaacttcctcagcgccgttaaagtcatgcacgagagtagtaagcgggtcagcgagaccctgcaggaaatctatagttcggagtgggatggacacgaggagttgaaagccatcgtgtgggaacgcattgccaagcgcggaaggaagctggtcgactatgatagcgcgcgacaccatcttgaggctgtgcagaacgctaaaaagaaagatgaggctaagacggccaaagcagaggaggagttcaacaaggcacaaaccgtgtttgaagacctgaatcaggagctgttggaggaactgccaatcttgtacaattcccgcataggctgttacgtgaccatctttcagaatatttccaacctgagggatgtgttttatcgcgaaatgtctaagttgaatcataacttgtacgaggtaatgtcgaaactcgagaaacaacattcaaataaggtgttcgtggtcaagggactatccagtagctccaggcgctcacttgttatatctccccctgtgagaacagccactgtgtcatctccactgactagtccgacgtccccaagcacactgtcgctaaagagtgaatcggagtccgtgtccgcaacagaggacctggcccctgacgccgctcagggcgaggacaacagcgaaataaaagagctacttgaggaggaggagatcgagaaggaagggagcgaggcatcgagctctgaggaggatgagcctctgccggcctgcaatggcccggcacaagcgcagccatcccccactacggagagagccaagagtcaggaagaagtcctgccaagctccacaacaccttcccctggcggagcgctgagcccaagcggccagcctagttcttccgcgacagaagttgtgctccgcactaggacagccagtgaaggatccgagcaacccaagaaacgagcgtcaatccagcgaacctccgcacctccatctcgccccccaccgccgcgggccacagcaagcccaaggccatcttccggcaacattccttcttctcctaccgcctcaggcggggggtctcccacctccccacgagcctccctcggaactggaacagcctctcctagaacatccctcgaagtgtctccaaacccagaaccccccgagaagccagtcaggacaccggaggcaaaggaaaacgaaaacatacataaccagaaccctgaagagctatgtactagccccactctcatgacatctcaggtggcatcagagcccggagaagccaagaagatggaagacaaggagaaggacaataaattgatcagcgcgaacagtagcgagggccaggatcagcttcaggtgagtatggtacccgaaaataacaatcttacagctccagagcctcaggaagaagtctcaacgagtgagaacccgcagctctag

SEQ ID NO: 180764 - DNA, 1620 bp, Artificial Sequence
  Description of Artificial Sequence: Synthetic coding sequence
atggtgctgcagaagctgggcaaggccgtggagaccaaggacgagagattcgagcagtccgcctccaacttttaccagcagcaagctgaggggcataagctgtacaaagatctcaagaatttcctgtctgctgtgaaagtaatgcacgaatcctctaagcgggtctcagaaacccttcaggagatctatagcagcgagtgggacggccatgaagagctcaaagcaatagtgtggaataacgatttactttgggaggattatgaggagaagttggccgaccaagcagtgcgcactatggaaatctacgtggcccaattttcagagataaaggagcgtatagcgaagcgggggagaaaactcgtggattacgacagcgctcgtcatcacttggaggctgtgcagaacgcaaagaaaaaggacgaagcgaagaccgccaaagctgaagaagagtttaacaaggcccaaaccgtgttcgaagacctcaaccaggaactgcttgaggaacttccgatcctctacaacagcaggattgggtgttacgtgaccatctttcaaaatatttccaatctgcgggatgttttttatagggaaatgagcaagctcaatcacaatctttacgaagttatgtcaaaattggagaagcaacattccaataaagtgttcgtggtgaaaggcctgtcctctagtagcagacggagtctggtcatcagtcctccagttcggacggcgacagtttcgtctccccttacatctccaacgagcccgtccaccctgtccctcaaatccgagtcagaatccgtcagcgcgactgaagacctggccccggacgcagcccagggagaggataatagcgagattaaggaactacttgaggaggaagaaattgagaaagagggatctgaagcctcaagctcagaggaggacgagccgcttccagcctgcaatggccctgcacaggcccagcccagtcccaccaccgaaagggccaagagccaagaagaagtgcttccatcttctactactcctagccctggcggggccctgagcccttccggacagccttcgtccagtgccaccgaagttgtgcttcgcactcgcacagcctcagagggcagtgaacagcccaagaaaagagcaagtatccagagaacatcagcaccccccagcaggccacccccaccccgggctaccgcttccccgcgtccatcatcgggcaacattcccagctcccctactgcctccggcgggggcagcccaaccagccctagggctagcttaggaaccgggactgctagtcctagaacatcactagaagtaagcccaaatcctgaacctccggaaaagccagtgcgcacacctgaggccaaggagaatgagaacattcataaccagaatccggaggaactgtgcacctccccaactcttatgaccagtcaggtcgccagcgaacctggcgaagcaaagaaaatggaggacaaggaaaaggataacaaactcataagcgccaactcctcagagggacaagatcagctgcaggtctctatggtgcccgaaaataataatttaaccgctcccgagcctcaagaggaagtgagcaccagtgagaatccacagctttag

SEQ ID NO: 180765 - DNA, 762 bp, Artificial Sequence
  Description of Artificial Sequence: Synthetic coding sequence
atgagctggatccccttcaagatcggccagcccaagaagcagatcgtgccaaagaccgttgaacgcgatttcgagagggaatatggcaaacttcagcagttggaggagcagactaggcggctgcaaaaggacatgaaaaagagcaccgacgctgacctggcgatgagtaaaagcgccgttaaaatctctttggatctcttgtcaaaccctctgtgcgagcaggaccaggatcttctgaacatggtcacagctttggacacagccatgaaacgcatggacgcatttaatcaagagaaggtcaaccagatccagaagacggtgattgagccactgaagaagtttgggagtgtctttccttctcttaacatggccgttaaaagaagggagcaggccctgcaagactataggagactgcaggccaaagttgagaagtacgaagagaaggagaaaacggggcccgtcctggctaaactccatcaagcgcgggaagaattaagacccgtgagagaggatttcgaagctaagaatcgccagctcctggaggaaatgccccggttttatggatctcggctggattactttcagccttcctttgagtccctgatcagggcccaggtcgtctattattccgaaatgcataaaatattcggcgacttatcccatcagctcgatcaaccgggccattctgatgagcagcgtgaaagggaaaatgaagccaagctgagtgagctcagggccctttctatcgtcgctgacgattag

SEQ ID NO: 180766 - DNA, 600 bp, Artificial Sequence
  Description of Artificial Sequence: Synthetic coding sequence
atgagcaagagcgccgtgaagatcagcctggacctgctgagcaaccccctatgcgagcaggatcaagatctgttgaatatggtgactgcattagataccgcgatgaagaggatggatgcattcaaccaggagaaggtgaatcagatccagaaaaccgtgatcgagccactgaaaaagttcgggagtgtgttccctagccttaatatggcagtcaaacggagagagcaagcgctgcaggattatcgccgtctgcaagccaaggtggaaaaatacgaggaaaaggaaaaaactggtccagtcctcgccaaactccatcaggctagagaggaacttcgcccagtgcgggaagacttcgaggctaaaaacagacagctgctcgaagagatgccccggttctacggttcaagactcgattactttcagccatcattcgaaagcctgatcagggctcaggttgtctactattccgaaatgcacaaaatcttcggagacttgagccaccaactagatcaacctggacacagcgatgagcagcgagagagagaaaacgaggcaaaactgagtgagctgagagccctgtcgatagtggcagatgattag

SEQ ID NO: 180767 - DNA, 2343 bp, Artificial Sequence
  Description of Artificial Sequence: Synthetic coding sequence
atgacccacacccggcggaagagcctgcccatgctgagcagcggcctgaccggtcgcagggaaccactacagatggaagacagtaacatggaacagggagtggaaggagttgaaccaggcatgcctgagagtcccggacacctgaccggccgccgtaaaaactatccccttcgaaaacgtccactggtcccagagaaaccaaaggcttgcaaggtgctactgacgcgcttggagaatgtggccggtccccgctcagcagatgaggcggacgaattaccccccgacctgcccaagcctccctctcctgcaccatcctcagaggatccagggctggcccagcccagaaagcgccggctggcctcactaaacgccgaggctctgaacaacctgctgcttgaaagagaagataccagctctttggccgggacccggaggtctagggcgggcgacccacaccggtctagggatagggatcgggccacggggggttggagttctagcaagaagagaccacgactaggggatcttggaggtggatcccgcgatctcagcccagagcccgcaccagatgaaggaccccgtcgggacggcgaccccgcacccaagaggctggcctcactgaacgctgctgcattcctcaaactgagccaggagcgcgaactacctctgaggctgccccgagcccatgctgaagtggatggccggtccacagagccccctgctcctaaggctcctaggcctaaatggccaaaggtgaacggcaaaaattatccaaaagcgtggcagggggcgagcagcggcgaggcagcaggaccgccgggctggcaaggctgcccagatgagccatggccgagcgccacaccatgtggcccaagtgtgcaaccttcacatcagcccttgagcaaagcactcgaatcacccctgggcttgcgacctcatttgccactcctgatgggagggcaggccgctctgaagccagaacccgggagacccggtgaggaatcacctgctcccaaacaggaattgcatcagccaagctttccaacccctcagctttctcccctgccaatgcccgggaatccagccgattataatggactgtgcgttgggccagaactcacagctcttggctccttctatctctactgtggtcaggaaggcctgcagtgcgggggctacagcccttgccctatgcttcctgagggcaagctcagtcccgtggccgcccctcatgaagaggggctcctgttggctccaagctctgtcccaagtggcaccccatttcaacacccgccgtggggctcaagtcgatactgtagctccgaggacacgggtgtaaacggatacagtatatgcggcgtactccccttatccgtgacccatgcgggcactacttgcgggggttgcccttacaagatgcctttcgcagctgagggctgtagatctcttgggcagctggaattccctctgcccgaagccggccatccggccagtcccgcccatccgctccttggctgcccggtaccatccgttcctccggccgctgaacccgtcccacatttgcagacaccaacgtccgagccacaaaccgtcgcaagggcctgtccacagtcggctaagccgcctagtggaagcaaaagcgggttgcgcacaggaagctcttgccgacatacagcccgaagcaaggcggctagaagaccttcccaccccaagcagccgcgcgtgcagcgacctcgtccccggaggagacgccggaggagaaccaatggttgggtgcccgtcggagccgcctgtgagaaagctgtatacgttttggatgaacctgaacctgcgatccgcaagagctaccaggctgtggaaaggcatggcgagaccatcagggtgcgtgatacagtcctgctgaagtccgggccaaggaagactagcaccccctatgtggccaagatctccgccctgtgggaaaacccggaatctggggagctcatgatgagtctcttgtggtactacagacctgaacatctacagggaggccgcagcccttccatgcacgagcctctccagaatgaagtctttgcttctcgtcatcaagaccaaaatagtgtcgcctgtatcgaagagaagtgttacgtgctaaccttcgctgagtactgccggttttgtgccatggctaagagacgaggtgaggggctgccctcccgcaaaaccgctctagtgcctccctccgcagactattcaaccccgccccataggacggtgccagaggataccgaccccgagctggtcttcctatgtcggcatgtctacgacttcaggcatggtcgaatcttaaaaaatcctcagtag

SEQ ID NO: 180768 - DNA, 2340 bp, Artificial Sequence
  Description of Artificial Sequence: Synthetic coding sequence
atgacccacacccggcggaagagcctgcccatgctgagcagcggcctcaccgggcggcgcgaacctctgcaaatggaggatagcaacatggagcagggggtggagggcgttgaacctgggatgccagaaagcccaggccacctgaccggacgtagaaagaactatcccctgcgtaagcgaccgctggtaccagagaagccaaaagcatgcaaggtgctgctaacaaggctggagaacgtcgccggccctcgttccgccgatgaggcggacgaactcccacctgacctacctaagccaccctccccggccccaagctccgaggaccccgggttagcccagccccgcaagaggcgtctagccagtctcaatgccgaagccctgaacaatctgctgcttgaacgggaggacactagtagtcttgcagggaccaggcgttctagagctggggatccacacaggtctcgcgaccgcgaccgggccactggaggttggtcatcttccaaaaaacgcccgcggctcggcgacctgggagggggaagccgtgacctgtcccctgaacccgcgcccgacgagggcccccgccgcgatggggaccccgcaccaaaacgccttgccagtctgaatgccgccgcctttctcaaactgtcacaggagagggagctgccacttcgccttccaagggcgcacgctgaggtcgacggcaggtcaacggagcctcccgcccctaaggcgccgagacccaaatggccaaaggtgaatggtaagaactatcccaaggcatggcagggtgcctcctctggcgaagctgccggcccgcccgggtggcaaggatgcccagacgaaccatggcccagtgctaccccctgcggccccagtgtgcagcccagtcaccaaccactgagtaaagcacttgagagcccattaggcctgcgaccccatctccctttacttatggggggacaagcagctctcaaacctgagcccgggagacccggagaggaaagccctgccccaaaacaggagctgcatcaacccagcttccccacgccacaactatcccctctgccgatgcccgggaacccagccgactataacgggttatgcgtgggacccgagcttacagctcttgggtcgttttatctctactgcggacaggaaggcctccaatgcggtgggtactcgccttgtcccatgctgcctgagggtaagctgtcacccgtagccgctccacacgaggaggggctgttgctcgcaccatcaagcgtgccttcgggaaccccattccagcaccctccttggggaagctcacggtattgctctagcgaagacaccggagtgaatggatatagtatatgtggggttctgcctctcagtgtaacacacgcagggaccacctgtggaggatgcccttacaaaatgcctttcgccgccggatgccgctcgctgggacagctcgaatttccattgccagaggctggccatcctgcctcaccggcccatcccttgctgggctgtcctgtcccctccgtgccccccgccgccgagccagtaccgcacttgcagacacctacttccgaacctcagacagtggctcgggcatgtcctcagagtgccaaaccaccctccgggtctaagagtggcctgcgtactggctcatcttgccgccacactgctcgctctaaggctgctaggaggcctagccaccctaaacaacccagggttcagaggccaagaccccgacgaagaaggagacgaaggactaacggatgggtgcccgtcggcgctgcctgcgagaaagctgtctacgttcttgatgagccggaaccggccataaggaagtcttaccaggcagtggaacggcatggtgagacaatccgagtacgggacactgtactgctgaaatctggtccgcgcaagacctccacgccttatgttgccaaaattagcgcactgtgggagaaccctgagagcggtgagttgatgatgtcactcctctggtactaccgaccagaacatctgcaggggggaaggtcccctagtatgcacgagccattgcagaacgaagtgttcgcttctcggcaccaagaccagaactcggtcgcatgcatcgaagaaaagtgttatgtcctcaccttcgctgagtattgtcggttttgtgcgatggctaaacgcaggggggaagggcttccttcccggaagacagcgcttgtgcctcccagcgcagactacagcacaccaccccaccgaacggtgccagaagacacagaccctgagctggtgtttctttgtagacatgtatatgacttcagacacggcagaatcctgaaaaaccctcagtag

SEQ ID NO: 180769 - DNA, 4575 bp, Artificial Sequence
  Description of Artificial Sequence: Synthetic coding sequence
atgcccctgctgcaccggaagcccttcgtgcggcagaagccccccgccgacttacggcctgacgaggaggtattctattgtaaagtaaccaatgagatattccggcattacgacgacttttttgagcgtaccattctgtgtaacagccttgtatggagttgtgccgtgaccggtaggcctggcctcacctatcaggaagctctggagagtgagaaaaaggcccgccaaaaccttcagagctttccagaacccctgattatccccgttctctacctgacctccctgactcaccgaagccggctgcacgaaatctgcgacgacatcttcgcatacgtcaaagaccgatactttgttgaggaaactgttgaggtgatccgcaacaacggcgctcggttgcagtgtcgcatcctcgaggtcctgcccccaagccatcagaatgggtttgcgaacgggcatgtgaatagcgtcgatggagagaccataatcatcagtgatagtgatgactcggagacacagagttgctcattccagaatggaaaaaagaaagacgccatcgacccactgttgttcaagtacaaggtacagcctaccaaaaaggagctgcatgagtcagcaatagtcaaagctacacagatttcccgcaggaaacaccttttttctagagataaattgaaactttttctaaagcaacattgcgagccccaggacggcgttattaagattaaggctagttccctgagcacatataagatcgccgaacaggacttttcatatttctttccagatgatccccccacattcatcttttccccagctaacagacgcaggggacgcccaccaaagcgtattcacatttctcaagaggacaacgtggcaaacaagcaaactcttgcgagctacaggtccaaagccaccaaggagagagataagttgctgaagcaagaggagatgaaaagcctcgccttcgaaaaggcaaagcttaagcgagaaaaggcggacgcacttgaggccaaaaagaaagagaaggaggacaaagaaaagaagcgcgaagaattgaagaaaattgtggaggaagagcgactgaagaagaaagaggagaaagaaagacttaaagtggaaagggaaaaagagagggaaaaactgcgggaggagaaaaggaagtacgtggagtatctaaagcaatggagcaaaccgcgcgaggacatggagtgtgacgatttaaaggaacttccagagcccacccccgtcaagacgaggcttcccccagaaatctttggggatgccctgatggtcctggaatttctaaatgcctttggagaactctttgatctgcaggatgaatttcctgatggagttaccctggaggtccttgaagaggctctggttggcaatgacagcgaggggcccctctgcgaactcctgttctttttcctgactgccatcttccaggccatcgcagaagaggaagaagaggtcgccaaagagcagctgacggacgcagacactaaggggtgttcgctgaagtcactcgatctggattcctgcacactaagcgaaatactgagactccacattttggcgagtggggccgacgtcaccagtgcaaatgccaaatataggtaccagaaacgaggtggcttcgacgccactgacgacgcttgtatggaactgcggctgtcgaatcccagtttagttaagaagcttagcagcacctccgtgtacgaccttacccccggcgaaaagatgaagatactccatgcattgtgtggaaaactactgaccttagtgtctaccagagatttcattgaagattacgtagacattctccggcaggctaaacaggagttcagagagctaaaagccgaacagcaccggaaggaacgggaggaggccgctgcaagaatcaggaagcgcaaggaggaaaagcttaaggagcaggagcagaaaatgaaagaaaaacaggagaaactaaaggaagacgaacagagaaacagcacagccgacatcagtatcggcgaggaggagagggaggacttcgatacctccatcgagtctaaagacacagaacagaaggaactggatcaggacatggtcacagaagatgaagacgatccagggtcacacaagcgcggtcgccgcggaaaacgggggcagaacggattcaaggagtttactcgacaggaacagataaactgtgtcaccagagagcctctcaccgcagacgaggaggaagcccttaagcaggagcatcagaggaaagagaaggaattactcgaaaaaatacaatcagctatcgcgtgcaccaatatctttccccttgggcgcgacagaatgtataggcggtactggatattcccatctatccctggcctgttcatcgaggaggattactcgggtttgaccgaggacatgcttctgccaaggccaagcagctttcagaacaatgtgcagtcccaggacccacaagttagcaccaagaccggcgagcctttaatgagcgaaagcacttcaaacatcgaccagggccctagagatcattctgtgcagctgcccaagcctgtgcataagccaaatcgctggtgtttctattcaagctgcgaacagctggaccagctaatcgaggctctgaactctcgaggccaccgcgaaagtgctctgaaggagacgctgctccaggagaagtcgcgcatatgtgcacaactggctcgtttcagtgaagagaagtttcacttttctgacaagcctcaacctgacagtaagcccacttacagcaggggccgcagtagcaatgcgtacgacccctctcagatgtgcgctgagaagcagctggaactcaggttgagagacttcctcctggatatcgaagatcgtatataccagggtacattgggagccataaaggtgaccgatcggcatatatggagaagcgcactcgagtccggaagatatgaactgttgtctgaagagaacaaagagaatggaatcattaaaaccgtaaacgaagatgtcgaagaaatggaaatagacgaacaaactaaggtgatcgttaaagatcggctcctgggcataaagaccgagacacccagcacagtgtctactaatgcctctacgccacagtcagtgtcctcagttgtccactatttggcaatggcgttatttcagatcgagcagggcatcgaaagacggttcctcaaagcgccgcttgatgcatccgattcaggccgcagctacaagactgtgcttgatcgttggcgcgaaagtctgctttcttccgctagcttaagtcaagtgtttctgcacctgtcaaccctggacaggtccgtgatttggagcaagtctatcttgaatgcccggtgtaagatctgtcggaagaagggggatgccgaaaatatggtgctgtgtgacgggtgtgatagggggcaccacacttattgcgtccgccctaagctcaaaactgtaccggaaggggattggttttgtcccgagtgtcggcccaaacagcgtagtagacgtctgtccagtcgacaacggccttctctagaatccgacgaagacgtggaggacagcatgggaggagaggacgacgaggtggacggagatgaggaagagggccaatcagaagaggaggagtacgaggtcgagcaggacgaggacgacagccaagaggaagaagaagtgagcctgccaaaaagaggccggcctcaggtccgactccctgtaaaaactaggggtaaactttcttccagtttttcctcccggggccaacagcaggagccaggcagataccctagccggagtcagcagtctactcccaagactacggtctccagtaaaaccggcagatctctgaggaagatcaacagtgcccctcccaccgaaacaaagagcctccgtattgctagccgatccacacgacactcgcacggaccactgcaggcggacgtcttcgtggagctgctctccccccgcagaaagagacggggcagaaaatctgcaaataacacacctgaaaactcaccaaatttccccaatttcagagtcattgccacaaaatccagtgaacagagccgcagtgttaacattgcaagcaaattatctctgcaggagtccgaatccaagcgcagatgcaggaagcgacaaagtccagaaccttctccagtgactttaggtagacgctcttcggggaggcaggggggtgtgcatgagcttagcgcctttgagcagctggtggtggaactcgtgcgtcatgatgactcttggcctttccttaagctagtgtctaaaatccaggtgcctgattactatgatatcatcaagaagcctatagctctgaacattatccgggagaaagtgaacaagtgtgagtacaaactggcatccgaatttatcgacgacatcgagttaatgttctccaattgtttcgagtacaacccacgtaataccagcgaggccaaagccggcactcgcctgcaggcctttttccacattcaggcccaaaaattggggttacatgttacgcctagtaacgtggatcaagtgtccaccccaccagctgcgaaaaagtctcgaatctag

SEQ ID NO: 180770 - DNA, 4671 bp, Artificial Sequence
  Description of Artificial Sequence: Synthetic coding sequence
atgcccctgctgcaccggaagcccttcgtgcggcagaagccccccgccgaccttcgacccgatgaggaagtgttctactgtaaggtcactaacgagatatttcggcactatgacgacttcttcgagcgtactatcttgtgcaacagcttggtatggtcttgcgctgtgaccgggcggccaggattaacgtatcaggaagctctggagagcgaaaagaaggctcgtcagaatttacaatcgtttcctgaaccactgatcatccctgtattgtacctgacttctctcacccatcggtcccgtttacacgagatttgtgacgacatctttgcctatgtaaaggacaggtatttcgtggaagagactgtggaggtgattcggaataacggagccaggctgcagtgtcgtattctcgaagtgttaccaccttctcaccagaacggctttgccaacggacacgtgaattctgtggatggggagaccattatcatctctgattcggacgacagcgagacacaatcctgtagtttccagaacggtaaaaaaaaagacgctatcgacccgcttttgttcaagtacaaggtgcagccaacaaagaaggaactgcatgaatcagccattgtgaaggcaacccagattagcagacggaaacatctgttctccagagataaattgaagttatttctgaagcagcactgcgagccccaggacggcgtgataaaaattaaggctagttccctgagcacgtataagatcgcagagcaggacttttcgtattttttcccggatgatccaccaaccttcattttttcccctgcaaataggaggcgggggagaccccccaagaggattcacatctcacaggaggacaacgtcgccaacaagcaaacactcgcttcctatcggtctaaagccactaaggagcgcgacaaacttctcaagcaggaagagatgaaatctctggcgtttgagaaggctaaactgaaacgtgagaaagctgatgcactggaggctaaaaaaaaggagaaagaagataaggaaaagaagcgggaagagctaaaaaagatcgtggaagaagagcggctcaagaagaaagaggagaaagaacggctgaaagttgagagggagaaggagagagagaaactacgcgaggaaaagcgcaagtacgtggagtatcttaagcagtggtccaaaccacgagaggacatggagtgtgatgacctgaaagaactgcctgaacccactcccgtcaaaactcggcttcctccagagatattcggggatgcgctgatggtgctcgagtttttgaacgcatttggcgaactgtttgatctgcaggatgagttccccgatggcgtgacactcgaagtgttggaagaagcactggtgggcaacgactccgagggcccactgtgcgagctactgtttttcttcctgacagccatcttccaggctatcgcagaagaagaagaagaggtggctaaggagcagctgaccgatgcggatacgaaggacctgactgaagcactggatgaggatgccgaccctacaaaatccgccttgtctgccgtcgcttcattagccgctgcctggccacagctgcaccaggggtgctccctgaagtcactagacttggacagttgcacgctgtctgagatcctgcgactgcacatactcgcatcgggggccgatgtgacttctgccaacgctaaataccggtatcagaaacggggaggcttcgatgctactgacgatgcttgcatggagctgcgtctgtcaaacccatcactcgtcaaaaaactgagctccacgtcagtctacgacctgacaccaggtgaaaagatgaagatcctgcacgcattgtgtggaaaactgctaaccttggtgtctactagagattttattgaagactacgtcgacatcctccgtcaggccaagcaggagttccgagagctgaaggctgagcaacatagaaaggagcgcgaggaagcagcagctaggatcagaaaaaggaaagaagagaagctgaaggaacaggaacaaaagatgaaagaaaagcaggagaagctaaaagaagatgaacagagaaatagtactgctgacatttctataggagaggaagaacgggaggatttcgatacctcaattgagtcaaaagacacagagcagaaagagttagatcaagacatggttactgaagacgaggacgaccctggctctcacaagcgcggaagaaggggcaaacggggccagaatggtttcaaagaatttactcggcaggaacagattaactgcgtaacacgggaacctcttaccgcagacgaggaggaggctttaaagcaggagcaccagcggaaagaaaaagagctcttagagaaaattcagagcgcaattgcttgcactaatatcttcccactggggagagatcgtatgtacaggcgatattggatatttccaagcatccccgggctgttcatcgaggaggactattccggccttacggaagacatgcttctgccccggccgagctccttccagaataatgtgcagtctcaagatcctcaggtgtcgaccaagacaggggaacctctgatgtctgagagcacatcgaatattgatcagggccccagagatcacagcgtacagctccctaaaccagtccacaagcccaaccgatggtgcttctattctagctgcgagcagctggaccaactgatcgaggccctgaactcccgggggcatagagagagtgccttgaaagagacacttctgcaagagaaatcacggatatgcgcacaattggcacggttcagcgaagagaaatttcatttctctgataaaccgcagccggactctaagcccacttattcaaggggcagaagtagtaacgcatacgatccatcacaaatgtgtgccgagaaacagctggaattaaggctgcgggactttctgctcgatatcgaagacaggatttaccaaggtacactgggcgccattaaggtgactgaccggcacatctggaggtcagcgctagagagtggtcgttatgaactccttagtgaggagaataaggagaacgggattataaaaaccgtcaatgaagatgttgaggaaatggagatagatgaacagaccaaagtgattgtgaaggataggttgctgggcataaagactgaaactcctagtacggtgtcaaccaacgcctcaaccccacagagtgtgtctagcgttgtgcactacctggcgatggctctcttccagatcgagcaaggtattgagcggaggttcctgaaggccccacttgatgcttcggactccggaagaagctataaaacagtcctggatcgctggagagagagtttgttgtcttcagcgtccctgtctcaggtctttctgcacctttctacactggacagatccgttatatggtcaaagtctatcctcaacgcacgatgtaaaatatgtcgaaaaaaaggagacgccgagaacatggtgctttgtgacggctgcgacaggggccatcacacatactgcgttcgtcctaaattaaaaaccgtcccagagggtgactggttctgtcccgagtgtaggcccaagcagaggagcagaagactgtccagcagacagagaccctccctggaatcggacgaggatgtggaggatagcatgggcggcgaggacgacgaagtggatggcgatgaagaggagggccagtctgaggaggaagagtatgaagttgagcaggatgaagatgactcccaggaggaagaagaggtttcgttgcccaagaggggccgccctcaagtcaggctgcccgtgaaaacacgagggaagcttagctcgtcattttccagcaggggtcagcagcaggaaccgggccgatatccctcccggtctcagcagtcaacccctaaaaccaccgtaagctcgaagacaggccgtagcctgaggaaaattaattcagcgccccccactgagacgaaatcactgaggatagcaagtaggagcaccaggcactcccacggtcctctccaggccgacgtattcgttgaactactctctccacgcaggaaaagacgtggccgcaagtcagctaataacactcctgagaactcacctaactttccaaacttccgggtaattgcgacaaaatcaagtgagcagtccagatctgtgaacattgccagcaagctctcgctacaggagtcagaaagtaagagacgatgccggaagcgtcaaagccctgagccatctccggtcactttgggaagaaggagttctggccggcagggcggggtgcacgaactctcagcttttgagcagctggtggtcgagttggtgcgtcacgatgactcctggccattcctaaaactcgtcagcaaaattcaggtgccagactactacgatatcataaagaaacccatcgcattgaatatcatcagggaaaaggtcaataagtgcgaatataagttggcatccgagttcatcgacgacattgagctgatgttctctaattgtttcgagtataacccccgcaatactagcgaggctaaggccggtaccaggctgcaggccttcttccatattcaggctcagaagctcgggctgcatgtgacccctagcaacgttgatcaggtttctaccccacctgccgccaagaaatctcgtatctag

SEQ ID NO: 180771 - DNA, 4671 bp, Artificial Sequence
  Description of Artificial Sequence: Synthetic coding sequence
atgcccctgctgcaccggaagcccttcgtgcggcagaagccccccgcagacctccgcccagacgaggaggttttttactgtaaggtaaccaacgagattttcagacattacgatgatttttttgagcgaactatactgtgcaactctctcgtgtggagctgcgctgtcacaggccggccgggactgacgtatcaagaggcgctagaatcggagaaaaaagccaggcagaacctgcagtcttttcccgaaccgttaatcatccctgtcctatacttgacctcactcactcatcgctcccggcttcacgagatttgtgacgacatctttgcatatgtcaaggacaggtactttgttgaagagactgtagaggtcattagaaataacggggctcggttgcaatgcagaatcctcgaggtcctgcctccgagccaccagaatgggtttgctaatgggcatgtgaactccgttgatggggaaactatcattatcagtgactcagacgactctgagacacaaagctgcagcttccagaacgggaagaaaaaggacgcaatcgatccactcctttttaaatacaaagttcaaccaactaagaaagaacttcatgagtctgccatcgtaaaagcaacccaaatcagcagaagaaagcacctttttagtcgtgataaactgaagctgttcctgaaacaacactgtgaaccacaggacggcgtaattaaaatcaaggcctcctctttatccacctataagatcgccgagcaagattttagctacttttttcctgatgatccgcccactttcattttctctcctgccaacaggcgaagggggcggccacccaagcggattcacatttcacaggaagacaacgtggccaacaagcagacccttgccagctaccgatccaaggccaccaaggagcgggacaagctgctcaagcaggaggaaatgaagagcctggcattcgaaaaggccaaactcaagagagaaaaggcagacgcgcttgaagcaaagaaaaaggagaaagaagacaaagagaagaagcgcgaagagctgaaaaagatagtggaagaggagcgcctgaagaagaaagaagaaaaggagcgtctgaaggttgaacgcgaaaaggaaagggaaaagctgcgagaggagaagaggaaatatgttgagtatctgaaacagtggagcaaacctcgggaggacatggagtgtgacgacctaaaagagctgcctgaacctacccccgtgaaaaccaggctccctccagaaattttcggtgacgcactcatggtgctggagtttctcaacgcgttcggagaactgtttgatctccaggatgagttccctgatggtgtcaccctggaggtcctagaggaagccctggtgggaaatgactccgagggccccctctgcgaacttcttttcttttttctgacagccattttccaagccatagccgaggaggaagaagaagtggctaaagagcagctcactgacgcagacacaaaggatctcactgaagccctggatgaagacgctgacccaacgaaatccgccttgtctgctgttgcctccctggccgctgcatggccccagcttcaccagggatgctcactgaaatccctggacttggattcttgtacactatctgagatactcaggctgcatatcctggcttctggtgcagacgtcacctccgccaacgccaagtatcgctatcagaaacgcggaggcttcgacgccaccgatgatgcctgcatggagttacggctttcaaacccttcactggtcaaaaaattaagcagtaccagtgtgtacgacctcactcccggcgaaaagatgaagatccttcacgcgctgtgtggcaagctgttaactctggtgtctacacgggacttcatagaggactatgtggacatccttagacaggccaaacaggagttccgagaactgaaggccgaacagcatcgcaaagagagggaggaggccgccgcgcgaatacgtaaacggaaagaggagaaactgaaggagcaggagcagaaaatgaaagaaaagcaggagaaactgaaggaggatgaacagcgcaatagcaccgccgatattagtattggagaagaggaacgagaggacttcgatactagcatcgagagcaaagacaccgagcagaaggaactcgaccaagacatggtgacagaggatgaggatgatcccggttcccataagagggggaggcggggcaaaaggggccagaatgggtttaaggagttcaccaggcaggagcagatcaattgtgtcactagagagcctctgacggccgatgaagaggaggccctgaaacaggagcatcaaaggaaagagaaggagctgttagagaaaatccagagtgcaattgcttgtaccaacattttcccactggggagggacagaatgtaccgccggtattggatcttcccaagcatccctggtctgttcattgaagaggattatagcggcctgaccgaggacatgctgctgccccgaccgagttcctttcagaacaacgtgcaaagccaagatccacaggtctccacaaaaactggagagccactgatgtcagaatccacaagcaatatcgaccaggggccccgagatcattccgtgcagttgccaaagccggtccacaaaccaaatagatggtgcttctatagctcctgcgagcaactcgatcagcttattgaggccttgaattcacgggggcatagagagtccgccctcaaggagacactgctgcaggagaaatcacgcatctgcgcccagttagcacgtttttcagaagaaaaattccattttagtgacaagccccagcccgattcaaagcccacatatagcagaggcaggagttccaacgcctatgatccttcgcaaatgtgcgctgaaaaacaacttgagctgaggttgcgcgatttcttgctcgatatcgaagacagaatttaccagggtaccctgggggctataaaagttacagatcggcacatttggagaagcgcgctggaaagcggtcggtacgagttactatcagaggagaacaaggaaaatggtatcataaagacagttaacgaagatgttgaagaaatggagatcgacgaacagacgaaggttattgtgaaggaccgactcctaggcataaaaactgaaaccccttccaccgtgtctactaacgcctccaccccgcagtcggtctcctcggtagtgcactatttggccatggccttgttccaaatcgaacaagggattgagcgtcggttcttgaaagctcccctggacgcttcagactccggccggtcctataagaccgtgctggaccgatggcgtgaatctctgttatcctccgcctccctgtctcaggtgttcttacatctcagcaccctggaccggtcagtaatctggtctaaaagtatcctgaacgctaggtgcaagatttgtcgtaaaaagggcgatgctgaaaacatggtcctgtgtgacgggtgcgacagggggcaccacacatactgcgtccggcctaaactgaagactgtgccggagggggactggttctgcccagaatgccgcccaaagcaacgaagccgacgactttccagtcgtcagcggccttccttggaatctgatgaggacgtggaagattccatgggcggggaagatgatgaggtggacggggatgaagaggaggggcagagcgaggaagaggagtacgaagtcgagcaggatgaagacgacagccaggaagaggaggaagtgtccttacctaaaagaggtagaccacaagttcgactgcctgtgaaaacgagaggaaagctctcatcttctttttcgtcgagaggacaacagcaggaacccgggcgttatccaagtagaagtcagcagtctacccccaagactacagtcagctccaagactgggcgaagcctgcggaaaatcaacagtgcccctcctactgaaaccaagtcattgcgcatcgcctcacgctccacccggcactctcatggacccctgcaggccgatgttttcgttgaattgctgagcccccgccggaagcgacggggtaggaaatctgctaataacacgcccgaaaattccccaaactttccaaattttagggttattgctactaagtcctctgaacagtcacggtcggtcaatatcgcgtctaaactaagtcttcaggagtccgagagcaaacggcgatgccggaaaaggcagtcacctgagccgtcaccagtaactttgggtagacggtccagcggacgtcagggtggtgttcacgaattgagtgcgttcgaacaactagtggtggagttggtgcgacacgatgattcctggccattcctaaaactcgtgagtaaaatccaggtgccggactattacgatatcattaaaaaacctatcgctctgaatataatccgtgagaaagtgaataagtgcgagtacaagctggcatccgaatttatcgatgacattgagttaatgttcagcaattgctttgagtacaatccgaggaatacaagcgaggccaaggccggcacgcgtctgcaggcgttttttcacatccaagcgcaaaagttaggactacacgtgacaccctccaatgtggatcaggtgagtactccgccagccgccaaaaagtcgagaatttag

SEQ ID NO: 180772 - DNA, 3702 bp, Artificial Sequence
  Description of Artificial Sequence: Synthetic coding sequence
atgaagagcctggccttcgagaaggccaagctgaagcgggagaaggcagatgcccttgaggctaaaaaaaaagagaaggaagacaaggagaaaaaacgggaggagctaaagaaaattgtcgaggaggagaggttaaaaaaaaaggaggaaaaggaaaggctcaaggtcgagcgggagaaagagcgcgagaaactccgtgaggagaaacgtaagtatgtggagtatctgaagcagtggtcaaaaccgagagaagacatggagtgtgatgacttgaaggaactgcccgagcctaccccggttaagacgagattacccccagagatctttggcgacgcattgatggtcctagaattcttaaacgccttcggcgagttgtttgacttgcaggatgagttcccagacggtgtcaccctagaggtcttagaagaagccctggtggggaacgatagcgagggtccactttgtgaactcttgtttttctttctaaccgctatttttcaggccatagcagaagaggaagaggaagtggctaaggagcaactgactgacgcagatactaaggggtgttcactcaagagcctggatttggatagttgcacactgtctgagattctcaggctgcacatattggccagcggagccgatgtaactagcgctaacgctaaatatcggtatcagaagagaggcgggtttgacgctacagacgacgcctgcatggaattgcgactctccaatcctagtcttgtgaaaaagctctcatccactagcgtgtacgatctaacccctggagagaaaatgaagatcctgcacgccctatgcggaaaacttctaacactcgtgtccacaagagactttatcgaggactacgtagacatactccgtcaggcaaagcaggaatttagagaactgaaagccgagcagcaccggaaggaacgggaagaggccgccgcccgcatccggaagaggaaagaagaaaagcttaaggagcaggagcaaaaaatgaaagagaagcaggagaagctcaaggaagatgaacagaggaatagcacagcggacatttcaattggtgaggaagaacgtgaagactttgacaccagcatagagtcaaaggacactgaacagaaagagcttgaccaggacatggtgaccgaagacgaggacgaccctggatctcataaacggggccgtcgaggaaagagagggcagaatggattcaaggagtttaccaggcaggagcagataaactgcgtcaccagagagccactgaccgcggatgaagaggaagctctaaagcaggagcaccagcgaaaagagaaagagttgctcgagaaaatccagagcgccatcgcttgcactaatatattcccccttggccgggatagaatgtacagaagatattggatatttccatcgataccagggctatttattgaagaagactactctggcctgacagaagacatgctgcttcccaggccgtcttcctttcaaaacaatgtgcagtctcaggatccccaggtcagcactaaaactggagagccgctcatgtccgaaagcacgtcaaacatcgatcaagggccacgggatcacagtgtacagttgcccaaaccagttcacaagcccaataggtggtgcttctactcatcatgtgagcagctagatcaactgatcgaggccttgaatagccgcggacatcgtgagagcgccctgaaagaaacgctcctgcaggaaaaatccaggatctgtgcccagctggcccgattcagcgaggaaaaatttcacttctctgacaagccgcagccggactcaaaacctacatattccagagggagaagtagcaacgcctatgatccttctcagatgtgcgcagagaaacagcttgaattgcgactgcgcgactttcttctggacattgaagataggatttatcaaggtaccttgggcgcgatcaaggttaccgaccgacacatctggagaagtgcactcgaatctggcagatatgagctgctctctgaggaaaataaggagaacggtataattaaaactgtaaacgaagacgtcgaagaaatggaaattgatgaacagactaaggtgatcgtcaaggatcgtcttctggggattaagaccgaaacaccctccactgttagcacaaatgctagcacaccacaatccgtgtcctctgttgttcactatctcgctatggccctctttcaaatcgaacaggggattgagaggaggttcctcaaggcaccattggatgccagcgattccggccgttcttacaaaacagtacttgacagatggcgagagtccctgcttagctctgcctcgttatcgcaagtgtttctgcacctatcaaccctagatcggagcgtgatctggtctaagtccattcttaatgctcgctgcaaaatttgcagaaagaaaggcgacgcggaaaacatggtgctgtgtgatggttgcgatcgcggccaccacacctactgcgtccgaccaaaactgaagaccgtgcccgaaggcgactggttttgcccggagtgtagaccaaaacaaaggagtcgaagactgtcttctaggcagcgcccctctctggagtccgatgaggatgtcgaggacagcatgggaggcgaggatgatgaggtggacggcgacgaagaagaaggtcagtccgaggaggaagagtacgaagtggagcaagatgaggatgactcacaggaggaagaggaggtctccttgccgaagagagggagacctcaggtccggttgcccgtgaaaactagaggaaaactgagctcatcgtttagcagcaggggacaacagcaagagcccggaagatacccaagccggagccagcaatccacacccaagaccaccgtgtcttctaaaacaggccgatccttgcggaaaatcaactctgctccacccacagagactaaaagtttgagaattgcttcccggtccaccaggcattcacacgggcccctccaagctgatgtgttcgtagaactgttgtcacctcggcgaaagaggcggggacggaaatccgcaaacaacaccccagagaatagtcccaattttcctaactttagagtgattgccacaaagagttccgaacagtctcggagcgtgaacatagcttccaaattgtccttgcaggaatctgagtccaaacgtcggtgtagaaagcggcagtcacccgaaccttctcccgttacgcttggtcgtagaagttctggcagacaagggggtgtacacgaactgagtgcttttgaacaacttgtggtcgagctggtccgccacgatgattcttggccttttttgaaattggtgtccaaaattcaggttcctgactattacgatatcattaaaaaaccaattgctttaaacatcattcgtgagaaagtaaacaaatgcgagtataagctcgcttccgagttcatcgacgacatagaattgatgttctcgaactgtttcgaatataatccccggaacactagcgaggcgaaagctggcacacgccttcaagcgttctttatattccgattgaaatctctggattctacttcacaccccgtcatgtggactaaactggctcaccaccgccttagaaagagccatgagagtgatttcgtgcttctgaaggatatcttcgaagagaagcagatcgtccacgagaatggcacccttaatcacgccgtctag

SEQ ID NO: 180773 - DNA, 4452 bp, Artificial Sequence
  Description of Artificial Sequence: Synthetic coding sequence
atggcccccctgctgggccggaagcccttccccctggtgaagcccctgcccggggaggaacctttgtttaccatcccccacacgcaggaagccttcaggaccagagaggagtatgaagcaaggctggaacggtatagtgagcgtatttggacgtgcaaatctaccggttcctctcagttgacacataaagaagcttgggaggaagaacaagaggtcgcagagcttctcaaggaggagttccctgcttggtatgagaaactggtcctcgaaatggtgcaccacaatactgcctcattggagaaactggtggacactgcctggctggaaatcatgaccaaatacgcggtgggcgaggagtgcgactttgaagtcgggaaagaaaagatgctgaaagtgaagattgttaagattcatccgctagagaaggtagacgaagaagccacagaaaaaaagtctgatggggcttgcgacagcccaagttccgataaagaaaattcaagccagatcgcccaggaccaccagaagaaagaaactgtggttaaggaggacgagggcagaagagagtccatcaatgaccgcgctaggcgcagtccgcgcaaactcccaacatccctgaaaaaaggggaacggaagtgggcaccgccaaaatttctccctcataaatacgatgtaaaactacagaatgaagataaaataatctcaaacgttccagccgattccctgatcagaactgaacgtcctcccaataaagaaatcgtgcgctattttattagacacaacgctcttcgggccgggacaggggaaaatgcaccttgggtcgtggaggacgagctggtaaagaaatactccctgccatctaagttcagtgactttttactcgatccctataagtatatgacactcaaccctagcaccaagcgaaaaaatactggatcccctgatcggaagccaagtaagaagagtaaaacggacaactcgtcccttagctccccgctcaaccccaaactttggtgtcatgtgcacctgaaaaaatcactcagcggctcacccctcaaagtgaaaaattccaaaaattcaaagtcacccgaggagcacttagaagaaatgatgaagatgatgtctcccaacaagcttcacaccaacttccacatcccaaagaaaggcccgcctgccaagaaacctggcaaacatagtgataagcctctgaaagccaagggaagatcaaaggggatcctgaacggtcagaagtccaccggaaactccaaatctccaaagaagggcctcaagacgccaaagactaaaatgaagcaaatgaccctgctcgatatggcaaaaggtacacagaagatgacccgggcaccccgaaactctggcggaacccctcggacctcaagtaaaccccataaacatcttcctcctgcggctctacatctgatcgcctactataaagagaataaggacagggaggacaagaggagcgctctaagctgtgtcattagtaaaacggcaagactcctttcctcagaagaccgcgcccggctccccgaggagctgcgctcactggtacaaaaaagatatgagctgctggagcacaagaagaggtgggccagcatgtcagaagaacagaggaaggaatacctcaagaaaaagagggaggaactgaagaagaaactgaaggagaaggccaaggaacgcagagaaaaggagatgctcgagcgattggagaagcagaagcggtatgaggaccaggagctcaccggtaaaaacctcccagcttttcgtttggtggatacaccagaggggctcccgaacaccctcttcggcgatgtggccatggtggtggaattccttagctgttactctggactgctgctcccagacgctcaatacccgattactgcagtttctcttatggaggccctgtccgcggataagggcgggtttttataccttaacagggtgttggtcattctgctccagactttacttcaggatgaaatcgccgaggactacggagaactagggatgaaactcagtgagattcccctaacactacacagtgtatccgagttggtacgcctgtgcctgagacgctcggacgtgcaggaggagagcgagggctctgacaccgacgacaataaggacagcgctgccttcgaggataacgaggtgcaggacgagttcctggaaaagctcgagaccagtgaattcttcgagttgacatccgaggagaagctgcagattttgactgctctctgtcacaggatcctcatgacctactccgtacaggatcatatggaaacccgacaacagatgagcgccgagctttggaaagagagactagcggttttgaaagaggaaaacgataagaagagggcggagaagcagaaacggaaggaaatggaggcgaagaacaaagagaacggcaaagtggaaaatgggctaggtaaaaccgatcgcaagaaggagattgtgaaattcgaaccacaagttgacactgaggccgaagatatgatctctgcggtcaaatcaagacgtctgcttgctatacaagccaagaaagaacgcgagattcaagagcgagaaatgaaggtgaaactggagcggcaggccgaggaagaaaggattcgaaagcacaaagctgccgctgagaaggcctttcaggaaggtattgccaaggcaaagctggtgatgcgcagaacacctatcggtactgaccggaatcacaaccgctactggttgttcagtgacgaagtccccgggctatttattgagaaggggtgggttcacgatagtatcgattatagatttaaccaccattgcaaagaccacaccgtgtcaggagatgaggactactgccctcgatcaaaaaaggctaatttagggaagaatgcgtctatgaatactcagcatggaaccgccaccgaggttgcagtggagacaacaacgcctaaacaaggccagaatctctggtttctgtgtgactctcaaaaagagctagacgaactgctaaactgtctccaccctcagggaattcgcgaatcacaactcaaggagcggcttgaaaaaagatatcaggacatcatccattccatacacctcgcccgaaaacccaaccttggcttgaagtcctgtgatggcaatcaggaattactaaatttcctcaggtctgacctcatcgaagtcgccacccggctacagaagggtggtctcggttatgttgaagaaacttccgaattcgaagcgcgagtcataagcctggaaaagcttaaagactttggtgagtgtgtgattgccctgcaagcctcagtgattaagaagttcctccagggcttcatggcaccgaagcagaagcgccgcaagctgcagtctgaagattcagcaaaaactgaagaagtggatgaagagaaaaaaatggtggaagaagccaaagttgctagcgcgttggagaagtggaagactgccatcagggaagcccagacgttcagtcggatgcacgtcttgcttgggatgctggacgcctgtattaagtgggacatgagtgcagagaacgcccggtgcaaggtgtgtcggaaaaaaggtgaggacgataaactcatcctctgcgatgagtgtaacaaagctttccacctgttctgccttcggccagctctctacgaggtaccagacggggagtggcaatgtcctgcttgtcagcccgctacagctaggaggaacagtagggggagaaattacaccgaggagagtgcctcggaggactcagaagatgatgaatctgatgaggaggaagaagaagaggaggaggaggaggaagaagaggattatgaagtggccggtctgaggctgcgcccgaggaagactatcagaggcaagcatagcgtgatccctcctgcagcccgtagtggtcgtcggcctgggaagaaaccacactcaacgcgtcgttcccagccaaaggccccccctgtggatgacgcagaggttgacgagctcgtcctgcagacaaaaagaagcagcagaaggcaaagtcttgagctccagaagtgcgaagagatcctgcacaagatcgtcaagtaccgattctcatggccattcagagaaccagttaccagagatgaagccgaagactactatgatgtgattactcaccctatggactttcagacagtgcagaacaaatgctcttgtgggagctaccggtccgtccaagaattcctgactgacatgaagcaggtgtttacgaatgcagaagtctacaattgtagaggctcacacgttctatcttgtatggtgaagaccgaacagtgcctcgtggctctgctgcataaacacttgccaggacacccatatgtgcgacgaaagcgaaagaaattcccagaccgactcgccgaggatgagggtgacagcgaacccgaggccgttggccagtcacgcggcagacggcagaagaagtag

SEQ ID NO: 180774 - DNA, 4452 bp, Artificial Sequence
  Description of Artificial Sequence: Synthetic coding sequence
atggcccccctgctgggccggaagcccttccccctggtgaagcccctacctggagaagaacccctattcacaatcccacacacccaagaggccttccggacacgtgaagaatatgaggccagactggagcgatattcggagaggatctggacctgtaaatccaccggaagctcacagctaacacacaaggaggcttgggaagaggagcaggaggtcgccgagctgctgaaggaagagttccccgcctggtatgagaaacttgtgctcgaaatggtacaccacaatacggcctctttggagaaactagttgacacggcctggctggaaatcatgaccaagtacgccgttggcgaggaatgtgacttcgaggtgggaaaggagaagatgttgaaggtaaaaattgtgaagatacatcccctcgaaaaagtggacgaggaagccaccgagaagaaatctgacggcgcttgcgacagtccgtcttccgacaaggagaatagcagccaaatcgcgcaggaccatcagaagaaagagaccgtggtgaaggaagatgaaggccggcgggagtccatcaacgacagagccaggcggagccctaggaaactgcccacgagcctcaaaaagggggaacgcaagtgggctccccccaagttcctccctcacaagtatgacgtcaagttgcagaatgaggacaagattatttcgaatgttcccgctgactccttaattagaacagagcgacctccaaacaaagaaatcgttcggtatttcatccggcataatgctctgcgagccggaacaggcgaaaacgcgccatgggtggtagaggatgagcttgtgaagaaatattccctccctagtaagttttccgactttctattggatccctataaatatatgacactcaatccatccaccaagcgaaaaaatactggatcgcctgatagaaagccaagcaagaagtcaaagaccgacaattcctccctgagctcaccgctcaatcccaagctatggtgccacgtccacctgaagaaatctctttcgggatctccactgaaggttaaaaactcaaagaattcaaaatccccagaggagcatctagaggagatgatgaagatgatgtctccaaacaagctccacaccaatttccacatccccaagaaaggcccccccgccaagaagcccggtaaacacagcgataaaccgctgaaggccaaagggaggagcaaaggtatccttaacggccagaaaagcacagggaattctaaatcacccaaaaaggggctgaagacccccaagaccaaaatgaagcaaatgacattactcgacatggccaagggtacacaaaagatgacgcgggccccccgcaactccggtgggacacccaggactagttcgaaaccacacaaacacctaccccctgctgccttacatttgatcgcatactataaggagaataaagacagagaggataagcgcagtgcgctcagctgtgtcatctccaagactgcgcggcttttgtcttcagaggaccgtgcccggctccccgaggagcttcgcagtctcgtccagaagcggtatgagctcctcgagcataagaaaaggtgggcaagcatgtctgaagaacagcgcaaggagtacctaaagaagaagagagaggagctcaagaaaaaattaaaagagaaggcgaaagagcggagagaaaaggagatgttggagaggctggagaagcaaaaacggtacgaggaccaagaactgaccggtaaaaatctgcccgctttccggctagtcgatacgcctgaagggctccccaacacgctgtttggtgatgtggctatggtggtcgaatttctgtcgtgctactccggactgttactacccgacgcccagtacccaataacagccgtttccttgatggaggcgctgagcgccgataagggaggatttctttacttgaatagggtgcttgtgatcttgttgcagacactactgcaggatgagatcgctgaggactatggggagttaggtatgaaactgtccgagatccctctgactcttcattcggtgagtgagctggtgaggttatgtttaagacgcagtgatgtccaggaggagtctgaaggctccgataccgacgacaacaaagattctgcagctttcgaggataacgaggtgcaagatgaattcctggaaaagcttgagaccagcgaattctttgagctgacatcagaggaaaagttgcagattctgaccgccctgtgtcacaggatactgatgacctactcagttcaggaccacatggagactaggcagcaaatgagcgccgagctctggaaagaacggctcgccgtactgaaggaggaaaacgataagaaacgcgccgagaaacaaaaaagaaaagaaatggaggcaaaaaacaaagagaacgggaaagtggaaaatggcctcggcaagacagacagaaaaaaagagatcgtgaaatttgagccccaggtcgacactgaggctgaagatatgatcagtgccgttaagagcagaaggttacttgccatacaagccaaaaaggaaagagaaatccaggaaagagaaatgaaggtcaaactcgagcgccaggccgaagaggagagaattcgcaaacataaagccgccgctgagaaagcgttccaagagggtatcgccaaggcaaaattagtaatgcgccgcactcccatcggaactgaccgcaaccataatagatactggctgttttctgacgaagtgccagggttgttcattgagaagggttgggtgcacgacagtatagactatcggttcaaccatcactgcaaggaccatacagtctcgggagacgaggattactgcccaaggagtaaaaaagcgaacctaggcaaaaacgccagtatgaacacgcagcacggcaccgccacagaggtggccgtggaaacaacaaccccaaagcagggccagaatttgtggttcctgtgcgacagccaaaaggaactcgatgaactccttaattgcctccaccctcaggggatcagagaatctcaactcaaagagaggcttgaaaaaagatatcaagacatcattcacagcatccacctggcccggaagccaaacctggggctaaagtcttgcgatggtaatcaagaactgctgaactttctccggagtgacttgatagaggtggcaaccaggttgcagaaggggggactaggatacgtcgaggagaccagcgagtttgaggctagggtgatctccctggagaagttgaaggacttcggagagtgtgtaattgccctgcaggccagtgtgataaaaaaatttctccaggggttcatggcccctaaacagaaacggaggaaattgcaatccgaggattcagccaagactgaggaggttgacgaggagaagaaaatggtcgaagaggctaaagtagcaagcgccctggagaagtggaagacagcgattagggaagctcagacgttcagtcgcatgcacgttctactgggcatgttagacgcctgcatcaagtgggacatgtctgcagagaatgccaggtgcaaagtgtgtaggaagaagggggaagatgataagttgattctgtgtgatgaatgcaacaaagcgttccaccttttctgcctacgcccagccctttacgaggtgcccgacggggagtggcagtgccccgcctgtcagcctgctaccgcccggagaaacagtcgaggccgcaattacacagaggagtccgctagtgaagactccgaagacgatgagtccgatgaggaagaagaggaagaggaagaggaggaggaggaggaagattatgaggtggccggactgaggctgaggcccagaaagacgataagaggcaaacatagtgttattcctcccgccgcgagatctggtcgacgcccgggaaagaagcctcattccacacggagaagtcagcctaaggctccacctgtggacgatgcagaagtggacgagctggttttgcaaacaaagagaagcagcaggcggcagtcacttgagcttcagaagtgtgaggaaatactgcacaaaatcgtaaagtacaggttttcgtggccctttagggaacccgtcacgagagacgaggcagaagattactacgacgtaattacccaccctatggattttcagaccgttcaaaacaagtgttcatgtgggagttacagaagcgtccaggagttcctcactgacatgaagcaggtgttcactaacgctgaggtgtataattgcaggggttctcacgttttgagctgtatggtcaagactgagcagtgcctggtggcgctcctccataaacatctgcccggccatccttatgtgaggagaaaacgtaagaagttcccagatagactggccgaggatgaaggcgatagcgagccagaggctgtgggccagtccaggggcaggcgacagaagaagtag

SEQ ID NO: 180775 - DNA, 5622 bp, Artificial Sequence
  Description of Artificial Sequence: Synthetic coding sequence
atggaggccaacgaccacttcaacttcaccggcctgccccccgcccctgccgcttcaggcctcaaaccttccccttcaagcggcgagggtttgtatacaaacgggagcccaatgaattttcctcaacaaggtaagagcctgaatggggacgtaaatgtgaatggcctctctacagtgtcccacacaaccaccagtggaatcctaaattctgcacctcactccagttcaacatcccatctgcaccatccttcggtggcttacgactgcctgtggaactattcacagtaccccagtgccaaccccgggagcaatttaaaggatccccccctcttgtctcagttttccgggggccagtaccccctgaacgggattctgggaggtagccgtcagccgtcatcaccctcacacaacacaaacctcagggccggttcccaggagttctgggctaacggaacccaaagtcctatgggcctgaattttgattctcaggagttgtacgacagctttccagatcagaactttgaggaggtgggaagcggcatccacccagacgaggcggccgaaaaggagatgacgtccgtggtggccgaaaacggtacaggtctcgtggggtccctcgaactagaggaggagcagccagaacttaaaatgtgcgggtataacggatcagtccccagcgttgagagtctccaccaggaggtctctgtgctcgtacccgacccaaccgtaagctgtctagatgatccttctcacctgcccgaccagcttgaggacacccccatcctcagcgaagatagtctagagccttttaattcactcgccccagagccagtgtcgggggggctgtatggaattgatgataccgagttaatgggtgctgaggacaaattgccgctggaggatagtccggtcatcagcgcgctcgactgtccatctttaaataatgccaccgcattcagtctgctggccgacgattctcagacaagtacctcaatcttcgcctctcctaccagccccccagtgctgggtgaatctgttttgcaggacaactcctttgacctcaataatggaagcgacgctgaacaggaagagatggagacacaaagttctgatttcccaccatctctgactcagccagcccccgaccagtcttccacaatccaactgcatccagcaacctcgcccgcagtgagccccactaccagccctgccgtgagcctggtggttagcccggctgcatcacctgagatatctcctgaggtttgccctgccgcttctactgtggtttctcccgccgtgttttccgttgtatctccagcttcctccgcggtattgccagccgtttcgctggaagtccccctaaccgcatccgtcacatctcctaaggcttcccctgtaacaagtccagctgccgctttccctactgcctcgcccgctaataaggacgtatcttcctttctggaaaccactgccgacgtcgaggagatcacaggagagggcctcacagcctcagggagcggagacgtgatgcgccgtaggatcgctacgcctgaagaggtgagattacctttgcagcatggctggcggcgggaggtcagaattaaaaaagggtcacacaggtggcagggcgaaacctggtactacggcccatgcgggaaaagaatgaaacagtttcctgaggtaatcaaatatctgtcaagaaacgtggtccacagcgtaagaagagagcacttttcatttagcccccgtatgcccgtgggagacttcttcgaggaaagagatacgcccgaggggctccaatgggtccagctttccgcagaggagatcccatcccgaattcaagcaataactggcaaacgtgggagacctaggaacaccgagaaggcaaaaactaaggaggtgccaaaggtgaagagagggcggggccgaccgcccaaggtcaaaataaccgagctgctgaataaaaccgataaccgtccacttaaaaaactggaagcacaggaaacactgaatgaggaagacaaggccaagattgcaaaaagcaagaaaaagatgagacagaaggtgcagcgtggggagtgccagacgaccatccaaggtcaggctaggaataaaaggaagcaggagactaagagcctgaagcagaaagaggcgaaaaagaaatccaaggccgagaaagaaaaagggaagactaaacaggagaagctgaaagagaaggtgaagcgggaaaagaaagagaaggtaaaaatgaaagagaaggaggaggtcaccaaggctaagcccgcctgcaaagctgataagactctggcaacgcaacggaggctagaagagcgccagcgtcagcagatgatactcgaagaaatgaaaaagcccacagaagacatgtgcctgactgatcaccagccactgccagatttttcgagggttcctggcctgacgctgcccagcggagcattctccgactgcttgacgattgtggagtttctgcacagttttgggaaggtactgggcttcgatcctgccaaggacgttccgagcttgggagtgctccaggaggggctactgtgtcagggggactccttaggtgaggtgcaggatttgctggttcgcctcttgaaggcagcccttcatgatcccggatttccttcttactgccaatcccttaagattctgggagaaaaggtgtcagagatcccactgacgcgggacaatgttagcgaaatactgagatgctttttaatggcctatggagtcgagcccgccttgtgcgatcgcttaaggacccagccttttcaggctcagccgccgcagcaaaaagctgctgtcctggctttcttggtccatgagctaaacgggtcaaccttgattatcaacgagattgataagaccctggagagcatgagtagttaccggaaaaacaaatggattgtcgaaggacgtcttcgtcgcctcaaaacggtactcgccaagcggacaggtaggtctgaagtcgagatggaggggcccgaagaatgtctcggccgaagacgttcgtcccggataatggaggagacgtccggaatggaggaggaggaggaggaggaatccatcgccgcagtgccgggacgaagggggagacgtgacggagaagtagacgcgacggcctcaagcataccagaactggagcggcagattgaaaagcttagcaaaaggcagctgttttttagaaaaaaactcctccattcgtcgcagatgctacgcgccgtctcgctcggccaagatagataccggcggcggtactgggtgctcccctatctggctggcatctttgtggaaggtacggagggcaatctggtaccagaggaagtgatcaagaaggaaactgactctctgaaagttgccgcacacgccagcctgaatcccgcccttttttcgatgaagatggaattggcaggcagtaataccacagcatcaagcccggcgcgtgctcgtggtcgaccccgaaaaacaaagccagggtctatgcagccccggcatcttaaaagtcctgttaggggacaggactcagagcagcctcaggcccaactgcagccggaagctcagctgcacgcgccagcccagccccagccccagctgcagctgcagctgcagagccataagggttttctggagcaggagggaagcccactgagtctaggacagagtcaacacgacttatctcagtccgccttcctgtcctggctctcccagactcagtcgcactcctcccttctgagcagcagtgttttaactcctgattcatcccccggaaagttggacccggctccctctcaaccacctgaggaacccgaacccgatgaggctgaaagttctccagacccccaggcgctctggtttaacatttcagcccagatgccatgtaatgctgccccgacacccccaccagctgtgtctgaggaccagcccactccatctccccagcagctggcctcatctaaaccaatgaaccggccttcagccgcaaatccctgctccccggtgcagtttagttctacaccactagctggactcgcaccaaagaggagggcaggggatcctggcgaaatgccccagtctcccactggtttggggcagcctaagcggcgggggaggcctcccagcaagttttttaaacagatggaacagagatatttgacccagctgaccgcccagccagttcccccagaaatgtgttccgggtggtggtggatacgggacccagaaatgctcgacgcaatgttgaaggccctgcacccccgcggtattagagaaaaggccttacacaaacacctgaacaagcatcgcgacttcctgcaggaggtctgtttgcggccctctgcggatccaatctttgagccacgccagctgcccgcgtttcaagagggcattatgagttggtccccaaaggagaagacatacgaaacagacctcgctgtccttcaatgggtagaagaactcgagcagcgtgtcataatgtctgatctccagatacgcggatggacctgtccatccccagatagcaccagagaggacttggcctattgcgagcacctctctgacagccaagaagacatcacatggaggggtcgaggcagggaggggctagccccccagagaaaaacaacgaaccctctggacctcgccgtgatgaggcttgcagcgcttgaacagaatgtggaaagacgctacctgagggagcccctgtggcccactcatgaagtggttcttgaaaaggctctgctgtctacccctaatggggccccagagggaaccacaaccgaaatcagttacgagatcacaccccgaatcagagtttggcgacagaccctggagcggtgccgtagtgcggcgcaggtttgcctttgcctgggccagctcgagcgatcaatcgcgtgggagaagtccgtcaataaagtgacgtgtctggtctgtcggaagggagataacgatgaattcctcctgctgtgtgatggctgcgacaggggttgccacatatactgtcacaggcctaagatggaggcagttcctgaaggagactggttttgcactgtgtgccttgcgcagcaggtcgaaggggaatttactcagaaaccgggctttccaaaacggggccagaaaagaaaatctgggtatagtcttaatttttctgaaggagatgggcgccggcgtagggttcttctgaggggacgtgagtcacccgcggccggaccccgttattccgaggagggcctcagcccatccaaaaggagacgcctgagcatgagaaaccaccactctgacctgacattctgtgagattattcttatggagatggaaagccatgatgctgcttggccttttctggaaccagtgaaccccagactcgtgtctggttacaggcggataattaagaatcccatggacttctccactatgagggaaagattgttaaggggcgggtacacatctagtgaagagtttgctgccgacgcccttctcgtctttgataactgtcagacatttaacgaggacgacagcgaggtggggaaggcaggacacattatgagaagattttttgaatctcgctgggaagaattttatcagggaaagcaggcaaatctctag

SEQ ID NO: 180776 - DNA, 2514 bp, Artificial Sequence
  Description of Artificial Sequence: Synthetic coding sequence
gtgcccggccggcggggccggcgggacggcgaggtggacgccaccgcctctagcatacccgaactcgaacgtcagatcgagaaactctcaaagcgccagctgttttttagaaaaaagcttctccactcttcccagatgttgagagcagtgagcttgggccaggacaggtaccgccggagatactgggttctgccctacctagctggcatttttgtcgagggaacagaaggaaacctagtacctgaggaagtgattaagaaagaaacggatagcctgaaggtggctgcccacgcctctttaaatccagctctcttctcaatgaagatggagttagcaggctcaaacactactgcctccagcccagctagagctcgtggtcgcccccgcaagactaaacctggtagcatgcagccacgacatctgaaatccccagtgcgcggccaggattctgagcagccccaggcccaactccaacctgaggcccagctgcatgcccctgcccaaccacagcctcagcttcaactgcagctgcaaagtcacaagggatttctcgagcaggaggggagtcctctctctttagggcagagccagcacgatctgtcacaaagcgcgttcctgtcttggctgtctcaaactcagagccacagctcactcttaagttcaagtgtactgacgccggacagcagcccaggcaagttggatcccgccccttcccagcctcccgaggaaccagaacctgatgaggctgagagtagccctgacccacaggccctgtggttcaacatctctgcccaaatgccgtgcaatgccgctccaacaccacccccagctgtgagcgaagatcagcccacccctagcccacagcagctggcatcttctaagcccatgaaccggcccagcgcggccaacccatgcagccccgtgcagttctcgtcaacccctctggctggcctcgcgccaaaaaggagggcaggtgaccccggggagatgcctcagagcccaacaggtttagggcaacccaagaggaggggacgccccccttccaaatttttcaaacagatggaacaaagatatctgacccagttaactgcccaacccgtcccccctgggtggtggtggattcgggaccccgagatgctagacgctatgctcaaggccctccacccccgaggcattagagagaaggccctgcataagcacctcaacaaacacagagattttctgcaggaggtctgtctccgacccagcgcagaccctatcttcgaacctcgacaactgcctgcttttcaggaaggtattatgtcttggtcaccaaaagaaaaaacatacgagactgatctggcagtccttcaatgggtcgaagagctcgaacagagagttatcatgagtgatctacaaataagaggatggacctgcccctcgccagacagtacccgagaagacctagcatactgcgaacatctcagtgactctcaggaggacatcacctggagaggcaggggacgcgagggactggccccccagaggaagactacgaaccccctcgaccttgccgtgatgaggctggccgctcttgagcagaacgtggagaggcggtacctgcgggagcccctttggcccacacacgaggtggttctggagaaagccctgctgtccacaccaaatggagcaccggaagggaccaccacagagatttcgtatgaaatcactccgcggatcagagtgtggcggcagaccttggaaaggtgtagaagcgcagcccaggtctgcctctgtctgggccaattggagaggtcgatcgcctgggagaagagtgtgaataaagtcacctgtttggtgtgtcgtaaaggggataacgacgagttcctgttgctgtgtgacgggtgtgaccgagggtgtcacatttactgtcatagacctaaaatggaagccgtgcctgagggcgattggttctgcaccgtgtgcctggcccaacaggtggagggggagtttacacagaagcccggctttccaaagcgcgggcagaagagaaaatccggctattcactgaacttttctgaaggtgacgggcggcgcagacgggttctcctcaggggccgcgagtcacccgccgcagggccacgttactcggaagagggactaagcccttcaaagcggcgccgactcagcatgagaaaccaccacagcgacctgacattctgtgagattatcctcatggagatggagtctcatgacgccgcatggcccttcctcgaaccggttaaccctcgcctcgttagcggctacagaagaatcatcaagaatcccatggatttttccacaatgcgtgaacggctccttagagggggatataccagctctgaagaatttgccgcggacgctctcctggtctttgacaactgtcagaccttcaatgaagatgactccgaggtaggaaaggccggacatatcatgcgccgttttttcgaatccaggtgggaggagttttaccaggggaagcaagccaacctctag

SEQ ID NO: 180777 - DNA, 5718 bp, Artificial Sequence
  Description of Artificial Sequence: Synthetic coding sequence
atggagatggaggccaacgaccacttcaacttcaccggcctgccccctgcaccagctgcttccggcttgaaaccctctccatctagtggagagggtttgtacaccaacggtagcccgatgaactttccccagcagggtaagtccttgaacggggacgttaacgtgaatggcttgtcaaccgttagccatacaactaccagcggcattctgaactcagctccccactcgagtagcacgtcacaccttcaccatccaagcgtcgcctacgattgcctttggaattactctcagtacccttccgccaaccccggatctaacttgaaggaccctccactgttatcccaattctcaggaggtcagtaccctcttaacgggatccttggagggtccaggcaacctagttcacctagccacaacacaaacctccgcgcaggctcccaggagttttgggcgaacggtactcagagcccaatgggacttaatttcgattcacaggagctctatgatagcttcccagaccagaatttcgaagtcatgccaaacggtccaccgtcattctttacgagtcctcagacctccccaatgcttggctcgagtattcagacttttgcaccgtcacaagaggtcgggtccgggattcacccagacgaagctgctgaaaaggagatgacatctgtggttgctgaaaacggcacgggcctggtcggtagcctggagctagaagaagaacaacctgagctcaagatgtgcgggtataatggctcggttccctccgttgagtctttgcaccaggaggtttctgtcctggtccctgatccaaccgtgtcctgtctggatgacccttcacacctgcccgatcagctggaggacactcctatcctcagcgaagatagcctcgagccattcaactcactagcccccgaaccagtcagcggaggactgtacggaatcgatgacaccgaactgatgggggccgaggataagttgcctctggaggattcccctgtgattagcgcgctagactgcccttcactaaataatgccactgcattctcactgctggctgacgatagtcagacttcgacgtccatctttgcctcacctacctctcctcccgtacttggggaatcagtgttgcaggacaacagctttgatctaaacaatggatcagacgccgaacaagaagaaatggagacccagtcatctgacttccctcccagcttaacccagcctgcccccgaccagagtagtaccattcaacttcatcctgcgacctcccctgcagtgtcacctactacctctccagctgtcagtctcgtcgttagccctgccgcctcaccagagattagcccggaggtttgcccagccgcttctaccgttgtgtcacccgcggtgttttctgtggtaagtcctgcatcttccgccgtgctcccagcggtgtctttggaggttcctctgacagcctcagtgacctctcctaaagcctctcccgtgacgtccccagccgctgcattcccgacagctagtccagcaaacaaagacgtgagtagcttccttgagaccaccgctgatgtagaggagatcactggtgaaggcctcacagcctcgggatccggagacgtcatgcgccggcgcatcgccacacccgaggaagtgcggttgcccctgcagcatggttggcgacgggaggtgcgtatcaagaaggggagtcacaggtggcagggcgagacgtggtactatgggccttgcgggaaacggatgaagcagttcccagaagtcatcaagtatctgtcacgaaacgtcgtacactccgtgcggcgcgagcacttctctttcagtcccagaatgccagtgggggacttctttgaagagagagatacccccgaaggtctgcaatgggttcaactgtctgccgaggaaatcccaagccgtatacaggctataaccggaaagaggggccggcccaggaatacagagaaagctaaaacaaaggaagtgcctaaggtgaagcgtgggcgcgggcgaccaccaaaggtgaagatcacagaacttctgaataaaaccgacaacaggccccttaaaaagctggaggcccaggaaacactcaacgaagaagataaggccaagatagccaaaagtaagaagaaaatgcgacagaaggtgcagagaggggagtgccagactacaatccaggggcaggcacgtaacaaaagaaaacaggaaacaaaatcacttaagcaaaaggaggcaaagaagaaatcgaaagcagaaaaggagaagggcaagacaaagcaggagaaattaaaggagaaggtgaagagagaaaaaaaagaaaaggtgaaaatgaaagagaaagaggaagttacaaaagcaaaacctgcgtgtaaagccgacaaaaccctggccacgcaaagaaggctcgaggagcgacagcggcagcagatgattctcgaggagatgaagaaaccgaccgaggatatgtgcctgactgatcaccagccacttcccgacttctcccgtgtacccggcctgaccctcccaagcggagccttctctgattgtctcacaattgttgaattcctgcattccttcggcaaagtattgggatttgatccagccaaggatgtgccgtccctgggcgtcctccaggaggggcttctctgccaaggcgactcactgggcgaagtgcaagacctactcgtgcggcttctaaaagcagctctgcatgaccccggctttcccagttattgccaaagtcttaagatcctgggagagaaagttagcgagatccctttaacgcgggacaatgtgtctgagattctgagatgcttcctcatggcctatggggtggaacccgccttatgcgaccgcttacgcacccaaccatttcaggctcagccacctcagcagaaggccgcagtgctcgctttcttagtccatgaactcaatggaagtaccctcattattaacgagattgataaaacgctggaaagcatgtcctcataccgaaagaataagtggatcgttgagggacgcctcagaaggctgaaaaccgttctggccaagaggactggtaggtctgaagtggagatggaagggccggaggaatgtctcggaagaaggcggtcttcacgtattatggaggagacatccgggatggaggaagaggaagaggaggagtccatcgcagctgtccccgggcgccgagggcggcgggacggagaagtggatgccacagcgtctagtatccctgagctggaacgacaaatcgagaagctctccaagcgtcagctgtttttccgaaagaagctattgcattctagccagatgctgcgggcagtgagtctggggcaagaccgatataggcgtcgctattgggtccttccatatcttgccgggatattcgtggagggcacagagggcaatctggttcctgaagaggtgatcaagaaagagacggattcactcaaagtggctgcccacgcctcgcttaacccggctctgttcagcatgaagatggagctggccggctcgaacactacagctagctcccccgccagggcacggggtcggcctagaaagacaaagccaggttccatgcagccccggcacctgaagtctccagtccgcggccaggattctgagcagcctcaggctcagttgcaacctgaagcccagttgcacgctcccgcacagccacagccgcagctgcagttacaattacagtcccacaagggctttttggaacaagagggctcgcctctttctctgggtcaatcgcaacacgatctgtcacagtccgctttcctgagctggctctctcagacacagtctcactccagtttgctgagttcgagcgtgctgacaccagacagcagccctggcaagctcgaccccgctccatcgcagcctcctgaggagccggagcccgatgaagctgagagcagtcccgacccccaggcattgtggtttaacatatcagctcagatgccttgtaatgctgcaccaacccctccacccgccgtgtcagaggaccaaccaacaccctccccccagcagctggcttcttctaagcccatgaaccggccatctgccgctaacccctgctcccccgtgcaattcagctcaacacctctggcaggacttgcacccaagcgtagagcgggggatcccggtgagatgcctcagtcacccacaggacttggccagcccaaacggaggggcaggccgcctagcaaattcttcaagcagatggagcagcggtatctaacacagctgacagcccagccggtgcccccagaaatgtgctctggatggtggtggatccgcgatcccgaaatgctggatgctatgttaaaagccttacacccacgagggatccgggagaaagctcttcataagcatttgaataaacatcgggacttcttgcaagaggtatgcttgcgcccaagcgcagaccccatattcgaaccccgtcagctccctgctttccaggagggaattatgtcatggtctccgaaggagaaaacatatgagactgacctggccgtgctccaatgggtcgaggaacttgaacaaagggtgattatgagcgacctgcagattaggggttggacttgcccctcccctgatagcacaagggaggatcttgcatactgtgagcacctgagcgattcccaagaggacatcacctggcgtggccgggggcgagaaggcttggcaccgcagagaaaaactacgaatccactggacctggctgtcatgcggctcgccgctttagaacagaatgtggagaggcggtacttgcgcgagcccttgtggcccacgcatgaggttgtgctcgagaaagcattattaagcactcctaatggtgcaccagagggcactaccacagagatcagctatgagataaccccaaggatacgagtgtggaggcagacactcgagcgatgtagatctgccgcacaggtctgtctttgccttggccagttagaacgctcaatagcctgggagaagagcgtcaacaaggtcacatgtctggtctgtaggaaaggagacaacgatgagtttcttctgttgtgtgatggatgtgacagaggatgccatatctattgccacaggcctaaaatggaggctgttcccgaaggcgattggttctgcactgtttgcttagctcagcaggtggaaggcgaatttacccaaaagccgggcttccccaagagagggcagaaaagaaaatctggctacagcctgaatttttcggagggggatggccgtcgaagaagggttctgcttaggggtagagagagccctgccgctggacctaggtacagtgaggaaggtttgtcaccctccaagaggaggcggctgtccatgagaaatcaccactctgatctgaccttttgcgagataatcctgatggagatggagtctcacgacgcggcatggccttttttagagcctgttaatccacgtctcgtctccggatataggcgcatcataaagaacccaatggacttttcaactatgagggagcgcctgttaaggggcgggtacacttcctcagaggaatttgccgccgatgctctgttggtatttgataactgccagacattcaatgaggacgatagcgaagtcggcaaggcaggccacattatgaggagatttttcgaaagtagatgggaagagttctatcaaggaaagcaagccaacctgtag

SEQ ID NO: 180778 - DNA, 6207 bp, Artificial Sequence
  Description of Artificial Sequence: Synthetic coding sequence
atggagagcggcgagcggctgcccagcagcgccgccagcagcaccaccccaacttcatcttctactcccagcgtcgcatctgtggtctctaagggcgggctatcaactggtgtggcttctttgtcctcaaccattaacccgtgcgggcacctcttcagaactgcaggagatcaaccttttaatctctccacagtgagttccgccttcccaatggtgtcccaccccgtgttcggcctgcattccgcgtcctctggccactcggagtttggcggcctgggaacgctggggaccccgactgctttggctgcgcatccccaattggcttcgttccccgaatggtggagaacgactgatgcacatacgagaacgggagcaaccttcttcccgccactcctcgggatacctccactgttcgctccccccgcgcaaaatcacgacagtagcagcttccactccaggacctcgggtaagtccaatagaaatggaccagaaaaaggggtgaacggcagcatcaatgggagcaacactagctctgtcattggcatcaatacgtcggtgctgtctacaaccgcctcaagttcgatgggacagactaaaagcacctccagtggcggcggcaacagaaagtgcaatcaggagcaaagcaagaatcagcccttagatgcccgggtggataagattaaggacaagaagcccagaaaaaaggccatggagagcagttccaattcagactccgatagtgggaccagcagtgacacaagttccgagggtatctcaagttctgactcagacgacctcgaggaagacgaggaggaagaagaccagtctattgaggagtctgaagatgacgacagtgatagtgaatcggaggcacagcataaaagcaataatcaggtgctcctgcatggaatatccgatcctaaagctgatggacagaaagcaacagagaaggcacaggagaaacggatacaccagcccctgccgctggccagcgagtctcagactcacagttttcagtcccagcaaaaacagcctcaggttctctcccaacagcttccttttatctttcaatccagccaagcaaaagaggagtctgttaataagcatactagcgtgatccagtcgacaggtttagttagtaatgtcaaaccactgtcattagtgaatcaggctaagaaggagacttatatgaagctgattgtgcccagtccagatgtattaaaagcaggcaacaagaacacttcggaagaatcttccctattaaccagcgagttaaggtcgaaacgagaacagtataaacaggcgttcccaagccagctcaaaaaacaagaatccagcaaatctctgaagaaagtgatagctgcactgagcaacccaaaggctacctcttcctcccctgctcatcccaagcagaccctggagaacaaccatccaaacccattcttgacaaacgctttgctcggaaaccaccagcctaatggagtgatacagagcgttattcaagaggccccgcttgcattgactaccaaaacgaaaatgcagagcaagattaacgagaatatcgccgcagccagttccacccctttctcctcccctgtgaacctttctaccagcggtaggcgcactcctggcaatcagactcccgttatgccaagcgccagtcccatcttgcatagtcaaggcaaagagaaagccgtgtccaacaacgtgaacccagtcaaaacacagcaccactctcacccagcaaagagtcttgttgaacagtttagggggactgactctgatattcccagttccaaggacagtgaagactccaacgaagatgaagaggaagacgatgaagaggaggatgaggaagatgatgaggatgacgagtcagatgactctcagagcggcacttctaaacgaaggcgcgttaccgacgaacgggagcttaggatccctcttgagtacggctggcagcgcgagactcggatcaggaacttcggaggccgacttcagggcgaagtcgcgtattatgcaccttgcggtaaaaaactgaggcagtaccccgaggtgataaagtatcttagtagaaacgggattatggatatctcacgcgacaattttagcttctctgcaaagatccgcgtgggagacttttatgaggcgcgggacggcccacaggggatgcagtggtgtctgctcaaagaagaggacgtaattccaagaatcagggctatggaaggaaggcgcggccgccctcctaaccccgataggcaaagggctagagaagagtccaggatgaggaggagaaaggggcgccctccgaatgtggggaacgcagagtttctagacaacgcagacgctaagcttctgcgcaaattgcaggcccaggagatcgcacgccaggcagcccaaatcaagctcctccggaagctgcagaaacaggaacaggctagggtggctaaggaggccaaaaagcagcaggctattatggccgctgaggagaagagaaagcaaaaggagcaaattaaaataatgaaacagcaagagaaaatcaaacgcatacagcagattaggatggagaaggagctaagggcccaacagatcctggaggctaagaaaaaaaaaaaagaggaggcggccaacgccaaacttctggaagccgaaaagaggatcaaggaaaaagagatgcggaggcagcaagccgtgctgctgaagcaccaggagcgtgagaggcgccgacaacatatgatgctaatgaaggccatggaggcgcggaagaaagcagaggagaaagaacggctgaaacaggaaaaacgcgatgagaagcggctgaacaaggaacggaagcttgaacagaggcggctggagctggaaatggccaaggaactcaaaaaacccaatgaagatatgtgccttgctgatcagaaacccctgccagagttaccgcggatacctggactggtcctgtctggcagtacattttcagactgcctcatggtagtccagtttcttcggaatttcggcaaggtgttgggcttcgacgttaacatagatgtacctaacctgagcgtactgcaggaaggccttcttaacataggagactcaatgggggaggttcaggatctcttggttcggctgctaagtgccgctgtttgtgatcccgggctgatcactggatacaaagccaaaacagcgctaggcgagcatctacttaatgtgggcgtgaaccgggataatgtgtctgagatattacaaatttttatggaggcacattgtggccagactgaactgactgagtcgcttaagacaaaggcctttcaggcccacacccctgcccaaaaggcctcagttctggccttcttgattaacgagctcgcttgcagtaagagtgtcgtcagtgagatagataaaaacatcgattatatgagcaatcttaggcgggataagtgggtagtggagggtaaactgaggaagctgaggataatacacgcaaaaaagaccgggaagcgtgacactagcggagggattgacctcggagaggagcagcacccacttggcactccgacacccgggcgcaagaggcggcgcaaaggaggggactcagactacgacgatgacgatgacgacgatagtgatgaccagggcgatgaggacgacgaggatgaggaggataaggaagataagaaaggtaaaaagacagatatttgtgaagacgaggacgagggtgaccaggcagctagcgtggaagagctggagaagcagatcgagaagctgtcaaaacaacagtcccagtatcgtcgaaagctgtttgacgcaagtcacagcctcagatccgtcatgttcggacaagaccgttaccggcgcagatattggattttaccacagtgcgggggtatctttgtagagggcatggaaagcggcgagggcctggaagaaattgccaaagagagagagaaactgaagaaggccgaatctgtgcagattaaggaagagatgttcgaaacttcaggcgattctttgaattgttctaataccgatcattgcgaacagaaggaggacctgaaggagaaagacaataccaatctcttcttgcagaagcctggaagtttctcgaagctttccaagctcctggaggtggccaagatgcctcctgagtctgaagtaatgacccctaaacccaacgccggcgccaatggctgcacgttgtcttatcagaacagtggaaagcactcactcggatcagtgcagtcaaccgcaactcagtcaaatgtggagaaagctgattccaacaatttatttaatacaggttcttctggtcccggcaagttctattccccactgccaaatgaccaacttctgaagactctgactgaaaaaaaccggcagtggtttagcttattgccccgcactccttgcgatgatacttccctgacccacgcggatatgagcaccgcttcactggttaccccccagtcccagccccctagcaagagtccctcacccacaccggccccgctcggatcctctgctcagaaccccgtcggattaaacccattcgccttatctcctttacaggtaaaggggggcgtatcaatgatgggattgcagttctgtggctggccaactggggtagtcacttcaaacatcccttttacttcctcagttccctccctcggcagtggcctgggactcagcgagggtaacggaaactcttttttaaccagcaatgtggcttctagcaagtctgaaagtccggtgccccagaacgagaaagccacttctgcgcaacccgctgctgtggaggtggcaaagccagtcgactttccttcgcccaaaccgatcccagaagaaatgcaattcggctggtggagaattattgacccagaggatttgaaggccctcctgaaagtactgcatctgcgcggcataagggagaaagcactccaaaaacaaattcagaagcatctagactacataacccaggcatgcctgaagaacaaggacgttgccatcattgagctgaacgagaatgaggaaaatcaggtgaccagggacatcgtggagaattggtccgtggaagaacaagccatggagatggatctgtctgtcctgcagcaagtggaagacctggaacgacgggtggctagtgcctctctccaggtcaaaggatggatgtgtccagaaccagccagcgagagagaggatcttgtgtatttcgagcataagtcatttaccaagctgtgtaaggaacacgatggcgagttcaccggtgaggatgaatcatcagcccacgcgttggagaggaagtccgataatccactcgacattgccgttacgaggctagccgacctggaaaggaatatcgaacggcgtattgaagaggatattgcacccgggcttcgcgtctggcgacgcgccctgagtgaagccagatccgcagctcaggtggcattgtgcattcagcagctccagaaatccattgcttgggagaagagcataatgaaagtgtattgtcaaatctgcaggaaaggcgataacgaagaactccttttgctgtgcgatggctgtgataagggatgccacacgtattgccatcggcccaagatcactactatccctgatggagattggttttgtcctgcctgtattgccaaggccagtggccaaacactgaagataaaaaagctgcatgtgaaaggcaaaaagacaaacgagagcaagaagggaaagaaggtcaccctgaccggggatacggaagacgaagattcagctagtacgtcatcctctctcaagcgaggaaacaaggaccttaagaaacgaaaaatggaagaaaatactagcattaacctgagcaaacaagaatctttcacgtctgtgaagaagccgaaacgagacgactccaaagatctcgctctctgttccatgatcctgacagagatggaaacgcatgaggatgcatggcccttcctgctcccggttaatctcaagctcgtccccggctataagaaagtgatcaagaagcccatggacttttcaacaataagggaaaagctgtcctccggacagtaccccaacttagagacttttgccctcgatgtcaggctggtattcgacaattgcgaaacattcaacgaagacgatagcgatatcgggcgcgcaggtcacaacatgcgcaaatatttcgagaagaagtggaccgataccttcaaggtatcttag

SEQ ID NO: 180779 - DNA, 6405 bp, Artificial Sequence
  Description of Artificial Sequence: Synthetic coding sequence
atggagagcggcgagcggctgcccagcagcgccgccagcagcaccacacctacttcaagctcaactccatctgtcgcctctgtcgtctctaaagggggattaagtactggcgttgcttctttgtcgagtacaatcaacccatgcggacacctgttcagaacggctggagatcaaccatttaacctcagcacagtctcctctgctttcccaatggtgagtcatcccgtatttggtttacatagcgcaagctctggacatagcgagttcggaggcctcggcaccctcggcacccctaccgctctggcagcccatccccagcttgccagcttcccaggcgccgaatggtggaggaccaccgacgcccataccaggaccggagccaccttttttccaccgttgctcggcatccccccgctatttgccccacctgcacaaaatcatgactcttccagcttccacagcagaacctccgggaagagcaatcggaacgggccggagaaaggcgtcaacggctcaatcaacggcagcaatacttctagcgtgatcgggataaacacctccgttctgtctaccactgccagcagctctatgggtcagacaaaaagtaccagctctggcggcgggaatcggaaatgcaatcaggagcagagtaagaaccagccactcgacgccagagtggacaagattaaggataaaaaaccccgcaagaaggcaatggaaagctcttctaattccgactccgactctggcacctctagtgacacaagtagcgaggggatctcctctagcgactccgacgacctggaggaggatgaggaggaagaggaccagtctatagaggagtctgaggatgacgactctgattccgaatccgaggcccagcacaagagcaacaatcaggtgcttcttcacggaattagtgatccaaaggccgacggacagaaagccacggaaaaggcccaagagaagcgcattcatcagcctctgccgctggcgtccgagagccaaacacattctttccagagccagcagaagcagcctcaagtcctgtcccaacagctaccgttcatctttcagagttctcaggctaaggaggaatcggtcaacaaacacacctctgtgattcagagtactggcctagtgagtaacgtcaaacctcttagcctggtaaaccaggctaaaaaagaaacctacatgaagttgatcgtgccctcacccgacgttcttaaagcaggcaataaaaatacgtccgaagagagctcactcctaacctccgagctccgatctaagcgagagcaatacaaacaggctttcccaagtcagctgaagaaacaagagtcgagcaaatcgcttaaaaaagtgatagccgccctctctaacccgaaggccacttcatctagtccagcgcaccccaagcagacgctggagaacaaccatccaaatcccttcctcacaaacgccctcctgggcaaccaccaaccaaacggtgtaatccagagcgtcattcaggaggcacctcttgcactgactacgaaaacgaagatgcaatctaagattaatgagaacatagcggccgcctcatctactcccttttcctctcctgtaaatctgtctacaagcggacgaagaaccccagggaaccagacaccggtcatgccttctgcttctccaatcctccacagccagggtaaagagaaggcggtaagcaataatgttaaccctgtcaagacccagcaccattcccaccctgctaagtcccttgtcgagcagttcaggggaaccgacagcgacattccatcatccaaagactctgaggattccaacgaggacgaagaggaggatgacgaggaggaagacgaggaggatgacgaagacgacgaaagcgacgattctcaatctgagtccgatagcaactccgagtcagacacagagggctccgaagaggaggatgatgatgataaggatcaggatgaaagcgactcagacactgaaggggaaaagaccagtatgaagctcaacaagaccacttcttccgtgaaaagtccttccatgtccctaacggggcatagcacgcccaggaatctccacattgcaaaggcccctggcagcgcacccgcagccctttgcagcgaatcccagtcccccgcttttcttgggacctctagcagcaccctgactagcagcccacattctgggacctccaagcgcaggcgggttacggacgagagagagttgaggatccccttagaatacggctggcagagagagacaagaattaggaactttggcggtcgactgcaaggggaagttgcttattatgcaccttgcgggaagaaattaagacagtatcccgaagtgattaagggaatgcaatggtgcctcctgaaggaagaggatgtgatccccagaatacgcgccatggaggggcgacggggacgcccaccaaatccggaccgacagcgggcccgggaagagtcccgcatgcgaagacgcaaggggagaccaccaaatgtcggcaatgctgagtttttggataacgccgacgcaaaactcctccggaagctccaggcccaggagattgcccgccaggcggctcaaattaagctgctaagaaaattacagaagcaggagcaggctcgggtggcgaaggaggcaaagaaacaacaagcaataatggccgccgaagaaaagagaaagcagaaagagcagataaagatcatgaagcaacaggagaagatcaagagaattcagcagataagaatggagaaggagctgagggcccagcaaatattggaagctaaaaaaaagaagaaagaagaggcggcaaatgccaagttgctggaggccgaaaagcggatcaaggagaaagagatgagacgacaacaggccgtgttactcaaacatcaggaacgggagcgacgcagacagcatatgatgctgatgaaggccatggaagccaggaagaaagctgaggagaaggagcgactcaagcaggaaaaacgcgacgaaaaaaggctgaataaggagagaaagttagagcagcgacggctggagctggaaatggcaaaagagctgaagaaacccaatgaagacatgtgtctggcagatcagaaaccattaccagagctgcccagaattcccggcctggtcttatcggggtcaacctttagtgactgtcttatggtcgttcagtttctccgaaactttggtaaggtgctcgggtttgatgtaaacatagacgtgcctaatttaagcgtgctgcaggagggactgctgaatattggagatagcatgggtgaagtgcaggacctgctggttcggctcctttccgctgccgtgtgcgacccgggattaatcactgggtataaggccaagaccgctcttggtgaacacctcttgaatgtcggagtgaatcgcgataatgtttcagaaatcctccaaattttcatggaggcccattgcggccagaccgagttgacagaaagtttgaagacgaaggccttccaggcacacacccctgcgcaaaaggccagcgtcctcgccttccttatcaacgagctggcttgcagcaagagcgtggtctctgaaatcgataaaaatatagactacatgtctaacttaaggcgcgataaatgggttgttgagggcaaactcagaaaactgcggatcattcatgccaagaaaactggaaaacgtgataccagcggagggatcgatctaggcgaggagcagcacccactggggacgcccacgccgggtaggaagcggaggagaaaggggggggacagtgactatgacgatgacgacgacgatgactccgacgaccagggcgatgaggatgatgaggacgaagaagacaaagaggacaaaaagggcaaaaagactgatatttgcgaggatgaagatgagggtgaccaggccgcaagcgttgaggagctggagaaacagatcgaaaagttgtccaagcagcagagtcagtaccgtcgcaagctgtttgacgcttctcatagtctgaggagcgtcatgtttggacaagatcgttaccgccgacgctactggattttacctcaatgcggcggcatcttcgttgaggggatggaaagcggcgagggcctcgaagaaattgctaaagaacgcgagaagctcaagaaggccgagtctgtacaaataaaggaggaaatgttcgagaccagcggggactcactcaactgttctaacacagaccattgcgaacagaaagaagacttgaaggagaaggacaacaccaacctgtttctccagaagcctgggtctttttcaaaactcagcaagctgttggaggtagcaaagatgccgcccgagagtgaggtcatgactcccaaaccaaatgccggagcaaatgggtgtactctttcctatcagaacagcggcaagcactcactggggagcgtgcaatctacagctacccaaagtaatgtggagaaagctgatagtaacaatctgttcaacactggctcaagtggaccgggaaagttctactctcccctgcccaacgatcagcttcttaagactctgactgaaaagaataggcagtggttttccctcttaccgcgaaccccttgtgacgacacttcactgacacacgctgatatgtccactgcaagtctggtcaccccacagagccagccacctagcaagtcccccagccctacacccgcccctctcggctccagtgcccagaaccccgttggactcaacccattcgccttatctcccctccaggtgaagggcggcgtatctatgatgggtctccagttctgtggctggcctacaggcgtggtgacatccaacatcccctttacaagttccgtaccctccctgggctctggcttgggcctttcggaaggtaatggaaacagttttctcacatcgaacgtggctagtagcaagagtgaaagccctgtgccgcagaacgagaaggccacgtccgcccagccagctgcagtggaagtagcaaaacccgttgattttcctagtcccaagcccatcccagaagaaatgcaattcggatggtggcgcatcatagatccagaagatctgaaagcactgctgaaagttctgcacctgcggggcatccgggagaaggctctgcaaaaacagatccagaaacatcttgattacatcacacaggcctgtctcaagaataaggacgtcgccatcatcgaattgaatgagaacgaggagaaccaggtgacacgggatatcgtagaaaactggtctgtagaagagcaggccatggaaatggacctctcagtactgcagcaagtagaggatctggagcggcgagtggcatccgcttcgctccaggtgaagggatggatgtgtcctgagcccgcttccgaaagggaagatttagtgtactttgaacataaaagtttcaccaaactttgcaaagaacatgacggagaattcactggcgaggatgaatcttctgctcacgctctggagcgaaagagcgacaatcccctggatattgcagtcacgcggctcgctgatctggagagaaacattgagcgccgaattgaagaagacattgcgcccggcctgcgagtttggcgccgagctcttagtgaggctcgatccgctgcccaggtcgctttgtgtatccaacaactgcagaaatcaatcgcatgggaaaaatcaatcatgaaagtctattgtcagatttgcaggaaaggagataacgaggagctgctgctcttatgcgatggttgtgataaagggtgtcacacctattgtcatcggccgaaaattactaccatacccgatggagactggttctgtccagcatgcattgcgaaagcttctggccagacactaaaaataaagaagctacatgtgaaaggaaagaagaccaatgagtcaaagaaagggaagaaagtcacactgacaggggatacggaagacgaggactccgcctctacatcttctagcctgaaacgcggcaataaggacctgaaaaaaagaaagatggaggaaaatacttctattaacttaagcaagcaggaatccttcaccagcgtgaagaagcccaaacgtgatgactcaaaggaccttgcgctgtgctctatgattttgacggagatggaaactcatgaggatgcctggccattcttgcttccggtgaaccttaaattggtgccgggatataaaaaggtcatcaaaaaaccaatggatttctctactatcagagagaagctgagctcaggacagtacccaaacctggagacattcgcactggacgtaagactcgtatttgataattgcgaaacgttcaatgaggacgattctgacattggcagggctggccataacatgcgcaagtatttcgagaagaagtggactgacacctttaaggtttcttag

SEQ ID NO: 180780 - DNA, 6399 bp, Artificial Sequence
  Description of Artificial Sequence: Synthetic coding sequence
atggagagcggcgagcggctgcccagcagcgccgccagcagcaccaccccaacttcttcatccacacccagcgtggcttcagtcgtttcaaaaggtggcctgtctacgggggttgcctcactgtccagtacaatcaacccatgcggccacctcttccgcactgccggtgaccaaccctttaacttatccacagtctcctcggcctttcctatggtctcccatccagtttttggattgcactccgcgtctagtggccactctgaattcggagggttgggaaccttggggactcccactgctctggccgcccacccgcagctcgctagcttcccagagtggtggaggaccacagacgcccacacacgaaccggggccaccttcttccccccactgctggggataccacctttattcgccccgccagcacagaatcatgactcctcaagtttccattctaggacgagtggcaagtccaaccgcaacggccccgagaagggcgtcaatggctcaattaacgggtcaaatacgagttcagtgatagggatcaacacctccgtacttagtaccactgccagcagcagtatggggcagaccaaaagtacttccagtggcgggggcaatcgaaagtgcaaccaggagcagtcaaaaaaccaacctttggatgccagagtggataagattaaggacaaaaagcctagaaaaaaagctatggaaagctcctcaaatagcgactccgattccgggacatcgagcgatacttctagcgaagggatcagctccagcgatagcgatgacctagaggaagacgaagaggaggaggaccagagtattgaagaatctgaagacgacgactccgactcagagagcgaggcccagcacaagtcgaacaaccaagtgctgctgcacggcatctccgaccctaaggccgatggccagaaggccacggaaaaagcgcaagagaagcgcatacaccaacccctcccactggctagcgagtcccagacccactcctttcagagtcagcaaaagcaacctcaagtgttatcccagcagctgccttttatcttccagagctctcaagcaaaagaggaaagcgtgaataaacatacgtccgtcatccagagtaccgggctggtctctaacgtcaagcctctcagtctcgtgaaccaagcgaaaaaggagacttacatgaagcttattgtccccagcccagatgttctgaaagcgggcaataagaatactagtgaggagtcctccctgctgacgagcgagctcaggtccaagcgcgagcaatataaacaggcgttcccctctcagctgaagaagcaggagtcctccaagtctctgaagaaggttattgcagccctgtcaaacccgaaagctaccagctcgagccctgcccatcctaagcaaacattggagaacaatcatccaaatccgttcctcacaaatgccctgctgggcaaccatcaaccgaacggagtgatccagtccgtgattcaagaggcaccccttgccctcaccacaaaaactaagatgcagtccaaaattaacgagaatattgcagccgccagctctaccccattctcttcaccagtgaatcttagcacctccgggcggagaacccctggaaatcaaacccctgtcatgccatcggcctcccctatactgcatagccaaggaaaagagaaagccgtcagcaacaacgtgaacccggtgaaaacccagcaccattcccaccccgccaagtcactcgtcgaacaatttcgcggcactgatagcgacatcccaagttccaaggactcagaggactcaaacgaggatgaggaagaagatgatgaagaggaggatgaggaagatgacgaggatgacgaatccgatgattctcagagtgagagcgactcaaattctgagtcagacaccgagggaagcgaagaagaagacgatgacgataaagaccaggacgaatctgatagtgatactgagggagaaaagacatctatgaagctcaataagacgaccagctccgtcaaatcaccgtctatgtctctcaccgggcatagtacgccgagaaacctgcacatcgcaaaggcacctggttctgcacccgccgccttatgttctgagagccaatctccagccttcctgggaacttcttcctcaactctgacatcatccccccactccggaactagtaaacggcggcgagttactgacgaaagggaactgcgaattcctctagaatacggttggcagagagaaactcggatccggaacttcggagggaggctgcaaggagaggtggcctactacgctccatgcggcaagaagctgcggcagtatccagaagtcataaagggcatgcaatggtgtcttttaaaagaggaggacgtgatcccccggatccgagcgatggaggggcgccgcggccgccctcccaaccccgatcgccagcgggcccgcgaggagtctagaatgaggcggcgcaaggggagacccccaaacgtaggaaacgccgaatttctggacaacgcagacgccaaactgctccggaagctgcaggcgcaggagattgcaagacaggcagcccagatcaagctcctacgtaaattacagaagcaggagcaagctcgggtggcaaaggaagctaagaaacagcaggcaatcatggcagctgaggagaagcggaagcaaaaagagcagatcaagataatgaaacagcaggaaaaaatcaagcgtatccaacaaatcaggatggagaaggaattgagggctcagcaaatccttgaggctaaaaagaagaaaaaggaggaagctgctaacgccaagttgttagaggcggagaaacgtataaaggaaaaagagatgcggagacagcaggcagtgctgcttaagcatcaggagagagagagacgtcgacagcacatgatgctgatgaaagccatggaagccaggaaaaaggcggaagaaaaggagcggcttaagcaggagaagagggacgaaaaaagattgaacaaagagaggaagcttgagcaacgaagacttgagctcgagatggctaaagagcttaaaaagccaaatgaggacatgtgcctggcagaccagaagcccctcccagagcttcccaggatacccggtttagtgctgagtggctccacattcagcgactgtcttatggtggttcagtttctgcgcaattttggtaaggtcttaggtttcgatgttaacatagatgtgcccaacctttctgttctgcaggagggacttctcaatattggcgactctatgggcgaggtccaggacttgctggtccgcctgctgtcggcagcagtatgcgacccaggtctcattaccggctataaggcaaagaccgcacttggggaacacctgttgaatgtcggggtcaatcgagacaatgtgtccgagatcttgcagatattcatggaggctcactgcgggcagaccgaattaacagaatctctgaagacaaaagccttccaggctcacacacctgcgcagaaagcaagtgtgctggcctttctgattaacgagctcgcttgctcaaaatctgtcgtgtcagaaattgataaaaatatcgactatatgtctaatttaaggcgtgataagtgggtagttgagggcaagctgcgcaaactgagaatcattcacgccaagaaaacaggaaagcgcgacacatccggaggaatagacctgggtgaggagcaacacccactggggacgcccacaccaggccgaaaacgcaggaggaagggcggtgattccgattatgatgacgatgacgacgatgattctgacgatcagggggatgaagacgacgaagacgaggaagacaaggaggataaaaagggaaaaaagacagacatatgtgaggacgaggatgagggagatcaagccgcaagcgtcgaggagctggaaaagcagatcgaaaaactgagcaagcaacaaagtcagtacagaagaaaactgtttgatgctagtcactcactgagaagcgtgatgtttgggcaggaccgttaccgtagaaggtactggattttaccccaatgtggggggatctttgtcgagggaatggaatcaggagaaggcctcgaggaaatagcaaaggaaagagagaaactaaaaaaggcagagagtgtacaaattaaagaagaaatgtttgagactagcggggactccctcaactgttcaaataccgatcattgcgaacagaaagaggacctgaaagaaaaggataacacaaatctatttctgcagaagccagggtcattttctaaactgtcgaaacttcttgaagtggccaagatgccacccgagtcagaagtgatgacccccaaaccaaatgctggggctaatgggtgcacacttagctaccaaaactccggaaaacattctctcggttccgttcaatcaaccgcgacccagtccaatgttgagaaggcagacagcaataatctgttcaacaccggatcttctggccctggtaagttctatagcccactgcctaacgatcagcttctcaagaccttaaccgaaaaaaatagacagtggttctcactcctcccgcgaactccgtgcgatgacaccagtttgacacatgcggacatgtctacagcgagcctagtaactccacagtctcagcctcctagcaaaagtccctccccaacaccagcccccctcggatcttcagctcagaaccccgtggggctaaatccttttgcactgtcacccctccaggtgaaggggggcgtctcgatgatggggctgcagttttgcggatggccaacaggggtggtgacttccaatattcctttcacatcgtctgtcccgtcactgggaagtggactaggtctatcagagggcaatggtaattcatttctaacttctaacgttgccagctcaaagagcgaatccccggtaccccagaatgagaaggcgacttcagcccaaccagcggctgtcgaagtagcaaaacccgtggacttcccatctccaaaacccatcccggaagagatgcagtttggatggtggcggataatcgatccagaagacctcaaagccctcctgaaggtgttgcacctccgaggaattagggagaaagccctgcagaaacagatccagaagcaccttgactacatcacgcaggcatgcctgaagaacaaggatgtggctattattgaactgaatgagaacgaggaaaaccaggttacacgagacatcgtcgaaaattggtccgtggaagagcaggccatggagatggatctaagtgttttgcaacaggtagaagaccttgagcgacgcgtggcctccgcttccttacaggtaaagggatggatgtgccccgagccagcatccgaaagagaggacctcgtgtattttgagcacaagagcttcacgaagctgtgcaaagagcacgacggagagtttacaggtgaggacgaatcttccgcacacgctctcgagaggaaatcagacaacccattggatattgccgttactagactggcggacttggaacgcaacatcgaacggcgaatcgaagaagatatcgccccaggattgagagtgtggcgtcgagccctttccgaggcacggtccgccgcacaggtggcactgtgcatccagcagctgcaaaaatccatcgcctgggagaagagcatcatgaaagtctattgtcagatctgccgaaaaggagacaacgaagagctgctcctactttgcgacggatgcgacaagggctgccatacgtactgccacagacctaagattaccactatcccagatggagactggttttgccctgcttgcatcgcgaaagccagtggtcagacactaaaaattaagaaactgcacgtgaaaggcaaaaaaaccaacgaaagcaagaagggtaagaaggtcacacttaccggagacacagaggacgaagatagtgcctctacaagttcctctttgaagaggggcaacaaagatctgaagaaacgcaagatggaggaaaacacatccattaacctgtctaagcaggaatcttttacatcagtcaaaaaacctaagagagatgactcaaaggatcttgccctgtgtagcatgatcctgacagagatggaaacccacgaggatgcttggcccttcctgctccctgtgaatctgaagttggtgcccggctataagaaagttataaagaagccaatggatttcagcacaataagggagaaactttcctcaggccaataccccaacctggaaaccttcgctctggacgttcgcctcgttttcgataactgcgaaacatttaacgaggatgactcagatattggccgcgcaggacacaatatgagaaaatattttgaaaagaaatggactgatacatttaaagtctcctag

SEQ ID NO: 180781 - DNA, 6507 bp, Artificial Sequence
  Description of Artificial Sequence: Synthetic coding sequence
atggagagcggcgagcggctgcccagcagcgccgccagcagcaccactcccacctctagcagcacaccctctgtggcctctgtggtctctaaggggggcctatccaccggcgtagcctccctttcttccaccatcaacccatgtgggcacctgttccgcactgccggggaccaaccatttaacctttccaccgtgagcagtgccttccccatggtgagtcaccccgtattcggtctccatagtgctagttctggtcactcagaattcgggggcctcggcaccctgggcactccaactgcactggcagcccatcctcagttagcaagctttccaggagccgaatggtggcgtacaacggatgcccatacacgaaccggcgccactttcttccctccgctactggggataccacctctgtttgcgccccccgcacagaaccacgattcttctagcttccacagccgcacatcggggaaaagtaaccgcaacggccctgaaaaaggtgttaacgggtcgatcaatggctcaaatacatctagcgtgattggaatcaacacatcagtgctgtcaactaccgccagttcttctatgggccagactaagagcacatcatcaggtggtggcaatcgcaaatgcaaccaggagcagtctaaaaatcaacctctcgatgccagggtcgacaaaatcaaggacaaaaagccgcgcaaaaaagccatggagtcatcaagtaatagcgatagtgacagtggcacaagcagtgatacatctagtgaaggtatatcatcctcagacagcgatgatctggaagaggacgaagaggaggaggaccagtccatcgaggaaagtgaggacgatgactcagactccgaaagtgaggcccagcacaaatctaacaatcaagtgctgttgcacggcatctccgaccctaaagctgatggccagaaggcaaccgaaaaggcccaggagaagcgaatccatcaacccctccccctggcctcagaaagccagacgcacagttttcaatcgcaacagaagcagccacaggtgcttagccagcagctgccttttatctttcaatcgagtcaagccaaagaagaaagtgtgaacaagcacaccagtgtgattcagtccacagggttggttagcaacgtcaaacctctgagcttggttaaccaagcaaaaaaagaaacctacatgaaattgattgttccgtcccctgacgttctgaaggctggaaacaagaatacatccgaggaatccagcctgctgacaagcgagctgcggtcaaaaagagaacagtacaagcaggctttccccagtcaactaaagaagcaggagtcttcaaaatcgcttaagaaggtaattgcggcactgagcaatcccaaagctacctcatcctccccagctcatcctaagcaaactcttgagaacaatcaccctaatcctttcctgaccaatgcgctgctgggcaaccaccaacccaacggtgttatccagtctgttattcaagaagccccactggcactgaccactaagactaagatgcagtctaagattaacgaaaacattgcagccgctagcagtaccccattttctagccccgttaatctttctacctcaggtcgtcgcacaccgggaaatcaaacaccggttatgccatctgcaagcccaattctgcactctcagggtaaggaaaaggcagtgtcaaataatgttaacccagttaaaactcagcatcatagccaccctgcaaaatcccttgtcgaacagttcagagggacagactccgatatcccctcttctaaggactctgaggatagtaatgaggatgaggaggaggatgacgaggaggaagatgaagaggacgatgaggacgacgaatctgatgacagtcagtctgagtccgattctaattccgagtcagacactgagggctctgaagaagaggatgacgacgataaggaccaagacgagtccgactctgacactgaaggcgagaaaacatcgatgaagctcaacaagactaccagctccgtaaaatctccctcaatgtctctaacagggcactcaactccgaggaacctacatatcgccaaagctccagggtctgcccccgccgccctttgcagcgagagtcaatcccccgcattcctcggtaccagcagctctaccctgacctctagcccacatagtggtacaagcaagcggagacgcgtcacagacgaacgcgagttacgcatccccctggagtatgggtggcagcgcgagacgcgcattagaaatttcggcgggcgcttacagggcgaggtcgcatactatgccccctgcggcaagaagctccgccagtatccagaggtgattaagtacctgagtagaaatggaatcatggatatttcccgggacaatttcagcttctctgccaaaatccgggttggtgatttctatgaagctcgggatgggccacaaggaatgcagtggtgcctgctcaaagaggaggatgttattccacggataagggcgatggaaggtagaaggggccggccacctaacccggaccggcagagagctcgcgaggagtcccggatgcgcaggcggaagggcagaccaccaaacgtgggtaacgccgagttccttgacaacgctgacgccaagttgctgagaaagctgcaggcacaagagatcgctcgacaggcagcccagattaaacttctcaggaaactgcaaaagcaagaacaggcacgcgtggctaaagaagccaagaaacagcaggcaatcatggctgccgaggagaagagaaaacagaaagagcagatcaagataatgaaacaacaggagaagattaagaggattcagcagatcaggatggagaaagagctccgcgctcagcaaatcctcgaggccaaaaagaagaagaaagaagaggcagccaacgcaaaacttctggaagctgagaaacggatcaaggagaaagagatgcggaggcaacaggccgtgctgctcaagcatcaggagcgcgagaggagaaggcaacatatgatgcttatgaaggccatggaggctagaaaaaaggcggaagaaaaagagcgccttaaacaggaaaaaagagacgagaaaaggctgaacaaggaacgcaaacttgaacagagacggctggagctagaaatggcaaaagagcttaaaaaaccaaatgaagacatgtgcttggccgaccagaagcccctgccggagttaccacggattcctgggctggtgctgagcggaagtaccttcagtgactgtctcatggtcgtgcagtttcttaggaattttggaaaggtactgggatttgatgtcaatatagacgtgcctaatttatccgtgctgcaggaggggcttctcaatattggggactcaatgggggaagttcaggatctcctggtcagattactgtcggccgcagtttgcgatcccggactgataactggatacaaggccaagacagccctgggagagcacttgctgaacgtgggcgtcaatagagataacgttagtgaaatcctgcagatcttcatggaagcccactgcggccagacagagcttacagaatccctgaaaacgaaagcgtttcaggctcacacacctgcgcagaaggcctctgttttagcattcctgatcaacgaattagcctgctctaaaagtgtggtgagtgaaatcgacaaaaacattgactatatgagtaatttgcgacgggacaagtgggtagtggagggcaaattgcgcaagttgagaatcattcacgctaagaaaaccggcaaaagggatacctccggagggatcgacctgggcgaggagcagcacccacttggaaccccaacacctggccgcaagcggaggcgcaaagggggagactctgactacgacgatgatgatgacgatgactcagatgatcagggcgacgaggatgatgaggatgaagaagataaggaggacaaaaaggggaaaaagacggacatttgcgaggacgaggatgaaggggatcaagccgctagcgtggaagagctcgagaaacagattgagaagctgagtaaacagcagtcccaatatcggcgaaaactctttgacgcctcccacagcttgagatccgtgatgtttggacaggataggtatagacgtagatattggattcttcctcagtgtgggggcatctttgtggaaggaatggagtccggcgagggcctggaggagattgcaaaggaaagggagaagctgaaaaaggctgagtctgtccaaattaaagaagagatgtttgagacatctggagactccttgaattgcagtaatacagaccattgtgagcagaaggaagatttgaaggaaaaagataacactaatcttttccttcaaaagccggggagttttagtaagctttccaaactcctggaagtggcaaaaatgccaccggagagcgaagtgatgacgcctaagcccaacgccggagccaacggttgcactctctcttaccaaaactcaggaaagcattccctgggctccgtgcagagtactgcaacacagtctaacgtcgagaaggccgatagtaataatctgttcaacacaggaagctcagggccaggcaaattttactctcccctgcccaacgaccagttgctcaaaacactgaccgagaagaacaggcaatggttttcactgctgcctcgcaccccctgtgatgatacctccctgacgcacgccgatatgagtacagcctccctggtcactccccagtctcagcctcctagcaagtcacctagtccaactccagccccgttgggttcatcggcacagaacccggtcgggctgaatcccttcgcactcagtccactccaggtaaaaggtggggtgtctatgatgggtctccagttttgcggctggccaactggcgtggtcacttctaacataccttttacgagtagcgtcccaagcctgggctcaggcttggggcttagcgagggaaacggaaactccttcttgacgtctaacgtagcctcatccaaatccgagtcccctgtgcctcagaacgaaaaggcaacctccgcgcagcccgctgctgtggaggtggctaaaccggtggattttccaagccctaagcccatccctgaggagatgcagttcggatggtggcgtataatcgatccagaagacttgaaggcgcttttaaaggtcctgcacctgcgtggcatccgcgaaaaagctcttcagaaacagatccagaaacatctggattatatcacccaagcttgtctcaaaaacaaagacgtggcaattatcgagctgaatgagaacgaagagaaccaagtgacaagggacattgtggagaactggtctgtagaagaacaggctatggaaatggatctctctgtccttcaacaagtagaagatcttgaacgaagagttgcttccgccagcctgcaggttaaggggtggatgtgtcctgaacctgcttcggagcgggaggacctggtttattttgagcataagtctttcaccaagctatgtaaggaacacgatggcgaattcaccggggaggatgaatcttctgcccacgcactcgaacggaaaagtgacaatcccctggacatcgccgtgacacgactggccgaccttgaacggaacatagagcgaagaatcgaagaagatatagcacccggcctccgagtttggcgcagagccttatccgaagcgagatctgccgctcaggtcgcgctctgcatacagcagttacagaagagcattgcctgggaaaaaagcattatgaaagtctattgtcagatatgcaggaagggagacaatgaggagttgttgcttctgtgtgatgggtgtgacaaggggtgtcacacatattgccacagaccaaaaattactaccatcccagatggggactggttctgtcctgcatgcattgcgaaagccagtggacagactcttaagattaaaaaattacatgtgaaagggaaaaagaccaatgaaagcaagaaaggaaaaaaggtcactctgacgggagacaccgaggacgaggattcagcctcaacgagcagttctctgaagcggggcaacaaagacctcaagaaacggaaaatggaagaaaacacctctatcaatctgtccaagcaggaatccttcacaagtgtcaagaagcctaagcgcgatgactccaaggatctggcgctctgctccatgatccttaccgagatggagacacatgaggacgcgtggcccttcctattgcctgtcaacctgaagctcgtcccaggctataagaaagtgattaagaagcctatggatttctccactattagagagaaactgtcctctggtcagtaccctaatttggagactttcgcactggatgtgcggcttgttttcgataattgtgagacattcaacgaggatgactctgacatcgggcgagcagggcacaatatgagaaaatatttcgagaagaaatggactgatacatttaaagtgtcttag

SEQ ID NO: 180782 - DNA, 432 bp, Artificial Sequence
  Description of Artificial Sequence: Synthetic coding sequence
atggagagcggcgagcggctgcccagcagcgccgccagcagcaccacacccacctcgtcctctacaccttcagttgccagtgtggttagtaaaggaggcctcagcactggggtggcctctctctcttccaccataaacccgtgtgggcacctgtttcggactgccggggatcagcccttcaacctctctactgtgtcatcggcctttcccatggttagccacccggtgtttggcctgcactcagctagcagtggccacagtgaattcggcggactggggacacttgggactcctactgccctggccgcccacccacaattggcttctttccccggagctgaatggtggcgcacaaccgatgcgcatacaaggaccggcgcaaccttttttcctccactactagggataccacccctcttcgcccctccttag

SEQ ID NO: 180783 - DNA, 1563 bp, Artificial Sequence
  Description of Artificial Sequence: Synthetic coding sequence
atggagagcggcgagcggctgcccagcagcgccgccagcagcaccaccccgacatccagctcaacccccagcgtcgcttctgtggtaagcaagggtggactgagcacaggggttgcctcgctctcgagcacgatcaatccttgtggggcagaatggtggcggacgaccgatgcgcatacgaggaccggcgctaccttcttccctccccttttaggaatccccccactctttgctccgcccgcacagaaccatgacagttcctcgttccatagtcggacttccgggaagagcaaccggaacggccctgaaaaaggtgtaaatgggagcatcaacggctctaatacttccagtgtaatcggcatcaacacctccgtcttgtctacgactgccagctctagcatgggtcagactaagagcacttcatcgggtggcgggaatagaaagtgcaaccaggagcagtccaaaaatcagcctctcgatgcacgcgtagataagataaaagataagaaacccagaaagaaggcgatggagtcgtcctcaaactccgattcagacagcgggacatcctccgatactagcagtgaaggaatcagcagctccgacagtgacgatctggaggaagacgaggaagaagaggatcaaagcatcgaggaatcagaagacgacgactctgattcggaatcagaggcacagcataagtctaacaaccaggtgcttctgcacggtatcagtgaccctaaggctgacggccagaaggctacggagaaggcccaggagaaacgcatccaccaacctctgcccctggcatccgagagtcagactcattcctttcagtcacagcaaaagcagcctcaggtgctgagtcagcagctgccgtttattttccaatcttctcaggctaaagaggagtccgttaacaagcacacaagtgtgattcaatctacggggttagtttcaaacgtgaaacccctgtcacttgtgaaccaagcaaaaaaggagacttatatgaagctcatcgtcccaagccctgacgtcctcaaggctgggaacaaaaatacaagtgaggagtcaagcctccttacttccgagcttcgatcaaagcgtgagcagtacaagcaggccttccctagccagctgaaaaaacaggagagttcaaagagccttaagaaagtcattgctgcactgagcaacccgaaagccaccagttcatcccccgcccatcccaagcagactctggagaacaaccaccctaatccctttcttactaacgcgctgttagggaatcatcagcccaacggcgtgatccagtctgtaattcaggaagcgccactcgccttaaccacaaaaacgaaaatgcagagcaaaatcaatgaaaacatagcagccgcatcctctactcctttttccagtccagtcaatctcagcacctctggaagacgtactcccggaaaccaaacaccagtgatgcccagtgctagtcctatcctgcacagccagggcaaggagaaagccgtgtccaacaatgtgaatccccgcaagatgatgaagaaaaagatgcgctag

SEQ ID NO: 180784 - DNA, 3645 bp, Artificial Sequence
  Description of Artificial Sequence: Synthetic coding sequence
atgggcgtggacttcgacgtgaagaccttctgccacaacctgcgggctaccaagcccccctacgaatgtccagtcgagacttgccggaaggtctataaatcatactccggcattgaataccatctttaccactacgatcatgataacccacctccgcctcagcaaacaccactaagaaagcacaagaaaaagggccggcaatccagacccgccaacaaacagtcgcccagtccgagcgaggtgagtcagtcccccggccgcgaggtaatgtcttatgcccaagcgcaacgtatggtagaagtggatttgcatgggagggtccataggattagcatctttgataacctggatgtggtgtccgaggatgaagaagctcctgaggaggcgccagaaaacgggtctaataaagagaacactgagacgcctgcggccacaccaaaaagcggaaaacataagaacaaagaaaaaagaaaagattcaaatcatcatcatcatcacaacgtgtccgcaagcactaccccgaagctgcccgaagttgtgtacagggagttagagcaggacacaccagacgcgccgccgagacctacaagttactatcgatacatagagaagagcgccgaggagctcgacgaagaagtcgaatacgatatggatgaagaggactacatttggctcgatataatgaacgagcgtcgaaagaccgagggcgtctcgcctatcccacaggaaatcttcgaatacctgatggaccgccttgagaaggagtcttatttcgaatcccataataaaggcgatcccaatgcccttgtggacgaggacgcagtttgttgtatctgtaacgatggcgaatgccaaaactcaaatgtgatccttttctgcgatatgtgtaacctggctgtgcatcaggaatgttacggcgtgccttatataccggaaggccaatggctgtgccgaagatgtctgcaatctccctctcgtgcggtggactgcgctctatgccccaataagggaggagcattcaagcagacagatgatggccgctgggcccacgtcgtttgcgccctctggattcctgaggtgtgcttcgcaaataccgtgttccttgaaccaatcgacagcattgagcatataccacctgctaggtggaagctgacgtgttatatttgcaaacagcggggctctggggcctgtattcagtgccacaaagccaactgctacacagctttccatgtcacttgcgctcagcaagcgggactgtatatgaagatggaaccagtgagggagaccggggctaatggcactagcttctcagttcgcaagactgcatactgcgatatccacacaccacctggaagcgccaggagattgccggctttgtctcactcagagggggaagaggatgaggacgaggaggaggatgaaggcaaggggtggagctcggagaaggttaaaaaggccaaagctaaatcccgaataaaaatgaaaaaagctagaaaaattctcgcagaaaagagagccgcggcacccgtggtgagcgtaccctgtatacccccacacaggcttagcaaaattaccaatcggcttactattcagaggaagtcgcaattcatgcaaagactccattcttattggactttgaaacggcagtctcgcaatggagtgcccttgctcaggcggctgcaaacccacctccagagtcagcggaactgcgaccaggtggggagagattctgaagacaaaaattgggcactaaaggagcaactgaaaagctggcagaggctccgccacgacctcgagcgagcgcggctgctagttgagctcattcgaaaaagggaaaaactgaagcgggagactataaaagtccagcagattgcaatggaaatgcagctgacgccttttttaattctgttgagaaagacattggagcagctccaagagaaagacacgggcaacatattcagtgaacccgtgcccctgagtgaggtaccagattatttggaccatatcaagaagcccatggacttctttacgatgaaacagaatctggaggcatatagatatcttaatttcgacgactttgaggaagacttcaatctcattgtctctaattgtctaaaatacaatgctaaggatacaattttttatagagccgctgttcggctccgagagcagggcggcgctgttcttcggcaagcccggcgacaagccgaaaaaatgggaatcgacttcgagacagggatgcatataccacatagtttagctggcgacgaagccactcaccacaccgaggatgccgcggaagaggagcgactcgtcttgctggaaaatcagaagcacctgccagtggaagaacagctgaagctgctgctggaacggttggacgaggtgaatgcaagcaagcaatcagtgggccggtcacggagggccaagatgataaagaaagaaatgacagcccttagaaggaagctggcccaccaaagagagacaggccgtgacggaccagagcgtcacggtccctcatcgcgcggcagcctgactccgcaccctgctgcatgtgacaaggatgggcagacagattccgctgccgaagagagttcatcgcaagagacctccaaaggtctaggtccaaatatgtcaagcacaccagctcacgaggtggggcggagaacctctgtacttttctctaaaaaaaacccaaaaactgcagggcctccaaaaagacccggcaggccacctaagaatcgcgaaagtcagatgacaccctctcacggcggttctcctgtaggcccaccacaactgcccatcatgtctagcctgcggcagcgcaaacgcggacgctcacctagaccaagctcctcgtccgattccgatagtgataaatcgaccgaggatcccccaatggatttgcctgccaacgggttctcgggagggaatcaacccgttaagaagtcattcctggtgtacaggaacgattgttccctcccgagatcttccagcgattccgagtcttcctctagctcctcttcttcagcagcctccgacaggacatcaaccacaccttccaagcaggggagagggaaaccttcttttagtcggggtactttccccgaggatagctctgaagacacttccggcaccgagaacgaagcctactccgtgggcaccggcagaggggtagggcattcaatggtcagaaagagtttagggaggggagctggctggctatcagaggatgaggattctcctctggacgctctggatttggtgtgggcaaagtgccggggctacccttcttacccggcactgatcattgaccctaagatgccacgcgaggggatgttccaccatggggtccccatacctgtgccacccctcgaggtactcaagctcggggagcagatgacacaggaggcccgggagcacctatacctggtcctgttcttcgacaataagcgtacctggcaatggcttccaagaaccaagctggtgcccctgggggtcaaccaagatctcgataaagaaaagatgctcgaaggccgcaagtccaacattcggaaatctgtgcagatcgcctatcatcgcgccttgcagcatcgttcaaaagtccagggggaacaaagtagcgagacatcagattcggattag

SEQ ID NO: 180785 - DNA, 3663 bp, Artificial Sequence
  Description of Artificial Sequence: Synthetic coding sequence
atgggcgtggacttcgacgtgaagaccttctgccacaacctgcgggctacaaagcccccatatgagtgcccagtcgaaacatgtaggaaagtttataagtcatattctggcattgagtatcatctgtaccactacgaccacgataacccaccacccccccagcaaacccccctccgcaagcataaaaaaaaggggaggcagagcaggccagcgaacaagcagtcccccagtcccagcgaggtgtcccaaagtcctggacgcgaagtcatgtcttacgcacaggcacagcgcatggtagaggtggacctgcacggacgtgtccataggatctccatcttcgataacctcgatgtagtgtccgaggatgaggaggcccctgaagaagcgcctgaaaatggcagtaacaaggaaaatacggagactcccgccgcgacccctaagagcgggaagcacaagaacaaagagaaaagaaaggattctaaccatcaccaccatcacaacgtgagcgcatccactaccccgaaactccccgaagtggtataccgagaactggaacaggatactcctgatgccccacccaggccaacctcttattatcgttacatcgaaaagtccgctgaggagctcgacgaggaggtagaatacgacatggatgaagaggactacatctggctggacattatgaatgagcggagaaagaccgaaggcgtttcccctatacctcaggaaatctttgagtacttaatggacagattggagaaggagtcctacttcgaaagccacaacaaaggcgaccccaacgccctagtcgacgaagatgccgtgtgttgtatctgcaacgatggcgagtgccagaacagcaacgttattctgttctgcgatatgtgcaatctcgcggttcatcaggaatgttacggagtgccttacattcctgaaggccagtggctgtgtagacgctgtctgcagtccccaagcagggctgtcgactgcgccctttgccctaataaaggaggcgccttcaagcagacagacgacgggagatgggctcacgtggtctgtgcgctgtggattccagaagtctgcttcgcgaatacagtattcctggaacccattgactctattgaacatatcccccccgcacggtggaaattaacctgctatatttgcaagcaacgagggtccggggcttgtattcagtgtcacaaagctaattgttacaccgccttccatgtaacgtgtgcacagcaggccggactctacatgaaaatggaaccagtgagagaaaccggcgcaaatgggacttccttttcagtcaggaaaaccgcctattgcgatatccacaccccacctggctctgccaggcgtcttcctgctctaagtcattccgagggtgaggaggacgaggatgaggaagaggacgaggggaagggctggtcttccgagaaagtgaagaaagcaaaggcaaaaagtagaatcaaaatgaagaaggccaggaaaatcctggccgaaaaaagggcagcggctcctgtggtgagcgtaccatgcatcccgccccaccgcttgagcaagattaccaaccgcctgactatacagaggaagtcacagttcatgcagagactgcacagctattggacactgaagcggcagtcccgaaatggtgtcccactcctacgccgtctgcagacacatctgcagtctcagcgcaactgtgatcaggtcggcagagactcagaagacaaaaactgggcccttaaagaacagcttaaaagctggcagcgactgcggcacgatctggaacgagctcggctgctggttgagctcattcgtaagagagaaaagctaaagagggagacgattaaagtgcagcagattgccatggagatgcagttgaccccctttctgatcctgcttcgtaagacccttgagcagttacaggagaaagatacagggaacatcttttccgagcccgtgccattaagtgaggtgaccgagctggatgaggtgcccgactatctagatcacattaaaaagcctatggattttttcaccatgaaacagaatctggaggcatatcgctatctaaacttcgacgacttcgaggaagacttcaacctcatcgtatccaactgtctcaaatacaacgctaaggacaccattttctatagggcagccgtgcgtctccgcgagcaaggcggagccgtgctgagacaggcacgtcggcaggctgaaaagatgggaattgatttcgaaactgggatgcacataccccattctctggccggagacgaggcaacgcatcacacggaagacgccgcagaggaagagcgtttagtcctgctggaaaaccagaaacatctgccagtggaggagcagctaaagttgctccttgaacgacttgacgaggtgaatgctagcaaacagtctgtgggtagatctcggcgcgcaaagatgattaaaaaggagatgactgccctgcggagaaagttggcacaccagcgagaaacgggccgagatggccctgagcggcacggaccctccagtagaggctccctcacaccccacccagctgcttgcgacaaagatggccaaaccgactcagccgctgaggagagctcatctcaagaaacctcgaaaggcctgggcccaaacatgtccagcactccggctcacgaggtgggcagacggacctcagttttgttcagtaaaaagaatcccaagaccgctggaccacccaaacggcccggcagaccccccaaaaatagggagtcccagatgacccctagtcacgggggaagccccgtgggacccccacagctgccaatcatgtcctcactgaggcagaggaaacgggggcgtagtcctcggccgagcagttcgtcagattccgactccgacaagtcgacagaggatcctcccatggatttgccagccaacggatttagtggtggcaatcagccagtaaagaaatcattcctcgtatatcgtaacgattgttctctgcctcgaagttcatccgacagcgaatctagctcaagttcctcctcatcagcagcctccgaccgtaccagtactacccccagcaagcaaggtcgcggcaagccatcttttagccgcgggacctttcccgaggacagtagcgaggatacctcaggaacagagaacgaggcctactccgtgggcaccgggcgaggcgtggggcattctatggttcgaaagagcctaggaaggggagctggttggctctctgaagacgaagacagtccactggacgccctggatcttgtgtgggccaaatgcagggggtacccatcttacccagcactgattattgaccccaagatgccaagggaggggatgtttcatcatggtgtacccatccccgtcccccctctcgaagtactgaaactcggagagcagatgacgcaagaagctcgggagcatttgtatcttgtcttgtttttcgataacaagcggacctggcagtggctaccacgtactaagcttgtcccactgggggtaaatcaggatttggacaaggagaagatgttggagggacgtaagtcaaacatcaggaagagcgtgcaaatcgcctatcatagagctttgcagcaccggtcgaaagttcagggtgagcaatcatctgagacatccgactctgattag

SEQ ID NO: 180786 - DNA, 303 bp, Artificial Sequence
  Description of Artificial Sequence: Synthetic coding sequence
atgggcgtggacttcgacgtgaagaccttctgccacaacctgcgggccaccaagccaccatacgaatgtcccgtcgagacatgcagaaaggtatataaaagctacagcggcatagagtaccacctatatcactacgaccatgacaacccccccccgccacagcagactcccttgcgcaagcataagaagaagggccgccagagcaggcctgcaaacaagcagagccccagccccagcgaagttagccagtcccccggtcgggaggttatgtcctatgctcaagcccagagaatggtggagtag

SEQ ID NO: 180787 - DNA, 318 bp, Artificial Sequence
  Description of Artificial Sequence: Synthetic coding sequence
atgggcgtggacttcgacgtgaagaccttctgccacaacctgcgggctacaaagcccccgtatgaatgtcctgtggagacttgccgcaaagtctataagagttattctggcatcgagtaccacctataccattacgatcatgacaatccaccccctcctcagcaaacgccgcttaggaagcataaaaaaaaagggcggcagagtagacctgcgaataaacagagtccgagtcctagcgaagtatcccagagcccgggccgggaggtcatgtcatacgctcaggctcagcgcatggtagaagtggacctgcacggatag

SEQ ID NO: 180788 - DNA, 3645 bp, Artificial Sequence
  Description of Artificial Sequence: Synthetic coding sequence
atgggcgtggacttcgacgtgaagaccttctgccacaacctgcgggcgacgaaaccgccttacgagtgccctgtagagacgtgtcgcaaagtttataagtcttactctggtattgagtaccacctctatcactacgaccatgataatccgccacccccgcaacagacaccactgcggaagcacaagaagaagggcagacagtcgcggcccgccaacaaacagagtccctctccttccgaggtcagtcagagtcccggcagggaggttatgtcttatgcacaggctcagcggatggtggaagtagacctccacgggcgagtgcaccggatctccatcttcgacaacctggacgtggtatcagaagacgaagaagcgcccgaggaggcacctgagaatggtagtaacaaggagaacacagagacccccgctgctaccccgaaaagcggaaaacacaaaaacaaagaaaagcgcaaggacagtaatcaccaccaccaccacaatgtgtccgctagcaccacacctaaactgcctgaggttgtgtaccgcgagttggaacaggatacacccgatgccccgccaagaccgacctcctattatagatatattgagaaaagcgccgaggagcttgacgaagaggtcgaatatgatatggacgaggaagactatatctggctggatatcatgaacgaacgtcggaagaccgagggagtatcaccaattccacaggaaatttttgaatacctgatggaccgcttggaaaaggagagctattttgaatcccataacaagggagatccgaacgctctggtggatgaagatgcagtgtgctgtatatgtaacgacggagaatgtcaaaactcaaatgtgatcctgttctgtgacatgtgtaacctcgcagtacaccaggaatgttacggggtgccctatatcccagaaggtcagtggctgtgcagacgctgcctacagtccccatctcgggctgtagactgtgccttgtgtcccaacaaagggggggcctttaagcagaccgacgacgggagatgggcccacgtggtctgcgcactctggatccctgaggtctgcttcgctaatacagtgttcctggagcctattgattccattgaacacatcccacccgctcggtggaagcttacctgctacatctgtaaacagcgtgggagcggcgcctgcatccaatgccacaaggcaaactgttacactgcatttcacgtgacctgtgcacagcaagccggtctatacatgaagatggagcccgtgcgggagacaggcgcaaatggcactagttttagcgtgcggaaaaccgcttactgcgacattcacacccccccagggtctgcacgacggctccctgctttgagccattcggaaggagaagaggacgaggacgaagaggaagatgaaggtaaaggctggagtagcgagaaggttaagaaggcaaaagcaaaatcacgcataaagatgaaaaaagcccgtaaaatcctggccgagaagcgagcagcagctcccgtcgtgtcagtgccctgcatcccaccccaccggctgtcaaaaattactaacagactgacaattcaacgcaaatcacagttcatgcaacgcctgcacagctactggacgttgaagaggcaaagtcgaaacggtgtaccactgttacggcgattgcaaacccatcttcaatctcaaaggaattgcgatcaggtcggtcgggacagcgaggacaagaattgggctctgaaggaacagctcaagagctggcagcgcttgcggcacgacctggagagagctagactcttggtcgagctgattagaaagagagagaagctcaaaagggaaacgatcaaggtccagcagattgctatggagatgcagctgaccccatttttgatcctcctgagaaagactctggaacaactgcaggagaaagacaccggaaatatcttctccgaacccgtgcccctcagcgaggtcccagattatctggaccatattaaaaaacctatggactttttcactatgaagcagaatttggaagcctatcgatatcttaactttgatgattttgaagaggactttaacctcattgtgagcaactgcctcaagtataatgccaaggataccattttttaccgggccgccgtcagactaagggagcaggggggcgccgtgttgcgccaggcccggagacaggccgaaaagatgggtatcgacttcgaaactggaatgcacatcccacactccctggcaggagacgaagccacacatcacacagaagacgctgccgaggaggagcgcctggtgctgcttgagaatcagaaacacctccccgtggaagaacagctaaaactgctgctggagaggttagacgaagtgaatgccagcaagcagagtgtgggacggtccaggcgggctaagatgatcaagaaggagatgacagctctgaggcggaagttagctcaccagagggagaccggccgagacggaccggagagacacggtccaagttcacggggatcacttacccctcatccagccgcctgcgataaagacgggcagaccgatagtgccgcagaggagtcttcatcccaggagacttcaaaagggctgggacccaatatgagttccacccccgcccacgaggtcgggcgtaggacatccgtgctgttcagcaaaaagaacccaaagacagcaggaccgcccaagaggccaggaaggccaccgaagaaccgagagagccaaatgacccctagccatgggggctcccctgttggcccccctcagctgccaattatgtcctcattgaggcaacgcaagcgcggcagaagtccaagaccctcctcctcctcagattctgatagcgacaaatctacagaggaccccccaatggacctcccggctaatggtttctcaggcggtaatcaaccggtaaagaaaagtttccttgtgtaccgcaacgactgttcgctgcctcgaagcagcagtgacagcgaatctagttcatcgtccagctcttctgccgcttctgaccgcacgtcaaccacacccagtaagcaaggacgtgggaaaccatcattctcaaggggaacttttcccgaagacagctccgaggatacatcaggtactgagaatgaggcatacagcgtgggaaccgggcgaggagtggggcactcaatggttcgcaaatcactggggcggggagcagggtggctatcagaggacgaagactctccgctggatgccttagacctggtatgggccaagtgcagaggctacccctcgtaccctgctctaatcatcgatcctaaaatgccacgggaaggaatgtttcatcacggagtgcctatccccgtgcctccactcgaggtactaaagcttggtgagcagatgactcaggaagcccgtgaacatctgtacctggtgttgtttttcgacaataaacgcacctggcagtggttaccacgtacaaaactcgttcctcttggagtcaaccaggatcttgacaaggagaaaatgcttgagggccgtaagagcaatattaggaaatctgtgcagatcgcttatcaccgcgccctgcagcaccgctcaaaagtgcagggtgaacagagtagtgaaacatccgactctgattag

SEQ ID NO: 180789 - DNA, 5409 bp, Artificial Sequence
  Description of Artificial Sequence: Synthetic coding sequence
atggccgccgcccccacccagatcgaggccgagctgtactacctgattgcaaggtttttacaaagcggaccctgtaacaagtcagcgcaagtgctggtacaagagctagaggagcaccagctcattccccggcggctagattgggaaggtaaagagcatcgacggtctttcgaagacctcgtggctgcaaacgcacacattcctcctgattatcttctgaagatatgtgagaggattgggcctctcctcgacaaggagattccacagtccgtgccaggagtgcaaaccctcctgggagtgggtagacaatctttgttgcgcgatgcaaaggactgtaagagtacattatggaacggaagcgcctttgcagctctgcaccggggtcgtcccccagaactgcccgtgaattatgtgaagccccctaacgtggtaaacatcactagcgcaaggcagctcacaggttgttcccgcttcgggcacatattcccttcaagcgcttatcaacacattaagatgcacaagagaatcctgggtcacctgtcatccgtgtattgtgtggcattcgatcgctctggacgacgtatcttcaccgggtccgatgactgtttggtcaagatctgggccactgacgatggacgcctacttgccactcttcgaggacacagtgcggaaatcagtgacatggccgtaaactacgagaataccctgattgccgcaggctcctgcgataaggtggtgagagtctggtgcctcagaacatgcgcaccagtggcagtgctgcaggggcacagcgcctcaattacatctatacagttctgtccgtccaccaaagggaccaatagatacctgacatctaccggagctgatggcaccatttgtttctggcagtggcatgtgaaaactatgaaattccgggataggcccgtgaaatttacagagaggtctcgccccggcgttcagataagctgttccagtttctccagtggcggcatgttcattacaaccggcagcacagatcacgtgatccggatttactatctggggtccgaggtcccggagaaaatcgcagaactggagagtcacacagataaggtggttgccgtacagttttgcaataatggcgattccttgcgatttgtgtcaggctctagagacggcaccgcacgtatatggcaataccagcagcaagaatggaagagtatagtgttggatatggccacgaaaatgaccggcaataacctgccctctggggaggataaaatcacaaagcttaaagtaacaatggtggcttgggacagatatgatacaacagttattaccgcggtcaataattttctcctgaaggtgtggaatagcattactggacagctgctccatacactctccggacacgatgacgaagttttcgtattagaggcacacccttttgaccagcggatcatactcagcgcaggacacgacggaaatatctttatatgggacctggacagaggcacaaagataagaaattacttcaacatgattgagggacaaggacacggcgcggtctttgattgcaagttctctcccgacggcaatcatttcgcctgcaccgatagccacggacacctgctgttatttggtttcggatgtagtaagtattatgagaagatacccgatcaaatgttcttccataccgattatcggccactgatcagagatgcgaataactacgtgctggatgagcagactcagcaggcacctcacctgatgccacccccattcctcgtcgatgttgacgggaacccccacccaacaaagttccagcggctggttcccgggagggagaattgtaaggacgaacaactgatcccccagctaggctacgttgctaatggtgacggtgaagtagtggagcaggttatcgggcagcagaccaatgatcaggacgaaagcatcctggacggaataatcagagagctgcaaagggagcaggatctgaggctgattaatgagggggacgtgcctcatctgcctgtaaacagagcatactcagttaatggcgctcttcgctccccaaatatggacatttcctcctcccctaatatcaggctcaggagacactcttcacaaatcgagggggttaggcaaatgcacaacaacgccccacggagccagatggcaacagagagggatctgatggcttggtcccgccgagtggtggtgaacgagcttaataacggagtatcccgcgttcaggaggaatgtcgtaccgctaagggcgacatagaaatttctctctatacggtggagaaaaagaaaaagccttcttataccacgcaacgtaacgactatgagccgagctgtggcaggagtcttcggcgcacacagcggaagcgacagcacacctaccaaactcgctctaacatcgaacacaacagccaagcctcttgccagaactcaggcgtccaggaggactctgattcctcttcggaggaggacgagaccgtcggaactagtgacgcatctgtggaggatcccgttgtcgaatggcagtctgaaagttcgtcaagcgactcaagctcagaatatagcgactggacggccgatgcaggtataaacctgcagccaccaaagcgccagacgcggcagacaacccggaaaatctgcagttctagtgatgaagagaatctgaagtcactcgaggagcggcagaagaaacccaagcaaacccggaagaaaaagggaggactcgtcagcatcgccggcgaaccgaatgaggaatggtttgccccccagtggatcttagacactatacctcgacgtagcccctttgtgcctcagatgggagatgaactgatttatttcaggcaaggccacgaggcatacgtgcgtgcagttcgcaagagcaagatctatagtgtaaatctgcaaaagcagccttggaacaaaatggacctcagagagcaggaattcgtgaagatcgtagggatcaagtatgaggtcggcccccctactctgtgctgcctgaagctggcatttctcgaccccataagtggcaagatgacgggcgagtccttcagtatcaagtaccacgacatgccagacgtgatcgactttttggtcctccaccaattctataatgaggctaaagagcggaactggcaaattggggataggttccgttcaatcattgatgatgcctggtggtttggcacagtggagtctcagcagccatttcagcctgaatacccggacagctccttccaatgctattccgtccattgggacaataacgagcgtgaaaaaatgagcccatgggatatggagcctatccccgaaggtaccgcgttcccggatgaggtgggcgccggagtgccagtttcacaggaggaattgacagctttgctctacaaacctcaggagggtgaatggggggcgcattcaagagatgaggaatgtgagcgggttatccagggcatcaaccatcttctgtctcttgatttcgcctctcctttcgccgtcccagttgacctctctgcttatccactgtattgcaccgtcgtcgcgtacccgacagatttaaatacaatccgcagacgcctggagaatcgtttttatcgccgaatctccgctttaatgtgggaggtcagatatatcgaacacaatgctcgtacatttaatgagcctgactcgcctatcgttaaagctgcaaaaatcgtgacggacgtgttgctgcgctttatcggagatcagtcctgcaccgacatcctggatacctataacaaaatcaaggcagaagaaaggaattccaccgatgctgaagaggataccgagatcgtggacttggacagtgatggacctggcacctcatcagggagaaaagtaaagtgcaggggcaggagacagagccttaagtgcaaccccgacgcctggaagaagcaatgtaaagagctgctctcgctgatctacgagagggaagattccgagcccttccgccagcctgcggatttgctgtcataccctggccaccaggagcaagaaggcgagagctcggaaagcgtagtgcccgagaggcagcaagacagcagcctgtctgaagactatcaggatgttatcgacacccccgtcgatttcagtaccgtcaaagaaacactggaagctggtaattacggtagcccactggagttttataaagatgtccgtcaaatctttaataattcaaaagcatataccagtaataaaaagtctaggatctatagcatgatgttgagactgtccgctctgtttgagtctcatattaaaaacatcataagtgagtacaaatctgctatccagtcccagaagagaagacgacctagataccgcaaacgcctccggtcaagctcctccagtctatcatcatctggcgcaccctctccaaaaggtaagcagaagcagatgaagctgcagcccaagaacgatcagaacaccagcgtgtctcatgctagaacatcaagtcctttcagcagcccggtgtccgatgccgccgaggggcttagtctttacttgctagacgatgagcctgacggacccttttcctcgagctcttttggaggttattcacggtcaggaaactctcacgacccaggcaaggccaaatccttccgaaatcgcgtactgccagtcaagcaggatcatagcttggacgggccattgaccaacggcgacggaagggaaccccgcaccggaataaaacgtaagctgcttagcgcttcagaggaggacgagaatatgggcggcgaggataaggaaaagaaggaaacaaaggagaagtctcatctgtccacatccgagagcggcgagctaggctcttctttgtcgagtgagagtacgtgcggcagtgattctgattctgagtctacatcacggacagaccaagattacgtggacggcgatcatgactacagtaagtttattcagaccagaccgaaacgcaagttgaggaaacagcacggcaacggcaagcgtaattggaagacccgtgggacgggcggtcggggcagatgggggcggtggggccggtggagtagaggcgggaggggcaggggaggcaggggtcgtggatcccgcggacgcggcggaggtggcacaagggggcggggccgtggtcgcggtggcagaggagcttccagaggtgccaccagagccaagagggccaggatagccgacgatgagtttgatactatgtttagtggccggttttcccgcctgccccgaattaagacgaggaaccaggggaggagaaccgtcctctataacgatgattccgacaacgacaacttcgtgagtaccgaggaccccctcaatctcggcacgagccgatcgggccgcgtccggaaaatgaccgaaaaggcaagagtgtctcacctgatgggctggaattactag

SEQ ID NO: 180790 - DNA, 2406 bp, Artificial Sequence
  Description of Artificial Sequence: Synthetic coding sequence
atgctgcagaacgtgaccccccacaacaagctgcccggcgagggcaatgctggcctgctgggattgggccccgaagccgctgctccagggaagcgtattcgcaagccttctctcctctacgaaggattcgaatccccaactatggcctctgttcccgccttgcagctgacgcccgcaaatcctcccccgcccgaggtgagcaaccctaagaagcccggacgggtgaccaaccagctccagtatctgcacaaagtggttatgaaagccctctggaagcaccaattcgcatggccgtttcgtcagcctgtggacgccgtgaagctgggacttccagattatcacaaaatcatcaaacagcccatggacatgggaacgatcaagcggagactcgagaacaactattattgggcagccagcgagtgtatgcaggacttcaacaccatgttcacaaactgctacatctacaataagcccaccgacgacatagtgcttatggctcagaccctggaaaagatcttcctgcaaaaggtggcctctatgccccaggaggagcaagaattagttgtgactatccccaagaattcacacaagaaaggagcaaaattggcggccctccagggatcggtcacatctgcccaccaggttcctgctgtgagctccgtttctcacacagcactatacaccccaccacccgagattccgacaaccgtactgaacataccgcacccttctgtgatttcctcaccactgctgaaatcactccactccgccggacccccgcttctagccgtaactgcagccccacctgctcaacctcttgcaaagaaaaagggtgtgaaacgcaaagcagacacaactacaccaacaccaaccgcaattctcgcgccaggctccccagcgtcaccacctggcagcctcgagccgaaggcagctagactcccccctatgcggcgcgaatctggcaggcccattaagccaccgcgcaaggacctgcccgattcacagcagcaacaccaatcaagcaaaaaggggaagttaagcgagcagttaaagcactgtaacggtatccttaaggagttgttgtctaagaaacatgcagcttacgcatggccgttttacaagcccgtagatgcctctgcactgggtttgcatgactaccacgatataatcaagcatccaatggacctctccaccgtgaaacggaaaatggagaatcgcgattaccgggatgcgcaggaattcgcagcagacgtgaggttgatgttcagtaattgttacaaatacaatccaccggatcacgatgtagtagccatggcccggaaattacaggacgttttcgagttccgctacgccaagatgcccgacgaacctctcgaaccaggccctttacccgtttccaccgccatgcctcccgggctcgccaagagttcctctgaatcctcatctgaggagagctcatccgaatcctcctccgaggaggaagaggaggaggatgaagaagatgaagaagaagaggagtcagagtcgtctgacagcgaagaggaaagggcccaccggctagccgaactacaggaacagctgcgggctgtgcatgagcagttagcggctctgtcacagggaccaattagtaaaccaaagcgtaagagagagaagaaggagaagaaaaagaaaagaaaggccgagaagcacaggggaagggctggcgcagacgaggacgataaaggacctcgggctccccgccccccacagcccaaaaagagcaaaaaagcaagcggcagcggtggaggttccgcggccctgggtcccagcgggttcggtccaagtggtggatctggcactaagctaccgaaaaaagcaacaaagactgctccccctgcgctgcctactggatatgacagtgaagaggaagaagagagccgaccgatgagctacgatgaaaaacgtcagctgagtctggatattaacaagctgccaggcgaaaagctgggaagagtggtgcatattatccaggcccgagagccaagtctgcgggacagcaatcccgaagaaatagagattgattttgaaacactaaaaccctccacgctacgcgaactggaacgctacgtgctctcctgcctacggaagaagccaagaaagccatataccatcaagaagccagtgggaaagacaaaagaagaactggccctggagaaaaagcgggaattagaaaagcgcctccaggatgtgtccggacaactgaactcgaccaaaaaacccccgaagaaggcaaacgagaaaaccgaatcttcctccgcacagcaggtggccgtgtcacgactcagcgcgtcaagttccagctcagatagttcctcgagctcctcctcgtcttcatcaagcgatacaagtgactcagattccggctag

SEQ ID NO: 180791 - DNA, 2406 bp, Artificial Sequence
  Description of Artificial Sequence: Synthetic coding sequence
atgctgcagaacgtgaccccccacaacaagctgcccggcgagggcaatgccggactgctcggactcggtcctgaggctgctgcccccggcaaacgcattcgaaagccgagcctcctttacgagggcttcgagtcaccgaccatggcctctgtgcctgctcttcagctaactccagctaatcctcctccacccgaagtgtcgaacccgaagaagccggggagggtgaccaatcagctccagtatctacacaaagtggtgatgaaggccctgtggaagcatcagttcgcctggccattccgacagccagtggacgcggttaaactggggctgcctgactaccacaaaattatcaagcaaccgatggatatgggcacaataaagcggcggctcgaaaacaattattactgggccgcctcagagtgtatgcaggacttcaacaccatgtttaccaattgctacatttacaataagccaactgatgacattgtgctcatggcccagacattagagaagatctttcttcagaaagttgccagcatgcctcaggaggaacaggagttagtggtgacgatcccaaaaaactctcataaaaaaggcgccaagctggccgccttgcagggaagcgtgacatccgcccaccaagtacctgctgtgtcctccgtaagtcataccgccttgtatactccaccccctgagattcctaccactgtcttaaacatccctcacccttccgtgattagcagtcctcttttaaagagccttcactccgctggtccccccctcctagctgtgactgctgctccaccagcccagccccttgccaagaagaagggtgtgaagcggaaagctgacaccactactccgacacctaccgctatactggcccccggctctccagctagccccccgggaagcctggagccaaaggcagccaggctccctcctatgcggcgggagagcggccggcccataaagccaccacgaaaagacctgccagattctcagcagcaacaccagagtagcaaaaagggaaagttgtccgaacagctaaagcattgcaatgggatcctaaaggaactgctgagtaaaaagcacgctgcatacgcttggccattctataagccagtggacgcaagcgccctcgggctacacgactatcatgacataatcaaacatcccatggacctgtcaacagtgaaacgaaagatggaaaaccgtgattaccgcgacgcccaggagttcgcagctgatgtacggttaatgttctccaactgctacaaatataacccaccggatcacgacgtcgtcgcgatggcccgcaagctgcaggacgtgttcgagtttagatacgcgaagatgccggacgagccgctagagcctggacccctgcccgtctccactgctatgcctccaggattggccaaaagctcatcagagtcgtcttctgaggaatcttcttctgaaagtagcagcgaggaggaagaagaggaggatgaggaggacgaagaagaggaggagagtgagtcttcagactctgaggaggagcgcgcccacagactcgccgaactgcaggagcagcttcgagctgtacatgagcaactggcagcactgagtcagggtcccatctccaagccgaagcgcaaacgggaaaagaaagaaaagaaaaagaaacgcaaagccgagaagcatcgcgggagagctggtgccgacgaagatgataaaggcccaagggcccccagaccaccccagcccaagaaaagtaaaaaggccagtggcagcggtgggggaagcgctgcactgggaccttctggttttggtccctcgggcggctcagggaccaagcttcctaagaaggccaccaaaaccgctccgccagccctccctacaggctatgacagcgaagaagaagaagaaagccgcccaatgtcctatgatgaaaagaggcaactgtcactggacatcaacaagttaccaggagaaaaactggggagagtggtccatatcattcaggcccgcgagccatccctccgtgatagcaatcccgaagaaatagagattgatttcgagaccctgaagccctcaaccttgcgtgaactggaacgctatgtgctgtcctgtcttcgtaagaaacctcgtaaaccctacaccattaaaaagccagtgggtaagacaaaggaagaactcgctttagagaagaaaagagaactggagaagcgccttcaggacgtttctggtcagctcaactccaccaaaaaacctcctaagaaagctaacgagaaaactgaaagcagcagcgcccaacaggtggcggtgtctcggttgagtgccagcagcagcagttccgattcctcaagcagttcctcttcgtctagcagctccgacacctctgattctgatagcggctag

SEQ ID NO: 180792 - DNA, 2406 bp, Artificial Sequence
  Description of Artificial Sequence: Synthetic coding sequence
atgctgcagaacgtgaccccccacaacaagctgcccggcgagggcaacgcaggcctgctgggcttaggcccagaggcagccgctcctggcaagcgcattaggaagccatccctcctgtatgaagggtttgagagccccaccatggcctcagttcccgccctccagctgacccccgcgaatcctcccccacctgaggtatcaaaccccaagaaacctggacgggtgacgaatcaacttcagtacttgcataaggttgtcatgaaagcactgtggaagcaccagttcgcatggcccttcaggcagccagtggatgccgtgaaactgggtttgccggactatcacaaaataattaagcagcccatggacatgggtaccattaaacgtcgcctggagaacaattactattgggccgctagcgaatgtatgcaagatttcaataccatgtttacaaattgctacatctacaacaagcccaccgacgatatcgttctcatggcacagacgttggaaaagatctttttgcagaaggtcgcgagcatgccccaggaggagcaggagctggtcgtgaccattcccaaaaattcccataaaaagggggccaagttagccgcactgcaaggctccgtaacctcggcccaccaggtgccggccgtgagcagtgtgagtcacacagctctgtataccccaccccccgagatccccacgaccgttctgaacatcccgcacccctccgtcatctcatccccacttcttaaatccctgcattcggccggccccccgctgctagccgttaccgcagctccgcccgcccagcccctggcaaaaaagaagggggtcaagaggaaggccgacacaacgaccccaactcctacagctatactagccccgggcagccctgcctccccacctgggagtctggagccaaaagctgctagattgccaccgatgcgtcgcgagtccggcaggccgattaagcccccccggaaagatttacccgattctcaacagcagcaccagtcatcaaagaaaggaaagctgagcgaacagctaaagcactgtaacggaatcctcaaagagctgctatccaagaagcatgccgcatacgcatggcctttttacaagccagtcgacgctagcgctctgggcctgcacgattatcacgacatcataaaacacccgatggatttgagtactgtcaagagaaagatggagaaccgagattatcgcgacgctcaggaattcgctgctgacgtaaggctcatgttctctaactgctacaagtataatccccctgaccacgacgtagtggctatggcccggaagctgcaggatgtctttgaattcagatatgcaaaaatgcccgatgaaccactcgagccagggcctctgcctgtgagcacggccatgccacccggtctcgcaaagtccagcagcgaaagctcaagcgaagaatcttccagcgagtcctcatctgaagaagaagaggaagaagacgaggaagatgaggaagaggaggagtccgagtcctcggacagcgaagaagaacgggcccatcggcttgcggaactgcaggagcagcttagggccgtgcacgagcaattggccgccctgagccagggcccaatcagcaaacctaaacggaaaagggaaaaaaaggagaaaaagaaaaaacgcaaggcagaaaaacacaggggaagagccggtgccgatgaggatgacaaaggtccgagagctcctcggccaccacagcctaaaaaatcaaagaaggccagcggcagcggcggaggatctgcggcactggggccgagtggatttgggccctccggcggctcaggcacgaagctccctaagaaggctaccaagacagctccccctgcattgccaaccggatatgacagcgaggaggaagaagagagccggccaatgtcctacgatgagaagcggcagctctcactagacattaataaacttcccggggaaaagctgggaagagtggtccatataattcaagcgagagagccatcactccgggacagcaatcctgaagaaattgagatcgactttgaaaccctgaaaccttcaacattgagagagctcgagcggtacgtactcagttgccttaggaagaagccccgcaagccctatacgatcaagaaacccgtggggaaaactaaggaagaactggctctggaaaaaaagcgggagttggagaagcgtttacaagatgtgtccggccagctcaactctaccaaaaagcctccaaagaaggccaacgaaaaaaccgagtcatctagcgcgcagcaggttgcagtgtctaggttgtcggcatcaagttcttcatcagattccagcagttctagttcctcgtccagctcatcagacacctccgattccgatagtggatag

SEQ ID NO: 180793 - DNA, 2511 bp, Artificial Sequence
  Description of Artificial Sequence: Synthetic coding sequence
atgctgcagaacgtgaccccccacaacaagctgcccggcgagggcaacgccggacttctaggtctgggcccagaagccgccgcacccggcaagcgaattagaaaaccctccctcctttatgaaggattcgaatctcctaccatggcatccgtcccggccctgcagctgacaccggcaaaccctcccccccctgaggtgtccaatccaaaaaagcccggtagagtgacaaaccagttacagtatctgcataaagtggtgatgaaggctctttggaaacaccagtttgcctggccattccggcagccggtcgacgcagtgaagctgggcctcccagattaccacaagatcatcaagcagcctatggatatgggaactatcaaacgtagactggaaaacaactattattgggccgcatcggaatgtatgcaggatttcaataccatgtttactaattgttatatctacaacaaacctacagacgatattgtcttaatggctcagactctggaaaagatatttcttcagaaggtggcgtccatgccacaagaggagcaggagcttgtcgtgaccattccaaagaacagccacaagaagggcgctaagctggccgcacttcaaggctccgtgacttccgcacatcaggttccagcagtatcttccgtttcacacaccgccttatatacccccccacctgaaatccccacgacagtcctgaatattccgcatccttctgtgatctcctccccgcttcttaaatcactgcattcagcgggaccaccgctgctcgccgtaactgccgccccacctgcgcaaccccttgccaagaagaagggcgtgaaaaggaaggccgatactactacccccacacccactgcgatcctcgcccctggatctcctgcctcacccccaggcagcctagagcccaaagctgcccgattacccccgatgagacgggaaagcggtaggcctattaaacccccaaggaaagatctgcccgattctcagcagcaacatcagtcgtctaagaaaggcaaattatccgaacagctcaaacattgtaatggcatactaaaggaactcctctcaaaaaagcatgccgcctacgcctggccgttttacaagcccgtcgatgccagcgctctggggttgcacgactatcacgacataatcaaacatcccatggatctgagtaccgtgaagaggaagatggagaatcgcgattaccgtgatgcccaagagttcgccgccgatgtgcgacttatgttcagtaactgctataaatataacccacccgatcacgacgtggtggcaatggcccgcaagttgcaggacgttttcgaatttcggtatgctaaaatgccagacgaaccgctggagcccggaccactgccggtgtctaccgcgatgccacctggtctggctaagagttcctctgagtccagcagcgaagaatcctcatcagagtcaagttccgaggaagaagaggaagaggatgaggaagatgaagaggaagaggagtcggagtcatctgactcagaggaggaacgtgcacaccggttagccgagctgcaagaacagctgagggcagtacatgaacaattggcagccctttcgcagggccctatatcaaaacctaagcgaaagcgggagaaaaaagaaaaaaagaagaagcgaaaggccgaaaagcatcgaggccgggctggcgcagatgaggacgataagggaccccgcgctccacggccaccccagccaaaaaagagtaaaaaggcttccgggtccggcggcggaagcgctgctctcggacctagtgggtttggcccatcaggagggagcggcacaaaactccaggctggcgtgcagtggagggacttgggcctgttacaaccgcctttattggggtttaagcggtttagctgcctgtccctgcccagttcacaggactacagacttcccaagaaggccactaagaccgcgccccccgcccttcccacagggtatgattcggaggaagaagaggaaagcagacccatgtcatacgatgaaaagagacagctgagcttggatatcaataagctgccaggagagaagctgggaagggtggtccacatcattcaggctagagaaccgtctctaagagattcaaatcccgaagaaattgagatagacttcgagaccttaaagcccagtacactgcgcgagctagaacgttatgttctcagttgcctgagaaaaaagccaagaaaaccatataccattaagaagcccgtgggcaaaacaaaagaggaattagccctcgagaagaagcgagagctggaaaagaggctccaggatgtctcaggacagttgaactctaccaagaaacccccaaaaaaggctaatgagaagacagaaagctccagcgcccagcaggtcgccgtcagccgcctgagcgcgagctccagttcctctgacagctccagcagctcctctagtagtagttcatcagacacctccgactcagattccggttag

SEQ ID NO: 180794 - DNA, 2511 bp, Artificial Sequence
  Description of Artificial Sequence: Synthetic coding sequence
atgctgcagaacgtgaccccccacaacaagctgcccggcgagggcaacgctgggctattgggactgggacccgaggctgccgcacctggcaagaggatcagaaagccatcgctgttgtatgaaggttttgaatctccaacgatggcctccgttcctgctttgcagctcacacctgcaaacccgccaccccccgaggtaagtaatccaaaaaagcctggtagggtgaccaaccagcttcagtacttgcataaagtggtcatgaaggccctctggaagcatcagttcgcatggcctttcaggcagccagttgacgcagtcaagctggggttaccagactaccataagatcatcaaacagcctatggacatggggacaatcaagcggaggctggaaaataactactactgggccgctagcgagtgcatgcaggattttaacaccatgttcaccaactgctatatctacaataagcccacggacgacatcgttctaatggcccagacgctggagaaaatttttctgcaaaaggtggcttccatgccccaggaggagcaggagctggtagtgacgatacctaagaacagccacaagaagggtgccaagctggcggctctccaaggtagcgtgacgagcgcccaccaggtcccagctgtctctagtgtgagccacacagccctctatacccctcctccagagataccgacaacagttctgaacatccctcacccaagtgttattagttcacctctcctgaaaagcttgcactctgccgggccgcccctcctggccgttacggccgcacccccagcccaaccactagctaagaaaaaaggtgtcaaacgcaaagccgatacaacaactcctacaccaacggctattttggctcccggatcgccggcaagcccaccagggtcgcttgaacctaaagccgctcggttaccccctatgcgtcgggagtccggaagaccaattaagcctcccaggaaagacctgcccgattcccagcagcagcaccagtccagcaagaagggtaagctttccgaacagctaaaacactgtaatggcattttgaaggagctactgtccaagaagcacgctgcgtatgcttggcccttttataagccggtggatgcctcagcactaggcctacatgattaccatgacattatcaagcatccaatggatttatccactgtcaagagaaaaatggaaaatagggactacagggacgcgcaggagtttgctgctgacgtgcgactgatgttctccaactgttataaatataatccacccgatcatgatgtcgtggccatggcacgaaagctccaggacgtgtttgagtttcgctacgccaagatgccagacgagcctctggagcccgggcctctgcccgtcagtactgccatgccacctgggttggccaagagcagctcagagtccagcagcgaggaatcctcatccgagtcctctagcgaagaggaggaggaggaggacgaggaggacgaggaggaagaagaatctgaatctagcgacagcgaggaagagcgggcacaccgactggccgagttacaggagcaactgcgtgccgtgcatgagcagttagctgcgttgtcgcaggggccaattagcaaacccaagaggaagcgggagaaaaaggaaaagaagaagaagcgtaaggccgagaagcaccgggggagagccggcgctgatgaggatgataaaggcccgagagcccccagacccccccaacccaaaaagagtaaaaaggcctcgggaagcggggggggatcagcagcactcggcccttccgggtttggccccagtggtggatccggtacgaaactgcaggctggtgttcagtggagggacttaggtctgctccagccacctttgctcgggtttaagcgcttcagttgcctgagcctgccatcttcacaggattatagactgcctaagaaggcgactaagactgcgccgccagccctgcccaccggctacgacagtgaggaggaagaggaaagcaggcccatgtcctatgatgagaagagacaactttctttagacatcaacaagttacctggagagaaactcggtcgggtggtccacattatccaggcgcgagagccgagcttaagggatagcaatcccgaagaaattgaaattgatttcgaaactctgaagccctccacgcttagagagctggagcgatatgtgctatcctgtcttaggaaaaaaccacgtaaaccgtacacaatcaagaagcctgtgggcaaaacgaaagaagagctagcattggagaaaaaaagggagctggagaagaggctccaggacgtgtctggccaactgaactcgactaagaagcctcctaaaaaggccaatgagaaaaccgagtcctcatcagctcagcaagtggccgtgagcaggctgtccgcctcaagtagttcttccgattcctcaagctcctcatcatcgtccagctccagtgatacatccgatagcgactcggggtag

SEQ ID NO: 180795 - DNA, 2511 bp, Artificial Sequence
  Description of Artificial Sequence: Synthetic coding sequence
atgctgcagaacgtgaccccccacaacaagctgcccggcgagggcaacgcgggtctgctgggacttggtccagaagccgcagcccccgggaagcgtatcaggaaaccttcgcttctgtacgaaggctttgagtctcctactatggcaagtgtgccagccctgcaattgacacccgcaaatccccccccgcctgaggtatccaaccccaaaaagcccggccgcgtaacgaatcagttgcagtatctgcacaaggttgtaatgaaagctttgtggaaacatcagttcgcatggccatttaggcagcctgtggacgccgtcaagttgggtctccctgattaccacaagattattaaacagcctatggacatggggactatcaagcgaagactggagaataactactattgggccgcctcggaatgcatgcaggattttaacaccatgttcacaaattgttacatctacaacaagccaaccgatgacattgtgctgatggcacagacattggaaaaaattttcctgcagaaagtggctagtatgccacaagaggagcaagagctcgtcgtgacgatcccgaaaaatagtcacaagaaaggcgccaagcttgctgccctacagggctcggtcacatctgctcatcaggtgcctgccgtctcttcagtcagccacacggctttgtatacacccccgcccgagattccaacaactgttctcaatatcccacacccgtctgtgatctcttcccccttgctgaagtcactacattctgccggcccaccacttcttgctgttaccgcggctccccctgcacagcctcttgcaaaaaaaaaaggagtcaagagaaaggccgatacgacaacacctacccccacagcgatcttagcaccagggtctccagcctcaccccctggctctctggagcccaaggccgcaaggctgcctccaatgcgacgagagagtggccggcccattaagcctccacgcaaggatttaccagacagccagcagcaacatcagtcatcaaaaaagggtaaactgagcgagcagcttaagcattgtaacggaatcctgaaggaacttctctcaaagaaacatgccgcctacgcctggcccttttacaaacctgtggacgcctctgcgttggggctccatgactaccacgatatcattaagcacccaatggatctgagcaccgtcaaacgtaaaatggagaatagggactatcgggacgcacaggagttcgcagctgatgtacgtctcatgttctccaactgctataaatataacccccctgatcacgatgtggtcgcgatggcaaggaagctacaggacgtctttgagttcagatacgccaagatgccagacgagccactggagcctggccccttgcctgtgagcaccgccatgccacctggactcgctaagtcaagttctgagagctcaagcgaagaatcatctagcgagtcttcctctgaagaggaagaagaggaggatgaggaggacgaggaggaggaggagagcgagagttccgattcagaagaggagcgggcacacagactggccgagctgcaggaacaattgagggcagtgcatgagcagttggccgctctgagtcagggccctatcagtaagcctaaaagaaagagggagaagaaggagaaaaagaagaaaagaaaggctgagaaacacaggggcagagctggcgccgatgaggacgataaaggtcccagagccccgcgccccccccagcccaagaagtccaaaaaagcgagtggatccggtggcggcagcgcggccttgggaccctccggctttggcccaagcggggggagcggcacgaagctccaggccggtgtccagtggagagatttgggcctgctacagccaccactgctgggatttaaacggttcagctgtttgtccttgccgtctagtcaggattatcggctgccaaagaaggcaacgaaaaccgcacctcctgcactgcctaccggttacgactctgaagaggaagaggagagtcgacctatgtcatatgacgagaaaaggcagctgtcgcttgacattaacaaactgcccggcgagaagctgggtcgggtcgtgcacataattcaggcgagggaacccagcctacgcgactctaacccagaggagatcgaaattgactttgaaacactgaagccatctacgctcagagaattggagcgctatgttctgtcctgccttaggaaaaaaccgcggaagccatacactatcaaaaaacccgtgggaaagaccaaagaagaactggcattagaaaaaaaacgggaactggagaaaaggcttcaggatgtcagtggccagcttaatagtaccaagaaacccccaaagaaagctaatgagaagaccgagtcatctagcgcgcagcaggtggccgtcagccgcttatctgcctcttcgagttcttcagacagctcatcgagttcatcctcttcgagcagcagcgatactagcgattcagactctggctag

SEQ ID NO: 180796 - DNA, 2406 bp, Artificial Sequence
  Description of Artificial Sequence: Synthetic coding sequence
atgctgcagaacgtgaccccccacaacaagctgcccggcgagggcaatgcgggcttactgggcctcggtcctgaagccgcagcccctggaaagcggattaggaagcccagtctgctgtacgaaggctttgaatccccaaccatggcaagtgtcccggctcttcagctaaccccagctaacccccccccccctgaagttagtaaccctaagaagcccgggagagtcactaaccagttacaatacctgcacaaggtggtaatgaaggcactgtggaaacatcagttcgcgtggccattcagacaacccgttgatgccgttaagctgggtctcccagactatcataagattatcaagcagcccatggacatgggcactattaaacggcgtcttgaaaataactattactgggcagcatctgagtgcatgcaggactttaacaccatgttcaccaactgctatatctataataagcctacagacgacattgtgctgatggcccaaaccttggaaaaaatattcttgcagaaagtggccagtatgccacaggaagagcaagagttggtggtcactatccccaagaattcacataagaagggggcaaaactcgccgcattacaaggcagcgtcaccagcgcccaccaggttcctgccgtttccagcgtgtctcacacggcactgtatactcctcctcccgagatccccactaccgttctgaacatcccacacccgtctgtgatatcctcccccctactgaagtcccttcatagcgcggggccacctctgctcgctgtaaccgctgccccacccgcacagcctctggccaagaagaagggggttaagcggaaggctgacactaccacccctacccccacagccattctcgcccctgggtccccagccagccctcctggatcgctagaaccaaaggcagcaaggctacctccgatgcggagagagagcggaagaccaatcaagccgccacgcaaggatcttccggacagccagcagcaacaccagtccagcaaaaagggcaaactgagcgagcagctgaagcactgtaatggcatcctgaaagaacttctgtccaaaaaacacgccgcatatgcctggcccttctacaaacctgtggatgcctcagctttgggcctccacgactaccacgacataattaaacatcctatggatctaagtactgtaaaaagaaaaatggagaatcgagactaccgcgacgcccaagaatttgctgccgacgtgcgccttatgttctccaattgttacaagtacaatccacctgaccacgacgtggtcgcaatggctcggaagctgcaggacgtgttcgaatttcgctacgccaagatgcccgatgagcccctggagcctggcccgttgcctgttagtacagccatgcctcctggcttagccaagagctctagcgaatcctcttccgaagaaagctctagtgagtctagctccgaggaagaagaggaagaagatgaggaagacgaggaggaagaggagtcagagtcttcggacagcgaagaagaaagggcacaccgactggccgagctgcaggaacaactgagggccgttcacgaacagttggctgcactctctcagggcccgatctcaaaaccaaagcgcaagagggaaaaaaaggagaagaagaagaagagaaaagctgaaaaacatagagggcgcgcaggggccgacgaagacgataaggggcctagagctcctcgccctccacaacctaaaaagagcaaaaaagcctctggaagcggtggcgggagcgcagccctgggtcccagcggctttggaccctcaggtgggtctggcaccaagcttcctaagaaggcaactaagaccgccccccctgcgctccctaccggttatgattcagaggaagaggaagagtctcgacctatgtcctacgacgagaagcggcaattgtccctggatatcaacaagctgccaggggaaaaactgggtagggtggtgcacatcatacaggcccgcgaacctagcctgcgggactctaatccagaggaaatcgagattgattttgaaacactgaagcccagcactctgagggagttggaaagatatgtactgtcgtgcttacggaagaagccgagaaaaccctacaccatcaagaaaccggttggcaagactaaggaagagctcgccctggagaagaaaagggaactggaaaaacggctgcaggatgtgtccggccagctcaattcaacaaagaaaccacctaagaaggccaatgagaaaacagagagctcgtcagcccagcaggtggctgtctcccgactgtctgcaagttcctcctccagcgactcatcttcgtcaagctccagtagttcgtctagtgatacatccgactccgactccggctag

SEQ ID NO: 180797 - DNA, 2406 bp, Artificial Sequence
  Description of Artificial Sequence: Synthetic coding sequence
atgctgcagaacgtgaccccccacaacaagctgcccggcgagggcaatgcagggcttcttggactcggtcctgaggccgccgctcccggcaaaaggatacgcaagccatctctactgtatgaaggtttcgagagtcccacaatggcatcggtaccagcattgcagttgacgccagccaacccgccccctccggaggtgtcaaaccctaagaaacccgggagagtcacaaatcagttgcagtacctgcacaaggtcgttatgaaagcattatggaagcatcaatttgcttggccgtttcgccaacctgtggacgcagtgaaactcgggttacccgattaccacaaaatcatcaaacaacctatggatatgggcaccattaaacgaagattggaaaacaattactattgggccgccagtgagtgtatgcaggatttcaacaccatgttcacgaactgttacatctacaacaagccaacagacgacatcgtactgatggcccagactctggaaaaaattttcctccaaaaggtggcttcgatgcctcaggaagagcaggaattggttgttacaattcccaaaaacagtcataaaaagggagccaaactcgccgctctccagggcagcgttacctcagcacatcaagtgccggctgtgagtagtgtgtctcacaccgcactgtacactccccctcctgaaattccaacaacagttctgaacatccctcacccctccgttatctcctcacctcttctaaagtccctgcacagcgccggacctcctttattggctgttacagctgcgcctccagctcagccgttagcaaagaagaagggggtgaagagaaaggccgatactacaacgcctactcccactgccattctcgcacccggcagtcctgcgtcccctcctggcagcttagaacctaaggccgctaggctgccacccatgcgccgggagagtgggcgtccaatcaagccaccgaggaaagatctacccgatagccagcagcagcaccagagcagcaagaaaggaaagttgtccgagcagttaaagcactgtaatggcattctgaaagaactgttgtcgaagaaacacgctgcctacgcctggcccttctacaagcccgtggatgcctccgctctgggactgcacgattaccacgacatcattaaacaccccatggacctctccactgtgaaaaggaagatggagaaccgagactaccgggacgcgcaagagtttgctgcagatgtgagactcatgttctctaattgctacaaatacaatcccccagaccatgacgtagtggccatggcccgcaagcttcaagacgtgtttgaattcaggtacgctaagatgcccgatgaaccactcgaacccggccccctacccgttagtactgcaatgccacctggccttgcaaagagcagtagcgagagttcgagcgaggagtcaagtagtgaatcttcttcggaagaagaggaggaggaggacgaggaggacgaggaggaggaggaatctgagtcatctgattctgaggaagaacgcgctcaccgcctggccgaactacaggagcagctgagggcggtgcatgagcagctcgccgccctgagccaggggccgatctccaagccaaaacgcaagcgtgagaagaaagaaaagaagaagaaacgaaaggccgagaagcacagaggcagagcaggagcggatgaggacgacaaaggccctcgggcaccaagacccccacaacctaagaaatctaaaaaggcctcaggcagtggagggggctcggctgctttaggccccagtggattcggcccctccgggggcagtggtaccaaattgccaaaaaaggctacaaagacagcccctcccgcactgcccacaggttatgatagcgaggaagaggaggagtctcgcccgatgtcatatgacgagaaaagacaactgtccctcgacattaataaactgccgggagagaaactgggccgcgtggtccacatcattcaggcgcgggaaccctcactgcgggattcaaatcctgaggaaatagagattgacttcgaaactctcaagccaagcactctcagagaactcgaaagatacgtgctgagctgtctcagaaaaaaacccagaaaaccatataccattaaaaagccggtcgggaaaacaaaggaggaattggcccttgagaaaaagagggagctagagaagcgtctacaggacgtgtccggccagctgaattctactaagaagccacctaaaaaggctaatgagaagacagagagtagttctgcgcagcaagtggccgtttcacgtctcagtgcttcttcatcttcctcggacagcagttcaagctcctcctcctctagctcttcagatactagcgattctgactccggctag

SEQ ID NO: 180798 - DNA, 891 bp, Artificial Sequence
  Description of Artificial Sequence: Synthetic coding sequence
tgacggcccctgggcgtgcagcagcccggcgcccggctgcccggcgaaggcaacgcaggcctgctgggcctaggtcccgaagcagccgctcctgggaagcgaatacggaaaccctccctgttgtacgagggttttgagagtcctaccatggcaagcgtgcctgctctgcagttaacacccgcgaaccctccaccaccagaggtgtccaaccccaaaaagcccgggagggtcactaatcagctgcagtacctccataaggtggtcatgaaagctctttggaagcaccagtttgcatggccgttcagacagccggtcgacgccgtgaagctcggtctgcctgattaccacaagattatcaaacaacccatggacatgggcacaattaaacgacggctggaaaataactactactgggccgcttccgaatgtatgcaggatttcaatacaatgttcaccaactgctatatctacaataagcccactgatgatatcgtgcttatggcacagacacttgaaaaaatcttcttgcagaaagtggcttcaatgccacaggaggaacaggagctggttgttactatcccaaagaattcccacaaaaagggcgccaaactcgctgcactccaggggagcgtgacttccgcccaccaggttcctgccgtctcgtccgtgtctcacaccgctctgtatacacctccaccagagatccccacaactgtactcaatatcccgcatccttcagtgatcagttctcccctgctgaagtctctccacagcgccggacctccccttctcgccgtgacagcggcccctccagcccagccattagccaaaaaaaaaggcgttaaacggaaggcagataccacaacccctactccaaccgcgattctatag

SEQ ID NO: 180799 - DNA, 2406 bp, Artificial Sequence
  Description of Artificial Sequence: Synthetic coding sequence
atgctgcagaacgtgaccccccacaacaagctgcccggcgagggcaacgccggactgctgggactaggcccagaagctgcagcgccaggtaagcgcatcaggaagccttccctgctgtacgaagggtttgagagccccaccatggcttccgtgcctgccctgcagttgacccccgcaaatccgccgccccctgaggtctctaaccctaagaagccaggcagagtgactaatcagttacagtatctccacaaagtggtgatgaaagcactgtggaagcaccagtttgcttggccgttcagacaaccggtggatgcagttaaactggggctccccgactaccataaaataattaagcagccaatggatatgggtaccattaaacggaggctggagaacaactattactgggccgcaagtgagtgcatgcaagatttcaataccatgtttaccaactgttacatctacaataagcccactgacgacattgtgctcatggctcagaccctagaaaagatcttcctgcagaaagtggcgtcaatgccccaggaggaacaggagttggtggtgacaattccgaaaaactctcataaaaagggggctaagctggccgctcttcagggttctgttacctcagcccaccaggtacccgctgttagttcagttagtcacacggcactctacaccccgcctccggagatacccaccacagtctttaatattccacacccctcagtgatcagcagtcctctcctgaagtccttacactcagccggccctcccttgctcgcagtgactgcagctccccctgcccaacctctggccaagaaaaagggggtgaaaagaaaagccgacaccacaactccgactcctaccgccatcctcgctcctgggtccccagccagtcccccaggctcattggagcccaaagccgctaggctgccgcctatgcgccgggaaagcggaaggccaattaagccccctagaaaagacctaccagattcacagcaacagcaccagagttcaaaaaagggaaaattgagcgaacagctgaagcactgtaacggaattctgaaagaattgttgtctaaaaaacacgcagcctatgcctggccattctacaagccagtggatgccagtgcactgggcttgcacgattatcatgatattattaagcatccgatggacctgtccacagtaaaacggaagatggagaatcgggattatcgtgacgcgcaggaattcgctgccgatgtgcgcctgatgttttcaaactgttataaatacaatcctccagaccatgacgtcgtcgcaatggcaagaaaattgcaagacgtctttgagttcaggtatgctaagatgcccgatgagccactggagccggggcctttgccagtgtctactgccatgcccccgggccttgccaagagcagttctgaaagcagctctgaggaatcaagcagcgagtcaagcagcgaggaagaggaggaggaggacgaagaggacgaagaagaagaggagtcagagagctctgacagtgaagaggaacgcgcacaccgactggctgagctgcaggaacagctgcgggccgtccacgaacagctcgcagctctttcccaaggacccataagcaagcccaagcggaagagggaaaagaaggagaaaaagaagaaacggaaagcggagaaacatagagggcgtgcaggggccgacgaagatgacaagggaccacgcgcgcctcgacccccccagcctaaaaagagtaaaaaggcctcagggtccggggggggatctgctgccctgggccccagcggtttcggaccatctggtggctctggaacgaagctccctaagaaggctactaaaaccgcaccaccagccttaccaacagggtacgactccgaggaagaggaagagtcaaggccgatgtcttatgacgagaagcgtcagctgtctctcgatatcaataaacttccaggggagaagctgggcagggtggtgcacatcatccaggcaagggagccatccctgcgtgatagcaatccagaagaaattgagattgattttgaaaccttaaaacctagcacactcagagaactcgagcggtacgtgctatcgtgcctgcgaaaaaagcccagaaagccctacaccatcaagaagccagtggggaaaactaaggaagaattagctttggaaaagaaaagggagctggagaagaggctgcaggatgtctccggacagttaaactcaaccaagaaaccccccaaaaaagcaaacgagaaaactgagagcagttccgctcagcaagttgccgtgagccggctcagcgcgagcagtagcagctccgacagtagctcctcaagcagtagtagttcctcctccgatactagtgactccgattcaggatag

SEQ ID NO: 180800 - DNA, 1842 bp, Artificial Sequence
  Description of Artificial Sequence: Synthetic coding sequence
atgctgcagaacgtgaccccccacaacaagctgcccggcgagggcaacgctggtttactggggctggggccagaggctgctgcccccgggaagagaatacggaagccaagcctgctgtatgagggttttgagtccccgactatggccagcgttccggcactccaactaacccccgccaatcctcctccgcccgaagtctcaaacccaaagaaaccaggacgggtcacaaatcagctgcagtacttgcataaggtagtgatgaaggctctctggaagcatcagtttgcatggccgtttcggcaaccagtggacgccgtgaagcttggtctgcccgactatcataaaattatcaagcagccaatggatatgggcactataaaacgccgactcgaaaataactactactgggcagcctcagagtgtatgcaggattttaataccatgttcaccaactgttatatttacaacaagcccacagacgatatcgtgctgatggcccaaactctcgagaagatttttctgcagaaagtggcctcaatgcctcaagaggagcaagaactggttgtgacgattcctaagaattctcataagaagggtgcaaaattggccgcccttcaaggttcggtgacctctgcccaccaggtccccgcagtatctagtgtgagccacaccgccctgtatacacctccgcccgagatacccaccacagtgctgaatattccccatcccagcgtgatcagctcacctctgctgaaatctttgcattcagccggaccccctttgttagccgtgaccgcagccccacctgcccagcccctggctaaaaagaaaggagtgaaacggaaggccgataccactacccccactccgaccgccatcctggccccaggctcaccagcctctccgcctggatcactggaacccaaggccgctcgactcccaccgatgcggcgagaaagtgggaggccaatcaaaccaccaagaaaggacctaccagattcgcaacagcagcatcagagctcaaagaagggtaagctgagtgagcagctgaagcattgtaacggtatcctcaaagaactgctctcgaagaagcacgccgcctatgcatggcccttttataagcccgtagatgcgagcgccctgggcctccatgactaccacgatattattaagcaccccatggatctcagcacagtgaagagaaaaatggagaatagagattaccgcgacgcgcaggagttcgccgctgacgtcagattgatgttctccaattgctacaaatataatcctccagatcacgatgtggtcgccatggctcgcaaactacaagatgtcttcgaattccggtacgctaaaatgcctgatgaacccctggaaccaggaccactgcccgtgtcaactgcaatgccacctggcctggctaaatcttcttctgaaagtagttctgaagaatccagctctgagagcagttccgaagaggaagaggaggaggacgaggaggacgaggaggaagaagagtcagagagctctgattcagaagaagaacgagcccacagactggccgagctgcaggagcaactgcgagcagttcacgaacagttagccgcccttagccagggtcccattagcaagccgaaaagaaagagggagaagaaagagaagaaaaaaaagcggaaagctgagaagcatcgtggtcgggctggcgctgatgaagacgacaaggggcctagagcccccagacccccacaaccgaagaaaagtaagaaggcaagcgggagtgggggaggctctgccgctctaggtccgagtgggtttggtccaagcggggggtccgggacgtag

SEQ ID NO: 180801 - DNA, 1842 bp, Artificial Sequence
  Description of Artificial Sequence: Synthetic coding sequence
atgctgcagaacgtgaccccccacaacaagctgcccggcgagggcaacgctgggctgctcggcctcgggcctgaagccgccgcccccggaaagcggattcgaaaaccctccctgctttacgagggctttgagtcacccactatggcttcagtccccgctctacagctcactcctgcgaatcctcctccacctgaggtctctaacccaaaaaaacccgggcgggtgactaatcaactgcagtaccttcataaggtagtaatgaaggccctgtggaaacatcaattcgcgtggcctttccgacagccagtggacgccgtaaagctgggactgccagactatcacaaaattattaagcagcccatggatatgggaactatcaagaggagactcgaaaataactactactgggcggcgagcgaatgcatgcaagactttaacaccatgttcacaaattgctacatatacaataaacctacagatgacatcgtcctgatggcacagactctggagaaaattttcttacaaaaggtggctagtatgccacaagaagaacaggagctggtggttactattcccaaaaactcccataagaaaggagcaaagttagcagctttgcagggatctgtcacaagtgcccaccaggtccccgccgtgtcaagcgtcagccataccgctctgtacaccccacctcccgaaattcctactactgtcctgaatattccccatccttctgtcatctcaagtcctttacttaaatccctgcatagcgcaggcccgcccctgttggccgtcacagccgcccctccagctcagcctctggcaaagaaaaaaggcgtgaagcgcaaggcagacactaccaccccaaccccaacagcaattctcgcacccggttcccccgcctctccgccaggctcactcgagccaaaagccgcccgcctgcccccaatgagacgcgaaagcggtcggccaatcaaacctcctaggaaagacctgcctgattctcagcaacagcaccagtcgagtaaaaaggggaagctgagtgaacagctcaagcactgcaatggcattctaaaggaactgctgagtaaaaaacacgctgcctacgcttggcctttctacaagccagtggacgcctccgctttgggcttgcacgactaccacgacattattaaacaccccatggacctgagcaccgtgaagaggaagatggaaaacagagactatagagatgcccaggagttcgctgccgatgtgcggctgatgtttagtaactgctacaaatataatccccctgaccacgacgtcgtggctatggcgaggaagctccaagacgtgtttgagtttcgctatgctaagatgcccgatgagccattagagcctgggcctctgccggtgtcaactgctatgcctcctggtttggccaagtcatcaagtgagagctcaagcgaggaatcgagttccgaaagctcctcagaagaagaggaagaggaggatgaagaggacgaagaggaggaggaaagtgaatctagcgactccgaagaagaaagggcacacagattggccgaactccaggagcagcttcgtgccgttcacgaacagctcgccgcactttcgcagggacccatcagcaaaccgaaaagaaaaagagagaaaaaggagaagaagaagaagcgcaaagccgaaaaacacagagggcgtgccggtgcggacgaggacgataaagggcccagagcaccccggccacctcagccaaagaagtcaaaaaaggcctctggcagtggaggcggcagcgccgcgctgggcccttccggcttcggcccatcagggggctccggaacctag

SEQ ID NO: 180802 - DNA, 987 bp, Artificial Sequence
  Description of Artificial Sequence: Synthetic coding sequence
tgagccaagagcagcagcgagagcagcagcgaggagagcagcagcgagagttccagcgaagaagaggaggaagaagatgaggacgaggaagaggaggagtcggagtcaagcgacagcgaagaggagagagcgcatcggctggccgaactgcaggaacagctccgcgctgttcatgaacagcttgctgcgttatcccaggggcccatcagtaagcccaagcgcaagcgcgagaaaaaggaaaaaaaaaagaagagaaaggcagaaaagcatagaggccgagccggagcagatgaggatgataagggacctagggctccacgacccccccagcctaagaagtcgaaaaaggcttccggatctggcgggggatccgccgctctcggcccatccgggttcggtcccagcggcggaagcggcaccaaactccccaagaaagctactaagacagcaccacccgctttgccaacaggatacgattcggaggaggaggaggagtcccgacctatgagctacgacgagaaacgccagttaagcctggatatcaataaacttcctggtgagaaactgggcagggtggtccacatcatccaggcacgcgagccatcactgcgtgattctaatcccgaagaaattgaaattgactttgagacccttaagccctccaccctgagagaattagagaggtacgtactgtcctgcctccggaaaaaacctcgaaaaccctataccatcaagaagccggtgggaaagacaaaagaagaattagctctggaaaagaagagggaattggaaaagcgcctccaagatgtatccggacagttgaacagcaccaagaaaccacctaaaaaggctaacgaaaaaactgagtccagctctgctcagcaggtggcggtgagtcggctttctgcctcctcatcctcttcagatagcagcagttcatcctcatcttccagttccagtgatacctccgactcggacagcggctag

SEQ ID NO: 180803 - DNA, 1947 bp, Artificial Sequence
  Description of Artificial Sequence: Synthetic coding sequence
atgctgcagaacgtgaccccccacaacaagctgcccggcgagggcaatgccggactactcgggctgggccccgaggcagctgcgcccggcaagaggatacgtaagccttccctgttatacgagggtttcgaaagtccaactatggcttctgtaccagccctgcagctcaccccggcgaatccaccgcccccagaagtgagtaaccccaagaaaccaggacgggtcaccaaccagctgcagtatctgcataaagttgtgatgaaagctctttggaagcaccagtttgcatggccattcagacaacccgtggacgccgtcaagctcggcctgcctgactatcacaaaatcataaagcagcccatggacatgggcacaattaaacgtcggctagaaaacaactactactgggccgcctctgaatgtatgcaggactttaacacaatgttcaccaactgctacatctacaataaacctaccgatgacatcgtgctcatggcacagactcttgaaaaaatcttcctacagaaggtcgcaagcatgccacaggaggaacaagaactggtggtgaccatccctaagaactcgcataaaaagggggctaagttggccgctttgcagggcagcgttactagcgcccaccaagtgcctgcggtgagttccgtgagccatacagctctgtacacgccaccccctgagatccctacaacagtgctgaacataccacatccatccgtgatatcctcaccacttttgaaatctttgcatagtgccgggccccccttactggccgtgacagcagctccgcctgcccagccgctggctaagaagaaaggagtcaaacggaaggcagacaccactacccctactccaacagctatcctcgcacccggtagtcctgcctccccccctggatccctcgagccaaaggcagctagactgccacctatgcgccgcgagtcaggaagaccaattaagcctcctagaaaagatctgcccgactcacagcagcaacatcagtcctccaagaaggggaaactgtccgaacaacttaaacattgcaatggcatcctgaaagagcttctgtcaaaaaagcacgccgcttacgcttggcccttttataaacctgtcgacgcctcagcactcggattacacgactaccacgatattattaagcatcctatggacctatccacggtgaagcggaagatggaaaatcgagattatcgcgacgcccaggagttcgccgctgacgtgcgcctcatgtttagtaactgttataagtataatccccccgaccacgacgtggtcgcaatggccagaaaactccaggatgtgtttgaattccgctacgcaaagatgcccgatgaaccgcttgagcctggacctctccccgtgtcaacggctatgccccctggtctggcgaagagtagcagtgaaagctcttctgaagagtcctcgtccgagtccagctctgaggaggaagaggaggaggacgaagaggatgaagaagaagaggaatctgaatcatctgatagcgaggaagaacgtgctcaccgcctggcagaacttcaggagcaactgcgggcggtgcacgaacagctggcggcactcagtcaggggccaatatccaagcccaagaggaaacgcgaaaagaaggagaaaaaaaagaaaaggaaggccgagaaacaccggggaagggctggggcagacgaagacgataaaggacctagggcaccccgtcctccgcaaccaaaaaagtccaagaaagcttctggcagcggcgggggaagcgcagccctgggcccctctggatttggcccgtccgggggtagtggaactaaactccaggctggcgtgcagtggcgtgacctggggctcttgcagccacctctacttggctttaaaaggttcagctgcttaagtctgcctagctcccaggattattag

SEQ ID NO: 180804 - DNA, 2424 bp, Artificial Sequence
  Description of Artificial Sequence: Synthetic coding sequence
tgaaacggcggcggcggcagcgccaccgcccggggcggcgagtaccggcttccaggtgaaggtaacgctggactcttgggactcggtccagaagccgcggccccaggcaaacggattcgcaagccatcactgctatacgaggggttcgagagtcccaccatggccagtgtacctgccttgcagctgaccccagccaacccgccaccccccgaagtgagcaaccctaaaaagcctggccgtgtgacaaatcagttacagtacttgcacaaggtggtgatgaaggcattatggaagcaccagttcgcttggccattcagacagcccgtggacgcggtgaagctggggctgcccgattaccacaaaatcataaagcaaccaatggacatgggcaccattaagagaagattggagaataattactattgggccgcgagtgaatgtatgcaggactttaatacaatgttcacaaactgttacatttataataagccaacagatgacattgtcctcatggctcagacattagaaaagattttcctgcaaaaggtggcatcaatgcctcaggaagagcaggaactggtggtgacgatcccgaagaattctcacaagaagggtgctaagctagcggcgctgcaggggtccgtaacgtcagcgcatcaagtcccggccgtaagctcagtcagccatactgccctgtatacacctcccccagagatacctacgacggtcttcaatataccacaccctagtgtcattagttcgccactcttgaaaagtttgcatagtgccggaccccccttgctggctgtcaccgccgcccctcctgcccaaccattggctaaaaaaaaaggcgtcaaacggaaggccgatactacaacaccaacacctactgcaatcctggctcccggttctcccgcatcccctccaggaagcctggagcctaaggccgcccgcttgcctccgatgagacgcgagagtggccggcccatcaagcctcctaggaaggatctccctgattcacaacaacagcaccaatcatctaagaagggtaagctctcagagcaactaaagcattgcaatgggattcttaaggaacttttgtccaagaaacatgccgcttatgcgtggcccttctacaagccagtggatgcctccgcattagggttgcacgactatcacgatatcatcaagcaccctatggacctgagtacagtgaagcgcaagatggaaaaccgcgactatagggacgctcaggagtttgctgcagacgtgcgcctcatgtttagcaattgctacaagtataacccccccgaccatgatgtcgtggccatggcccgcaagctgcaagatgtgttcgaattccgctacgcaaagatgcccgacgagcccttggaacccgggcccctaccagtgtcaacggccatgccccccggtctggccaaaagctcatctgaatcctcgagcgaagaatcaagtagcgagagctcctcggaggaagaggaagaagaagatgaggaggacgaagaggaggaagagtccgagagctctgacagcgaagaggaacgagctcaccgactggcggaactgcaggagcagttgcgggcagtccatgaacagctggccgcactcagccaaggacctattagcaagcctaaaaggaaacgggagaagaaggagaagaaaaaaaagcgaaaggcggaaaaacacagagggagggccggcgctgatgaagacgacaagggccccagggcacccagaccccctcagcctaaaaagtctaaaaaggctagtggctcaggcggaggatcggctgccttaggaccaagtgggttcggcccgtctggcggatctggaacaaaattacctaaaaaggcgacgaagactgccccccctgccttacctactggctatgactccgaggaggaggaagagagccgcccaatgtcttacgacgaaaagcgtcaactatctctggacatcaacaagctccccggcgaaaaattgggcagggtcgtgcacataatccaagctcgtgagcctagtctgcgtgattctaatcctgaggaaatagagatagattttgagactctcaagccaagtaccctccgtgaactcgaacggtacgtgctgtcctgcttgaggaagaagcctcgcaaaccctacacaatcaagaagcccgtgggcaagactaaggaggagctcgcattagagaagaagcgggaattggagaagagactgcaggatgtgagcggccagctgaacagtaccaagaaaccacccaagaaggctaatgaaaagactgagtccagtagcgcacagcaggtggctgtgtcaaggttgtccgcctcctcttccagctccgatagtagctcttcatcatcttcaagttcatctagtgatactagcgattctgattctgggtag

SEQ ID NO: 180805 - DNA, 891 bp, Artificial Sequence
  Description of Artificial Sequence: Synthetic coding sequence
tgacggcccctgggcgtgcagcagcccggcgcccggctgcccggcgaagggaatgcgggactcctgggacttggtccggaggcagccgctcctggaaaaaggataaggaagcccagcctgctgtacgaagggtttgagtcacccaccatggcctctgttccggccctacagctcacaccggccaacccccccccccctgaagtatccaacccaaaaaagcccggtcgagtgacaaaccagctgcaatacctgcataaagtcgtcatgaaagccctgtggaaacatcagtttgcttggccgtttagacagcctgttgacgctgtcaaactaggtcttcctgattaccacaaaataatcaagcagcccatggatatgggcaccatcaaaaggcgactcgagaataactattattgggctgccagcgagtgtatgcaggatttcaacacaatgtttaccaattgctatatatataataagcctactgatgacatcgtccttatggcacaaactctcgagaaaattttcttgcagaaggtcgcttccatgcctcaagaggaacaagagctggtcgtcaccattccaaagaacagtcacaaaaagggtgcaaaattggctgccctccagggctcagtgacgagcgcacaccaggtgccagctgtttcctcggtgagccacacagctttgtatacccctccacccgagatccccactacagtcttcaatatcccacacccgagcgtgatctcatcacccctgctgaaaagcttgcactcagcgggtcccccgctgctcgcagtgactgcagccccacctgcacagccactggccaaaaaaaagggagtgaaacgcaaagctgacaccaccacgccaactcctactgccatcctgtag

SEQ ID NO: 180806 - DNA, 2265 bp, Artificial Sequence
  Description of Artificial Sequence: Synthetic coding sequence
atggccagcgtgcccgccctgcagctgacccccgccaaccccccccctccggaggtgagcaaccctaagaagccgggcagagtgacaaaccagctacagtacctgcacaaggtggtcatgaaggccctgtggaagcatcaattcgcctggccctttcggcagcccgttgacgcggttaagctgggtttgcctgattaccacaagattataaagcagccaatggacatggggaccatcaagcgcaggctggaaaataattattactgggccgcctccgagtgtatgcaagactttaataccatgtttacaaattgctacatttacaacaagccgaccgatgatatagtcctgatggcacagacgctagagaaaatttttttacagaaagtggcttccatgccccaggaagagcaggaactggtagtgaccatccccaaaaatagtcacaaaaagggggcgaaactagccgccttgcaggggtctgtgacatcagctcaccaggtcccagcagtctcctctgtgtcacacaccgcactgtataccccaccccctgagattcctactaccgtcttgaatattccccacccgtcagtaatttcaagtcctcttttaaagtccctccacagcgccggccctcccctgcttgctgttactgcagcaccacctgctcagccattggccaaaaaaaaaggagtgaagcgaaaagccgataccaccaccccaactcccacagctatcctggctccagggtctcctgccagtcctcccggatcgctcgagccgaaagccgccagactgccccccatgcggcgcgagtccggtcggccgataaaaccccccaggaaagatttgccagactcgcagcagcaacatcaaagctcaaagaaaggaaaactgagtgagcagcttaagcactgcaacgggatcctcaaggaactgctgtcaaagaaacatgcggcttacgcttggcctttttacaaacccgtggatgcatctgctctgggactgcacgattatcatgatatcattaaacaccctatggacctcagcaccgtgaagagaaaaatggaaaatagagactaccgggacgcccaggagtttgccgccgatgtgcgcctgatgttttctaactgttacaagtacaacccccctgaccatgacgtggtagcaatggccagaaaattgcaagatgtgttcgaattcaggtacgccaagatgccggatgaaccccttgagcccgggccgctccccgtgagcaccgctatgcctccaggcctggcgaagtcatctagtgaatcttcgtccgaggagagcagttccgagtcttcgtccgaagaagaggaagaggaggacgaagaagatgaggaagaggaggagtccgaatccagcgacagtgaggaggagcgcgctcaccgattggcggagttacaggagcagctacgggctgttcacgaacagctggccgccttgtcgcaggggcccatcagtaagcccaagagaaagagagagaagaaggagaaaaaaaagaaaaggaaagctgaaaagcaccgcgggcgcgcgggagctgacgaagacgataagggaccgcgggcacccagacccccacaacccaagaaatctaagaaagcttcaggttcaggaggaggctccgcagcactcgggccttctggattcggacctagcggcggtagtggcacaaaactgcccaaaaaagccacaaaaaccgccccacccgcattgccgaccggctatgactccgaggaagaggaggagagcagacctatgtcatacgatgaaaaacgtcagctttctctggacatcaacaagctgcctggagagaagctggggagagtggtgcacattattcaggctcgagagccctcactccgcgatagcaatccggaggagatagagatcgattttgaaactcttaagcccagtaccctgcgcgagttggagcggtacgtcctgtcttgtctgcgcaaaaaacctcggaaaccctacactatcaaaaagcctgtgggtaagacaaaggaggagttggcactggagaagaaaagggagctagaaaaaaggctccaagacgtgtcaggacaattgaatagcacgaagaagcctccaaagaaagctaatgaaaaaactgagtcctcctcggcccagcaggtggccgtatcaaggctgtccgctagtagttcctcatctgactcaagttcttccagttcgtcaagctcctcaagcgatacctctgactctgatagcggatag

SEQ ID NO: 180807 - DNA, 2406 bp, Artificial Sequence
  Description of Artificial Sequence: Synthetic coding sequence
atgctgcagaacgtgaccccccacaacaagctgcccggcgagggcaatgccggtctgctcggactgggtccggaggcagctgcacccggaaagcgcatcaggaaacccagccttttgtacgaagggtttgaatctccaacaatggccagcgtgccagctctgcagttgactcccgcaaacccaccacctcctgaggtcagcaacccaaaaaagcctggccgagttacaaaccaactgcaataccttcataaggtggtaatgaaagcgctatggaagcaccagttcgcttggcctttcagacagcccgttgacgccgtcaaacttggactgcccgactatcataagatcatcaagcagccaatggatatggggacgataaagcgccgtctcgagaacaattactactgggcagcgagtgaatgcatgcaagattttaacactatgttcacaaattgttacatttataataaacccaccgatgatatcgtgctgatggctcagacactggaaaagattttcctccagaaggtggcctccatgcctcaggaagaacaggagctggtggtgaccatccccaaaaacagccataagaaaggtgcaaagctcgccgctctgcaaggcagtgtgaccagtgcccatcaagtgcccgccgtatcaagtgtgtcccataccgcgctttacacgccaccacctgagatccccacaaccgtcttgaatattcctcatccttcagtaatcagttccccgctgctcaaaagccttcactccgccggcccaccactgctggccgtgaccgccgccccaccagcccagccattagccaagaaaaagggcgtgaagcgaaaagctgacacaacaacacctacccctaccgcgatattagccccaggctcaccagctagccctcccggctccctggaaccaaaggctgcaagactgccacccatgaggagagagagcggaagacccataaagccccccaggaaggacttgccggatagccagcagcagcatcagtcatctaaaaagggcaagctgtctgaacaactcaaacactgtaatgggattctcaaggagcttctgtctaagaagcatgcagcatacgcctggcccttttacaagccagtggacgcctctgctcttggactccatgactaccacgacatcattaagcaccccatggacctttcaacagtgaagagaaaaatggagaatcgcgattatcgggacgctcaggagttcgcagctgacgtgaggttaatgttctctaattgctataagtataatccacctgaccacgacgtggtggcgatggctcgaaaactgcaagacgtgttcgagtttaggtacgccaagatgcctgatgaacccttagagccaggccctctgcccgtgtccacagctatgccccctgggctggctaagagctccagcgaatcaagctctgaggaaagctccagtgaatcaagctctgaagaggaagaagaagaggatgaggaggacgaagaggaggaggagagcgaaagttctgattcggaggaggagagggctcaccgtctcgcggagctgcaagagcagttaagggctgtccacgaacagctggcagcgctttcccaggggccgatttcaaagccaaagagaaagagggaaaaaaaggagaagaagaaaaagcggaaagccgagaagcatcgtggacgtgctggggccgacgaggacgacaaaggacctcgggccccacgaccgccccaacctaagaaatccaagaaagcgtccgggtccggcggtggtagtgccgccttgggaccttcgggctttggtcccagtggagggagcggcacgaaacttcccaagaaagctaccaaaacagcaccacccgcattgccgacagggtatgactccgaggaggaagaggagagccgacctatgtcttatgatgaaaagcggcagcttagcctcgatatcaataagctgccgggcgagaagctgggtagggtcgttcatatcatccaggcacgcgagccaagcctgcgtgattcgaatcccgaggaaattgaaatcgatttcgagacgctgaaaccgagcaccctcagagaactagaacgttatgtattatcttgccttagaaaaaagccacgtaagccttataccatcaaaaaacctgtcggcaaaaccaaggaggaattggctttggagaagaaacgcgaacttgaaaagcgcctgcaggacgttagcgggcagttaaatagcactaaaaaacctcccaagaaggccaatgaaaagactgagtcttctagcgcacagcaggttgccgtcagccgcctgagcgcgagctcaagcagttctgactcctcatctagtagttccagttctagcagctccgacacctccgacagcgattcaggatag

SEQ ID NO: 180808 - DNA, 2424 bp, Artificial Sequence
  Description of Artificial Sequence: Synthetic coding sequence
tgaaacggcggcggcggcagcgccaccgcccggggcggcgagtacagactgccaggtgaaggcaacgctggactgcttggcctgggccctgaggccgctgctcctggcaagaggatccgcaagccgtctctgctttacgagggctttgagtcgccaacaatggcctccgtgcctgctctacaactgacaccggctaaccccccaccaccggaggtttccaacccaaagaaaccgggaagggtcactaatcaactgcagtaccttcacaaggtcgtgatgaaagccctgtggaaacaccaatttgcttggcctttcagacagcccgtggatgctgtgaaactggggctgcctgattaccacaagattattaaacagcccatggatatgggaaccataaagagaaggttagaaaataactactactgggccgccagtgagtgcatgcaggattttaatacgatgttcacgaattgctacatctataacaagcccacagacgacattgtgctgatggcacagactcttgaaaagatattcttgcaaaaagtagcgagcatgccacaggaagagcaggaattagtagtgacaatacccaagaactcccacaagaagggcgctaagctggcagctctccagggtagcgtgacatcagctcaccaggtgcccgccgtgtcatccgtgtcacacactgcactgtatacacccccaccagaaattcccactacagtcttgaacatcccacaccctagcgttatcagcagtccactccttaaaagcctccatagcgctggtcctcctctattggccgtcactgctgctcctccggcccagcccttagcgaagaagaagggagtgaagcggaaggcagataccacaacgcctactccgaccgcaatactcgcaccagggagcccggcttccccaccggggagcttggagcctaaagccgcccgtctccctccaatgagaagagaaagcggtagaccaattaagcctcccaggaaagatcttccagattcccaacagcagcatcagagcagtaagaaggggaagttgagcgagcagctcaagcactgcaatggcatcctgaaggaactgctttcgaagaagcacgctgcctatgcatggcctttctacaagccagtggatgcttccgctctggggctgcatgactaccatgacataataaaacatccaatggacctgtctacggtcaaacggaagatggagaatcgagactacagggatgctcaagaattcgccgctgatgttcgcctgatgttctccaactgctacaagtataatccacctgaccacgacgtcgtcgccatggccaggaaattgcaagacgtgttcgaatttcgatacgcaaagatgcccgatgaacccctggagcccggcccactccctgtgtccacggccatgcccccaggcctggccaagtcatcttcggagtcttcaagtgaagagtccagcagcgagagctcttctgaagaagaggaagaagaggacgaagaggacgaggaagaagaggagtccgaatctagcgattctgaagaggagagagctcatcggctcgctgagctgcaggaacagctgcgggccgtgcacgaacagttagccgctctgtcgcaggggccgatcagcaagcctaagcggaaacgcgaaaaaaaggaaaaaaagaaaaaacgaaaagctgagaaacacaggggacgcgccggagctgatgaggacgacaagggacctagagcacctagaccccctcaacccaagaaaagcaagaaagccagtgggtcaggaggaggatccgctgccctgggacctagcggctttgggccttctggcggcagtggcacaaagttgccaaagaaggcaactaaaactgcaccacccgcccttcccaccgggtatgacagcgaagaagaggaggagtcgcgtcctatgtcctatgacgagaagcggcagttgagcctcgacattaataaactcccaggagagaaactagggagagtggtccacattatccaggctcgagaaccttccttacgggacagcaaccccgaagaaatagaaatagacttcgagaccctgaagccgtctaccttacgcgaactggagcgctatgtgttgagttgccttaggaagaagccccggaaaccatatactattaaaaaacctgttggaaaaacaaaggaggaacttgcacttgagaagaaaagagaactggagaagcgactgcaggacgtgtcgggccagctgaattccaccaagaaaccccctaaaaaagccaacgagaagactgagagttcgtctgcacagcaggtggcagtgagcaggctgtcggccagctcatcttcatctgactcgagttccagctcgtctagtagctcttcctccgatacaagtgactctgacagcgggtag

SEQ ID NO: 180809 - DNA, 1092 bp, Artificial Sequence
  Description of Artificial Sequence: Synthetic coding sequence
tgagccaagagcagcagcgagagcagcagcgaggagagcagcagcgaatcatctagtgaggaagaggaggaggaggacgaggatgaagaggaggaagagtcagagtcgagcgacagtgaggaggaacgcgctcatagactcgccgaattgcaggagcagcttcgcgcagtgcacgaacagcttgctgcattgagccagggtcccatcagcaagcccaaaagaaagcgggaaaagaaagaaaagaaaaagaaacggaaggctgagaagcatagaggtcgcgctggcgctgacgaggatgataaaggtccccgcgctccccggccgccacagccgaagaagtctaaaaaggcttctggatccggcggtggaagcgccgcactgggaccctcagggtttggaccctccgggggttccggtaccaagctgcaagccggcgtgcagtggagggatctggggctccttcagcctcccctcctgggattcaaacggtttagttgtctctctttacccagttcccaggactaccgtcttcccaagaaggccacaaagacggcacccccggcccttcctaccggctacgatagcgaagaggaggaagagtcccgccccatgtcctatgacgagaagcgacagctgtcattagatatcaacaaactgcccggtgagaaattgggacgagtggtgcatattattcaagctagagagcccagcttgagagattccaatccggaagaaatcgagatcgacttcgagacgttaaagccgagcactcttcgcgagttagaaagatacgtgctgtcgtgtctcaggaaaaagccacgaaaaccttacacaattaagaagcctgtggggaaaaccaaggaggagctggcactggaaaaaaagagggagctggagaaaaggctccaggacgtctcagggcaactgaattccaccaagaaaccccctaagaaggccaatgagaaaaccgaaagttcatctgcccagcaggtcgctgtaagccggttgagcgcatcatccagcagctcggattcttctagcagtagcagctcatccagtagcagcgatacatcagatagcgattctggctag

SEQ ID NO: 180810 - DNA, 2511 bp, Artificial Sequence
  Description of Artificial Sequence: Synthetic coding sequence
atgctgcagaacgtgaccccccacaacaagctgcccggcgagggcaatgccgggctgcttggcctaggtcctgaggccgcggctcccgggaaaagaattcgcaagcccagcctgctctatgagggttttgaatctcctacaatggcttctgtacccgcattgcagctcactcctgccaatcccccccctcccgaagtatcaaatccgaagaaacctgggagagttacaaaccagctgcaatacctgcacaaagtggtcatgaaggctctgtggaaacaccagtttgcctggcctttcagacagcccgtcgatgccgtgaaattgggccttccggactatcataagatcatcaaacagcccatggatatgggcactatcaagagaaggctggaaaacaattattattgggccgctagcgaatgcatgcaggattttaacacgatgtttaccaattgctacatctacaacaagcctactgacgatattgtcctgatggcacaaacgctcgagaagattttcctccagaaagtagctagcatgccccaggaggaacaagagcttgtcgtgaccattccaaaaaatagtcacaagaagggagccaaactggcggccctacaaggtagcgtgaccagcgcccatcaagtccctgctgtaagtagtgttagccacactgccctctatactcctccgccagagatccctactaccgtcctgaacataccacatccgtcagtgatcagttccccgctcctcaaaagcttgcattccgccggccctcccctcttggctgttaccgctgctccgccggctcagccactagccaaaaagaagggggtgaagcgcaaggcagatacaacaaccccaactcccaccgccatactcgctcccggtagtcctgctagcccgcctggcagccttgagccaaaggccgcccggctaccccctatgcggagggaatccggcagacccatcaaaccaccacggaaagaccttcccgatagccaacagcagcaccaatcatccaagaaaggaaagctcagtgaacaactgaagcattgtaatggcatcctgaaggagctcctgagtaaaaaacacgcagcttatgcctggccattctataagcccgtggacgcctctgcgcttggtctccacgactaccatgatattatcaaacaccccatggatctctccacggtgaagcggaagatggagaatagagactatagggatgctcaggagtttgctgcggacgtgcgacttatgttcagtaactgctacaagtacaaccctccagatcacgacgtggtcgccatggcaaggaaactgcaggatgttttcgaattcagatacgctaaaatgccagatgagcctttagagcccgggcccttacctgtgtccacagcaatgccccctggccttgcaaagagctcttcagaaagctcctcggaagaatctagtagcgaatccagcagcgaagaggaagaggaagaggacgaggaagacgaggaggaggaggagtcggagagctccgactccgaagaggaacgcgcccaccgcctcgcagaactacaggagcagctgcgggcggtgcatgaacagctggctgcactctcacaaggccccatctctaagccaaagcgcaaaagggaaaaaaaagagaaaaagaagaagaggaaggccgagaagcataggggaagagctggcgcagatgaggatgataaaggaccaagggctccccgccctccacagcccaaaaaatccaagaaagcgtccggctccgggggagggagcgcagccctgggcccatctggtttcgggccctccggagggtccggtacaaagctgcaagccggggtccaatggcgggacctaggactgttacagccacctctcctgggattcaaaagatttagttgtctaagtctaccaagttcccaggactaccgactacctaaaaaagcaacgaagactgcgcctcccgctctgcccaccgggtacgattccgaggaggaagaggagtcccgtcctatgagctacgacgagaagcgccagctgtctctggatatcaataagctaccgggggagaagctggggagggtagtccatataattcaagctcgggaaccctccctccgagactctaaccccgaggagatagaaattgacttcgagactttgaagccctcgactctgcgggagttggagcggtatgtattgtcctgtctaagaaagaaacctcggaagccttatacaattaagaaacctgttgggaaaaccaaagaagaactggcccttgagaagaagagggagctggagaagaggttgcaggacgtcagtggacagctcaattccactaagaagccaccaaagaaggcgaacgagaagacggagtcttcttctgctcagcaggtggccgtcagccggctaagcgcctcatcctcttcgtctgactcttccagtagcagtagcagtagtagctcgtcggacacgtccgactcagattccgggtag

SEQ ID NO: 180811 - DNA, 2046 bp, Artificial Sequence
  Description of Artificial Sequence: Synthetic coding sequence
atggacatgggcaccatcaagcggcggctggagaacaactactactgggcagcaagcgagtgcatgcaagactttaataccatgtttaccaattgctacatctataataagccaacggacgacatagtcttaatggcgcagactctcgaaaagatctttctccagaaggtcgccagtatgccacaagaggagcaagagcttgtggtcacaattccaaaaaattcccacaaaaagggggccaagctggccgccctacagggctcagttactagcgcacaccaggtgccagctgtgtcttccgtcagccataccgcattgtatacaccaccacccgaaattcctaccaccgtgctgaatatccctcatccttctgtgatctcgtcccccctgttgaagagcctacacagcgcgggcccacctcttctcgctgtaacagccgctcctccagcccagccactcgcgaagaaaaaaggggtcaaaagaaaggctgatactacgacccccacgccaaccgccatcctggcaccaggatccccagctagccctccggggagtctggagccgaaagccgcccggctgcccccaatgagacgagaatccgggcggccgatcaagccaccgaggaaggatctgccggattcccagcagcagcatcagtccagtaagaagggaaagctgagcgagcagctcaaacattgcaatgggatcctgaaagaactgctcagtaagaagcacgcagcttatgcgtggcccttctataagcctgtagatgccagtgcactggggctgcatgattatcacgatatcattaaacaccccatggaccttagcacagtaaagagaaaaatggaaaacagggattatcgcgacgcccaggaatttgcggccgatgtcagattgatgttttcgaactgctacaaatataatccacctgaccatgacgtcgtggcaatggcgcggaaattgcaggacgtgttcgagttcaggtatgctaagatgcccgatgagccgcttgaaccaggccccctgccagttagcactgccatgcccccgggtcttgccaagtccagtagcgaatcttccagtgaagaatcatcttctgagtcgtctagcgaggaggaggaggaggaagatgaagaagacgaggaggaggaggaatctgaatctagcgatagtgaagaagagcgggcacaccgcctggccgagctgcaggaacagcttagagccgtccacgaacagctcgctgctctaagtcaggggcctatctccaagccgaagaggaagcgagagaagaaggaaaagaaaaagaaacgtaaagccgagaagcacaggggacgcgctggagctgatgaggatgacaaaggcccccgagcgcctcgaccaccccagcccaaaaagagcaaaaaagcctccggcagcggtggtggcagtgctgcccttgggccatccgggttcgggccctccgggggatctggaacaaaactccccaaaaaagccacgaaaacggccccccctgccctgcctaccgggtatgacagcgaggaagaagaagaaagccgccccatgtcctacgacgaaaaaaggcagctatccttggatataaacaaactccctggcgagaaacttggaagagttgtgcacatcatacaggcacgcgaacccagcctgcgggatagcaaccctgaggagatcgaaatcgatttcgagactctgaaacctagcactctgagggaactggagcgctacgttctctcatgcctgaggaaaaaacctcgcaagccttatacgataaaaaaacctgtggggaagacaaaagaagagctggctcttgagaagaaacgggagcttgaaaagagactccaagacgtgtctgggcaattgaactccaccaagaagcctccaaaaaaggcaaacgagaaaacagaatctagttcagcacagcaagtagcagtttcccggctgtcagcaagttcgagttcgtcagattcgagctcgagttccagttcctccagttcatctgatacctccgacagcgacagcggatag

SEQ ID NO: 180812 - DNA, 2424 bp, Artificial Sequence
  Description of Artificial Sequence: Synthetic coding sequence
tgaaacggcggcggcggcagcgccaccgcccggggcggcgagtacagactgcccggggagggcaacgcagggctgttgggcttggggcctgaggccgccgccccagggaaaagaatccgtaagcctagtctcctctacgagggctttgagtcacccaccatggcctccgtccctgcgctccagttgacgcctgccaatccacctccacctgaagtgtccaacccaaaaaaacctggccgcgtaacaaaccaacttcagtacttacacaaggtcgtgatgaaggcactatggaaacatcagttcgcctggccatttcgacaaccagtggatgccgtgaaacttggactgcctgactatcacaagatcataaaacagccaatggatatgggcactatcaagcggagactggagaataattactattgggcagcctctgagtgcatgcaggacttcaataccatgttcacgaattgttacatctataataagcccaccgatgacatagttcttatggcgcagacactggaaaaaatttttctgcaaaaggtggccagtatgccacaggaagaacaggagctcgtggtcaccatccccaagaattcccataaaaagggggcgaaactggccgccttgcaggggtccgttacaagcgcccaccaggtcccagccgtgagtagtgtcagccataccgcactgtataccccccctccagagatacctaccaccgttctgaacattccccacccctctgtgatctccagtcccctcttgaaaagtctccacagcgccggtccacctctcctggcagtcacggctgcacctcccgcacaacctctggccaagaaaaaaggcgttaaaaggaaggccgacaccacgacccccactccaaccgccattctggcaccaggctctcctgcatcccccccagggtccttagaacctaaggcggcacggctgccgcccatgcgcagagaaagcggtcgccccataaaaccccctcgaaaggatctgcccgacagtcaacagcagcaccaaagttctaaaaagggcaagctgtctgaacaattgaaacactgtaatgggatactgaaagaattactcagtaaaaagcatgcagcttacgcctggccattttataaacctgtggatgcctccgcccttgggttgcacgactaccacgatattatcaaacaccccatggaccttagcaccgttaagcgtaaaatggaaaacagggactaccgcgacgcccaggagtttgccgcagacgtgcgcctgatgttctccaattgctacaagtacaatcctcccgatcacgatgtagtagctatggctaggaaactccaggacgtctttgaatttaggtatgccaagatgcccgacgagcccctggagccaggccctctgccggtctctacggctatgcctcctgggctggcaaaatcatcatctgagtcctcaagcgaggaatcttcttccgaaagttctagtgaggaggaagaggaggaggacgaggaggatgaagaggaggaagagagcgaatctagcgactcagaggaggagagagcccatcgccttgccgagttacaggagcagttgcgtgccgttcatgagcagctcgccgcactgtcccagggtcccatcagcaagccgaagaggaagcgcgagaaaaaagaaaagaagaaaaaaagaaaagcagagaagcacaggggccgagccggggccgacgaagatgataaaggtcctagagctccacggccaccacagcccaagaaaagtaaaaaggcctcaggatccggaggtgggagtgccgctttgggaccaagtgggtttgggccaagtggaggatccggaacaaaattgcccaaaaaagctaccaagacagctccccccgccctgccgaccggttatgatagcgaggaggaagaagagagcagacctatgtcttacgatgaaaagcgtcagctgtctcttgatattaataaacttcctggggaaaaattggggagggtcgtgcacattatccaggcacgtgaaccttccctgcgagacagtaacccggaagagatcgagatagactttgagacgttaaagccttctactctccgagagttggagcggtacgttttgagctgtctcagaaagaagcccaggaagccctatactatcaaaaaaccagtcggcaagacaaaggaagaactcgcccttgagaaaaagcgtgagctcgagaagcggttgcaggatgtgtcagggcagctcaacagtacaaagaaaccccccaagaaggccaacgaaaagactgagtcgagttcggctcagcaggtggctgtgtcccgactttctgcttcttcgtccagtagtgattcatcttcatccagcagcagttctagctcttccgatacaagtgactccgacagtgggtag

SEQ ID NO: 180813 - DNA, 987 bp, Artificial Sequence
  Description of Artificial Sequence: Synthetic coding sequence
tgagccaagagcagcagcgagagcagcagcgaggagagcagcagcgaatcgtctagcgaggaggaagaagaagaagatgaagacgaagaagaggaggagtccgagtcttctgactcagaggaagaacgggcccacaggctggcagagttacaggagcagttacgggccgtgcacgaacagctagcagcactgtcacaaggacccatctccaagccaaaacgtaagcgggagaagaaagaaaagaagaagaaacgtaaagccgagaagcatagggggcgcgctggcgccgatgaggacgataagggccctcgtgcgcctaggccaccgcagccaaaaaagtcgaagaaggcgagtggtagtgggggcgggtctgcggctcttggccccagtggtttcggaccctctggcgggagcgggaccaagcttcccaagaaggccacaaagactgcaccacctgccctgcccacaggatacgacagcgaagaagaggaggagagcaggcccatgtcctacgacgagaagagacagctgtcccttgacattaacaagctccctggcgagaaactgggtcgtgtggtgcatatcatccaggcccgagaaccctctctgcgagattctaatcctgaggaaatcgagattgatttcgagacccttaagccctccacactgagagaactcgagcggtacgtgctctcctgtttgagaaagaagccgagaaagccttacacgatcaagaagccagtaggcaagacaaaggaggaactcgcacttgagaagaaacgggagttggagaagaggctgcaggatgtctcaggccagctcaattctaccaagaagcctccaaagaaggccaatgaaaaaaccgaatcatcttcggcgcagcaggtggcagtgtcccgattgtccgcttctagcagttcctccgattcttcctcatcctcctcgtccagcagttcctctgacactagcgattccgattcaggttag

SEQ ID NO: 180814 - DNA, 2511 bp, Artificial Sequence
  Description of Artificial Sequence: Synthetic coding sequence
atgctgcagaacgtgaccccccacaacaagctgcccggcgagggcaacgctggcttgttgggtctcggacctgaggccgctgcccccggtaaacgcatacgtaaaccaagccttctgtacgagggtttcgaatcacccacaatggcatccgtgccggccctgcagctcacgcctgccaatccgccaccccctgaggtgtccaatccaaaaaaacctggacgggttacaaaccagctgcagtacctgcacaaggtcgtgatgaaagccctttggaagcatcagtttgcatggcccttccgccagcccgttgacgctgtgaaactggggctgcccgattaccataagattatcaagcagccaatggatatgggcacgatcaagcgacgcctagagaataactactactgggctgcctcagaatgtatgcaggactttaacactatgttcaccaattgctacatttataacaaaccaactgacgacattgtcctgatggcccagacactggaaaaaatcttcctccagaaggttgcgagcatgccccaggaagaacaggaactggtcgtgaccatacccaagaactctcacaaaaaaggggcaaaattggccgcccttcaggggtctgtgacatctgcccaccaggtcccagccgtgtcatctgtgagccatacagcactttacacccctccgcctgagattccaaccactgtgctcaatatcccccatccctcagtgatttcgtcaccacttctaaagagtctgcacagcgccggtccgcccttactggcagtcactgccgctccccccgcccagccactagctaagaagaagggagtgaagcgcaaggcagacaccacaacacctacacccacggcaattctggcccctggtagtcctgccagtcccccaggcagcctggaaccgaaagccgcacgcctgcctcccatgaggcgggaatcaggcaggcccattaaacctccaaggaaagacttgccggactcccagcaacaacatcaatcttcaaaaaaaggcaagctttccgagcagcttaaacactgcaacggcatcctgaaggagctgttaagcaagaagcacgccgcttacgcttggcctttctacaagccggtcgacgctagcgccctcggtctccacgattatcatgacataatcaaacaccctatggatctcagcaccgttaaacgtaaaatggaaaatcgagattatcgcgacgcccaagagttcgctgccgacgtccgcttgatgttttcaaactgctacaaatacaatcctccagaccatgatgtggtggccatggccaggaagctgcaagacgtgttcgagttcaggtacgccaaaatgcccgacgagcctctcgagcccggccctctgccagtgtcaactgctatgccccccgggttagcgaagagctcaagtgagtcaagttcagaagaatctagcagcgagagcagttcggaagaagaggaagaagaggacgaagaagacgaggaagaggaagagagcgaatcttccgacagcgaggaagagcgcgcccataggctcgccgagcttcaggagcaattaagggccgtgcatgagcaactggccgccctatcgcaggggcctatcagtaaacccaaacggaaacgtgagaaaaaagagaagaaaaagaagagaaaagccgagaagcaccgcgggagagccggggccgacgaggatgataaaggcccgagggctccaagacccccacaacctaagaagtcgaagaaggcttctggaagcgggggggggtcagctgcattaggcccatctggctttggtccaagcggggggagcgggacgaagctgcaggccggtgtccagtggcgcgacttgggtctgctgcagccgcctttactgggctttaagagattttcctgcctcagtctgcccagctctcaagattaccggctgcctaaaaaggccacaaagactgcaccacctgcattacccacggggtacgatagcgaagaggaggaggagtctagacctatgtcctatgacgagaagcgccagctttcactggacatcaataagctcccaggagagaagcttggtagagtcgtgcacattattcaggcccgtgagccaagcctcagggactcaaacccagaggagattgagattgacttcgagactctgaaaccctctacgctgagagagctggagagatatgtgctatcttgcctgaggaagaagcctagaaaaccgtatacgatcaaaaagcctgtggggaagaccaaggaagagctagcactggagaagaaacgcgaactggagaaacggctccaggacgtctctggccagcttaactcaactaagaagccccccaagaaggcaaatgaaaaaacagagtcctccagcgctcagcaggtcgccgtctctaggctctccgcaagttccagctcatccgattcctcttctagcagctcaagttcaagctcttcggacacatcagactcggatagcgggtag

SEQ ID NO: 180815 - DNA, 2424 bp, Artificial Sequence
  Description of Artificial Sequence: Synthetic coding sequence
tgaaacggcggcggcggcagcgccaccgcccggggcggcgagtacaggttgcccggagagggtaacgcaggactgctgggcctcggacccgaggctgccgcaccagggaagcgaattaggaaaccatctttgctctatgaagggtttgagagcccaaccatggccagcgtgcctgccctgcagctgactcctgctaaccctcccccgccagaagtcagcaaccccaagaaaccaggcagggtgactaaccaactgcagtatctgcataaggttgtgatgaaagctctatggaaacaccagttcgcctggccgttccggcagcccgttgacgcagtgaagctgggacttcccgattatcacaaaataataaaacagccaatggacatggggacaatcaaacgaagacttgaaaataattattactgggctgcatctgaatgtatgcaggacttcaatacaatgttcacgaactgttacatttataacaagccgacagatgacatcgtgctgatggcacagactctcgagaagatattcctgcagaaggttgccagcatgccgcaggaggagcaggagcttgtcgtgaccataccgaaaaattcacataagaagggcgctaaactggctgcgcttcagggatctgtcacgtctgcccaccaagtgcccgctgtgtcctctgtgagccacaccgccctgtacacacctcctcccgagatccctacgacggttctgaacatcccacatccctctgtgattagttcccccttactgaaaagtctccactcagccggcccccctttgctcgcagtgacggctgcccctcctgcccaacccttggctaaaaagaaaggggttaaacgcaaggctgatacaacgaccccaacacccacggcaatcctggcccctgggtctcctgccagtccaccaggaagccttgaacctaaggcagcccgtcttccgccaatgagaagggagagcgggcggccaattaagcccccacgcaaagacttgcccgactcccagcaacagcatcagtcatcaaagaagggcaaactgtctgagcagctgaaacattgtaacggaattctgaaggaactgcttagtaaaaagcacgccgcctacgcctggccattctacaagcccgtggacgcatccgctctaggactgcacgactatcatgatattatcaagcaccccatggatctttctacagtaaaaagaaaaatggaaaacagggactatcgagacgcccaagagttcgcagccgatgtcagactgatgttcagcaattgttacaagtacaatccgcccgaccacgacgtcgtggccatggctcgcaaactgcaggacgtgttcgaattcagatacgctaagatgccagacgagcctctcgagccaggccccctgcctgtctcaactgccatgccacccggcctagccaagagttcatcggagagtagctccgaagaatcatcctctgaatctagttcagaagaggaagaggaagaggacgaggaagatgaagaagaagaggagtcagaaagttctgatagtgaagaggaacgggcccatcgattagcagagctgcaggaacagctgagggcggtgcatgagcagctcgcagcattaagccaggggccaatcagcaaacctaaacgaaaaagagagaagaaggaaaagaaaaaaaagcgcaaagccgaaaaacatcgcggtcgcgccggcgctgacgaagacgataaggggcccagggcgcctcgcccaccgcagccgaagaagtctaagaaggcttctggctctggtggtgggtccgccgcattgggcccatctggatttgggccgagcgggggtagcggtactaaacttccaaagaaggccactaagacagcccctcctgctctgcccacagggtacgacagcgaagaggaagaagagtcgaggcctatgtcttatgatgaaaagcggcagctgtctttggatattaacaaactgcctggggaaaagctgggtcgggttgtgcatattattcaggcacgagagccgtctttaagagatagcaacccggaagagattgagattgatttcgaaacattgaagccaagtacgctgagagagctggaacgctatgttctgtcttgtttgagaaagaagcctcgcaagccctatactatcaagaaacctgtcggtaagactaaagaggagttggccctggaaaagaagcgcgaactggaaaagaggctccaggacgttagcggacagcttaactcaaccaagaaaccccccaagaaggccaacgagaaaactgagtcgtcatccgctcagcaggttgctgtgtccagattgtccgcttcctcttcctctagcgattcatcttctagttcgtcctccagctcgtctagtgacacatcggatagtgattccgggtag

SEQ ID NO: 180816 - DNA, 2265 bp, Artificial Sequence
  Description of Artificial Sequence: Synthetic coding sequence
atggccagcgtgcccgccctgcagctgacccccgccaacccccccccgcccgaggtcagcaatccgaagaagccaggtcgcgtgaccaatcagcttcagtacctccacaaggtggtcatgaaagcactgtggaagcatcagtttgcttggccattccggcagcctgttgacgctgtgaaactcgggttgccagattatcataaaataataaaacagcctatggatatgggtaccattaagagacgcctggaaaacaattactactgggcggcttcggagtgcatgcaggacttcaacaccatgttcactaactgctatatctacaataaaccaactgacgacatcgtcctgatggctcaaactctagagaagatttttctacagaaggtggcctcgatgcctcaggaagaacaggagctcgtagtgaccatccccaagaacagccataagaagggggccaaactggcggctctccagggaagtgttactagcgctcatcaggtccccgcagtctctagtgtgagtcacacagcattgtataccccccctccagagattcccacgacggtgctcaacatccctcatccttctgtcatctctagcccccttctcaagtcacttcattccgccggtcctcctttactcgccgtaactgcagcacctcccgctcagcctctcgcgaaaaagaaaggtgtgaaacgaaaggctgacaccactaccccaaccccaactgctatcctggcccccgggagccctgccagcccaccggggtccctcgaacctaaggcagcccgccttccgcccatgcgccgcgagagcgggagaccgattaaacctccaaggaaagatctacctgatagccagcaacagcatcaaagcagtaaaaaaggtaagctctctgagcagctcaagcactgcaacggcatcttaaaagagctgctttccaagaagcatgcagcttacgcatggccattttacaaacctgtggatgcgagtgctttgggacttcacgattaccatgacatcattaaacatcccatggacctctctactgttaaacgcaaaatggaaaatagggattacagagatgctcaggaattcgcagccgacgttagactcatgttcagtaattgctacaaatataaccctccagaccatgacgtggtggctatggccagaaagcttcaagacgtcttcgagtttcggtatgcaaaaatgccagatgagccccttgagccgggtcccctgcccgtttctacagcaatgccccccggtcttgcaaagagcagctcagaatcaagcagcgaggaaagttcctccgagtcatcatccgaggaagaggaggaggaggatgaggaagatgaggaggaagaagaaagcgagagtagcgattctgaggaggagagagcccatcgactggcagagctgcaagagcagctgcgggctgtccatgagcagttggccgccttgagccagggcccaatatctaaacctaaaagaaaacgcgaaaagaaggagaagaaaaaaaagaggaaagcagagaaacatagaggccgggctggggccgacgaggacgacaagggcccccgtgcccccaggcctccccaaccgaagaagagtaagaaagcaagcggtagtggcggtggcagtgctgccctgggtccttcaggatttggacccagcggagggtccgggaccaagctgcccaaaaaggccactaaaacagcaccacctgccctccctactggatacgatagtgaggaggaggaggaaagccgacccatgtcttacgacgagaagaggcagttgagcctggatatcaacaagctcccaggagagaagctagggcgtgtcgtgcacattattcaggcacgtgagccaagccttcgagattcaaatcctgaggagatcgaaatcgattttgagacactcaagccgagcactttgagagaactagagcggtacgtcctctcatgcttacggaagaaacctcgtaagccttatactatcaagaaaccagtgggtaagacaaaggaagagctcgcccttgaaaaaaagcgcgagctggagaagcgattacaggacgtgagcggccaacttaactctactaaaaaaccaccgaagaaggcgaatgaaaagaccgaaagctccagtgcccagcaggttgctgtatcacggttgtcagcaagctccagctcttcggacagctcgtcatctagctccagttctagtagctccgatacttctgattccgatagtggctag

SEQ ID NO: 180817 - DNA, 2406 bp, Artificial Sequence
  Description of Artificial Sequence: Synthetic coding sequence
atgctgcagaacgtgaccccccacaacaagctgcccggcgagggcaacgcggggcttctgggactaggaccagaagcagcagcaccaggcaaaaggatcaggaagccctcactgctgtatgagggattcgagagtcccacgatggccagcgttccggccctgcagctgacccccgccaacccacctcccccagaagtgtcaaaccctaagaaacctggcagggtgacaaatcagctgcagtacctacacaaggtggtcatgaaggctttatggaaacaccagtttgcctggcctttcagacagccagtggacgccgtcaaactaggcctgccagactaccataagataatcaagcagcctatggacatgggcactattaaacgtcggctggaaaacaactactattgggcagcatccgagtgcatgcaggacttcaacaccatgtttacaaactgttacatatacaataaacctactgacgatattgtccttatggcccagacactagagaagatttttttacagaaggttgcttctatgcctcaggaagagcaggaactcgtcgtgaccattccaaaaaattctcataagaagggagcaaagttagccgctcttcagggatctgtgacttctgcgcatcaggtgccggccgtgtcaagtgtctcccacaccgcactgtatactcctcctccggaaataccgactaccgtgttcaacatcccacatccgtctgtcatttcatccccgctgttaaagtcacttcactccgccgggcctccattgcttgcagtcactgctgccccccctgcacagcctcttgccaagaaaaagggtgtgaaacggaaggcggacacaactacacccaccccaacggctattctggcccccggaagcccagcaagccctccaggatctctcgaacctaaagcggccagactgccccctatgcgcagagagtctggcagacccatcaaacctcctaggaaggacctgcctgattcccagcaacaacaccagtccagtaagaagggaaagctctcagagcaattgaagcattgcaatgggatcctaaaggagcttttgagtaagaagcacgccgcctatgcctggcctttttacaaacccgtagacgcctccgcattgggtctgcatgactaccatgatatcataaagcatccaatggacttgagcacagtgaagaggaaaatggaaaacagggattacagggacgcccaggagttcgctgctgacgttaggctcatgttcagtaattgctacaagtacaacccgcctgatcatgacgtggtagccatggctcgcaaactccaagacgtgtttgaatttcggtacgcaaaaatgccagacgagcccttggagcctggccctctgccagtaagtacagctatgccccccgggttggctaagtctagctccgaaagctcttccgaggagtcttccagcgagtcttctagcgaggaggaggaggaggaggacgaggaggacgaggaagaagaggagtctgaaagttccgattcagaggaggagagggcgcatcgattggcagaactgcaggaacagctgcgcgctgtccatgagcagttggcagctctctcccaaggaccgatctcaaaacccaagaggaagcgggagaaaaaggagaagaaaaagaagagaaaagccgaaaagcatcgggggcgcgcaggcgccgatgaagacgataaggggccgagagccccgaggccgccccaaccaaagaagtctaagaaagcctcaggcagtggcggagggtctgcagccctcggtcctagtggattcggaccatccggaggttcgggcacaaaactgcccaagaaagctacgaaaacagccccgcctgctctgcctacaggttacgatagcgaggaagaagaggagagcaggcctatgtcctacgacgagaaacgccagctttctctggatattaacaaacttcctggcgagaagttgggccgcgtggtgcacattatccaggctagggagccaagcttgcgagatagcaacccggaggagatcgaaattgacttcgaaaccctgaaaccaagcaccctcagagaattggaacgatatgtgttgtcctgtctaagaaaaaaaccgcgcaagccgtatacgattaaaaaacccgtggggaagaccaaggaggagcttgctctggagaagaagcgagagctggaaaaaagacttcaagacgtgtctggccagctgaactccacaaagaaaccccctaagaaagcgaacgagaaaaccgagagctccagcgcacagcaagtcgctgtgtctcggctctcagcttcatctagctcttctgacagctcttcaagtagcagcagctcctcttcttccgacaccagcgattctgattcgggatag

SEQ ID NO: 180818 - DNA, 891 bp, Artificial Sequence
  Description of Artificial Sequence: Synthetic coding sequence
tgacggcccctgggcgtgcagcagcccggcgcccggctgcccggcgagggaaatgccggactcctgggcctgggacctgaagcggctgcccctggcaagaggatcaggaagccaagcctcctgtatgaagggttcgagtcacccactatggcatccgtcccagcattacagctcacacctgccaatccccctcccccggaggtgtcaaatcctaagaaacccggtcgggttactaaccagctacagtacctgcataaggtagtgatgaaagccctttggaaacatcagttcgcttggcccttcagacagcctgtggatgcggttaagcttggactgcctgactaccacaaaatcattaagcagcccatggatatggggaccattaagaggcggctggagaataactattattgggcggcttccgagtgcatgcaggacttcaataccatgtttacgaattgctatatttacaataagccaaccgacgacatcgtactgatggcacagacactggagaagatttttctccagaaagtggccagcatgccccaagaggagcaggaacttgtcgtcactattccgaaaaactcacataagaagggcgccaaactggccgcactccagggaagcgtcacaagcgcacatcaggtccctgccgtttcatctgtaagccatactgctctctataccccgccacctgagatcccaactaccgtactcaatattccacacccaagcgtgatttcctccccactgctcaagagcctccattcagcaggaccccctcttctggccgttacggccgctcctccggcacaacccctggcaaagaagaagggggtgaagagaaaagccgatacgactacaccaacacccacagctatcttatag

SEQ ID NO: 180819 - DNA, 2511 bp, Artificial Sequence
  Description of Artificial Sequence: Synthetic coding sequence
atgctgcagaacgtgaccccccacaacaagctgcccggcgagggcaatgccgggctgctgggactgggtcccgaggccgccgcgccagggaagagaataagaaaacctagccttttgtacgaagggttcgagagccctacaatggctagtgtacctgccctacagctcactccagccaacccaccgccccctgaagtttccaatcccaagaaaccaggacgcgtgaccaaccagctgcagtacctccacaaggtggtgatgaaggctttatggaagcatcaattcgcgtggccgttcaggcaacccgtcgacgctgtcaaattaggtctccctgattatcacaagatcatcaaacagcctatggacatggggaccatcaaacggcggctggagaataattattattgggcagcttctgagtgcatgcaggacttcaacaccatgttcacaaactgttatatctacaataagcctaccgatgacatcgtactgatggcccagactctcgagaaaattttcttgcagaaggtggccagcatgccacaggaagagcaggagctggtcgtgaccatccctaagaactcgcacaagaagggtgctaagcttgcagccctgcagggttctgtgacgagtgcccatcaagtcccagccgtttcaagcgtctcccacacagccctgtacaccccccctccagagataccaactacagtttttaacatcccccacccaagtgtgatctcaagtcctttattgaagtcattgcactcagccgggccccccctgttggctgtgactgcggctcccccagcccaacctctcgcaaaaaagaagggggtcaaacggaaagctgacacgacaaccccaactccaaccgccatacttgcgccaggttctcctgcttcacccccgggttcgctggagccgaaggccgccagacttcctcctatgcgaagggaaagcggtcgtcctatcaagcctcctagaaaggacctgcccgattcacagcagcagcaccagtctagcaagaaggggaagctgtctgaacagctgaaacattgcaatggtatcctcaaagagttgcttagcaagaagcatgccgcctacgcctggccattttacaaaccagtcgatgcctccgccctgggtttgcacgactaccatgatatcatcaaacacccaatggacctgtccacagtgaaaaggaaaatggaaaacagggactaccgtgacgcccaggagttcgcagctgatgtacggctgatgttcagtaattgttacaagtacaatccaccagaccacgacgtagtcgcgatggctcgtaaactgcaggatgtgtttgaattcaggtacgcaaaaatgcccgatgaacccctcgaacccgggcctctgcccgtttccaccgctatgcccccagggttagccaaatccagcagcgagtcttcctctgaggagagtagcagcgagagtagttcagaagaggaggaggaggaggacgaggaagacgaggaagaagaggagtccgagtccagtgattccgaggaagaaagggcacatcgcctggctgaactccaggagcagctgcgagcagtccatgagcagctggccgcactgtcacagggacccatttcaaaacctaagagaaaacgggagaagaaggagaagaaaaagaagagaaaagctgagaaacacagagggagagccggagctgacgaggacgataagggtcctcgagcgcccagaccccctcaacccaaaaaaagtaagaaagcctcaggcagtggaggcgggtcagccgcgctaggacctagcggttttggaccatctggtggaagcggtacgaagcttcaggctggagtacagtggcgcgacctggggctccttcagccccccctgcttggattcaagcggttcagttgccttagcttaccttccagccagaattaccggctgccaaaaaaggccaccaagactgccccgccagccctacctacaggctatgacagcgaagaagaggaggaatccaggccgatgtcatatgatgagaagagacagctgtctctggacatcaacaagctgccaggtgaaaagctcgggcgggtggtgcatatcatccaagcccgcgaaccatccctgcgggattcaaaccctgaagagatcgaaatcgacttcgagaccctgaagccgagtacattgcgggagctcgagagatacgtcctgtcttgcctgcgcaaaaagccaagaaagccgtacactatcaagaagccggtggggaaaacaaaggaagagctcgcccttgaaaagaaacgcgaactggagaagagacttcaggatgtctccgggcagctaaatagcacaaagaagccccccaagaaggctaatgagaagacagagtcctcttccgcacagcaggtcgctgtgtctagactgtctgcctcttccagtagtagtgactcttcttcttcaagctcctcttcgagctcttctgacacgtccgatagcgactctgggtag

SEQ ID NO: 180820 - DNA, 987 bp, Artificial Sequence
  Description of Artificial Sequence: Synthetic coding sequence
tgagccaagagcagcagcgagagcagcagcgaggagagcagcagcgagtcctcttcagaagaggaagaggaagaggacgaagacgaagaagaagaggagtctgagagctctgattcagaggaggagagggctcatcggctcgcggaacttcaggaacaactgagagccgtgcatgagcaactggctgccctttcccaggggcccatctcgaagcccaaacggaaaagggagaaaaaagagaaaaaaaagaaaaggaaagcggagaagcacagaggtcgagcgggtgccgatgaagatgacaaaggaccacgggccccacggcctccccagccaaagaaatctaaaaaggcttccggatccggtggaggtagtgctgcactcggaccctcaggatttggaccctctggtggctccggtactaaactgccaaagaaggctaccaaaacggctccacctgccttgcccaccgggtatgactccgaggaggaggaggagtctcgtcccatgtcctacgacgagaaacgccagcttagcctggatattaataagttgccaggcgaaaaactgggaagggtcgtgcatatcatccaggcaagggaaccaagcctgcgcgattcaaacccagaggagatcgagattgacttcgagactctgaaacccagcacgctgcgggaactcgagaggtacgtcctgtcctgcctacgcaaaaagcctcggaagccctacactatcaagaaaccagtaggtaaaactaaagaggaattggccctcgaaaaaaagcgggaactcgagaagaggctccaggatgtgagcggtcagttgaattctactaagaaaccgccaaagaaggcgaatgagaaaactgagtcctcctccgcgcaacaagtagccgtgagtaggctcagtgcctccagttccagctccgatagctcaagctcatcttcttccagctcgagcagcgacacatccgactctgactctggctag

SEQ ID NO: 180821 - DNA, 891 bp, Artificial Sequence
  Description of Artificial Sequence: Synthetic coding sequence
tgacggcccctgggcgtgcagcagcccggcgcccggctgcccggcgaaggaaatgccggtctcctcggcctcgggcctgaagcggctgcccccggcaaaaggattagaaagccaagtttgctctatgagggatttgagagtcccaccatggcgtctgtgcctgcacttcagctgactcctgccaacccccctccgcccgaagtgagcaatccgaagaagcccggacgggtaacaaatcagctccagtatctgcataaggtcgttatgaaggctctgtggaagcatcaatttgcttggccatttcgccagccggtggatgccgtcaagttgggcctcccagactatcacaagatcatcaagcagcccatggacatggggactatcaagagacgactggaaaacaactattattgggccgcctccgagtgtatgcaagactttaacaccatgttcacaaactgctacatttacaacaaacccacggacgatattgttcttatggcgcagaccttggaaaagatcttccttcaaaaggtggctagtatgccacaggaagaacaggagctggtcgtgacaattcccaagaactcccacaaaaaaggggctaagctggccgctctgcaaggatccgtgaccagcgcacatcaggtcccagcggtcagcagcgtgagccacaccgcactatacacaccaccccccgaaattcccactactgtcctgaatatccctcatccctcagtgatctcgtcgcccctgttgaagtccctgcacagcgctggtccacccttgttggcagttactgcagccccccctgcacagccgttagccaagaagaaaggggtgaagcggaaggccgacacaacaactcccaccccaactgctatcctttag

SEQ ID NO: 180822 - DNA, 891 bp, Artificial Sequence
  Description of Artificial Sequence: Synthetic coding sequence
tgacggcccctgggcgtgcagcagcccggcgcccggctgcccggcgagggaaacgcaggcctcctgggccttggacctgaggccgccgctccaggaaagcggattagaaagccctccctgctgtatgaggggtttgagagccccaccatggcttctgtgcctgctctgcaacttacaccggctaatccaccccctcctgaggtttccaaccccaagaaaccgggtagggtgacaaatcagctccaatacctgcataaagtcgtcatgaaggctctttggaagcaccagtttgcctggccctttcggcaacccgtggatgctgtcaagctgggtctccccgactatcacaagatcatcaagcagcctatggacatggggaccatcaaaagaaggctggaaaacaattactattgggccgctagcgagtgtatgcaggatttcaatactatgttcaccaactgttacatctataacaagcctaccgacgacatcgtgctgatggctcaaacactggagaaaatcttcttacagaaagttgcatctatgccacaggaagagcaggaacttgtggttactataccaaaaaattcccataaaaaaggcgccaagctggcagctctgcaggggtctgtgaccagtgcccaccaggtgcctgctgtctcatcagtctctcacacagctctctataccccacccccggagattccaaccactgtgctgaacatacctcaccctagcgtcatctccagcccgctgttgaaaagcctgcacagcgccggcccacctctcctggcagtgactgccgcgccaccagcccagcccctggccaaaaagaagggcgttaaacgaaaggccgacacaactacacccacaccaacagctatcctttag

SEQ ID NO: 180823 - DNA, 1860 bp, Artificial Sequence
  Description of Artificial Sequence: Synthetic coding sequence
tgaaacggcggcggcggcagcgccaccgcccggggcggcgagtacaggctgccgggagaagggaacgcgggcctgttgggtttaggtcccgaggcggcggcaccaggtaaacgcatcagaaagccgagcctcctgtacgaagggtttgagagtcctaccatggcttctgtgcctgccctgcagcttacgccagcgaatccgcctcctccggaggtgtctaatcctaaaaagcccggccgggtcaccaaccagctacagtacctgcataaggtcgtcatgaaagccttatggaaacatcaatttgcctggcctttccggcagcccgtggacgcggtgaagcttggactgccagattaccacaaaataatcaaacagccaatggacatgggaaccatcaaaagacgccttgagaacaattattactgggctgccagcgaatgtatgcaagactttaacaccatgtttacaaattgctatatctataataagcctacagacgacatagtgttgatggctcagactctagaaaagatttttctgcaaaaggtcgcttcgatgccccaagaggaacaggaactggtggtcaccattcccaagaattcccacaaaaagggcgctaagctagccgccttgcagggcagcgtgacatccgcgcaccaggtgcccgccgtctcatctgtgtcgcataccgcattatacacccccccgccggagattcctacgaccgttctaaatatccctcatccctcggtcattagttctcctcttctcaaaagcctgcatagcgccggcccccctttattggcagtaaccgccgcacccccggcacagccccttgcgaaaaaaaagggggtaaagcgcaaggcagacactacaactcctacccccactgcaattctggcccccggttctcccgcatctcctcccggctcccttgagccaaaggctgctagattgcctcctatgaggcgtgagtccgggcgcccaattaaacctcctcgcaaagaccttcccgatagccagcagcagcatcagtcttcaaagaagggtaaattaagtgagcagctgaaacactgcaatggtatcctaaaggagctattgtccaagaaacacgctgcttacgcctggcctttctataagccagtcgatgcttcggccctgggcttacatgactatcacgacattatcaagcacccgatggatctgagcactgttaagcgtaagatggaaaatcgagactatcgggacgcgcaagaatttgccgccgacgtgcgccttatgttttccaactgttataaatataaccccccagaccatgatgtggttgcgatggctcgaaagctccaggacgtgttcgaattcaggtatgctaaaatgccggacgagcctctcgaacctggccctctgccagtgtccaccgccatgcctcccggactggccaaatcgagctccgagagctcaagcgaggaaagtagctcagaaagttcctccgaggaggaggaggaggaggacgaggaggacgaggaagaagaagagagcgagtcctctgactcagaggaagagcgggctcaccggctcgccgagctgcaggagcagcttcgcgccgtgcacgagcagctggcggctctcagccaggggccgatctcgaagccgaagagaaagagagaaaaaaaggagaaaaagaagaagcggaaggcagagaagcacagggggagggcaggagctgatgaagacgacaagggcccccgcgctcccagacctccacagccgaagaagtctaagaaggcctctggctctgggggaggatcagcggcactgggcccctcaggctttgggcctagcggaggatcgggaacctag

SEQ ID NO: 180824 - DNA, 987 bp, Artificial Sequence
  Description of Artificial Sequence: Synthetic coding sequence
tgagccaagagcagcagcgagagcagcagcgaggagagcagcagcgaatcgtcttcggaggaagaggaagaggaggatgaggatgaggaggaagaagaatcagaatctagtgacagcgaggaagagcgggcacatcgcctcgctgaactccaggaacagcttcgagcagtgcacgagcagcttgcagccctcagtcagggtcccatatctaagcccaaacgaaaacgcgaaaagaaggaaaagaaaaagaaaagaaaagctgaaaagcaccgagggagagccggcgcggatgaggacgacaagggtccaagagcacccaggccaccacagcctaaaaaatccaaaaaagcctccggctcagggggaggtagcgccgcactcggacccagcgggttcggccccagcggcggctcgggaacgaagctgcctaagaaggccacgaaaacagcccctccggctcttcctaccggctatgattcggaagaagaggaagaaagtcggcccatgagctacgacgaaaagcggcagctttccttggacatcaataaactacccggcgagaaactgggccgagtagtccacatcatccaagccagggaacctagcttgagagattcaaatccggaggagatcgaaattgatttcgagactcttaagccgagcaccctgagagagcttgagcggtatgtcttgagttgtctgcgcaagaaaccgaggaaaccctacacgataaaaaaaccagtcggcaaaactaaagaagagctagccctggagaagaaacgtgagcttgaaaaacggcttcaagacgtttccggtcaactaaacagcaccaaaaaacccccaaaaaaagccaacgagaagactgagagcagttctgcacagcaggtcgcagtgtcaagactgagtgcatcatccagttcatcagattcctcttctagctccagtagttcatcttctagcgacacttctgattccgattctggatag

SEQ ID NO: 180825 - DNA, 2046 bp, Artificial Sequence
  Description of Artificial Sequence: Synthetic coding sequence
atggacatgggcaccatcaagcggcggctggagaacaactactactgggccgcttcagagtgcatgcaagacttcaataccatgtttactaactgctatatttataacaaacccacggatgatattgtgctgatggcacagactctcgagaaaatattccttcagaaggtagccagtatgccacaggaggaacaggaattggtcgtcacaatccctaagaactcacacaagaagggagccaagctggcagccctgcagggtagtgtcaccagcgcccaccaggtcccggctgtgtccagtgtgagccacacggccctgtacacaccacctcctgagattcccacgaccgtattcaacattccccatcccagtgtgatttcttcacccttgctgaagtcattgcacagcgccgggccacccctcctcgccgtcactgcagcccccccagcgcagccactggctaaaaagaagggcgtgaagcgcaaggccgacacgacaacacccacccccacagctatcttggcccccggttctcccgcctccccccctggcagtctcgagccaaaagctgcccggttgccccccatgaggcgagaatctggccggcccattaagccgccccgcaaagacctgcccgacagtcagcagcaacatcagtcttccaaaaaagggaagttgtccgagcagctcaagcattgtaatggcatcctgaaggagctcctgtccaagaagcatgcggcttatgcatggccgttctacaagcccgtcgacgccagtgcactgggtttgcacgattatcatgacatcatcaaacatcctatggacttgagtaccgtgaaacggaagatggagaatcgggattatcgggatgcacaggaatttgctgccgacgtacgactgatgtttagcaactgttacaagtacaatcctcctgaccatgacgtcgtcgccatggctcgaaagcttcaagacgtatttgaattccggtacgcgaagatgcctgacgagcctttggagccggggcctctcccggtgtcaacagccatgccccctggattggctaaatcatcctccgagagctcgtcggaggagtcatcctcagaaagcagttctgaagaggaggaggaagaggacgaggaagacgaggaggaagaggagagcgagtcatccgacagcgaagaagaaagggctcatcgcctcgccgaattgcaggagcagcttcgagcagtgcatgagcagctcgctgccttgtcccaaggtcccatttccaagcccaaacgaaaacgtgagaagaaggagaagaagaaaaaacgaaaggcagagaagcaccgaggccgcgccggagccgatgaggacgacaagggcccacgagcccctcggcctccccagccaaaaaagagtaagaaggcttctggaagcggtggcgggtccgctgcacttggaccatccggcttcggtccttccggggggagcggcaccaagctgccaaagaaggccaccaagaccgcaccgcccgcactgcctactggttacgacagcgaagaggaagaggaatccagacccatgtcttacgatgagaagcggcagttgtcgcttgacattaataaattacccggtgaaaaactggggcgggtcgtgcatattatccaggcgcgcgagccctcgctacgggatagcaatcccgaagagattgagattgatttcgaaacactgaagccctccactttgcgtgaactggagcggtatgtgctgagctgcttgagaaagaagcctcgtaaaccttacaccatcaaaaaacccgtagggaaaaccaaagaggagcttgcgctagaaaagaaaagagagctagagaaacgcctgcaggacgtttccggtcaattaaatagcacaaagaagccacccaagaaagcaaacgaaaagaccgagtcctccagcgctcagcaggtcgccgtcagtcgtctctccgctagtagcagtagctcagattccagcagcagctcttcatcatcaagttcaagcgatacctctgattcagactcagggtag

SEQ ID NO: 180826 - DNA, 2265 bp, Artificial Sequence
  Description of Artificial Sequence: Synthetic coding sequence
atggccagcgtgcccgccctgcagctgacccccgccaaccccccccctcctgaagtgtccaaccccaaaaaacctgggcgagtgaccaaccagctgcagtacctgcacaaagtggtaatgaaagcattgtggaagcatcaattcgcctggcctttccgacaaccagtcgacgccgtgaagctgggattgcccgactatcacaaaattatcaaacagcccatggacatgggaaccatcaagcgaagacttgaaaacaattattattgggcagcctccgagtgtatgcaggattttaatactatgttcacgaattgctacatctacaataaaccaaccgatgatattgtgctgatggcccagactctggagaagatcttcttgcagaaagtcgcatctatgccccaggaagaacaagaactcgttgtgacaattcctaaaaatagccataagaaaggagctaagctggctgcccttcaaggctctgtcacaagcgcccaccaggtgccggctgtgagctccgtgtcacatacggcattgtatacgccaccccctgaaatccccaccacagtattcaacatccctcaccccagtgtcatcagttcgccactgcttaaatcactgcattctgcggggccaccgctcctcgctgtaaccgccgctccgccagcccagccactagcgaagaagaaaggcgtgaaaaggaaggccgatacgaccacacccactcctaccgcaattctcgctccaggctctcccgcaagccctcctggcagtcttgaacccaaagctgcgcggttaccaccaatgcggagagaatcggggcgccctatcaagcccccaagaaaagaccttccagatagccagcagcagcaccaatcttctaagaaggggaagctgtctgaacaactgaagcactgtaacgggatcctgaaggagttgctgtccaagaagcacgcagcctacgcttggccgttttacaagcctgttgacgcctcagctcttgggttgcacgattaccacgacatcatcaaacacccaatggacctgtcaacagtcaaaagaaagatggagaatagggactatcgggacgctcaggagtttgcagctgatgtacggttgatgttttcaaattgctataaatataatcctcccgaccacgacgttgtcgccatggcacggaaactccaggacgtgtttgagttcaggtacgcgaaaatgccagacgaacctctggagcctggccctcttcctgtgagtacagccatgccgcctggactcgctaagtcatctagcgaatctagctcagaagagtcttcttctgagtcgagttctgaagaggaagaggaggaggacgaggaggacgaagaggaggaagagagcgaaagcagcgattccgaagaagaacgagctcaccgcctcgctgaactgcaggaacagctgcgtgctgtccatgagcagcttgcagctttatcccagggtcccatatcgaaaccaaagcgaaagcgagagaagaaggagaaaaagaaaaaaagaaaagccgaaaaacacaggggcagagcgggggcggacgaggatgataaagggccccgagctccaaggcctccccagcctaaaaagtctaagaaggcgtctggctctggaggaggtagcgcagcactgggacccagcgggtttggaccgtccggtggaagcggcaccaagctgcccaaaaaggctaccaagaccgccccccccgccctcccgacaggatacgattccgaggaggaggaagagtcccgtcccatgagttatgatgaaaaacgccagctgtctctggatataaacaagctgccaggagagaaactaggcagagtggtgcacatcatccaggcgcgagagccaagcctgcgagacagtaatcccgaggagatcgagatcgatttcgagaccctgaagcctagtacacttcgagagctggagcgatatgttcttagctgcttgcggaaaaagccaaggaagccttacacgataaagaagcccgtgggcaagacgaaagaagagctggcgttagagaagaagagagaactggagaagagactccaagacgtgagcgggcagctaaactctactaagaagccgcctaaaaaggctaacgaaaaaactgagtctagctctgctcagcaagtggctgtcagcagactcagcgcatcttcttcatcatctgatagttcaagctcaagcagttctagctcttcctccgatacgtctgatagcgatagcggctag

SEQ ID NO: 180827 - DNA, 2511 bp, Artificial Sequence
  Description of Artificial Sequence: Synthetic coding sequence
atgctgcagaacgtgaccccccacaacaagctgcccggcgagggcaacgctggtttactgggactgggacccgaagctgctgcacctggcaagcgcattcggaagcctagtctcctctacgaggggtttgagagccccaccatggcctctgtacctgctcttcagctgacccctgccaaccctccaccacctgaggtttctaaccccaagaagcccggacgagtaacgaaccaacttcaatatctccacaaggtggtaatgaaagctctgtggaaacaccaatttgcgtggccctttcggcaacctgtagacgcagtcaaactcggactgcctgattatcataaaataattaagcagcctatggatatgggcacaatcaagaggaggcttgaaaacaactactactgggctgcgtccgaatgcatgcaggactttaacacaatgttcacaaactgttacatttataacaaacctacggacgacattgttctgatggcccagactcttgaaaagatctttttgcagaaggtagcctctatgcctcaggaagaacaggaactggtcgtgacaataccaaagaatagccataagaaaggcgccaagctggccgctcttcagggctctgtgactagcgcccaccaagttcccgctgttagctcagtgtcgcatactgctttgtacactcctccgcctgagatcccaacaacggtcctgaacatccctcatccgagcgtgatctcttcccccttgctgaaatctctgcacagcgccgggccgcccttactcgcagtgacagctgcaccacctgctcaacccctagccaagaaaaagggggtgaagaggaaggccgacactacaacccctacccctaccgcgatcctagctcccggcagccccgcgtccccgcccggttctctggagcctaaggctgcccggttgccaccaatgcgccgcgagtctggcaggcctatcaagccccctcgcaaggatctgcccgactctcagcaacagcaccaaagctctaaaaagggcaagctgtccgagcagctcaagcactgtaatggcatactgaaggagctactgagcaaaaaacatgccgcgtacgcatggcccttttacaagcccgtagacgcatccgctttgggattgcatgattaccacgacattatcaaacacccaatggatctgtctactgtcaagaggaagatggaaaacagagattaccgggacgcccaagagtttgcagccgacgtgaggttgatgtttagcaactgttacaagtacaacccacccgaccacgatgtggttgcaatggcccgcaagcttcaggacgtatttgaatttagatacgctaagatgcccgacgagcctctcgaaccaggcccgctcccagtttccacagcgatgccaccgggtctggcaaaaagttcttccgaatcctcgtccgaggagtcttcctctgagtcctccagtgaggaagaggaggaggaggatgaagaggatgaggaggaagaagaatctgagtctagtgactcagaggaagaacgggcccatagacttgcggagttacaggagcaattaagagctgtccacgagcagctggctgccctgagccaaggtcccatctccaaaccgaagagaaaacgggagaaaaaggagaaaaagaaaaaacgcaaggcagagaagcaccgtggcagggctggcgctgatgaagatgataaggggccaagggccccaaggccaccccagcccaaaaaatccaagaaggcatcagggtcggggggcggcagtgccgcccttggcccaagtggattcggaccaagcgggggctctggtaccaaactgcaggctggcgtccagtggagggatctggggttgctgcagccaccactcctgggatttaaaagattcagttgcctgagtctgcccagttcacaggattaccgcctcccgaaaaaagctacaaagaccgctcctcccgctttgcccacgggctacgactcggaagaggaggaggagagcaggcctatgtcctatgacgagaagaggcagctcagtctggacataaacaagctcccaggagagaagctgggacgagtagtgcacatcatccaggcgagagagccatccctgcgtgatagcaaccctgaggagatcgaaattgatttcgagaccctgaaaccttctactctgcgggaattagagcgttacgtgttatcatgtctgcgcaagaagccgcgcaaaccatacacgatcaagaagcccgtgggaaagacgaaagaagagctcgctctggaaaagaaacgcgagctggagaagaggttgcaagacgtgtctggtcagttaaattccacaaagaaacctcccaagaaagcgaatgagaagaccgagtctagcagcgcccagcaggtcgcggtcagcaggctctctgcgtctagctcctcgagcgactcttcgtctagctcaagtagctcaagctcttctgacacaagtgatagtgactcaggctag

SEQ ID NO: 180828 - DNA, 2046 bp, Artificial Sequence
  Description of Artificial Sequence: Synthetic coding sequence
atggacatgggcaccatcaagcggcggctggagaacaactactactgggcagctagcgaatgtatgcaagactttaataccatgtttacaaactgctacatctataacaaaccgaccgacgacattgttctgatggcacagactcttgagaagatctttctccaaaaagtggcatcaatgcctcaggaggaacaggagctggtagtaacaattcccaaaaattcacacaagaaaggcgccaagctcgcggctttgcaggggtccgtgacgagtgcacatcaagttcctgccgtgtctagtgtatcgcacacagccctttacacaccaccccctgaaatcccaactaccgtacttaacataccccatccctcagttatcagcagcccactactaaaaagcctgcattctgccggccccccgctgctcgcagtgaccgcagccccaccggcgcagccattggcgaagaaaaaaggcgtgaaacgtaaagctgacaccacgacccctacaccaactgccatcttggcacccggcagccccgctagtcccccgggatctctcgagcctaaggctgccaggttaccgcctatgaggcgggagtctggccggccaataaagccaccaaggaaggaccttcctgattctcagcaacagcaccaatctagcaaaaaggggaaactttctgagcaacttaaacactgtaacggaatcttgaaggagctcctcagtaagaaacacgctgcatatgcctggccattctacaagcctgtggatgcctcagctctcgggctccatgattatcatgatattattaaacatcctatggacctgtcaacggtgaaaaggaaaatggagaacagggactatagggatgcgcaagagtttgccgccgacgtgcgccttatgttttcgaactgctacaagtacaatccccccgatcatgacgtggtagcaatggctaggaaattgcaagatgtctttgaatttagatatgcaaagatgcccgatgagcccctcgaaccaggtcccctacccgtttcaacggccatgccaccaggactcgccaaatcttcttcagaatcaagttctgaggagtctagctcagagtcaagtagcgaagaggaagaggaggaggacgaggaagacgaagaagaagaagaatcagagagcagcgactccgaagaagagcgagcccacaggcttgccgagcttcaggagcagctgagggccgtgcatgagcagttggctgccttatcccaaggaccaatctctaaaccaaagaggaagcgggaaaagaaggaaaaaaagaagaagaggaaagccgaaaagcaccgagggagagccggagctgatgaggacgataaaggccctcgggcccccaggcctcctcagcctaagaagtctaaaaaggcaagtggctcaggcggagggtctgctgccctcggcccctctgggttcggaccctctggcggctctgggaccaagctaccaaagaaagccaccaagaccgcccctcccgcactcccaacaggttacgatagtgaggaggaagaggaatctaggcctatgtcctacgatgagaaaagacagctttcactcgatattaacaaacttcccggggagaagctagggcgggtcgtccatattattcaggctagagaaccatccctcagggactctaatccagaagaaatcgaaatcgactttgagaccctgaagccctctacactacgggagcttgaacgctatgtcctgagttgtctgcgtaagaaacctagaaaaccgtatacgatcaaaaagccagttggtaaaaccaaggaggaactggccctggaaaagaaaagggagctcgaaaaaagactccaggatgtttcaggacagctaaactccacaaaaaagccaccaaagaaagcaaacgagaagactgagtcttctagcgcccaacaggtcgctgtaagccgactgagtgcctccagctcgagctccgattctagttctagctcttccagctcttcctcatccgacacatctgattccgattctggttag

SEQ ID NO: 180829 - DNA, 2511 bp, Artificial Sequence
  Description of Artificial Sequence: Synthetic coding sequence
atgctgcagaacgtgaccccccacaacaagctgcccggcgagggcaatgctggccttttggggctgggcccagaggctgccgccccaggcaagcggatccgcaagccttcactcctgtatgagggattcgaaagccccaccatggccagcgtgcccgccctgcagttgaccccagcaaatccgcccccacccgaggtgtctaatccaaaaaagcccggcagagtgaccaatcagttgcaatatttgcataaagtcgtaatgaaggcgttatggaagcatcagtttgcctggccctttcgccagcccgtcgacgccgtaaagctggggttaccagattatcataagataattaagcagcccatggacatgggtaccataaagcgcaggttggagaataactactactgggcggcaagtgagtgcatgcaagattttaacactatgttcaccaactgctatatctacaataagccaacggatgatattgtcttgatggcgcagacactggaaaagatctttttgcaaaaggtggcatcaatgccacaagaggaacaggagttagtcgtaactattcccaagaatagccataaaaaaggtgccaaactggcagctctgcagggcagcgtgacaagtgcccatcaagttccagcggtctcttcagtgtcacacacagcactatacaccccccccccagagatacccactactgtactgaacattccccatccatcagtgatcagtagccccctactcaagtccctgcactcagccggcccacccctccttgctgtcaccgccgctccgccagctcagcctttggccaagaagaagggcgtgaaacgaaaggctgacacgacaactcccactcccaccgccatcctggcgcccggcagtcccgcatctccccctgggtccctggaacctaaagccgcacgcctgccacctatgaggagagagagcgggcgccccattaaacccccacgcaaagatctaccagattcccaacaacaacatcaaagcagtaaaaaaggaaaactgtcagagcagctgaagcattgcaatggcatcctgaaggagttactgtccaagaagcatgccgcttacgcttggccattctacaagccagtggacgcctcagctctaggcctgcatgactatcacgacatcatcaaacatcccatggacctatcaacggtaaagagaaaaatggagaatagggattacagggacgctcaggagttcgcagccgacgtcagactcatgttctctaactgctacaagtataatcccccagatcacgacgtcgttgctatggccagaaaactgcaggatgtatttgaattccggtatgcgaagatgccagatgaacctttagagccaggtcccctcccggtgtccacagccatgccgcccggcctcgccaagtcaagctccgaatcctcatcagaagagagttccagcgagtctagttcagaggaggaggaggaggaggatgaggaagatgaggaggaggaggaaagcgaatccagtgattctgaagaagaacgcgcccatcgccttgccgaactgcaagagcagcttagggccgtccatgagcagctggctgctttgtcccaggggcctatctccaagcctaagcgaaagcgcgaaaaaaaagagaaaaagaagaagaggaaggcggagaagcaccggggccgcgcaggagccgacgaggacgataaaggacctagagccccacggccgccacagcctaaaaagtcgaagaaggcttcaggatctggggggggttcagctgctctggggccaagtggtttcggcccaagtggcggttcgggcaccaaattgcaggctggcgtgcagtggcgggatctgggccttttgcagccacctctactgggctttaaaaggttttcatgtctgagtctgccctcctctcaggactatagactgcccaaaaaagccaccaagactgccccgcctgccctccctaccggctatgatagcgaagaagaggaagagagtaggccaatgtcctacgacgagaagcggcagttatctcttgatatcaataagctgccaggggaaaagctgggtcgggtcgtgcacattatccaggcccgtgagccatcactccgtgactccaatccggaggaaatcgaaattgactttgagaccttaaagcccagcacactacgagagctcgaaaggtacgttctgagctgtctgagaaagaagccacggaaaccttacactatcaagaagcccgtagggaaaaccaaagaagaactggcactggagaagaaaagagagctggaaaagcggctgcaggatgttagcggccagctgaatagcactaagaaaccgccaaaaaaagctaacgagaagacagagtcctccagtgcccagcaggtggcggtctctaggttgagtgcttcttcatctagtagcgattcatcttcctcatcctcaagttcatcaagcagtgacacttccgactctgacagcgggtag

SEQ ID NO: 180830 - DNA, 2265 bp, Artificial Sequence
  Description of Artificial Sequence: Synthetic coding sequence
atggccagcgtgcccgccctgcagctgacccccgccaaccccccccccccagaggtctccaaccccaagaagcccggtcgagtgacgaatcaactgcagtacctccacaaggtagtcatgaaagctctatggaaacaccagttcgcttggccgttccggcaacctgttgatgcggtgaaactgggtctccctgattaccataagatcatcaaacagcccatggatatgggaacgatcaagcggcgtcttgagaataactattactgggccgctagtgagtgtatgcaagatttcaacacgatgttcacaaactgctacatttacaataagcctactgacgatatcgtattgatggcccagacgcttgaaaagatattcttgcaaaaggttgccagtatgccccaggaagagcaggaactggtggtgaccatcccaaaaaatagccacaagaaaggagctaaactggcggccttgcaaggatccgtgacctcagctcaccaggtaccagctgtgtcttcggttagccacaccgccctctacactccgccacctgaaataccgaccacagtattaaacatcccacacccgtctgtaatttccagcccactgctgaagagcctgcacagcgccggcccccctctgctggctgtaacagccgccccccctgcccaacctctggccaagaagaaaggcgtcaagcgcaaagctgataccactacccccacaccaacagccatcttggccccgggctcgccagccagcccgcctggaagtctcgaacccaaagcggcccggctccctcctatgcggcgggagtccggccgaccgattaaaccacctaggaaggatctgccggacagtcagcaacaacatcagagctcgaaaaagggcaagctgtctgagcagcttaaacattgtaatggcatactaaaggaactcctgtccaaaaaacacgccgcgtacgcatggcccttttataaacccgtggacgcgagtgccctcggtcttcatgattatcatgatatcattaaacatcccatggacctgagtaccgttaagcggaaaatggaaaaccgagactaccgtgatgctcaagaattcgctgccgatgtgagactcatgttctccaattgttataaatataacccaccagaccatgatgtcgtggccatggcaaggaagctgcaggacgtgtttgagtttagatatgcaaaaatgccagacgaaccactggaacctggacctctgccagttagcaccgccatgccaccaggcttagccaagagctcgagtgagtcttcaagtgaggagtcttcctctgaaagttcctcagaagaggaggaagaagaggacgaagaggacgaagaggaagaggagtctgaatctagcgactcagaggaggaaagagcccacagattagcagagctgcaggagcaactgcgggccgtccacgagcaattagctgccctctcccaaggaccgatcagcaagccaaaacggaagagggagaagaaggagaagaagaagaaaaggaaggcggaaaagcaccgggggcgggccggggctgacgaggacgataaggggccgcgtgcccccaggccgccgcagcctaaaaagtccaagaaggcttccggctcgggtgggggctcggctgcactggggccatcaggctttggtcctagcggtgggtcagggactaaactaccaaagaaagctaccaagaccgctcctcctgcactgcccacaggctacgactcagaggaagaagaagagagccggcctatgtcttatgatgagaagaggcagctgagtttggacattaacaagctgcccggggagaaacttggcagagtggtgcacatcatccaggctcgcgagccgtcactgagagacagtaacccagaagaaatcgagatcgacttcgagacattgaaaccaagcaccctgcgcgagctggaacgatacgttctgtcctgtctgagaaagaagccaaggaagccctatacaatcaaaaagccagtagggaaaacaaaggaggagttagcactcgaaaagaagcgcgaattagagaagagactccaggatgtaagtggacaactgaattctaccaagaagcctcctaaaaaggctaacgaaaagacagaatcttcaagcgcacaacaggtggccgtaagcagactgtctgcttcctcttcctcctctgatagttcttcaagtagttcttcctcctcaagcagcgacacctccgattccgattctgggtag

SEQ ID NO: 180831 - DNA, 2046 bp, Artificial Sequence
  Description of Artificial Sequence: Synthetic coding sequence
atggacatgggcaccatcaagcggcggctggagaacaactactactgggctgcaagtgaatgcatgcaggactttaacacaatgtttaccaactgctacatttacaacaagcctacagatgatattgtcttgatggctcagactctggagaaaatatttctgcaaaaggtggcaagcatgccccaggaagaacaggaactggtagttaccatacctaagaattctcacaagaagggagcaaaactggcagcccttcagggtagcgtcaccagtgcgcaccaggtgccagctgtttcctccgtgtcccacactgctctctatactcctcccccagaaatccccaccaccgttctgaatatcccacacccctcagtaatcagctccccgttgttaaagtccctacattctgcaggtccccctctcctggccgttaccgcagctccccccgcacagcctctcgctaaaaaaaaaggagtgaagaggaaggcagacacgactactcccactcccacagccatcctcgcccccggcagcccagccagtcctcccggatctctcgaaccaaaagccgccaggttaccccctatgcggagagagagcggaagaccaatcaagcctccaagaaaagatttacccgactcccagcagcagcaccagtctagcaagaagggcaaacttagcgagcagctgaaacactgcaacggaattctgaaagagctgctgagtaaaaagcacgccgcgtacgcctggcccttttataagccggttgacgcctcggctcttggacttcacgactatcacgacataatcaaacacccaatggacctgtccacggttaagcgtaaaatggaaaatcgcgactaccgcgacgcccaggaattcgcagctgacgtgaggcttatgttcagcaactgttacaaatataaccctccggaccatgacgtggtggccatggcgaggaagttgcaggatgtgtttgagtttcgttatgccaagatgcctgacgaaccgttggagcctggcccactgcccgtaagcaccgctatgccacccggcctggcgaaatctagctcagaaagttcatccgaggagagctcttccgaatcctcatccgaagaagaagaagaggaggacgaggaagatgaggaagaggaggagtctgagtcatctgattccgaagaagagagggcacatcgcttggccgaactgcaggagcagttacgagccgtccatgaacagcttgcggccctgtcccaagggccaatctctaagcccaagaggaagcgcgagaagaaagagaagaagaaaaaaagaaaagccgaaaagcaccgcgggagagctggcgctgatgaggatgacaaaggcccacgggcacctcgcccaccccagccaaagaagtctaaaaaggccagtggctccgggggcgggtcggcagccctgggccctagcggcttcgggccatccgggggatctggaaccaagctgcccaaaaaagcgacaaagaccgcccctcctgccctgccaaccggctacgactctgaggaagaagaggagagtagacccatgagctatgacgaaaagcggcagctctctttggatataaacaaactgcctggtgagaagctcgggagagtggtgcatatcatacaggccagggagccttccctgcgggacagtaaccctgaggagattgagattgattttgaaaccctcaaaccatctaccctgagagaattagagcgctatgttctcagctgcctgaggaagaagcccagaaagccgtacaccatcaagaagccagttggtaagacgaaggaggagctggctttggaaaaaaagagggaactggaaaagagactgcaagatgtcagtgggcaactgaattcaacgaagaagcctcctaaaaaggccaacgaaaaaactgagtcttcatccgcacagcaagtagcggtgtcaaggctgtctgcatctagttccagctcggatagctcctcgtccagcagttcctcctcctcttcagatacatcagacagcgattccgggtag

SEQ ID NO: 180832 - DNA, 2511 bp, Artificial Sequence
  Description of Artificial Sequence: Synthetic coding sequence
atgctgcagaacgtgaccccccacaacaagctgcccggcgagggcaacgctggtctactgggactcggacccgaagcagctgccccagggaagcgcattcggaagcctagtctgctgtacgagggcttcgaaagccccacaatggcctctgtccctgcccttcaacttacacccgctaaccccccgccacccgaggtctccaacccaaagaagcctggtcgagtgactaaccagctgcaatatttgcataaagtagtgatgaaggccctgtggaaacatcaatttgcttggccattccgccaacccgtggacgcagttaaattgggcttgccagattatcacaagatcataaaacaacctatggacatgggtacgatcaagcgccgtctcgagaacaattactattgggccgcaagtgagtgcatgcaggacttcaatactatgtttaccaactgctacatttacaacaaacctacagatgacatcgtgttgatggctcagaccctggagaagatattcttacagaaggtcgcttcgatgccacaggaggaacaggagctggtagtcaccatacctaaaaacagccacaagaaaggagccaagctcgccgccctccaggggtccgttacctccgcacaccaagtccccgccgtgtcttctgttagccacactgccctgtacacaccaccgccggagatcccaactacagtactgaacattccccacccaagcgtgatatccagccccctgcttaaatccctacactctgctggcccaccattactcgccgtcacagcagccccccccgcccagcctttagccaagaaaaagggagtgaagagaaaggcagacactactacgcctaccccgaccgctatactcgcacccggcagcccagcatctcctccaggatccctcgagccaaaggccgctcggttaccacccatgagacgagaatctggacggccgattaagcctcctagaaaagaccttccagattcacaacagcagcaccagagcagcaagaagggcaagctgtccgagcagttgaaacattgcaacggaatcctaaaagagctgctgtctaagaagcacgcggcgtatgcctggcccttctacaagcccgtggacgccagcgcattaggacttcacgactatcatgacataataaaacacccgatggacctgtccaccgtaaaacggaagatggagaaccgagattacagagacgctcaagaattcgccgccgatgttaggctcatgttcagtaattgctacaaatacaaccccccagaccacgacgttgtggctatggcccgtaagctacaagacgtattcgagttccgctatgctaaaatgcccgacgagccacttgagcctggcccactgcctgtttctacagcaatgccgccagggttggctaagagttcttcagaatcatcttcagaagagtcatcttctgagagctcttcagaagaggaggaagaagaggacgaggaagatgaggaagaagaagagtctgaatcctcagattcggaggaggagcgggcgcacagactcgccgagctgcaggaacagctgagagctgtccacgaacagctcgccgcgctgagccagggcccaataagcaaaccaaagaggaagagagaaaaaaaggaaaagaaaaagaagcgtaaagctgagaagcacagaggccgtgccggagccgacgaagacgacaagggccccagagcgcctcggcctccacagcctaagaagtccaaaaaggcatcgggctctggtggcggaagtgctgcgctggggccttcgggattcggtccatccggcgggagcggaaccaagctccaggccggggtgcaatggagggatctgggactcctgcagcctcccttgttaggttttaagcggttctcttgcttaagcctcccctcttcccaggattataggctgccgaagaaggcaacaaagacggccccacccgctctacccactggatatgactctgaagaggaagaggagtcccggcccatgagttatgatgaaaaaaggcagttaagtctggacatcaacaagctgccgggagagaaattggggcgggttgtgcatatcatccaggctcgtgaaccctctctacgagacagcaaccctgaggagatagagatcgactttgaaaccctcaagccgagcacactgcgcgaactggaaagatacgtcctgagctgccttaggaagaagcctcgaaagccttatacgatcaagaagcccgtgggcaagacaaaggaggaactcgccctcgaaaagaagcgcgagcttgaaaaacggctgcaggacgtgtccgggcaattgaattcgactaagaagcctcccaaaaaagcgaacgaaaagactgaatcttcctcagcccagcaggtggctgtgagcaggctgagcgcctcgtcttcctcaagtgactcgagctctagttcatctagttctagctcctccgacacttccgattctgatagtgggtag

SEQ ID NO: 180833 - DNA, 2511 bp, Artificial Sequence
  Description of Artificial Sequence: Synthetic coding sequence
atgctgcagaacgtgaccccccacaacaagctgcccggcgagggcaacgcgggattactgggccttggcccagaagccgccgctcctggtaagcggatacgcaaacctagcctgctctatgaagggtttgaatcgccaactatggcctctgtgcccgcccttcaattaaccccagccaaccccccccctccagaggtgtccaaccctaagaaaccgggccgggtgactaatcaactgcaatacctccataaagtcgtgatgaaggccctttggaaacaccagtttgcttggccctttagacagccagtggacgcagtgaagctgggcctaccagactaccacaagattataaagcagcccatggatatgggtaccattaagcgccggctagaaaacaattattactgggccgccagtgaatgcatgcaggatttcaacaccatgttcacaaactgttatatctacaataaacccacggacgatatagtcttgatggcccaaacgttagaaaagatctttctgcagaaagtggcctcgatgccgcaggaagaacaggaattagtagttacgattccaaagaactcccacaagaagggcgccaaactggcggctctgcaagggtcagtgacaagcgcccaccaggttcctgctgtctcctccgtgtctcatactgcactatatactccccctccagaaatcccaactacagtgtttaatattccccatcccagcgtgatctcatctcccctcctcaaatccctccacagcgccggtccacccctactagctgtgacagcggcgcctcccgcccagcctctggcaaaaaaaaagggggtgaaacgcaaggcagacactactactccgacgcccaccgcgatcctggcgcctggctcccccgcctcacccccggggtctctggagccaaaagcggcaagactaccccccatgagacgggagtccggtcgccctattaagcccccgaggaaggacctacccgatagccagcagcagcaccagtcatcaaagaagggaaagctaagcgagcagctgaagcattgtaatggtattctcaaggagctgctttccaaaaagcacgcagcctacgcatggccattctataaaccagtggacgccagtgcattgggcttacacgactatcacgacatcattaagcaccctatggatctgtctacagtgaagaggaagatggagaatcgagactaccgagacgctcaggaatttgcagcggacgttcggttgatgttctcaaactgctataaatataaccctcccgatcatgacgtagttgccatggccaggaaattgcaggatgtctttgagtttcgctatgcgaagatgcccgatgagcctctggagcccggccccctgcccgtgtccacagcaatgcctcctggcctcgccaagtcatcctccgagagctccagcgaagaaagtagttctgagtccagttccgaggaggaagaggaagaggacgaggaagatgaggaggaagaggaatcagagtcctcagactccgaagaggaaagggctcataggctcgccgaattacaagaacagctgagggctgtccatgagcagttagctgccctgtctcaagggcctatctcgaaaccaaaaagaaagagagagaagaaggagaaaaaaaaaaagcggaaggccgagaagcatagggggcgagccggggccgacgaagatgacaaaggtccccgggcgcccagacctccacagcctaaaaaaagcaaaaaagctagcggatctggaggcggctctgccgccctgggaccttcagggtttggcccctcaggtgggtctgggacaaaactgcaggccggggtgcagtggagggatctcggactcctacagcccccactactcggattcaaaagattttcttgcctctcactacccagctcccagaactatagattacctaagaaagccaccaaaaccgccccacccgcccttcccactgggtatgactcagaggaagaagaggaaagtcgacctatgtcttatgatgagaagcgccagttgtcattagatattaacaaacttccaggggaaaagctgggcagagtcgtgcatatcatccaggccagggagcccagtctgagagactccaatcctgaggagattgagatcgacttcgagacccttaaaccttcaacactgcgagaactcgagagatacgtgctctcatgtctccggaaaaaacccaggaaaccatacacgataaagaaacctgtgggtaaaactaaggaagagctggctttagaaaaaaagcgagagctcgagaaacggctacaggatgtgtctgggcagttgaactccaccaagaagccacccaaaaaagcaaacgaaaagactgaatccagcagcgcccaacaggtggcagtgagtagactaagtgctagtagctcttcttcggactccagttctagctcctcgtcctcctcttccagtgacacaagtgactccgattctggctag

SEQ ID NO: 180834 - DNA, 2265 bp, Artificial Sequence
  Description of Artificial Sequence: Synthetic coding sequence
atggccagcgtgcccgccctgcagctgacccccgccaacccccccccacctgaggtttctaatccaaaaaaacccggacgagtcacaaatcaattgcagtacttgcacaaagtggtgatgaaggccctctggaaacatcaattcgcttggcccttccgccagccagtggacgccgtgaagctcggattgcctgattaccacaagatcataaaacagcccatggatatggggaccattaaaaggcggctagaaaacaattactattgggccgcaagtgaatgtatgcaggactttaataccatgttcaccaattgttacatttacaataaaccaaccgacgatatcgtgcttatggcccaaacccttgaaaagatctttcttcagaaggtggctagcatgccacaggaagagcaggagttagttgtgacaattccaaagaactctcacaaaaagggggccaagctcgcagctctgcaggggagtgtcacatcagcccaccaggttccagccgtgtcctctgtatctcataccgcattgtatactcccccccctgagattcccaccactgtgttaaatatcccccatccttcggtcattagcagccctctgcttaaatcactccactccgcaggcccaccactcctggccgtaaccgcggctccacctgcccagcctctggctaaaaagaagggggtcaagagaaaggccgacactacaactcctacacccacagcaatcctggcgccaggcagtcctgcaagccccccagggtcactcgaaccaaaagccgctagactgcctcctatgcgaagggaaagcgggcggcccataaagcccccacgcaaggatctcccagactcgcagcaacaacaccagagttccaaaaaaggaaagctgagtgagcagctgaagcactgcaatggcatccttaaagagcttctgagcaaaaaacatgcagcttatgcctggcctttctataagccagtagacgctagtgctctcgggctgcacgattatcatgacatcataaaacatcctatggatctgagcaccgtgaaacgcaagatggaaaacagagactatcgtgacgctcaggaattcgcggccgatgtccgcttaatgttcagcaattgctataaatataatcccccagatcacgacgtggttgctatggcacggaagctgcaagatgtattcgagtttaggtacgccaaaatgcctgacgagccactagagccgggccccctgcccgtgtcgacagccatgcctcctggccttgccaaatcatccagtgagtcaagcagtgaagaaagctcctccgagtcaagctcagaggaagaggaagaggaggacgaggaggacgaagaagaggaggagagcgagagcagcgactctgaggaagaacgtgcccacagactggcggagcttcaggagcagctgagagctgtccacgagcagctagccgccctatctcagggcccaatctccaaacccaagaggaaacgggaaaaaaaagagaaaaagaagaaacgtaaggcagaaaaacaccgggggagagccggagccgacgaggacgataaagggcccagagccccaagaccgccccagcctaagaagagcaagaaagcctccggatcgggtggtggctcagccgcattaggacccagtggattcggaccttccggtggatccgggaccaagctgccaaagaaagctaccaagaccgcccccccagctctcccaaccggatacgactccgaggaggaagaggaatcccgccctatgagttacgacgagaagcgtcagctgagcttggatatcaataaactgcctggtgaaaagctggggagagtggtgcacatcattcaggctcgtgaaccctcactgcgggattcaaaccctgaagaaatcgagatagattttgagacactgaaaccttccacccttcgggagttggaaaggtacgttctgtcatgtcttcgcaagaaaccgcggaagccgtacaccattaagaaaccggtagggaagaccaaggaagaactggcactggagaagaaaagagagctggaaaaaaggctgcaggatgtctccggacaattgaactccacaaaaaaacctcccaagaaggccaatgagaagacagagtcgagttcagctcagcaagtggctgtgtcccgtctctcagcctcctcatcaagttccgacagtagctcgtcctcgtctagctcgtcgagctctgacacctccgattctgactccggctag

SEQ ID NO: 180835 - DNA, 2406 bp, Artificial Sequence
  Description of Artificial Sequence: Synthetic coding sequence
atgctgcagaacgtgaccccccacaacaagctgcccggcgagggcaatgcaggcctcctgggtctgggccccgaagccgcagcccccggcaagagaatccgaaagccgagtctcctgtacgagggcttcgagtcgcccaccatggcctcagtgcctgctctgcagctgacgccagcgaatccaccaccacccgaagttagtaaccccaaaaagcctggccgggttacaaaccagcttcagtatctccataaggtagtcatgaaagccttgtggaagcatcaatttgcttggccctttaggcaacctgtagacgccgtcaagctgggtctaccggattaccataagatcataaagcagcccatggacatgggaaccataaaacggaggctggagaataactactattgggccgcttccgaatgcatgcaggatttcaataccatgttcaccaactgttacatctataacaaaccaaccgacgacatagtcctcatggctcaaactctagagaaaatattccttcagaaggttgcttctatgccacaggaggagcaggagctggtagttaccattccaaagaattcacataagaagggagccaaattggccgcgctgcaaggtagtgtgactagtgcccaccaggttcctgctgtgagctccgtttcccatacagcactctacactccccctccggagattccaacaacagtgcttaacattccccatcctagtgtgatcagcagtcctctgttgaagagcctacactccgctggacctccccttctcgcagttactgcagctccccccgctcagcccctggctaaaaaaaaaggagtgaagcggaaggctgacacaacaacccccacccccaccgcaatactggcgccgggttctcctgcatcgccaccgggtagtctggaacccaaagcagcccgcttgccccctatgcgaagggaatccgggcgaccaatcaagccacctagaaaagatctgcctgactcgcaacagcagcaccagtctagcaagaagggcaagctgtcagaacaattaaagcattgcaacggcatcctgaaggagcttttgtcaaagaagcacgcagcatacgcttggccattctacaagcccgtcgacgccagtgctttaggacttcacgattatcatgacatcattaaacatccaatggacctatccacagtgaaaagaaagatggaaaatcgggattacagggacgcacaagagtttgccgcagacgtgagactcatgttttcaaattgttacaaatataacccaccagaccacgatgtggttgctatggctagaaaactgcaagacgtgttcgaattcagatatgctaaaatgccagatgagcccctggaaccaggtcccctgccagtgtctacggctatgccgcctggacttgcaaagagctcgagtgaatccagcagcgaggagtcttcttcagagtctagtagcgaagaagaggaggaggaggatgaggaggacgaggaggaagaggaatccgaatcatcggatagcgaggaagagcgcgctcaccggctcgccgaactgcaggaacaactacgagctgtgcatgagcaactggcagcactatctcagggacccatttcaaagccaaagcggaagcgagagaagaaggaaaagaaaaaaaagcgaaaggcagaaaaacataggggccgtgcgggagcggatgaagacgataaaggccccagagcaccccggcccccacagccaaaaaaaagtaagaaagcgtctggctccgggggcggatctgctgctctgggaccctctggattcgggccctcgggaggttccggaaccaagttacccaaaaaagccacgaagaccgctccccctgctcttccaacaggctatgattctgaagaagaggaggagagtcgaccaatgagctatgacgagaagcgccagctgtctctagatatcaataagttgcctggagaaaaactcgggagagtcgtccatatcatccaggcgagagagccttctttgagagattctaaccctgaagagatcgaaatcgatttcgagacgctgaagccatctaccctgagggaactcgaacgctacgtgctgtcgtgcttgcgcaagaaaccacggaaaccttatactatcaagaagcctgtcggtaaaactaaggaggagttggcgttggagaagaagcgggaattggagaagaggttgcaggacgtctccggacagctcaacagtactaagaaacctccgaaaaaggcgaacgagaagacagaaagctccagcgcacagcaggtggcagtgagcagactgagtgcctcaagcagcagctctgactccagctcaagctcatcttcctcctcctcttccgacacctctgattctgatagcggttag

SEQ ID NO: 180836 - DNA, 2046 bp, Artificial Sequence
  Description of Artificial Sequence: Synthetic coding sequence
atggacatgggcaccatcaagcggcggctggagaacaactactactgggcagcctcagaatgcatgcaggacttcaatactatgtttactaactgttacatctacaacaaacctaccgatgatattgtcttaatggctcagaccctcgaaaaaatctttttacagaaagtagccagcatgccacaagaggaacaagagctcgtggtgactattcctaagaattcccacaagaagggggccaaactggccgccctgcagggatcagtgacaagtgctcatcaggtgccagctgtttcttcggtgagccacactgcactttacaccccgcctcctgagatcccaacaacggtgctgaacattccgcacccatcagtgatttcttcaccgctgttgaagtctctgcactctgcggggcctcctctgctcgccgtcacggcggccccacctgcccagcccctagccaagaagaaaggcgtgaagaggaaggctgacacaactacacctacacctactgccatcctggcgcctggcagtccagcttcgccccccggatctctcgaacctaaggctgcccgcctgcccccaatgcgtcgggaatcagggcgccccatcaagccaccacgcaaggacctcccagatagtcaacagcagcaccaatccagtaagaaagggaagctctccgaacagctgaaacactgtaatggtatactcaaggaactcttatcaaagaaacatgccgcatacgcttggccattctataagcccgtggacgccagcgcactgggactacatgactatcacgacatcattaagcaccctatggacctaagcactgtcaagcgaaaaatggagaacagggactatcgggacgcccaagagtttgccgccgacgtgaggctgatgttttcaaattgctacaagtacaacccgcccgaccatgatgtcgtggccatggcacgaaagctccaagatgttttcgaattcaggtatgccaagatgcccgacgagcctctcgagcccggcccacttcctgtatctactgctatgcctcccggactggccaaaagttctagcgagagctcctcagaggaaagtagctctgagtcttcctcagaagaggaagaagaggaggacgaagaagatgaagaagaagaggagagcgagagttccgactctgaagaggagagagcccaccgactggccgagctgcaggagcagttgcgcgctgtccatgagcagctggctgccctctctcagggacctatatctaagcccaagaggaagagggagaagaaggagaagaagaagaagcggaaggccgaaaagcatcggggccgcgcaggcgctgatgaggatgataagggtccacgcgcacctcgccctccacagccaaagaagagcaagaaagctagtggcagcggtggtgggtcggctgcacttgggccctccggctttgggccctcaggcgggtcaggtacaaaattgcccaagaaggctacaaaaacagccccccctgccctacccacgggctacgacagcgaagaggaagaggaatctcgtccaatgtcctacgatgaaaagaggcagcttagcctagacattaataaactgccgggcgagaagcttggcagagtagttcatatcatccaagccagggagcccagcctgcgggacagtaaccctgaggaaatcgaaatagattttgagactctgaaaccctctacactcagggagctggaacgctatgtgctgtcatgtttacgaaaaaagccccgaaaaccttataccattaagaaaccagtgggcaagaccaaggaggagctggctctggagaagaagagggaactcgagaagcgacttcaagatgtgtcaggacagcttaattcaacaaagaagccgcccaagaaagctaacgaaaagactgagagcagtagcgctcagcaggtggccgtctccagactgtccgcttcgagcagctcgagcgactcctcttctagctctagttcttcgagtagcagcgacacttccgattcggattccgggtag

SEQ ID NO: 180837 - DNA, 4089 bp, Artificial Sequence
  Description of Artificial Sequence: Synthetic coding sequence
atgagcgccgagagcggccccggcacccggctgcggaacctgcccgtgatgggtgacgggctagaaacctcccaaatgtctacgactcaggcgcaggctcagccgcaacccgctaacgccgcttccactaatcccccgccacccgaaaccagtaacccgaacaaacccaaacggcaaactaaccagctgcaatatttactccgcgtggtgctgaagacgctttggaaacaccagttcgcctggccgttccaacagccggtggacgcagtgaaactcaatctgccggactattacaaaatcattaagacccctatggacatggggactatcaagaagagactagagaacaactactattggaacgcccaagagtgtatccaggatttcaacacaatgtttactaactgctatatctacaacaagccaggtgatgacatcgtactgatggctgaggcgctggagaaactttttcttcagaaaattaacgaactcccaacggaggaaactgaaatcatgatcgttcaggccaaggggcgcggacgtggccggaaggagaccggtaccgcgaagccaggagtatccacagtccctaacacgacccaggcatccacccccccacagacccagaccccgcagcccaatccaccaccggtgcaggccacgcctcatccttttcccgctgtcacccccgacttaatcgtccaaacacctgtaatgaccgttgtgcctccccagcccctgcagaccccaccacccgtgccccctcagcctcagcctcccccagcaccggccccccagcctgtccagagccacccgccaatcatcgcggcgaccccccagccagtgaaaacaaagaagggggttaaacgcaaggccgacaccaccacacccacaactatcgatcctattcacgagcccccatcccttccacccgagcctaagacgaccaagctgggacaacggcgcgaatcatcaagacctgttaagccgccgaaaaaggacgtgccggatagtcagcagcaccccgcccccgagaagtcatctaaagtctcagaacagctgaagtgttgttccgggatcttaaaggagatgttcgcaaagaagcacgcggcttacgcctggcccttctacaagcccgtggatgtggaagcactcgggctgcacgactactgcgacattatcaagcatcctatggacatgagcacgatcaagagcaagcttgaagctcgggagtatagggacgcgcaggaatttggcgcagatgttcgactgatgttcagtaattgttataaatacaatcctccagaccacgaggtcgtggctatggcacgtaaacttcaagatgtctttgagatgagattcgcaaagatgcctgatgaacctgaggagccagtcgtcgccgtcagctctcccgccgtgccaccccccacaaaagtcgtcgctccaccttccagcagtgactccagctccgactctagttcagactctgactctagcaccgacgattccgaggaggaaagggcccagaggctggccgagctccaggagcagctgaaggccgttcacgagcagctggcagccctttcccagcctcagcagaacaagcccaagaaaaaagagaaagataagaaggagaagaaaaaagagaaacacaaaagaaaagaagaagtcgaggaaaacaagaagtctaaggcaaaggaaccaccaccaaagaaaactaaaaagaacaactcatcaaactccaacgtctccaaaaaggagcccgctccaatgaagtctaaacccccccccacttacgagagcgaggaagaggataagtgcaaacccatgagctacgaggaaaaaaggcagctgtctcttgatatcaataagcttcccggcgagaaattgggccgagtggtacacatcatccagtctcgtgaacccagcctcaaaaatagcaatccggacgagatcgaaattgactttgagaccctgaagcctagcactctgcgcgagctagagcgctacgtcacctcttgcctgcggaagaagagaaagcctcaggccgagaaggtggacgtgatcgctggctcttcaaaaatgaagggcttctcatcgtccgagtccgagagctctagcgagtcatcaagctctgatagcgaggactccgaaacggaaatggcaccgaaaagcaagaagaaggggcatccggggagggagcagaaaaaacaccatcaccaccaccatcagcagatgcagcaggcacctgcgccagtgccccaacaacctcccccccccccccagcagcccccgcctcctcctccccctcagcagcagcagcagccaccccctcctccccctcctcctagcatgcctcagcaggctgcgcctgcaatgaagtcttctccaccgcccttcattgccacccaggtgcctgttctggagcctcagttacccggctcagttttcgaccccattggccacttcacccagcccatactccatttgccgcagcctgaattgccacctcacttgccacagcctcctgagcactcgacacctccacacttgaatcagcacgctgttgtatctccccctgccttacataacgctttgccccaacagccgagtcgcccaagcaatagagccgctgcgctgcctccaaaaccggcaaggcctcccgcggtatccccagccctgacccagactcccctgctgcctcagccgcccatggctcaaccgcctcaggtcctgctggaagacgaggaaccccccgcgccacctctaacgtccatgcagatgcagctgtaccttcagcagctgcagaaagtgcaaccaccaaccccactcctgccctcagtgaaggttcagtcccagcccccacctccacttccacccccgccacatccatccgtgcagcagcagctgcagcagcaacctcccccccccccaccaccacagccccagcctccccctcagcaacagcatcagcctccgcccagaccggtgcacctacaacccatgcagttttccacgcatatacagcaaccccctcccccccagggacaacagcccccacacccacctcctggccagcagcccccgcctcctcagcccgctaaaccacagcaggttattcagcaccaccattcccctagacatcacaagtccgacccttactctacagggcacctacgggaagcaccgagccccttgatgatccactcaccccaaatgtcccagtttcagagtctaacccaccagtctccccctcagcaaaatgtgcagccaaaaaagcaggagttgcgtgcagcctccgtagtgcagccgcaacccctggtggtcgtgaaggaggagaaaatccacagccccattatcagaagcgagcccttttctccaagcctcaggccagagccccccaagcaccctgaatctattaaggccccagttcacctcccgcagcgtcccgaaatgaaaccagtggacgtgggacggccagtgatccgcccacctgagcaaaatgctcccccacccggtgctccagacaaggataagcaaaaacaggagccaaagacgccagtggctccaaagaaggatctaaagatcaagaatatgggatcctgggcctctttggttcaaaagcacccgactactccgtccagtacagcaaaaagctcatctgactctttcgagcagtttcgtcgtgctgcacgagaaaaagaggagagagagaaggcgctgaaggcacaagccgagcacgctgaaaaagagaaagagcggttgagacaagaaaggatgaggtctcgggaggacgaggacgcccttgagcaagcaaggcgagcccatgaggaggcccgaaggcgtcaagagcagcaacaacagcagagacaggagcagcaacagcaacagcagcaacaggccgctgccgtggcagctgctgcaacaccccaggctcagtcctcacagccacagtcgatgctggatcagcagcgagagttggctagaaagcgggaacaggagcgtcggcggcgggaggccatggctgcgacgatcgatatgaatttccaatcggaccttctgagtatttttgaggaaaaccttttctag

SEQ ID NO: 180838 - DNA, 2385 bp, Artificial Sequence
  Description of Artificial Sequence: Synthetic coding sequence
atgagcgccgagagcggccccggcacccggctgcggaacctgcccgtaatgggtgatggactcgaaacctctcaaatgagtacaacacaagctcaagcccagccacagccagcaaatgctgccagcactaacccaccaccccccgagacaagcaaccctaataagccaaaacggcagactaatcagcttcagtatttacttagagtggtcttgaagacactgtggaagcatcaatttgcctggccattccaacagcctgtcgacgcagtcaaattgaatctgccagattactacaagattatcaagactcctatggatatgggcactatcaagaagagactagagaacaattactattggaatgcccaggaatgtattcaggattttaataccatgtttaccaattgctacatatacaacaagccgggggacgacatagtgctaatggccgaagcgcttgaaaaactatttcttcagaagatcaatgaacttccgacagaagagacagagatcatgatcgtacaggccaaaggcagagggcgcgggcgcaaagagactggaacagctaagccaggcgtctcaacagtccctaatacaacccaggcatcaacacccccgcaaacccagacgcctcagcctaatccacctccagtgcaggctacaccacacccgtttcccgccgttaccccggatctgattgttcaaacacccgtcatgactgtcgtccctccccagcccctccaaaccccgcctcctgtgccaccccaacctcagcctccgcctgctccggctcctcagccggtacagagtcacccgcccattatcgctgcgactccacagcccgttaaaacaaaaaagggagtcaagcgaaaggccgacactacaacccccacaaccattgatcctatacacgagcccccttcgcttcctcctgaaccaaaaacaactaaactcgggcagagacgggagtccagccggcctgttaagcctcccaagaaggatgtgcctgacagtcagcagcaccctgcacctgagaagagctccaaggtctctgagcagctcaagtgctgcagcggaattctcaaagaaatgttcgccaaaaaacacgccgcctatgcatggcccttttacaaaccagtggatgtagaagccctggggttacatgattattgtgacattatcaaacatcccatggacatgagcacaataaaatctaaactggaggccagggaatacagagatgcgcaggaatttggcgccgatgtcaggttaatgttcagcaattgctacaaatacaaccctcctgatcacgaagtagttgctatggcacgtaaacttcaggatgtgttcgaaatgagatttgcaaaaatgccggacgaaccggaagagccagtggtggctgtttcctcccccgctgtcccgccgcctacgaaggtcgttgcccctccctcctccagtgactctagttcagattcatctagcgattctgacagctctactgacgactcagaagaagaaagggcacagaggctcgccgagctacaagaacagctcaaagctgttcatgaacagctagcagctctgagccagccccaacagaataagcctaaaaagaaggaaaaagacaagaaagagaaaaagaaagagaagcataagagaaaggaggaggttgaagaaaacaaaaagtccaaggccaaagagcccccccccaagaagaccaagaaaaacaatagctccaacagcaacgtgagcaagaaggagccagcacctatgaagagtaagccacccccaacatatgagtctgaagaagaagacaaatgtaagcctatgtcctacgaggaaaagcggcagctgagcctcgatattaacaaattacccggagaaaagttgggacgagtggtgcatatcatccagagccgagaaccgtcactgaaaaattctaatcctgatgaaatcgagatcgacttcgagaccctgaagcccagtacactgagagagctcgagaggtatgtcaccagctgtttacgcaaaaagcgtaagccccaagccgagaaagtggacgttatcgcaggatcctctaagatgaaaggcttcagcagctcggaatcagaaagcagctcagagtcaagctcctctgactctgaggactctgaaacagctttctgtacttcaggtgattttgtttcacctgggcccagcccctatcacagccatgttcagtgtggtaggttccgggaaatgctgcggtggtttctggtggacgtggaacaaacagccgctggccagccccacaggcagagcgcagcgggtccagctatcacttgggcccccgccatcgcgtatccctcacctgaatgcgcccgctgctgcgtgggatgtagttag

SEQ ID NO: 180839 - DNA, 2169 bp, Artificial Sequence
  Description of Artificial Sequence: Synthetic coding sequence
atgagcgccgagagcggccccggcacccggctgcggaacctgcccgtgatgggcgacggtcttgagaccagtcagatgagtacaactcaagcacaagcccagccacagcccgccaacgccgcctctacaaatccccctccccctgagaccagcaaccctaacaagcccaaaagacagacaaatcagctgcaataccttcttagggtggtgctgaaaacgctgtggaagcaccagtttgcttggcctttccagcagcccgtagatgccgtgaaactgaacttacctgactattacaagatcattaaaacacccatggatatgggaacaattaagaaaaggctggagaacaactattactggaacgcacaggagtgcatacaggattttaacacgatgttcaccaactgctacatatacaacaagccaggagacgatattgtcctcatggctgaagccctggagaagttgttcttgcaaaagattaatgagctgccgaccgaggaaaccgagattatgatcgtgcaggcaaagggtagaggtagggggaggaaagagaccgggacagccaaacccggagtcagcaccgtccctaatacaactcaggcttctacacctcctcaaactcagacaccccagcccaatcctccaccagtgcaggctacaccccacccgtttcctgctgtaactcccgacctgatcgtgcagacgccagtaatgaccgtcgttcccccacagccactacagacgcctcctccggtgcccccacaaccacagcctcccccggccccagcacctcagcctgtgcagtctcacccacccatcattgccgccaccccacagcctgtcaagaccaagaagggagtcaagcggaaggccgacacgacaactccaacaaccatcgatcctattcacgaacccccctcactgcctcccgaacctaaaactaccaagctgggacagagaagagaatccagccgccctgtgaagccacccaaaaaggatgttcctgactcccagcagcatccagcaccggaaaagagttctaaggtaagcgaacaactgaaatgttgcagcggcatcctgaaagagatgtttgctaaaaagcatgcagcctatgcctggcctttttataaacctgtggacgtggaagcccttggattgcatgactactgcgatattatcaagcacccaatggatatgagcacgatcaagtcaaaacttgaagcgagagagtatagagacgcacaggagtttggggctgacgtgcgtctgatgttctccaactgctacaagtacaacccccccgaccacgaggtcgttgcaatggccagaaaacttcaggacgttttcgagatgcgcttcgctaaaatgccagacgaacccgaggagccagtggtagcagtgtcatcccccgctgttccacctcccaccaaagtggtcgcaccccctagcagtagcgatagctctagtgattcaagcagtgactcagactcgtctacggacgatagtgaggaagaaagagcacagaggcttgctgaactgcaggagcagctgaaggccgtacatgaacaattggccgcccttagtcagccccagcagaacaaaccaaagaaaaaagaaaaggacaagaaagaaaagaaaaaggagaagcacaagagaaaagaagaagtggaggagaacaaaaagtctaaagcaaaggagcctccgccaaagaagaccaagaagaacaatagttccaactcaaacgtctccaagaaggaacccgctccaatgaagagcaaaccacctccaacttacgagagcgaagaagaggataagtgtaaacctatgagctatgaggagaaacgtcagttgtccctggacatcaacaaactgccaggagaaaagcttggacgggtggtccacataattcagagtcgcgagccatccctcaagaactccaaccctgacgaaattgagattgatttcgaaacactcaaaccctcgaccctgagggagctggaaagatatgttaccagctgcctgaggaaaaagaggaagccccaagccgagaaagtcgacgttatcgcgggttccagtaaaatgaaaggcttttcttcgtccgagagtgagtcctcctccgaaagctcaagctcagactccgaggacagtgaaaccgggcccgcgtag

SEQ ID NO: 180840 - DNA, 2625 bp, Artificial Sequence
  Description of Artificial Sequence: Synthetic coding sequence
atggacctgaacaccatcaagaagcggctggagaacaagtactacgcaaaggcaagtgagtgtatagaagattttaacactatgttctccaattgttacctgtataacaaacctggggacgacatcgtccttatggcgcaagcactcgagaaactcttcatgcagaaactgagccaaatgccacaggaagagcaggtggtgggagtaaaggagcgcattaaaaaagggacacagcagaacatcgccgtctccagtgccaaggagaagtccagcccatcagccacagagaaggtgttcaaacagcaagaaattccttcggtgtttccgaagacgagtatttcaccactgaacgtcgtccagggtgcatctgtgaattcatcatctcaaacggctgctcaggtaaccaagggcgtgaagagaaaggcagacacaaccacccctgccactagtgctgtgaaagccagctccgaattctcccccaccttcacggagaagagcgtggcgttaccaccgataaaagaaaatatgccaaaaaatgtcttgcctgatagccagcaacagtacaacgtggtgaagactgtcaaggtcacagaacaacttagacactgctccgaaattctaaaggaaatgttagccaagaaacattttagctacgcctggcccttctacaaccctgtggacgtaaatgccctaggccttcacaactactatgacgtcgtcaaaaatccaatggacctcggcacaataaaagagaagatggacaatcaggagtacaaggacgcgtacaagtttgcagccgatgttagacttatgtttatgaactgctataagtataatccccccgatcacgaggtggtcacaatggccaggatgctgcaggacgtctttgaaactcatttttctaagatcccaatcgagccagtggaatccatgcctctgtgttacatcaagaccgacattacagaaacaactggtcgtgagaacaccaacgaggcctcttccgaagggaactctagtgatgattccgaagatgagcgcgtcaagagactcgccaagctccaggaacagctgaaggccgttcatcagcaactacaggtgctcagtcaagttccgtttcggaaactgaataagaaaaaggagaagtccaagaaagagaaaaaaaaggagaaggtcaacaacagcaacgagaatccccgaaaaatgtgcgaacaaatgcgcttgaaagaaaagagcaagcggaaccaacctaaaaagcggaaacagcagtttatcggactcaaaagtgaggacgaggacaatgccaagccgatgaattacgatgagaagcgccagttgagccttaatataaacaaacttcctggggacaaactgggcagggttgtccacatcatacagtctcgagaaccatccctgagcaattcaaaccccgacgaaattgaaatcgattttgaaacactcaaggccagcacgcttcgggagctggaaaaatatgtgagcgcttgtctgcgtaagcgccccctgaagcctcccgcaaagaagatcatgatgagtaaggaagaactccatagccagaaaaaacaggaactcgagaagaggctcctggatgtgaacaatcagctgaattctaggaagaggcaaactaaatccgataaaacccagccatctaaggcagttgagaacgtctctcgactgtccgagtcttctagcagctccagctcttcaagcgagagcgagtcgtccagctcagatcttagttctagcgatagttcagactcagaatcggagatgtttcctaaattcacggaggttaagcctaatgacagtccctccaaagaaaatgttaagaaaatgaagaacgagtgcattccacctgagggccgaactggagtgacccagatcggttactgcgtgcaggacaccaccagcgccaacacgaccttggtgcaccagacaacgccaagtcatgtgatgccaccaaaccaccaccagctggcctttaactaccaggaactcgagcacctgcagaccgtcaagaatatttcccctctccaaatcctgccaccatctggcgattcagaacagttgtcaaatgggattacagtgatgcacccctccggggactctgatacaacgatgctggagagcgaatgtcaagctccagtgcagaaggacatcaagattaaaaatgcagactcatggaagtccttaggcaagccggtgaaaccctctggggtgatgaaatcttcagacgagctgtttaaccagttcaggaaggctgctattgagaaggaggtgaaagccagaacccaggaactgattagaaaacacctggagcaaaataccaaggaattgaaggcttctcaggaaaaccagcgggaccttggtaacggcctcaccgtggaaagtttttctaacaaaattcaaaacaaatgcagcggggaggaacagaaagagcaccagcaatcttcagaggcccaggataaatccaaactgtggctgcttaaggaccgcgatcttgctcgacagaaggagcaggagaggcggcggagggaggccatggtgggcaccatcgatatgacattgcagtccgatataatgaccatgttcgaaaacaattttgattag

SEQ ID NO: 180841 - DNA, 45 bp, Artificial Sequence
  Description of Artificial Sequence: Synthetic coding sequence
atgagcctgcccagccggcagaccgccatcatcgtgaacccctag

SEQ ID NO: 180842 - DNA, 2844 bp, Artificial Sequence
  Description of Artificial Sequence: Synthetic coding sequence
atgagcctgcccagccggcagaccgccatcatcgtgaacccccccccccccgagtacattaatacaaaaaagaatggacggcttaccaaccaacttcaatacttacagaaagtggtcctaaaagatctatggaagcactccttttcttggccatttcaacgccctgtggacgccgtcaagctccagcttccagactactacaccattattaaaaaccccatggacttaaatactatcaaaaaaaggctcgagaacaagtattacgcaaaagcttctgagtgtattgaggactttaatactatgttcagcaattgctatctctataacaaacctggagacgacatcgtgttaatggctcaggccttggagaagctgttcatgcagaagctgagccagatgccacaggaggagcaggtggtcggagtaaaagaacggataaagaaaggcacccagcagaatatcgccgtgagctccgccaaagagaagagctccccctctgctacggaaaaggtatttaaacagcaggagataccttccgtgttccctaaaacatcaattagccctcttaacgtcgtgcagggtgcttcagtcaatagctcctcccagactgctgcacaggtgaccaaaggcgtgaaaagaaaagccgacaccacaactccagcaacctctgcagtaaaggcttcctcggagtttagccccacatttacagaaaagagcgtggctttaccgcccattaaagagaacatgccgaagaatgtgctgccggacagccaacagcaatacaatgtggttaaaaccgttaaggtgacggaacagcttaggcattgtagcgagatcttaaaagaaatgctggccaaaaaacacttttcctatgcctggccattctataatcctgtggatgtgaacgcactgggcctgcacaactactatgacgtggtcaagaatcctatggacctgggaactatcaaagagaagatggataaccaggagtacaaagatgcatacaaatttgcagccgatgtcagactgatgtttatgaactgctacaagtacaatcctcccgaccacgaagtggtcactatggcccggatgctacaggatgtgtttgagacccactttagcaagattccgattgagcccgtggagtccatgcccctgtgctacataaagaccgacatcacagagactaccggcagggagaacacgaatgaggcttcttcggagggcaacagcagcgatgattccgaggacgagcgggtaaaacggctagcaaaactccaggaacaactcaaggccgtgcatcagcagctgcaggtgctctcacaggtcccattccggaagctaaacaagaagaaagaaaagagcaaaaaggagaagaagaaggagaaagtgaacaattccaatgagaaccctcgaaaaatgtgtgagcaaatgcgtctgaaggaaaaatcgaagcgtaaccagcctaagaagagaaagcagcagtttatcggcctcaagagtgaggacgaggacaatgcaaagcctatgaactatgacgaaaagcgccagctttcccttaatataaacaaacttccgggagacaaactcgggagggtggttcatatcatccaatccagggagccgtccctgtcgaattcaaacccggacgagattgagatcgatttcgaaaccctaaaggcttctaccttgcgtgaactggagaagtatgttagcgcttgtctgcggaaaagacccttgaaaccccccgcgaagaaaatcatgatgtccaaagaggaactgcattcgcagaagaagcaggaactggagaaaaggctgctcgatgtgaataatcaactgaattctcggaaacggcagaccaagagtgataagacacagccctccaaagcggtggagaatgtttctaggctttccgagtcatcttcttcctccagttcgagttccgaatccgagagcagcagttccgacctgtcttcttcggacagcagcgatagtgagagcgagatgtttcctaaattcacagaggtaaaacccaacgatagcccaagcaaggagaacgtgaagaagatgaagaacgagtgtattcctcccgagggcaggactggggtgacccagatcggttactgtgtgcaggatacaactagcgcgaacaccacactcgtacatcagactactccctctcatgtgatgccccccaaccaccaccaattagcctttaattatcaggagctggaacatctgcagaccgttaaaaacatcagccccctacagatcctacctccttccggagactcagagcagttaagcaacgggattacagtcatgcaccctagcggcgattctgataccacaatgctagaaagtgagtgtcaggcccctgttcagaaggacatcaaaattaagaacgctgactcctggaaaagcttgggcaaacctgtcaaaccatccggagtcatgaagagtagcgacgagctgtttaatcaattccggaaggcagccattgagaaggaggtgaaagcgagaacccaggaactgattaggaagcatctggagcagaatacaaaagagcttaaagcatcacaagagaatcaacgcgatctgggaaatggactgacagtcgaaagttttagcaataagatccaaaataaatgcagcggagaggagcagaaggaacaccagcagtcttccgaagcccaggacaagagtaaattgtggctcctaaaagaccgggacttggctaggcaaaaggagcaggaaagacgacgacgggaggcaatggttgggaccatcgatatgacgcttcagtctgatatcatgactatgttcgagaacaattttgattag

SEQ ID NO: 180843 - DNA, 2706 bp, Artificial Sequence
  Description of Artificial Sequence: Synthetic coding sequence
atgagcctgcccagccggcagaccgccatcatcgtgaacccccccccacccgagtacattaatacaaagaaaaacggcagactgaccaaccagctccagtatttgcaaaaagttgttctgaaagacttgtggaaacatagcttttcctggcccttccagaggcccgtggatgctgtcaagctacaactcccacctggagatgatatcgtgctcatggctcaagcgttggagaagttatttatgcaaaagctctctcagatgcctcaagaagaacaggtcgtgggagtgaaagagagaatcaagaagggtacccagcaaaacattgccgtgtcctccgctaaagaaaaaagcagtccctccgccaccgaaaaggtttttaaacaacaggagatcccgtcggtgtttccgaagactagcattagtcctctgaatgtggtgcaaggtgctagcgtaaatagtagcagccagactgcagcccaggtgaccaagggcgtgaagaggaaggctgatactactactcccgccacctccgcggtgaaggcttcctccgaattttctcccacatttacggagaagtccgtggccctacctcccataaaggagaatatgccaaagaacgtgctccccgatagtcagcagcaatacaatgtcgtaaagacagtcaaagtgacggagcagttgcgtcattgttccgagatcctaaaagaaatgctagcaaagaaacacttcagctatgcgtggcccttctataatccagtcgacgttaatgctctgggactgcataactactacgacgtggtaaagaacccaatggacctgggaactataaaggagaagatggacaatcaggaatataaggatgcctataaatttgcagccgatgtacgacttatgtttatgaactgctataaatataatcctccagatcacgaagttgtgactatggcgagaatgctacaggacgtgttcgaaacgcactttagtaagataccaatcgaaccagtggagtccatgcccttgtgctatattaaaaccgacatcacggaaacaaccggtcgcgaaaatacaaatgaggccagctctgaggggaactcaagcgatgattcggaggacgagagggtcaagaggctggcaaagcttcaggaacagcttaaggctgtgcaccagcagctgcaggtgttgagccaggtccccttccggaagctgaataagaaaaaggagaaaagcaagaaggaaaaaaagaaagagaaagtgaacaacagtaatgagaatccaaggaaaatgtgcgaacagatgcggctgaaggaaaagagcaagagaaaccaaccaaagaagcggaaacagcaattcatcggcttaaagtcagaagacgaggataatgccaagccaatgaattatgacgagaagcgccagctgagtctgaacataaacaagctcccaggcgacaagctggggcgggtcgtgcacatcatacagtctagggagccgagcctctcgaattcaaaccccgacgagatcgaaatagactttgagaccctcaaagcttccaccctaagggagttggagaaatacgtgagtgcgtgtcttcgaaagagaccactcaagccacctgctaaaaagatcatgatgagtaaagaggaattgcactcccagaagaaacaggagcttgaaaagcggctgctggatgtgaacaaccagctcaactcccggaagcgacagactaagtctgacaagacacagccttccaaagccgttgagaatgtaagcagactgtcagagtcatccagttccagcagctcatcttccgaaagcgagtcctctagcagtgacctgagtagtagtgattctagcgatagcgagtccgaaatgtttcctaagttcaccgaggtcaagcccaacgactctcctagcaaagaaaacgttaagaagatgaaaaatgaatgtattcctcccgagggccggacaggggtcacccagattgggtactgtgtgcaggatacaacgtctgccaatacaactctggtacatcagactaccccaagtcacgtgatgccccctaatcaccatcagctcgccttcaactaccaggaactggaacacctgcagaccgttaagaatatctcccctctgcaaatcctcccaccctcaggcgatagtgagcaattatctaacggcatcaccgtgatgcaccccagcggggactccgacacaaccatgttagaatccgagtgccaagccccggtgcagaaggatatcaaaattaaaaacgcggattcttggaagagtttaggcaaacccgtgaagccatccggtgtcatgaagagtagcgacgaactatttaaccagtttcgtaaggccgctatcgagaaggaggtgaaggctagaacccaggagctgattagaaagcatctcgagcaaaacacgaaagaacttaaggcctcacaggagaaccagcgtgaccttggtaatggactcaccgtagaatccttctctaataaaattcagaataaatgctcaggcgaagagcaaaaagaacaccagcagtcgagcgaagcgcaagacaagtcgaagctttggttgctgaaggatagagacctggcgaggcaaaaagaacaagaacgacgacggcgagaggctatggttggaaccattgatatgacgctgcagagcgatatcatgaccatgttcgagaataatttcgactag

SEQ ID NO: 180844 - DNA, 2844 bp, Artificial Sequence
  Description of Artificial Sequence: Synthetic coding sequence
atgagcctgcccagccggcagaccgccatcatcgtgaaccccccccctccggagtatatcaataccaagaaaaatgggcgtctcacaaatcagcttcagtacttgcagaaagttgtcttaaaagacttatggaagcactccttttcttggccatttcaacggccagtggatgcagttaagctacagctgcccgactattataccattattaaaaaccctatggacctaaatacaatcaagaaacgcctcgaaaacaagtattatgccaaggcctctgagtgtattgaagacttcaacacaatgttctccaattgttatctgtataataaacccggcgacgatatcgttctcatggcccaggcacttgagaaattgttcatgcaaaaactctctcagatgccccaagaagaacaagtggtgggagtgaaggagcggataaagaaaggcactcagcaaaatattgccgtcagctcagccaaagagaaaagtagcccctccgcaaccgaaaaagtgttcaagcagcaggagatccccagtgtctttcctaaaacctccatttctcctctgaacgtagtccagggcgcaagcgtgaattctagttcacagacagccgcccaagtaaccaaaggcgtgaagagaaaggcggacacgacaactcccgctactagtgcagtcaaggcctcatcagaattctccccaactttcactgaaaagtccgttgcgctgccccccataaaagaaaatatgccgaaaaacgttttaccggattcgcagcaacagtacaacgttgttaagaccgttaaagttacagagcagctcagacactgcagcgaaatcctgaaagaaatgctggctaagaagcatttttcatacgcctggccgttttacaatcctgtcgacgtaaatgctctcgggctccacaattactatgatgtggtaaaaaatcccatggacttgggcacaatcaaggagaagatggacaaccaggaatataaagatgcctataaattcgctgccgatgttagactgatgttcatgaattgctacaagtacaatcctccagatcatgaagttgttactatggccaggatgctgcaggacgttttcgagacccatttttcgaagatccctatcgagcccgtggaaagcatgcctctctgctacattaagaccgatatcactgaaacgacggggagagagaacaccaacgaagcctctagcgaaggaaacagctcggacgactcggaagacgaacgagtaaagcgtttggctaaactccaggagcagctcaaggctgtgcaccagcagttacaggtcctgtcgcaggtgcccttccgcaaattaaataaaaaaaaagagaagagcaagaaggagaaaaagaaagagaaagtcaataacagcaatgaaaaccccagaaagatgtgcgagcagatgcgtttgaaggaaaagtcgaagcggaaccagcccaagaagcgtaagcaacagttcatcggtctaaaatctgaggatgaagataacgcaaaacctatgaattacgacgaaaagaggcagctctccctaaacattaacaagctgcccggtgataaactgggcagggtggtccatattattcagtcccgcgaaccgtccctgtcgaattcaaaccccgacgaaatcgagatcgattttgagactctaaaagcaagcacattgagggaacttgagaaatacgtgagcgcatgtctccggaaaagacccctcaagccacccgcaaagaaaattatgatgtcgaaagaggagttacactcgcagaagaagcaggaactggagaagcgtctcctggacgtgaacaatcaactgaactctaggaagcggcaaaccaagtccgacaaaacacagcctagtaaggcggtggaaaacgtgtcaagactgtctgaaagctcgagcagctctagctcctctagtgagtcagagtcaagctcgtccgatctgagctccagcgatagcagcgactctgaatcagagatgttcccaaagttcacagaagtgaaacccaatgactccccatcgaaggaaaatgtgaaaaaaatgaaaaatgagtgcattcccccagagggccggactggggttacccagatcggctattgcgttcaagatactacatccgcaaacacaacactggtgcatcagacaactcctagccacgttatgccacccaaccatcaccagcttgcattcaattaccaggagctggagcatctccagacggtgaagaatatctcaccactacagatcctgcctcccagtggagactcggaacaattgtccaacggaatcaccgtgatgcacccgagtggagattccgatacaactatgctggagtcagagtgtcaggccccagttcagaaagatataaagataaagaatgcggactcgtggaaatcactcggcaaacctgtgaagcctagcggggtgatgaagagtagtgacgagttgttcaatcagtttagaaaggcagcaatcgagaaggaggtcaaggccaggacccaagaactgattaggaaacacctggagcaaaacactaaggagctcaaagcctcccaggagaaccagcgggacctgggaaatgggctgacagtcgagtcattctccaacaaaatccaaaataaatgctctggcgaggagcagaaggaacaccaacaaagctccgaagctcaagataaaagtaaactgtggttgctgaaagaccgggacttagccagacagaaggagcaagaacggcggagacgggaagccatggtggggacaatagacatgaccctacaaagcgatatcatgaccatgttcgaaaacaatttcgactag

SEQ ID NO: 180845 - DNA, 2844 bp, Artificial Sequence
  Description of Artificial Sequence: Synthetic coding sequence
atgagcctgcccagccggcagaccgccatcatcgtgaaccccccccccccggagtacattaacacgaagaagaacgggagattgacaaatcaactgcagtacctgcagaaggtcgttttaaaggatctttggaagcactcatttagctggccgttccagcgtcccgtggacgcggtgaagctgcaactccccgattattacacgataatcaagaatccaatggaccttaataccattaagaagaggctcgagaataagtactatgccaaagccagtgaatgcattgaggacttcaacactatgtttagtaattgctatttgtataataagccaggagatgacattgtactgatggcacaggcactcgagaaactgttcatgcaaaagttgtctcaaatgcctcaagaggaacaagttgtcggtgtgaaagagcggattaagaaggggacgcagcagaacatagcagtgtcttctgccaaggagaagtcctctccgagcgccaccgaaaaggttttcaagcagcaggagataccgtcagtgtttcccaaaaccagcatcagccccctcaatgtcgtacagggcgcatccgtgaacagtagcagtcagaccgccgcccaagtgactaagggagtcaagcgaaaggccgacacaaccacacccgccacctcagccgtgaaagcctctagcgagtttagtcctaccttcaccgaaaaaagtgtcgctctgcctccgataaaggaaaatatgcctaaaaatgtccttccggatagtcagcagcaatacaacgtggtgaagaccgtaaaggtgacagagcagctacggcactgttctgaaatccttaaggagatgctggccaagaagcacttttcctatgcctggcctttctataacccagtcgacgtcaatgccctagggctacacaactattacgacgtggtgaagaaccccatggacctggggacaattaaagaaaaaatggataatcaagaatacaaggacgcctacaagtttgccgcagacgtgcgcctgatgttcatgaattgttacaaatacaaccctcccgatcacgaggtcgttacaatggcacgaatgttgcaagatgtcttcgaaactcatttctccaagattccaatcgagccggtagagagtatgccactgtgctacattaagactgatattacggagacaacaggacgggagaataccaacgaggcatcctcagaaggcaattcaagtgatgactccgaggatgagagggttaagcgtcttgcaaagttgcaggagcaattgaaggcagtgcatcagcaactgcaggtgctgtctcaggttccctttcggaagcttaacaagaaaaaggaaaaatcaaagaaggaaaagaaaaaggaaaaagtgaacaactcaaacgagaatcccaggaagatgtgtgagcagatgcggctgaaggagaagtccaaaagaaatcagcctaaaaaaaggaagcagcaattcatcggactgaagagcgaggacgaggacaacgcgaagccaatgaactacgatgagaaacggcagctctcactaaacattaacaaactacctggagataaactagggagagtcgttcacatcatccagtctagagagccttctcttagcaactctaatcctgatgagatcgagatcgacttcgagaccttaaaggcttctacccttagagagttagagaaatacgtatccgcctgcctccgcaagcgccctctaaagccacccgccaagaagattatgatgtctaaagaagagctgcattcacagaagaaacaggaattggagaagaggctgctggacgtgaataaccaactgaacagcagaaaaagacagaccaagtccgataaaactcagccctccaaggctgttgaaaacgtctccaggctgtcagaaagcagtagtagttcgtcttctagttcagaatcagagtctagttcctctgacctgagctcatcggactcctccgactccgaaagcgagatgttccccaaatttaccgaagttaaaccgaatgacagtccctccaaagagaacgtcaaaaagatgaagaacgagtgtattcctcctgagggacgcacaggtgtcacacagatcgggtattgtgttcaggacaccacgagtgcgaacacaacattagtgcatcagactacaccatcccacgttatgccccctaatcaccaccagctggcttttaattatcaggaattggagcaccttcagactgtaaagaacatcagtccgctgcagattctccctccgagtggagattccgagcaactttcgaatggaattacagtgatgcatccctccggtgattcagatacaaccatgttagaatccgaatgtcaggctcccgtgcagaaggacatcaagataaagaatgccgatagctggaagagtctggggaaacctgtgaaaccatcgggcgttatgaaatcaagtgacgagctgttcaaccagttccgaaaagccgccattgaaaaggaagtaaaggcgaggacgcaggaactcatccgtaaacatctggagcaaaacactaaggaattgaaggcctctcaagaaaaccagcgagatttgggtaatgggctgacggtcgagtcattcagtaataaaattcagaataagtgtagtggggaggaacaaaaagagcatcagcagagctccgaggcacaggacaagtcgaaactgtggctccttaaggacagggaccttgcccgccagaaagaacaagaaagacgcagaagagaggctatggtgggcaccatagacatgacgcttcaatcagacattatgaccatgtttgagaataattttgactag

SEQ ID NO: 180846 - DNA, 531 bp, Artificial Sequence
  Description of Artificial Sequence: Synthetic coding sequence
atgagcctgcccagccggcagaccgccatcatcgtgaacccccccccaccagagtacatcaacaccaagaagaatggtaggttaacgaatcaattgcagtacctccagaaagtggttctgaaggacttgtggaagcatagcttctcatggccattccagagaccagtcgatgcagtgaaactacagcttccggattactacaccatcattaaaaacccaatggatctgaacacaatcaaaaaaagattggaaaataaatactacgcaaaagcctcagaatgcatcgaagactttaacaccatgttttcaaattgctacctgtacaacaagcccggagatgacatcgtgcttatggctcaggctctggaaaagctgttcatgcagaagctctcccaaatgccacaggaagagcaggtggtgggcgtgaaagagcgaataaagaagggaactcagcagaatattgctgtcagttctgcaaaggaaaaatcctcaccgagtgccactgagaaggtcttcaaacagcaggaatag

SEQ ID NO: 180847 - DNA, 1389 bp, Artificial Sequence
  Description of Artificial Sequence: Synthetic coding sequence
atgagcctgcccagccggcagaccgccatcatcgtgaacccccccccacctgagtacataaacaccaagaaaaacggccggttgactaaccaactgcagtatctccagaaagtcgtcctgaaagacctgtggaagcactcgttttcctggcctttccaaaggcccgtggacgcggtcaaattgcagttaccagactattacactataattaaaaatccaatggacctcaacacaatcaagaagcgactggaaaacaaatactacgcaaaggccagtgaatgtatcgaggacttcaatacaatgttttcgaactgttacctctataacaaacctggagatgatatagtccttatggcccaagctctggaaaagctctttatgcagaagctctctcaaatgccacaggaggaacaggttgttggggtgaaggagcgtattaagaagggcactcagcaaaacatcgctgttagctccgccaaagagaagtccagccctagcgcgacagagaaggtgtttaagcagcaggagatcccatcggtgtttcctaagacctctatctctcctttgaacgtggtgcagggagcatcagtaaacagcagtagccagactgccgctcaggtgacaaaaggcgtgaaacggaaggcggacacaacgactcctgcgaccagtgccgtgaaggcttcgtctgagttctccccaacctttaccgagaaatcagtggccctgccacctatcaaagaaaacatgccaaaaaacgtcttgccagacagccagcaacagtataacgtggtgaaaaccgtgaaagtgacggagcaactccggcattgctcagaaatactgaaagaaatgctcgctaagaagcacttttcctacgcatggccattttacaatccagtggatgtcaacgcattaggactacataactattatgatgtggtcaagaaccccatggatcttggtacgattaaggaaaagatggacaatcaggaatataaagacgcatataagtttgccgctgatgtcaggctaatgtttatgaactgctacaagtacaacccccccgatcatgaagtcgtaaccatggccagaatgctgcaggatgtgtttgagacgcacttcagcaaaattcctatagaacctgtggagtccatgcccctgtgctatatcaagaccgatattaccgaaaccactggcagggagaataccaatgaggccagcagcgaagggaatagcagcgacgacagcgaggacgagcgcgttaaacgactggcgaagctccaggagcagctcaaagcggtgcaccagcaactccaggtcttaagtcaggtgccattccggaagttgaacaagaagaaggagaagtccaagaaggaaaagaagaaggagtag

SEQ ID NO: 180848 - DNA, 468 bp, Artificial Sequence
  Description of Artificial Sequence: Synthetic coding sequence
atgagcctgcccagccggcagaccgccatcatcgtgaaccccccccctccagaatatattaacaccaaaaaaaacggccgtcttaccaatcagcttcagtacctgcagaaggtcgtcctgaaggacctgtggaagcatagcttttcctggcctttccaaaggcctgtggacgccgtgaaacttcagcttccagattattatacgataattaagaaccccatggatctgaacactataaaaaagcgacttgaaaacaagtactacgccaaggcgtctgaatgcattgaggacttcaatacaatgttttctaactgctacctctacaacaaaccaggagacgatattgtcctgatggcccaagcactggagaaattgtttatgcaaaaactgagccaaatgccccaggaggaacaagtcgtgggcgttaaggaaaggattaaaaaaggtacccagcagaatatcgcgtag

SEQ ID NO: 180849 - DNA, 603 bp, Artificial Sequence
  Description of Artificial Sequence: Synthetic coding sequence
atgagcctgcccagccggcagaccgccatcatcgtgaaccccccccctcctgagtatattaataccaagaagaacggaagattaaccaatcagctccagtatctgcagaaagtggttctgaaggatctgtggaagcattcattctcttggccctttcagcggcccgtagatgccgtgaaattgcagctgccagactactacaccattattaaaaatccaatggatctgaatacgattaaaaagagactggagaacaaatattatgccaaagcttctgaatgtattgaggactttaatactatgtttagcaattgctacttgtataataagcctggggatgacattgtattaatggcccaggccctggagaaattattcatgcagaagctttctcagatgccacaggaggaacaggtggtgggagttaaagagagaattaagaagggaacacaacaaaacattgctgtctcctctgcaaaggaaaagtctagtccatccgccactgagaaggtcttcaaacagcaggagattcccagcgtcttcccaaaaacaagtatctcccctttgaacgtggtacagggagccagtgtgaacagctcctag

SEQ ID NO: 180850 - DNA, 468 bp, Artificial Sequence
  Description of Artificial Sequence: Synthetic coding sequence
atgagcctgcccagccggcagaccgccatcatcgtgaacccccccccccccgaatatattaacactaaaaagaatggccggctgacaaatcagctccaatacctgcaaaaggttgtcctaaaagatctttggaaacactcatttagctggcccttccagagaccagttgatgctgtaaagctgcaactgccggactattacactattatcaaaaaccccatggacctgaacaccattaaaaagagactggagaacaagtactatgctaaagcctctgaatgcatcgaggactttaacactatgttttctaactgttatttgtacaataagccgggcgacgatatcgttctgatggcgcaggcactggagaaacttttcatgcaaaaactgagccagatgccgcaagaggagcaggtcgtgggggtgaaggagaggattaagaaaggtactcagcaaaacattgcgtag

SEQ ID NO: 180851 - DNA, 159 bp, Artificial Sequence
  Description of Artificial Sequence: Synthetic coding sequence
atgagcctgcccagccggcagaccgccatcatcgtgaacccccccccgcccgaatatatcaacactaaaaagaacggccggttgaccaatcagttgcagtatctacagaaagtcgtgctgaaggatctttggaagcactcatttagttggccgttttag

SEQ ID NO: 180852 - DNA, 291 bp, Artificial Sequence
  Description of Artificial Sequence: Synthetic coding sequence
atgagcctgcccagccggcagaccgccatcatcgtgaacccccccccgccggagtacatcaacacgaagaagaacggccgactcaccaatcagctgcagtacctccagaaagttgtgctgaaggacctttggaagcattccttcagttggcccttccagaggccagtggacgcagtgaaacttcaactcccggattattataccatcatcaaaaacccaatggatctgaacaccatcaagaaaagacttgaaaataagtactacgcaaaagccagcgaatgtattgagtag

SEQ ID NO: 180853 - DNA, 99 bp, Artificial Sequence
  Description of Artificial Sequence: Synthetic coding sequence
atgagcctgcccagccggcagaccgccatcatcgtgaaccccccccccccagaatacataaatacgaaaaaaaacgggagacttaccaatcaactctag

SEQ ID NO: 180854 - DNA, 1398 bp, Artificial Sequence
  Description of Artificial Sequence: Synthetic coding sequence
atgagcctgcccagccggcagaccgccatcatcgtgaacccccccccaccagaatacataaacaccaaaaagaatggaagattgaccaatcagctgcagtacctgcaaaaagtggtgctgaaggacctgtggaaacactccttctcttggccctttcagcgacccgttgacgccgtcaagctgcagcttcctgactactataccattatcaagaaccctatggatctgaataccatcaaaaaacgactggaaaataaatactacgctaaggcgtccgagtgtattgaggacttcaatactatgtttagcaattgctacctctacaataaaccgggggacgatatcgtcttgatggcacaggccctcgaaaaactctttatgcagaagctgtctcagatgcctcaggaagagcaggtggtgggggtaaaggaaagaatcaagaagggcacccagcaaaatatcgctgttagcagcgccaaagaaaagtccagtccatccgctacggagaaggtctttaaacaacaagagatccctagcgtttttcccaagacatctattagccccctgaatgtcgtccagggcgcatccgtcaatagctcctcgcaaaccgccgcacaggtaactaaaggcgtaaaaagaaaagccgacactaccacccctgcaaccagtgctgttaaagcatctagcgagttctcccctacctttacagagaaatccgtggctctgcctcccatcaaggagaacatgccgaaaaacgtgttgcctgattcgcagcagcagtataatgtggtgaagacagtgaaagtcaccgagcagctgaggcactgcagtgagattttgaaggagatgctggccaagaagcattttagctatgcttggcctttctacaaccccgtcgatgtcaatgcgctaggccttcacaactattatgacgtggtcaaaaatcccatggatctgggtactattaaggaaaaaatggataatcaggagtataaggatgcctacaagttcgccgctgatgtgcggctgatgtttatgaattgttataaatataatcctcccgaccacgaagtagtaaccatggcccgtatgctgcaggatgttttcgagactcacttttctaaaatacccatcgagccagtggagtcaatgccactgtgttacataaagactgacattaccgagaccacggggagggagaatacgaatgaagctagctcggaaggaaatagcagcgacgactcagaagacgaaagggtgaaaaggctggcgaagctccaagagcagctgaaggcagtccaccagcagctccaggtattgagtcaggtcccttttcgaaagctcaataaaaagaaggaaaaaagcaaaaaagagaaaaaaaaagaaaaaaagaagtag

SEQ ID NO: 180855 - DNA, 303 bp, Artificial Sequence
  Description of Artificial Sequence: Synthetic coding sequence
atgagcctgcccagccggcagaccgccatcatcgtgaacccccccccacccgaatacattaacacgaaaaaaaatggacgccttaccaatcagcttcagtaccttcaaaaagtagtcctcaaggatctgtggaagcatagtttctcatggccatttcagaggccagtggatgcagtcaagcttcagttacccgattattacactattatcaagaaccccatggacttgaacaccataaagaaaagattggagaacaaatactatgcaaaggcctctgagtgtatcgaagatttcaacacatag

SEQ ID NO: 180856 - DNA, 5550 bp, Artificial Sequence
  Description of Artificial Sequence: Synthetic coding sequence
atggccgtgagccggctggaccggctgttcatcctgctggacaccggaactacgcccgttacacggaaggctgctgcccagcagctcggagaggtggtaaagcttcatccgcacgagctgaataacctgctttcaaaagtacttatctacctacggtcagccaattgggacacccgcattgctgcgggccaagcggtcgaagccattgtcaagaacgtacctgagtggaaccctgttcctcgcacacgacaggaacccacttcagagtcttccatggaagactccccaaccacagaaaggctcaacttcgatcggttcgacatatgccgcctactgcagcacggggcgtccctgcttggaagcgccggcgctgaattcgaagtacaggatgagaagagcggtgaggtggatcccaaagagcgaatcgcccgacagagaaaactcctacagaagaaacttggcctcaatatgggtgaagctattggaatgtccaccgaggaactgttcaatgatgaggatctggactacacaccaacaagcgcatctttcgtgaacaaacaaccgaccttgcaagctgcggagcttatcgatagcgagttcagagcgggcatgagtaaccggcagaagaataaggcgaagcgaatggccaagctgttcgctaaacagaggtcaagagatgccgtggagaccaacgagaagagcaacgattctaccgatggcgagcccgaggagaagcggagaaagatcgccaatgtggtgataaaccaaagcgccaacgatagtaaggtgttaattgataacatccccgatagctcttctctgattgaggagaccaacgaatggcctctagagagcttctgtgaggaactttgcaatgacctgttcaacccctcgtgggaagtccggcacggtgcgggaactggcctgcgagaaattcttaaggcccatggcaaaagcgggggtaagatgggggactctacactggaggaaatgatccagcaacatcaggaatggctggaggatctggtgattcgcctgctctgcgtattcgccctggatcgattcggtgactttgtctctgatgaagtcgtggccccagtccgggagacctgcgcacagacactgggcgtggtgctaaaacatatgaatgagacgggcgttcacaagaccgtggacgtgttactgaagctgttgacccaggaacagtgggaggttaggcacggaggccttctcggtatcaaatatgctctggctgttcggcaggacgtgattaacaccctcctgcccaaggtgcttactaggataatcgagggacttcaagatctggatgacgacgtgcgagccgttgcagcagcctcactggttcccgttgtggaatctttggtgtacttgcaaacccagaaggtgccttttatcattaacactttgtgggacgccttactggagctggatgacctaacggctagtaccaattccattatgacattgcttagcagtcttctcacctaccctcaggtgcagcagtgtagtatacagcagtctctgaccgtacttgttcctcgggtgtggccgtttctgcatcacactattagctccgtgcgacgcgccgctctggagacactgtttacactgctgtccacgcaggatcaaaattcgagcagctggttgatcccaatcctgcctgacatgttgcgtcacatattccagttttgtgtgctcgagagtagtcaagaaatcctggatcttattcataaggtttggatggaactgctctcaaaggctagcgtccagtatgtcgtggccgcggcatgtccgtggatgggagcttggctctgtctgatgatgcagccttcccacttgcctattgatctgaacatgcttctggaggtaaaagctcgagcaaaggagaaaacaggtggaaaagtgaggcaaggacaatcccagaataaggaagtgctgcaggagtacatcgccggagccgacactattatggaggatccagcaacaagggactttgtggtgatgcgagcccgaatgatggcagcgaaactactcggcgccttgtgttgttgcatctgcgacccgggcgtcaacgtagtgacccaggagatcaaaccggccgaatctctggggcagttactgctatttcatctgaattctaaaagcgcactccagcggatatccgtagcccttgtcatttgtgagtgggccgccttgcagaaagaatgtaaagccgtaacccttgcggtgcagccgcggctccttgacatcctctccgaacacttgtattacgatgaaattgcagtcccattcaccagaatgcaaaatgaatgcaagcagctgatatcaagcctggccgatgtgcacatagaagtcggcaacagagtcaacaacaatgtgctcaccatcgatcaggccagcgatctggtgacaactgtgtttaacgaggccacctcatcattcgacctcaatccccaggttctgcaacagctggactcgaaacggcaacaggtgcaaatgacggtgacagagactaatcaggagtggcaagttcttcaacttagagtgcacaccttcgcagcctgcgcagtggtcagtctgcaacaactccctgaaaaactcaaccctatcattaaaccactgatggagacgattaagaaagaggaaaatacgctggtgcagaactatgcagcgcagtgtattgctaagcttttacaacagtgtaccactaggacaccatgtccgaatagtaagattatcaaaaatttgtgcagctcactttgcgtggacccgtatcttactccctgcgtaacatgccccgtgccgactcagtctgggcaggaaaattccaaaggatcaaccagcgagaaagacgggatgcaccatactgttaccaagcaccgtggcattattaccctgtaccggcaccagaaggccgcctttgcaattaccagccggcgaggtccaacccccaaggctgtgaaggcgcagatcgcggacctcccagccggctcttccggaaacatcctagttgaacttgatgaggcgcagaagccttatctggtccagcggcgtggagctgaattcgcacttacaacaattgtcaagcatttcggcggcgagatggcagtaaagctcccccatctctgggacgctatggtggggcctctgcgcaacacgatcgacatcaacaattttgatgggaagagcctcctagacaagggggatagtcctgctcaggaactggtaaattcgctgcaggtcttcgagaccgctgccgcgagcatggatagcgaactgcacccacttctggtgcagcatctgcctcatctttacatgtgcctccaatacccatcgaccgcagtacggcacatggctgcacgttgcgtgggcgtgatgagcaaaattgctaccatggagactatgaacatttttcttgagaaggtgctgccttggctgggggcgatcgatgacagtgttaaacaggagggggccatagaggccttagcttgtgtcatggagcaactagatgtcggcattgtcccatatattgtacttcttgtcgtaccagtgctgggcaggatgtctgaccagacggacagtgtgcggtttatggcaacccagtgctttgccactctcattcgattgatgcctctggaagcaggcatccccgatcctcctaacatgagtgctgagttaatacaattgaaagcaaaggagagacattttctggaacagttgcttgacggcaaaaagttggaaaactataaaattccagtaccaattaacgctgagctgagaaaatatcagcaggacggtgttaattggctcgctttcctgaataagtataagctccacggcattctgtgcgacgacatgggcctgggaaagacgttgcaaagcatttgtattctggccggagaccactgccatcgagcacaagaatatgcacgctctaaacttgctgagtgtatgcccttgccctccctggtagtttgtcctccaaccctgaccggccactgggtggacgaagtgggcaagttctgcagcagggaatacttgaaccctctgcattacacgggccccccgactgaacgcataaggcttcaacatcaggttaaacggcacaacttgattgtagctagctatgacgtcgtaagaaatgacatagacttttttcggaacatcaagtttaattactgcatccttgacgaaggtcacgtcatcaagaacgggaagaccaaactgtccaaggccgttaaacaactcaccgcaaactaccgcatcatcctgagcggaacgcccattcaaaacaatgtcctagagctttggagtttgtttgactttctaatgcccggttttttgggcacagagaggcagttcgctgctcgatacggaaagcctattctggcaagccgggatgccagatctagttcaagagagcaagaggccggcgtgctggctatggatgccttgcacaggcaggtgctgccatttcttctgagacgaatgaaggaggacgtgctgcaggacctgcccccaaagatcatccaggactactattgtacactgagcccattacaggttcagctctacgaagacttcgcaaaatcgcgggctaagtgtgatgtggacgagacggtgtcgtccgccacgctgtccgaggagacagagaaacccaagctgaaagctaccggccacgtcttccaggccttacagtacctgaggaagttatgtaaccatcccgctctcgttctgacaccacagcatcccgagtttaagactaccgccgaaaaactggctgtacagaacagtagcttgcacgacatccagcacgccccaaagctatccgcacttaaacagcttctactggactgtgggcttgggaacggtagtacgtcagagtctggcactgaatccgtggtggcacaacatcggatactaatattttgccagctcaagtctatgcttgatatcgtggaacatgatctgctcaaaccccatcttccctctgtaacatacctgcgacttgatggatccattcctccaggtcagaggcacagcatcgtgtccagatttaacaacgatccgtccatcgatgtgctgcttctgaccactcacgtcgggggtctggggctgaacttaaccggggctgataccgtggtgtttgtagaacacgattggaatccaatgagagatctgcaggctatggatcgggctcacagaataggccaaaaacgcgtcgtgaatgtgtataggctgattacccgtggtaccttagaggaaaaaatcatgggtttgcagaagtttaagatgaacattgctaatacagtaatctcccaggaaaattcgtctcttcagagcatgggtactgaccagctattagacctgtttacactggataaagacggtaaggcagaaaaagccgacacatcaacatcgggaaaagcctcaatgaaatctattctggaaaacctgtccgacttgtgggatcaagagcagtacgactctgagtactctctggaaaatttcatgcacagcctgaagtag

SEQ ID NO: 180857 - DNA, 2100 bp, Artificial Sequence
  Description of Artificial Sequence: Synthetic coding sequence
aagctgtggttcaagaacaccgaggactaccggcggaccgccctgaccaggctaacttctggagtgatggagcagctggatgttggaatagtcccgtatatcgtcctccttgtggttccagtcttggggcggatgtccgaccagacggattccgtcaggttcatggccacccagtgcttcgctacactgatacggctcatgcccctggaagcaggtattccggatcctcccaatatgagcgccgagcttatacagctgaaggccaaagagaggcatttcctggagcagctgctggacggcaaaaaactcgagaattacaagattcccgtaccaataaatgctgaattaagaaagtatcagcaggacggcgtgaactggcttgcatttctaaataaatacaaacttcacgggatcctctgtgatgacatgggacttggcaagacgcttcagtcaatctgtatattagccggcgatcactgccatagggcccaggaatacgctagatccaagttagccgagtgcatgcccctgcccagccttgttgtgtgtccccccaccctgactgggcactgggtcgatgaagtaggaaagttctgcagtagggagtacctcaatccgttacattatacaggaccacccaccgagcggatccgactgcagcaccaagtgaagcgccataatttaatcgtagcaagctacgacgtggtaaggaacgatattgatttcttccgaaatatcaaatttaattattgcatccttgatgaaggtcacgtgatcaagaacggaaagaccaagctgagcaaggccgtgaagcaactgacagcaaactatcgcataattctgagcggaaccccaattcagaacaacgtgctagaactatggtccttgttcgacttcctgatgcccggatttttgggaacagaacgtcagttcgcagccaggtatggcaagcccattcttgccagccgcgacgctcgctcgagttctagagaacaagaagccggtgtcctggccatggacgcacttcatcggcaggtgcttccttttctcctgcgacgcatgaaggaagacgttttgcaggacctgccaccaaagataattcaggactattattgcactctgtctcccttacaagtccagctgtacgaggactttgcaaaaagtcgcgctaaatgtgacgtggacgagaccgtttcctccgctaccctgtccgaggagaccgagaaaccaaaacttaaggccaccgggcatgtcttccaagctctacagtacttaagaaaactgtgcaaccaccctgcattggtgcttaccccacagcacccggagtttaaaacaaccgcagagaagctcgcagtccagaatagctccctccacgatatccaacatgcgcccaaactctcagctttgaaacaactccttctagactgcgggcttgggaatgggtctacatccgagagcggaactgagtctgttgtggcgcagcatcgaatcctcattttttgtcagctgaaaagtatgctcgacatcgtggagcacgacctcttgaagccacatctgccctctgtcacctacctcagactggacggttccatcccccctggtcagcggcactcgattgtgtcaaggtttaataacgatccctccatcgatgttttgctgctgaccactcacgtgggtggtctgggactaaatctcaccggtgccgacactgtcgttttcgttgagcatgactggaatcccatgagagacttacaggctatggatagagcacatcggatcgggcagaagcgcgttgtcaatgtttaccgcttgatcaccagagggaccttggaggagaagattatgggcctgcagaaatttaaaatgaatatcgccaatacggtgatatcccaggaaaatagctctctgcagtcaatggggactgaccaattgctggatctttttaccctggacaaggatggaaaggcggagaaggcagacacctccacatccgggaaggcctcaatgaagtccatcctagagaacctgtcagatttatgggaccaggagcagtatgatagcgagtactctctggagaatttcatgcacagcctgaagtag

SEQ ID NO: 180858 - DNA, 2034 bp, Artificial Sequence
  Description of Artificial Sequence: Synthetic coding sequence
atggagcagctggacgtgggcatcgtgccctacatcgtgctgctggtggttcctgtattaggaaggatgagcgaccagactgacagtgtgaggttcatggcgacacagtgttttgcaactcttattagactcatgcccttggaggcaggcattccagatccacctaatatgagcgccgagctgattcagttgaaagccaaagagcgccactttctcgagcagctgctcgacggcaagaagctggaaaactataaaattcctgtgccaattaacgccgaactccgtaagtaccagcaggatggcgtgaattggctggcgtttttaaataaatacaagctgcatggtattttatgtgacgacatgggcctcggcaagacacttcaaagtatttgtattcttgcaggtgaccactgccaccgggcacaggagtatgcaaggtccaaattggcagaatgcatgccgcttccctctctggtggtgtgccctcccaccctcaccggccattgggtggatgaggtggggaagttttgtagcagagagtatctcaaccctctgcactatactggaccccccactgagcgtattaggcttcagcatcaggtaaagcgccataacctaattgtagccagttatgatgttgtccgtaacgatatagactttttccggaatatcaagtttaactattgcattctggatgaggggcatgtgatcaagaatggcaaaaccaagctgtccaaagcagtgaaacagctaacagcaaattaccgcattatactatcgggcacgcctattcagaacaatgtgcttgagttatggtctctgttcgattttctaatgccgggcttcctgggaacagagaggcaattcgcagcacgatatgggaaacccatccttgcttcaagggacgcccgctcatcaagtagagaacaagaagccggagtcttggctatggacgctctccataggcaggtcctgccattcctactgaggcggatgaaggaagatgtcttacaggatctgccacctaaaattatccaggattattattgcaccctgtcccctttacaggtccagctttacgaggattttgccaagagtagggccaaatgcgatgtggatgaaacagtttccagtgcgactctgagcgaggagaccgagaaacccaaactgaaggccacagggcatgtcttccaggccctacagtacctgcggaagttgtgtaaccaccccgcgttagtactgacaccgcagcaccccgaattcaaaactacagccgagaagctcgctgtccaaaattcatctctgcacgatatccagcatgcccctaagctctcggccctaaaacagctattactggattgcgggctggggaatgggtctacctccgaaagcgggacagaaagtgtcgtggcccagcacagaatactgatcttctgccagttgaaaagtatgctagatatcgttgagcacgatttactaaagccacatctccccagcgtgacttatctacggctggatgggtcaatcccacctggacagaggcattctatagtgtctagatttaataacgacccatcaattgacgtactgttgctaaccacgcacgttggcggtctcggcctgaacctgacaggcgccgacaccgtggtatttgtggaacacgactggaatccaatgagggatctccaggccatggaccgcgcccacagaattgggcagaagagggtcgtgaatgtgtatcgcctaatcacacggggaacactggaggaaaagatcatggggctgcagaagttcaagatgaacatagctaacaccgtaatctctcaggaaaattctagcctgcagtcaatgggaacagaccagctgctagacctgttcaccttggataaagacggcaaagccgagaaggccgatactagcacgtccgggaaggcttccatgaagtccatcttagaaaacctgagtgacctctgggatcaagagcagtatgacagtgagtatagcctggaaaatttcatgcacagtctgaaatag

SEQ ID NO: 180859 - DNA, 1233 bp, Artificial Sequence
  Description of Artificial Sequence: Synthetic coding sequence
atgggcgccaacgccagcaactacccccacagctgcagcccccgggtgggtggcaactcccaggctcagcagaccttcatcggaactagctcatactctcagcagggctatggttgtgagagcaagctttactcactggaccatggacatgagaagcctcaagacaagaaaaagcgcacatctggcttggccaccttaaaaaagaagtttatcaaaagacgcaaatcgaaccgctcggccgaccatgctaagcaaatgcgggagctgctttccgggtgggatgtacgagatgtgaatgcccttgtagaagagtatgagggaacatctgctctgaaagaactgagtcttcaggcctccctagcccggcccgaggctcggacattgcagaaagatatggcagatctctacgaatataagtactgcacggatgttgaccttattttccaggagacctgtttccccgtccatcgggccatcttagcagcccgatgtccctttttcaaaaccctgctgtcctccagtccagaatacggtgctgaaattatcatggacatcaacaccgcaggcatcgacatgccaatgttctctgcactgctacactacctctatacaggggagtttggaatggaggattcccgattccagaatgtggatatacttgtgcagctgagcgaggagttcggaacccccaactctttggatgtggatatgcgaggtctcttcgactacatgtgctactacgatgtcgtactgtctttctcctctgatagcgagctggtggaagcctttgggggaaaccagaactgtctggacgaggagctgaaggcccacaaggcagtgatctccgcccggagtccattctttagaaatctcttgcagagaagaatccggaccggtgaggaaattaccgaccgcactctccgtacacctaccagaattattctcgatgaatcaatcattcccaaaaaatacgctacggtcatattacactgtatgtacacagacgtggttgatctgtctgttctgcactgttccccttccgtcgggagtctatctgaagtgcaggcccttgtggctgggaagcccaacatgactagagccgaggaagctatggagctttaccatatagccctattcctggagttcaacatgctagctcaggaggaaaccaccgttatccgccctgcatgtgccgccgagctttctaactcttgccttttacctcagtcctag

SEQ ID NO: 180860 - DNA, 3399 bp, Artificial Sequence
  Description of Artificial Sequence: Synthetic coding sequence
atgggcgccaacgccagcaactacccccacagctgcagcccccgggtcggtggcaactctcaggcacagcagaccttcattggaactagcagttactctcaacaaggctatggatgtgagtccaaactttatagcctagaccacggacacgaaaagccgcaagataagaagaagagaactagcggccttgccacacttaaaaagaaatttattaagagacgtaagagcaacaggagcgccgaccacgccaagcaaatgagagagcttctgtctggctgggacgtgcgagacgtgaatgcactggttgaggagtacgaagggacaagtgcacttaaggaactgagccttcaggccagccttgcccgcccagaagcaagaactctgcagaaggacatggccgatctgtacgaatacaagtactgtaccgatgtggacttgatcttccaagaaacttgtttcccggtacatagagccatactggcagcgcgttgcccgttctttaagactctgctctctagctccccagagtacggagcagagataatcatggacattaatacagcaggcattgacatgcccatgttttctgctctccttcactacctgtacactggtgagttcggaatggaggatagccgtttccaaaatgtggatatccttgtccagctatccgaagaattcgggaccccaaactctcttgacgtcgatatgaggggactcttcgactatatgtgttactacgatgtggtgctgtccttttccagcgacagcgagctggtggaggccttcggcgggaaccagaactgccttgacgaggagctgaaagcacacaaggcagtcatcagtgcacgatctccgtttttcagaaatctcctgcagaggaggattcgtaccggcgaagaaatcactgacaggacgctgcgcacaccaaccagaattatcctggatgaaagtatcatacccaaaaagtacgctacagtgattctccattgtatgtacaccgatgtggtggacttgtccgtgctccattgttctccttctgtgggctcgctgtccgaggttcaagctctcgtggctggaaagccgaacatgactagggcagaagaggccatggaattataccacattgccctattcctggaatttaatatgttagcacagggctgtgaggacatcatcgccgaatcaatttccctggacaccctgatcgcgattctcaagtggtcatcgcatccatacgggtctaagtgggtccatcggcaggccctgcattttttatgcgaggagttcagccaggtcatgactagcgatgtattctacgaactgtcaaaagaccacttattgacagctatccagtcagactaccttcaggccagcgagcaggatatcctcaagtacctcatcaaatggggtgaacaccagttgatgaagagaatcgccgatcgggagccaaacctgcttagtggcaccgcacacagtgtgaataagaggggcgtgaagaggcgggatctggacatggaggagctccgtgagatcctgagctctcttctcccgtttgtgcgcatcgagcatatcctgccaatcaattcagaggtgctctcagatgctatgaagcggggtttaatctccaccccccccagtgacatgctaccaactaccgagggcggtaaaagcaatgcctggctccgtcaaaaaaatgcaggcatctacgttcgtccacgcctgttcagcccatacgtggaggaagccaagagtgtcctggacgagatgatggtcgagcagaccgacctcgtacgcctgaggatggttcggatgagcaacgtgcctgacacactttacatggtcaataacgctgtgccccagtgctgccacatgatcagccaccagcaaatctcaagcaatcagtcctcaccgccctcggtcgttgccaatgaaatcccagtcccgaggctgctgatcatgaaagacatggtccgtcgattgcaagagctgagacacacggaacaagttcagagagcatacgccctgaattgcggagagggggcaaccgtttcctacgaaatccaaattcgcgttttacgggaattcgggttagcggatgccgcggccgaattgctccagaaccctcataaattctttcctgacgaacgctttggtgatgagtcccccctcttgactatgagacaaccaggccggtgcagagtaaactcaacccccccggcagagacaatgttcacggaccttgattccttcgtggcttttcatcctcctctgcctcctccgcctccaccctatcaccctccagccacacccattcacaatcaattgaaagcaggatggaaacaacggcccccgtctcagcatcccagtcgcagtttctcctacccatgcaatcactctctgtttcattcccgtaccgctcctaaggcaggccccccacctgtgtatcttcccagcgtgaaggcagccccccccgactgcacgtcgacagccggcctcggtcgccaaactgtggctgccgccgccgcaacgactacaagcaccgcaacagcggccgccgctgccgcctccgagaaacaagttaggacccagcccgtcctgaacgacttaatgcccgacattgctgtgggagtgtccacactgagtctgaaggaccggcgactcccagagctggccgttgatactgaattatcccagagcgttagcgaagccggacctggcccacctcagcacctgtcctgcattccccaacgccacacgcacacatcccggaaaaaacatacactggagcagaaaactgatacaagggagaaccctcaagagtatccagatttttacgatttctccaacgccgcttgcaggcccagtacaccagccctgtctcggagaaccccatctccatcacagggcggctatttcgggccagacctctacagtcataacaaagcctccccaagcggcctaaagtctgcatatctgccaggccagacatctcccaaaaagcaggaggaggcaaggcgagagtacccactgagtccggatgggcacctgcatcggcaaaaaaacgaaccgattcatctcgatgtagtggaacagcctccccagcggagtgactttcccttggcagcgcctgaaaacgcaagtaccggaccagcccacgtacgggggcgcacagccgtggagactgatttaaccttcggcctgacacccaatagaccttctcttagcgcctgttcatctgaggccccagaggaaagatcaggacggcgtctcgcagactccgagtcactgggacacggcgcccagaggaatacagacctggagcgagaagactccatcagccggggacggaggtcccctagcaagccggacttcttgtacaagaaatctgccctgtag

SEQ ID NO: 180861 - DNA, 2121 bp, Artificial Sequence
  Description of Artificial Sequence: Synthetic coding sequence
atgtacaccgacgtggtggacctgagcgtgctgcactgcagcccctcagtaggcagcttgtctgaagtccaggccctggtcgcgggcaaaccgaacatgacccgcgctgaggaagcaatggagctgtaccacatagccctgttcctggagtttaatatgctcgcccaggagcctaacctgctgagtggcaccgcccactctgtgaataaaaggggcgtgaagcggagagacctggacatggaggagctgcgcgagatcctgtcatccctgctcccgtttgtccggattgagcacattctacccatcaattctgaggtgctcagcgacgccatgaagagaggcttaattagtacgccaccttccgatatgcttcccactactgagggtggtaaatcaaatgcctggctgcgacagaagaacgccggcatctacgttagacctagactttttagtccgtacgtcgaagaggcaaaatcagttcttgacgaaatgatggtggagcagacagatctagtgcgactccgcatggtgcgaatgagcaacgtacctgataccctgtacatggtgaacaatgccgttcctcagtgttgtcatatgataagccaccagcagatctcctccaaccagagctcccccccaagcgtggtagctaatgagataccagtgcctagactgctcattatgaaggatatggtgcggagactacaggaattgaggcacacagagcaagtgcagcgcgcctacgctctgaactgtggcgagggagccactgtgtcgtacgaaattcagatccgggttttgcgagagtttgggctggccgacgccgccgctgaattgctgcaaaacccacacaagttctttcctgacgagcgctttggtgacgaatctccactgctgaccatgcgccaaccgggtagatgcagggtcaatagcaccccccctgctgagacaatgttcaccgacctggacagctttgtcgccttccaccctccacttcccccccctccaccgccctaccacccgccagccactccgatccacaaccagctcaaggcaggttggaagcaaaggccccctagtcagcacccttcccggtcttttagctacccctgtaaccattccctgtttcattcacgcaccgccccaaaagccggccctcctccagtgtacctgcctagcgtcaaagcggcgccacccgactgcacaagtacagctgggcttggaaggcagaccgtggccgccgcagccgctactacaacttccacagctaccgccgccgctgccgcagctagcgaaaagcaggtgaggacccagcccgtcttgaacgatcttatgcccgacattgccgtcggagtcagcacactaagtttgaaagatagacgcctccccgagctagccgtagacactgagttatcacagagtgtcagcgaggcaggtccaggtccccctcaacacctgtcgtgcatcccacaaagacacacgcacacctctcgcaagaaacacacccttgaacaaaagactgacactagagagaatccccaagagtacccggacttctatgacttttcaaatgcggcatgccgccccagtacccccgccctgtcccgcaggacaccttctccatctcagggtgggtatttcggcccagatctgtattctcataataaggcctccccttctggtctcaagagtgcctacctgccaggacagaccagccccaagaagcaggaggaggctcgcagggagtatccactgtcgcctgatggccacctacacagacagaaaaacgaaccaattcacctcgatgtcgtcgagcagccaccccaacggtctgatttcccactggcagccccagaaaatgcttcaaccggccccgcacatgtcagaggaaggaccgctgtggaaacagacctgacatttggcttgacccctaaccggccttcgctgagcgcgtgcagctcagaagcacctgaggagaggagcggtcgccgtctggctgactctgagagcctgggacacggggcccagcggaatacagacctcgagagggaagactcaatcagccggggaagaaggtctccttcaaaaccggatttcttgtacaaaaaatcagcactctag

SEQ ID NO: 180862 - DNA, 2346 bp, Artificial Sequence
  Description of Artificial Sequence: Synthetic coding sequence
atggccggcggcgccggcgccggcgccgacggcggcgccggcggcgggggcggtggcggcgacggatctggtccatcgggttcctcgagcggcgggcggtctctccggggttgtgaagacattatcgctgagtctatatctctggataccctcatcgctatactcaaatggtctagccatccatatggtagtaaatgggttcatcgacaggctctgcactttctctgcgaggaattctctcaagtcatgactagcgatgtcttctatgagctctctaaagatcacctgctaaccgctattcagtcagactatctgcaggcttctgaacaggacattctgaagtacctgattaagtggggcgagcatcaactgatgaagcgaattgctgatagagagcctaatctgctctcaggtaccgcccatagtgtcaataaacggggagtcaaacggagggacctggacatggaggaactgagagaaattttgagctcactgctgcctttcgtccgaattgaacatatcctaccaatcaacagtgaagtgctcagtgacgctatgaaaagaggtctgatctcgactccccccagcgatatgttgcccacgaccgagggcggaaagagcaatgcttggctgagacagaaaaacgccggcatctacgttcggccacgactttttagcccttatgtggaggaggcgaaatcagtcttggacgaaatgatggtggagcagacggatctggtccgactgaggatggttaggatgtctaatgtgcctgacactctgtacatggtgaacaatgctgtcccgcagtgttgccacatgattagccaccaacagattagttcgaaccagtcctcccccccctccgtcgttgccaatgaaatcccagtcccacggctgctcattatgaaagacatggtccggcggctgcaggagctgagacacaccgagcaggtacagagagcctacgcactaaactgcggagaaggggccaccgtgtcatacgagattcagataagggtacttcgtgagtttggattagccgacgccgcagcagaattactccagaatccacacaagttttttccggatgagcgtttcggcgatgagtcccctctgctcaccatgagacagcccggacgctgcagagtcaattccactccgccggctgagactatgtttacggacttggacagttttgtggcgtttcatccaccactgcccccccctccgccaccctatcacccacctgcaacaccaatccacaaccaactgaaggcagggtggaagcagagaccaccgagccagcatcctagcagatctttctcttacccgtgtaatcatagtctgttccatagtcgaaccgcccccaaggccgggccgccacctgtgtacttgccctccgtaaaggccgcacccccggactgtacctctaccgcaggcttgggtcgccagaccgtggccgctgcagccgccacaaccactagtaccgccacagcagcagctgctgccgcgtccgaaaagcaggtgaggacccaacccgttctaaatgatctgatgccagatattgccgtaggcgtgagcaccctgtcccttaaagacagaagactgccagagcttgccgtggataccgaattgtcccagtcagtcagcgaggctgggcccggtcctccccaacatctgtcatgcatcccccagcgacatacccacacgtccagaaaaaagcatacactggagcagaagaccgacacccgcgagaatccccaggagtaccccgacttttacgatttcagtaatgcagcgtgccgcccatctacccctgccctcagcagacgcacaccctcgccctctcaaggagggtactttggccccgacctttacagtcataataaagcaagccccagcggtttaaaaagcgcctatctgccaggccagacctccccaaagaagcaggaagaggctcgccgagagtacccgctgtcgccagatggccacctgcacagacagaagaacgaacctattcatttagacgtagtggagcagccgcctcagaggtcagatttccctcttgcggccccagagaatgcttccactggcccggcacacgtgcgtggccggacagccgtcgagaccgacctcacttttgggctgacacctaataggccctctctttctgcctgttcttctgaagccccggaggagagaagtggcagacgactggccgattcagagtccctcgggcacggagcacagaggaacacagacctagaaagagaagattctatcagcaggggaagaaggagtccttccaaaccagatttcctttataaaaagagcgcactatag

SEQ ID NO: 180863 - DNA, 168 bp, Artificial Sequence
  Description of Artificial Sequence: Synthetic coding sequence
atgggcgccaacgccagcaactacccccacagctgcagcccccgggtcggaggtaactcacaggcacagcagacctttattgggacttcatcttactcgcagcagggctatggctgtgaatcaaagctctactcgctcgatcacgggcatgaaaaacctcaggattag

SEQ ID NO: 180864 - DNA, 1635 bp, Artificial Sequence
  Description of Artificial Sequence: Synthetic coding sequence
atgcgggagagccagcccgaggccgagatccccctgcaggacaccactgccgaggcattcaccatgcttctcaagtacatctatactgggcgagcaactcttactgacgaaaaggaagaagtacttctagatttcctgagtctggcccacaagtatggatttccggaactcgaagactcgacaagtgaatacctgtgcaccatactcaatatacagaatgtgtgtatgacgttcgacgtggcaagtctatactcccttcctaaactgacttgtatgtgctgcatgttcatggacaggaatgcacaagaagtgctttcctctgagggatttttaagtctttctaagacagctttgttaaatattgtgctcagggactcattcgcagctcccgagaaagacattttccttgcccttctcaattggtgtaagcacaatagcaaggagaatcacgctgaaatcatgcaggcagtgagactgccgcttatgtcacttacagaactcctgaacgtggtgcgccctagtggattgctgagccccgatgccattcttgatgccattaaggtgcgttcagagagcagggatatggaccttaactaccgagggatgctcatccctgaagaaaatatcgccactatgaagtacggcgcccaagtcgtcaagggagagcttaaatctgcgctgctcgacggcgacacacagaattacgacttagatcatgggttctctcgacacccaatagacgacgattgccggtcaggcattgagataaagctggggcagcccagcattattaatcacatcagaatcttgctttgggatcgggacagtcggtcatatagttattttattgaggtaagcatggatgaactcgactgggtgcgagtgatcgaccattctcagtatttgtgtcggtcttggcagaagctgtacttcccagcgagggtgtgccgatatattaggattgtgggcacacacaacactgttaacaagattttccacatcgtggcgttcgaatgcatgtttactaataagacatttactttagagaaagggctgattgtgccaatggagaacgtggccacaattgccgattgtgcttcagtcattgagggagtgtcacggtctcgtaacgcactgttgaacggggacactaaaaactatgattgggatagcgggtatacttgtcaccagctgggctccggggctattgtcgttcaactggctcagccgtacatgatcgggtcgattaggttactgctctgggactgcgatgatcggtcatacagctattacgttgaggtatctacaaaccagcagcagtggacaatggtggctgaccgcacaaaagtctcctgtaaaagttggcagagtgttacgttcgaacgtcagccagcctcattcattaggattgttgggactcataataccgccaatgaagtgttccactgcgttcatttcgagtgccccgagcaacagtcaagccagaaggaagagaattccgaggaatcaggaacaggagatacttcactcgctggccagcaactggactcacacgcactgcgggctccaagtggctcatccctgccttcctcaccagggtctaattcacgcagtcccaatagacaacatcaatag

SEQ ID NO: 180865 - DNA, 1839 bp, Artificial Sequence
  Description of Artificial Sequence: Synthetic coding sequence
atgagcaacagccaccccctgcggcccttcaccgccgtgggcgagattgaccacgtgcacatccttagtgagcatatcggggctctcctcatcggtgaggagtacggggacgtcacctttgtggtggagaagaagagatttccagctcacagggttatactggcagcccgctgtcagtattttagggcactgttatacggcggaatgcgggagagtcagccagaggccgagattcccttgcaggacacgaccgcggaggcctttacgatgcttttgaaatacatctacaccggccgggctacactgacagacgagaaagaggaagtgcttttggatttcctcagcctagctcataagtatgggttccccgaactcgaggactcaaccagtgagtacctttgcaccattttgaatatccagaacgtgtgcatgactttcgacgttgctagcttgtattcactgcccaagttgacatgtatgtgttgtatgttcatggatagaaacgctcaggaggtcctttcatcggaggggttcctcagtctcagtaagactgcactgctgaacatagtgctgcgggattcattcgccgctcctgagaaggacatctttcttgctcttctgaactggtgtaaacacaatagtaaggaaaatcatgcggagattatgcaagccgtgcggctacccctgatgtctttgactgagcttcttaacgtcgtccggccaagtggactcctgtcacccgatgctatcctcgacgctattaaggtgagaagcgagtccagagacatggacttgaattataggggaatgttgattcccgaggaaaatatcgccacaatgaagtacggagcccaggtggttaagggcgaactgaagtcagccctgctggatggtgacactcaaaactacgacctggaccacggcttctctcgtcatcccattgatgatgattgccgctccggaatcgaaattaaactcggccagccatctattattaatcatattcgcattctcctgtgggatagggactctaggagttacagctattttatagaagtttcaatggacgagctggattgggtgcgggtgatcgaccacagtcaatacctttgccgatcttggcaaaaactgtacttccccgccagggtctgtaggtacattcggatcgttggaacccacaacaccgtaaacaaaatctttcacatcgtagcttttgagtgtatgtttactaacaaaacattcacactcgagaaaggtctgattgtccccatggaaaacgtggcaacgattgcagattgtgcaagtgtcattgaaggcgtcagccggtcccgtaacgcgctcctaaacggcgacacaaaaaattacgattgggatagtggctatacctgccatcaactggggtctggcgcaatcgtcgtccagctggctcagccttatatgatcggatcgattagacttctgctctgggactgcgatgatcggagctattcctactacgtcgaggtctccaccaaccagcaacagtggacaatggtggccgatcgaacaaaggtgtcttgcaagagctggcaaagcgtgacgtttgaaaggcaacccgccagtttcattcggattgttgggactcacaacactgccaacgaggtctttcattgcgtccacttcgagtgtcccgagcagcagagtagtcagaaggaggagaactctgaggaatctggcacaggtgatactagcctggccggccagcagctggatagccatgcactgcgcgctcctagcggatcatcactgcctagctccccaggcagtaattcacgctcacccaatcgccagcaccagtag

SEQ ID NO: 180866 - DNA, 1635 bp, Artificial Sequence
  Description of Artificial Sequence: Synthetic coding sequence
atgcgggagagccagcccgaggccgagatccccctgcaggacaccacagccgaagcgtttaccatgttgctgaaatatatttacacaggtcgggcgaccttgaccgacgaaaaggaggaagtgctgttggacttcctgtctcttgcccacaaatacggctttcctgaactagaagacagcacctcagaatacctatgtaccattctgaacattcagaacgtctgcatgacgtttgacgtggcaagcctgtactccctgccaaaactgacctgtatgtgctgtatgttcatggatagaaacgcgcaagaggtcttatcctctgagggattcctttccctgagtaaaactgcactgctcaacattgtgctgagggatagctttgctgccccggagaaagacatcttcctggccctgcttaactggtgtaagcataacagtaaagagaaccatgccgagattatgcaggcggtcagactcccccttatgtctctgactgagctgctcaatgtcgtgagaccttccgggctgctctcgccagatgctattctcgacgctatcaaagtcagatcagaaagccgcgatatggacctgaactacaggggaatgttaatacccgaggaaaacatcgctactatgaaatacggagcccaagtggtgaaaggtgagctgaaatccgctctgttggacggcgacactcaaaattatgacttggaccacggcttttcaaggcatccgatcgacgacgactgcagatcagggattgagatcaagctaggtcagcccagtataattaatcacatccggattctactgtgggatcgtgatagcagatcctacagctacttcatcgaagtgtccatggacgagcttgattgggttcgggtgatcgatcatagtcagtatctgtgccgctcttggcagaaactctacttccccgcacgggtgtgccggtatatccgtatcgtcggcacccacaacaccgtgaacaagatttttcacatcgtcgcctttgagtgcatgttcacaaacaaaacctttaccctggaaaaggggctgattgtccctatggagaatgttgcaactatcgcagattgcgcctctgtgatcgaaggcgtgagcagaagccgtaatgcccttctgaacggcgacaccaaaaactatgactgggattccggatacacctgccaccaacttggttctggcgcaatcgttgttcaactggcgcagccatacatgattggttctataagactgctcttgtgggactgcgatgacagaagctactcttactacgtggaggtgtcaactaaccagcagcagtggaccatggtggctgaccgtacgaaggtttcctgtaagtcctggcagtcagtgacctttgagcgacaaccagcctcatttattagaatcgtcgggacccataatactgccaacgaagtgtttcactgcgtgcatttcgaatgcccagagcaacagtcatctcagaaggaagaaaactccgaagagtccggaactggagatacttctctggcgggccagcagctcgacagccacgcactgcgggcccccagcgggtctagccttccttctagtcccggaagcaattctcgctctccaaaccggcagcaccagtag

SEQ ID NO: 180867 - DNA, 1839 bp, Artificial Sequence
  Description of Artificial Sequence: Synthetic coding sequence
atgagcaacagccaccccctgcggcccttcaccgccgtgggcgagatcgaccatgtgcatatcctgtccgagcatattggcgctttattaatcggcgaagaatacggggacgtcacctttgtcgtcgagaaaaagcgttttccagcacaccgcgtcatactggctgcccgatgccagtacttccgcgctctcctgtatggtgggatgcgtgaatctcagcccgaggccgaaattcctcttcaggatacgactgcagaagcgtttacgatgttgttgaagtacatctatacaggtagagctaccctgacagacgagaaggaggaggtgcttctggatttcctgagccttgcccataagtatggctttcccgagttggaagactccacatcggaatacctctgcacgatcctcaacatacagaatgtgtgcatgacattcgacgttgcctccctgtactcattgccaaaacttacgtgcatgtgttgcatgttcatggacagaaacgcgcaagaagtgctcagttcagagggattcctatctctaagtaagacagctctgttgaacattgtcctgcgcgacagctttgccgcccctgagaaggatatcttcctcgctctgttgaattggtgtaagcataatagcaaagagaaccacgccgaaattatgcaggctgtgcggctcccactcatgtccctgaccgaattactgaatgtggttcgcccatccggcctgctgtcccctgatgctatactagatgccatcaaggtgcgctctgaaagcagagatatggacctcaactataggggaatgctcatcccggaggaaaacatcgcaaccatgaaatatggcgcgcaggtcgttaaaggtgaactgaaatccgccctgctggacggcgacacccagaactacgacctagatcatggcttctcccggcaccccatcgacgatgactgcaggagcggaattgagatcaaactcggccagccctcgatcataaaccatatacgaattttgttatgggatcgggactcaagaagctattcctatttcatagaggtgagcatggatgagctggactgggtgagggtgattgatcactctcagtacctctgccgtagctggcagaagctatactttcccgctagggtgtgcaggtatatccgtatcgttgggacgcacaatacagttaataaaatcttccatatcgtggcctttgagtgcatgtttacaaataagacattcaccctggagaaggggctgatagttccgatggagaatgtcgccactatagctgactgcgctagtgttatcgaaggagtgtctcggtctaggaatgccttgctgaacggggataccaagaattatgattgggatagcgggtatacatgtcaccagttgggatctggagcgatcgtcgtacagttggcgcaaccgtatatgatcggctcaatccggttgctcctgtgggattgcgacgaccgcagctactcctactacgttgaggtgtccactaaccagcagcagtggactatggtggcggatcgcaccaaggtgagttgtaaaagttggcagtctgtgacttttgaacgccagccagcatcattcatcaggattgtcgggacacacaacaccgccaatgaggttttccattgtgtgcacttcgaatgcccagagcaacagtcttcacaaaaagaagaaaatagcgaagagtccggaactggtgacacatcccttgctggccagcaattggacagccacgctctacgagcaccctccgggagttcattaccttcctctccagggagcaattcccgttcccctaaccgacagcatcagtag

SEQ ID NO: 180868 - DNA, 279 bp, Artificial Sequence
  Description of Artificial Sequence: Synthetic coding sequence
atgagcaacagccaccccctgcggcccttcaccgccgtgggcgagattgaccacgtccacattctcagtgaacatattggtgcgctcctgattggtgaggagtacggagatgtcacatttgtggttgagaaaaagagatttccagctcatcgggtcattctggctgccagatgccagtattttagagcactgctctatggaggaatgagagagtcccagcccgaagcagaaatccctcttcaggacacgactgccgaggctttcaccatgttattgtag

SEQ ID NO: 180869 - DNA, 1749 bp, Artificial Sequence
  Description of Artificial Sequence: Synthetic coding sequence
atgtgccgggccctgctgtacggcggcatgcgggagagccagcccgaggccgagatccccctgcaggacaccactgccgaagccttcactatgctccttaaatacatttacaccgggcgcgccacgctgaccgatgagaaggaggaagttctcctggattttctcagtctcgcgcacaagtacggattccctgagctggaggatagcacttccgaatacctgtgcacgattttaaacatacagaatgtatgtatgacattcgatgtggcctcgctgtattccttgccgaaacttacctgcatgtgttgtatgttcatggacagaaatgcacaggaggttctctcaagcgaagggttcttgagtctgagcaaaacagccctcctaaacattgtcctgcgcgacagtttcgccgcaccagagaaagacatattcctggcgttgctgaactggtgcaagcacaattccaaggagaaccacgcagaaatcatgcaggcagtgcgtctgccgctgatgtctttgacagagctgctgaacgtggtgcggccctccgggttgctgtcaccagacgcgatacttgatgctattaaagtgcggagtgagtccagagacatggatttgaactacaggggtatgctgatccctgaggagaacatcgctaccatgaaatatggggcccaggtcgtgaaaggggaacttaaaagcgccttgctcgacggtgacacacagaattacgacctggaccacggcttctcaagacacccaatcgacgatgattgtcgaagtggtattgaaatcaaattaggtcagcccagcatcatcaaccacattagaatcctcctgtgggatagagattcccggagctatagttatttcatagaagtaagtatggatgagcttgactgggttcgggttattgatcacagtcagtacttatgcaggtcttggcaaaagctgtattttcctgcacgtgtgtgcagcggcgatggcgtttctctgtggtgcccactgtggagtcggactcctgagttgaagcagtccagcttgctgggattaccaaaatgcaggtatataaggatcgtcggaacacataatactgtgaacaagattttccatatcgtggccttcgagtgcatgttcaccaacaagacgttcactctagaaaaggggctaattgttcctatggagaatgtggccacgatagccgactgcgcatcagtcatcgagggcgtgtctcgctcaagaaacgccttattgaacggggacacgaaaaactacgactgggactcagggtacacctgccatcaactcggctcgggcgcaattgtagtccaactggcccaaccctatatgattggaagtattaggctcctgctgtgggactgcgacgataggtcatattcttactatgttgaagtctcaaccaatcagcaacagtggacaatggtcgcagatcgtactaaagtgtcatgtaagtcatggcaaagtgtcacgtttgaacgccaacccgccagtttcataagaattgttggcactcataatactgcgaacgaagtattccactgcgtccactttgaatgccctgagcagcagtcatcccagaaagaggagaatagcgaggaatctggtacaggtgataccagtctcgctggacagcagcttgatagtcacgcattgcgagctcctagtggatcatctctgccaagttcccctggttctaatagcaggagccctaacagacaacatcagtag

SEQ ID NO: 180870 - DNA, 2211 bp, Artificial Sequence
  Description of Artificial Sequence: Synthetic coding sequence
atgagcctgagcgagaacagcgtgttcgcctacgagagcagcgtgcacagtaccaacgtactattaagcctgaatgatcagcggaagaaagacgtgttgtgcgacgtcactatcttcgttgagggccagagattccgtgcacataggagcgtgctagccgcttgctcaagttacttccactcgaggattgtgggacaagccgacggtgagctcaacataactctgcccgaggaggtaaccgtgaaaggatttgagcctctgatccagttcgcctacacggcaaaactgatcctgagtaaagaaaacgtggacgaggtgtgtaagtgcgtcgaatttctgtctgtccataacattgaagagtcatgcttccagttccttaaatttaagtttcttgacagcacagctgatcaacaggagtgtccaaggaaaaaatgtttttcctcccactgtcagaaaacagacttgaaactatccctcttggatcagcgcgaccttgagaccgacgaggttgaagaattcttagaaaataaaaatgtccagactccacagtgtaaattgcggcggtaccagggtaatgctaaggctagcccccccttacaggactccgcgtctcagacttacgaatcaatgtgccttgagaaagatgccgctctcgccctccccagcctgtgtcccaaatatagaaaattccagaaagcgttcggaaccgatagggtccgcacaggcgagtcctccgtcaaggatattcacgccagtgtccagcctaatgagagatctgaaaacgaatgtctgggcggcgttccagagtgccgcgacctgcaggtaatgctgaaatgcgatgagtcaaagctggccatggagccagaggagactaagaaggacccagcttctcaatgtcctaccgagaaaagcgaggttactcctttcccccacaacagcagtatcgacccacacggactctacagccttagcctactacacacctacgaccaatacggcgacttgaactttgcagggatgcaaaatacaaccgtgctgactgagaaaccactgagcggcactgacgtccaggaaaaaactttcggtgaaagccaagatttgcctctcaagtctgatctgggtacaagagaagattcctcagtggcgagcagcgaccgctcatccgtcgaacgggaagttgctgagcacttggctaaaggtttctggtcagacatttgctctactgataccccatgtcagatgcaactaagccctgctgtagccaaggatgggtcagagcagatcagccagaagaggagcgagtgtccatggctagggattagaattagcgaatcacctgaacccggccaaagaacatttacaaccttaagctctgtgaactgcccgttcatctccacactaagtacagaggggtgttcgtcaaatctggaaattggcaatgacgactacgtcagcgaaccacagcaggagccatgtccatatgcctgcgtgatttctttgggagatgacagcgaaaccgataccgaaggggattcggaatcctgcagtgcacgcgaacaggagtgtgaggtaaaacttccgtttaatgcgcagcgcatcataagcctgtcccgcaacgactttcagtcactgctgaagatgcacaagctgacgcctgaacagcttgattgcatacacgacattagacggcggagtaaaaacagaatcgctgcacagcggtgtcggaaacggaagttagactgtattcaaaatctcgagtcggaaatcgaaaagttgcagagcgagaaagagtctctgctcaaagagcgagaccacattctgtccactctgggcgagaccaaacaaaacttgaccggactatgccaaaaggtgtgcaaagaggcagcgctctcccaggaacaaatccagatcctggctaagtatagtgctgccgactgccccttaagttttctgatctctgagaaggacaagagtacgccagacggggaactggctctcccgtcaatttttagtctgtcagacagaccaccggccgtgctgcctccatgtgctaggggaaattctgagcccggctacgctcgggggcaagagagtcagcagatgagcaccgcaacttcagaacaggctggacctgctgagcaatgtcggcaatccgggggaatctccgatttttgtcagcaaatgactgacaaatgtaccacagacgaatag

SEQ ID NO: 180871 - DNA, 2211 bp, Artificial Sequence
  Description of Artificial Sequence: Synthetic coding sequence
atgagcctgagcgagaacagcgtgttcgcctacgagagcagcgtgcattctaccaacgtacttctttccttgaacgaccagagaaagaaggatgtgttgtgcgacgtgactattttcgtggaaggccagagattccgcgcccacagaagtgtgctggccgcttgctctagctattttcattctagaatagtgggtcaggcagatggagagctcaacatcacgctgccggaagaagtcactgtgaaggggtttgagccattgattcagttcgcctataccgctaagttgatactgagcaaggagaacgttgatgaagtctgtaagtgtgtggaattcttatcagttcacaatatagaggaaagctgttttcagtttctgaagttcaagttcctagacagcacagcagaccaacaagaatgtcccaggaaaaagtgcttcagctctcactgtcagaagaccgacctcaaactttcactgttagatcaacgcgatctcgagactgacgaagtggaggagttcttggagaacaagaatgttcagacaccgcaatgtaagcttcggcggtaccaagggaacgctaaggcttcccctcctctgcaggatagcgccagccaaacatacgagtcaatgtgtctcgagaaagacgccgccctggcccttccctcactatgcccaaagtatcggaaatttcaaaaggcgtttggcaccgatcgagtccgtactggagagtcatccgtgaaagatatccacgccagcgtgcaacccaatgaacgcagtgagaacgagtgtctgggcggggtacctgagtgcagggatctgcaggtgatgctcaagtgcgacgagagcaagctggccatggagccggaggaaaccaagaaagatcccgcttctcagtgccccacagagaagagcgaggtcactcccttcccgcataactccagtatcgatccgcacgggttatatagcttgagcctgcttcatacatacgaccaatatggcgatttgaattttgccgggatgcagaacacaacagtacttacggagaagcccctgtctggcacagatgtccaagaaaaaacctttggagaaagccaggacctgcccctgaagtccgaccttgggaccagggaggactcctctgttgcatccagcgatcgttcatccgtagagagagaggtggccgaacatctcgctaagggtttctggtccgatatctgttcaacggataccccgtgccaaatgcagctatctcctgccgtggctaaggacgggtccgaacagatttcccagaaacgctctgagtgcccatggctaggaattcggatttctgagtcgcccgagcccggtcagcggacgttcactactctgtcatccgtgaattgtcctttcataagcacactgagcacagagggctgctcaagtaatctcgagattggtaacgacgattatgtatccgagccccagcaggagccctgcccctacgcgtgtgtgatcagtctaggcgatgactctgagaccgacaccgaaggcgattctgagtcgtgctctgcccgggagcaggagtgtgaggttaaactgccttttaacgctcagcgaatcattagccttagccgtaacgattttcaaagtctgctgaagatgcataaattgaccccagaacagctggactgtatacacgatatccgaaggcgatcaaagaataggattgcagcgcagcggtgccgcaagaggaaactggactgcattcagaaccttgagtcagagatagagaagctgcagagcgaaaaggaatcactactcaaagagcgggatcatatcctatctaccttgggcgaaaccaagcaaaacctgacggggctgtgtcagaaggtctgtaaggaagccgctctgagccaagagcagatccagatcttagcaaaatactcggcagccgactgccccctatccttcctcatctctgagaaggataagtccactcccgacggcgaacttgcattaccctccatcttctcgttgtctgatagacccccagccgttctgccgccctgtgccagggggaattcagaacccggttacgcacgggggcaggagagtcaacagatgtcaacagctacaagtgagcaggcaggaccagctgaacagtgtcgccaaagtggggggatcagtgacttttgccagcagatgaccgataaatgcacaaccgatgaatag

SEQ ID NO: 180872 - DNA, 513 bp, Artificial Sequence
  Description of Artificial Sequence: Synthetic coding sequence
atgagcctgagcgagaacagcgtgttcgcctacgagagcagcgtgcacagtaccaatgtgctccttagtttgaacgatcagcgcaagaaggacgtgctctgcgacgtcacaattttcgttgaaggccagaggttcagggcccaccgctcagtgttggccgcttgttcttcttacttccacagtcgaattgttggccaagccgatggtgaactgaatatcactttaccagaggaggttaccgtcaagggctttgaaccactaatccagtttgcttacactgctaaactcattcttagtaaggagaacgttgacgaagtttgtaaatgtgtcgaatttctgagtgtccacaacattgaggaatcatgcttccagttcctgaagttcaagttcctcgactcaaccgcagatcaacaggaatgcccccggaaaaaatgcttctctagtcattgtcaaaaaactgatctgaagctgtctctgctggaccagagagatctggagacagatgaggtgtag

SEQ ID NO: 180873 - DNA, 663 bp, Artificial Sequence
  Description of Artificial Sequence: Synthetic coding sequence
atgagcctgagcgagaacagcgtgttcgcctacgagagcagcgtgcactctactaacgtgctgctttctcttaacgaccaacggaagaaggatgtcttatgcgatgtcacaatttttgttgagggacagcgcttccgggcccacagaagcgtgttagccgcttgctccagttacttccatagcagaattgttgggcaggcggacggggagctgaatattactcttccagaagaggtaaccgtgaagggatttgagcccctgatacagttcgcttacacggccaaactgatcttgtctaaggagaacgtggatgaagtgtgcaaatgtgtggagttcctgtctgttcataacatcgaggaaagttgtttccaattcttgaagtttaaattcctagactcaacagcggatcaacaggaatgtccaagaaaaaagtgttttagttcccactgtcagaaaacagacttgaaattgtcactcctggatcaaagagacttggaaactgacgaagtggaggagtttttagaaaacaaaaacgtgcagacaccccagtgcaagctccgtcgctatcaggggaatgccaaggcttccccccccctgcaggactctgcgtcacagacctacgaatctatgtgtctggagaaggacgctgctctggcactctag

SEQ ID NO: 180874 - DNA, 678 bp, Artificial Sequence
  Description of Artificial Sequence: Synthetic coding sequence
atgagcctgagcgagaacagcgtgttcgcctacgagagcagcgtgcatagtaccaatgtgctgctcagcctgaatgatcagaggaagaaagatgtcctttgtgacgttacaatcttcgtggaagggcagagatttcgcgcacatcgatccgtgttggctgcctgcagctcttattttcactccagaatagtcggccaggctgacggggaactgaacattacactgcctgaggaggtgaccgttaagggatttgaaccattgatccaatttgcatacaccgcaaaactgatcctgagtaaagaaaacgtggatgaggtttgtaagtgtgtggagtttctgagtgttcataatatcgaggagtcatgctttcagtttctgaaattcaagttccttgacagcacagcagatcagcaggagtgcccgcgcaagaaatgcttctcttcacactgtcagaagacagatctgaaacttagcctgctggaccaaagagacctggagacggatgaggtggaggagtttctcgagaacaagaacgtgcagacaccccaatgcaagcttcgacgatatcaaggaaacgcaaaggccagtcctccgttacaggatagcgcttcccagacttacgaatccatgtgtctggagaaagacgccgctctggcgctgccgagcctctgcccctag

SEQ ID NO: 180875 - DNA, 78 bp, Artificial Sequence
  Description of Artificial Sequence: Synthetic coding sequence
atgagcctgagcgagaacagcgtgttcgcctacgagagcagcgtgcatagcacaaacgtgctcctgagtctcaattag

SEQ ID NO: 180876 - DNA, 78 bp, Artificial Sequence
  Description of Artificial Sequence: Synthetic coding sequence
atgagcctgagcgagaacagcgtgttcgcctacgagagcagcgtgcactcaaccaatgttctactgtccctgaactag

SEQ ID NO: 180877 - DNA, 78 bp, Artificial Sequence
  Description of Artificial Sequence: Synthetic coding sequence
atgagcctgagcgagaacagcgtgttcgcctacgagagcagcgtgcacagtaccaatgtccttctgtccctgaattag

SEQ ID NO: 180878 - DNA, 78 bp, Artificial Sequence
  Description of Artificial Sequence: Synthetic coding sequence
atgagcctgagcgagaacagcgtgttcgcctacgagagcagcgtgcatagcactaacgtactgttatccctgaattag

SEQ ID NO: 180879 - DNA, 78 bp, Artificial Sequence
  Description of Artificial Sequence: Synthetic coding sequence
atgagcctgagcgagaacagcgtgttcgcctacgagagcagcgtgcactcaacgaacgtactcctctctttgaattag

SEQ ID NO: 180880 - DNA, 2526 bp, Artificial Sequence
  Description of Artificial Sequence: Synthetic coding sequence
atgagcgtggacgagaagcccgacagccccatgtacgtgtacgagtccactgtgcactgcacaaatatactactgggtctgaacgatcagagaaagaaagacattctgtgcgatgtgactttgattgtagaacgtaaggagtttcgagctcatagggctgttctggccgcttgctcggagtacttttggcaggccctggttggccagaccaaaaacgacctggtggtcagcttgcccgaggaggtgaccgctcgcggcttcgggcccctgttgcagttcgcttataccgcaaagcttctgctaagtcgggaaaatatcagggaggtcatcagatgtgccgagtttctccgaatgcataacttagaggacagctgtttttcattcctgcagactcagctcttgaatagcgaggatgggctgttcgtgtgtcggaaagatgctgcctgtcagagaccccacgaagactgcgaaaacagtgccggagaggaagaagatgaggaggaggagacaatggattcggaaacagccaaaatggcctgcccacgggaccaaatgcttccagagccgattagctttgaggccgcggccatcccagtggccgagaaggaagaagcgttattaccagaaccagacgtgcccaccgacacaaaagagagttctgaaaaagacgccttaacccagtacccaaggtataaaaagtatcagttggcttgcacaaaaaatgtgtacaacgccagttcccatagcacgtccggttttgcttctacgttcagggaagataacagctcaaactccttgaagccaggcctagcacgcgggcagattaaatccgaacccccctccgaggagaatgaggaggagagcatcacactgtgtctgtccggtgacgaaccagatgctaaggacagggcgggtgacgtcgagatggatagaaaacagccctctcccgcccccacccccactgcccctgcaggcgccgcctgtctggaaagatccagatctgtcgccagtccctcttgtctccggagcctgttttcaatcactaagagcgttgagctttctggattgcctagcacatcccagcagcacttcgctcggagcccggcttgcccctttgacaaggggataacacaaggggatcttaagacagattatacacctttcacgggtaattacggccagccacatgtaggacagaaagaggtctctaactttaccatgggtagccctctgagaggcccaggactcgaggcactctgcaagcaggaaggagaactggatcggaggagtgtgattttcagttcatcagcctgtgatcaggtatctacctccgtgcatagttacagtggcgtctcctctctcgacaaagaccttagcgagcccgtccccaaaggactctgggtcggggcgggccagtccctaccttcaagccaggcatacagccatggcggactcatggcggaccacttgcctggtagaatgagacctaatacatcttgtcccgttccaatcaaggtttgtccaagatctcctcccctagaaactagaacacggacaagctcttcctgtagctcttattcgtacgctgaggatggcagcggcggttcaccatgtagtctgccactttgtgagttctcttcctcaccctgcagccagggagctcgattcctggcaaccgaacaccaggagcctggcctcatgggggatggaatgtacaatcaggtgaggcctcagatcaagtgtgagcagtcatatggcacaaatagttcagatgagagtggttcattcagcgaggccgattcagaaagctgtcctgtgcaggaccgcggccaggaagtgaaactcccgttccccgtggaccagattacagacctccctagaaacgatttccagatgatgattaaaatgcacaaactgacatccgagcaattggagttcattcatgatgttaggaggagatctaaaaataggattgctgctcaaagatgtcggaaacgaaagctggactgcatccaaaatctcgaatgcgagatcaggaagctcgtctgcgaaaaagagaaactactcagtgagagaaatcagctgaaagcctgcatgggggaactgctggacaactttagctgtctcagccaagaggtctgtagggatatacagtcccctgaacagattcaagcactgcaccgctactgtccggttttacgacccatggatctgcccaccgcttcgagtatcaaccccgctcccttaggcgccgagcagaatatcgccgcctcccaatgtgccgtgggagaaaatgtgccctgctgtctcgagccaggagctgcccctcctggccccccctgggcacccagtaacacgtcagaaaactgcacctctggaaggcgcttagagggtaccgaccccggaaccttctccgagcggggcccgccccttgagcctaggtctcagacagtaaccgtagatttctgtcaggaaatgacagataaatgtacaaccgatgagcagccgagaaaagactacacctag

SEQ ID NO: 180881 - DNA, 2526 bp, Artificial Sequence
  Description of Artificial Sequence: Synthetic coding sequence
atgagcgtggacgagaagcccgacagccccatgtacgtgtacgagtcgacagtccattgcaccaatattctactgggtctgaatgatcagcggaagaaagatatcttatgtgatgtcactcttatcgtcgagcggaaggagttccgggctcatagggctgtactcgcagcatgttccgaatacttttggcaagcactcgtcggccaaaccaagaacgaccttgtcgtgtccctccctgaggaggtgactgccagaggatttgggcctttgctccagtttgcgtatacagcgaaactgctgttgtcaagggaaaacataagggaagtgatccgctgcgccgagttcctgcggatgcataatctcgaggacagctgtttttcttttctacagacccaactgctcaactccgaagacggactgtttgtgtgcaggaaagacgccgcctgccagagaccacatgaggattgtgaaaacagcgctggtgaggaagaggacgaggaggaggagactatggattctgagactgcaaagatggcttgcccacgggatcagatgctgcctgagcctatttcattcgaggccgctgccatccccgtcgcggaaaaagaagaggcgttgctgccagaaccagacgtgcctaccgacactaaagagagcagcgaaaaggatgccctgacacaatacccaagatataagaaatatcagctcgcttgtacgaagaacgtctataatgcctcaagccacagtacttctggcttcgcctctacattccgagaggataattcgtctaactctcttaaaccagggctggctcgggggcaaatcaagtcagaaccacccagtgaggagaacgaggaggaatcaataacactttgcctgtccggggatgaacccgacgccaaggacagggccggagatgtggaaatggaccgaaagcagccatcccccgcacctacgcctaccgccccagccggggctgcctgcctggaacggagcagatccgttgccagtccttcttgtttacgaagcctgttttccattaccaaatcggtcgagttatccgggctgccatctacaagtcagcagcactttgcgcggtcccccgcttgtccttttgataaaggtataacccagggcgatcttaagactgattatacccctttcaccgggaattatgggcagccccatgtaggacagaaagaggtgtccaatttcaccatgggcagcccattacgtgggccagggctcgaggctctttgcaaacaggagggcgagttggatcggaggagcgttattttttcgtcttctgcgtgtgaccaagtcagtacctccgtgcacagctattctggggtgagttccctcgacaaagacctgagtgaaccggtcccaaaaggtctatgggtgggtgcaggacagagtttacccagtagccaggcttacagccacggcggactgatggctgaccatctccccggtagaatgcggcccaatacttcatgcccagtcccaatcaaggtatgtcctcgatcacctccgcttgaaactcggacccgcactagttcctcctgctccagctattcatatgccgaagatggaagcggcggcagcccatgctccttgcctctatgcgagttcagcagctctccctgcagccagggcgccagatttctcgccaccgagcaccaggagccaggcctgatgggggatggaatgtataatcaggtacggccacaaatcaaatgcgagcaatcatacggcaccaactcatcggacgagtcaggttctttctctgaggccgattccgaaagttgtccagtgcaggaccgggggcaagaggtgaaactaccctttccagtcgatcaaatcaccgacctgccaagaaacgatttccagatgatgatcaagatgcacaagctcacctccgaacagctggagtttattcatgatgtgaggaggcgaagcaaaaacaggattgcagctcagcgctgtcggaagcggaagctagactgtatccagaatctggagtgcgaaattcgaaaactagtttgcgagaaggaaaaactgctgtctgagaggaaccagcttaaggcatgtatgggcgagctgctcgataatttctcatgcctgtcccaggaagtctgcagggacattcagtctccagagcagattcaggctttacacaggtactgtcctgtactgcgccctatggatctgccaaccgcttcctctatcaatcccgcaccgctcggagccgaacagaacattgctgccagtcagtgcgctgtaggtgaaaacgtgccttgttgcctggagcccggcgctgctccgcccggccccccttgggcgccaagtaacaccagtgagaactgcaccagcgggcggaggctggaagggacagacccagggactttttcggagcgcgggcctcctctcgagcccaggagccagacggtcactgtagacttttgccaggagatgacagacaagtgtacaacagatgagcaaccccggaaggactatacctag

SEQ ID NO: 180882 - DNA, 246 bp, Artificial Sequence
  Description of Artificial Sequence: Synthetic coding sequence
atgagcgtggacgagaagcccgacagccccatgtacgtgtacgagtccactgtgcactgtacgaacattctactcgggctgaatgaccaacgaaaaaaggacatcctctgtgatgttaccctgatcgtcgagagaaaggaatttcgggctcaccgggcagttcttgcagcgtgtagtgagtatttctggcaagccctggtgggtcagacgaagaatgacctcgttgttagccttcctgaagagtag

SEQ ID NO: 180883 - DNA, 246 bp, Artificial Sequence
  Description of Artificial Sequence: Synthetic coding sequence
atgagcgtggacgagaagcccgacagccccatgtacgtgtacgagagtacagttcactgtactaatatccttctggggttaaacgatcagagaaaaaaggatattctttgcgacgttacgttgattgtggagagaaaagagttccgggcgcaccgcgccgtcctggcggcgtgctccgaatatttttggcaggcactcgtgggccagactaagaatgacttggtggtgtcactaccggaagaatag

SEQ ID NO: 180884 - DNA, 2526 bp, Artificial Sequence
  Description of Artificial Sequence: Synthetic coding sequence
atgagcgtggacgagaagcccgacagccccatgtacgtgtacgagtctaccgtgcactgcactaatatcctcctggggctcaatgaccagaggaagaaggacatcctgtgcgatgtcacacttatcgtcgagcgtaaggagttccgggcccatcgcgcagtcttggcggcctgttcagagtacttctggcaggctcttgtgggacaaacaaagaacgatttggttgtttccctaccggaggaggtgactgctaggggatttgggccactcttacagttcgcatacacagctaagctccttttgagcagagaaaacattcgagaagtgattcggtgtgctgagttcctgaggatgcataacctagaggattcttgcttttctttcctgcaaacacaactgctaaatagtgaggatgggttgttcgtgtgcaggaaagatgccgcttgtcagcgccctcacgaggattgcgagaactctgccggagaggaggaggatgaagaggaggaaactatggatagcgaaaccgccaagatggcttgtcctagggaccaaatgctgccagaaccaatctctttcgaagcagccgccataccagtggccgagaaagaggaagctctgctgcctgagcctgatgtgccgacagatacaaaggagagctctgaaaaggatgccctcacgcagtatccgcgatataaaaaataccagctggcctgcacaaaaaatgtgtacaacgcctcttcacattctacctcggggtttgcttccacgttccgtgaggacaactctagcaattccctgaaacccggcctcgcccgcggtcagattaaaagcgagcctccgtctgaggaaaatgaggaggagagcatcactctatgtctgtctggagatgaaccagatgccaaggaccgggcaggggacgtcgagatggataggaaacaaccatctccggcaccgacaccaactgcccccgccggggcagcctgtctggagcgctctcggagtgtggctagccctagctgcctgagaagcctgtttagcatcacaaagtcagtggaactgagcgggctgccgagtacctcccagcagcacttcgctcgcagcccagcgtgcccctttgacaaggggattacgcaaggtgatctcaaaaccgattatactcctttcacggggaattacggacagccgcacgtgggtcaaaaggaggtgtcaaattttacaatgggctcccctctgcggggaccgggcctggaagccctctgcaaacaggagggggagcttgacaggaggagtgtcatcttctcatcctctgcatgcgaccaagtctctacttcagtgcacagttactccggggtgagctcccttgataaagacctgtcggaacctgtgcctaagggcttgtgggtgggggcaggacagtcgctcccaagcagccaggcatacagccacggcggattgatggccgatcatctgcctggtcggatgagacccaacacgagctgtccagttcctattaaggtgtgtcctagaagtccaccactggaaacgagaaccaggaccagtagttcctgctcttcttatagctatgcggaagacggcagtggcgggtctccatgctcactgcctctctgtgaattctccagttctccatgtagccagggagcacggtttctcgcgaccgaacaccaagagcctggtctgatgggcgatggcatgtacaatcaggttagaccccagatcaagtgtgaacagagttatggtaccaatagcagcgatgaatccgggtctttctcagaagctgattcagagagctgtccagttcaagataggggccaggaggtgaaactgccatttcctgtcgatcagattacggatttgccccgaaatgattttcagatgatgatcaagatgcataagctgacaagcgagcaactagagttcattcatgacgtgaggcggaggtctaaaaatcggatcgccgcccagcggtgccgaaagcgaaaacttgactgcattcagaacttggaatgcgaaattagaaaattggtttgcgaaaaggagaagctactgagcgagcggaatcagttgaaagcctgcatgggagagctgcttgacaacttcagttgcttatcccaggaggtgtgtagagacatccagtcccccgaacagatccaggccctgcaccggtattgcccagtcctgcggccaatggatctgcctactgccagctctatcaacccagctccccttggagcggagcagaatatcgccgcttctcagtgcgcagtgggcgagaatgttccctgctgtctcgagccgggagcagcaccacccgggcctccatgggccccatctaacacgtccgaaaattgtacctccggaagaagactggagggtacagatcccggcacattcagcgaaaggggccccccgctggaacctagatcccagaccgttaccgtcgatttttgtcaggagatgacagacaagtgtaccacagacgaacagcctcggaaagactatacctag

SEQ ID NO: 180885 - DNA, 477 bp, Artificial Sequence
  Description of Artificial Sequence: Synthetic coding sequence
atgagccacggcaagggcaccgacatgctgcccgagatcgccgccgccgtggggttcctgtcatccttgttaaggactagaggctgcgtttccgagcagcggttgaaagtctttagcggcgcactgcaggaagcacttactgagcactataaacatcattggttccccgagaagccgagcaaaggctccggctatcgctgtatacgaatcaaccataaaatggatcccatcatctctagagtggcctcccagataggtctcagccagccccagctccatcagcttttgccctcggaacttacactgtgggtagatccttacgaggtgagttacagaattggcgaggatggcagcatttgcgtactctacgaggaagcgcctttggcggccagctgcggattgctgacttgcaagaatcaagttttactggggcgtagtagccctagcaagaattatgtgatggccgtgagttcctag

SEQ ID NO: 180886 - DNA, 3258 bp, Artificial Sequence
  Description of Artificial Sequence: Synthetic coding sequence
atggacacccccgagaacgtgctgcagatgctggaggcccacatgcaaagttataagggcaatgatcccctgggagagtgggagcgctacatccagtgggtcgaagaaaactttccagagaacaaggagtacctcatcaccttgttagaacaccttatgaaagaattcctggacaagaagaaataccacaacgatccacgatttatttcttattgtctgaaattcgctgagtataatagtgacctccatcagttcttcgaatttctatataatcacgggatcggtactctcagctcgcccctctacatcgcctgggccgggcaccttgaggcacaaggggaactgcagcacgccagtgcagtgctacagagaggaattcaaaatcaggccgagcctagagagtttttgcagcagcagtacaggttgtttcagacaaggctcaccgagacccacctgccagcgcaggccagaacatcagagcctctgcacaatgtgcaggttcttaatcagatgatcacttctaagagtaaccctggcaacaacatggcctgcataagtaaaaatcagggttccgaactgtctggggtcatcagcagtgcgtgtgataaggagagcaatatggaacgaagagtgataacaatctctaaatcagagtacagcgttcactcatccctcgcttccaaggtggacgtggagcaggttgtaatgtactgcaaggaaaaactcatcagaggcgaatcggagttttcttttgaggagctgcgtgctcaaaaatataatcagaggcgtaaacacgaacagtgggtcaatgaggataggcactacatgaaacggaaagaggctaatgctttcgaagaacaattgctgaagcaaaagatggacgaacttcacaagaaattacatcaggtggttgagaccagccacgaggatttgcctgcaagtcaggaacgatctgaagttaaccctgcccgcatgggaccgtccgtgggatcgcaacaggagcttagggccccctgtttgccagtcacctaccaacagactccggttaacatggagaaaaatccgcgtgaagccccacccgtcgtgcccccactcgcaaatgccatttcagctgccttagtatctcccgcgacgtcccagagcatagcaccacctgttcccctgaaagcgcagactgtgacagatagtatgttcgctgttgcctcaaaggacgccggatgcgttaacaagtctacacacgagttcaagcctcagtcaggtgccgagattaaggagggctgcgaaacacataaggtggctaacaccagcagcttccacacaacgcctaataccagtctgggaatggtccaggctacaccctctaaagttcaaccatctcctacagtccacacaaaggaggccctgggtttcattatgaatatgttccaggcccccaccctgcctgatatcagtgacgataaggatgaatggcagtcactcgatcaaaatgaggatgccttcgaggcccagttccagaagaacgtgcgcagtagcggtgcgtggggcgttaataaaatcatctccagtctgtcgtcagcgtttcacgtgtttgaagacggcaacaaggaaaattatggtctgccacagcccaagaacaagcccacaggcgctcgcactttcggtgagcggtctgtctctagactgccctccaagccaaaagaggaggtgccgcatgcggaagagttcctggatgactccaccgtgtggggcataaggtgtaacaagacccttgcccctagccccaaatcgccaggagactttacttcagccgctcagttggcttctacaccatttcataagctgccggttgaatccgtccatattctggaggacaaagagaatgtcgtggccaaacaatgcactcaagccactcttgactcatgtgaagaaaacatggttgtgcccagccgcgacggtaagttttcccccatccaggagaaaagccctaaacaggccctgagctcacacatgtatagtgccagcctgctgcgactgagtcagcctgccgccggtggagtcctgacctgtgaggcggagctcggggttgaagcgtgcagactaaccgataccgatgcagctatagctgaggatcctcccgatgccattgcgggcctgcaagcggaatggatgcaaatgagcagtttgggcactgtggatgcccccaattttatagtggggaacccatgggacgataagctgatttttaagctcctctctggattgagcaaacccgtgtccagctaccctaacacattcgagtggcaatgcaaactgcccgcaataaaaccgaagactgagtttcagttggggagtaagcttgtctacgtgcatcacctcttgggggagggcgcctttgctcaagtatacgaggcaacccagggggatctgaacgatgctaaaaacaagcaaaaattcgtactgaaagtccaaaagccagccaatccgtgggagttttatatcggaacccaattaatggaaagactaaaaccaagtatgcaacatatgttcatgaagttctatagtgcccatctattccaaaacggcagcgtgctggtcggcgagctttacagttacgggacattactcaatgcaatcaacctgtataaaaacacacctgaaaaggtcatgccccaggggcttgtgatctcattcgctatgcgaatgctgtatatgatcgaacaggtacacgattgtgaaatcattcatggggacatcaagccagataatttcatcctggggaatgggttcctggagcaggacgacgaagatgacctgtcagccggcctggcgctcatcgatctgggacagtctattgatatgaagctgttccctaaagggaccatatttacagccaagtgtgagacttccgggtttcagtgcgtagagatgttgagcaacaaaccatggaactatcagatcgactacttcggcgtggccgccactgtgtattgcatgctgttcggtacatatatgaaggtgaagaacgaggggggtgaatgcaagcccgagggattgtttcgacggctaccacacctggacatgtggaatgaatttttccatgtcatgctgaatatccccgactgccatcatctgccatctctggacctccttcgtcagaagctcaaaaaggtgtttcagcagcactacactaataagattagagccctcagaaaccgattgatcgtgctgctcctcgaatgcaagcgaagccgtaaatag

SEQ ID NO: 180887 - DNA, 3087 bp, Artificial Sequence
  Description of Artificial Sequence: Synthetic coding sequence
atggacacccccgagaacgtgctgcagatgctggaggcccacatgcagtcatacaagggaaatgacccgctgggagaatgggagagatatattcaatgggtggaggagaacttccctgagaataaggagtatctgatcacactgctagaacacttgatgaaagagttccttgataagaaaaaataccacaacgatcctagattcatcagctactgtctcaagttcgcagagtataacagtgatctgcaccaattttttgagttcctatataatcacggcattggcacacttagtagccctttgtatattgcatgggccggccacctcgaagcccagggcgagctgcaacacgccagtgctgtgctccagcgtgggattcaaaatcaggctgagccaagagagtttcttcaacagcaatacagattgtttcagacaagactcacagagacccacctccctgctcaagcacgaacaagtgaacctctgcacaacgtgcaggtgttaaaccagatgatcacctccaaatcaaatccaggcaacaacatggcctgcatcagcaaaaatcaggggtcggagctgtccggagtgataagctcagcatgtgacaaggagagtaacatggaaaggagagtgatcaccataagcaaaagcgagtattctgtgcattcctcccttgcaagtaaggtggacgtggaacaggtcgttatgtactgtaaggaaaaactgatcaggggtgagtctgaattttcatttgaagagctaagagcgcagaagtacaaccagcgtcgtaagcatgagcagtgggtaaatgaggaccggcattatatgaaacgcaaggaggctaacgccttcgaagaacaactgctgaaacaaaagatggatgagctccacaagaagctgcaccaagtggtggaaacttcgcatgaagacttacccgcttctcaggaacgcagcgaagtcaatcccgctagaatgggaccatccgtgggcagccagcaggagctgcgggctccatgccttcctgtgacgtatcagcagacgcccgtgaatatggaaaaaaatcccagagaggccccccctgtcgtaccaccacttgccaatgcaattagcgctgcgctggtgagcccagccacaagccaaagtatagcaccaccagtcccactcaaggcccaaacagtaacagacagtatgttcgcggtggcctcgaaagatgcgggctgcgtgaataagagcacccacgaattcaaaccacagtccggcgccgagattaaggagggctgcgaaacccacaaggttgccaatacatctagcttccatactacacccaacaccagtttagggatggtccaggcaactccatccaaggtccaaccttctccaacagtgcatacaaaggaagcactagggttcattatgaacatgttccaagcgcccaccctgccagatatcagcgatgacaaggatgaatggcagtcgctggatcagaatgaggacgcctttgaagcccagttccaaaaaaacgtgaggtcctccggcgcttggggagttaacaaaatcatctctagtctctcctcagcatttcacgtctttgaggacgggaacaaggaaaactacgggctcccccagcccaaaaataaacctactggggcccggacattcggagagagaagtgtgagccgcctcccatcaaaaccgaaagaagaggtccctcacgccgaggaatttctggacgactccacagtatggggtattcggtgtaacaaaactctcgctccctcacccaaatctcccggggatttcacatcagcggcccagcttgcatccacgccgttccacaagcttcccgtcgagagcgtacacattctggaggataaagagaatgttgtggccaaacagtgcactcaggcaaccctggatagctgtgaagagaacatggttgtgcccagtagggacggcaaattttcaccaattcaagaaaagtcccccaaacaggctctctcgagccatatgtactccgcgagcctgcttcggctgtcacaacccgccgcaggcggagtgctgacgtgtgaggctgagttaggggttgaggcctgccgacttacagatacagatgctgctatagccgaggaccccccggacgcaatcgccggtttgcaggcggagtggatgcagatgtccagtctgggcaccgtggacgcccccaattttattgtgggcaatccgtgggatgacaagctgatcttcaagctcctgtccggcctttcaaagcccgtgagttcttaccctaacaccttcgaatggcagtgtaagctgccagccatcaaacccaaaactgagttccagctaggcagcaaactcgtgtacgttcatcatctcctgggggaaggagccttcgcccaagtgtacgaagcaacacagggagacctcaacgatgctaaaaacaagcagaagtttgtccttaaggttcaaaagccagccaatccttgggagttctatatcggcacgcagttaatggaaaggttaaagcctagcatgcagcacatgtttatgaagttttattccgcccatctgtttcagaacggcagtgttctggtcggagaactttatagttatggcaccctgctggacgatgaggatgacctttcagctggtcttgcgttgatcgatttggggcagagcatagacatgaaattatttcccaaggggaccatctttaccgccaagtgcgagacatctggcttccaatgtgtggaaatgttatccaacaagccctggaactaccaaatcgactattttggggtggcagcgaccgtgtactgtatgcttttcggtacctatatgaaggttaaaaacgagggcggagagtgtaagcccgaggggcttttccgccggttaccacatcttgacatgtggaatgagttttttcacgtaatgctcaatattccagactgccaccatttgccgagcctggacctcttgcggcagaagttaaaaaaggttttccagcagcactacaccaacaagatccgggctcttcgaaatcggttgatcgtgctgttgctggagtgcaagaggagccgaaaatag

SEQ ID NO: 180888 - DNA, 3198 bp, Artificial Sequence
  Description of Artificial Sequence: Synthetic coding sequence
atggacacccccgagaacgtgctgcagtacatccagtgggtggaggagaactttcctgagaacaaagaatacctgattacactgttggagcacctgatgaaagagttcctggacaaaaagaaataccataatgacccacggtttatatcctactgtctgaaatttgcagagtacaactcagacctgcaccaatttttcgagttcctgtacaaccacggaattggcacactgtcatcaccactgtacatcgcatgggccggccatctggaagctcagggtgagctgcagcacgccagtgcagtgttacagcgcggaatccagaatcaggccgagcctcgtgagttcctgcaacagcagtatcgcctgtttcaaacacggcttaccgagactcacctgcccgctcaggcgagaacgtctgagcccctgcacaatgtccaggtgctcaatcagatgatcacttcgaagtctaaccccgggaataacatggcttgtatttcaaaaaaccagggtagtgaactctccggggttatctcttccgcctgtgataaagagagcaacatggagaggcgcgtcatcaccatctccaagagcgaatatagcgttcatagtagtttagctagtaaggtggacgttgaacaggtggtgatgtattgcaaggagaaactgatccgaggcgagtctgaattttcgttcgaggagctgcgggcccaaaaatacaaccagcgccgaaagcatgaacagtgggtgaacgaggataggcactacatgaagcggaaagaggccaatgcatttgaagaacagctactgaagcagaagatggatgagcttcataaaaagctgcatcaggtcgtggaaaccagtcatgaggaccttcccgcgtctcaagagcgctccgaggtcaatccagcgaggatgggcccgagcgtgggctcccagcaagagttaagagccccttgtctgcccgtaacgtatcagcagacccccgtcaatatggagaaaaaccctcgggaggcacctcctgtggttcccccactggccaatgctatctccgccgccttggtgtcacctgccacgagccagtccatagctcctcctgtgcctctgaaagcacaaactgtgactgattccatgttcgctgtggcctcaaaggatgcaggctgcgtgaataagtccactcacgagttcaagccacagagcggcgccgagatcaaggaaggatgtgaaactcacaaagttgctaacacctccagctttcacacaactcctaacacatcactcggcatggttcaggccacgccaagcaaagttcagccttcccccacagttcataccaaggaagctcttggctttatcatgaatatgtttcaggcccccacactcccagatattagtgacgacaaagatgagtggcaaagcttggatcagaatgaggatgcttttgaggcccagtttcagaagaacgttagaagctctggcgcatggggagtgaacaagataatcagctccctatcttcagcctttcatgtgttcgaggatgggaataaggaaaactatggtctaccacagcctaaaaataaacccactggggcccggacatttggtgaacggtcagtcagccgactaccaagtaagcctaaagaagaggtgccccacgccgaggagtttcttgacgattcaactgtatggggcattcgctgtaataaaactcttgccccctccccaaagagcccgggcgacttcacctccgccgcgcagttggcaagcactccattccataagcttccagttgagtcagtgcatatactagaggacaaggagaatgtggtcgcaaagcagtgcacccaggcgacccttgattcctgcgaggaaaacatggtggtgcccagtagggatggtaagttttctccaatccaggagaagagtcctaagcaggccctctcatcccacatgtatagcgctagcctgcttaggttgagccagcctgcagccggcggtgtcttgacttgcgaggcggaactgggcgtcgaggcttgtcggttgacagacacagatgccgctatagcagaggaccccccagatgcaatcgcagggctgcaagcagagtggatgcagatgagctccctcggtaccgtggacgcgcctaatttcattgtggggaacccttgggacgacaaacttatcttcaagctgctgtcagggctgtccaagcccgtgtcaagctatccgaacacctttgaatggcaatgcaagttgcccgctattaagcccaaaaccgagttccagctgggatccaaactggtgtacgttcaccacctgctgggcgaaggcgcatttgcccaggtttatgaggcaactcagggcgaccttaacgatgcaaagaacaagcagaaatttgtcctcaaggtgcaaaagcccgctaatccctgggagttttacatcggaactcagctcatggagagactgaagccatctatgcagcatatgttcatgaagttctatagtgcccatctgttccagaatgggagcgtcttggttggggagctgtatagctacggaaccctgctgaacgctatcaatctttacaagaatacacctgagaaggtaatgccccagggcctagtgataagctttgcaatgagaatgctgtacatgattgagcaggtccacgactgcgagatcattcatggggacattaagcctgacaattttattctggggaacggttttttggagcaggatgacgaagacgatctgagtgctgggttggctttgatcgacctcggacagtccatcgacatgaaactgttcccaaaggggaccatcttcaccgcaaaatgcgagactagcggcttccagtgtgtggagatgctcagcaataaaccatggaattatcaaatcgactacttcggcgttgccgcaactgtctattgcatgctgtttggtacttatatgaaggtgaagaatgaagggggcgaatgcaaaccggaaggcctttttcgtcgcctcccccatcttgacatgtggaacgagttttttcatgtgatgctgaacataccagattgccaccacctgcctagcctagatttgctccgacagaagctgaagaaggtatttcagcagcactatacgaacaaaattcgggcccttcgaaatcgacttatagttttgctccttgaatgcaaaagatcccggaagtag

SEQ ID NO: 180889 - DNA, 2475 bp, Artificial Sequence
  Description of Artificial Sequence: Synthetic coding sequence
atggacacccccgagaacgtgctgcagatgctggaggcccacatgcagtcttataagggcaacgaccccctcggcgaatgggaacgttatatacaatgggtcgaggagaattttcccgaaaacaaagagtatcttataacacttctggagcacctgatgaaagagtttctggacaagaagaagtaccacaatgatcccagattcatcagctactgcctcaagtttgccgaatataatagcgacttacaccagttcttcgaatttctgtacaaccacggcatcggcactctatcatcgccgctatatatcgcctgggccgggcatcttgaggctcagggggagctgcagcatgctagcgccgtactgcaaaggggcatccagaaccaggcagaaccaagagaattcctgcagcagcagtaccgacttttccagactcgccttactgagactcacttgccagctcaggccagaacttcagagccgctccataatgtgcaggtgctaaatcagatgataacaagtaaatcaaaccccgggaacaacatggcttgtatttctaagaatcagggctctgagttaagtggagtcatcagttcagcatgcgacaaagaaagcaatatggagaggagagttattactatttcgaaatcggagtactcagtgcacagtagcctggcttccaaggtggacgtcgaacaagtggtaatgtactgcaaggaaaagcttatccgaggagagagcgagttttcttttgaggagctccgggcgcagaagtataaccagcggaggaagcatgagcaatgggttaacgaagaccgccactacatgaaaaggaaggaggcaaacgcctttgaagagcagctgctgaagcagaagatggacgagctccacaagaagcttcaccaggttgtggagaccagccacgaagacctgcctgcttctcaggaaagaagtgaagtgaatcccgcgagaatgggcccatccgtagggagtcaacaagagctccgcgccccatgccttcctgtgacataccagcagacacccgttaacatggagaagaacccacgagaggccccccccgttgtgccccccttggccaacgccattagtgctgccctggtctcacccgctacttctcagagcatcgcccctccggtaccattaaaagctcagacagtcacagatagtatgtttgctgtagcgagcaaggatgctggttgcgtgaataagtcgacccacgagtttaaaccccagtcaggcgctgaaataaaagaagggtgcgagacccacaaagtggcaaatacatccagctttcatactacccctaacacaagcctcgggatggtgcaagctacccctagcaaggtgcaacccagtccaaccgtacataccaaggaggcgcttggatttattatgaacatgttccaggctccaactttaccagacatctctgacgataaagacgagtggcagagtctggatcagaacgaggatgctttcgaagcgcagtttcagaaaaatgtcagaagctctggggcctggggtgtgaacaagattatcagctccctgagtagtgcgttccacgtgttcgaggacgggaataaggagaattatgggcttccgcagccgaagaacaaacccaccggagcaaggacattcggggagagaagcgtgtcacgacttccatctaaacctaaggaggaggtgccccatgctgaagaatttttagacgacagcactgtctgggggatccggtgtaataagaccttggccccaagcccaaaaagccccggggactttacttctgcagctcaactggcttctacgccttttcacaagttgcctgtggagtcagtacatatcctggaagacaaggagaatgttgtagccaaacagtgcacacaggccaccctcgactcttgtgaggaaaacatggtggtcccctcgagggacggcaagtttagcccaatccaagaaaagtctccaaagcaggccctatccagtcacatgtatagcgcttccctcctgcgattaagccagcctgctgcgggaggagtgctcacttgcgaggcagaacttggtgttgaggcttgcagactgaccgacactgacgccgcaatcgctgaggacccaccagacgccatcgcaggccttcaggcagaatggatgcagatgtcatccctaggtaccgtggatgctcctaacttcatagtggggaatccttgggacgacaagttaatcttcaagctgctgtctgggctcagtaaacccgtgtctagttaccctaacactttcgaatggcagtgtaaattgcccgctatcaagcctaaaaccgaattccaactgggcagtaaattggtgtatgtgcaccacctgctcggggaaggcgcctttgcccaggtatacgaggctactcagggtgacctcaacgacgcaaagaataaacagaaattcgttctcaaggtgaaaagttag

SEQ ID NO: 180890 - DNA, 981 bp, Artificial Sequence
  Description of Artificial Sequence: Synthetic coding sequence
atgaccggcagcaacgagttcaagctgaaccagccccccgaggacggcatcagctccgtgaagttttcaccaaacacaagccagttcctcctggtgagtagctgggacacatcagtgcgtctgtatgacgtgccggctaatagcatgcgccttaagtatcagcacacaggcgctgtcctggattgtgccttctacgaccctacacatgcttggtctggcggtttagaccatcaactgaagatgcacgacctcaatactgatcaggagaacctggtgggcacccatgatgctccaatccgctgcgtcgagtactgtccggaagtcaacgttatggtcacggggtcctgggatcagaccgtaaagttgtgggacccacgtaccccttgcaatgccggtaccttcagccagccagagaaagtatatactctgtctgtctcaggcgaccggctgattgtggggaccgcgggacggagggtattggtctgggaccttaggaatatgggatatgtgcagcagagacgcgagagttctctcaagtatcaaacgcgatgcatacgggcattccctaacaagcaggggtacgtactcagtagcatagagggcagggtagctgtggaatatctcgatccctcgcccgaagtccagaagaaaaaatatgcttttaaatgtcaccgactgaaagagaacaacatcgaacagatttaccccgtgaacgccatctcgttccataatatccacaatacttttgcgacgggagggtccgacggattcgttaacatctgggacccgttcaacaagaagagactttgtcagttccatcgatacccaaccagtattgcatcgttagcattttccaacgacggcaccacattggccatcgcctcaagctatatgtatgagatggatgacacagaacaccctgaagatggtatctttattaggcaggtaacagacgccgagaccaagcccaagtcgacctag

SEQ ID NO: 180891 - DNA, 987 bp, Artificial Sequence
  Description of Artificial Sequence: Synthetic coding sequence
atgaccggcagcaacgagttcaagctgaaccagccccccgaggacggcatatcgagtgtcaagttcagccccaacacttcccagtttcttctggtctccagctgggatacatcagtgaggctctatgacgtgcccgccaacagcatgaggctgaagtaccaacacaccggtgcagtgctcgactgcgccttctatgaccccactcacgcctggagcggagggctggatcaccagctgaagatgcatgacctgaacaccgaccaagagaatctggtgggaacacacgacgcaccgatccggtgtgttgagtattgccctgaagtgaatgtgatggtaaccggatcctgggatcaaacagttaagctatgggaccccagaacaccctgcaatgccggtacattttcccagccagagaaggtgtatacactcagcgtctccggagatcgcctgatagtggggacagctggccggagggtgcttgtgtgggatctgagaaacatgggatatgtgcagcagcgacgggagtcgtctttaaagtatcagactagatgcatccgggcatttccgaataagcagggctacgtcttaagctccatcgaggggagggtagctgtcgagtatctcgatccatcacccgaggtgcagaagaagaagtatgcctttaagtgccaccggctgaaggagaataacattgaacaaatatacccagtgaatgctatcagctttcataacattcataatactttcgctacaggcggcagcgacgggtttgtgaatatttgggatcctttcaacaagaagaggttatgccaattccaccggtacccaacatcaattgcaagcttagcctttagtaatgacggaacgacgcttgctatcgcaagcagctatatgtacgagatggacgacacagagcacccagaggatggcatttttatccgccaggtcacggatgcggagaccaaaccaaagagtccttgtacttag

SEQ ID NO: 180892 - DNA, 747 bp, Artificial Sequence
  Description of Artificial Sequence: Synthetic coding sequence
atgcacgacctgaacaccgaccaggagaacctggtgggcacccacgatgcacccattaggtgtgtggagtattgcccggaagtcaacgtgatggtgacaggttcttgggaccagacggtcaaactgtgggatcccagaacgccttgcaatgcggggaccttctcgcagcctgaaaaggtgtacaccctgtccgtgagtggcgatcgactcatcgtagggactgcagggaggcgcgtcctcgtttgggacttacgcaacatgggctatgtgcagcagaggagggaatccagcttgaaataccagacgcgctgcatcagggctttccccaacaaacaagggtacgtgctcagcagtattgagggcagagtggccgtggaatacctcgacccttcccccgaggttcagaagaagaaatacgcattcaagtgccacagactcaaagagaataatattgagcagatctatcccgtgaacgcaatttctttccataatatacacaatacctttgcaactggagggtcagatggtttcgtgaacatctgggatccgttcaataaaaagagactttgtcagtttcacaggtacccgacgtcaattgcttcattggccttcagcaacgacggtaccactctagctattgcatcctcctacatgtatgagatggatgacaccgagcatcctgaagacggaatatttatcagacaggtcactgatgcggagaccaaacctaagtccccttgcacttag

SEQ ID NO: 180893 - DNA, 1164 bp, Artificial Sequence
  Description of Artificial Sequence: Synthetic coding sequence
atggcctgcaccatccagaaggccgaggccctggacggcgcccacttaatgcaaatactctggtatgacgaggaagagagcctttatccagctgtgtggctgagggacaattgtccttgctcagactgctacctcgacagcgcaaaagctcgcaagcttttggttgaagctctcgatgtgaacatcggcattaaaggattgatcttcgaccggaaaaaggtgtacataacctggcctgacgagcactatagcgagttccaggccgactggctcaagaaaaggtgcttctcaaaacaggcgcgcgcaaagctccagagggagctgttctttccagagtgccagtactggggatctgagctgcagctaccgacccttgactttgaagacgtcctacgctacgacgagcacgcctacaaatggctgtctacccttaagaaagtaggcattgttaggctgactggggcttctgataagcctggcgaggtgagcaaactaggaaaacgcatggggttcctttaccttacattctacggacatacctggcaagtgcaagataagatcgatgcaaacaacgtcgcatacaccaccggaaaactgtcctttcatactgattaccccgccctgcaccatccccccggcgtgcagcttcttcattgtatcaaacagaccgtgacaggcggcgattccgagattgtcgacggctttaacgtctgccaaaaattgaagaagaataatccccaggctttccaaatactctcctctaccttcgtggattttactgatatcggggtcgactactgtgacttcagcgtgcaatctaagcacaagattatagagctcgatgataaaggccaggtggtgcgaatcaacttcaacaatgcaactagggataccattttcgatgtacccgtggaacgcgtacaacccttctatgcagctttgaaggaattcgtagaccttatgaactccaaagaaagtaagtttacttttaaaatgaacccaggcgacgtgattacctttgataactggagactgttacacggaaggcgatcctatgaggcaggcaccgagatatccaggcatctggagggcgcatacgccgattgggatgtggtgatgagccggctcagaattctccgacaaagagttgagaatggaaactag

SEQ ID NO: 180894 - DNA, 1164 bp, Artificial Sequence
  Description of Artificial Sequence: Synthetic coding sequence
atggcctgcaccatccagaaggccgaggccctggacggcgcccacctcatgcagatcttgtggtatgacgaggaggaaagcttgtatcctgctgtgtggctgagggataactgtccatgttccgactgttacctcgactctgcgaaggctcgtaagctgctcgtcgaggcactggacgttaacattggcatcaaggggcttatttttgatagaaaaaaagtttacattacgtggcccgacgagcactattctgagtttcaagccgactggctgaaaaagcgctgtttcagcaagcaggcaagggccaagctgcagagggaactcttttttcctgagtgccaatactgggggtcagaattgcagctgcccacgctggactttgaggatgtgctgcgctacgacgaacatgcctataagtggctctccacactgaaaaaggtcggaattgtccgcctcacaggtgcttctgacaagcccggggaagtgtctaagttagggaaacggatgggattcctttatctcaccttttatggccatacctggcaggtgcaggacaagatcgatgcaaataacgtggcatacacgactggtaagctctcatttcataccgattatcctgcacttcatcatcctcctggggtgcagctgctgcattgcattaagcagacagtgaccggcggcgactctgagattgttgacggcttcaacgtctgtcagaagctgaaaaagaacaatccccaagcgtttcagatactgtcgtctacctttgtggacttcaccgatatcggagtagactattgtgacttcagcgtccagtccaagcataaaataattgaactcgacgataagggccaggtcgttcggatcaacttcaacaacgcaactagggatactatttttgatgtgccagtcgaacgagtacagcctttttacgccgccctgaaagaatttgtagatctcatgaattcaaaggagagtaaattcactttcaaaatgaatcctggcgatgtgatcaccttcgacaactggcggcttctgcacggacgacggagctacgaggctggtacagagatctctcgtcatctggagggagcctacgcagactgggatgtggttatgtcccggctcagaattctgagacagagggtggagaacggcaactag

SEQ ID NO: 180895 - DNA, 1164 bp, Artificial Sequence
  Description of Artificial Sequence: Synthetic coding sequence
atggcctgcaccatccagaaggccgaggccctggacggcgcccaccttatgcagatcttatggtatgatgaggaggaatctctgtaccctgccgtgtggctgcgtgataactgtccctgctccgattgctatttggactcagcaaaagccagaaagctcctggtggaagccctcgatgttaacattggcataaaagggctgatctttgaccgtaagaaggtgtatatcacttggcctgacgagcactatagtgagttccaagcagactggttaaaaaagcggtgcttcagtaagcaggcgcgggcaaagttgcaacgggagctattcttcccggaatgccagtattggggcagcgagctacagcttcccactctggacttcgaagacgtcttacggtatgacgagcacgcctataagtggctttccactcttaaaaaggttggaatcgtgaggctcaccggtgcctccgacaagccaggcgaggtgagtaagctggggaagagaatggggtttttgtatctgacgttttatggacatacttggcaggtccaggataaaatagatgcgaacaacgtggcttacaccacggggaaattgagctttcatacagactatccagctttacaccacccgcctggcgtccagctgctgcattgtataaagcagactgtaactggcggggatagcgagatagttgatggctttaatgtgtgccaaaaactcaaaaagaacaaccctcaggcttttcagatcctctcatctacctttgttgactttacggacataggggtcgactattgcgatttctctgtgcaatccaaacacaagatcattgaactcgatgataaaggacaggttgtccggattaactttaataatgctacgcgagatactatcttcgatgtgccggttgagagagtgcagccattctacgctgccttgaaggaatttgtggatttgatgaatagcaaagagagcaagttcacctttaagatgaacccgggtgacgttataacctttgataactggagactcctgcatgggcgcaggtcctacgaggccggcacagagatttccaggcacctggaaggcgcttacgccgattgggacgtggtgatgagtcgcctgaggattctccgccagagggtggaaaatggcaattag

SEQ ID NO: 180896 - DNA, 1164 bp, Artificial Sequence
  Description of Artificial Sequence: Synthetic coding sequence
atggcctgcaccatccagaaggccgaggccctggacggcgcccacttaatgcagattctttggtacgatgaggaagagtccctctatcccgcggtgtggcttagggataactgtccgtgttctgattgttacctagactctgccaaagcacggaagctgctcgtggaagctctcgatgttaacatcggtattaagggtctcattttcgaccggaaaaaggtgtacattacatggcccgatgaacactacagtgaattccaagcagattggctgaagaagcgatgtttctccaaacaagcacgagccaagctgcagagagagttgttttttcctgagtgtcagtactggggcagtgaactgcagttacctaccttggactttgaggacgttctgcggtacgacgaacatgcttataaatggctctctactttgaagaaagtggggattgtgagactgacaggtgcatctgacaagcccggtgaggtatccaaactggggaaaaggatgggctttctatatttaacattttacggccacacctggcaggtccaggacaaaatcgacgctaacaatgtggcctatacgacgggcaagctctctttccacacggattatcctgccctgcatcaccctcctggcgtgcagttgctgcactgtatcaagcagacagtaacaggaggggattccgagatagttgatggctttaacgtctgtcagaagctgaagaaaaataatccccaggcctttcagattctttcgtcaacctttgtagacttcacagacattggcgtagactactgcgattttagtgtgcagtcgaaacacaagatcatcgagctggatgacaagggacaagtcgtgagaatcaacttcaacaacgcaacaagggacacaatctttgacgtgcccgtagagcgggtgcagcctttttatgcagccttaaaagagtttgttgacctcatgaactcaaaggagagtaaatttaccttcaagatgaatcccggcgatgtgatcacattcgataattggcggcttcttcacggtcggagaagctacgaggccggaaccgaaatcagtagacatctggagggagcgtatgcggattgggatgttgtgatgtcacgccttagaattctacgccagcgggtggagaacggcaattag

SEQ ID NO: 180897 - DNA, 207 bp, Artificial Sequence
  Description of Artificial Sequence: Synthetic coding sequence
atggcctgcaccatccagaaggccgaggccctggacggcgcccacctaatgcaaatcttatggtatgatgaagaagagtctctgtaccccgcagtgtggctccgtgacaactgtccttgctccgactgttacctcgacagtgctaaggcccgaaaattgctcgtggaggcccttgacgtcaacattgggataaagggccttatctag

SEQ ID NO: 180898 - DNA, 771 bp, Artificial Sequence
  Description of Artificial Sequence: Synthetic coding sequence
atggagcccgccgccgccctgcacttcagcctgcccgccagcctgttgctccttctactgttactattactcagcctgtgcgctctggttagcgcacaattcacagtcgtgggccccgccaatccaattttagccatggttggtgagaatacaactctgcggtgccacctgtccccagaaaagaacgccgaggacatggaagtgaggtggttccgtagtcaattcagcccagcagtttttgtgtacaaaggagggcgggagagaactgaagaacagatggaggagtacagaggccgtatcacattcgtctccaaagacattaaccgtggctccgtcgccctagtcatccacaatgtgacagcacaggagaacggtatttatcggtgctatttccaggagggccgaagctatgatgaggcgatcctgagattggtggtggccgagagtttcatgccgagcgccagcccctggatggttgccctcgccgtgatcttgaccgccagcccatggatggtgagcatgacagttatcctcgcggtcttcataatcttcatggccgtgtccatatgctgtattaagaaactacagcgtgaaaagaagattttaagcggtgagaagaaagtcgagcaagaggagaaagagattgcacaacagctgcaggaggagctacggtggcgaagaactttcctgcacgctggttacgagcttcctggaatccggggcccaagctggaaaagaccactgcacggggagccaccaagcgctttctag

SEQ ID NO: 180899 - DNA, 942 bp, Artificial Sequence
  Description of Artificial Sequence: Synthetic coding sequence
atggagcccgccgccgccctgcacttcagcctgcccgccagcctgctgctcctcctgcttctgctactcctttccctgtgtgcacttgttagcgaaagcttcatgccttcggccagcccatggatggttgcccttgcggtgatcctgaccgcctcaccatggatggtatcgatgaccgtgattttagctgtgttcattatctttatggctgtatcgatttgctgcattaagaaactccagagagagaagaaaatcctctccggcgagaaaaaagtcgagcaggaggaaaaagagattgcacaacaattacaggaagagctaagatggcgccgcacatttctccatgctgctgatgtggtactagaccctgatactgcacatcccgagctcttccttagcgaagatcgccgctctgtcaggaggggaccgtacagacagcgcgtccccgacaaccctgagaggttcgatagccagccttgtgtgctgggttgggaatcattcgcatctgggaagcactactgggaggtcgaagtcgaaaacgtaatggtctggactgtgggggtgtgtcgccacagtgttgagagaaaaggagaagtcctcctgatacctcagaacggattctggaccctggagatgtttggaaatcaatacagagctctgtctagtcctgagcgaatcttgccattaaaagagtccctttgcagggtgggagtgttccttgactatgaggcgggcgacgtgagcttctacaatatgagggatcgcagccacatctacacatgtccaagatctgcatttacagtgcctgtccgacctttcttcaggctgggatccgatgactccccgatatttatttgtccggccttaacaggggccagcggtgtgatggtgcctgaagagggccttaagctgcatcgcgttggaacccaccagtccctgtag

SEQ ID NO: 180900 - DNA, 1608 bp, Artificial Sequence
  Description of Artificial Sequence: Synthetic coding sequence
atggtgggcgaggacgccgacctgccctgccacctgttccccaccatgagcgccgaaacgatggagttacgttgggtttcaagctctttgaggcaggttgtgaacgtgtacgcagacggcaaggaagtggaagaccgccagagtgccccttacaggggcagaacaagcatcctccgtgatgggattactgctgggaaagcggccctgagaatccataacgtcacagcatctgacagcggcaagtacttgtgctattttcaggacggcgacttttatgaaaaggccttggtcgagctgaaagtagccgcgctgggttctgatctgcacatagaggtcaagggatatgaggacggaggaattcacctcgaatgtcgtagcaccggttggtacccgcagccccagattaagtggagcgacacaaagggagagaatatccccgctgtagaggccccagttgtcgcagacggcgttgggctgtatgcagtggcagcaagcgtgatcatgcgaggcagtagtggtggaggcgtgtcctgtattattagaaattcactgctgggccttgaaaaaaccgcgtccatttccatcgcggacccttttttccggtccgcacagccgtggatcgccgcactcgctgggacactcccaataagtctgcttctgctggctggcgccagctacttcctgtggcgacagcagaaggaaaagatcgctttgagcagggaaaccgaacgagagcgcgaaatgaaggaaatgggctacgcagccacagaacaggagatttccctcagagagtggcggaaaatacaatatatggcccgcggggaaaagtccctggcttaccacgagtggaaaatggctcttttcaaacccgcagacgttattctggacccagatacagctaatgccattctcctggtttctgaggatcagcgaagtgtgcaaagggctgaagaaccacgggatttacccgacaacccggaacgcttcgaatggcgctactgtgtgctaggttgtgaaaattttacatccggaaggcattattgggaggtggaggtgggcgatcgtaaggagtggcacattggcgtttgctcgaaaaacgtggagcgcaagaaggggtgggtgaaaatgacgccagagaacgggtactggaccatgggcttaactgatggaaacaaatacagggctctgaccgaacctcggactaacctaaagctgcctgagcctccaaggaaagtcgggatttttttggactacgaaaccggcgagatctcattctacaatgccactgatggcagccatatttatacattccctcatgcatccttcagcgaacccttgtaccctgtcttccgaatattaacgctagaaccaacggctctgacaatctgccccatacccaaggaagtagagtctagtcctgacccagatctggtacccgatcatagtttggagacgccattgacacccggtctggctaatgagtctggcgaaccacaggccgaagtgacaagtcttctgttgcccgcccacccgggggctgaagtgagccctagtgctaccaccaaccagaaccataagctgcaagcccggacggaggccctatactag

SEQ ID NO: 180901 - DNA, 1581 bp, Artificial Sequence
  Description of Artificial Sequence: Synthetic coding sequence
atggccgtgttccccagcagcggcctgccccggtgcctgctgacccttattctcctgcagctgcctaagttagacagtgctcccttcgatgttatcggtcctcccgagccaatccttgccgtcgtcggagaggacgcagagctgccctgtcggctatcccccaatgccagtgcggaacatctcgagctgagatggttccgcaagaaagttagtcctgcagtactggtgcatagagatggcagggagcaagaagctgaacaaatgcctgaatacagagggcgggctacattagttcaggacgggattgcgaagggacgagtagcgctgcggataagaggggtcagagtatccgacgatggtgagtatacatgtttcttccgggaagacgggtcctacgaggaggccctggtgcatctcaaagtggcagccttaggatctgatccccacattagtatgcaggtgcaggaaaacggcgagatatgtcttgaatgtacttctgtagggtggtatcctgaaccccaagttcagtggcggacgagcaagggggaaaaattcccttctacatcggaatcccggaaccctgacgaagagggcctctttaccgtggccgcttcggtgatcatccgcgatacaagcgccaagaacgtttcatgctacattcagaacctgctgcttggacaggaaaaaaaggtcgagatctctattccggcttcatcactaccgaggttgactccctggatagtagcagtcgccgttatccttatggtcttagggctattgaccatcggctccattttcttcacatggaggctgtataatgaaaggccacgggaacgaagaaatgagttttcttctaaggagcggctcctcgaggagttgaagtggaaaaaggccactcttcatgctgtggacgtcaccctcgacccagacactgctcatccacatctgttcctgtacgaagacagtaaaagcgtgaggctcgaggactccaggcagaagctgccggaaaagactgaaaggttcgactcttggccttgtgtgctaggtcgcgagacctttacctctggtaggcactattgggaggtggaggttggggaccgaaccgactgggctatcggagtgtgtcgggaaaatgttatgaaaaagggcttcgatcccatgactcctgagaatggcttttgggcagtggagttgtatggcaacggttactgggcccttaccccactacgcactcctcttcctctggcaggacctccccgtagagtcggcatcttcctggattacgagagcggggatatttctttttacaatatgaatgacgggtccgatatttataccttttccaacgtgaccttctctgggcccctcaggccattcttctgcctgtggagttctggaaaaaaacccctcactatctgccccatcgcagatggccccgaacgcgtgactgtaatcgccaacgctcaggacctctcaaaagaaatcccactctcacctatgggggaagattccgccccgagagacgccgatacccttcactccaagctcataccaacccaaccatcgcaaggagctccatag

SEQ ID NO: 180902 - DNA, 1485 bp, Artificial Sequence
  Description of Artificial Sequence: Synthetic coding sequence
atggccgtgttccccagcagcggcctgccccggtgcctgctgaccctcatcctgctacaacttcctaagctagattctgcacccttcgatgttatcggacctcctgagcccatacttgctgtggtaggggaagacgccgagttaccctgtcgcctgtccccaaacgcctccgcggagcacctggaacttaggtggtttcgaaaaaaggtgagcccagctgtgctcgttcatcgggacggtagggaacaggaagctgaacagatgcctgaatatcgcgggcgggctactctcgttcaggacggaatagcaaaaggaagagtggcacttaggattagaggggtcagggtgagtgacgacggtgagtacacctgttttttccgggaggacggatcttacgaggaagctttggtccatttgaaggtcgccgccctgggctccgacccccatatttccatgcaggttcaggaaaatggcgaaatctgtttagaatgcacctctgtcggatggtaccctgaaccacaggtgcagtggaggacgtcaaaaggagagaaattcccgtctacttccgagtcacgtaacccagatgaggagggattgttcacggtggccgcaagcgtcatcattcgagatacctctgcgaagaacgtatcatgctatattcagaacttgctgctgggacaagaaaaaaaggtagagatcagtattccagccagttcactccctagattgacaccatggattgtggcagtggcagtgatcctgatggttctgggcctgctgacgatcggttcgatcttttttacttggaggctctataatgagcgcccccgtgaacggagaaacgaatttagcagcaaggaaagactgctggaggaactgaaatggaagaaagccacgctgcacgctgtcgacgtgacactggaccctgacactgcccatcctcatctgtttctttacgaggactctaagtcagttaggctcgaagacagccggcagaaattgcccgaaaaaactgagcggttcgacagttggccttgtgttctgggcagagagacctttactagtggccgtcattattgggaggttgaagtgggagacagaaccgactgggccattggcgtctgccgggaaaacgtgatgaagaaagggttcgatcctatgacccccgagaacggattttgggcagtagagctgtatgggaatgggtattgggcactcactccactcaggacaccactgcctctggccgggccaccccgacgcgtgggcatttttctcgactatgagtctggagacataagcttttacaacatgaatgatgggtcagacatttatacattttctaatgtcacagtcatcgcaaatgcccaagacctttcaaaggaaatccctctctccccaatgggcgaggatagcgctcccagagatgccgacacccttcactctaagctaattcccactcaaccttcacagggcgccccctag

SEQ ID NO: 180903 - DNA, 1590 bp, Artificial Sequence
  Description of Artificial Sequence: Synthetic coding sequence
atggagagcgccgccgccctgcacttcagccggcccgccagcctgttgctgctgctcctgtctctatgcgccctggtttcagctcagttcatagttgtcggccccacagatccaattttagccacagtgggagagaatactactctgagatgccatctctcccctgagaaaaatgcagaggatatggaagtgcggtggttccggagccagttctcgccagcagtgttcgtgtataagggcggtagggaacggactgaggaacagatggaggaatatcgagggcgcactacctttgtgtcaaaagatatctcgaggggttctgtggcactggttatacacaatatcacggcacaggagaacggcacatatagatgttatttccaggagggtaggagttacgacgaggctatccttcacttggttgtggccgggcttggatccaagcctctcatctcaatgcgcgggcacgaagacggagggattcgtttagagtgtattagtcgggggtggtacccgaagcctctcactgtgtggcgggatccatatggtggggttgcgccagcactcaaagaggtgtccatgcctgacgccgatggtctcttcatggtgaccaccgccgtgatcattagggataagtcagtacgaaatatgtcctgcagcataaacaacaccttgttggggcagaagaaagagtctgtgatcttcatcccagaatctttcatgccatccgtgtcgcctccgatcgctgtgtgcatctactggatcaataagctgcagaaagaaaagaaaattctcagtggcgagaaagagttcgaaagggaaacaagagagatcgctttgaaggaactggaaaaagagagggtgcaaaaggaggaggagctccaagtgaaggaaaaattacaagaggagctgcggtggcggagaacgtttcttcacgcggtggacgtggttttagacccagatactgcccacccagatctgtttcttagcgaggatcggcgatcagttagacgctgtccatttaggcacctgggagagtcagttccagacaatccggagaggttcgattcacagccgtgtgttttaggcagagagtccttcgccagcggcaaacattattgggaggttgaggtggagaatgtgatcgagtggacggtgggggtgtgcagggacagcgtggaaaggaagggcgaggtgctacttattcctcagaacgggttttggacattggagatgcacaagggacaataccgagccgtttcctcccccgacaggattttgcccctcaaagaatctctatgccgggtgggcgttttcttggattacgaggccggggacgtatccttttataacatgagagatcggagccacatctacacttgccctcgctctgccttctcagggccggatacaagtcagagcggagacccgcccgagccgatcgaatcaattccttggagtcattcacacgtcgataagccttggtcttcccagcagccacctcataacacacacctgcccgctgcctcgttcactcccacaacagacctctcaccttccttcctacttttgacacgactgtgcttctag

SEQ ID NO: 180904 - DNA, 1584 bp, Artificial Sequence
  Description of Artificial Sequence: Synthetic coding sequence
atggagagcgccgccgccctgcacttcagccggcccgccagcctgctgttgttgctgctgagcctttgtgctttagtgtctgctcaatttattgtggtggggcccaccgacccaatcttagccaccgtgggagaaaacacgaccctccgatgtcacctgagcccggaaaaaaacgctgaagatatggaagtcagatggttccggagtcagttctctccggccgtctttgtctacaaggggggacgggaacgcaccgaggaacagatggaagaataccgcggacgcacaacttttgtcagtaaggatatatctcgggggagtgtggcactggtaatacacaacatcaccgcacaggagaatggaacataccgctgttactttcaggaggggcggagctatgacgaggcaattttacatctagtggtcgcagggctgggctctaaaccccttatctcaatgcggggccatgaggacggcggtattcgtttagaatgcatatcacgcggctggtacccaaagcctttaactgtctggcgcgacccatacggtggggttgcaccagccctcaaggaagttagtatgccggatgcagacggcctgttcatggttacaactgctgttattatccgcgataagtctgtccgaaatatgtcttgcagcattaataacactctactgggacagaagaaagaatcagtgatctttattcctgaaagctttatgccgagtgtttcaccgtgtgcggtagctttgcccatcattgtggtcatccttatgattccaattgctgtttgcatatattggataaacaagttacaaaaagaaaaaaaaatcttgagcggcgaaaaagaatttgaaagagagacacgggaaattgccttgaaagagctggaaaaagagcgtgttcaaaaagaagaagagctgcaggtgaaggagaaactacaggaggagcttcggtggcgcaggacattccttcacgccgtcgacgtggttctcgatccggacaccgcacacccagacctctttctctcagaggataggaggagcgtccgacgatgcccatttaggcatcttggggaatctgtgccagataaccctgagagattcgacagccagccttgtgtcttgggccgggagagttttgccagcggcaaacattactgggaggtggaagtggaaaacgtgattgaatggaccgtaggcgtttgtagagactccgtggagcgcaaaggcgaagtgttactgatcccacaaaacggtttctggaccctcgagatgcataaaggacagtatagagccgtctccagcccagaccggatcctcccgctcaaggaaagtctttgtagagtcggagtctttctggattacgaagcaggcgacgttagtttttataacatgcgcgatcgctcacacatctatacatgtccacggtccgctttctctgtgcctgtgagaccattttttcgactcggttgcgaagactcgcctatttttatctgccctgcactcactggtgctaatggcgtaacagttccagaggagggactgaccctgcacagggtcggtacccatcagagcctctag

SEQ ID NO: 180905 - DNA, 1005 bp, Artificial Sequence
  Description of Artificial Sequence: Synthetic coding sequence
atggagagcgccgccgccctgcacttcagccggcccgccagcctgctattgctgctgctcagcttgtgtgctctggtttcggcgcagtttatcgtcgtcggaccaaccgaccctatcctcgccaccgtgggcgaaaacacaaccctgaggtgccacctctcccctgagaaaaacgccgaagacatggaggtgcgatggttcagatcccagttttcccccgcagttttcgtgtacaagggaggtcgggaaaggacggaagaacaaatggaggaataccgcggacgcacaaccttcgtttccaaagatatctccagaggcagtgtggcactggtgatccacaacataacggcgcaggagaacgggacctaccggtgttatttccaagaagggcggagttatgacgaagctatactacaccttgtggtggcaggattgggttctaagcctttaatctctatgagagggcatgaggacggtgggattagactggagtgcatcagtagaggctggtatccaaagccgctgactgtctggcgggacccatatgggggagttgcacccgctttaaaggaagtgagtatgcctgacgccgacggtctgttcatggtgactacagccgtcatcatccgggacaaatccgttagaaatatgagctgcagcatcaacaacacacttctgggacaaaaaaaggaatccgtgattttcattcccgagtcttttatgccatccgtgagcccctgtgcagtggccctgcccataatcgtggtgattctcatgattccaattgccgtgtgcatttattggattaacaagttacagaaagaaaagaagattctttccggggaaaaggaatttgagcgagagaccagggagatcgcattgaaagagctggagaaggaacgagtgcaaaaggaggaggaactgcaggtgaaagagaaactacaggaagagctgcggtggcgccgcacattcctgcatgcagagctacagttcttttcgaattag

SEQ ID NO: 180906 - DNA, 993 bp, Artificial Sequence
  Description of Artificial Sequence: Synthetic coding sequence
atggagagcgccgccgccctgcacttcagccggcccgccagcctgttgctgctcctactgagcctgtgcgcactggtgtcagctcagttcattgtggtaggaccaaccgatcctatactcgcgacagttggtgaaaacaccacgctgagatgtcacctttctcctgagaagaacgccgaggatatggaagtgcgctggtttagatcacaattcagccccgctgtattcgtttacaaaggtggacgcgagaggactgaagagcaaatggaagaatacagggggcggaccactttcgtgagtaaggacataagccgaggaagcgtggctcttgtgatacacaatattaccgcgcaggagaatggcacatacagatgttatttccaggaagggcggtcatacgacgaggctatactgcacctggttgtagcgggactaggctctaagccactcattagcatgcgcgggcacgaggacggtggaatccggctggagtgcatttctagggggtggtacccaaagccacttaccgtttggagggacccatatggcggtgtagcaccagctttaaaggaggtgagtatgcccgatgccgatggactcttcatggtaacgactgctgtcattattcgggacaaatctgtccgaaatatgtcttgttcgatcaataacactctattaggtcagaaaaaggagtcagtaatttttatccccgagtcttttatgcctagcgtttcgccttgtgcagtcgccctcccgattatcgtggtgatacttatgattcccattgcggtgtgcatctactggatcaacaagttacaaaaagagaaaaagatcttgagtggtgaaaaggaatttgaacgcgaaacccgggagatcgcgctgaaagaacttgagaaggagcgcgtgcagaaggaagaggagcttcaagtgaaagagaagttacaagaggagttgaggtggcgcagaaccttcctgcacgcgggccctgtctag

SEQ ID NO: 180907 - DNA, 1401 bp, Artificial Sequence
  Description of Artificial Sequence: Synthetic coding sequence
atggaggtgcggtggttccggagccagttcagccccgccgtgttcgtctacaaggggggcagggagcgcaccgaggaacagatggaggagtaccgcggcaggaccacattcgtgtcaaaggacatttcacgaggatccgtcgctcttgtgatccataatatcacagctcaggagaacggcacctatcgttgctatttccaggaaggacggagctacgatgaagcaatcctgcacctcgtggtggccggtcttggcagtaaaccactgataagcatgcgtggccatgaggatggcggcattcggctggaatgtatatcaagaggctggtaccctaaaccactgaccgtgtggagagatccctacggtggagtggctcccgcattgaaggaagtgtccatgccagatgcggatggcctgtttatggttactaccgctgtgattatccgcgacaaatcagtcaggaacatgagttgtagcattaacaacaccctcctcgggcaaaagaaagaaagcgtgatttttatccctgaaagctttatgccaagcgtttcaccctgtgccgtcgcgctgcctatcattgtagtgattctcatgatccctatcgccgtctgcatttactggatcaataaactgcagaaggaaaagaaaattctctcaggggagaaagagtttgaacgcgagacccgcgaaatcgcacttaaggagctggagaaggagagggtccaaaaagaggaggagctgcaggtcaaagagaagcttcaggaggaactccgctggaggcggaccttcttgcatgccgtagatgtggttctcgacccggatacagcacatcccgacttgttcctttcagaggacaggcgatcagtgaggaggtgtccattccggcatttaggggagtccgtccccgataaccccgagagatttgatagtcaaccttgcgttcttggacgagaaagctttgcctccggtaagcactattgggaagtagaagtggaaaacgtcatcgagtggacagtaggcgtgtgtcgcgatagcgttgagaggaaaggggaagttcttctcattccccaaaatggtttctggaccctggaaatgcacaaggggcagtatcgcgccgtatcaagcccagatcgaattctgccactgaaggagtccctgtgcagagtgggtgtttttctagactacgaggccggcgatgttagcttttataacatgagagatcggagccacatctatacttgtcctagatccgcattcagcgtgccagtgcgcccctttttccgacttggctgtgaggacagccctatattcatctgcccagccctcactggggccaacggagttactgtcccagaggaaggcctaactttgcacagggtgggcacacaccagtcactgtag

SEQ ID NO: 180908 - DNA, 1224 bp, Artificial Sequence
  Description of Artificial Sequence: Synthetic coding sequence
atggagcccgccgccgccctgcacttcagcctgcccgccagcctgctgttgctcctcctgctcctgctcctcagcttgtgtgcgctggtgagtggcctcggatccaagccgctgatcgaaatcaaggcccaggaggacggtagcatctggctggaatgtattagtggcggatggtatccggagccacttaccgtgtggcgagacccttatggagaagtcgttcccgctctgaaagaggtgagcatcgccgatgccgacggtctgtttatggtgacgaccgcggtgattatcagagacaagtacgtccggaatgtgtcctgttccgtgaacaataccttgctgggtcaggagaaggaaacggtcatattcattcccgagtcattcatgccctcggcatctccgtggatggtggccctggcagtaatacttacagcgtcaccttggatggtatccatgaccgtgatcttggcggtcttcatcatttttatggcagtttcaatctgctgtatcaagaaacttcagagagagaaaaagatcttgtctggggaaaagaaggtggagcaggaagaaaaagagatcgcacagcagttgcaagaagaactgcggtggaggcgcactttcctgcatgctgccgacgtggtcctggatcccgacactgcacatcccgagctgtttcttagtgaagatcgacggagtgtccggcgcggaccttacagacagagggtgcctgacaacccagagagattcgattcccagccctgcgttctggggtgggagtcgtttgccagcggtaagcactattgggaagtggaggttgagaatgtgatggtttggacggttggagtgtgccgacattccgtagaacgcaaaggagaagttcttctgattccccagaacggtttttggaccctggaaatgttcggcaatcagtacagagctctctcttctcccgaacggatcttgccgctgaaggaaagcttgtgtcgcgttggggtctttctcgattacgaagccggggacgtttccttctacaatatgcgtgatcgttcacacatctacacatgcccgagaagtgcattcaccgtacccgtccggcccttttttcgattagggagcgacgactcgcccatatttatttgtccagctctgactggagcaagtggagtgatggtacccgaggagggcttaaaactacaccgggtgggcactcatcagagtctgtag

SEQ ID NO: 180909 - DNA, 1572 bp, Artificial Sequence
  Description of Artificial Sequence: Synthetic coding sequence
atggagcccgccgccgccctgcacttcagcctgcccgccagcctgctgctcctgctgctactgctgttattaagcttatgcgcattggtatctgcgcagttcaccgttgtgggccctgccaatcctattctagcaatggtgggcgagaatactacactgaggtgccacctcagccccgagaagaacgccgaggatatggaggttaggtggttccggagccagttttctccggcagtgtttgtgtacaaaggaggccgagagcgaacagaggaacaaatggaagaatatcgcggcaggataactttcgtatccaaagatattaaccgcggaagcgtcgcactggtgatccacaacgtgactgcacaagaaaatgggatctacaggtgctacttccaggagggccgctcttatgacgaagccattctgcgtttagtagtcgccggcctgggcagtaaacccctcatcgaaatcaaagcccaagaggatgggtcaatttggcttgagtgcatcagcggtgggtggtacccagaaccattaacggtttggcgcgacccttatggagaggttgttccagccctgaaggaggtgtcaatcgccgatgcagacggactgttcatggtgacgaccgccgtgattatccgtgataaatacgtgcgtaatgtatcctgctccgttaacaatacgctgcttggccaggaaaaagaaactgtgattttcattcccgagagcttcatgccttccgccagcccatggatggtggcactcgcagttatcctgacagcatccccttggatggtcagtatgacagtcattctagccgtcttcatcattttcatggctgtgtcaatctgctgtatcaaaaaactccaacgggagaaaaagatactcagtggcgagaagaaagtggaacaagaagaaaaggaaatcgcacagcagcttcaggaagaactgagatggcgcaggacattcttacacgccgcagatgtggttctggaccccgataccgctcatcccgagcttttcctgtctgaggacagacgcagcgtccgacgaggcccttaccgccagcgggtgccagacaaccctgagcggtttgactcccagccttgtgtgctgggctgggaatctttcgcctccggaaagcactactgggaagtggaagtggagaacgtgatggtctggaccgtgggcgtttgcaggcacagcgtggaaaggaaaggggaggtgctgctgatcccgcagaatggattctggacacttgagatgttcggcaaccagtatcgcgctctctcctccccagagaggatcttgccattgaaagagtcactgtgcagagtcggcgtgtttttggattacgaggcaggggacgtgagcttttacaatatgcgcgaccgaagtcacatttacacttgtccgcgctcagctttcactgtaccagtgaggcctttctttcgtttgggaagcgatgatagtcctatattcatatgtccagccttgacaggcgccagcggagtgatggtgcccgaagagggcctgaaactgcatagagtaggtacgcaccagagtctgtag

SEQ ID NO: 180910 - DNA, 1572 bp, Artificial Sequence
  Description of Artificial Sequence: Synthetic coding sequence
atggagcccgccgccgccctgcacttcagcctgcccgccagcctgctgcttttactccttcttctcttgctgtctttatgcgcactggtcagcgcacaattcaccgtcgtgggacccgcaaaccctattttggcgatggtcggagagaataccactctacgctgtcacttgagcccagagaagaacgctgaagatatggaggtccggtggttcagatcccaattctcgccagccgtttttgtgtataaggggggcagagaaaggaccgaagagcaaatggaagagtacagagggcggatcacttttgtctccaaggacattaacagaggctccgtagcccttgtcatccataacgtcaccgcacaagagaacggcatttatcggtgctattttcaagagggaagaagttatgatgaggctatcctccgattagtcgtggctgggctcggctcaaagcccttgatagaaattaaagcccaagaggacggcagtatttggctggagtgtatttccggcgggtggtacccggagcctctgacagtttggcgcgatccatatggagaagtagtccccgcgctgaaagaggtatcaatagccgacgccgacggactgttcatggtgaccaccgcagttataattcgggataaatacgtgcggaacgtttcttgcagcgtgaataacaccctgctggggcaggaaaaggagaccgttatcttcattcccgagtcattcatgccttcggcctccccatggatggtggccctggccgttattctgaccgcatctccatggatggtcagcatgactgtgattctggccgtgtttattatcttcatggcagtgagcatctgttgcatcaagaagctgcaacgggaaaagaagattcttagtggagagaaaaaggtggagcaggaggagaaagagattgcccagcagttgcaggaagagttgcggtggcgtcgcacttttctgcacgccgcagatgtcgtcctggaccccgacaccgcacaccctgagctgttcctatccgaggaccgaagatcagtgcgacggggtccctataggcagcgcgtacccgataaccccgagagattcgactctcagccctgtgttctgggatgggagtcctttgccagtggcaagcactattgggaggtggaagtcgagaacgtgatggtgtggacagtcggggtatgtcggcattctgttgaacgcaagggggaagtactgctcataccgcagaatggattctggaccctcgagatgtttggcaaccagtatcgggccttgagctctccggagcgcatccttccgttgaaggaaagcctgtgtagggtaggagtcttcctagactatgaggcaggcgacgtctctttctacaatatgagagatagatcccatatctatacatgtccacgatcggctttcactgtgcctgtcaggcctttctttcgcctcgggagtgacgactcccccatcttcatttgtcccgcactgacaggcgctagcggcgttatggttcccgaagagggcctgaaactgcatcgcgtaggcacccaccagtctctgtag

SEQ ID NO: 180911 - DNA, 1011 bp, Artificial Sequence
  Description of Artificial Sequence: Synthetic coding sequence
atggagcccgccgccgccctgcacttcagcctgcccgccagcctgctgttgctattgcttctgctcctcctgagtctgtgcgcattggttagtgcccaattcacagtggttggacctgctaatcctatcttggccatggtcggtgagaacactaccttgagatgccaccttagtccagagaagaacgctgaggatatggaagtccgctggtttcggtctcagttctcacccgctgtctttgtatataaaggcggaagggaacgtacagaagagcaaatggaggagtatagggggcgcatcacttttgtgtcaaaggatattaaccgcggatctgtggcccttgtaattcataacgtgactgctcaggagaatggaatataccgctgctactttcaggaaggacgcagctatgacgaagcaattcttagattggtcgtggccggactgggatccaagccccttatcgagatcaaagcacaggaggatggcagcatctggcttgagtgtatttcagggggctggtatccggagcctctgactgtgtggcgggatccctatggcgaggttgtgccagcattgaaagaggtatcaatcgccgacgccgacggtctgttcatggtaactactgcagtgattattcgggacaaatacgtcaggaatgtttcatgctctgtcaataacacgctactcgggcaagaaaaggagacagtgatcttcattccagagagcttcatgccaagtgccagcccttggatggtcgcattagccgtgattctgaccgcttcaccatggatggttagtatgacggtcatcctggccgtgttcattatcttcatggctgtcagcatctgctgcattaagaaactacagagagagaaaaaaattctgagcggtgagaagaaggtcgagcaggaggaaaaggagatcgcacagcaactgcaggaggaattacggtggaggcgaactttcttgcatgccgatgttaacctcacagggctgagaaacacatag

SEQ ID NO: 180912 - DNA, 333 bp, Artificial Sequence
  Description of Artificial Sequence: Synthetic coding sequence
atggagcccgccgccgccctgcacttcagcctgcccgccagcctgctactcctgctactgctgctcctactgtccctgtgtgctttagtgtccggtctcggcagtaaacccctgatagaaattaaagcccaggaagacggctccatttggctggagtgtatatcaggaggctggtaccctgaaccactgacagtgtggagggacccatatggggaagttgtcccggcactgaaggaggtaagcatcgcggacgcagatggcctgtttatggtgacaaccgctgtgatcattagggataagtacgtgcgcaacgtcagctgcagcgtcaactag

SEQ ID NO: 180913 - DNA, 555 bp, Artificial Sequence
  Description of Artificial Sequence: Synthetic coding sequence
atggagcccgccgccgccctgcacttcagcctgcccgccagcctgctgctacttctgctcctcctactgctgtccctctgcgccctcgtgagtggccttggctccaagccgttaattgagataaaggctcaggaagatggctccatctggctcgaatgtatctctggtggctggtatcctgagcctctgaccgtctggagagatccctacggggaagttgtccctgcactcaaggaagtcagcatcgcagacgctgatgggctgttcatggtcactacggctgtcattattcgggacaaatatgtgcgaaacgtgtcttgttcggtgaacaacactttgctcgggcaggagaaggagaccgtcatcttcattcctgaatcttttatgccaagcgctagtccgtggatggtggccttggccgttatcctcaccgccagcccttggatggtgagcatgactgtgattcttgccgtgttcatcatctttatggccgtgtcaatatgttgcattaaaaagttgcagcgcgaaaaaaaaattttatccggcgagaagtag

SEQ ID NO: 180914 - DNA, 720 bp, Artificial Sequence
  Description of Artificial Sequence: Synthetic coding sequence
atggagcccgccgccgccctgcacttcagcctgcccgccagcctgcttctgctgctgctgttgctcttgctcagcctgtgcgcgctcgtaagtgcccagtttactgtggtagggcctgccaatccaattttggcaatggtgggcgagaacacaacattgcgctgccacctgtcccctgagaagaatgcggaagatatggaggtacggtggtttagatcccagttttctccagccgtgtttgtgtacaagggcggcagagaacggaccgaagaacagatggaagagtatcgcgggcggattacctttgtgagtaaggacatcaatagaggttctgtcgcactagtcattcacaatgtgactgcacaagaaaatggcatctatcgctgttacttccaagagggccgaagctatgacgaagccatcttgcgccttgtggtcgccggcctgggatctaagcccctgattgagataaaagcccaggaagacggttctatttggctggaatgtatttcaggcggatggtacccggaaccacttaccgtttggcgagacccgtacggcgaagtggtgccagccttgaaggaggtcagcatcgccgatgccgatgggctgtttatggtgactacagcagtcatcattcgggataaatatgtgcgaaacgtgagctgctccgtgaataataccctcctcggtcaggagaaggagaccgtgattttttag

SEQ ID NO: 180915 - DNA, 291 bp, Artificial Sequence
  Description of Artificial Sequence: Synthetic coding sequence
atggagcccgccgccgccctgcacttcagcctgcccgccagcctgctcctgcttctcctcctcctgttgctgagtctttgtgcgttggtatctgcacagttcactgttgtgggacctgcgaacccaatcctggctatggtaggcgaaaacacgacattgaggtgtcatctaagccccgagaagaatgccgaggatatggaagtgagatggtttcgcagccagttttcccctgctgtgtttgtgtacaagggcggcagggagcggaccgaggagcagatggaggagtactag

SEQ ID NO: 180916 - DNA, 1542 bp, Artificial Sequence
  Description of Artificial Sequence: Synthetic coding sequence
atgaagatggccagcttcctggccttcctgctgctgaacttccgggtgtgtctcctattacttcagctgcttatgccccattctgcccagttcagcgtgctgggacccagtggccctatcttggcaatggttggggaagacgccgacctcccctgccacctatttcctacgatgtccgcggaaacaatggaactaaaatgggtgagctcttctctccgccaagtcgtaaacgtgtatgccgatggaaaagaagtcgaggataggcagtccgcgccataccgaggaaggacttctatcctgagagatggaatcaccgccggcaaagccgcattaaggatccacaatgtgaccgccagcgacagtggaaaatatctttgttactttcaagacggcgacttttatgagaaagctttggtggaactgaaggtggccgccttgggctccgacctgcatgtagatgttaagggatataaggacggtggtatacatttggagtgccgctcaaccggctggtacccacagccccaaatccagtggagcaataataaaggggagaacattccaactgtggaggctcctgtagtcgctgatggcgtgggactttatgccgtggccgccagtgttatcatgaggggctccagtggagagggcgtctcatgcacaatcaggtcttctttgcttgggttagagaagaccgcctctatatctatcgccgacccgttttttaggagcgcccagcgctggatcgctgcgctagccggtaccctcccggtgctgttgttgttgctgggaggtgctggatactttctgtggcagcagcaggaagagaagaagacacagttccgaaagaagaaacgagaacaagagctaagggagatggcatggtcgacaatgaaacaagagcagtctactcgggttaagttgctcgaggaattgcggtggcggtcaatccaatatgcatcccgtggagagagacatagtgcgtataacgaatggaagaaagctcttttcaagccagccgatgtcattctcgacccaaagaccgccaatcctatcttgcttgtgagcgaggaccagaggagcgtgcagagagcaaaggaaccgcaggacctgcccgacaaccccgaacgatttaactggcactattgcgtgctcggctgcgagtccttcatttccggcagacactactgggaagttgaagtcggtgaccgcaaggaatggcatatcggagtctgtagcaaaaacgtacagcgtaagggatgggttaagatgacgcccgaaaacgggttttggaccatgggtctcactgacggtaacaagtaccggacgctgaccgaacctaggaccaacttaaaactccccaaacctcctaagaaagtcggagtctttctggactatgaaactggcgatatctcattctataatgcggtggatggcagccacatccacactttcttggacgtcagcttcagtgaggcactgtaccccgtcttccgaattctaacacttgagccaaccgccctaacgatttgtcccgcctag

SEQ ID NO: 180917 - DNA, 1386 bp, Artificial Sequence
  Description of Artificial Sequence: Synthetic coding sequence
atgaagatggccagcttcctggccttcctgctgctgaacttccgggtttgcctcctgctgctgcagcttctcatgccccattcagcacagttctcggtcttaggtccaagcggaccaatcctcgctatggtgggagaggatgcggacctaccttgccatctgtttccaaccatgtccgccgagacgatggagctgaagtgggtgtcctcttccctgaggcaggtggtgaatgtctatgctgacggaaaggaagtggaggaccggcagtccgccccttatagggggagaacatctattttgcgcgacggaatcaccgcgggcaaggccgctctccggatccacaatgtcactgcatctgattccgggaaatacctgtgctacttccaggatggagacttttatgagaaagcgctagtggaactgaaagttgccgacggggtaggcctctatgctgtcgcagcctctgtgatcatgcgcggaagttcaggagagggtgttagttgcaccataaggtcttctcttcttggactggagaagacagctagtatctctatagccgatcccttcttccggtctgcccagcggtggattgccgcgctagcaggcacactgcccgtcttgctgctgttactcggaggagcaggatattttctgtggcagcagcaggaagagaagaaaacacaattcagaaaaaaaaagagagagcaggagctgcgggagatggcttggagtacaatgaagcaagaacagagcacccgggtcaaacttctggaagagctgaggtggcgaagcatccagtatgcatcccgtggcgagcgacacagtgcatacaatgagtggaaaaaggccctctttaagcccgccgatgtcatcctggaccccaaaactgcaaatcctattttactggtatccgaggatcagcgttctgtgcaacgggcaaaagaacctcaggacctccccgacaatcccgagaggttcaattggcactactgtgtgctgggttgtgagtcctttatcagcggacgccattactgggaagtggaggtgggtgatcgtaaagagtggcatattggggtttgcagtaaaaacgtacaaaggaaggggtgggtgaaaatgacccccgagaacggtttctggactatgggtctgacggatggcaacaaataccgcacattgacagaaccacggaccaatctgaagttgccaaaacccccaaaaaaggtgggggtcttcctggactatgaaacaggggacatttccttttataacgccgttgatggatcccacatccatacgttcctggacgtttctttttcagaggccctgtacccggtattcaggatactcaccttggagcccacagctctaacaatatgtccagcttag

SEQ ID NO: 180918 - DNA, 1137 bp, Artificial Sequence
  Description of Artificial Sequence: Synthetic coding sequence
atgaagatggccagcttcctggccttcctgctgctgaacttccgggtttgtcttcttcttctgcagctccttatgcctcacagcgcccagttttcagtacttgggccgtccggacctatcctagccatggtgggggaggacgccgatctgccatgtcatctgttcccgactatgagcgccgaaaccatggagctgaagtgggtgagttcgagcctccggcaagtggtaaacgtgtacgccgatggaaaggaggtggaggaccggcaaagcgccccttaccgggggagaacctccatactgcgggacggtatcacagccggcaaggccgcactgcgaatccataacgttactgcatccgattcaggcaaatatctgtgttatttccaggatggcgacttctacgaaaaggccctcgtggagctcaaggtcgcagcgttaggtagtgatctccatgtggacgtgaagggctacaaagacggtggtatccatctggagtgcaggagcacaggatggtacccccagcctcagatccaatggtcgaataacaaaggcgagaacatccctacggttgaggctcccgtcgtggccgatggcgttggactgtacgccgtcgccgcaagcgtgattatgcgaggttccagtggtgagggcgtgtcttgcacaatcagatcctctctgctgggcctggaaaagacagcctcgatttcgattgcagacccttttttccgctccgctcagcggtggattgcggcactggctggaactctcccagtgcttttactcctgttggggggcgctggatactttctttggcagcaacaggaggagaagaagacgcagtttcgcaagaagaagagggagcaggagcttcgggagatggcctggtctaccatgaaacaggagcaaagcactagagttaaactgttagaagaactgcgttggcggtcaatacagtacgcatcccggggcgagcgtcactccgcgtacaacgagtggaagaaggccctctttaaacccggccccccaattggccagacacagcaacagacccggggtcaaggttcgccagtggccctcagtcaggagtcggctcagcgaacagactcttggggacccgaggagggaggtgagagttag

SEQ ID NO: 180919 - DNA, 132 bp, Artificial Sequence
  Description of Artificial Sequence: Synthetic coding sequence
atgaagatggccagcttcctggccttcctgctgctgaacttccgggtttgtctgctactcctgcagctgctgatgcctcacagcgcacaattctctgttctcggaccctcaggcccaatcctggctatgtag

SEQ ID NO: 180920 - DNA, 360 bp, Artificial Sequence
  Description of Artificial Sequence: Synthetic coding sequence
atgaagatggccagcttcctggccttcctgctgctgaacttccgggtctgtttgttacttctgcagcttctcatgccccactcagcacagttcagtgtgctcggcccctcgggacccatcctggccatggtgggcgaagatgcggacctgccttgtcatctttttcctactatgtctgcagagacaatggagcttaaatgggtgtctagtagtctccggcaggtggtcaatgtctatgctgacggcaaagaagttgaggatagacagagcgcgccctacagagggcgaaccagtattttgcgagacggtataactgcaggcaaggcagccctccgcatccacaacgtgacggcctcttag

SEQ ID NO: 180921 - DNA, 1059 bp, Artificial Sequence
  Description of Artificial Sequence: Synthetic coding sequence
atgaagatggccagcttcctggccttcctgctgctgaacttccgggtgtgtcttctcctcctccaactgctgatgccacacagcgcgcagttttcagttttgggaccctccggtcccatcctggccatggtaggtgaagatgctgacttgccctgccacctgtttcctacaatgtctgctgaaactatggagcttaaatgggtgagcagttccttacgtcaagtggtgaacgtctatgccgatggcaaggaagtagaggacagacagagcgctccttatagaggacggacttcaatactgcgggacggaatcaccgcaggtaaggcagccctgcggattcacaatgtcactgcatctgatagcgggaaatatctgtgttattttcaagacggcgatttctacgaaaaggccctagtggaactgaaagttgcagctctcggcagcgatttacacgtggatgttaagggttacaaagatggcggaatccaccttgaatgccgatctacaggctggtacccccagccacagattcagtggtcaaataacaaaggagaaaatatcccaacagtcgaagctcctgttgtggccgatggcgttggactgtatgctgtggccgcgagtgtaatcatgaggggttcatccggagaaggcgtgtcctgcacaattcggagcagtctgctgggactcgagaagacagccagtatttccatagcggatcctttcttcagaagcgctcagcgctggatcgccgctctcgcaggaacgttaccggtactgcttttgctgctggggggagcagggtactttttgtggcagcagcaggaggagaagaagacgcagttcagaaagaagaagagagagcaagagctgagagaaatggcttggtctacaatgaaacaggaacagagtaccagggtaaaattgctcgaggaactgcggtggaggtcaatacagtacgccagccggggcgaaaggcatagcgcttataacgagtggaaaaaggcattgtttaaaccaggcgaggagatgctgcaaatgcgactgcacttcgtgaaatag

SEQ ID NO: 180922 - DNA, 279 bp, Artificial Sequence
  Description of Artificial Sequence: Synthetic coding sequence
atgaagatggccagcttcctggccttcctgctgctgaacttccgggtgtgcctcttgttgctgcagctccttatgccacattccgcacagttttctgtgttaggtccatccgggccaattctggctatggtgggagaagatgcagatcttccctgtcacctctttccaaccatgtccgcagaaaccatggaactcaagtgggtgtcttccagcttgcgtcaggtcgtcaatgtgtacgcagacggcaaggaggtcgaggacaggcagtcggccccctag

SEQ ID NO: 180923 - DNA, 1005 bp, Artificial Sequence
  Description of Artificial Sequence: Synthetic coding sequence
atgaagatggccagcagcctggccttcctgctgctgaacttccacgtttctctgctcctcgtgcagctgctgaccccttgcagcgctcagttctccgtcttgggaccctccggaccaatcctggcaatggtcggagaagatgcagacctcccctgtcatctttttcccaccatgtcagcagagaccatggaactgaagtgggtgtctagtagtctgcgacaggtggttaacgtatatgcagatggaaaagaagtcgaagatcgtcagtccgctccgtacagaggccgaacaagtatccttcgtgacggaatcacggcggggaaagctgcgctacgcatacacaatgtgactgcctcagattctggcaaatacctctgttattttcaagacggagatttctacgaaaaggccctggttgaactaaaagtggcagccttaggtagcaacctccacgtcgaagtcaaagggtatgaggatggcgggatacacctggagtgtcgctctacaggctggtatccccaacctcaaatacagtggagcaatgctaaaggggaaaacattccagcagtcgaagccccagttgtggccgatggggtcggcctgtacgaggtggccgcatctgtaataatgaggggcggtagcggagaaggggttagctgcatcattaggaactccctgctcggcctggaaaaaacggcatccatcagcatcgccgacccctttttcaggtcagcccagccgtggatcgctgcgctagctggcactcttcccatattgctcttgctgttggctggcgcatcttattttctatggaggcaacagaaggaaattaccgcgttgtcaagcgaaatcgaatctgaacaagagatgaaggagatgggatatgcagcaactgagagagagatcagcctcagggagtctcttcaagaagagttaaaaaggaagaagatacagtacctgactcgaggggaagagagcagttccgataccaacaagagtgcttag

SEQ ID NO: 180924 - DNA, 1005 bp, Artificial Sequence
  Description of Artificial Sequence: Synthetic coding sequence
atgaagatggccagcagcctggccttcctgctgctgaacttccacgtgagtctgctcctggtgcagctacttacaccctgtagcgcccagttctctgttctcggcccatcaggcccaatcttggcaatggtcggtgaggatgcagatcttccttgtcatctatttccaacaatgtccgctgaaaccatggaattgaaatgggtttcttcgagtttgcgtcaagtggtgaacgtatacgcggatggaaaggaagttgaggaccgacaatctgcaccttatcgcggaaggactagcatcctgcgtgatggcataacggccggaaaagcagcactcaggatccataacgtgaccgcctctgatagtggaaagtacctctgctatttccaggacggtgatttctatgagaaggccttggtggagctcaaagtggccgccctaggcagtaatcttcatgttgaagtgaaaggttacgaggacggcggcattcatttagagtgcaggtccacgggttggtacccccagccccagattcaatggagtaacgcaaagggagaaaacatcccggcagtggaggcgcccgtggtcgccgacggggtgggcctttacgaggtggcggccagtgtgattatgcgaggaggctccggcgagggagtaagctgcattatccgaaattctttgctcgggctcgaaaagactgcatctatctcaattgcagatcccttttttcgatcagcccagccttggattgccgcattagcagggaccctccctattttgttgttgctactcgcaggagcatcttattttttgtggaggcagcagaaagagattactgcgctgagttccgagatcgagtccgaacaggaaatgaaggaaatggggtatgccgctacagaacgggagatttctcttagggaaagccttcaggaagagctaaaaagaaagaaaatccagtacctgacacgaggcgaggagagctcttccgacacgaataaatcagcctag

SEQ ID NO: 180925 - DNA, 936 bp, Artificial Sequence
  Description of Artificial Sequence: Synthetic coding sequence
atgggcatcccccgggcccagttcagcgtgctgggccccagcggccctattctggcaatggtcggagaggatgcagatctgccatgccacctcttccctacaatgagtgccgagacaatggagctgaaatgggtgagtagctctctccgccaggtcgttaatgtctacgctgatggcaaggaggtcgaggacaggcagagtgccccgtaccgcggtcgcacctcaattctgagagatggcataaccgcgggaaaagctgctctccgaatacacaacgtcactgccagtgatagcgggaaatacctgtgttatttccaagatggagacttctacgaaaaggcgctggttgagttgaaagtcgccgcactcgggtccaacctgcacgttgaagtcaaaggctatgaggatggaggtatccacctggagtgtcggagcactggttggtacccacagccacagatccagtggagcaacgctaagggagaaaatattcccgcagttgaggctccagtggtcgccgacggcgtaggcctctatgaagttgccgcgtccgtcatcatgaggggcggaagtggagagggcgtgagttgtattatacggaatagcctgttgggcctggagaaaactgcctcaattagtattgctgatccatttttccgcagcgcccagccctggatcgctgccctggccggaacactccccatccttctattgctcctggctggggccagctacttcttatggaggcagcagaaggagataaccgcactctcatccgagattgaatctgaacaagaaatgaaagagatgggctacgccgcgaccgagagagagatatcactcagagaaagtctgcaggaggaactgaagcgtaagaagatccagtacctgacgcgtggcgaggagagcagttcagacacaaacaagtcagcatag

SEQ ID NO: 180926 - DNA, 1005 bp, Artificial Sequence
  Description of Artificial Sequence: Synthetic coding sequence
atgaagatggccagcagcctggccttcctgctgctgaacttccacgtgagccttttgctcgtgcagcttctgactccttgtagcgctcagttctctgtactcggtcccagtggccctatcctggccatggtaggcgaagatgccgacctgccctgtcatctcttccccaccatgagcgcagagactatggagctgaaatgggtgagctcatcacttcggcaagtggtgaatgtttatgccgatggcaaagaagttgaagatcgacagagcgccccctaccgcggccggacctccatcctaagagacggcatcacggccggcaaggctgccttgcggatccataacgtcaccgcttccgactctggaaagtatctgtgttacttccaggatggggacttctacgaaaaagcccttgtcgagctcaaggtcgccgcactgggctccaatctgcacgtcgaggtgaagggctacgaagacggagggatccatctggagtgccgcagcactggatggtatccccagccccagatacaatggagcaacgccaaaggggaaaatattccagccgtggaggctccagtcgtggccgatggagtgggactatatgaggtcgctgcgagcgttataatgcgcggaggttccggggaaggcgtcagctgtattatcagaaattctttgctgggcctggaaaaaactgcctctatttctatcgctgacccattctttcgtagcgcccagccatggatcgccgcgctagcaggaaccctccctatcctgcttctgctactagcaggcgcaagctactttttatggcggcaacagaaggaaattacagccttgtctagcgaaatagagtcagagcaggaaatgaaggaaatggggtatgccgctacagaacgagagatttctctgcgcgagtccctgcaagaggagctgaagcggaaaaaaatccaatatctcacccgcggcgaggagtcctcatctgacactaacaaaagcgcttag

SEQ ID NO: 180927 - DNA, 879 bp, Artificial Sequence
  Description of Artificial Sequence: Synthetic coding sequence
atggtgggcgaggacgccgacctgccctgccacctgttccccaccatgagtgcagaaaccatggaattaaaatgggtgtcgagctccctacgccaggttgtgaatgtgtacgcagacggcaaagaggtagaggaccggcagtctgccccttatagaggccgaaccagcattctgcgggacggcatcaccgccggtaaggccgctctgagaattcacaatgtgaccgcaagcgattctggcaaatacctctgttattttcaggatggtgacttttatgagaaagcgctggttgaactgaaagtggcggcactgggcagcaacttgcacgtcgaggtaaaggggtatgaagatggcggcatccacctagagtgccgcagtaccggatggtatcctcagccacagattcagtggtctaatgctaaaggggagaacatccctgctgtagaagccccagtggtggctgacggtgttgggttgtacgaggttgcggcttcagttataatgagaggcggcagcggcgaaggggtgtcctgtatcatacggaattctctacttggacttgagaagactgcgagtatttccatcgctgatccctttttccggagcgcgcaaccatggatagctgcccttgccgggacactgcctatcctcctcctcctgttagccggggcttcctactttctctggcgccagcaaaaggaaattacagcactctcttccgaaattgagtcagaacaagagatgaaggagatgggctacgcagccacggaacgggaaattagtctccgcgagtcactgcaggaggagctcaagaggaaaaagatccaatacttaacccgtggggaggaaagctcctcagatactaataaaagtgcatag

SEQ ID NO: 180928 - DNA, 1005 bp, Artificial Sequence
  Description of Artificial Sequence: Synthetic coding sequence
atgaagatggccagcagcctggccttcctgctgctgaacttccacgtttccctcttactcgtccagctcttgactccatgtagcgcacagttttcggtcctcggaccatcaggccccatcttagctatggtcggagaggatgcagatctgccctgtcacctctttccgactatgtcagcagagacaatggagcttaagtgggtgtccagttctctccggcaggttgtgaatgtctatgccgatggtaaagaggttgaggaccgacagtctgccccatacaggggacgaacaagtatcctgagggatgggatcaccgctgggaaagcagctctgagaatccacaatgtgactgctagcgactcaggaaagtacctgtgttattttcaggacggtgacttttacgagaaggccctcgtggaactgaaagtagccgctttaggctcaaatttgcatgtggaagtcaaggggtatgaggatggtggaatccatctggaatgtagatccactggttggtaccctcagccacagattcagtggagcaatgctaaaggtgagaacatacccgctgtggaggcacctgttgtggccgatggtgttgggctttatgaggtcgccgcgagtgtgattatgcggggtggcagcggggaaggcgtgtcttgcatcatcagaaacagtctgcttggattggaaaaaacagccagcatttctattgccgaccccttctttcgtagcgctcagccatggatcgccgctctggccgggaccctgcccatcctgttgctgttgttggcaggtgccagctacttcctgtggcggcagcaaaaagaaattacggctctgtcttctgaaatcgaatcagaacaagaaatgaaagagatgggctatgccgcaacggaacgcgaaatctcccttcgggagagtctgcaggaagagctgaagcggaagaagatacagtacttaacgcgcggagaggaatccagctccgatacaaataagagcgcttag

SEQ ID NO: 180929 - DNA, 960 bp, Artificial Sequence
  Description of Artificial Sequence: Synthetic coding sequence
atgaagatggccagcagcctggccttcctgctgctgaacttccacgtgtcattactcctcgtgcagctgctaacgccatgctcagcacaatttagcgtgttaggaccaagcggcccgattctggcaatggtgggcgaagacgctgatctgccatgtcaccttttcccaactatgtcagccgagaccatggaactcaagtgggtgagcagctcactccgccaggtagttaacgtgtacgctgacgggaaagaagtagaggaccggcaatcagccccttaccgtggacggacctctattctgcgtgacggcattactgctgggaaggccgctctgcgaatccacaatgtgaccgcttcagacagcgggaagtacttgtgctacttccaggatggcgatttctatgaaaaggccctggtggagttgaaggtcgccgctctgggatcaaatttacacgtggaagtaaaagggtatgaggatggcggcattcacctggaatgtcgatccacgggctggtatccgcagccccagatccagtggtccaatgccaagggtgaaaacatcccagccgtggaagcaccagtcgtggcggatggggtcggtctgtatgaggtggccgcctccgtaatcatgcgcggggggtcaggggaaggcgtcagctgcatcatccgcaacagcctgctggggttggagaagactgcatcaatttctatcgccgacccattttttcgatcagctcagccgtggatcgccgcactggccggaaccctgcctatcttgctgcttctcctggccggtgcctcttatttcttatggcggcagcagaaagagattacagcattatcttctgaaattgagagtgagcaggagatgaaggagatgggctacgccgccactgaaagggaaatttctctacgggagagcttacaggaggaactgaaacgtaagaaatccagcacctag

SEQ ID NO: 180930 - DNA, 1755 bp, Artificial Sequence
  Description of Artificial Sequence: Synthetic coding sequence
atgaagatggccagcagcctggccttcctgctgctgaacttccacgtgtccctctttctggtgcaactgctgaccccatgtagcgcccagttctccgtgctgggtccatcaggcccaatccttgcgatggtcggtgaggacgccgacctgccatgtcatttattccctacaatgtcagccgaaactatggaactgcgctgggtgtcctcctcgctgcggcaggtggtgaacgtgtatgctgacgggaaagaggtggaggatcggcagtccgcaccctatcgcggcagaacaagtatcctgcgagatggaataactgccgggaaagccgcgctgaggattcacaacgtgactgcctctgacagtggcaaatacttatgctattttcaagacggggatttctacgaaaaggctctggtggagctgaaagtggctgctctcggttcggacttacacattgaagttaagggttatgaagacggcgggatccacttagagtgtcgcagtaccgggtggtatcctcagccgcagatcaaatggtcggacaccaagggcgagaacattcctgcagtggaggcgcctgtcgtcgccgacggagtaggtctctatgctgtggcggctagcgtcatcatgcggggatccagcgggggcggggtgtcctgcattatcagaaatagccttctgggactggaaaaaacggcgtccattagcatcgccgacccattttttagatctgcacagccatggatcgccgcacttgccgggacgctcccaatttctctcctgctcttggccggagcaagttacttcctttggcgacagcaaaaagagaagatcgctctgagccgcgagaccgaacgcgaaagggaaatgaaggagatggggtacgctgctacggagcaggagatctctttacgagagaaactgcaggaggagctcaagtggagaaagatccaatacatggcgaggggagagaagagtcttgcgtaccatgaatggaaaatggctctctttaaaccagccgacgtgatcctggacccagacacagccaatgccattttactggtctcagaggaccagaggtccgtgcagagagcagaagagccgagggatctgccagataacccggaacgcttcgagtggcgatattgtgtcctggggtgtgaaaatttcacgtctggccggcactactgggaggttgaggtgggcgacagaaaagagtggcatatcggagtctgcagtaagaacgtagagcgcaagaaaggctgggtgaagatgacgcctgaaaacggatattggacgatgggactcaccgatgggaacaaatacagggctcttactgagccaaggaccaatctgaagttgccagagcccccaaggaaggttggcatcttcctggactacgaaacgggcgaaatctcattctacaatgcgactgacggaagtcacatttacactttccctcacgcctcattcagcgaaccgctgtatccagtatttcggatcctgacgctggagcctacggcccttacgatatgcccaattcccaaggaggtggagtctagccccgatccggacctcgtgccagatcattccttggagaccccactcacacctggactggctaacgagagtggggaaccccaagccgaggtgacaagcctgctgctcccagctcacccaggggctgaggtgtctccaagcgcaaccacaaaccagaatcataaattgcaagcgcgaaccgaagcactgtattag

SEQ ID NO: 180931 - DNA, 1629 bp, Artificial Sequence
  Description of Artificial Sequence: Synthetic coding sequence
atggtgggcgaggacgccgacctgccctgccacctgttccccaccatgagtgcggagaccatggaattacgatgggtatcaagttcattgaggcaggtagtcaatgtttacgctgatgggaaggaagtagaagacaggcagtcagccccttatagaggcaggacgagcatattgagagacggcataaccgccggcaaggctgcactcaggattcataatgttaccgcctcagacagcggcaagtatctgtgttactttcaggacggagacttttacgagaaggcgctggttgaactgaaggtggctgcccttgggagcgatctgcacatcgaagtcaagggttacgaagatggcggaatccaccttgaatgtcgatcaacaggatggtacccccagccgcaaatcaagtggtccgatactaagggggaaaacattcccgccgttgaggcgcctgtcgtagctgacggagtgggcctgtatgcggtggctgcctctgtgatcatgcgtgggtcctctggagggggagtgtcctgtatcatcagaaactcactcttgggcctcgagaaaactgcatcaatttcaatcgctgacccattctttcgctcggctcagccctggatagccgccttagcgggcaccctgcccataagtcttctcctgttagcgggggcgtcatactttctctggcgtcagcagaaagagaaaattgccttatcacgggaaactgaaagagagcgcgaaatgaaggagatgggctacgccgctaccgaacaagagattagcctaagggagaagctacaggaggaattaaagtggagaaaaattcaatatatggctagaggcgagaagtccttggcctaccatgaatggaaaatggccctgtttaaaccggccgatgtgatactggatccggacaccgcaaatgccatcttactcgtcagcgaagaccagcgatcagtccagcgcgctgaggaaccacgagacctaccagacaaccccgagcgttttgaatggcgatattgcgtgttgggttgcgagaatttcacttcaggacgccattactgggaagtcgaggtgggcgacagaaaagaatggcatattggcgtgtgttctaaaaacgttgagcgcaagaaaggatgggtgaagatgacgccagaaaacgggtattggaccatgggccttacagacgggaataagtatcgcgctctcaccgaaccaagaaccaatttgaagctgcccgaacccccaaggaaggtcggcatattcctggactacgaaacaggtgaaatatcattttataacgcaacagatgggagtcatatctatacctttccacatgcttccttcagtgagccactgtatcccgtgttcagaattttaacactcgagccaacggccctgactatttgtccgattcccaaggaggtggagagcagtcccgaccctgacctcgtcccagatcatagcctggaaacgcccctgacccctggtctggctaatgaaagtggtgaaccccaggccgaggtgacctcccttctgttaccagcccaccctggagccgaggtgagcccttcagccactactaatcagaaccataaactacaggccaggaccgaggcgctgtactag

SEQ ID NO: 180932 - DNA, 417 bp, Artificial Sequence
  Description of Artificial Sequence: Synthetic coding sequence
atgaagatggccagcagcctggccttcctgctgctgaacttccacgttagtctgttcctggtacagctgctcactccgtgtagcgcccagttctccgttctgggaccaagcggcccgatactagccatggtaggggaagacgcagacctgccttgtcacttattccctacaatgagtgccgaaacaatggagttacgatgggtttcctcatccttgcggcaggtggttaatgtctatgcagatgggaaggaggtagaggacagacagagcgctccttaccgaggcaggacaagcatactgcgggacggtatcactgcaggcaaagcggcactgagaatccataacgttactgcttctgatagcggaaagtacctctgctacttccaggacggtgatttttacgaaaaggctctgtag

SEQ ID NO: 180933 - DNA, 717 bp, Artificial Sequence
  Description of Artificial Sequence: Synthetic coding sequence
atgaagatggccagcagcctggccttcctgctgctgaacttccacgtctccctgtttctggtgcagctgctcacgccgtgttccgctcagtttagcgtcctgggaccctcaggccctatactggccatggtgggggaagatgccgatttgccatgccacctgtttccaaccatgtctgccgaaacgatggaattaaggtgggtgtcatcatcattaaggcaagtggtgaacgtgtatgcggatggtaaggaagtggaggacagacaatccgcaccatacaggggacggacctccattctccgtgatggcattacggccggtaaagcagccctgagaattcacaatgtgacggcctccgattctggaaaatacctctgttattttcaggatggggacttttatgaaaaggctctcgtggaacttaaggtagcagccctgggcagcgatctgcatatcgaggtgaaggggtatgaagacggggggatccatttggagtgtaggtcaacaggttggtatcctcaaccgcagatcaaatggagtgatactaagggcgaaaatatccccgcggtggaggcccctgtagttgcagacggggtgggactttacgccgtggcagcgtctgtcatcatgaggggaagcagcggcggcggcgtatcatgcatcatcaggaacagtttgttgggattagagaaaacagctagcatatcaatagcttag

SEQ ID NO: 180934 - DNA, 1368 bp, Artificial Sequence
  Description of Artificial Sequence: Synthetic coding sequence
atggtggacttccccggctacaacctgagcggcgccgtggccagcttcttgttcatcctgctcacaatgaagcagtctgaagacttccgggtgattgggccggcccatccaatcctagccggcgtgggcgaggacgcactcttgacttgtcagctgcttcccaagcggacaaccatgcatgtggaagtccgctggtatagaagtgagcctagtacacccgttttcgttcacagggatggcgtagaagttaccgaaatgcaaatggaggagtatcgtggctgggtcgaatggatcgaaaacgggattgctaaaggtaacgtagcactgaaaatccacaacatccagccaagcgataacggtcagtactggtgccactttcaggatggaaattattgcggcgagactagcttgctactaaaggtggctggactcggctccgccccatctatacacatggagggtcccggagagtcaggagtgcagctggtttgcacggcccgcggatggttcccagagccccaggtctattgggaagacatccgcggagagaagctgttggccgtgtccgagcacagaattcaggacaaggatggtctgttctatgccgaagctaccctggtggtgagaaacgctagtgcagaatccgtctcttgcctagtacataatcccgtgttgacagaagagaaagggtctgtcatttcactgcccgagaagttgcagacagagcttgcctcgctcaaagtaaacgggccttcacagcctatccttgttagggtcggcgaagatatccagctgacgtgttacttgtctccaaaggcaaacgcccagtcaatggaggtccggtgggataggtctcatagatatccagccgtgcatgtctatatggacggggaccacgtcgcaggagagcagatggccgagtaccgcggaagaactgtacttgtgtccgacgccatcgacgagggtcgtctgacgctgcagatccttagcgccaggccttccgatgacgggcagtatcggtgtctgtttgaaaaagatgacgtgtaccaggaagcctcattagatttgaaagtggtgtcgttgggatccagtcctctcatcacagtggaggggcaggaagatggggagatgcagcccatgtgctcctcagacgggtggttcccgcaacctcatgtgccttggagagatatggaggggaagacaattccgagtagctcgcaggccctcacacaaggatcccacggattgttccacgttcaaactctgctgcgggttaccaatattagcgccgtggatgtcacctgttcaatctccatcccgtttctgggggaggagaagatcgcaactttttcactgagcggatggtag

SEQ ID NO: 180935 - DNA, 1167 bp, Artificial Sequence
  Description of Artificial Sequence: Synthetic coding sequence
atggtggacttccccggctacaacctgagcggcgccgtggccagctttttatttatacttctgacgatgaagcaatccgaggatttccgagtgatcgggcccgcccaccctattcttgcaggggtgggagaggacgcgctgttgacttgccagctactgcctaagaggactaccatgcacgtcgaggtcagatggtaccgctccgaacccagcacaccggttttcgtgcacagggatggcgtcgaagtgaccgagatgcagatggaagagtatagaggctgggttgagtggatcgaaaatggcatagccaagggtaatgttgcactcaaaattcacaacattcaaccctcagacaacggacagtactggtgtcattttcaggatgggaattattgtggcgaaactagcttactgctaaaagtcgccgagaagctactggcggtcctgagcagcttgaaggtgaacggcccttcccaaccaatcttagtacgagtgggagaagatattcagctgacctgttacttatcgcctaaggctaacgcgcagagtatggaggttcggtgggatcggagccacagataccccgcagtgcacgtctacatggatggcgaccatgtagccggagagcagatggcggaatacagaggcaggaccgtgctggtcagtgacgccatcgacgagggaagactgaccttgcagatcctgagcgctcgtcccagcgacgacggtcaatacagatgtctgttcgagaaggatgacgtgtatcaggaagctagtctagacctcaaggtcgtgtctctggggtcttctccacttatcaccgtggagggtcaagaggatggagaaatgcagccaatgtgcagcagtgatggttggtttcctcagccacatgtcccgtggagagacatggaaggaaagaccattccctcaagtagccaggctttaacacaagggagccacggcctttttcacgtacaaacactgctgcgcgtcacaaacatctcagcagtcgatgtgacatgcagcatctccatcccatttctgggagaggagaagatcgcaacgttcagtctctccgagtcccgcatgacattcctatggaagactctgctggtatggggattactgctggccgttgctgtggggctgcccaggaagcgatcttag

SEQ ID NO: 180936 - DNA, 738 bp, Artificial Sequence
  Description of Artificial Sequence: Synthetic coding sequence
atggtggacttccccggctacaacctgagcggcgccgtggccagcttccttttcatattactgaccatgaagcaaagcgaaaaattacagacggaattggcatctctcaaggtgaacgggccaagtcagcccatcttggttagagtaggtgaagacatccagcttacatgctacctctcaccgaaggccaacgcgcagagcatggaagttagatgggatcgtagccacaggtatcctgcagtccatgtgtatatggatggagatcacgttgcgggagaacagatggccgaatatcggggccgaactgttctggtcagcgatgctatcgacgaaggcagactcacactccagattctgtcagctcggcctagtgacgatggacagtacaggtgcttgtttgaaaaagatgacgtatatcaggaggcgtcattagacctaaaagtcgtttcactgggcagctccccactgataacagtggagggccaggaggatggagagatgcagccaatgtgctcctccgacggatggtttcctcagccccatgttccatggcgggatatggagggcaagactatcccgtcatcttctcaagccctgactcagggcagtcatggcctgttccacgtgcaaactctcctgcgcgtgaccaacatctcagcagtagatgtaacctgtagcattagtatacccttcctcggggaagaaaagattgccacattttctctatcaggatggtag

SEQ ID NO: 180937 - DNA, 327 bp, Artificial Sequence
  Description of Artificial Sequence: Synthetic coding sequence
atggtggacttccccggctacaacctgagcggcgccgtggccagctttctgttcatactgctgaccatgaagcagtcagactttagagtgatcgggccggcacacccaattctggctggtgttggcgaagacgctctgcttacgtgtcagttattgcccaagcgcaccacaatgcacgtggaggtaaggtggtatagatccgaaccgtccacgcctgtcttcgtgcaccgggacggagtggaggtaaccgaaatgcagatggaggagtatcgcggctgggtagaatggattgagaacgggatcgctaaggggaacgtggctctttag

SEQ ID NO: 180938 - DNA, 780 bp, Artificial Sequence
  Description of Artificial Sequence: Synthetic coding sequence
atggtggacttccccggctacaacctgagcggcgccgtggccagctttctctttatactgctcaccatgaagcagtcggaggatttcagagtgatcggaccagcccacccaattcttgcgggggtcggagaagacgccctccttacgtgtcagctgctcccaaaacgcactactatgcacgttgaagtccgctggtatagatcggagccttccacgcctgtgttcgtccatagggacggtgtcgaggtgactgaaatgcagatggaggagtatcgaggttgggtcgagtggatcgagaacggtattgcaaagggtaacgtagccctgaagatacataacatccaaccctcagataacggccagtactggtgtcacttccaggatgggaattactgtggggagacgtccctcctgcttaaggtagctgggctgggctccgccccatcaatacatatggaaggccccggtgaatcaggggtgcagttggtgtgtacggcacgaggctggttccccgaaccacaagtctactgggaggacatacgaggggagaagctcctcgcagtaagtgagcaccggatccaggacgaggacggactgttttatgcagaagcgactcttgtggtgagaaacgcttccgctgagagtgtttcctgcctggtgcacaatccagtgttaacagaagaaaaaggctcagtgatctccctgcccgaaaagctgcagaccgagctggggaaatacgaggttctagcacacacctgcgggggctcactatgtccttag

SEQ ID NO: 180939 - DNA, 780 bp, Artificial Sequence
  Description of Artificial Sequence: Synthetic coding sequence
atggtggacttccccggctacaacctgagcggcgccgtggccagctttctgtttatccttctaaccatgaaacaatctgaagacttccgggtcataggtcctgctcatcccattcttgcaggagtgggggaggacgcccttctgacctgtcagttgcttcccaagagaacgactatgcatgtggaagtcaggtggtaccgcagcgaacccagtaccccagtcttcgtgcaccgtgacggggtggaagtgacagaaatgcaaatggaagagtaccgcgggtgggtggaatggatcgaaaacggcatagcgaagggtaacgtggccctgaaaatacacaatatacagccatccgataacggacagtactggtgccatttccaggacggcaattattgcggagaaacttccctgttgcttaaggttgcaggcctgggaagcgccccctccattcatatggagggcccaggtgaatcaggagtgcagctggtttgcacagcccggggttggtttcccgaaccccaggtctactgggaggacatccgtggcgagaaactgctcgctgtatcagagcatcgtattcaggacaaggatggcctgttctacgccgaggccactcttgtagtaagaaatgcttccgccgaatcagttagctgtctcgttcataaccccgtcctcacagaagagaaagggtcagtaattagcctccctgagaagcttcaaaccgagctgggcaagtacgaggtgttggcccacacgtgcggcgggagcctgtgcccctag

SEQ ID NO: 180940 - DNA, 636 bp, Artificial Sequence
  Description of Artificial Sequence: Synthetic coding sequence
aaggccaacgcccagagcatggaggtgcggtgggaccggagccacagatatccagcagtccatgtttacatggacggggaccatgtggcaggcgaacagatggccgagtatagagggaggacagtgctggtgagtgatgctattgacgagggacgtctcaccctgcaaattttgagtgctagacccagcgacgatggccagtatagatgcttatttgagaaggatgacgtctaccaggaagcctccctggatttgaaggtagtcagtttaggttcatcaccactcataaccgtagaaggtcaggaggacggggagatgcagcccatgtgttcaagcgatggttggttccctcaaccgcatgttccatggcgcgacatggagggaaaaacaatcccctcaagcagccaggcccttacccagggcagccatggcctatttcatgttcagacccttctgcgcgtcactaacatttccgccgtggatgtgacttgcagtatatcaatcccatttttaggcgaagaaaaaattgccaccttttccctctccgagtcgagaatgacatttctctggaaaacgctgttggtctggggcctgcttctggccgtcgccgtagggttacctaggaaacgcagttag

SEQ ID NO: 180941 - DNA, 780 bp, Artificial Sequence
  Description of Artificial Sequence: Synthetic coding sequence
atggtggacttccccggctacaacctgagcggcgccgtggccagctttctgttcattttactcactatgaagcagtccgaagacttcagagtcataggccccgctcatccaatcctggcgggggtgggggaagacgcgttactcacttgccagctactgcccaagcgaaccacaatgcacgtggaagtgcggtggtacagatctgagccctcgacccctgtgttcgtgcaccgcgacggcgtagaggtaacagaaatgcagatggaagaatacagaggatgggtcgagtggattgagaacggcatcgcaaaaggcaacgtggctctcaagatacacaacatacagccatcagataatgggcagtactggtgtcactttcaggacggtaattattgcggcgagacaagccttttgctcaaggtggccggcctaggctctgcaccaagtatacacatggaaggccccggtgaatccggcgtgcagctggtgtgcactgccagggggtggtttcccgagccacaggtttattgggaagacatccggggcgagaaattgcttgccgtgtccgaacacaggatccaggacaaggatggactgttctatgcggaggcaactctcgtggtgagaaatgcttccgccgaatcggtatcctgcctcgttcataaccctgttttgactgaagagaagggctccgtgataagcttgcccgagaagctgcagactgagcttggcaaatatgaagtcctcgctcatacgtgtggtggttccctttgcccatag

SEQ ID NO: 180942 - DNA, 327 bp, Artificial Sequence
  Description of Artificial Sequence: Synthetic coding sequence
atggtggacttccccggctacaacctgagcggcgccgtggccagcttcttgttcatcctgcttactatgaagcaaagcgacttccgcgttattggtccagcccatccaatccttgctggtgtcggtgaggacgctctgctgacttgccagttattgccgaaacgtacaacaatgcacgttgaagtccggtggtacaggtctgagccctcgacgcccgtgttcgtgcacagagacggcgtggaggtgaccgaaatgcaaatggaagaataccgcgggtgggtcgagtggatcgaaaatgggattgctaaaggtaacgtggccctgtag

SEQ ID NO: 180943 - DNA, 327 bp, Artificial Sequence
  Description of Artificial Sequence: Synthetic coding sequence
atggtggacttccccggctacaacctgagcggcgccgtggccagcttcctcttcattttgctgacaatgaagcagtccgattttcgcgtaataggaccagctcatccaatactagctggtgtcggtgaggatgccctgctcacctgccaactgctccctaagcgcaccactatgcacgtggaggtgaggtggtacaggtctgagcctagcactcccgtattcgtccaccgcgacggcgtggaagtgactgaaatgcagatggaagagtataggggctgggttgagtggatcgaaaacggtatcgcaaaagggaacgtcgcattatag

SEQ ID NO: 180944 - DNA, 636 bp, Artificial Sequence
  Description of Artificial Sequence: Synthetic coding sequence
aaggccaacgcccagagcatggaggtgcggtgggaccggagccacagatacccagccgtacacgtatatatggacggcgaccatgtagccggcgaacagatggccgagtataggggtagaaccgtgctcgtatctgacgccattgatgaaggcaggttaaccctgcagattctaagtgcaaggccatcagacgatggccagtatagatgtctgtttgagaaagacgacgtctatcaagaggcctccctcgatttaaaagtcgtcgggctgggtagctcccctctcatcacagtggaagggcaggaggatggtgagatgcagcctatgtgttcctccgacggatggttcccgcagccccacgtgccttggcgtgacatggaagggaaaacaataccttccagctcccaggctctgacacagggcagtcacggattgttccacgtccagacccttctgcgtgtaacaaacatttctgcggtagacgtgacctgctcaatcagcattccattcttgggcgaggagaaaatcgcaacttttagcctctctgagagccgcatgactttcttgtggaaaacgttactggtatggggcctgctgctggccgttgccgtgggcctgcctcgaaagaggagctag

SEQ ID NO: 180945 - DNA, 816 bp, Artificial Sequence
  Description of Artificial Sequence: Synthetic coding sequence
atggtggacttccccggctacaacctgagcggcgccgtggccagctttctctttattttgctgacaatgaaacagtctgaagatttccgcgttatcggtcctgcccatcctatcctggccggcgtgggggaagacgccctgctcacatgccaactgctgcccaaacggactactatgcacgtggaggtgcggtggtataggtccgagccctcaacccctgtttttgttcaccgcgacggagtggaagtgaccgaaatgcaaatggaagagtatcgcggttgggtggagtggattgaaaatggaatcgcaaaggggaacgtggctctgaagatacacaatatccagcccagcgataacggtcagtactggtgccactttcaggacggtaactattgtggagagacaagccttctgctgaaagtggcagcagttttgcgagacgacattatcgcaagtctcaaggtcaatggaccaagccagccaatactggtgcgagtcggagaggacattcaattgacatgctacctgagccccaaagccaatgctcagtctatggaggtgaggtgggaccgaagtcacaggtatcccgctgtgcacgtgtacatggatggagaccatgtcgcaggtgagcagatggccgagtataggggtaggacagtgcttgtctctgacgctattgatgagggccgacttacacttcagatcctttcagccagaccaagtgacgacggtcagtatagatgcttattcgaaaaggacgacgtgtatcaggaagctagtttagacctgaaggtcgtgtgggtgctgccacattag

SEQ ID NO: 180946 - DNA, 327 bp, Artificial Sequence
  Description of Artificial Sequence: Synthetic coding sequence
atggtggacttccccggctacaacctgagcggcgccgtggccagcttcctatttatactcctaactatgaaacagtcagacttccgagtcattggtcccgctcatccaatcttagctggagtcggcgaagatgctctgctgacatgccagttgctcccaaaacgcacaaccatgcacgttgaagtgagatggtaccgtagcgaacccagtacccccgtttttgtgcatagagatggggtggaagttacagagatgcagatggaggagtaccgcgggtgggtagagtggatcgagaacggcatcgctaagggcaacgttgctctgtag

SEQ ID NO: 180947 - DNA, 780 bp, Artificial Sequence
  Description of Artificial Sequence: Synthetic coding sequence
atggtggacttccccggctacaacctgagcggcgccgtggccagcttcctattcatcctcttgacaatgaagcaatccgaggactttagggtaattggaccagcccacccaatcctagccggtgtaggcgaggatgcacttttgacgtgccaattactccccaaacggactaccatgcacgtcgaagtgagatggtatcggtccgagccctcaactcccgtgttcgtgcacagggacggtgtggaagtgaccgagatgcaaatggaagagtatcgagggtgggttgagtggatagagaacggcatcgccaaaggcaacgtggccttgaaaatccacaacatacagccatccgataacggacaatactggtgccattttcaagacgggaactactgcggcgaaacttctcttctgctaaaagtcgcaggcctcggctcagcgccttccatccacatggagggcccgggggagtcaggcgtacagctagtttgcacagccagagggtggtttcctgaaccacaggtctactgggaggatatccgtggagagaaacttctagcagtgtcggaacatagaatccaggacgaggacggactgttctatgcagaagcaacattggttgttagaaatgccagcgccgagtccgtctcttgccttgtccacaaccctgtgctgacagaagagaaaggtagcgtgattagcttacctgagaaactacaaaccgagctggggaagtacgaagtgctggcccacacctgtggggggtccttgtgtccctag

SEQ ID NO: 180948 - DNA, 327 bp, Artificial Sequence
  Description of Artificial Sequence: Synthetic coding sequence
atggtggacttccccggctacaacctgagcggcgccgtggccagctttctcttcattttgttgactatgaagcaaagtgactttcgggtgatcggtcctgctcatcccatactggcaggggttggcgaagacgccttgttaacatgccaattgcttcctaagcgcaccaccatgcacgtggaggttaggtggtaccgctccgaaccatccacccccgtgtttgtgcaccgggatggagtagaagtaaccgagatgcagatggaggaatataggggttgggtcgagtggattgagaacggaatcgcgaagggcaacgtcgccctatag

SEQ ID NO: 180949 - DNA, 636 bp, Artificial Sequence
  Description of Artificial Sequence: Synthetic coding sequence
aaggccaacgcccagagcatggaggtgcggtgggaccggagccacaggtaccccgccgtgcacgtctatatggatggagaccacgttgccggagaacagatggctgagtatcgggggcgcacagtcctggtgagtgatgctatcgatgagggtagactgacgctgcagatccttagtgccagaccttcagacgacggccaataccggtgcctgtttgaaaaggacgacgtctaccaggaggcttcactcgacctgaaagtggtgggactcggttccagtccgctgataactgtggaaggccaggaggatggagaaatgcagcccatgtgctcatccgatggatggtttccccaaccacatgtgccttggcgggacatggaaggcaagaccattccttctagctctcaggcactgacgcagggctcacacggcttgttccacgtgcagacccttttgagggtgaccaatatcagcgccgtggatgttacctgttctatctctatccccttcttgggcgaagagaagattgccacgttctccctttccgaaagccggatgacattcctgtggaagacactcttggtgtggggactgttgctggcagtggccgtgggactccccagaaagcggtcatag

SEQ ID NO: 180950 - DNA, 780 bp, Artificial Sequence
  Description of Artificial Sequence: Synthetic coding sequence
atggtggacttccccggctacaacctgagcggcgccgtggccagcttcctattcattttactgacgatgaaacagagtgaggacttccgtgttatagggcctgcgcaccctattctggcaggggtgggggaagacgcgctgctgacatgtcagttgctgcccaaacgaactactatgcacgttgaggtacggtggtacagatccgagcccagtaccccagtctttgttcatcgcgacggtgtggaggtgaccgaaatgcagatggaagagtatagaggctgggtagaatggatcgagaacggcattgcaaagggcaacgtggctctaaagatccacaatattcagccctctgataacggccagtactggtgccacttccaggacggcaactattgcggggagactagcctgctcctcaaagttgccggacttggtagcgctcccagcatccatatggagggacccggcgagagtggagtgcagctggtgtgcacagcccgcggttggtttccagaaccccaagtctactgggaggatatccgtggggaaaagctcttggccgtgtcggagcacagaatccaagatgaagacggcctgttttacgcagaagccactcttgttgttagaaatgcctccgctgaatcggttagctgcctggtccataatccagtgctaactgaagaaaagggctcggtcatctctttacctgagaagctacagaccgagctgggtaaatacgaggtgttagctcatacttgtggaggctccttgtgcccatag

SEQ ID NO: 180951 - DNA, 780 bp, Artificial Sequence
  Description of Artificial Sequence: Synthetic coding sequence
atggtggacttccccggctacaacctgagcggcgccgtggccagcttcctgttcattctgctgacaatgaagcagagtgaggatttcagggtaatcggccctgcacatcccatcctggctggcgtcggcgaagacgcattgcttacatgccaactccttcctaagagaaccaccatgcatgtggaggtcaggtggtatcggtcagagccatcaacgcccgtttttgtccacagggacggggtcgaggttaccgagatgcaaatggaggagtataggggctgggtcgaatggattgagaatgggatcgcaaagggtaatgttgctctcaaaattcacaacatccaaccctccgataatggacaatactggtgccatttccaggatgggaattattgcggcgaaacaagtctcctgctcaaggtcgcgggactagggtctgctcccagtatacacatggaaggccccggagagagcggcgtccagctggtgtgcaccgcccgcgggtggttcccagagccccaggtctactgggaggacatccgcggagaaaaattactggcggtgtctgaacaccgaatacaggacaaagatggcttgttctacgctgaagcaaccctggtggttaggaacgcatccgctgagagcgtcagttgccttgtgcataatcctgtgctgaccgaagaaaaggggtcggtgatcagtttacctgagaaactccagactgagttaggcaagtacgaggttctggctcacacctgtgggggctcactgtgcccgtag

SEQ ID NO: 180952 - DNA, 327 bp, Artificial Sequence
  Description of Artificial Sequence: Synthetic coding sequence
atggtggacttccccggctacaacctgagcggcgccgtggccagcttcctatttattctgttaactatgaagcagagcgactttcgggtcatcggaccagcccatccgattctggccggtgtgggcgaggacgcactcctcacatgccagctgttacctaagcggacgaccatgcatgtagaggtgagatggtatcgctctgagccaagtacacccgtatttgtacatcgtgacggagtggaggtaacagaaatgcagatggaggaataccgggggtgggtggaatggattgagaacggcatagcgaagggtaatgtagctctatag

SEQ ID NO: 180953 - DNA, 780 bp, Artificial Sequence
  Description of Artificial Sequence: Synthetic coding sequence
atggtggacttccccggctacaacctgagcggcgccgtggccagcttcctttttatcctcctgactatgaaacaatccgaagatttccgcgttattggcccagcccatcccattctagccggggttggggaggatgccctgctaacttgtcagctgctcccaaaacgcactaccatgcacgtcgaggtgaggtggtatagatccgagccaagcacacctgtcttcgttcatcgggacggagtggaagtgacagagatgcaaatggaagagtatcgcgggtgggtcgaatggatcgagaatggcattgcaaaaggcaacgtggctctgaagatccacaatatccaacccagtgacaacggacagtactggtgccacttccaggacggcaactattgtggcgagacaagccttctgttgaaggtagctgggttaggctcggcgccctcaatccacatggaaggaccaggcgagagcggagtgcagttagtctgtactgcccggggctggttccctgagccccaagtgtattgggaggatattcgaggtgaaaagctgttggccgtgtctgaacataggattcaagataaggacggcctgttctacgctgaagctactttggttgttagaaatgcttcggccgagtcggtctcttgccttgtccacaacccagtactgaccgaagagaagggcagcgttatctcccttcctgaaaagctgcaaactgagttgggaaaatatgaggtgttagcacatacctgtggaggctccctgtgcccttag

SEQ ID NO: 180954 - DNA, 636 bp, Artificial Sequence
  Description of Artificial Sequence: Synthetic coding sequence
aaggccaacgcccagagcatggaggtgcggtgggaccggagccaccgttatccagctgttcacgtgtatatggacggcgaccacgtggctggtgaacagatggccgagtaccgtggacggactgtactcgtcagtgacgctatcgatgagggtcgactgactctgcagatcctgtcagcacggccttctgacgacggacaatatcgctgtctatttgaaaaggacgatgtatatcaagaggcaagcctggacctaaaggtggttggtctgggcagctcacccctgattactgtcgagggacaggaggatggtgagatgcaacctatgtgcagttcagatggctggttcccacagccacacgtgccttggagagatatggagggaaaaaccatccctagttcgtcgcaggcgctgacccaggggtcccatggcttattccacgtgcagaccttgctgcgcgttaccaacatcagtgctgtcgatgtgacatgctcaatctctattccttttctgggggaagagaagattgccacttttagtctgtccgaaagtaggatgacatttctttggaaaacactgttagtgtgggggttgctactggcagtggctgtggggctgccacgcaaaagatcttag

SEQ ID NO: 180955 - DNA, 636 bp, Artificial Sequence
  Description of Artificial Sequence: Synthetic coding sequence
aaggccaacgcccagagcatggaggtgcggtgggaccggagccacaggtatcccgctgtgcacgtctacatggatggggatcacgtcgcgggggagcaaatggcagaatatagaggccggacagtgttggtgtcagacgctatcgatgagggcaggctaacacttcagatattatcggccaggccatcggatgatggccagtaccggtgcctgttcgaaaaggacgacgtataccaggaagcgtcccttgacttgaaagttgttagtctcggatccagtcccctcatcactgtagagggccaggaagacggcgagatgcagccaatgtgcagcagcgacggatggttcccccagcctcatgtgccatggagagacatggagggtaaaacaattcccagctctagccaggcgctaacacagggcagccacggcctctttcacgttcagacgttgttgcgcgtaaccaacatatcagccgtggacgtaacttgcagtattagcattccctttctgggggaagaaaaaatcgctactttctccctaagtgagtctaggatgacctttctttggaagaccttgcttgtatggggtctccttttggctgtggcggtcggcctcccccgaaagcgatcatag

SEQ ID NO: 180956 - DNA, 636 bp, Artificial Sequence
  Description of Artificial Sequence: Synthetic coding sequence
aaggccaacgcccagagcatggaggtgcggtgggaccggagccaccgttatccagctgtgcatgtctacatggatggcgatcacgtggcaggagaacaaatggccgaataccgaggacgaaccgtgctcgtatctgatgctatcgatgagggacggctgacactccagatcctctccgccagaccttccgacgacggacagtatcgttgcctcttcgaaaaggacgacgtctaccaggaagcttcgttggatctaaaggtggtcagtctcgggtcctcccccctgataactgtggagggtcaagaggacggtgaaatgcagccaatgtgtagtagcgacggctggtttccccaaccacacgtaccatggagggacatggaaggaaaaacaatcccttctagttcccaagcactgacgcaggggtcccacggactcttccatgtccagacactactgagggtgacaaacataagcgccgtggacgttacatgcagtattagcatcccgtttctcggggaggaaaagatagccaccttttcgctgtctgagtcccggatgacctttttgtggaaaacactgctggtgtggggcctactgctcgccgtcgccgtgggactgccaaggaaacgaagctag

SEQ ID NO: 180957 - DNA, 327 bp, Artificial Sequence
  Description of Artificial Sequence: Synthetic coding sequence
atggtggacttccccggctacaacctgagcggcgccgtggccagctttctgtttatcctgttgaccatgaaacagagtgattttagagttatcggcccagcacaccctatcctggccggcgttggtgaggacgccctcctcacatgtcagctgctaccaaagagaaccaccatgcacgtggaagtgcgatggtatcggtccgagccttcaaccccagtgtttgtgcatcgagacggcgtcgaagtgaccgagatgcagatggaggagtataggggttgggtcgagtggatcgaaaacggcatcgctaaaggcaacgtggccctgtag

SEQ ID NO: 180958 - DNA, 636 bp, Artificial Sequence
  Description of Artificial Sequence: Synthetic coding sequence
aaggccaacgcccagagcatggaggtgcggtgggaccggagccacaggtatcccgctgtacatgtgtatatggacggcgaccacgttgccggcgaacaaatggctgagtaccgaggccgtactgtgcttgtcagtgatgctatagacgaaggccgactaaccctgcagattttgagtgccagaccgagcgatgatggacagtacaggtgtctctttgaaaaggacgatgtctaccaggaagcgagcttagatttaaaggtggtgtcactaggctcaagccctctcatcaccgttgaaggccaggaggacggggaaatgcaacctatgtgcagttcggatgggtggtttccacaaccacacgttccatggcgagatatggagggcaagacgattcccagctcatcccaggcgttgacacagggaagccacggtctgtttcacgtgcagaccctgcttagagttactaacatctcagcggtggacgtgacatgctctatttccatcccgttccttggcgaagagaaaatcgctactttctcgctgtctgaatcccggatgactttcttgtggaaaaccctcctggtctggggtctgctgctggcggttgccgttgggctcccacgcaagcgctcgtag

SEQ ID NO: 180959 - DNA, 1449 bp, Artificial Sequence
  Description of Artificial Sequence: Synthetic coding sequence
atggtggacttccccggctacaacctgagcggcgccgtggccagctttctgttcattcttttgaccatgaagcaaagtgaggatttcagggtgattggtccagctcaccctatattggccggagtgggcgaggacgcccttttgacctgccagttactgcccaaaagaaccactatgcatgtcgaggttcgctggtatcgctcagagccatctacacccgtcttcgtacaccgggatggagtggaagttaccgaaatgcagatggaagaatatcgcggctgggtggagtggatcgaaaacggcatcgcgaagggtaatgtcgcgctgaaaatacataatatccagccgagtgataatggacagtactggtgccattttcaagacgggaactactgcggagaaacatcactgctgctaaaggtggctggcctaggcagcgctcctagcatccacatggaggggcccggagagtccggggtgcagcttgtttgtacagctagggggtggtttccagagccccaagtgtactgggaggacattcgaggcgaaaaacttctggccgtgtcggagcaccgaatccaggataaagacgggctcttttatgccgaggcaacattagtggtcaggaatgcctcggcagagagtgtgtcatgtctggtgcacaatcctgtgctcaccgaagagaagggttccgtcatcagcctccctgagaaactgcagaccgaactggcatccttaaaagttaatggcccctcgcagccgattctcgttcgtgttggtgaggacattcagttgacttgttatctgagtcccaaagccaatgcccagtctatggaggtacgatgggataggtctcaccggtatcctgccgtccatgtttatatggatggggaccacgtggctggcgaacagatggctgaataccgaggaagaactgttctagtcagcgacgcaatcgatgaaggaagacttacgctccagattttgagcgccagaccctcagacgacggtcagtacaggtgccttttcgagaaggacgacgtctatcaggaggcaagtctcgacttgaaggttgtcagcctcgggagttcaccactgatcacagtggagggtcaggaggacggcgaaatgcagccaatgtgttcgtctgacggctggtttccacagcctcacgtgccttggcgggatatggagggcaagaccataccttccagttctcaagccctgacccagggctctcacggtctctttcacgtccagacccttcttagagtcacaaatatctccgctgtggatgtaacctgtagcatctctattccttttctgggggaggaaaaaattgccacgttctccttgtctgagtccagaatgaccttcctttggaagacccttctggtgtggggcctgctgctggctgtggctgtggggctccccagaaagcgctcatag

SEQ ID NO: 180960 - DNA, 738 bp, Artificial Sequence
  Description of Artificial Sequence: Synthetic coding sequence
atggtggacttccccggctacaacctgagcggcgccgtggccagctttctttttatcctgctgacaatgaaacagagcgaccgtctggatacccctaaggcctcactgaaagttaacgggccaagccagccaattcttgttcgagtcggcgaggacatacagctgacttgctatctgtccccaaaggcaaacgcccagtcaatggaggttaggtgggacagaagccatcgctaccccgctgtccatgtgtacatggacggcgaccatgtcgccggcgagcagatggccgaataccggggaaggacggtcctagtgagcgatgctatcgatgagggccgccttacactgcaaatactttcagcgcgcccgagtgacgacggccaatatagatgcctttttgaaaaagatgatgtgtatcaagaggctagtttagacttgaaggttgtgtcgctgggaagttcacccctgatcactgtcgaaggccaggaggatggtgaaatgcagcccatgtgttcttcagatggatggttcccacagccacacgtgccctggcgggacatggaagggaaaaccattccatctagttcccaggcactaacgcaaggctcgcacgggcttttccacgtacagaccttactgcgtgtgacaaacatctccgcggtcgatgtaacttgttctatctctattccctttttgggagaagaaaagatcgctaccttctcgctgagcggctggtag

SEQ ID NO: 180961 - DNA, 537 bp, Artificial Sequence
  Description of Artificial Sequence: Synthetic coding sequence
atggaggtgcggtgggaccggagccaccggtaccccgccgtgcacgtgtacatggacggtgaccacgtggctggcgagcagatggccgagtacagaggccgcactgtcctagtgtccgatgctatcgacgagggtagactcacactgcaaattttgtctgctagaccctcagatgatggccagtatcgctgcctgtttgaaaaagacgatgtataccaggaggcctcactcgacctgaaggtggtgtctctgggtagctcccctctgataactgtcgaaggtcaggaggatggagagatgcaaccgatgtgttcttccgacgggtggtttcctcagccccacgttccttggagagatatggagggcaaaactatcccttcttcctctcaggcactgacccagggcagccatggtttgtttcacgtgcaaacactgcttcgagttacaaatattagcgccgtagatgtgacttgttcaattagcataccttttcttggggaggaaaaaattgccaccttctccctgagcggctggtag

SEQ ID NO: 180962 - DNA, 1167 bp, Artificial Sequence
  Description of Artificial Sequence: Synthetic coding sequence
atggtggacttccccggctacaacctgagcggcgccgtggccagctttcttttcattctgctcacaatgaagcagtccgaggactttcgcgttatcggcccagcccacccgattttagcaggagtcggagaggatgccttgctgacgtgtcagctgctgcctaagcggaccacgatgcatgtagaagtacgatggtaccgttctgaaccaagcacgcccgtttttgtccaccgagacggggtggaggtgaccgaaatgcaaatggaagaatacaggggatgggtcgaatggattgaaaatggaattgccaaaggtaatgtggccttgaagatccacaatattcaaccaagcgataacggtcagtattggtgccattttcaggacgggaattactgtggggaaacatctctacttctgaaggtggctgagaagctgcttgccgtcctgtcttctttgaaagtgaatgggccttcccagcctatcctcgtaagggttggcgaagacattcagttaacttgttatctcagtcccaaggccaatgcacaatcaatggaagtgcggtgggatcgctcacaccgctatccagctgttcatgtttacatggatggtgatcacgtggccggcgagcaaatggcagagtacagaggcagaaccgttctggtcagcgatgccattgacgaaggtaggctgaccttacagattctgtctgcgaggccttcagacgatggccagtacagatgtctttttgagaaggatgacgtgtaccaggaagcatctttggacttgaaggtagtgagcctagggagctctccactgattaccgttgagggccaggaggacggcgaaatgcagccgatgtgcagctccgatggctggttcccacagccacacgtcccatggcgcgatatggaagggaaaacaatcccaagcagttctcaggcccttactcagggctcacatgggttattccacgtccaaactctcttgagggttactaatatctctgccgtggatgtgacttgttccatcagtatacccttcctcggcgaggagaagatagctaccttttctctatccgaaagtcgcatgacatttctctggaagaccttgctggtttgggggctgctgctcgctgtcgccgtaggactcccccggaaacggagctag

SEQ ID NO: 180963 - DNA, 1167 bp, Artificial Sequence
  Description of Artificial Sequence: Synthetic coding sequence
atggtggacttccccggctacaacctgagcggcgccgtggccagcttcctctttatccttctgactatgaagcagagcgaggatttccgggtcatcgggcctgcccatcctatcctcgcaggggtgggtgaggatgctctgttgacgtgccagttacttcctaagaggactacaatgcatgtggaggtaagatggtatagaagtgaaccatcaactcctgtcttcgtgcatagggatggagtggaagtgacagagatgcaaatggaagagtacagaggctgggtagagtggatcgaaaacggtatagccaaaggaaacgttgctctgaaaatccataacattcaaccaagcgataatgggcagtactggtgccactttcaggatggcaactactgcggtgaaactagcctgctgcttaaagtggctgagaagctcctcgcagttctctccagcttgaaggtcaacggcccatctcagcccatactcgtgagggtcggcgaagatattcaattaacatgctacctatcccccaaggcgaatgctcagagcatggaagtgaggtgggataggtcgcacagatatccagcagtgcacgtttatatggatggagatcacgttgcgggggagcaaatggctgaataccggggccgcactgtgttagtgtccgacgcaatcgatgaggggaggctaacattacagattctctccgctaggccctcagatgatggacagtataggtgcttgttcgaaaaagatgacgtgtaccaggaagcttccctggacctgaaagttgtcggactcggatcttcaccgctgatcacggtcgaagggcaagaggatggagagatgcagccgatgtgctcatccgatggttggttccctcagccacatgtgccatggcgggatatggaaggcaagaccatccctagttccagtcaagccctcacccaagggtcccatggactcttccatgtgcagaccctcttaagagttaccaatatttcagccgtagatgtgacatgttcaatctccattccctttctgggggaggagaagattgctacattctcactgtccgagagtcgtatgaccttcttgtggaaaacccttctcgtgtggggtctcttgctggccgtggctgtcggactgccgaggaagcggagctag

SEQ ID NO: 180964 - DNA, 1167 bp, Artificial Sequence
  Description of Artificial Sequence: Synthetic coding sequence
atggtggacttccccggctacaacctgagcggcgccgtggccagcttcctctttattcttctgactatgaagcaatccgaagatttccgggtcataggacccgctcaccctatcctggcaggagttggcgaagacgcactgctcacttgccaattgttacccaagcgcacgactatgcacgtggaggtccggtggtatcggtcggagcccagcacccctgtgttcgtgcacagggatggcgtggaggtaacggaaatgcagatggaagaataccgcggttgggtggaatggattgagaacggcatcgctaagggcaatgtggccctgaagatccataacatccagccctctgacaacggccagtattggtgccatttccaggatggcaattattgcggcgagaccagtctgttacttaaggttgcagaaaaattgctcgcagtgctgtccagtttgaaagtgaacgggccctctcaacccatcttagtcagagtcggggaagatattcagctgacttgctacctgagtcccaaagcaaacgcacagtcgatggaggtgcggtgggacaggagccaccggtaccctgctgtccacgtttacatggacggcgatcatgtggctggcgaacagatggccgagtaccggggcaggactgtgctggtctcggacgccattgatgaaggtcggctcacacttcagatcctttctgcgcgaccttccgacgacggccagtatcgctgcctctttgagaaagacgacgtgtaccaggaggccagcctggacctcaaagtggtgtccctgggcagtagtcctctgatcacagtagagggccaggaagatggcgaaatgcagccaatgtgcagcagcgatggatggttcccgcagcctcatgtcccctggagggacatggaagggaagacaattccgtcatcttcgcaggcccttacacaaggctcccatggcctgtttcatgttcagacactcctgagggtgaccaatattagcgctgtcgacgttacatgcagcattagcatcccgtttctgggcgaggaaaagatcgcaacattctcgttgagtgagagccggatgacctttttatggaaaaccctgctcgtgtggggattgctattggcagtagccgtcggcctccccaggaaaagatcatag

SEQ ID NO: 180965 - DNA, 738 bp, Artificial Sequence
  Description of Artificial Sequence: Synthetic coding sequence
atggtggacttccccggctacaacctgagcggcgccgtggccagcttcttattcattttacttaccatgaaacagtctgaccgcctggacactccaaaagcatctttaaaagtaaacggaccaagtcagcccatcctcgtacgagtcggggaggacatccagttaacatgttacctgtcccccaaagcgaatgcccagtccatggaggtgaggtgggaccgctctcaccggtaccctgcagtgcacgtgtacatggacggtgatcatgtggccggtgaacagatggccgagtacagaggcagaaccgtccttgtatcagacgccattgacgagggccgactgaccctgcagattctcagcgctcgcccaagcgacgatggccagtatagatgcctgtttgaaaaggacgacgtataccaggaagcctccctcgatctcaaagttgtggggctgggatctagtccactgatcacagttgagggccaggaggatggcgaaatgcagccgatgtgcagttcagatgggtggtttccccagccacacgtgccgtggcgggacatggagggaaaaactatcccaagtagctctcaggccctgacccagggttcacatggcctgtttcacgtacagacactgttgagagtgacaaatatctcagccgtggacgtgacatgtagcattagtattccttttctgggggaggaaaaaatagcaactttcagtctttccggatggtag

SEQ ID NO: 180966 - DNA, 738 bp, Artificial Sequence
  Description of Artificial Sequence: Synthetic coding sequence
atggtggacttccccggctacaacctgagcggcgccgtggccagcttcctgttcattttactcacaatgaagcagtccgatagattggacactcctaaggcaagcttaaaggtcaacggaccaagccagccaattcttgtccgggttggggaagatattcaactgacttgctatctctctccaaaagctaatgctcagagtatggaggtaaggtgggatcgctcgcatcgctaccccgctgttcatgtctatatggatggcgaccacgtcgctggagagcagatggccgagtaccggggacggactgtcctcgttagtgacgccattgatgaaggtcggttgacgcttcagatcttgagcgctaggccatctgatgacggacagtacaggtgcttgttcgagaaggacgacgtctaccaggaggcctctttggacttaaaagttgtttcgctcgggtctagccccctcattacagtagaggggcaggaggacggcgagatgcagcctatgtgttcctcagacggttggtttcctcagccccacgttccatggagagacatggaaggtaagacgatcccttcctcctcacaggccctgactcaaggaagccatgggctttttcacgtgcaaaccctgttaagggtcacaaacatttccgctgtcgacgtcacctgcagcattagcatacccttcttaggagaagaaaaaatcgcaacattctctctgtcaggttggtag

SEQ ID NO: 180967 - DNA, 1167 bp, Artificial Sequence
  Description of Artificial Sequence: Synthetic coding sequence
atggtggacttccccggctacaacctgagcggcgccgtggccagcttcctgttcattctcctgacaatgaaacaatccgaagattttagggtgatcgggcccgctcacccaatactagctggcgttggcgaggacgcacttttgacctgccaattgctcccaaaacgaacgaccatgcacgtggaggttcgttggtatagaagtgaacccagtacgcccgtcttcgtccacagagacggcgtggaggtgactgagatgcaaatggaagaatatcggggctgggtggagtggatcgaaaatggaatagcgaaagggaacgttgccctcaaaatccacaacattcagccgtctgacaatggccagtattggtgtcatttccaggatggcaattattgtggcgagacaagtctcttgctcaaagtggctgagaagctgctggctgtattgtctagcctcaaagtaaatggcccttcccaacccattctcgtgagggtcggcgaggacatccagttgacttgttacctatcacccaaggcaaacgcccagtccatggaagtgcgctgggacagatcacatcgataccccgccgtgcacgtctatatggacggcgatcacgtcgctggggagcagatggctgagtatcgtggcaggactgttctggtgtctgacgcgattgacgagggccgcttaacattgcagatcctttcggctaggcctagcgacgatgggcagtacagatgtctgtttgagaaagacgatgtgtaccaggaagcgtcactcgatctgaaggtggtttctttggggtcctctcctcttatcacggtggaggggcaggaggatggcgagatgcagcctatgtgtagctcagacggctggttcccacagccccacgttccttggcgtgatatggaagggaagaccatcccctccagctctcaggctctgacccagggctcacatggactgttccatgtgcagaccctcctgagagttaccaatatatccgccgtggacgtaacatgctcaatttcaattccctttctgggcgaggagaaaatcgctaccttcagcctttctgagagcaggatgaccttcttatggaaaacactgctcgtttggggactcctcctggcagtggccgttggcttacccagaaagaggtcttag

SEQ ID NO: 180968 - DNA, 816 bp, Artificial Sequence
  Description of Artificial Sequence: Synthetic coding sequence
atggtggacttccccggctacaacctgagcggcgccgtggccagctttctgttcattctgctgaccatgaagcagtcggaagacttcagggtgattggcccagcccatcctatcctggccggcgtgggcgaagacgcactactgacatgccagctccttcccaaacgtacaactatgcatgtggaggtgagatggtatcgcagtgagccctctacacctgttttcgtgcatcgggatggggtggaggttactgaaatgcagatggaggagtatcggggctgggtggagtggatcgagaacggcattgctaaaggaaacgttgcgctaaagattcataacattcagccctccgataacggccagtactggtgccatttccaagatggcaattactgcggcgaaaccagtctgcttctgaaagtggcagctgtgctaagagatgatatcattgctagcctcaaagtgaacggaccttcccagcccatcctcgtgcgggtgggggaggatatccaactgacctgttatctttccccgaaggcaaatgcacagtcgatggaagttaggtgggataggtctcatagatatcctgccgtccacgtttacatggacggtgaccatgttgccggggaacaaatggcagaatatcgaggccgaacagtgctggtatcagacgccatagacgaagggaggctcacactccagattctgagcgcgagacccagcgatgacggtcaatataggtgcctgtttgaaaaggacgatgtataccaagaagcttcgctagatctcaaggttgtgtgggtgcttcctcactag

SEQ ID NO: 180969 - DNA, 738 bp, Artificial Sequence
  Description of Artificial Sequence: Synthetic coding sequence
atggtggacttccccggctacaacctgagcggcgccgtggccagcttcttgttcatactgctaaccatgaagcagagcgagaaattgcagactgaactggcttccttgaaagttaatgggccttctcaaccaattcttgtgcgagtgggcgaggatatacaactgacctgttatttgtccccaaaagccaatgcccagagcatggaggtgcggtgggatagatctcaccgttaccctgccgtgcacgtgtacatggatggggaccacgtcgctggagaacaaatggcagaatatcgcgggagaaccgtgctcgtgagcgacgccattgacgaaggcaggctgacgctgcagatactgtcagcccgaccctccgacgacggacaatatcgatgtctcttcgagaaagatgacgtctatcaggaagctagtctggacctcaaagtagttggactgggaagcagtccccttattaccgttgagggacaagaggatggggaaatgcagcctatgtgctcgagtgacggttggttccctcaaccccatgttccttggcgggatatggagggcaaaaccataccttccagctctcaagctcttactcagggcagccacggcctcttccacgtccaaacgctcctgcgcgttacaaatattagcgccgttgatgttacctgttctatctccattccatttctgggcgaagagaaaatagcaaccttctcgttatccggctggtag

SEQ ID NO: 180970 - DNA, 537 bp, Artificial Sequence
  Description of Artificial Sequence: Synthetic coding sequence
atggaggtgcggtgggaccggagccaccggtaccccgccgtgcacgtctatatggacggagatcatgttgctggggagcagatggccgagtaccgaggccggactgtattggtcagcgacgctatcgacgagggtcggctcactctacagatcctgtctgcccggccgtccgacgatggtcagtaccgttgcctcttcgagaaagatgatgtatatcaagaagccagcctggacctgaaggtggtcgggcttggcagttcacctctgatcacggtcgaaggccaagaagacggggaaatgcagcccatgtgtagtagcgacggctggtttccacaacctcacgtgccgtggagagatatggagggaaagaccataccatcgtcttctcaagccttgacacagggcagccacgggttgtttcacgttcaaactctgcttagggtgaccaacatttccgccgtcgatgtgacttgtagcatatccatccctttcctgggtgaggagaaaattgccacattctctctgtctgggtggtag

SEQ ID NO: 180971 - DNA, 738 bp, Artificial Sequence
  Description of Artificial Sequence: Synthetic coding sequence
atggtggacttccccggctacaacctgagcggcgccgtggccagcttcctctttatcttgctcacgatgaaacagtccgatcgactcgacactcctaaggctagtctgaaggtcaacggtccttcccagccaatattggtgcgcgtgggtgaggacattcagttaacatgctacctttctcctaaagcaaacgcccagagtatggaagtgagatgggaccgtagccaccgatacccagccgtgcacgtgtatatggacggagaccatgtggccggcgaacagatggccgagtatagaggacgcactgtccttgtttcggatgctatcgacgagggcagactcacgctccagatactttccgcacggccctcagacgatggtcaatacaggtgcctctttgagaaagacgatgtttaccaggaggctagcctggatctgaaagtggttagtctggggagctcccccctcattactgtggaaggtcaggaagacggtgagatgcagccgatgtgctccagtgacgggtggtttccgcagccccatgtgccatggcgcgatatggagggcaaaaccatcccgagttcttctcaggctctgacgcaaggcagccacggtctgtttcatgtgcagactctgttacgggttactaatatctcagctgtcgatgtgacgtgcagcatcagtatcccctttttgggcgaggaaaaaattgcaactttctctctcagcgggtggtag

SEQ ID NO: 180972 - DNA, 1368 bp, Artificial Sequence
  Description of Artificial Sequence: Synthetic coding sequence
atggtggacttccccggctacaacctgagcggcgccgtggccagcttcctattcatcctgctgacaatgaaacagtcagaggactttcgggttatagggccggctcaccctattctcgcgggtgtgggagaggacgcactcttaacctgccaactcctgccaaagcggacaacgatgcacgtagaggttcgttggtatagatccgagccatcgactcctgtctttgtccatagagatggtgtggaggtgactgagatgcaaatggaagaatacagagggtgggtggagtggattgagaacggcatcgcaaaaggtaacgtggcgctgaaaattcataatatacagcccagtgacaacggacagtattggtgccatttccaagatggcaactactgtggagagacttcccttttactaaaagtggccggtctgggtagtgctcccagcatacacatggaaggtcccggcgaatccggagtgcaacttgtttgtacagcccgaggctggtttccagaacctcaagtatattgggaggatatccgaggagaaaagctgcttgctgtgtctgaacacagaatccaggacgaagatgggctgttttatgctgaagctacccttgtcgttcgtaatgcgtctgcagaaagcgtctcctgcctggtgcataacccggtcttgactgaagagaaaggcagtgtcatctccctgccagaaaagctgcaaactgaactggcaagcctcaaggtgaatggaccatctcaacccatcctcgtccgggtcggtgaggatatacagttaacctgctacctctctccgaaggctaatgcccaatccatggaagtgcgctgggatcggtctcatcgctatccagcagtgcacgtgtacatggatggtgaccacgtggcgggagagcaaatggccgagtaccgcgggcggaccgtgctcgtgagcgatgctattgatgagggtcggttaactctgcagatactgtcagctcggccctcagacgatggacagtaccggtgcctgttcgaaaaagatgacgtctaccaggaggcgtccctggacctgaaagtcgttgggctggggagttcacctctgattacagttgaggggcaggaagacggggaaatgcagccgatgtgcagcagcgacggctggttcccccagccacatgtgccctggagggacatggaaggcaagaccatcccctcctcctcgcaggccctcacccaaggatcgcatgggctgtttcacgtccaaacactgctgcgggtgactaacatcagcgctgtggacgtgacatgcagcattagtataccctttcttggtgaagaaaaaatcgctacattcagcctatcaggatggtag

SEQ ID NO: 180973 - DNA, 816 bp, Artificial Sequence
  Description of Artificial Sequence: Synthetic coding sequence
atggtggacttccccggctacaacctgagcggcgccgtggccagctttctgtttattctgctaacgatgaagcagtccgaagatttccgggttattggtcctgcgcacccaattcttgcaggcgtgggagaagacgccttactgacgtgtcagctgttgcctaaacgaaccaccatgcacgtagaggttcgctggtatcgaagtgagcccagtactcctgtgttcgttcatcgagacggcgtggaagtgaccgaaatgcagatggaggaatacaggggctgggtggaatggattgagaatggcatcgctaaagggaatgttgctcttaaaattcacaacattcagcctagcgacaatggtcagtattggtgtcactttcaggatggcaactactgcggcgaaacatctctgttgctcaaggtcgccgctgtcctgagagacgatatcatcgcctccctgaaggttaatgggcccagtcagcccatactggtcagggtcggagaagatatacagcttacatgctatttgagccccaaggccaacgctcagagtatggaagtcagatgggacaggtcccatcgctatccagctgtgcacgtgtacatggatggggatcatgtagcgggggaacagatggcagagtacagagggcgtaccgtcctcgtatccgacgctatcgatgaaggtcgcctgacactgcagatcctgtcagctagaccaagcgacgatgggcagtaccggtgcctattcgaaaaagacgacgtgtaccaagaggcttcattagatttaaaagtggtctgggtgctgcctcattag

SEQ ID NO: 180974 - DNA, 816 bp, Artificial Sequence
  Description of Artificial Sequence: Synthetic coding sequence
atggtggacttccccggctacaacctgagcggcgccgtggccagctttttgttcatccttctgaccatgaaacagtcggaagattttcgcgtgatcggccctgctcacccgattcttgctggtgtcggagaggatgctctgcttacttgccagctcctgcccaaacggacaactatgcatgttgaagtgcggtggtatcggtctgaacctagcacacctgtcttcgtgcacagggacggtgtggaggttactgagatgcaaatggaggagtaccggggatgggtggaatggatcgagaacggaatcgccaaagggaatgtggctttgaaaatccataacatccaaccctctgataacggccaatactggtgtcatttccaagacggcaattattgcggcgagacctcccttcttctcaaagtcgctgctgttctgcgggacgacatcatcgctagcctgaaggtgaacggcccgtcacagcccattctcgttcgagtcggggaggatatccagctgacatgctatctttcccctaaggcaaatgcccagtccatggaggtgagatgggaccggtcccatagatatccagccgtacatgtctacatggacggcgaccacgtggccggtgagcaaatggcggaataccgggggagaactgtcctagtgagcgacgctatcgacgagggaagacttacgctgcaaatcttatcggcaagacccagtgatgacggacagtatagatgtttgtttgagaaagatgacgtgtatcaagaggcatcgctggatttgaaagtcgtgtgggtactgccccattag

SEQ ID NO: 180975 - DNA, 738 bp, Artificial Sequence
  Description of Artificial Sequence: Synthetic coding sequence
atggtggacttccccggctacaacctgagcggcgccgtggccagctttctctttattcttttaacgatgaagcagtccgaccggttggacactccgaaagcatcactgaaggtgaatggcccaagtcagcctattctggtgcgggtgggtgaggatatacaactgacatgttatctgtctcctaaggcgaatgcacagtcaatggaggtgcggtgggaccgtagccaccgctatcctgcagttcacgtatatatggacggcgatcacgtcgccggggagcagatggcggagtatcgtgggagaactgtgttagtgtcagatgcgatcgacgagggacggctgacccttcagatcctgtctgctaggccttctgatgatggtcagtataggtgcctctttgaaaaagatgacgtttatcaggaggccagtcttgacctgaaagtcgtgtctctgggttcgagcccactgattacagtagagggtcaggaagatggagagatgcaacctatgtgtagctccgacgggtggtttcctcagccccacgtcccttggagggatatggaaggaaagactatcccctcgtcatcccaggctcttacacaggggtcccacggcttatttcatgtccagacgttgttacgcgtgaccaacataagcgcagttgacgtgacttgttccatctcaatcccctttcttggggaggaaaaaattgccacgttctccctgtccggctggtag

SEQ ID NO: 180976 - DNA, 816 bp, Artificial Sequence
  Description of Artificial Sequence: Synthetic coding sequence
atggtggacttccccggctacaacctgagcggcgccgtggccagctttttgttcattctcctgactatgaagcagagcgaagactttagggtgattgggcccgcacacccaatactcgctggcgtaggcgaggacgcgctgctgacatgtcaactcttgcccaagcgcaccacaatgcacgtggaagtgagatggtacaggtccgagccttctacaccagttttcgtgcaccgggacggggttgaagtaaccgaaatgcaaatggaagagtatagaggttgggtagagtggatagaaaacggcattgccaagggcaatgtcgcactgaaaattcacaacatccagccatcggataacgggcagtactggtgccatttccaagacggaaattattgcggtgagaccagtctcctgctgaaggtggcagccgtcctgcgcgacgatattatcgccagtctcaaagtgaacgggccctctcagcccatactggtacgggtcggtgaggacatccagctgacctgctacttgtctccaaaggctaatgcccagtctatggaggtccgatgggaccgctcccatcggtatcccgcggtccatgtatatatggacggggaccacgtagccggcgagcaaatggcggagtacagaggccggacagtgctggtttctgacgcaatagatgaggggcgcctcaccctgcagatcctctcggcaaggccctccgacgatggtcagtataggtgcctgttcgaaaaagatgatgtttaccaggaggcctcgctggaccttaaggttgtgtgggtcttaccgcattag

SEQ ID NO: 180977 - DNA, 738 bp, Artificial Sequence
  Description of Artificial Sequence: Synthetic coding sequence
atggtggacttccccggctacaacctgagcggcgccgtggccagctttttgtttatcttattaaccatgaagcagtccgaccgccttgacaccccaaaggcctccctgaaggtgaacggccccagccagcccatccttgtgagggtgggcgaggacatccagctgacatgctacctctcacccaaggcgaatgcgcagagtatggaagtgaggtgggatcgaagtcaccgatacccggctgtacacgtgtacatggacggagaccacgtggcaggcgaacagatggctgaatatcgcggtcgaaccgtactggtttctgatgccatagacgagggaagactgacgctgcagattctgtccgcccggcccagcgacgacggccaatatcgatgtctttttgaaaaagacgatgtttatcaggaggcttcactggatttgaaggtggtaggccttggctcttcccccttgattacagttgaggggcaggaggatggcgaaatgcagcctatgtgctcttccgacggatggttccctcagccccacgtgccctggcgcgatatggagggcaagactataccttcatcttcccaagctcttacccagggaagccacgggcttttccatgttcaaacccttctccgggtgactaatatcagtgccgtggacgttacctgtagtatctctattcccttccttggcgaagagaaaattgctactttttcactgagcggatggtag

SEQ ID NO: 180978 - DNA, 738 bp, Artificial Sequence
  Description of Artificial Sequence: Synthetic coding sequence
atggtggacttccccggctacaacctgagcggcgccgtggccagcttcctgtttatcctgctcaccatgaagcagtccgacagactagacactcctaaggcatccttaaaagtcaacggcccaagccagcccatcttggtgagggtcggagaggatatacaactgacatgttatctctccccaaaagctaacgcgcagtctatggaggttcggtgggatcgctcccatcggtaccctgccgtccatgtgtatatggatggggatcacgtggcaggcgaacaaatggccgaatatcgcggccgaacagtcctagtatccgacgcgattgatgaagggagactgaccttgcagatcctgtccgcacgcccctctgacgatggccagtaccgctgtctctttgagaaggacgacgtgtaccaggaagcttctttggacctcaaggtggtgagccttggctcatctccactaattaccgtagagggacaggaggacggggaaatgcaacccatgtgttctagcgatggatggtttccacagcctcatgtgccctggcgagatatggagggaaaaaccattcctagttcttcccaggccttaacacagggttcccacggcttatttcatgtccagacactgctccgcgtcaccaacatatcggctgtcgacgtaacctgcagtatcagcataccatttctcggggaggaaaagatcgccactttctcactcagcggatggtag

SEQ ID NO: 180979 - DNA, 1368 bp, Artificial Sequence
  Description of Artificial Sequence: Synthetic coding sequence
atggtggacttccccggctacaacctgagcggcgccgtggccagctttctttttatattgctaaccatgaagcagtcagaagacttccgcgtcattggtcccgcacacccgattttagccggtgtcggagaggatgctctactgacgtgccagctgctgccaaagcgaaccactatgcatgtggaagtgaggtggtaccgttcagagccatctactcctgtgtttgttcacagggatggcgtggaagtcacagaaatgcagatggaggagtacagagggtgggtggagtggatcgaaaacggtatcgccaaggggaacgtagccctaaagatccacaacatacaacctagcgacaatggccagtactggtgccatttccaagatggaaactactgcggcgaaacctcacttctcctgaaagtcgctggcctgggctctgctcctagcatccatatggaggggcctggcgaatcgggtgtgcagctggtctgtactgcccgtgggtggtttccagagcctcaggtgtattgggaagacatcaggggggagaaactactagccgtgtctgagcaccggatccaggacaaggacgggctcttttatgccgaggcaacactggtagtaagaaatgcaagcgctgagtccgtgtcctgtctcgtgcacaacccagttctgactgaggagaagggctcagtgatctctcttcccgaaaagcttcaaacagagctcgcatctctgaaagttaacggacctagtcagcctattcttgtacgcgtgggagaggatattcagcttacatgctacttgtcccccaaagctaacgcccagagtatggaagtgcgttgggataggagtcatcgctatccagccgtccacgtctacatggacggggatcatgtggccggggagcagatggcggagtatcgcggccgcactgtgctcgtgagtgatgccatagatgagggtcggctcactctgcagattttgtcagccaggccaagcgatgatggtcaataccgttgtctgttcgagaaagatgatgtataccaggaggccagtctggatctcaaggtcgtgtctcttggttcaagtcccctgattaccgtagaggggcaagaggacggagagatgcagccaatgtgctcatccgatgggtggtttccacagcctcacgtaccctggcgagacatggagggtaagaccatcccgtcttccagtcaggccttgacgcaagggtcccatggactgttccacgtccagaccctgctacgagtaactaatatctcggcagttgacgtgacctgctcaatcagcatacccttcctaggagaggagaagatagccaccttttccctgagtgggtggtag

SEQ ID NO: 180980 - DNA, 1368 bp, Artificial Sequence
  Description of Artificial Sequence: Synthetic coding sequence
atggtggacttccccggctacaacctgagcggcgccgtggccagcttcctctttatcctgctgactatgaagcagtccgaggattttcgagtgatagggcccgcgcatcctatcctagccggagtgggcgaagacgctctgttaacatgccaacttctgccaaaaagaacaaccatgcacgtagaagtaagatggtaccgctcagaacctagcacccccgtgtttgtccatcgggatggtgtggaggtgacagaaatgcaaatggaggaatataggggatgggtcgaatggatcgagaacgggatcgcaaaggggaacgtcgcactcaaaattcacaatattcagccgtccgataacggacagtattggtgtcactttcaggacggaaattactgtggcgaaacgagcctgctcttgaaagtggctggcctggggagtgccccgtcaatccatatggaaggtcctggtgagagtggtgtgcaactagtttgtacagctcgggggtggttccccgagccacaggtgtactgggaggatatcaggggcgagaagttgctggcagtgtcagaacaccggatccaagataaagatggcttgttttacgcggaggccacacttgtggtgcgcaacgcaagtgccgaatctgtgtcctgtctggtccacaatccagtactgactgaggagaaaggcagtgtaatatctctgccggaaaaattgcagacagaattggccagcctgaaggtgaacgggccttctcagcctattctcgtgcgggtcggagaggatatccagctgacttgctatctatctcccaaagccaatgcccagagtatggaagttagatgggacaggtcgcaccggtatcctgctgtgcacgtctatatggatggcgaccatgtggcaggcgagcagatggccgagtatcgaggacggaccgtattggttagcgatgcgatcgatgaaggtaggctgacactccaaatcctgtccgcccgaccatcagatgacggacagtataggtgtctcttcgagaaggacgacgtgtatcaggaagcatctctcgatctgaaggtggtatccctgggatccagcccgttaatcacggtggaggggcaggaggacggcgagatgcagcctatgtgtagtagcgatggctggtttccccagccccacgtgccttggcgcgacatggaaggcaaaaccattccttcttcttctcaggctctcacccaaggcagccatggtctgttccatgtccagactctgctcagagtaacgaatatttctgccgtcgatgtgacctgttctatttcaatcccctttctgggcgaggaaaaaatcgcaacattcagtctcagcggatggtag

SEQ ID NO: 180981 - DNA, 537 bp, Artificial Sequence
  Description of Artificial Sequence: Synthetic coding sequence
atggaggtgcggtgggaccggagccaccggtaccccgccgtgcacgtgtacatggacggagatcacgtagctggcgagcagatggccgaatatcgcggccggaccgtgttggtgtccgacgctatcgacgaaggaagactgacactacaaatcctgtctgcccggccttccgacgacggtcagtatagatgccttttcgagaaggacgacgtctaccaagaggcgagtctggacctgaaggttgtgtctcttggaagttcgcccctcatcacagttgagggacaggaggacggtgagatgcagcccatgtgtagctctgatggttggtttccacaaccccacgtgccttggcgtgacatggagggcaaaaccataccctccagctcacaggctctcacacaaggaagtcatggcttatttcacgtccaaaccctcctgcgggtgaccaacatttccgccgtggatgttacttgtagcatcagcattccattcttgggcgaggaaaaaattgccactttcagcctgagcggctggtag

SEQ ID NO: 180982 - DNA, 1368 bp, Artificial Sequence
  Description of Artificial Sequence: Synthetic coding sequence
atggtggacttccccggctacaacctgagcggcgccgtggccagcttcttatttattctcttgaccatgaaacagtccgaggactttcgtgtgatcggaccagcgcaccctatccttgcaggggtgggcgaggacgccctgctgacttgccagctgctgcccaaaagaaccacgatgcacgtggaagtgaggtggtaccgctcagagccttctacccctgtgttcgtgcatagggacggggttgaagtgaccgaaatgcagatggaggagtataggggctgggtggaatggatcgagaacgggattgctaagggaaatgtggcattgaaaatccacaatattcagccgtcagataacggtcagtattggtgccatttccaggatgggaactactgcggtgagacctcactgttgctgaaggtggccggtctgggttcagctcccagtattcacatggagggccccggagagagcggagtccaacttgtttgtaccgccaggggctggttccccgagccccaagtttattgggaggacataaggggtgagaagctgttggctgtttccgagcatcgaattcaggacaaggacggattattttacgctgaggccacactggtggttcgcaacgcctccgccgagtctgtgagttgtcttgtgcacaatccagtgcttaccgaggagaaagggagtgtcattagtctgcccgagaagctacagaccgaactggcaagcttaaaggtgaacggaccttcccaacccattctagtgcgggttggcgaagacattcagctgacctgctacctgtctccaaaggcgaacgctcagagcatggaggtgaggtgggaccggagccaccggtacccagcagttcacgtgtacatggatggggaccatgtagctggagaacagatggcagaataccggggcaggaccgtgctcgttagcgatgctatcgacgagggccgcttgaccctgcagatcctatctgcacggcctagtgatgacggacagtatcgctgcctgttcgagaaggacgatgtgtaccaggaggcctctctcgacctcaaagtcgtttcgcttggctcttcccctctgatcactgtggagggccaagaggacggcgagatgcaaccgatgtgtagctccgatggatggttcccccagccccacgttccttggcgcgatatggaaggaaaaaccattcctagctcctcccaggccctcacgcagggcagccatggcctcttccacgtccagaccctgcttcgggtgacaaatatatcagctgttgacgtgacctgcagcatctccatacctttcttgggagaagagaaaatagctacctttagtctcagtggatggtag

SEQ ID NO: 180983 - DNA, 816 bp, Artificial Sequence
  Description of Artificial Sequence: Synthetic coding sequence
atggtggacttccccggctacaacctgagcggcgccgtggccagctttctctttatattacttaccatgaagcagagcgaggacttccgcgtgattgggcctgctcacccgattcttgcaggagtaggggaagacgcgttgctcacttgccagctactgccgaagcgcaccactatgcacgttgaagtacgttggtataggagcgagccttccactccagtgttcgtacatcgcgatggcgtggaagtcacagagatgcagatggaggaatatcgtggatgggtggaatggatcgagaatggcattgcaaaaggtaacgtggctctgaaaattcacaacatacaacctagcgataatggccagtattggtgtcactttcaggacgggaactactgtggcgaaacctcattgcttctcaaggtggcggcggtgctgcgggacgacatcatcgccagcctgaaggtaaacgggccaagtcagcctatactggtccgggttggagaggacattcagctcacatgctacctttcccctaaggctaacgcacagtcaatggaggtcaggtgggataggagccacagataccccgcagtgcacgtctacatggatggcgatcacgtggccggagaacaaatggccgagtatagaggcagaaccgtcttagtctcagacgcaattgatgaaggcaggctcacattgcaaattctatccgccagaccatcagatgacggtcaatatagatgcttgttcgagaaggacgacgtgtatcaggaggcgtctttagacctcaaagtggtatgggtgctgccccactag

SEQ ID NO: 180984 - DNA, 1368 bp, Artificial Sequence
  Description of Artificial Sequence: Synthetic coding sequence
atggtggacttccccggctacaacctgagcggcgccgtggccagctttctgtttatattgctcaccatgaagcagagtgaagacttcagagtgattggccccgcacatcctatcctggccggggttggagaggacgctttgttgacctgtcagttgctgcccaagcgcaccaccatgcatgtcgaggtccggtggtacagatcagagccctccactcccgtctttgtgcaccgagatggagttgaagttaccgagatgcaaatggaggaatacagagggtgggtggagtggatagaaaatggaatagctaaaggcaacgtcgcactgaagattcataacatccagccaagtgacaacggccagtattggtgccatttccaagacgggaactattgtggggagacgtcactgctgctcaaggtagccgggctgggaagtgcaccatccatccatatggagggcccgggtgaaagcggagtgcagctggtgtgcacagcccgggggtggtttcccgagccgcaggtgtactgggaggacattagaggagaaaagctcctagccgtatctgaacataggatccaggacgaagacggcctgttctatgccgaagctacgcttgtggtgagaaacgcgagcgcggaatcagtctcttgcttggtgcataatccagtccttaccgaagaaaagggctctgttatctctctgccagagaagttgcaaactgagctggcttctctcaaggttaacgggccttctcaaccaatattggtaagggtcggggaggatatccagcttacttgctacctcagcccaaaggctaacgcccaatctatggaggtgcggtgggatcggtctcatcggtatcccgccgtgcatgtttatatggatggggaccatgtagcgggcgaacaaatggccgagtatagaggtaggactgtactggtctctgatgcgattgacgagggccgcctgaccctgcaaattctgagtgctagacctagtgacgatggacaatatagatgcctgttcgaaaaggatgatgtttaccaagaggcaagtctcgatctgaaagtcgtaggtctggggtcatcaccgttgatcactgtggaaggacaggaggatggagagatgcagcctatgtgctccagcgatgggtggtttccacagccacacgtcccctggagagacatggagggaaagacgatccctagctcttcccaagctctcacgcaaggcagccacggtctgtttcacgtccagaccctcctacgagttacaaacattagtgccgtagatgtgacgtgttctatctcaattccattcttaggggaagaaaagattgcaacgttcagtctgagcggatggtag

SEQ ID NO: 180985 - DNA, 1368 bp, Artificial Sequence
  Description of Artificial Sequence: Synthetic coding sequence
atggtggacttccccggctacaacctgagcggcgccgtggccagctttctgtttatccttctcacaatgaaacagagcgaggattttagggtgatcggaccagcacaccctatcctggctggagtgggggaggacgcattgctaacttgccagttgctgcccaagcgcacgacaatgcacgttgaggttcgctggtacaggtcagaaccctccactcccgtgttcgtccatagagatggggtggaggttactgagatgcagatggaagagtaccgcggctgggtggagtggatcgaaaacgggatagccaagggaaatgtggccctaaagattcacaatatccaacctagcgacaacggccagtattggtgtcacttccaggatggaaactattgcggggaaaccagtcttctccttaaagtggcgggtttgggtagtgcaccttccatccacatggaggggccaggagaatctggcgttcagctcgtttgtactgcgcgtggttggttccctgagccgcaggtgtactgggaagatatcaggggcgagaaactgcttgccgtaagtgagcacagaatccaggatgaagacggtctgttctatgctgaggctaccctggtggttagaaatgcctcagccgagtccgtctcctgccttgtgcataatcccgtactgactgaagagaaaggctcagtaatctccctccccgagaaactccagacagagctggccagcttaaaggtcaacggccccagtcagcctatcctggtgagggtcggcgaagacatccagttgacatgctatctgagccctaaggcaaatgcccaatccatggaggtgcgctgggatcgctcacataggtaccctgcagtgcacgtgtacatggatggggatcatgtcgctggggaacagatggctgaatacaggggaaggacagttctggtgtccgatgccattgatgaggggaggctgaccctccaaattttgtcagccaggcccagcgacgatggtcagtacagatgcctcttcgagaaggatgatgtataccaggaagccagtctggacctgaaagtcgtcggtttgggctcatcacctctgatcacggtggagggtcaggaagacggggaaatgcagcctatgtgcagttcagatggttggtttcctcagccacatgttccgtggcgcgacatggaaggcaagaccatcccctcctctagccaggccctgacccaggggtcccacggtttgttccacgtgcagacattattgcgagtaacgaacatttctgccgtggatgtgacctgttccatctctattccgttccttggagaagaaaagattgccaccttttcactctctggttggtag

SEQ ID NO: 180986 - DNA, 816 bp, Artificial Sequence
  Description of Artificial Sequence: Synthetic coding sequence
atggtggacttccccggctacaacctgagcggcgccgtggccagctttctgtttattctgcttaccatgaagcaaagcgaagactttagagtgattggccccgcacaccctattctggcaggggttggggaggacgctctgctgacctgtcagcttttacccaaacgcacgactatgcatgtggaggtccgatggtacagaagtgaaccttcaaccccagtgtttgtccatcgagacggggtggaagtcaccgaaatgcaaatggaggagtacagaggctgggtggagtggatagaaaatggaatagcaaagggcaacgtggcactgaaaatccacaatattcagccctcagataatggacagtactggtgtcattttcaagatggaaactactgtggggagacaagccttctgctcaaggtggccgccgttcttagagatgatatcatcgcttccctcaaggtgaacgggccctcccagccgatcctggtacgtgtcggcgaggatatccaattgacctgttacctgtcccccaaggccaacgctcagtcgatggaggtgcgatgggaccggagtcatagatatcccgccgtgcacgtgtatatggacggtgatcacgttgcaggtgagcaaatggccgagtacagaggccgcaccgtgctggtgtctgacgccattgacgagggaaggttaacactgcagattctcagcgctagacctagcgatgacgggcagtataggtgtctcttcgaaaaagacgacgtttatcaggaggcttctcttgatttgaaggttgtgtgggtcctgccccactag

SEQ ID NO: 180987 - DNA, 537 bp, Artificial Sequence
  Description of Artificial Sequence: Synthetic coding sequence
atggaggtgcggtgggaccggagccaccggtaccccgccgtgcacgtttacatggatggtgaccacgtggcaggagagcagatggccgagtatagagggcgcacggtgctggtgtctgacgctattgacgaaggccgtttaacactgcagatacttagcgcgaggccgtccgatgatggccaatatcgatgtctcttcgaaaaagacgatgtgtatcaggaggcatccctggatctaaaggtggtggggttgggcagctcgcctctcattacagtggagggacaggaagacggcgaaatgcagcccatgtgctccagcgacggatggttcccccagcctcatgttccctggcgggatatggagggcaagacaattccctcatcaagccaggctttaacacagggatcccatggtctgttccatgtgcagacactcctgcgggtgaccaacatcagcgctgtagatgtaacctgctcgatcagcatcccttttctgggagaggagaaaattgccacctttagtctctctggatggtag

SEQ ID NO: 180988 - DNA, 738 bp, Artificial Sequence
  Description of Artificial Sequence: Synthetic coding sequence
atggtggacttccccggctacaacctgagcggcgccgtggccagcttcctgtttattcttctgaccatgaagcagtctgagaaattacaaacagaactggccagcctgaaggtgaacggtccaagccagccgatcctggtgagggttggggaagatatccagttgacttgttatctttcacccaaggccaacgctcagagcatggaggtgcgctgggacaggtcacaccggtatcctgccgtccacgtctatatggacggagaccacgtcgcgggggaacagatggcagaatatagaggccgaacggtgctagtcagtgacgctattgatgaagggcgtttgaccttacaaattctgtccgctcgaccctcagatgacgggcagtacagatgtctgtttgaaaaggacgacgtctatcaagaggctagcctcgacctcaaagtcgtgggcctaggttcctctccgctaattaccgttgaaggacaggaagacggtgagatgcagccaatgtgcagtagcgatggttggtttccccaaccccatgtgccatggagagacatggagggaaagaccattccctcctcttcccaggcgctgacccaggggtctcacggattgttccatgtccagactctgctgcgtgtcaccaacatctcagctgtggatgttacatgtagcatctctatcccattcctcggtgaggagaaaatcgcgaccttttcacttagtggctggtag

SEQ ID NO: 180989 - DNA, 738 bp, Artificial Sequence
  Description of Artificial Sequence: Synthetic coding sequence
atggtggacttccccggctacaacctgagcggcgccgtggccagctttctgttcatacttttaacgatgaagcaatccgaaaaattacagacagaacttgcaagcctgaaggtgaatggaccctcgcaacccatccttgtgcgggtgggcgaggacattcaactgacctgttatctttcacccaaggcaaacgcccagtccatggaggtgcggtgggaccggtcacaccgctaccctgcggtgcatgtctacatggatggcgaccacgtcgccggagagcagatggccgagtaccgcggacgaaccgttctggtgtccgatgccatagatgaaggacggctgaccttacagattctcagcgctcgtcctagcgatgatggacaatataggtgcctcttcgaaaaggatgatgtctatcaggaggcatccctcgacctgaaggtggtatcgttggggagctcacctcttattaccgtggaggggcaggaagacggcgaaatgcagcccatgtgttcctccgatggctggttcccccagccacacgtgccgtggcgagacatggaaggtaagaccataccctcctctagccaggcacttactcaggggtcccacggactctttcacgttcaaactttactgcgagtaacgaatatttcagccgtcgacgttacatgctccatcagtattccattcctgggggaggaaaagattgccacattcagcttaagcgggtggtag

SEQ ID NO: 180990 - DNA, 1167 bp, Artificial Sequence
  Description of Artificial Sequence: Synthetic coding sequence
atggtggacttccccggctacaacctgagcggcgccgtggccagcttcctgtttattctccttacgatgaagcagtctgaagactttcgagtgatcggccctgcacaccctatcctggccggcgtcggggaggatgcactccttacttgccagctcctgcccaagcgcacgaccatgcatgtagaggtgaggtggtatcgctcagagcctagcactcctgtgtttgtccacagggacggagtagaagtaactgaaatgcagatggaggagtatagaggatgggtcgagtggatcgagaacgggattgctaagggaaacgtagctttaaaaatccataatattcaacctagtgataacggacaatactggtgtcactttcaagacgggaactattgtggcgagacatcgctcctccttaaagtcgcagagaagcttctcgccgtgctcagctcactgaaagtgaatggaccgtcccagcctatcttggttcgggttggagaggatattcagctcacttgctacctgagtccaaaggcaaatgctcagagcatggaagtgcgatgggacaggagtcaccgatatcctgccgtgcatgtttatatggacggtgatcacgtggccggggagcagatggcggaataccgaggccgcacagttctggtttccgacgctatcgatgaggggaggcttacccttcagattttgtcggcacgaccctctgatgatgggcagtaccggtgtctctttgaaaaagacgatgtgtaccaggaggcatccctggatctgaaggtggtgtcactggggagtagtccactgataacagtagaggggcaggaggacggtgagatgcagccaatgtgtagctccgacggttggtttcctcaacctcacgtcccgtggagagatatggagggcaagacaatccccagcagtagtcaggcccttacacaagggtcccatggccttttccatgttcagacactcctccgcgtgaccaacatttcggccgtggacgtgacgtgttcaattagcattccattcctcggagaagagaaaatcgcaactttctcactgtccgagagccgaatgacgttcctgtggaagaccctactcgtatggggtttacttcttgccgtggccgtaggattgcctaggaagaggtcttag

SEQ ID NO: 180991 - DNA, 1368 bp, Artificial Sequence
  Description of Artificial Sequence: Synthetic coding sequence
atggtggacttccccggctacaacctgagcggcgccgtggccagctttttgttcattctgcttacaatgaagcagtccgaagatttcagagtcatcggacctgcccatcctatcctggctggcgtgggtgaagacgccctgctgacatgccaactcctgccaaagagaaccacgatgcacgtggaggtgaggtggtacagatctgaacctagcaccccagtgtttgtccatcgagacggtgtggaagtgacagagatgcaaatggaggaatatcggggctgggtggagtggatagagaacgggattgccaaaggaaatgtcgcgctgaagattcataatatacagccaagcgataacggtcaatattggtgtcacttccaggatggcaattattgtggggaaacttcccttctgctcaaagttgctggacttgggtctgcaccctctattcatatggagggcccaggcgaatctggtgttcagctggtttgcactgcccgtggatggttccctgagccccaagtgtactgggaggatatccgaggcgaaaagcttttggccgtgtccgagcacaggattcaggacaaggatgggctgttttacgctgaagccacactggttgtgcggaatgccagcgccgagtccgtgagttgtctggtccacaaccctgtactcaccgaagaaaaagggagtgtcatcagcctccctgagaagctgcagacagagctggcctctttgaaagtcaatggacccagccagccaatcctggtccgcgtcggcgaagacattcagttgacttgctacctaagccctaaggcgaacgcccagtccatggaggtgcggtgggataggagtcaccgctatcccgctgtccacgtctatatggacggagaccatgtggccggtgagcaaatggctgagtaccgcggtaggactgttctggtatccgacgctattgatgaagggcgacttaccttgcaaatcctctctgcccgaccatctgatgatggccagtacaggtgcctatttgaaaaggatgacgtataccaggaggcctccctggacctgaaggttgtatcattggggtccagcccactaattaccgtagagggtcaggaggacggggagatgcagccaatgtgtagctcagatggttggtttcctcagcctcacgtgccctggcgggatatggaaggaaaaactattccatcatcctctcaggctctgacacagggttctcatggactttttcatgttcagacgctgttgagagtcacaaacatctctgctgtggatgtaacgtgcagcatttccattcccttccttggcgaggaaaagatcgcgacattttctttgagcggctggtag

SEQ ID NO: 180992 - DNA, 1167 bp, Artificial Sequence
  Description of Artificial Sequence: Synthetic coding sequence
atggtggacttccccggctacaacctgagcggcgccgtggccagctttctgttcattctgttgacaatgaagcagagtgaggatttcagagtgattgggccagcccacccaatcctggccggggtcggagaagatgcgctgctaacctgccaactgctgccaaagcggaccacaatgcacgtcgaggtaaggtggtataggtctgagccgtcaacccctgttttcgtccatagggatggcgttgaggtgaccgaaatgcagatggaggaatatcgcggctgggtggagtggatcgaaaatggtatagcaaaaggcaacgtcgccctgaaaattcacaatatccagccctctgacaacggtcaatactggtgtcatttccaggacggaaattattgcggagagacatccttattgcttaaggtggctgaaaagcttttagccgtcctttcatctttaaaagtgaacggcccctcacagcccatcttagtgagagtgggcgaggatatacagctgacctgctacctgtctccgaaagctaatgcacagagcatggaagtgcggtgggacaggtctcatagataccccgctgtgcacgtctatatggacggtgaccacgtcgctggtgagcagatggccgagtatcgggggagaaccgtgctcgtgagcgatgctattgatgagggaaggctgaccctgcagatactgtcagctcggcccagtgatgatggacagtaccgttgtctgtttgaaaaggacgatgtctaccaggaagcctcactggatctgaaagtggtgggcctggggagtagtcccttaattactgtggagggccaagaggatggcgagatgcagccaatgtgttcgtccgacggatggtttcctcaaccacacgtgccgtggcgggacatggagggcaagactattccgtcatcctctcaggctcttacccagggctctcatggactgttccatgtccagaccttactgcgtgtgactaacatcagtgccgtggacgtgacgtgtagcatttccattccattcttgggcgaggagaagattgccaccttctctctcagcgaatcccgcatgaccttcttatggaaaaccctgctggtgtggggcctgttattggcggtggcggtgggattaccgcgaaaacgctcttag

SEQ ID NO: 180993 - DNA, 738 bp, Artificial Sequence
  Description of Artificial Sequence: Synthetic coding sequence
atggtggacttccccggctacaacctgagcggcgccgtggccagctttttgttcatactcctcacaatgaaacaaagtgatagactggacacacccaaggcgtctctaaaagtgaacggaccatctcagcctatcctggtgcgcgtgggagaggacatccagctcacctgctacttgtctcctaaagctaacgcccaaagtatggaggtgagatgggatcgcagccacaggtacccagccgtgcacgtttatatggacggagaccatgtagctggggaacagatggccgaatacaggggacggactgtcttagtctccgatgcaatcgacgaaggccgccttaccctacagattctttccgccaggccaagtgatgacggacagtatagatgtcttttcgagaaggacgatgtgtaccaagaagccagcctcgatctgaaagtcgtgggcctggggtcctcacccctcattacagtggaagggcaggaggacggcgaaatgcaaccaatgtgctcctcggatggctggtttccccagccccatgttccctggcgtgacatggaaggaaaaaccattcctagctcctcccaggctctaacgcaggggtcacacggcttatttcacgtccagaccctgctgcgggtgaccaatatttccgcagttgacgtgacttgtagtatctccattccttttttgggagaggaaaagatcgccacctttagtctatcaggatggtag

SEQ ID NO: 180994 - DNA, 816 bp, Artificial Sequence
  Description of Artificial Sequence: Synthetic coding sequence
atggtggacttccccggctacaacctgagcggcgccgtggccagcttcctgtttatccttttaacaatgaagcagtcagaagatttccgggtgatagggcccgcccacccgattttggccggagttggagaggatgcactactcacttgtcagctcctcccaaagcgcacgacaatgcacgtagaggtcaggtggtataggtcagaaccttcaacacctgtgttcgtacatcgggacggggtcgaggtcactgagatgcaaatggaggaatatcgcggatgggtggagtggattgaaaacggtattgccaagggaaatgtggctctcaagattcacaatatccaaccaagcgacaatggtcagtactggtgccacttccaggatggaaattactgtggggagacttcactcctgctcaaggtcgctgccgttttacgggacgatatcatcgcctcactgaaggttaacgggccctctcagccaattcttgtgcgcgtgggcgaagatatccagttgacatgctatctgagccccaaggccaatgcccagtccatggaagtgaggtgggacaggagccatcgctaccccgcggtgcatgtgtatatggacggtgatcacgtagccggagagcagatggcagagtaccgcggccgcacagtcctcgtgagcgacgctattgacgagggccgcctgactttgcagatcctcagtgcaaggccatccgatgacggacagtacagatgcttatttgaaaaagatgacgtataccaagaagctagcttggatttgaaggtagtgtgggttctgccacattag

SEQ ID NO: 180995 - DNA, 1167 bp, Artificial Sequence
  Description of Artificial Sequence: Synthetic coding sequence
atggtggacttccccggctacaacctgagcggcgccgtggccagcttcctttttatcctcctgaccatgaaacagtctgaggacttccgagtgattggacccgctcaccctattctagcaggggttggtgaggatgcacttctgacatgccagttgctcccaaagcgcaccaccatgcatgtggaggtgcggtggtacaggagcgagcctagcacccccgtttttgtgcatagagacggggtcgaagtgaccgaaatgcagatggaagaataccgtggctgggttgaatggattgaaaacggcattgctaagggcaatgtagcactcaagattcacaatattcaacctagtgacaacggccagtactggtgtcacttccaggacggaaattactgcggcgaaacgtccttgctgttgaaagtcgctgaaaagttactcgcagtgttgtcctccctgaaggtgaacggtcctagccagccaatcctggttcgcgtaggcgaggatatccagctcacatgctacttgtctcccaaggccaacgcccagtcaatggaagttcgctgggatagatctcacaggtacccggccgtgcacgtttacatggatggcgaccacgttgctggcgagcagatggcagaatatcgcggcagaaccgtgctggtgtcagacgcaatcgatgaggggcggctgacgctccagatattatccgctcgcccttccgacgatggccagtaccggtgcctgttcgagaaagacgacgtctatcaggaagcctcgctggatttgaaggtcgtgggcctgggaagctcacctctcattacggttgagggacaagaggacggtgagatgcagcccatgtgtagctctgacggctggtttccgcagccacacgttccgtggcgcgacatggaaggcaaaaccataccctcttcctcgcaagccctaacccaaggaagccacggactgttccacgttcagacgctgcttagagtcacgaatattagcgcggtcgatgtaacatgttctatctcgatacccttcctgggggaagaaaagatcgccaccttcagcttaagtgagtcccggatgacattcttgtggaaaaccttgctggtgtggggcctcctgctggccgtggccgttgggttgccgaggaagagaagctag

SEQ ID NO: 180996 - DNA, 1401 bp, Artificial Sequence
  Description of Artificial Sequence: Synthetic coding sequence
atggccttcgtgctgatcctggtgctgagcttctacgagctggtgtccggccagtggcaggtcaccggtccaggcaaattcgtacaggcactcgtaggggaggacgccgtgtttagctgcagcctgtttcctgagacgagtgccgaggcaatggaggtgcgcttcttcagaaatcagtttcatgcggttgtccatctctatagggatggagaggattgggaatctaaacagatgccccagtatcggggccgtaccgaattcgtgaaagattcaatcgctggaggaagagtcagcctgagactgaagaacattacaccaagcgatattggcctttacggatgttggttctcctcccaaatttacgatgaagaagctacttgggaactgcgcgtcgccgccctgggtagcctgccattgattagtatagtgggatacgtagatggggggatccaactgctttgcctaagtagcggatggttccctcagcccactgccaagtggaagggccctcagggacaggatctttcttccgattctcgtgcaaatgccgatggctatagcctctacgacgttgagatcagtatcatagttcaggagaacgctggtagcattctgtgcagtatacacctcgccgagcaaagccacgaagtggagtcaaaggtactgataggtgagacatttttccaaccatccccatggcgactcgcctccattcttcttggcctgctgtgtggggctctgtgtggagtcgtgatggggatgattatcgtgttcttcaagagtaaagggaagatccaagcagagctggactggaggcgcaagcatgggcaggcggagctacgcgatgccaggaagcatgccgtcgaagtgacactggatcctgaaaccgcccatcccaaactatgcgtgtcggacctgaaaaccgtcactcacagaaaggcccctcaggaagtcccgcacagtgagaagcgattcacaagaaaatccgtggtggcctctcagggattccaggctggaaagcactattgggaggtggacgtggggcagaacgtcggatggtatgtgggggtgtgcagagatgacgtcgaccgagggaaaaacaacgttaccctaagccctaacaacggttactgggtcctgaggctaaccacagagcacctgtattttacctttaaccctcacttcattagtctgccaccaagcaccccaccgacccgggtcggggtcttcctagattacgaaggcggtaccatcagcttctttaatacaaatgaccagagcctgatatacactctgttgacatgccagtttgaaggattgcttaggccctatattcagcatgccatgtacgacgaggaaaagggaacccctatcttcatttgtcccgtgtcctggggttag

SEQ ID NO: 180997 - DNA, 1299 bp, Artificial Sequence
  Description of Artificial Sequence: Synthetic coding sequence
atggccttcgtgctgatcctggtgctgagcttctacgagctggtgtccggacagtggcaggttactggtcctggaaagtttgtgcaggcccttgtgggagaagacgctgtcttttcctgcagccttttccccgagactagtgcagaggctatggaagtgagattttttaggaatcaattccacgcagtcgtgcatctgtatagggatggcgaagattgggaatccaaacaaatgcctcagtacagaggccgcacagagtttgttaaggatagcattgccggagggagagtttcactacgactgaaaaatatcacaccctcagacataggcctgtatggctgttggttttcctcccaaatctacgatgaggaggctacatgggagttgcgcgttgccgcactgggcagcttacctctgatttcaattgtagggtatgtggatggcggcattcagctgctgtgcctgtccagcgtccagccctctccttggagattagcaagtattcttctgggactgctgtgcggtgcgttgtgcggcgtagtcatgggcatgattatcgtctttttcaaatctaagggcaagattcaggcagagctgggaatgtgccatgtgttatccctcccacacatggtgctcccaggtcccagtctcatacattccctgtccctctggacaaccctggccgcaggttggacaggatccaccgactggcggcgaaagcatggacaggcggaactgcgagacgcacgtaagcacgcagtcgaggtgacacttgaccccgagaccgctcaccccaagttatgcgtgagtgacctcaaaacagtgacccacagaaaagctcctcaggaagtgcctcactcagagaaaaggttcaccagaaagtccgtcgtggcctcacaggggttccaagcaggcaaacattattgggaagttgacgtggggcaaaacgtagggtggtacgtgggcgtatgccgtgacgatgtggaccgagggaaaaacaacgtgaccctttcccctaacaacggatattgggtcttaaggctgaccacggagcacctttacttcactttcaaccctcacttcataagcttacctccatcgaccccccctacgagagtgggcgtctttctggattatgagggcggcaccataagcttttttaacacaaacgaccaatccttaatttacacgctgcttacatgtcaatttgaggggctgctgcgaccctatattcagcacgctatgtacgacgaagaaaagggcacgcccattttcatttgtcccgtgtcctggggttag

SEQ ID NO: 180998 - DNA, 1809 bp, Artificial Sequence
  Description of Artificial Sequence: Synthetic coding sequence
atgcacagcaaggtgaccatcatctgcatccggttcctgttctggttcctgcttctctgcatgctcatcgggaagtcccatactgaggatgatatcattatagccaccaagaatggcaaggtccgagggatgaatttgaccgtctttggaggaacagtaacagccttcctgggcattccctacgcccagccacctcttggaaggctgcgcttcaagaagccccagtcactgactaagtggagcgatatatggaacgctactaaatacgcaaacagctgctgccagaatatcgatcagtcgtttcccggctttcacggcagtgaaatgtggaatccgaacaccgacttgagcgaggactgcttgtatctgaacgtgtggattccggccccaaaacctaaaaacgccacggtgctgatctggatctacggcgggggtttccagacaggaacttcctctctccatgtttatgatggcaagttcttagcgcgcgtcgagcgagtgatagtggtcagtatgaattatagggtgggtgcactgggtttcctggcccttccaggcaaccctgaggcccccggaaatatgggtctatttgatcaacagctggctctgcagtgggtgcagaaaaatatcgccgcctttggcggaaatcctaaatcggtcacgctattcggcgaatctgcgggcgctgccagcgtaagtctgcatctgctctcacctgggagccatagcctctttacccgggctattcttcagtccggatcttttaacgcgccatgggccgtgacctccctctatgaagcccggaatcggactctaaacctggccaagcttaccgggtgcagcagggaaaacgagacagagatcattaagtgccttaggaataaggacccccaagagatcctcttgaatgaggcatttgtcgtgccttatggtacccccctcagtgtcaacttcggcccaactgttgatggcgactttctgacagatatgcccgacatattgttggagctgggccagttcaaaaaaacacagattctagttggcgtaaacaaagacgaggggaccgctttcctggtatatggagcgccaggtttctctaaagacaataatagtattatcacccggaaagaatttcaagaaggtctcaagatattctttccgggagtcagtgaatttgggaaggagtccatactctttcactatacggattgggttgatgaccagcgtcccgagaattatagagaagccctgggcgatgtcgtgggcgattataactttatttgccccgctctggaatttaccaagaagttcagcgaatggggaaacaatgccttcttttactattttgaacaccgaagtagcaagctgccatggcctgaatggatgggggtcatgcacggctacgaaattgagttcgttttcggcttgcccctggagagacgtgataactacactaaggcagaggagattctatcgagatccattgtgaaacgctgggcaaatttcgccaaatacggcaaccctaatgaaactcagaataatagcacctcatggcccgtgttcaaatcaactgaacagaaatatctcactcttaatacagagtccactcggattatgaccaaactaagagcccagcagtgccgtttctggacgtccttctttcccaaggtgcttgagatgacgggaaacatcgacgaggcagagtgggagtggaaggctggttttcaccggtggaataactacatgatggactggaaaaatcagttcaacgactacacatccaagaaagaatcttgtgttggactgtag

SEQ ID NO: 180999 - DNA, 399 bp, Artificial Sequence
  Description of Artificial Sequence: Synthetic coding sequence
gccgtgcagttcaccggctggagcagcagctgcatcctgcacttcccagaggtcctgcacgactttcactcacttcagaccctgccgtcacttctccagcgcattggaaacccaaacgagacacagaacaactccacgtcctggcccgtttttaagtctactgagcagaagtatttaacactcaacacagagtccacccgcatcatgacaaaactgagggcacagcagtgccgattctggacatcctttttcccgaaggtgctggagatgacaggaaatattgacgaggccgagtgggagtggaaggcgggatttcaccggtggaataattatatgatggactggaagaaccaattcaacgactataccagcaaaaaggaatcttgtgttggactgtag

SEQ ID NO: 181000 - DNA, 195 bp, Artificial Sequence
  Description of Artificial Sequence: Synthetic coding sequence
atgaccaagctgcgggcccagcagtgccggttctggaccagcttcttccccaaggtactcgaaatgacaggaaacatcgacgaagcggagtgggagtggaaagcaggctttcacaggtggaacaactacatgatggactggaagaaccagtttaatgattacactagtaaaaaagagtcttgcgtcgggctgtag

SEQ ID NO: 181001 - DNA, 1431 bp, Artificial Sequence
  Description of Artificial Sequence: Synthetic coding sequence
atggccagccggatcggcctgcggatgcagctgatgcgggagcaggcccagcaggaggaacaacgcgagaggatgcaacagcaggctgttatgcactatatgcaacagcagcagcagcagcagcagcagcaactgggagggcctccgactccagccataaacacacccgtgcacttccagagtcctcctccagttccgggggaggtgctcaaggtacagtcctacctcgagaatccaacctcctaccatttgcaacagtcgcaacaccagaaagtccgagaatacctgtcggaaacctacggaaataagttcgcagcccatatcagcccggcccagggcagccccaagccacctcccgctgcttcccctggagtgcgagctggtcatgtgctatcatcgagcgctgggaattccgctcctaactcccccatggctatgctgcacatcggcagcaacccggaaagggaactcgatgatgtcatcgataacatcatgaggctggatgacgtactaggatatataaaccctgagatgcagatgcccaatacactgccactgtctagcagtcacctgaacgtgtactcgtccgacccccaggtgaccgcttctttggtcggcgtcactagctcttcatgtccagctgacctgactcagaagcgcgagcttacagatgctgaaagtcgggccctcgccaaagaaagacagaagaaggacaatcacaatctgatcgaaagacgtagacgcttcaatattaacgatcgaattaaggagctggggatgctcatcccaaaagctaacgatctcgatgtgaggtggaataagggaactattttaaaagcttccgtggactatatccggcgcatgcagaaggatcttcagaaaagccgtgagctggagaaccattcccggcggcttgagatgacaaataaacagttatggctgcgcatacaggagctggaaatgcaggctcgggtccatggcttgcctaccaccagcccttcgggcatgaatatggctgaactggcccagcaggtcgtgaaacaggaacttccgagtgaggaagggccaggggaagcgctgatgctgggcgctgaggttcctgatccagagcctctgccggctctgcccccccaggctcctctgccgttgcccacccaaccgccaagcccgtttcaccatttagattttagccacagcctgagtttcgggggcagagaagatgaagggccacctggataccctgagcccttagcaccagggcacggcagcccctttccgtccttgagcaaaaaagacctggacctgatgcttctagacgattccctgttgccactcgcaagcgatccactgctgagcacgatgagtccggaagcaagtaaagcgagctccagaaggtctagcttttccatggaggagggcgacgtcctgtag

SEQ ID NO: 181002 - DNA, 426 bp, Artificial Sequence
  Description of Artificial Sequence: Synthetic coding sequence
atggccggcgaggagatcaacgaggactaccccgtggagatccacgagtacttaagtgcttttgaaaatagcattggcgctgtggatgaaatgctgaagactatgatgtctgtgagtcgcaacgagctcctgcagaagctggatcctctcgagcaggccaaagtggatctggtttccgcctacactctgaattctatgttctgggtgtatttggctacacagggcgtgaatcccaaggaacatcctgtcaagcaggaattggagcgcattagagtctatatgaatagagtcaaggagataacagacaagaagaaggctggaaagctggatcgaggggccgctagtaggtttgtgaagaacgccctgtgggagcctaaatctaagaacgcaagtaaggtagccaacaagggcaagagcaaatcttag

SEQ ID NO: 181003 - DNA, 543 bp, Artificial Sequence
  Description of Artificial Sequence: Synthetic coding sequence
atgcccagccccagcgtgagcaccagcgccgccagcgtgctggagggcgtatgtggaagggccagaagtacctaccggactcccgaagagggcgaggaacaaagttggagtgcaatcatggctggggaagagatcaatgaggactatccagtcgaaatccacgaatatttgagtgctttcgagaacagcataggcgcagtggacgagatgctcaagaccatgatgtcagtctcaaggaacgaactgttgcagaagctcgatccacttgagcaggctaaggttgatcttgtctctgcctatactttaaatagcatgttctgggtctaccttgccacacagggggttaacccgaaagagcaccctgttaaacaggagctcgagcgtatccgggtgtacatgaatagagtgaaggagatcaccgacaaaaagaaagccggaaaactggatcggggcgctgcctctcgttttgtaaaaaatgccctctgggagccaaaatccaaaaacgcctctaaagtggccaacaagggcaaaagcaaaagctag

SEQ ID NO: 181004 - DNA, 426 bp, Artificial Sequence
  Description of Artificial Sequence: Synthetic coding sequence
atggccggcgaggagatcaacgaggactaccccgtggagatccacgagtatctgtccgccttcgaaaactctataggagcagtcgacgagatgctgaaaacgatgatgtccgtaagtagaaacgagctcctccaaaagctcgaccctctggaacaggctaaggtagacctggtgtctgcatatacccttaattccatgttctgggtgtatctggctacccaaggcgtcaatcccaaggagcatccggtgaagcaggaactcgagcggattagggtctatatgaatcgggtcaaagagattacagacaaaaaaaaggcgggcaaattggacagaggagccgccagcaggttcgtgaaaaatgccttgtgggagccgaagtccaaaaatgcgtctaaagtcgctaacaaaggtaaaagcaagagttag

SEQ ID NO: 181005 - DNA, 426 bp, Artificial Sequence
  Description of Artificial Sequence: Synthetic coding sequence
atggccggcgaggagatcaacgaggactaccccgtggagatccacgaatatctgagtgcattcgaaaactcaattggagctgtggacgagatgctaaagaccatgatgagtgtttctcggaatgagctgcttcagaaactggatcccttggaacaggccaaagtggacctggtctcagcctatactctcaactcgatgttctgggtgtatttagcgacacaaggcgtcaaccctaaggaacaccccgtgaagcaggaactcgagagaatcagagtctacatgaacagggtcaaagagattaccgataaaaagaaagccggaaagctggaccgaggcgccgccagcaggtttgttaaaaacgccctttgggagcccaaaagcaaaaatgcctccaaagtcgcaaacaaggggaaaagcaaatcttag

SEQ ID NO: 181006 - DNA, 957 bp, Artificial Sequence
  Description of Artificial Sequence: Synthetic coding sequence
atgctgagcgagagcagcagcttcctgaagggcgtgatgctgggcagcatcttttgcgccttaattacaatgctgggccacataagaattggccacggaaatcggatgcatcaccacgagcaccaccacctccaggcccccaacaaagaggatattcttaagattagcgaggacgagaggatggaattgagcaagagcttcagggtgtattgcattattctagtgaagcctaaagacgtgtctctgtgggctgccgttaaggagacatggacaaagcattgtgataaggccgaatttttctcctccgagaatgtcaaggtgttcgagagtattaatatggataccaatgacatgtggcttatgatgagaaaggcgtataaatatgcttttgacaaatatcgcgaccagtataattggtttttcctagcccgccctaccacctttgccatcatcgagaatctgaagtatttcctgcttaaaaaggatccttctcaacccttctaccttggacacacaatcaagtccggcgacctggagtacgtcgggatggagggcggcatagtgctctccgtcgagtccatgaaaaggctgaactccctcctcaatatccccgaaaagtgtccagagcaaggcggtatgatctggaaaatctctgaggataagcagcttgctgtgtgcctgaaatacgccggggtgtttgcagagaatgccgaagacgcagatggcaaggacgtgttcaataccaagtctgttggcctttctatcaaagaggcaatgacgtatcacccgaaccaagtggttgaaggatgttgctctgatatggcggtcacctttaacggactcacacccaaccagatgcacgtcatgatgtatggagtctatcgcctccgagcgttcggtcacatcttcaacgatgccctggtgttcctccctcctaacggcagtgataatgattag

SEQ ID NO: 181007 - DNA, 957 bp, Artificial Sequence
  Description of Artificial Sequence: Synthetic coding sequence
atgctgagcgagagcagcagcttcctgaagggcgtgatgctgggctctatattttgcgctctgattaccatgctggggcacatccgcatcggtcatggaaatagaatgcaccatcacgagcatcaccacttacaggcccctaacaaagaagatatattaaagatcagtgaggatgaacgcatggaactgagcaagtcctttcgggtttactgcatcatcctggtcaagcctaaagatgtctctctgtgggccgctgtcaaagaaacgtggactaaacactgtgataaggccgaatttttttcatccgaaaacgttaaagtgttcgaatcaattaacatggacactaatgacatgtggctcatgatgcggaaggcctataagtacgcctttgataaataccgcgaccaatataactggtttttcctggcccgccctaccacctttgcgatcattgagaacctgaaatactttcttctgaaaaaggacccttcccagccgttctatctcggtcatacaattaagtcaggtgatttggaatacgtaggaatggagggcggaatcgttctctcagtggagagtatgaagagattgaactctctgctgaatatccccgaaaaatgtcccgagcagggtggaatgatctggaagatctcagaagataaacaactggcagtctgcctgaaatacgccggagtctttgccgaaaacgccgaggatgccgacggaaaggacgttttcaacactaagtcagtaggcctttctattaaggaggcaatgacctatcacccaaatcaggttgtagaaggatgttgcagcgatatggcagtcactttcaatggcttgactcctaatcaaatgcatgttatgatgtacggcgtttatcgtctgagggcgttcggtcatatttttaatgatgcgctggtgtttctgccacccaatggttccgacaatgattag

SEQ ID NO: 181008 - DNA, 732 bp, Artificial Sequence
  Description of Artificial Sequence: Synthetic coding sequence
atgcggcccctgctggtgctgctgctgctgggcctggccgccggctcccctccactggatgataataagattccgtctctatgccccggacatccaggtctgcctgggacccctggccaccacggcagccagggattacccggaagggacggacgcgacggtcgggacggagcgccgggggctcccggtgagaaaggcgaaggagggcggcctggcctgcccggcccccgtggagatccgggcccaagaggcgaagctggtcctgctggccccaccgggccggctggagagtgtagcgtgcccccgcgttctgcctttagtgccaaacgctccgaatctcgagtgcctcctcccagtgatgccccattgccatttgatcgtgttctagtcaatgagcagggacactatgatgcagtcacaggaaagttcacatgccaggtgccaggcgtctactatttcgctgtgcatgctaccgtgtaccgcgcttccctccagttcgatctcgtgaaaaacggcgagtccatcgctagcttttttcagttctttggtggatggccaaagcccgcatcgctgtctggtggcgctatggtgcggctggagccggaagaccaagtctgggtgcaggtaggtgtgggcgattatattggcatatacgcatcaataaaaacagactccactttcagtggctttctggtttattcagactggcattcaagccctgttttcgcatag

SEQ ID NO: 181009 - DNA, 732 bp, Artificial Sequence
  Description of Artificial Sequence: Synthetic coding sequence
atgcggcccctgctggtgctgctgctgctgggcctggccgccggctctccccctctggacgacaacaaaatcccgtcgctgtgcccgggacacccgggactgccaggtacacccggtcatcacggcagtcagggcttgccaggtcgggacgggcgagacggcagagatggcgcaccaggcgcaccaggtgagaagggagaaggcggtcggcctgggctgccgggaccaaggggcgaccctggtcctagaggagaggcgggccccgcgggccccaccgggccagctggagagtgtagcgtgccgcctcggtcagccttttcagcaaagcggagtgaatccagagtgccccctccctctgatgctccactgccattcgatcgggtacttgtgaacgagcagggacattatgatgcggtcaccgggaaattcacatgccaagttcccggcgtgtactacttcgcagttcacgctacagtatatcgggcgagtctgcagttcgacctcgtgaaaaacggcgagtccatcgcctcattcttccagttcttcggtgggtggccaaaaccggcatccctgagcggtggcgccatggtgaggctggaaccggaggatcaagtctgggtgcaggtgggcgttggagattatattgggatttacgcctcaatcaaaacagactctacgttctccggcttcctggtttactcagactggcattccagcccggtgttcgcgtag

SEQ ID NO: 181010 - DNA, 759 bp, Artificial Sequence
  Description of Artificial Sequence: Synthetic coding sequence
atggccgcccccgccctgctgctgctggccctgctgctgcccgtgggtgcctggccaggcctgccccggcggccgtgtgtgcactgctgccgcccggcttggccccccggtccctatgcccgcgtaagcgatagggacttgtggcgcggcgacctgtggcgaggcctcccacgcgtccgtccaactattgacatagagatcctgaagggggagaagggcgaggcaggggtgcgcggaagggctggccgctcagggaaagaaggtccccctggggccagaggcctgcagggcagacgcggacagaagggacaggtaggtccaccgggagcggcgtgcagaagagcctatgccgccttcagcgtcggaaggcgagagggactgcatagcagtgatcactttcaggccgtgccatttgataccgaactggttaacctcgatggggccttcgacctggccgcagggcggtttctctgtaccgtccccggggtctatttcctgagtctgaatgtccatacctggaattacaaagaaacatatctgcacattatgctgaacagacgtccggccgcagtcctatatgcgcaaccatctgagagatctgttatgcaggcccagagcttgatgctcctcttggccgccggagacgctgtgtgggtgcgtatgtttcaaagggatcgcgacaacgcaatttacggcgagcacggggacctgtacataactttttcagggcatctggtaaaaccagcggctgagctgtag

SEQ ID NO: 181011 - DNA, 1002 bp, Artificial Sequence
  Description of Artificial Sequence: Synthetic coding sequence
atgcggatctggtggctgctgctggccatcgagatctgcaccggcaatatcaactcccaggacacttgccgacaaggacatcctgggattcccgggaaccccggccataacggcctgcctggacgggacggtcgagacggcgccaagggcgacaagggagatgcgggcgagcctggtcggcctggctcccccggaaaagacggaacaagtggggaaaaaggcgagagaggggcagacgggaaggttgaggcaaaaggtatcaagggagaccagggctctcgcggttcgcccggtaaacatggcccaaagggcctcgctggtccaatgggggagaaaggtttaagaggggaaactggcccccaaggccagaaagggaataagggggatgtgggaccaaccggccctgaaggcccccgtggaaatattggtccccttggccccactggactgccggggcccatgggcccaatagggaagccaggccctaaaggcgaggctggaccgaccggtccgcaaggcgagccgggcgtacgcggcattcgaggatggaaaggcgacagaggtgagaaagggaagataggcgagactctggtgctgcctaagagcgcatttaccgttggtctgacggtgctgagcaagtttccctctagcgacatgcccatcaagtttgataagattctgtataatgagttcaatcattacgatactgccgcaggtaaattcacctgccacatcgctggtgtgtactatttcacctaccacattaccgtattcagtcgtaacgttcaggtgtccctggttaagaacggagtcaagatcctgcataccaaagatgcctacatgtcctccgaggaccaggcgtctgggggaatagtgttgcaactcaaattaggcgacgaggtttggttgcaagtcaccgggggcgaaagattcaatggccttttcgctgacgaagacgatgataccaccttcactgggttcctcttattctcctctccgtag

SEQ ID NO: 181012 - DNA, 1002 bp, Artificial Sequence
  Description of Artificial Sequence: Synthetic coding sequence
atgcggatctggtggctgctgctggccatcgagatctgcaccggcaacattaactcccaggacacctgtcgacaaggccacccgggcattcccggtaatcctgggcacaacggcctgcccggcagagacggtcgtgatggagccaagggagacaagggggatgctggcgagcccggtcggcctggatccccagggaaagatggcacctcaggtgaaaagggcgaaaggggcgccgatgggaaagttgaggccaaaggcatcaaaggtgaccaggggagtaggggaagccccggtaagcacgggcctaagggattggcgggtcccatgggggaaaagggccttaggggcgagaccggtccccagggccagaagggaaacaagggggatgtcggacccaccggccccgaagggccgcgcggtaacatcggacccctgggcccgaccgggctcccaggccctatgggacccattggaaagccaggaccaaagggggaggctggaccaactggtccccagggagaacctggcgtgcgaggtatccggggatggaagggcgaccgtggagaaaagggaaagataggagagacattggtgctccccaagtctgcgttcacagtcggtctcacggtactttccaagtttccttctagcgacatgcccattaagttcgataaaatactgtacaatgaatttaaccactatgatacagctgccggcaagttcacctgtcatattgcgggcgtctattacttcacataccatataacggtattttctaggaacgtgcaggtatccttggtgaagaatggtgtaaaaatcctacatactaaggatgcatacatgtcctcagaggaccaggcctcaggcggtattgtcctccagctcaagctgggcgacgaagtctggctgcaagtcaccggtggcgaacgtttcaacggactctttgcagacgaagatgatgataccacttttactgggttcctcctgtttagctctccttag

SEQ ID NO: 181013 - DNA, 300 bp, Artificial Sequence
  Description of Artificial Sequence: Synthetic coding sequence
atgcggatctggtggctgctgctggccatcgagatctgcaccggcaatattaattcacaggacacctgtcgccagggacatcctggtatccctggtaaccctgggcacaacggccttcccgggagagacggaagagatggcgctaagggtgacaaaggcgacgccggtgaacccggttgccccggcagccccggaaaggatggcacaagtggggaaaaaggcgaacggggggctgatggcaaagtcgaggctaaaggaatcaagggtatgttcagatgtctctggagcaaaacagagtag

SEQ ID NO: 181014 - DNA, 1002 bp, Artificial Sequence
  Description of Artificial Sequence: Synthetic coding sequence
atgcggatctggtggctgctgctggccatcgagatctgcaccggcaacatcaattcacaggacacatgtaggcaaggccacccgggcataccggggaaccccggccataatggtctccccggtagggacggtagagacggcgccaaaggcgacaaaggcgatgccggtgagccaggatgtcctggctcgcctggaaaagatgggacctccggcgagaagggtgagcggggagctgacggtaaggtggaggccaagggaatcaaaggggaccagggctcccggggcagcccggggaagcacgggcccaaaggactcgctggtcctatgggcgaaaaaggactgcggggcgagacaggaccacagggacagaagggcaataagggcgacgtggggcctacaggccccgagggtccccgggggaatatcggcccgctcggtcccactgggcttccgggcccaatgggcccaatcggcaaacctgggcccaagggagaggccggacccaccgggccacagggcgagccaggcgttcgcggtatcaggggctggaaaggagataggggtgagaagggtaaaattggagaaaccctggtgttgccaaaaagtgcttttacggtgggtcttacagtgttaagtaagttcccgtcctcagatgtcccgattaaatttgacaaaatcttgtataacgaattcaaccactacgataccgctgttggaaaattcacttgtcatatcgccggcgtgtattatttcacctatcatataaccgtgttctcgcggaatgttcaggtttccctcgtcaagaatggcgtgaagatcctgcacacacgggacgcttacgtttctagcgaggaccaggcatcaggctccatcgtgctccagctaaaactaggggacgagatgtggcttcaggttaccgggggcgagcgctttaatggtctgtttgcagacgaggacgacgatactacatttactggctttctactgttttcatcccagtag

SEQ ID NO: 181015 - DNA, 1002 bp, Artificial Sequence
  Description of Artificial Sequence: Synthetic coding sequence
atgcggatctggtggctgctgctggccatcgagatctgcaccggcaatatcaactcgcaggatacctgcaggcaaggacacccggggatccctggaaatcctggccacaatggactccctggacgagacgggagggacggggccaagggggataagggggacgctggggagcccggctgccctggctcccccggaaaggatgggacttcaggcgagaagggtgagcggggcgccgacggaaaggtggaagccaaaggcatcaaaggggaccaggggagcaggggatcacccgggaagcatggccctaaggggctggctggtcccatgggggaaaaaggcctccggggcgagaccggaccccagggccagaagggcaacaaaggcgacgtggggccgaccggcccagagggtccccggggcaacatcggtcccctcggaccaaccggattaccagggcctatgggccctattggtaaacctggccccaagggcgaggctggtccaacaggcccccaaggcgagcccggggtgcgaggaatccgaggctggaagggtgatagaggggaaaagggaaagatcggcgaaacacttgtactgcctaagtctgcgttcactgtggggctgactgtgctgtccaagtttccttctagcgatgtcccaattaagttcgataaaatcctttataatgaatttaatcattatgacacagcagtggggaagttcacatgccatattgccggggtgtactattttacttatcacattacagtgttcagcagaaatgtgcaggtatctctggtcaagaacggcgtaaaaattctccacacacgggacgcctatgtaagcagtgaagatcaggctagtggatctatagtgcttcagctgaagctgggcgatgaaatgtggctgcaggttacagggggtgagcgcttcaatggtctgtttgcggacgaagacgacgatacgactttcactggttttctgctgtttagttcccaatag

SEQ ID NO: 181016 - DNA, 150 bp, Artificial Sequence
  Description of Artificial Sequence: Synthetic coding sequence
gtgggccccaccggccccgagggcccccggggcaacatcggccccctcggtcctaccggattacctgggcccatggggccaatcggaaagcctggccccaagggagaggccggcccgacaggcccccaagtttttccgttttgcatctag

SEQ ID NO: 181017 - DNA, 1110 bp, Artificial Sequence
  Description of Artificial Sequence: Synthetic coding sequence
atgtggtgcctggagcggctgcggctgggccccgagtgcctgcggcgaagtggggactggctgctcccgggccgagcccgaggcgccaagtcaagaaccactgccgcatgcgctaacgtcctaaccccggacagaatccctgaattttgtatacccccaagactcatgccaaggctggccctggcggcactgaggaactcatgggtggaggaagcgggtatggacgaaggcgcaggccggaccgattgggatccacggtcacaggccgccctgtccctgccccatctccctagagtgcggacggcttacggtttctgtgctctgctcgagagcccacacactaggcgcaaagaaagcctgctgctgggtggccccccggcgcctaggcctagggctcatacttatggaggaggcggaggcccggacgcactactgggtacactgcgagtgccacgcgctccggggccggccacaccagccgcacccggatgccctaggccgccgcaggacgcactggctcgccgacccagagggtgcaggttactgagagtgcccgatgggctgctgtcacgggccctgcgtgccggaagaagcagacggttgactcgtgtaagatccgtgtcatccggaaacgaggacaaggaacgacgagctggctcccagtccccagcacgcgccccctccacttcacctccttcttcccgcgtcccgtttcctgaacggctcgaagctgaggggaccgtggccctgggcagagccggagacgccctccgcctggctgcagagtactgtccagggactggccgcctgcgcttgcgactactgagggcagagagtccagcaggtggagcccctggcccccgggctgtgtcctgtaggctgtcacttgtgcttcgtccacccggcacagcgcttcgccagtgcagcaccgtggtcggcagatctcgaaaggctagcttcgatcaagatttttgttttgacggtctgagcgaggacgaggtacgacgcctggccgtccgcgtgaaagcacgcgatgaaggtagaggccgcgagcggggaagactgctgggacagggcgagctgagcctcggcgctctgctgctcttgtag

SEQ ID NO: 181018 - DNA, 1095 bp, Artificial Sequence
  Description of Artificial Sequence: Synthetic coding sequence
atgcggctgctggagaagctgtgcagcagcgccgccggcagcagcgcccctaagccagctttcgccaaggttttaacacctaacagaatcccagagttctgcattccacctaggctccccgcgccttgcactctggagtctcctattagagctgccgctgtgcctcgaaggtgtgccgcggagtccgacctgtggccccgagctgccgatgaagacgcagggagaacagactgggacccacgctctcaagccgcgctcagcctgccccacttaccacgagtgaggaccacttatgggttctgcgccctgctggagtccccccatacaaggagaaaggaatccctgctgctgggagggcctcctgcaccacgaccccgggcacattcctgtggtgggggtggagggcccgacgcgccactgggcaccctgtgtggtccccgaggtcccgggcccgctacccccgctgctcccggtggccctaggcttccgcaggatgctctggctgctggccctcggagatgtagactactgcgtgtgcccgacggacttctgtcacgggcgctcagagctggtcgctcaagacgccttgcgagggtgcgttctgtgtcctcaggtaatgaagacgaagaaagacgagctggctccgaaagccccgctcgagctcctagcagcagtcctctgagcagtagagcacctctgcctgaacgcctggaggctaaaggaaccgtggctcttggtagggcgggcgacgcgttgagactcgccgctgaatactgtcctggtacccgcagactcagactgcgattgctccgggctgagtcgctctttggcggggccccaggcccacgtgctgtgagatgtagattatccctggttctcagaccccccggcaccgcccgttggcagtgttccgctgtcgttgggaggagtcgcaaggctagttttgatcaggatttctgctttgacggcctcagcgaggatgaggtgaggaggctcgccgtgagggttaaagcacgggatgagggcaggggacgggatagagggaggctgctgggccagggcgagctctctctaggggcccttctgctgctgtag

SEQ ID NO: 181019 - DNA, 1266 bp, Artificial Sequence
  Description of Artificial Sequence: Synthetic coding sequence
atgcggaagaccaacatgtggttcctggagcggctgcggggcagcggcgagaatggggcggctagaggagtgggatccgaagcaggggacaaagcctctaaaggtcccttgtactcgaatgtgctgacccccgataaaattccagacttttttatcccaccgaaactgccttcgggacctgcagaaggtgagggccaagcagctctgggtccctctacaagtgagcagaatttggccagtgcggcgcctcgccagacccccaggtctccaaggctccctgctaaactggctgctgaaagcaagagcctactcaaggccgctacacgacatgtaatccaaattgaaagcgcggaggattggttgagtgaggaagctaccgacgcagaccctcaggctcaaggtgccatgagcctgccctcagtgcctaaggcccaaacgagctacggatttgctatgctagccgagagtcctcacacacggcgtaaagagtcccttttccatagtgagcacggggctctggcacaagtgggctctcccggggccgggaggcgcagagcagccgccaaagccaatggaggcgatggaggtccgcgcgaggcgggtggggcattaatgagccccgggaggtatttctcaggcggcgagtccgacacaggatcttctgccgaatcgtcacccttcggatctccgctgctgtcccgttctgtaagcctcctgaagggctttgctcaggattcacaagccaaggttagtcaactacgacactccgtcggtcggcacggaagtctctcggctgacgacagtacgccggatgcctccccaggtagcaggaggcgactgaccaggagagcccccccagagccaggacctgagagtgggcaggcgagaggagaacataccgtgcacgtggggccgcgggggagcgttcggctgttagcagaatacgaggctggccaggcacggctcagagtgcacctgctcgcggccgagggtctctacgaccggttgtgtgacgcccgcagtatcaactgctgcgtgggcctgtgcctcgtacctggaaagttacagaagcaaaggtccacaatcgtgaagaacagtaggaggccagtgtttaatgaggatttcttcttcgatggcttggggccggcctcggttcggaaattagcccttagaatcaaagtggtgaacaagggctccagccttaagcgggataccttgttaggtgaaaaagagctgcccctgacgtccctactacctttcttatag

SEQ ID NO: 181020 - DNA, 3945 bp, Artificial Sequence
  Description of Artificial Sequence: Synthetic coding sequence
atgctggaccccagcagcagcgaggaggagagcgacgagatcgtggaagaagagtctggtaaagaggttctgggcagcgcaccatccggcgcaagactgagcccgtcaaggacatctgaaggatcggctggctccgctggtctgggggggggcggcgctggagcaggcgccggtgtgggtgcaggtggcgggggtggatccggcgcttcaagcgggggcggggccgggggactgcagcctagctctcgcgccggtggcgggcgcccctcatcaccctccccaagcgtcgtgtccgaaaaggagaaagaggaactggagcggctccagaaggaggaggaagagcgcaagaagcggcttcaactttacgtctttgtgatgcgctgcatcgcctaccccttcaacgctaagcagcccaccgatatggccaggcgccagcagaagatttcaaagcagcagctgcagaccgtcaaggacaggtttcaggccttccttaacggcgagactcagataatggccgacgaggcctttatgaatgctgtacagtcctactacgaagtcttcctcaagtcagaccgggtggctcggatggtgcaaagcggcggatgtagcgcgaatgattccagagaagtcttcaagaagcacattgagaagagggtcagaagtctaccagagatagatggtctgtccaaggaaaccgttctgagctcgtggatggccaaattcgacgccatttaccgtggtgaagaagacccacggaagcagcaggcccgcatgacagcctctgcagcaagtgaattaattctgagcaaagagcagctgtacgagatgttccagaatatactggggataaaaaaattcgagcatcagttgctgtataatgcatgtcaacttgacaatcccgacgagcaagcggcccaaatccgtagagaactggacggacgccttcagatggcggaccagatcgcccgcgagaggaaattccccaaatttgtaagcaaagaaatggagaatatgtatatcgaggaactcaaaagctccgtcaaccttctaatggccaatttggaatcaatgcccgtgtccaaagggggggaattcaaattgcagaaactcaagcgtagccacaatgcgtccattattgacatgggcgaggagtccgaaaatcagctgagcaaatcagatgtggtgctgtctttcagcctcgaggtagtgatcatggaagtccaggggctcaaatctctggcccccaatcgaatcgtttactgcactatggaagttgaaggcggtgagaagctgcagaccgatcaggccgaagcatctaagccgacttggggcacacagggcgactttagtacaacgcacgcacttcctgcagtgaaggttaaactattcacggagtcaactggagtccttgccttggaagacaaggagttgggtcgagtcattctccatcctactcctaactccccaaaacagtcagagtggcataaaatgacagtgagcaaaaattgtccagaccaggacctgaaaatcaagctggctgtcaggatggacaagccacaaaatatgaagcactcagggtacctgtgggccatcggcaaaaacgtatggaagcgctggaagaagcggttctttgtgctggtgcaggtctctcagtacacattcgctatgtgttcgtaccgggagaaaaaagcagaacctcaggagctcttacagcttgatggttataccgtagactacaccgacccgcagcccggcttagaaggcggccgcgctttctttaacgccgtcaaggaaggggacacagtaatcttcgcctccgacgacgaacaagacaggattctgtgggtccaggctatgtacagagccaccgggcagtcccataagcccgttccgccaacacaggtccagaagctcaatgcaaaggggggcaacgttccccaactggatgctccaatcagccaattctacgcagaccgtgctcagaaacacggcatggatgagttcatttcaagtaatccatgcaattttgaccacgcatccttatttgaaatggtacaaagactgactttggatcaccggctcaatgactcctacagctgtcttggatggttcagcccggggcaggtctttgtcctggatgagtactgcgcccgcaatggcgttagagggtgccaccgccacctgtgttacctgagagacctactggagcgtgccgaaaacggagcgatgattgacccaaccctgctgcactactcctttgccttttgcgcctcacacgttcacgggaatcgccccgatggtatagggacagtgaccgttgaagagaaagaacgattcgaggagatcaaagagcggttacgggtgctgcttgaaaaccagatcacacactttcgatattgctttccattcggtagacccgagggggccttaaaagcaactctatcactcttagagagagtgttgatgaaagacattgtgacaccagtccctcaagaagaggtgaagactgtgatcaggaagtgccttgagcaggctgcgctcgtcaattatagcagactgtctgaatacgccaagatagagggcaaaaagcgtgagatgtatgagcatcctgtgttctgtctcgctagccaagttatggatctgactatccagaatgtcggccgactcatcacacctgcaaaaaagctagaagacacgatccgcctcgccgaactggttatagaagtgctgcaacagaatgaggaacaccacgcagaggcattcgcatggtggtccgacctgatggtagagcacgccgagacattcctgtcattgtttgcagtcgatatggatgccgctttggaggtccaacctcctgacacttgggattcctttcccctcttccagctcctgaacgactttctccgcaccgattacaacctgtgcaacggtaagttccataagcacctccaggacctgttcgcaccactggtggtgcgctacgtggacctcatggaatctagcatcgctcagagcatccatagggggttcgagcgcgaatcatgggaaccagtcaataatggttcgggtacctctgaggacctattttggaagctcgacgccttgcagacttttattagagacctgcactggcctgaagaagagttcgggaaacacctggagcagaggcttaagttgatggcaagtgacatgatcgaaagctgcgtgaaaaggaccaggatcgcctttgaagtcaaactccagaaaacctcccggagcacggacttccgtgtgcctcagtccatctgtaccatgtttaatgttatggtagatgctaaggcgcagagcacgaagctgtgttcgatggaaatgggccaagagcaccagtaccactcgaagatcgacgagctcatcgaagagactgtgaaggaaatgataaccttgttagttgctaagtttgtgactatactggaaggcgttctggccaaattgtcgcgatatgacgaaggtaccctcttcagttctttcctctcttttaccgttaaggcggctagcaaatacgtggatgttcccaagcctgggatggatgtcgctgacgcctatgtgaccttcgtgagacactcacaagacgtgttgagggacaaggtcaacgaggagatgtacattgaaagattatttgaccagtggtacaatagttcaatgaacgtgatctgcacgtggttaactgacagaatggatctacaacttcatatctaccagttgaaaacactgattcgtatggtcaaaaaaacataccgagactttcgactgcagggtgtcctagacagtacccttaattccaagacttatgagacaattagaaataggctcacggttgaggaagccactgctagtgtgtctgagggagggggcttacaaggcatttcgatgaaggacagtgatgaggaggacgaggaagacgactag

SEQ ID NO: 181021 - DNA, 3825 bp, Artificial Sequence
  Description of Artificial Sequence: Synthetic coding sequence
atgctggaccccagcagcagcgaggaggagagcgacgagatcgtggaagaagaatcaggcaaggaggtcttaggcagcgctccttccggagccagattgagtccctcacggactagcgaagggagcgcaggctctgccggcctcggcggagggggcgccggggctggagcgggcgtaggcgctggcggcggaggcggatcaggcgcctcatctggcggcggagctggcggacttcagccctcaagccgggccggcgggggaaggccttcatcgccaagcccctcagtggtcagcgagaaagagaaggaggaactagagcggctgcagaaggaagaggaggagcgcaagaagagactccagctgtacgtgttcgttatgcggtgtatagcttatccatttaacgcaaagcagccaacggatatggcacgaaggcagcagaagattagcaaacagcagctgcagaccgttaaggatcgcttccaggctttcctgaatggagagacacaaataatggcggatgaggcctttatgaacgccgtccaatcatactacgaggtctttctgaaatccgacagggttgctcgaatggtccagtcaggcggctgttcagccaacgacagccgagaggtcttcaagaaacacattgagaagcgtgtcaggtccctgcctgagattgatgggcttagcaaggagacagtcctgagctcatggatggcaaaatttgacgccatctataggggggaagaggatcctcggaagcagcaagcccggatgaccgcttctgccgcatctgagctcatactgtcaaaggaacagctgtacgaaatgtttcagaatatcctgggaatcaaaaagttcgagcatcagctgctttataatgcctgccaactggacaatccagatgaacaggcagctcaaattcggagggagctcgatggaaggctgcagatggcagaccagattgcacgggagcgaaagtttccgaagtttgtaagcaaagaaatggagaacatgtacatcgaggaactcaagtcctctgtgaatctcctgatggccaacttggagtccatgccggtgtcaaaagggggcgaatttaaattacaaaaactgaaaagatcccataacgcaagtataatcgacatgggcgaggagtccgagaatcagctgtccaaatcagacgtggtgctctctttcagcctggaggtggttatcatggaagtccaggggttaaagagtctggcccccaatcgaattgtttactgcactatggaagtcgaaggaggtgaaaaattgcagacagatcaggctgaggcttcgaagccaacctgggggacacagggcgatttctccactactcatgcactcccagccgttaaggtgaagctctttactgaatccactggcgtgctcgctctcgaggataaggagctaggcagggtgatcttgcaccccacccccaattcacccaagcagtctgaatggcacaagatgacggtgtcaaaaaattgccctgatcaggacttgaaaattaagctggctgtccgtatggataaacctcagaacatgaaacattccgggtacctttgggcgatcggaaaaaatgtctggaaacggtggaagaagcgcttttttgtgcttgtgcaggtgtcacagtacacattcgctatgtgctcttatagggagaaaaaggccgaacctcaagaacttctgcagttggacggatatactgtggactacactgacccgcaaccagggttagagggcgggagggctttttttaacgcggttaaagagggtgacacagtgatttttgcaagcgacgacgagcaggaccgcattctgtgggttcaggctatgtatcgagcaacaggacagtctcacaaaccagtgcccccaacgcaggtgcagaagctaaacgcaaaggggggaaacgtgcctcagctcgacgcccccatcagccaattctatgcagatagagcacagaagcatggtatggacgaattcattagcagcaatccctgcaattttgaccacgcctcattatttgagatgggatggttcagccctgggcaggtgttcgttctcgacgagtactgcgctcgaaacggggtaagaggatgccaccgtcatctgtgttaccttcgggacctgttagagcgtgcggaaaatggcgcgatgatcgacccaacactgctccattacagcttcgccttttgcgcgtcacacgttcatggaaaccgccctgacgggattggaaccgttaccgtcgaggaaaaagaaagattcgaggaaataaaggaacggctgcgcgtgttgctggagaaccagataactcactttcgttactgttttccctttggccgaccggagggagccctgaaagcaaccctgagcctcctcgaaagagtgctcatgaaagatatcgttacccctgtcccgcaggaggaggtgaagaccgttattcggaaatgcctggagcaggctgcgctcgtcaactatagtaggcttagcgaatacgccaaaatcgaggagaacgtgggacggctaatcaccccggcaaaaaaactggaggacactattaggctggctgagctcgttatcgaagtattgcagcagaatgaggaacatcatgcagaagcgtttgcatggtggagtgacttgatggtcgagcatgccgagacatttctcagtctgtttgctgttgacatggacgcagcattggaggtgcagcccccagacacctgggatagtttcccattgttccaactgctaaatgattttttgagaactgattacaatttgtgcaatggaaagtttcataaacacctacaggatctatttgctccactcgtggtccgatatgttgacctcatggaaagctccatcgcccagagtatccacaggggatttgagcgggagagctgggagcccgttaataatggcagcggcaccagcgaggacctcttctggaaattagacgcactgcagacctttatccgcgatctgcactggcccgaagaggagtttggcaagcatctggagcagcgactgaaacttatggcttccgatatgatcgaatcttgtgttaaacggactcgaattgcatttgaggtgaaactccagaaaacttcacgttcaacagattttagggtacctcagtctatctgtacaatgttcaatgtcatggtcgatgctaaagcacaaagtacaaaactgtgttcaatggaaatgggtcaggagcaccaatatcacagcaaaatcgacgaattgattgaagagaccgttaaggagatgattacccttttggtggccaagttcgtaaccattttagaaggggttctcgctaagctgtcacgatacgatgagggcacactcttttctagctttctgtccttcactgtgaaagcagcaagcaagtacgtggatgttcctaagccagggatggatgtggccgacgcctatgtcacctttgtccgccatagccaggacgtcctcagagacaaggtcaatgaagagatgtacatagagcgactgtttgatcagtggtacaattcatccatgaatgtgatctgcacctggctgaccgacagaatggacttgcagctgcacatctaccagttaaagacactgattcgcatggtcaaaaagacttatagagatttcaggcttcaaggagtgcttgactcaactcttaattccaagacatacgaaactatccggaataggctcacggtggaagaggcaaccgcctctgtgtctgaaggcggtggcttacaggggattagcatgaaggacagcgatgaagaagacgaagaggacgactag

SEQ ID NO: 181022 - DNA, 4080 bp, Artificial Sequence
  Description of Artificial Sequence: Synthetic coding sequence
atgctggaccccagcagcagcgaggaggagagcgacgagatcgtggaggaagagtctggaaaggaagttctggggagcgcaccttccggtgcaaggttgtcccccagtcggacctctgaagggagcgcgggcagtgctggacttggaggaggcggtgctggagcaggcgccggggtcggggcaggcggaggtggcggcagcggcgcgtcctccggcggaggtgccggcgggctgcagccatccagtcgtgcaggcgggggtcgcccttccagcccgtctccgtcggtggtgagtgagaaagaaaaagaagaattagaacgcctgcaaaaagaggaggaggaaagaaagaaacgcttgcaactgtatgtgtttgtaatgagatgtatcgcatatccctttaatgcaaagcaacccacggacatggctcgaaggcagcaaaagatttccaagcagcaactccagacagtcaaggacaggttccaagccttcctgaacggggagactcagataatggccgacgaagcttttatgaacgccgtgcagtcctactacgaagtattccttaagtctgatagggtcgcaaggatggtccagagcgggggctgttccgcaaatgacagcagagaggtgttcaaaaagcacatcgaaaaaagagttcggagcctccccgagattgatgggctctcaaaggaaaccgttctgtcttcttggatggcgaagttcgacgcgatttataggggcgaagaggatcctagaaagcagcaggcgcgaatgacggcatctgccgcgtccgagctcatcctgagcaaagaacagctctacgaaatgttccagaatattctcggtatcaaaaaatttgagcatcaattattatacaatgcctgtcaactcgataacccagacgagcaagctgctcagatacggcgagagcttgatggacgattgcagatggctgaccaaatcgcgagggagcgtaagttcccgaagtttgtgtccaaagaaatggaaaacatgtatatcgaggaattgaagtcttccgtcaacctgctaatggccaacctagagagtatgcccgtgagcaagggaggtgagttcaagctccagaagctgaagcgcagtcacaacgctagcataatcgacatgggcgaggagtcagagaaccagctctccaaatctgatgtcgtgctgtctttttccctagaggtcgttatcatggaggtgcaagggctcaagtctttagctcctaaccggatcgtttactgtaccatggaggtggaaggaggagaaaaactccaaactgatcaggcagaggctagcaagccaacatggggaacccagggggacttcagcacaacccatgcgttgccggctgtcaaagtgaagctcttcacagagtccacgggcgttctggccctcgaagacaaggaactgggtcgtgtgattttgcaccctactcccaactcaccaaagcaaagcgaatggcacaaaatgacagtgagcaagaattgtccagaccaggatctcaagatcaaactggcagtgaggatggataaaccccagaacatgaaacactccggatacctgtgggctattggtaagaatgtctggaagagatggaagaaacggttttttgttcttgtccaggtgtctcagtacacattcgcgatgtgctcatatcgcgaaaagaaggcagaacctcaggaactgttacagctggatgggtatacagtggattatacagatcctcagcctggcctggaagggggccgagccttttttaatgctgtgaaagagggcgacactgttatctttgcttcagatgacgagcaagatagaatactgtgggtgcaggcaatgtatcgggctacagggcagagccataaaccggtacccccaacccaagtgcagaaactaaacgctaaaggcggaaatgtgcctcagctggacgctccgataagtcagttctacgcagatcgggcgcaaaagcacggcatggacgagttcatctcttcaaacccttgcaattttgaccacgcctcccttttcgagatggtacaacgcctgacgttagaccatcggctgaacgactcatactcgtgcctaggatggtttagtcccgggcaggtcttcgttcttgatgagtactgtgcgcggaacggagtcagggggtgccaccgacatctgtgttatctgcgggacttactcgaacgcgctgagaatggcgcaatgatcgatccgaccctgttacattactccttcgccttctgcgccagtcatgtccacggtaaccgcccagacggcatagggaccgtgactgtcgaggaaaaggaacgcttcgaggagatcaaagagaggctgcgcgtgctgctggaaaatcagattacccactttagatattgttttcccttcggccgacccgaaggagccctcaaagccaccctttcgctccttgagcgcgttctcatgaaggatattgttacccctgtgcctcaggaggaggtcaagacagtaataagaaaatgtctggaacaggcagctctagtgaattatagtcgcttgtccgagtatgccaagatcgaggctaactcatgtaccacggaaaacgtcggacgcctgattacaccagcgaaaaaactggaagacaccatccggttagcggagcttgtaatcgaggtgctgcagcagaacgaggagcaccacgccgaacctcacgttgataagggcgaagcatttgcctggtggtccgatctcatggtagaacatgcagaaacatttctgtctttgtttgcagtggatatggacgccgctctcgaagtgcagcctcccgacacatgggattctttcccactgtttcaactcctgaacgattttctcaggactgattacaatttgtgtaatggtaaattccataagcacctgcaggatctgtttgctcccttggtcgtacgttacgtggatctcatggagagtagtatcgctcaatccatacatcgcggatttgaacgagagtcctgggaacctgttaaaagcttaactagtaatctgcccaatgttaacttgccaaacgtgaacctccccaaagtgcctaacctacctgtgaacattccgttagggatcccccagatgcccacgttttctgccccttcctggatggcagccatttatgatgctgacaacgggagcggtacctccgaggatttattctggaagttggatgcactgcagacttttatcagagaccttcactggccagaagaggagttcggaaagcacctggaacagagactaaaactcatggccagcgatatgatcgaatcttgtgtcaaacgtactagaattgcatttgaagtaaagttacaaaaaacttcgcggtccaccgattttagggtgccacagagcatttgcacaatgttcaatgtaatggtcgacgccaaagcccaaagcacgaagctctgtagtatggagatggggcaggaaaaatataagaaaatgcgacaccaatatcacagtaaaatcgatgaacttatagaagaaactgttaaggaaatgattacgcttctggtagcaaagtttgtcacaatcctggagggagtgctagctaaactctctcggtatgatgaagggaccctgttctctagttttctcagctttacagtgaaagccgcatcgaaatacgttgatgtgcccaagccagggatggatgttgccgatgcttatgtgacatttgtgcgccattcccaagatgtattacgggacaaagtgaacgaagagatgtacatcgagaggttattcgaccagtggtacaactccagcatgaacgtgatttgcacatggctgaccgatagaatggacctccagctccacatctaccagcttaagaccttaattcgtatggtgaaaaaaacatatcgtgattttcgactgcagggagttctagactcaaccctcaactcgaaaacttacgaaaccatcagaaatcgactaactgtcgaagaagccaccgcctctgtaagcgagggcggaggtcttcaaggcatatcaatgaaagactccgacgaggaggatgaggaagacgattag

SEQ ID NO: 181023 - DNA, 4062 bp, Artificial Sequence
  Description of Artificial Sequence: Synthetic coding sequence
atgctggaccccagcagcagcgaggaggagagcgacgagatcgtggaggaggaatccggaaaggaggtgctggggtcagccccttccggagctagactctcgcctagcagaacttccgaagggtccgctgggagtgccgggctcggcgggggcggggcaggggcaggagcgggagtgggcgctggaggtggcggaggatcaggggccagtagcggcggtggggctgggggtctgcaacccagttcaagggccggaggtggccgcccgagtagtccttctccctcggttgtgagcgagaaagaaaaggaggagctggagaggctgcaaaaggaggaggaggaacggaaaaaacgcctccagctgtatgtgtttgtaatgagatgcattgcctaccctttcaatgccaaacagccaaccgacatggcaaggaggcagcaaaagatctccaagcaacaacttcagaccgtaaaggaccgctttcaggcctttcttaatggtgagacccagatcatggcagacgaagcctttatgaacgctgtgcagagttattatgaagtgttcctgaaaagcgacagggtggcacgcatggtgcagtccggcggatgcagtgcgaatgattctagggaggtgtttaagaagcacatcgaaaaaagggtgcgtagcctccctgagatcgacggattgagtaaggagaccgtgctctccagctggatggcaaaattcgacgccatttatagaggtgaagaggatccaagaaaacagcaggctcggatgacagcttcagcagcctcggagctgatcttatctaaagaacagctgtatgagatgtttcagaatattctggggattaagaaattcgaacatcagttgttgtacaatgcctgtcagcttgataaccccgatgaacaggcagcccaaatcagacgcgaactggatggccggctgcagatggcggatcagatcgctcgggaaagaaagttcccgaagttcgtgtcaaaggaaatggagaatatgtatatcgaggagctaaagtcctcagttaacctcctaatggctaatcttgaaagcatgcccgttagtaaaggaggcgaattcaagttacagaaactgaaaagatctcacaatgccagcatcatagatatgggcgaagagagcgagaatcagctgtctaagtcagacgtcgttctctcattcagcctggaagtcgtcatcatggaggtgcaggggcttaagtcactggctcctaatagaatcgtctactgtactatggaagtggagggcggagaaaagctccagaccgaccaagcggaggcaagcaagcctacttggggcacacagggtgacttcagtacaacccacgcccttcccgccgtgaaagtcaaactttttacggaaagtacaggcgttttggctctggaggacaaggagcttggtcgggtgatcctacatccgacaccaaatagccccaagcaaagcgagtggcacaagatgaccgtgtccaagaattgcccggaccaggatctcaagattaaacttgccgtccgcatggataagccacaaaatatgaaacattccgggtatctgtgggcaatagggaaaaacgtatggaaacggtggaagaagcggtttttcgtactagtgcaggtctcccaatacacattcgctatgtgctcttacagagagaagaaagccgaacctcaagaactcttacagctggatggctataccgtcgattacacagatccacaacccgggctggagggaggcagagcatttttcaacgccgtcaaggagggagacactgttatcttcgcctccgatgacgagcaggacagaatcctgtgggttcaggcgatgtatcgggccaccggccagagccacaagcccgtcccacctacccaggtgcagaagcttaacgcaaaaggtggcaacgtaccacaattagacgccccgattagtcagttttatgctgaccgtgcacaaaaacacggtatggacgaatttattagttccaacccctgcaattttgaccacgcttctctcttcgaaatggtgcagcggctgacgttggaccaccggctgaatgattcctactcctgtctgggatggttctcacctgggcaggtctttgtcttggacgaatattgcgcacgcaacggagtgcgaggatgccatagacacctctgttatttgcgagacctactagagcgcgctgagaatggcgctatgatcgatcccactctactgcattattcatttgccttctgcgcctcacacgtccatgggaaccgacccgatggcatcggcacagtgaccgtggaggagaaagagagatttgaagagattaaggagcgtctccgggtccttctggagaaccagattacccatttccgctactgtttccccttcggcaggccagagggtgctctaaaggccactctctcactgcttgaacgcgttttgatgaaagacattgtcacccctgttccccaggaggaagtgaagacagtaattaggaagtgcctggagcaggccgccctggttaactactcaagacttagcgagtacgcgaaaattgaagagaatcagaaggatgccgagaatgtgggcagactgatcacccctgccaaaaagctggaagacaccatccgcttggccgaactggtgattgaagtattgcagcagaatgaggaacaccatgctgaaccgcacgtggacaagggagaggccttcgcatggtggtctgatctcatggtggagcatgccgaaacctttctgagcctgttcgccgtggacatggacgcagcccttgaggtgcaaccgccggatacatgggatagctttcctttgtttcaattactgaatgactttctgagaacggactacaatttatgcaacggcaaatttcacaagcatcttcaggatctttttgcccctttggtcgtaaggtacgttgacctgatggaatccagcatcgcccagtctatacatcggggattcgaacgagagtcatgggaacctgtgaaaagcctgacttccaatctgcccaatgtgaacttacccaacgtgaacttacccaaggtgcctaacttgccagtgaatatccctctggggattccacagatgccaaccttctcggcaccttcatggatggccgctatctacgatgcggataatggcagtggaacatcagaggatctgttctggaaacttgatgcgctgcagacatttattagggacctgcattggccagaagaggagttcggcaagcatctggagcagcgtctgaaactgatggcatctgatatgatcgagtcctgcgtaaaacgcactaggatcgccttcgaggtcaagctgcaaaaaactagccgaagtacagattttagagtgccccaatccatctgtacaatgtttaatgtcatggtggatgctaaggctcagtctacaaaactatgcagcatggaaatgggacaggagcaccagtaccactccaaaatcgacgagctgatagaggaaactgtgaaagaaatgatcactctgttggtggcgaaattcgtgactatcctggagggagtgctggctaagctgtccaggtatgatgagggcacattattttcgtctttcctttccttcacagtgaaggccgctagcaagtatgtagatgtgcccaaaccaggtatggatgtggctgacgcctacgtgacctttgtccgccacagtcaagatgtgctgcgcgataaggtcaatgaggaaatgtacatcgagcgcctgttcgaccagtggtacaacagtagcatgaacgtgatctgtacttggctcaccgatcgaatggacctgcagttacacatttatcaattaaaaacactgatacggatggtgaagaaaacttatagggatttccgcttgcaaggtgtcctggacagtacgctcaattctaagacatacgagacgattcgaaatcgtctaacagttgaagaggcgaccgcaagtgtgagtgaaggaggggggcttcagggcattagcatgaaggactctgacgaagaggatgaagaggacgattag

SEQ ID NO: 181024 - DNA, 1038 bp, Artificial Sequence
  Description of Artificial Sequence: Synthetic coding sequence
tgactgcccaacgtgaacctgcccaacgtgaacctgcccaaggtgcccaacctcccagtgaacattcccctggggattccccagatgcccactttctcagccccatcctggatggccgccatttacgatgccgacaatggcagtgggacgagtgaagatttgttctggaaactcgacgcccttcagacatttattagagacctgcattggcccgaagaggagtttggcaagcacctggagcagagattaaaacttatggcatcagacatgattgagagctgtgttaagcgtaccaggatagccttcgaagtgaagttacagaaaacaagtcggagcaccgactttcgagtcccacagtctatatgtacaatgttcaatgtgatggtggatgcaaaggcccaaagcacaaagttgtgtagcatggagatgggccaggaattcgctaaaatgtggcaccagtaccattcaaagatcgacgaactcattgaagagactgtcaaggaaatgatcacgctgctcgtggcaaaatttgtgactattttagaaggtgtgctggctaagctctcccgttacgacgaagggactctgttcagttcatttctctcgtttacagtaaaggcagccagtaagtacgtagacgtaccaaaaccaggcatggatgttgctgatgcctacgtcactttcgtacggcatagccaggacgtcctgcgagataaagtaaatgaggaaatgtatattgagcggctctttgaccagtggtacaatagcagcatgaatgttatctgcacatggttgacagatcggatggaccttcagctgcacatctaccagctcaaaactctgatacgaatggttaagaaaacctaccgcgactttaggctgcaaggcgtgcttgacagtactctgaattccaagacctacgagactatacgtaaccggctcacagtggaagaagccacagcgtccgtgtctgagggcggggggctacaggggatcagtatgaaagatagtgatgaggaggacgaggaggatgactag

SEQ ID NO: 181025 - DNA, 3768 bp, Artificial Sequence
  Description of Artificial Sequence: Synthetic coding sequence
atgctggaccccagcagcagcgaggaggagagcgacgagggcctggaagaagagtcgagggacgtgctggtagctgctggttcttcccaaagagctcctccagccccgacacgggaagggaggagagatgcccctggcagggcagggggcggcggcgctgctcgcagcgtgtccccctctccctctgtgctgtccgaagggcgggatgaaccccagcgtcagcttgacgacgagcaggagagaaggatccggcttcaactgtatgttttcgtcgttcggtgtattgcttatccattcaacgccaagcagccaaccgatatggccagaagacagcagaaactcaacaaacagcagctacagctcctcaaggagaggtttcaggcctttctgaatggtgagacccagattgtggcagacgaggccttctgcaatgccgtcaggagctactatgaagtgttcttgaagtccgatagggtggctcgcatggtacagagtggtggctgctctgctaacgatttcagggaagtctttaagaagaacatcgaaaagcgagtgcggagtttacccgaaatcgatggattgtccaaggagacagtgctgtcatcctggatcgccaagtacgacgcgatttacaggggcgaggaggatttgtgcaagcagccaaacagaatggccctgagcgcagtgagtgagcttatccttagcaaagaacagctgtacgagatgtttcagcagatcctaggaatcaagaagctggaacaccagctcctctataatgcctgtcaactggacaacgccgacgagcaggccgctcaaatccgtagggagctcgacggccggttgcaactagccgacaaaatggctaaagagagaaagttccccaagtttatcgccaaagatatggagaacatgtatattgaggaactcaggtccagcgtcaatctgctgatggctaatctggagagtctccctgtgagcaaggggggccctgagttcaaattacaaaaactgaaacggtcccaaaattccgcatttctggacattggtgatgaaaacgagattcagctgagtaagtctgacgttgttctcagcttcacgcttgagatcgttattatggaggtgcaggggctgaaaagcgttgctcctaatcggattgtttactgcacaatggaagtggagggagaaaagctgcagacagaccaagccgaggcctcacgtccacagtgggggacacaaggggactttacaaccactcacccaagacccgttgttaaggtgaagctgttcacggaatctaccggcgtgctcgcattggaagacaaggagttaggacgggtcatcctctaccccacatcaaacagctcaaaaagcgccgaattgcacaggatggtggtccccaaaaacagccaggactccgatctgaaaataaaactcgctgtgagaatggacaagccggcccacatgaaacacagcggatatctgtacgcactaggccagaaggtttggaagcgatggaaaaaacggtattttgtgttggtacaagtgtcccaatacaccttcgctatgtgctcttatagagagaaaaagtctgaaccgcaggagctgatgcaattagaagggtacactgttgattacaccgacccccacccaggactgcaagggggatgcatgttttttaacgccgttaaggaaggagacaccgttatcttcgcctctgatgacgagcaggacagaattctatgggtccaagctatgtaccgggcaacggggcaaagctacaagcccgttccggcaatccagacgcagaagctcaaccccaaaggcggaacactgcacgcagacgcccagctttacgctgataggtttcagaaacacgggatggatgaattcatttccgccaatccttgtaagcttgatcatgcctttttattcaggattctgcaacgccagactttggaccatcgtctgaacgactcttacagctgcctgggttggttttccccgggacaggtttttgtgctagacgaatactgtgctaggtatggagttagaggctgccaccggcacctatgttacctcgctgagctcatggaacacagcgagaatggagccgtcatcgatccaacccttctccactactcatttgcattttgcgcaagtcatgtgcacggaaaccggcctgatggtattgggacagttagcgtggaggagaaggaaaggtttgaagagattaaagaaaggctttcttcccttttagaaaatcagatcagtcacttccgctattgctttccatttggaagaccggagggcgcccttaaggccactttatctctcttggagagggtcttgatgaaggacatcgccacgccaatccctgccgaggaagtgaagaaggtggtgagaaaatgtctcgaaaaagccgccctcattaactacacccgtctaaccgagtacgctaagatcgaagaaaccatgaatcaagcaagccctgctagaaaactggaggaaatcctgcatttggccgaactttgtatagaggtgctgcaacagaatgaagagcatcacgccgaagcctttgcttggtggcctgatctgctcgcagaacatgctgaaaaattctgggctctatttacagttgacatggacacagccttagaagcgcaacctcaggacagctgggattcgttcccactctttcaactcctcaacaactttctaagaaatgacactctgctttgtaatggaaaattccacaagcacctgcaagagattttcgtgccactggtggtgcggtacgtcgacctcatggagtcctccattgcccaatcaatacatcgcggattcgagcaggagacttggcagcccgtgaacaatggatccgcaacgagtgaggaccttttttggaagttagacgcgcttcagatgttcgtctttgatctccactggcccgaacaggagtttgcccatcacttagagcaaagactgaagctcatggcaagcgatatgctcgaggcttgcgttaagcgcacgaggaccgccttcgaactgaaactgcagaaggcaagtaagactaccgatctccggattccagcctcagtgtgtacaatgttcaatgtgctggtggatgcaaagaagcagtcgacaaagctgtgtgccctggacggcggccaagaggtgtgcagaatctttcagcagtatcatagtaagatcgatgacctgatagacaactccgttaaagagattatttcactgctggtgagtaaatttgtctcggtgcttgagggagtgctcagcaaactgagccgctacgacgaaggcacttttttttcatctattctttcctttaccgtcaaagccgctgctaaatatgtggatgtccccaaaccaggcatggatttggcagacacttatataatgttcgttagacaaaatcaggacatcttgcgcgaaaaggtaaatgaggaaatgtacattgagaagctatttgaccagtggtactcctcctctatgaaagttatatgcgtctggctgactgacaggctagatctccagctacacatttatcagctgaaaaccctaataaagatcgttaagaagacttatcgcgattttcggctacagggtgtgttggagggtaccctcaacagcaaaacatacgataccgtccatcgacgtttaactgttgaagaggcaacagcaagtgttagcgagggaggtggcctgcagggaataaccatgaaggactcggatgaggaggaggagggctag

SEQ ID NO: 181026 - DNA, 3885 bp, Artificial Sequence
  Description of Artificial Sequence: Synthetic coding sequence
atgctggaccccagcagcagcgaggaggagagcgacgagggcctggaagaggagagccgggatgtgttagtggccgcgggatcctctcagcgggcacctccagctccgaccagggagggaaggcgggacgctccaggccgggcaggtggcggcggtgcagcacggtcagtgagtccctctccatccgtattgagcgaggggagagacgagcctcagcggcagctcgacgacgaacaagaacgccgaattcgtctccaactttatgtgtttgtggtccgctgcatcgcttacccttttaacgctaaacagccgacagatatggccagacgtcagcagaagcttaacaagcagcagttgcaactgcttaaggagagatttcaggcctttttgaatggggagacccagatcgtggcagacgaagcattctgtaacgccgtacgctcctactatgaggtcttcctcaagtcagacagggttgccagaatggtgcagagcggtggttgcagcgccaacgactttcgggaggtgtttaagaaaaatattgagaaacgcgtgaggtctctaccagagatcgacgggctaagtaaggaaacagtgctcagcagttggattgcaaaatacgacgcaatatatcggggggaggaggacctctgcaagcagccgaatcgaatggcgcttagtgctgttagcgaactgatcctgtcaaaggagcaactgtacgaaatgtttcagcagatcctgggtattaaaaaacttgagcaccagttgttgtataacgcctgccagctggacaacgccgatgagcaggcagcacaaatccggcgtgagctagacggacggctacagctcgccgacaaaatggccaaggaaagaaagttccccaagttcatagccaaggatatggaaaacatgtatatcgaggagctaagaagctcagtgaacttgctgatggcaaacttagaaagtctgcctgtgagcaaaggaggcccagagttcaaactgcagaaactgaaaaggtcacagaactctgcttttctggacataggggatgagaacgaaatacaactctccaaaagcgacgtggtccttagttttaccctggagattgtcataatggaggtacagggcctgaaatccgtggcccctaatcgcattgtgtactgtacaatggaggtagaaggcgaaaagctgcagaccgatcaagccgaagccagtaggccccagtgggggacccaaggggactttacaaccactcaccctcgacccgtggtaaaggttaagctgtttacggaaagcaccggggtgctggcgttagaggataaagaactcggacgtgttattctctatcctacgagcaatagcagcaagtctgctgagttacacaggatggtcgtccctaagaactcccaggatagcgatctgaaaattaagctggccgtgagaatggacaagccagcgcacatgaaacattctgggtacctatatgccttgggccagaaggtgtggaagcggtggaaaaagagatattttgtgctggttcaagtgagccagtatactttcgccatgtgttcatacagggagaagaaatccgagccacaagaactgatgcagttagagggctatactgtagattataccgatcctcaccctgggcttcaaggcggatgcatgttcttcaacgccgtgaaagagggggataccgtgatcttcgcctctgacgatgagcaagaccggattctttgggttcaggctatgtaccgggccacagggcagagctacaagccggtccccgccatacagacccagaagctgaaccccaaaggcgggactttgcacgcagacgctcagctttcagaatttactgacgcagatcgcttccaaaagcatggcatggacgagttcatctccgctaacccttgtaaacttgatcatgcttttttattcaggatcctccagcgacagacgctcgatcatagattgaacgacagttactcctgtttgggctggttcagtcccgggcaagtgttcgttttggacgagtactgtgctcgctacggcgtaagagggtgccacagacacctgtgctacctggcggaattgatggagcactctgagaatggcgctgtcattgacccgacgctgctgcattactcattcgctttttgcgcctcccacgtgcacggtaaccggcccgatggaatcggtactgtgtccgtggaggagaaggagcgctttgaggagattaaagagcgactctcttccctcctagagaaccagatcagtcatttccgatattgctttcctttcggcagacccgagggcgccctgaaagccaccctaagccttctggaacgggtactgatgaaagatatcgccacacccattcccgcggaggaggtgaaaaaggtcgtacgcaagtgcttggaaaaggctgccctcatcaactatacccgtttaaccgaatacgcaaagatcgaggagactatgaaccaggcgagtcctgccaggaaattggaggagatcctccatctcgcagagctgtgtatcgaggtgttacagcagaatgaggagcaccatgcagaggctttcgcatggtggcctgatttgttagccgaacacgcagagaaattctgggcattgttcaccgtggacatggataccgccctggaggcacagccccaagatagctgggacagttttcccctatttcaattactgaataattttctgagaaatgatactctgctatgcaacgggaagttccataaacacctccaggaaatctttgtgccactggtggtacgctacgttgatcttatggagtcatctatcgcgcagtcaatccatagagggttcgagcaggagacatggcagcctgttaaaaacatcgcaaatagtctgccaaacgtcgctttacccaaggtcccctctttgcccctgaacttacctcaaattcccaatattagcaccgcttcttggatgccttctctctacgaaagtactaacggatccgcaacgtctgaggatttgttttggaagttggatgctctacagatgttcgtatttgatctccactggccagaacaagagttcgcacatcacctcgagcagcggctaaaacttatggcctcggacatgctcgaggcctgcgtgaagaggacccggactgccttcgaactgaagctccagaaagcgagcaagacgactgacctgagaataccagcaagcgtctgcacgatgtttaatgtgcttgtcgatgcaaagaagcagtcaactaagctatgcgccttggatggcggacaggagcagcagtaccatagcaaaatcgacgatctcatagacaatagtgtgaaggaaattatttccctcctagtgtcaaaattcgtgtcagtcttggagggcgtactgtctaaactaagccgctacgatgagggaacatttttctctagcatcttaagcttcacagtaaaggccgccgccaagtatgtggacgtgcccaagccaggaatggatcttgccgatacctacattatgtttgtgcgtcagaaccaggatatcttgcgcgagaaggtaaacgaagagatgtatattgaaaaactattcgaccaatggtacagcagtagtatgaaagtgatctgtgtatggctgaccgaccggctggatctccagctacatatctatcagctgaaaaccttgatcaaaatcgttaaaaagacctatagggacttcagactccaaggggttctcgaaggcactcttaatagcaaaacttacgatacagtgcaccggaggctcactgtggaagaggcaaccgcgtcagtctcagagggcggcgggctgcagggaattacgatgaaggattccgacgaagaagaggagggctag

SEQ ID NO: 181027 - DNA, 1410 bp, Artificial Sequence
  Description of Artificial Sequence: Synthetic coding sequence
atgaaccaggccagccccgcccggaagctggaggagatcctgcaccttgctgagctctgtattgaggtgctccaacagaatgaggagcaccacgcggaactgaggcacgccttcgcctggtggcctgacctcctggcagagcatgcagagaagttttgggcgctgttcacagttgacatggatactgccttggaggctcagcctcaggattcatgggactcttttcccctcttccaactgctgaataatttcctgaggaacgatacactactgtgcaacggaaagttccacaaacacttgcaggagatcttcgttccactcgtggtacggtatgtcgatctgatggaaagctccattgctcagtctatccacaggggatttgaacaggaaacctggcagccggtcaagaatattgccaactccttaccgaacgtagctctgcccaaagttcctagtctgcctctgaatctgcctcagattcccaatatcagcacagcttcatggatgccatctttgtatgaaagcactaatggtagtgccacttcagaggatctgttttggaagctggatgcccttcagatgttcgtatttgatcttcattggccggagcaggagttcgcccaccacctggaacagagactgaaactcatggccagtgatatgctcgaagcctgcgtcaaaagaacccggaccgcttttgaactgaagttgcagaaagcctccaagactacagatttgaggatccctgctagcgtgtgcactatgtttaatgtactcgttgatgctaaaaaacagtctacaaagctgtgcgcactggacggcggacaggagcagcagtaccacagcaagatcgacgacctgatagacaactctgtgaaggaaataatcagcttgcttgtgtccaaattcgtttccgtgctggaaggcgtgcttagcaagttgagcaggtatgatgagggtaccttcttctctagcatactctcttttaccgtaaaagcagcagccaaatacgttgatgtgcccaaaccaggcatggatcttgcagatacttatattatgttcgttcgacagaaccaagatattttacgtgaaaaagtgaacgaagagatgtatattgaaaaactctttgaccaatggtacagttcttcgatgaaggttatctgtgtgtggttaactgacaggctggatctgcagctgcatatctaccagctcaaaacgttgataaagatcgtgaagaaaacttacagagactttcgcctgcaaggcgtcttagaaggcacactgaactcaaaaacctacgacacggttcaccgcaggttgacagttgaggaagcaacagcatctgtgtcagagggcggaggcctgcagggtatcaccatgaaagactcagacgaagaggaggaaggctag

SEQ ID NO: 181028 - DNA, 2700 bp, Artificial Sequence
  Description of Artificial Sequence: Synthetic coding sequence
tgagagatccagctgagcaagagcgacgtggtgctgagcttcaccctcgaaatcgtgattatggaggtgcaggggctcaagtctgtggctcccaatcggatcgtgtattgtaccatggaggtggagggggaaaaattgcaaactgatcaggccgaggctagccggcctcagtggggaactcagggcgacttcacaactacgcatcctcgacccgttgtaaaagtgaaactgttcaccgagtctacaggggtgctggccttagaagacaaggagttaggacgtgtcatcctgtatcccacatccaacagtagcaagagcgcagaacttcatcgtatggttgtccccaaaaactcgcaagactcggatctgaaaattaagctggccgttcgaatggataagccagcccacatgaaacattctgggtatctgtatgcattggggcagaaggtttggaagagatggaagaagaggtatttcgttctcgttcaggtgagccaatacacgtttgcaatgtgctcttacagagagaaaaaatccgagccacaggagttgatgcagctggagggttacaccgtagattacacagacccgcaccctggccttcaggggggttgcatgttctttaacgccgtaaaagaaggcgatacggtgatcttcgctagtgacgacgaacaggataggattttgtgggttcaagcgatgtatcgggcaaccggacaatcctataagcccgtgcctgcgatccaaactcaaaagcttaacccaaagggaggcacactccacgctgatgcacagctatatgccgaccgatttcaaaagcacggcatggacgaattcatttcagctaacccttgcaagttggatcacgcctttctgtttcggatcctacagcgccaaactctggaccatcgcctgaacgattcctactcatgcttgggatggtttagtcctgggcaggtgtttgtcctggacgagtattgcgcaaggtatggggtcagggggtgtcatcgccacttatgttacctcgccgaattgatggaacactccgagaatggtgctgtaatcgatccaacgcttctacattattcctttgccttttgcgcatctcatgtccacggtaataggcctgatgggatcggcactgtgtcggttgaggagaaggaacggtttgaggagattaaagaaagactcagctcactcctggagaatcaaattagccacttccgttactgtttccccttcgggagacctgagggagcacttaaggctaccttgtccttactcgaacgagtattaatgaaagacattgcgacacctatcccagcggaagaagtgaaaaaagttgtgcgaaagtgtttggagaaggcagccctgataaattataccagactcacagaatacgctaaaatcgaggagactatgaatcaggcgagccctgctcgaaaactggaggaaattctccacctcgccgaactgtgtatcgaagtactgcagcaaaacgaagagcaccatgctgaggcttttgcttggtggcccgacctgctggctgaacacgctgagaagttttgggctttgttcacagtggacatggatacagccctggaagcacagccacaggattcttgggactcattcccactctttcaactgttgaacaatttcctcagaaacgatacgttgttgtgcaatggaaaattccacaagcacttgcaggaaattttcgtgccactggtcgtacggtatgtggatttaatggaatcaagtattgcacaatctatccacaggggttttgaacaggagacctggcaacctgtcaataatggctctgctaccagtgaggacctgttctggaagctggacgcactgcagatgttcgtattcgacctgcattggccggaacaagagttcgctcaccacctggaacagcgccttaagctcatggcatccgatatgctggaggcttgcgtcaagcgaacaagaacagctttcgaactcaagctgcagaaggcctctaagaccaccgatctaaggatccctgcttccgtttgtacaatgttcaatgtgctcgttgatgcaaaaaaacaaagcacaaagttatgcgctctcgatggtggacaggaacagcagtaccactccaagatcgatgacctgatagacaacagcgtcaaggagatcatctctctgctagtcagtaaattcgtgtctgtgcttgagggcgttctgagcaagctctcacgatacgacgagggtaccttcttctcttcgatcctgagcttcacagtaaaggctgccgccaagtatgtggacgtgccaaaacccggcatggatctggccgatacctacatcatgtttgttcgacaaaatcaagacattctgcgcgagaaggtgaatgaagaaatgtatattgagaagctgtttgatcagtggtattcttcttctatgaaggtaatttgcgtgtggttgacggataggctggatctgcaattgcacatttaccaactgaagaccctgattaaaatcgtgaaaaaaacctacagggatttccgacttcaaggggtgctcgaaggcacgctgaatagcaaaacctatgatactgttcatcggcgcctaactgtagaggaagcaacagctagcgtcagtgagggcggcggattgcagggaataacaatgaaagactctgacgaagaggaagagggatag

SEQ ID NO: 181029 - DNA, 3768 bp, Artificial Sequence
  Description of Artificial Sequence: Synthetic coding sequence
atgctggaccccagcagcagcgaggaggagagcgacgagggcctggaggaggagagcagggacgtgcttgtcgctgcaggctcctcgcagagagcccctcctgcccccacgcgtgagggccggcgggacgccccgggaagggccggtggaggcggcgcggcgaggtccgtgtcaccctcaccaagtgttctgtctgaaggccgggacgaacctcaaaggcaattagatgatgagcaggaaaggcggataaggctccagttatatgtcttcgtggttcggtgcattgcctatccattcaacgccaagcagccgacagacatggcccgcaggcagcagaagctaaataagcagcagcttcaactgctgaaagaaaggttccaagcttttttaaacggggaaacccaaatcgtcgccgacgaggcattttgcaatgccgtgaggagttactacgaggtgttcttaaagtctgaccgagtagcaagaatggttcagagtggcggctgctccgccaatgatttccgggaagtgttcaagaagaatatcgagaaaagagtgaggagccttcccgaaattgacggcttaagcaaagagacagtactgtcttcatggatcgctaagtatgatgccatatatcgtggagaagaggatctctgcaagcaaccaaaccgcatggcgctttcagccgtgagcgaactgattctgagcaaggagcaactttatgagatgttccaacagattcttgggatcaagaaattggagcatcagctgctttataatgcatgccagctggataatgcagacgagcaggccgctcagatccgcagggagttggatggccggttgcagctcgccgacaaaatggccaaagagaggaaatttccaaaattcattgccaaagacatggaaaacatgtatattgaagagctccgcagctccgtgaacctactgatggcaaatctggagtctcttcccgtaagtaagggcggtcctgaattcaaacttcaaaaactcaagagatctcagaactccgctttcctggacattggtgatgagaacgagatccagctgtcaaaaagcgacgtggtcctgtcgttcacgctcgaaatcgtaattatggaggtgcaggggctgaaatccgttgcacccaatcgaatcgtctactgcactatggaagtggagggggagaagctccagacagaccaggcggaggcctcaaggccacagtggggaacacagggcgattttaccaccacccacccacggcccgtggtgaaagtaaaactcttcactgagtcaacgggcgttctcgcccttgaagacaaagaacttggccgcgtgattctgtaccctacctctaattcaagtaaatcagcggagctgcaccgtatggtcgtgccaaaaaacagccaggacagcgatttaaagatcaaactcgcagtgcggatggataagcccgcccatatgaaacactccggttacctctacgctctgggacaaaaagtgtggaaacgatggaagaagaggtattttgtgctcgtccaggtgtcccagtacaccttcgcaatgtgctcttacagggagaagaaatcagaaccacaggagctaatgcagctcgagggctatacagtagattataccgacccgcaccctggtctgcagggcggctgcatgttcttcaatgccgtcaaagagggcgacactgtgatatttgcctccgacgacgaacaggaccgtattttatgggtccaggctatgtatcgcgcgactgggcagtcttacaagcctgtgcccgccatccagacccagaaattaaacccaaagggaggaactctgcacgccgacgcacaactgtacgccgatcgctttcagaagcacggcatggacgagtttatcagtgccaatccctgcaaacttgaccacgcctttttatttagaattctgcagagacagactctcgatcatagactgaatgacagctatagctgcctggggtggttcagcccggggcaagtgtttgtactggatgaatactgcgcccgctacggggtgcgcggttgtcacaggcatttgtgttatcttgctgagctgatggagcattccgagaatggggcagtcattgatcccacgctcctacactacagctttgctttctgcgcctcccacgtgcatgggaacagacccgacggtatcggaaccgtttcagtggaggaaaaggagcgcttcgaggagattaaggagcggctgagctctctgctcgaaaatcagataagtcacttccgctactgtttcccctttggacgccccgagggggctttgaaggccaccctgagccttctggagagggtgttaatgaaagatatcgctacacccattcctgccgaggaagtgaaaaaggtcgtaagaaagtgtctggaaaaggcagctttaataaactataccagactgactgagtatgctaagatagaggaaactatgaatcaagcgtcccccgctaggaaactcgaggagatactgcacttagctgaactgtgtattgaagtgttgcagcaaaatgaggagcatcatgctgaagcctttgcttggtggcccgaccttttggccgaacatgccgaaaaattctgggcgttattcaccgtggatatggataccgcccttgaagctcagcctcaggattcctgggatagttttccgctcttccaactcctgaacaatttcctgcggaatgacaccctgctttgcaatgggaaattccataaacacctgcaggagatctttgtgccattggtggtgagatacgttgatctcatggagtcgtccatagctcagagcatccacaggggttttgagcaggagacctggcagcctgttaataatgggtctgcaacgtccgaggacctcttctggaagcttgacgcacttcagatgttcgttttcgacttacattggcccgaacaggagtttgctcatcatttagagcagcgtctgaaactcatggctagcgatatgctagaggcctgtgtgaagcggacaaggacggccttcgaactgaagctacagaaagcctcaaagacaactgatctgcgaatacctgcttcagtctgcacaatgttcaacgtacttgtggacgctaagaagcagtctacaaagctgtgtgccctggacgggggccaggaattcggttctcagtggcaacagtaccacagcaagatcgatgatctgattgacaactcagtgaaagaaattatcagtctgctcgtctccaagtttgtgtctgtcctggagggggtattgtctaagctgagcaggtatgatgagggaacttttttctcctcaatattatccttcacggtgaaggccgctgccaaatacgtcgacgttccaaagccaggaatggatctggccgatacctatattatgttcgtgcgacagaatcaggatatcctgagagaaaaggtgaacgaggagatgtacattgaaaagctctttgaccaatggtactccagtagcatgaaagtcatctgtgtgtggttgactgatcgactggaccttcagcttcacatctaccagctcaagacgctcataaagattgtgaagaagacataccgcgactttcgcttgcaaggggttctggaagggacccttaacagcaaaacgtacgataccgttcacagaagactgactgttgaggaagccacagcaagtgtgagtgaggggggcggactccaggggataactatgaaggactccgacgaagaggaagaaggttag

SEQ ID NO: 181030 - DNA, 3906 bp, Artificial Sequence
  Description of Artificial Sequence: Synthetic coding sequence
atgctggaccccagcagcagcgaggaggagagcgacgagggcctggaggaagaatcgagggatgtcttggtggctgccggttcctcacagagggcgccaccagcacctacaagagagggacgccgggacgccccaggccgtgctggagggggcggcgctgcccgctccgtgtctccctccccaagtgtcctgtcagaagggagagacgagcctcagagacagttggacgatgagcaagagcgtcgcatccgcctacagctttacgtgttcgtggtgcggtgcatcgcctatcccttcaatgccaaacaaccaaccgacatggccagaagacaacagaaactgaataagcaacagctccagctgttgaaggaaagatttcaggcattcctcaacggcgaaacacagatcgtggccgatgaagccttttgtaatgccgtgcgctcatattacgaggtatttttgaagagcgacagggtggcccgcatggtgcaatctggtggttgttctgccaacgatttcagagaggtctttaaaaaaaatatcgagaaacgtgtgcggagtctgcccgaaattgatggcctctcaaaagagaccgtgctgtccagttggatcgctaagtacgatgccatttacagaggggaggaagatctgtgcaaacagccaaaccgtatggcccttagtgctgtgagcgaacttatactctcaaaggagcagctttacgaaatgttccagcagatcttagggatcaagaagctggagcatcagcttctttataacgcgtgtcagctggataacgctgacgaacaggctgcacagattcgccgcgaattggatggcagattacagctggccgacaagatggccaaagaacgcaagttccctaaatttatagccaaagatatggagaacatgtacattgaggaactgcggagcagcgtcaacctcctgatggcaaatctggagagcctcccagtgtctaaggggggccctgagttcaagctgcaaaaattgaaacgcagtcagaatagtgccttcttggatatcggagacgaaaacgagatccagctctcaaaatctgacgtcgtgctgtcattcacgttagaaatcgtgatcatggaagtccagggcctgaaaagtgtcgcaccaaatcgcattgtgtattgtactatggaagtcgaaggagagaaactgcaaaccgaccaggctgaggccagtcggccacagtggggaacccagggggatttcacgaccacgcacccgagacctgtcgtgaaagtgaagctgtttacggaatccaccggagtgctcgccctcgaagataaggaactcggtcgggttattctgtacccgacatccaacagctccaagagcgccgaattgcacaggatggtcgtgccaaagaattcacaggattccgatctgaaaatcaaactcgccgtgcgcatggataagccagcacatatgaaacattccggctacctctacgcactgggccagaaggtgtggaagcgatggaagaagcgctacttcgtactggtgcaagtgagtcagtatacctttgcaatgtgtagctatcgtgagaagaaatccgaaccacaggagcttatgcagctggagggctacacagtggactacacagatccacacccaggtctgcagggcggatgcatgtttttcaatgctgtcaaggaaggagatacagtcatatttgcaagtgatgatgagcaagatcgcattctgtgggtgcaggcaatgtacagagctactggccagtcgtataaaccagtgcccgcaattcagacccagaagctgaaccccaaagggggcacccttcatgcagacgcccaactcagcgagttcactgacgcagaccggttccagaaacatggtatggatgagtttataagtgcaaatccatgtaaactggatcacgcattcctctttagaatcctccaacgacagaccctcgatcacaggctgaatgactcctattcgtgccttggctggttctcacctggtcaggtgtttgtgctcgatgagtactgtgccagatacggcgtacggggctgccacaggcatctgtgctatctagcagaactgatggagcactcggaaaatggcgccgttatcgacccgactttgttgcattactcgttcgcgttctgcgcctctcatgtgcacgggaacaggcctgacggcatcggtacagtctcagtggaggagaaagaacggtttgaggagattaaagagaggctgtcgtccttgctggaaaaccagatttcacatttccgctattgctttccctttgggcggccagagggagccctcaaagccaccctgtcactcctcgaaagggtgctgatgaaggacatcgctactccaatacccgctgaagaggtcaagaaggttgtgcgcaaatgcctagaaaaggccgccctcatcaactacacgcgcctcacggagtacgcaaaaattgaaggacccgccgagaaggagactgaaaccatgaaccaggccagccctgctcggaaattagaggaaatattgcatttggcggaactgtgtattgaagtgctgcagcaaaatgaggagcaccacgcagaggcattcgcatggtggcccgatttacttgcagagcacgccgagaaattctgggctcttttcaccgtggacatggatactgctttagaggctcagccccaagacagctgggattctttcccactctttcagctcctgaacaattttttaagaaacgataccctactctgcaacgggaaattccataaacatctacaggagatatttgtgcccctggtggtgaggtatgtggatttgatggagagctccattgctcagtcaattcacagaggattcgagcaagagacttggcaacctgtaaagaacattgccaacagcctgcccaacgtggcacttccgaaggtgcctagtctcccccttaacctgccccaaataccaaacatcagtaccgcgagctggatgcccagcctctacgagagcaccaacggcagtgccacctcagaagacttgttttggaagctagacgcactgcaaatgttcgtgtttgaccttcattggcctgagcaggaatttgcccatcaccttgagcaacggttgaaattaatggccagcgatatgctcgaagcatgcgtgaagagaacgcgaactgcattcgagctgaaactacagaaagcctctaagaccacagatcttcgcataccagccagtgtttgcaccatgttcaacgtcctggtggacgcaaagaagcagtccactaaactgtgcgcactggatggcggacaggagcaacagtatcactctaaaattgacgatctgatcgataactccgttaaagaaatcatctcgttactggtcagtaaattcgtctccgtcttggaaggtgtgctatccaagctgtcccgatatgatgaaggaactttttttagcagtattctgtcctttacagtgaaagcggccgcgaagtacgtggacgtccccaagcccggcatggacttggccgatacctacatcatgttcgttagacagaaccaggacatcctgagggagaaagtgaatgaggaaatgtatattgagaagttgtttgaccagtggtattcttcatcaatgaaggtgatttgcgtgtggctgaccgaccgcctcgatctgcagctgcacatttaccaactgaaaactttaatcaaaatcgtcaagaaaacttatcgcgactttcgtctgcaaggcgttctggaaggtaccctgaattcgaagacttatgatacagtccatagacgattgaccgtggaggaagccacggcctctgtgtcagaaggaggaggccttcaggggatcaccatgaaggacagcgatgaagaggaggaaggatag

SEQ ID NO: 181031 - DNA, 3891 bp, Artificial Sequence
  Description of Artificial Sequence: Synthetic coding sequence
atgctggaccccagcagcagcgaggaggagagcgacgagggcctggaggaagagtcccgggacgtgttggtggcggccgggagcagccagagagcaccaccggctcctacacgcgaggggcggcgcgacgcccctggacgggccggtggcggtggggctgcacgatcggttagcccgtctccatcagtgttaagcgagggcagggatgagcctcagcggcagcttgatgacgaacaggaaaggagaattcggctgcaactatacgtgttcgtggtcagatgtatagcctaccccttcaacgccaagcagcccacggacatggctcgaagacagcagaaactgaataagcagcagctgcaactgctgaaagagagatttcaggcattcctgaatggagaaactcagattgtcgccgacgaggcattttgcaacgctgttcggtcctattacgaggtgttccttaaaagtgaccgggtagcccgtatggtccagagcggcgggtgcagtgccaacgactttagggaagtgtttaagaagaacatcgagaaaagagttagatccttgcctgagatcgatggcctgagtaaagagactgtactgtccagttggatcgccaagtatgacgccatttaccgcggagaggaggatttatgcaaacagcctaacaggatggccctgagcgctgtttccgaactcatcctatctaaagagcaactgtatgaaatgttccagcagatcctgggaataaagaagcttgaacaccagctcctctataatgcgtgtcagttggacaacgccgacgagcaggccgcccagatccggagggaactcgatggacggcttcagctagccgataaaatggcaaaggagcgaaagtttcctaaattcatagctaaagatatggaaaacatgtacatcgaagaacttcgctcctctgtaaacttattaatggcaaacctggagagcctccccgtatcaaagggtgggcccgaattcaaactgcagaagctgaaacgatcccaaaattccgctttcctggatattggtgacgaaaacgaaattcagctgagcaagtccgatgtcgtgctcagcttcaccctggagatagtcattatggaggtccaaggccttaagtccgtagcgcccaaccggatcgtgtattgcacgatggaggtggagggtgagaaactgcagacggaccaggccgaggcaagccggccacagtgggggactcagggtgatttcacaaccactcatcctcgacctgtcgtgaaggtgaaactcttcactgagtcaacaggtgttcttgccctggaggataaagagttagggcgtgtcatactgtaccccacctctaatagcagtaagtccgcagaactgcacaggatggtcgtgccaaagaattctcaggattcagatctcaagatcaagcttgcagtgcgcatggataaaccagcgcatatgaaacactctggttacctgtatgccctcgggcagaaagtgtggaaacggtggaagaaacgatatttcgtactagtgcaggtaagtcaatacacctttgctatgtgctcgtaccgggagaagaagagcgagcctcaagagctgatgcagctggaaggctacacagttgactacaccgatcctcacccagggctgcagggaggctgtatgttttttaatgccgtgaaggaaggcgacaccgttattttcgcctctgatgacgaacaggacagaatcctgtgggtacaggcgatgtatagagccacaggtcagagctacaaacctgtgcctgccatacagactcagaaacttaatcccaaggggggtacccttcatgcggacgcacagctaagtggaaaggatgcagacagattccaaaagcacggcatggacgagttcatctcagccaatccctgcaagctggatcacgcctttctgtttaggatcctccagaggcaaacgctggatcatcgcctgaacgactcatacagttgtttgggatggttttccccaggacaggtgtttgtgcttgatgaatattgcgccaggtatggtgtgcggggttgccacagacacctgtgctacctggcagagcttatggagcacagcgagaacggcgcagtgatcgatcccacactactgcactacagctttgccttttgcgcctcgcatgtgcacgggaaccgccccgacgggatcggtacggtctccgtcgaggagaaggagcgcttcgaagagattaaagaaagacttagttccctgctagaaaaccagatctctcactttaggtactgcttccctttcgggcgtccggaaggagccctgaaagctacactgtccctgttggagagagtcctgatgaaggatattgctacacccatccctgcagaagaagtgaaaaaggtggtgcgcaaatgtctggagaaagcagctctgattaattacacccggctaactgagtacgccaagattgaggaaacaatgaatcaagcctcacctgccaggaagctggaagagattttgcacctggccgaactgtgtattgaagtgttgcaacaaaacgaggaacaccatgcagaaggaagggaggcatttgcatggtggccggacctcctggcggagcatgctgaaaaattctgggctctgttcaccgtggatatggacacagccctggaggcgcagccccaggatagttgggactcttttcctttgttccagctgttgaacaactttctccgcaatgacacgctgttgtgcaacggtaaattccataaacatttgcaagaaatctttgttccactggttgtgcgctatgttgacttgatggagtcctctatcgctcaatccatccaccgtggcttcgaacaggaaacctggcagcctgtcaaaaacattgcgaattctctaccgaatgtggcccttcccaaggtgccttccttgcccctcaacttgccccagattccaaacatctccactgcaagctggatgcccagcctgtacgaatcgaccaacggaagtgctacttccgaagacctcttctggaaacttgacgctctccaaatgttcgtgtttgaccttcactggcccgaacaggagttcgcccatcatctggaacagaggttgaagctgatggcgtctgacatgctcgaggcttgcgtcaagcgcacacgcactgcattcgaacttaaactgcaaaaagcatcaaagactacggacttgcgcatcccggcttcagtgtgtacaatgtttaatgtcttggtcgacgccaagaagcagagcactaaattgtgcgctctcgatgggggtcaagaacagcagtaccatagcaagatcgatgatctcattgacaacagtgtcaaagagataatttctctactagtcagcaaattcgtgtcagtgcttgagggagtgttgagcaagctctcccggtacgacgaaggaacatttttctcatcgattttgtcctttacagtcaaagctgctgccaaatatgtggacgtacccaagcctgggatggatctggcggatacttatattatgtttgtcagacagaaccaggatattctgagggagaaggtcaacgaggaaatgtacatagagaagctgtttgatcagtggtactcatcatccatgaaggtaatctgcgtgtggctgactgaccgcctggacttgcagctgcacatctatcagctgaagactctaatcaagatcgtaaagaaaacttaccgcgatttcaggttgcagggggtccttgagggaaccttgaactctaagacctacgatacagtccataggagactgacggtcgaggaagctaccgccagtgtttcagagggaggagggctccaagggattaccatgaaggactccgatgaggaggaagagggctag

SEQ ID NO: 181032 - DNA, 1473 bp, Artificial Sequence
  Description of Artificial Sequence: Synthetic coding sequence
tgatacacccggctgaccgagtacgccaagatcgagggccccgccgagaaggaaactgaaacgatgaatcaagcctcgcctgctcgaaagctggaggagatcctacatctggcagaactgtgtatcgaagtgctccagcagaatgaagaacatcatgccgaaggcagagaagcgttcgcctggtggcccgacctgctggctgaacacgccgagaagttctgggctttattcaccgtcgatatggacactgctctcgaagcccagccacaggatagttgggactccttccccctttttcaactcctcaataacttcctgaggaacgataccctgttgtgtaacggcaagtttcataaacaccttcaggagatcttcgtccctttggtggtgcggtacgtagatctgatggaatcaagcatagctcagtctatccatcgcggattcgaacaggagacctggcagcccgttaagaacatcgctaactcattaccgaatgtagccctgcctaaagtgccctcgcttccactgaatttgccgcagatcccaaacatcagcactgcgtcctggatgccgtctctgtacgagtcgactaacgggagcgcgacttcggaggacctcttttggaaattggacgcccttcagatgttcgtttttgatctccactggcccgagcaagagtttgcccatcacctggagcagcggctcaagctcatggcctctgacatgctggaggcatgcgttaaaaggactcgaaccgctttcgagctgaagctccaaaaagcgtccaaaactactgacttacgaatcccagccagtgtgtgcacaatgttcaatgttctggtcgacgcaaaaaagcaaagtactaaactttgcgctttagatggaggccaggagcagcagtaccatagcaaaatcgacgatctgattgacaattccgtcaaagagattatcagcctcctcgtcagtaaattcgtgtcagtgctggaaggggtgctgtccaagctgtccagatacgacgagggtacgtttttttcatcaattctgtcatttacagtaaaagccgccgcaaagtacgtggatgtacctaagcccggtatggacttagcagacacctacatcatgttcgtgcggcaaaatcaagacatcttgcgcgaaaaggtgaatgaggagatgtacattgaaaaattatttgaccaatggtatagtagctcaatgaaggtgatctgtgtttggctgaccgataggctggacctgcagctccatatttaccagcttaaaacgcttattaagatcgtaaagaaaacgtaccgcgactttagattacaaggggttttggaggggactctaaatagcaagacatacgacacggtgcaccgaaggctgaccgtcgaagaggccacagccagtgtctcagagggggggggtctccagggcatcactatgaaggattcggacgaggaagaggaggggtag

SEQ ID NO: 181033 - DNA, 3669 bp, Artificial Sequence
  Description of Artificial Sequence: Synthetic coding sequence
atgctggaccccagcagcagcgaggaggagagcgacgagggcctggaggaggagtcccgcgatgtgctggtggccgccggatcgtcccagagagcaccccctgcgcctaccagggagggacagctcgatgacgagcaggagcgccgaatacggctccagctgtacgtgttcgtggtccggtgtatagcctatccttttaatgctaaacagcccacagacatggccaggcgacaacagaagctgaacaagcagcagcttcagttgctcaaagaaagattccaggcctttctcaacggtgagacgcagattgtggcagacgaggcgttctgcaacgccgtgagatcctattacgaggtcttcttgaagagcgacagggtggcacgtatggtgcagtccggaggctgcagcgctaacgactttagagaggtgttcaaaaagaacatcgagaagagagtccggtcactgcccgagatcgatggactttccaaagaaaccgtgctgtcttcctggattgcaaaatacgatgcgatctataggggggaggaggacttatgcaaacagccaaaccggatggccctctctgctgtctcagagctgattttatctaaggagcagctctacgagatgttccagcagatcctaggcataaaaaagctcgagcatcaacttttgtacaatgcctgtcaattagacaacgctgacgaacaggccgcgcagatccgacgcgagcttgatgggcggttgcagctggccgacaagatggccaaagagaggaagttcccaaagttcatagcgaaggacatggagaacatgtacatcgaggagttacgctcatcggtcaacctcctcatggcgaatctcgagagccttcccgtatccaagggaggccctgagttcaagctgcagaagttaaagcggtcacagaattccgccttcctggatatcggggacgaaaacgagattcagctatctaagagtgacgttgtgctgtccttcacattggagatcgtgatcatggaagtgcaaggactgaagtctgtggcacctaacaggatagtttactgtactatggaagtagagggggagaaacttcagacagaccaagccgaagcgtctcggccacaatggggcactcagggggattttaccaccactcacccccgtccagtcgtgaaggtcaaattgttcactgagagcaccggtgtgctagctctcgaagacaaagagctcggccgggtgattttataccctacttccaacagcagcaagagcgcggagctgcaccgaatggtggtgcctaagaactcccaggattctgacctaaagatcaaattggcggtcaggatggataaaccggctcacatgaagcattcaggctacctttatgccctgggacagaaggtttggaagaggtggaaaaagcgctacttcgtcttggtgcaggtctcccagtataccttcgctatgtgtagttaccgcgaaaagaaatccgaacctcaggaattaatgcagctggaggggtacactgttgattacaccgacccccatcccggcttgcagggcggatgtatgttctttaacgccgtgaaggagggtgacacggtgatctttgcaagcgacgacgagcaggacaggatcctctgggtccaagccatgtacagggccactggccagagttacaaacctgtaccagccattcaaacacagaagcttaatcccaaaggaggcaccctccatgctgatgcccagctgtacgccgacagattccagaaacacggaatggacgagttcatctccgcgaacccttgtaaattagatcacgcctttctgttccgcattctccaaagacaaaccttagatcaccgtcttaacgatagctacagctgtttggggtggttttcacccggccaagttttcgtgctagacgagtattgcgctcgatacggtgttagggggtgccaccgacacctgtgctacttggccgagcttatggagcattccgagaatggcgcagttatcgatccaactctgctgcactattcatttgccttctgcgcgtctcatgtgcacggaaatcgcccagatgggattgggactgttagtgtggaagaaaaggaacggttcgaggaaattaaggagagactatcctccctgttggagaaccagatctcccacttccggtattgttttccattcggccgacccgaaggggcgcttaaagctaccctgtctctcctcgaacgggtgctcatgaaagatatcgctaccccgatccccgcggaggaagtgaagaaggttgttcggaagtgcctcgaaaaggctgcactcattaattatacccgtttgactgagtacgctaagatcgaggagactatgaaccaggcaagtcccgcacggaaattggaggagattctccaccttgccgagctgtgcattgaggtgcttcagcagaacgaggagcaccacgcggaggctttcgcctggtggcctgatctgctcgcagaacatgcagaaaaattttgggccctattcaccgtggacatggatactgccttagaggctcagccacaggacagctgggactctttccccctgttccagctgctcaataattttttacggaatgacacactactatgcaatggcaagtttcacaaacatctgcaggagatatttgtgcccctcgtcgttaggtacgtggacttgatggaatccagtattgctcaatctatccaccgtggttttgagcaagaaacatggcagcctgtgaataatggctccgccacatcggaagacctcttttggaagctcgatgccctgcagatgttcgttttcgatctccattggcccgagcaggagttcgcccaccatctggaacaacgcctgaaattgatggcaagtgacatgctggaggcgtgtgtgaagcgcacccgcaccgcttttgagttaaagctccagaaggctagcaagaccacagatctgaggatcccagcttccgtgtgcactatgttcaacgtcctggtggatgccaagaagcagtccaccaaactgtgcgccctggacggcggacaggagttcggctctcagtggcagcaataccacagtaagattgatgatctaatcgacaacagcgtgaaagagatcattagtctgctggtctcgaagtttgtgtcagtgctagaaggagtgctgagcaaactgtcacgctacgatgaaggaacctttttcagcagcatactgagttttactgtcaaggcagctgcaaagtatgtggacgtgcctaagccgggaatggatctggcagacacgtatatcatgtttgtgcgccagaaccaggacatcctcagagagaaagtgaatgaagaaatgtacatcgagaaactcttcgaccagtggtattcatccagcatgaaagtgatttgcgtgtggttgaccgaccgacttgatctgcagctccacatttatcagctcaaaacattaattaaaatcgtcaagaagacctacagagacttccggcttcagggcgtcctggaggggacactgaattcaaaaacatacgacacagtacaccgtcgcctaacagtagaggaggcaaccgctagcgtgagcgagggcggcgggcttcaaggcattacaatgaaagactccgatgaagaggaagagggatag

SEQ ID NO: 181034 - DNA, 2367 bp, Artificial Sequence
  Description of Artificial Sequence: Synthetic coding sequence
atgaccatccaccagttcctgctgctgttcctgttctgggtgtgcctgccccatttctgtagtcctgaaatcatgtttagaagaacaccagtgccccaacagagaattctgagcagtcgggtgccacgtagcgacggtaaaatactgcacaggcaaaagaggggatggatgtggaaccagttttttttgctggaagaatataccgggagcgattaccaatatgttggcaaactccattctgatcaggataaaggtgatgggagcctgaagtatatcctctccggggatggggctggaacgctgttcatcatagacgaaaagacgggcgacattcatgcgactcggcgcatagacagggaagagaaagctttctacacattaagagcccaggccataaataggaggaccctcaggcccgtagagcctgagtccgagttcgtgatcaagattcacgacatcaacgacaacgagcctacctttcccgaagagatttacactgccagcgtgccagagatgagcgtggtagggaccagcgttgtgcaagtgactgctactgatgctgatgatccgtcctacggaaacagtgcccgcgtgatttacagcatccttcagggccagccttacttttctgttgagcctgagacggggatcattcgtactgctctccctaacatgaatcgagagaaccgggagcaataccaggttgtgatccaggccaaggatatggggggacagatgggtgggctgtcaggaacgaccacggttaatattacgctcaccgatgtgaatgataatcccccccgcttccctcagaacacaatccaccttcgggtgctcgaaagcagccctgtgggcaccgctatcggctccgtgaaggctactgatgcagatacaggaaaaaatgcagaagtggaatatcggattatcgacggtgatggtactgacatgttcgacattgtgacagagaaggatacacaggagggaataataacagtgaagaagcctctcgattacgagtcaaggcgcctgtacaccctgaaggtggaggccgagaacacccacgtcgaccctagattttactacctgggtccattcaaagacactacgattgttaagatctcgatcgaagacgtggatgagccaccggttttcagccgcagcagctatttgttcgaggtgcacgaggatattgaggtgggtacaattatcggcacggtgatggccagggaccctgatagcattagcagcccaatacggttcagcctggaccgacataccgatctggatagaatttttaatatacactcgggcaatggcagcttatacaccagcaagcccctggatcgcgaattaagccagtggcataacctaactgtcatcgcggcagaaattaataatccgaaagagactactagagtagcagtcttcgtgcgcatcttagacgtcaacgacaacgccccacagtttgctgtattctatgacacctttgtctgtgaaaacgctcgacctgggcaactcatccagacgatctcagccgtggacaaagatgatcctttaggagggcagaagtttttcttcagtctcgctgccgtgaatccgaattttactgtgcaggataatgaagacaacacggcgaggattcttactcgcaaaaatgggtttaatagacacgaaataagcacttacctgttgcctgtagtaatctcggataatgactaccctatccagagttcgacaggtaccctgaccatacgcgtgtgtgcttgtgacagtcagggcaatatgcaatcctgctccgcagaggccctcctgctgcctgctgggttaagtacaggtgcactgatcgcaattttgctgtgtataataatactgctggttattgttgtgctgttcgctgcgctgaaaagacaaaggaaaaaagaaccattaattcttagcaaggaggacatccgagataatatagtgtcttacaatgacgagggggggggagaggaagatacacaggcattcgatattggaacactccgcaacccggccgccatcgaggaaaaaaaactaagacgcgacatcatccctgaaaccctgtttattccccgacggacccctaccgccccagacaatacagatgtgcgcgacttcatcaacgaaagactcaaggaacatgacctcgatccaaccgctcctccttatgattccctggcaacatacgcctatgagggaaacgactccattgctgagtctctgagctcattggaatcaggaactacagaaggcgaccagaattatgattacctccgcgaatggggccctcgatttaataaactcgccgaaatgtacggaggaggcgagtccgataaggactcatag

SEQ ID NO: 181035 - DNA, 2385 bp, Artificial Sequence
  Description of Artificial Sequence: Synthetic coding sequence
atgctgacccggaactgcctgagcctgctgctgtgggtgctgttcgatgggggtctcttaacgcccctgcaaccgcagcctcagcagacactggctacagaacctagggaaaacgtcattcacctccccgggcagaggagccacttccagcgggtcaagcgcgggtgggtctggaatcagttctttgtgctagaggaatatgtcggatccgaaccacagtacgtcggcaagttgcactctgatttagacaagggcgaagggaccgtgaagtacacactctccggcgacggggccggaactgtctttactattgacgagacaaccggcgacattcacgccatccgcagcctagatcgggaggagaagcccttctacaccttgcgagcgcaggcggtggacattgaaactcgcaaacccctggagcctgagtcggagtttattatcaaggttcaggacatcaacgataatgagcctaaatttctcgatggtccttacgtagcaacagtgcctgagatgagtcctgtcggcgcatacgttctccaggtgaaagccacagatgccgatgaccccacgtatgggaattctgcacgtgtcgtatacagcattctgcagggacagccatatttctccatagaccctaagaccggcgtgatcaggactgccctcccaaacatggacagggaagttaaagagcagtaccaagtccttatccaggctaaagatatgggcggacagctggggggcctagctggcacaaccatcgtgaacattacacttactgacgtaaacgataaccccccacgttttcccaagagtatcttccatttgaaggttccagaatctagcccaataggctccgctatcggcagaatccgtgcggtggatccggacttcggccaaaatgcagagatcgagtacaatatcgtgcctggggacggaggtaatctgttcgacatcgtcacggacgaagacacacaggagggggtcatcaaacttaagaagccgctcgattttgagacaaaaaaggcctatacattcaaggtcgaggcctccaacctgcatctcgaccatcgattccatagtgccggcccatttaaagacacagcgaccgtgaaaatctccgtgttggacgttgacgaaccacctgtgttctcaaagccactctacacgatggaggtctacgaggacacccctgtcggaactatcattggcgctgtgactgcccaagacctggatgtgggtagctctgccgtgcggtactttatagattggaaaagtgatggcgattcctattttacaatcgatggcaacgaaggcaccattgcaacaaatgaattgctggatagggaatcgaccgcccaatacaatttctccattatcgcgtctaaagtctcaaaccccctcctgaccagtaaagtgaacatactgataaatgtactcgacgttaatgaatttcctccagaaattagtgtcccttatgagacagcggtgtgcgaaaacgctaaacccggccagatcatacagatcgtgtcagcagctgaccgcgatctgtctcccgctggtcagcagtttagctttcggctgtcccccgaagctgctatcaaaccaaactttacagtcagggattttcgtaataatacagccgggatcgagactcgcaggaatggctacagccgacgccaacaggagctctacttccttcccgttgtaattgaggattcatcctaccctgtgcaaagctcaacaaacaccatgacaattcgtgtgtgccgctgtgactctgacggaacaatccttagctgcaatgtcgaagcgattttcttacctgttggcctgtccaccggcgcactaattgccattctgctgtgcattgtgatcctgctggcgatagtggtcctgtacgtagcgctccgaagacagaaaaagaaagatactttgatgacaagtaaagaggacattcgtgacaatgttatacactatgacgatgagggaggcggcgaagaggacacacaagcattcgacataggagcccttaggaaccctaaagtaattgaagagaataaaatccgacgcgacatcaaaccagattccttgtgcctgcccagacagcggcccccaatggaagataacacagacatccgcgacttcatacatcaacgtttgcaagagaatgatgtggaccctacagcccccccatatgatagcctagcaacatatgcttatgaggggtcagggagtgttgccgagtccttgtcctcgatcgactccctgacgaccgaagccgaccaagactatgactacctgaccgattggggaccaagatttaaggttctggccgatatgtttggggaggaagagagctacaacccagataaggtcacctag

SEQ ID NO: 181036 - DNA, 2385 bp, Artificial Sequence
  Description of Artificial Sequence: Synthetic coding sequence
atgctgacccggaactgcctgagcctgctgctgtgggtgctgttcgacggagggttgcttacccctctacaaccccaaccgcagcagacactggccactgagccgcgggagaacgtgatccacttgcctgggcagagaagccactttcagcgcgtgaagcgtgggtgggtgtggaaccaatttttcgtactcgaagagtacgtgggcagtgaaccccagtacgttggtaaactgcatagcgacttggacaagggcgaggggaccgttaaatatactctttccggggacggcgccggtacggtatttactatagacgaaaccacgggggacatccacgcaatccgctccttggaccgggaagaaaagccattttacaccttgagagctcaggcagtggacatcgagacacggaagcctctggagcccgagtccgaatttatcattaaagtccaagacattaacgataacgagcctaagttccttgatggcccctacgtggcaactgtccctgagatgtcgcctgttggagcctacgtcctccaggtaaaggccacagatgctgatgatcctacctacggcaatagcgctcgcgtggtctatagcattttgcaggggcagccctacttttctatcgaccctaagaccggtgtcatccggaccgcactgccgaacatggacagggaagtgaaggaacagtaccaggtgttgatccaggcgaaagatatgggcgggcagctcggaggtctggctggcacaaccatcgtgaacattacgttaaccgacgtgaacgacaaccccccccgattccctaagtctattttccatctgaaagtgcccgaatcttcccctattggatccgccattggccggatccgagctgttgatcctgattttggccaaaatgccgaaattgagtataatatcgtgccaggggatgggggtaacctgtttgacatcgtgacagatgaggatacacaggaaggagttattaagttgaaaaagcctttggactttgaaacaaaaaaagcctacacgtttaaggtagaagcatccaacctccacctggaccacagattccacagcgccggacccttcaaagatactgcaaccgtgaagatttccgtgctcgacgtggatgagccgcctgtgttttcgaagccactgtacaccatggaagtgtatgaggacactccagtggggacaattatcggggcggtgactgcccaggatctagacgtgggaagcagcgccgtaaggtattttatcgattggaaatctgatggagactcctactttacaattgatggtaatgaaggcaccattgccaccaacgagctgctggatcgtgaaagcactgcgcagtacaacttctctatcattgccagtaaggtgagcaacccattactgacatccaaggtaaacatcttaatcaatgttctggatgtgaatgaatttccacccgaaatatccgtaccttacgaaactgcagtatgtgagaatgctaagcccggacagatcatacagatagtcagcgccgccgatcgcgacctgtcccccgccgggcagcagttctcattccgcctatcccctgaggcagccatcaagccaaacttcaccgtgcgggacttccggaacaatacggccgggatagagacacggagaaacggttacagtaggaggcagcaggaactttatttcctcccagtcgtaatagaagattcgtcctaccctgtccagagctctacaaatactatgacgatccgggtgtgtagatgtgactccgatggaacaatcctgtcttgtaacgttgaagccatctttctaccagttggcctgtccacaggagcccttatcgccatcctgctctgtatcgtcatactgctcgccatcgtggtgctgtacgttgccttgcggagacagaagaagaaggatacactgatgaccagcaaagaggatatacgcgataatgtaatacattatgacgacgagggcggaggcgaggaggacacgcaagctttcgatattggagcactgagaaacccaaaagtgattgaggaaaacaagattcggcgcgacatcaaacccgacagtttatgcctgcctagacagagaccacctatggaggataatactgatatccgtgatttcattcatcaaaggttgcaggagaatgatgtggatcccacggccccaccttacgattctttagccacatacgcatacgaaggatcaggatccgtggctgagtcactcagctccatcgatagtcttacaactgaagccgaccaggattacgattatttgacagactggggaccccgttttaaagtgcttgccgatatgttcggcgaggaagaaagttacaatccggacaaagtgacttag

SEQ ID NO: 181037 - DNA, 2265 bp, Artificial Sequence
  Description of Artificial Sequence: Synthetic coding sequence
atgctgacccggaactgcctgagcctgctgctgtgggtgctgttcgatggcgggctactgactcctctgcagccgcagccacagcagacccttgcaaccgaacctagggaaaacgtcatccacctaccgggccaaaggagtcattttcagcgggtgaaaagggggtgggtctggaaccagttttttgtattggaagaatacgtcgggtctgagccccagtacgtcgggaaactgcattccgacctggacaagggagaaggcacagtcaaatacactttatcgggagacggggcaggcactgtcttcaccatagatgagaccaccggcgacatacatgcaatccggagtctggaccgtgaggaaaagcctttttacacgctacgggctcaggccgttgatattgaaactcggaagccactagaaccggaatcagagttcattatcaaagtgcaggatattaatgataacgaacccaagtttctggacggtccttatgtcgcaactgtgccagagatgtcccccgtgggggtgatccgaaccgctctgccaaatatggatagagaggtcaaagaacagtaccaggtcctgattcaagcgaaggatatgggaggacaactgggtggactggcgggtaccaccatcgtcaatataaccctcacagatgtgaacgataatccaccacggttcccaaagagcatcttccatctcaaagttcctgaaagttctcctattggctccgcaattggccgaatccgggcggtcgatccggactttgggcagaatgccgagattgaatacaacatcgtgccaggggacggtggaaacctgttcgatatcgtgacggacgaggatacccaagaaggtgtgatcaaactaaaaaaacctctagactttgaaacaaaaaaagcttatactttcaaggtggaggcatccaacttgcatctggatcatagattccacagcgcagggcctttcaaggacaccgcgaccgtaaagatctccgtgctggatgtagacgagcccccagtgttctctaagccactttacactatggaagtgtacgaagacacgcccgtggggacaatcattggtgcagttaccgctcaggatctagacgtgggttcctccgccgtccggtattttatcgattggaagagcgatggagactcctatttcaccatcgatggtaacgaagggaccatcgcgaccaatgagctactcgacagagagagcaccgcccagtacaacttttctatcattgctagtaaagttagtaatcccctcctcacatcaaaggtgaatatcctgatcaacgtgcttgacgttaacgaatttcctccagaaatatcagtgccatatgagacagcagtgtgcgagaacgcaaaaccgggtcaaattattcagattgtgagcgctgccgatagagatctgagtcccgcaggccagcaattcagcttccgactgtctccagaggccgctatcaagcctaacttcaccgtccgggatttccggaataacacagcagggatagaaaccaggcgtaacggctactccagacgtcagcaggaactgtactttctgcccgtggtaatcgaggactcatcctatcccgtacagtcatcaaccaacacaatgacaatccgagtctgcaggtgcgattctgacgggactattctgtcgtgcaatgtggaggctattttcctgccagttgggctgtctaccggagctttgattgctattcttctgtgtatcgtgattcttctggccattgtggtgctctacgtggcacttcggaggcaaaaaaaaaaggacaccctcatgaccagcaaggaggacattcgcgacaacgtaattcactacgacgacgagggcggcggagaggaagatacccaggctttcgatataggcgctctgcgaaacccgaaggttatcgaggagaacaaaatacggcgagacattaagccagatagtctctgtctcccacgccagcgaccacctatggaggataacacagacattcgggacttcatccatcagcggctccaggagaacgatgtcgatcccaccgctccaccttacgattcgctggccacttacgcatacgaggggtccgggtccgtcgcagaatcattaagttcgatcgattctctcaccactgaggccgaccaagattacgactaccttactgactggggtcctcggtttaaagtgcttgcagatatgtttggtgaagaggagtcctataaccccgacaaggtaacctag

SEQ ID NO: 181038 - DNA, 2445 bp, Artificial Sequence
  Description of Artificial Sequence: Synthetic coding sequence
atggacgccgccttcctgctggtgctgggcctgctggcccagagcttatgcctctccctaggagttcccggctggcgcagacccactaccctttatccgtggcgacgcgcaccagcactgtcgcgcgtcagaagggcctgggtgatccctccgatctcagtgagcgagaaccataaaagacttccttatcccctggtccagattaaaagcgacaagcagcaattaggctcagtgatttattcaattcagggcccaggggtcgacgaagaacctcgcggagtcttcagcattgacaaattcacaggcaaggtgtttctcaatgcgatgcttgaccgagaaaaaaccgaccgcttccgcctgagggctttcgctctcgatcttggaggctcgacgctggaggatccaacggacctggagatagttgtcgtcgaccagaatgacaacagacctgccttcttacaggaggcctttaccgggagggtactagaaggtgctgttcctggcacatatgtgacacgcgccgaagctaccgacgccgatgaccccgagacggacaacgcggccctccgcttcagcatccttcagcagggatcccctgagctcttcagtattgacgagctgacaggggaaattagaaccgtacaggtgggcctcgacagggaggtagtggccgtttacaatctaactcttcaggtggctgatatgtccggggatggcttaacagccactgctagcgctataataaccctggacgatattaacgataatgcacctgagtttaccagagatgaattcttcatggaggcgattgaagcagtgtccggggtggatgtggggagactcgaagtcgaggatagagacctgccaggctcacctaactgggtagcacgtttcactatacttgagggcgatcccgacggccagtttacaatacggacagaccccaagactaacgaaggagtcctttccattgtgaaggccctggactacgagtcttgtgaacattacgaattgaaagtctcggtgcagaacgaggctcccctgcaggcagctgctctgcgggcagaacggggacaagccaaggtcagagtacacgtgcaggacacgaacgagcctcctgtattccaggagaaccccctgcgcaccagtttagccgaaggcgccccccccgggacactggtcgcgacattttctgctagagaccccgataccgagcaattacagagactctcttattccaaggactatgacccggaagactggctgcaggtggatgctgcaacagggcgaattcagactcagcatgtcctgagtccggcgtctccatttttaaaggggggatggtatagagccattgttctggcccaagacgatgcaagccagcctcgtaccgcaaccggcacattgtctattgaaattctggaggtaaatgaccacgctcccgtcctggctccgccccccccaggaagcctgtgctctgagccacaccagggtcccggattactgctcggggcgaccgatgaggatctgcccccacatggggcaccttttcattttcagttgtcgccccgtctgcccgaattgggtaggaattggtcactgtcacaagtgaatgtcagtcatgcaaggttgcggcctcggcaccaagttcccgagggcctgcaccgtctgtctctgttgctgagagattccggccaaccaccccagcaacgcgaacagcctttgaacgtgaccgtttgtcgctgcggcaaggatggcgtgtgtctgcctggcgccgctgccctgttagccggtggtaccggactttctctgggggcccttgtaattgtcctggcgagcgccttactgctgctggtgctggtgctgctggtggcactgcgagctcgattttggaagcaatcccgcggcaagggccttctgcacggccctcaggacgatctcagagacaatgtgctgaattatgatgaacagggaggcggggaagaagaccaggatgcctatgacattagccaactacggcatcctaccgccctatctctccctctgggccccccaccattaagacgggatgctccccaaggaaggctccatccccagccacccagagtcctccctacaagccctctcgatatagcagatttcatcaatgatggactggaggccgcagacagtgatcctagcgttcccccatacgataccgctcttatttacgattatgagggagacggctcagttgccgggacgttgagttccattctgtcctcccagggcgatgaagatcaggactatgactacctgcgtgactggggccctagattcgcacggctcgcagatatgtacggacatccatgcgggctagaatatggggctcgctgggatcaccaggcgagagaaggcctgtcgccaggtgccctgctcccgcgccatagggggagaacggcatag

SEQ ID NO: 181039 - DNA, 2373 bp, Artificial Sequence
  Description of Artificial Sequence: Synthetic coding sequence
atggtgcccgcctggctgtggctgctgtgcgtgagcgtgccccaggcactgcccaaggcccagcctgccgaattatcggtcgaagtcccggaaaactacgggggcaatttcccgctatacctgactaaactgccactccccagagaaggagcggagggccagatcgtattgtcgggagactccggcaaagcgaccgagggaccatttgcaatggaccccgactccggttttcttttagtgactcgtgcgctggatcgtgaagagcaggctgagtatcagttgcaggtgactcttgaaatgcaggacggacatgtcctgtggggaccacagcctgtgctggtgcacgtcaaagatgaaaacgaccaagttccccacttcagccaggccatttaccgggcgagattaagtcgtgggacccggccgggtattccttttctgtttctggaagcttccgatcgcgatgaaccaggtacggctaacagcgatctgcgtttccacatcctaagccaggccccagcccaacccagtccagacatgttccaactggagccccgcctgggcgctttagccctcagtcccaagggtagtacttctctggaccacgcacttgagcgtacttaccaactactcgtgcaagtgaaggatatgggcgaccaggcctccggtcatcaagcgacagcaaccgttgaggtgagcatcatcgaaagcacatgggtttccctggaacctattcacctggctgagaatcttaaggtcctctatccacatcatatggcgcaggtgcattggagtggtggcgacgtgcactaccatctagaaagccacccgcccggcccgttcgaggtgaatgcggaagggaacctatacgtgacaagggagttagatcgagaggctcaggcagagtacctccttcaggtgcgggcccaaaatagccatggcgaggactacgctgcccctctcgagttacatgtgctggtgatggacgagaatgacaatgttcctatttgtcccccaagagatccaaccgtctcaatccctgagttgtcaccaccgggaaccgaagtcacccggctttcagcagaggatgcagacgctcccgggagtccgaatagtcatgttgtctaccagctcttaagtccggagcccgaagatggcgtggagggcagggcctttcaggttgaccctacctcaggatcagtcacgcttggcgtgttacctctgcgcgcaggtcagaacattcttctgctcgttttggctatggacctggcgggagccgaaggagggtttagcagcacctgcgaagtcgaggttgctgtcacagacattaatgatcatgcccctgagttcatcactagccagatcggccccatttctttgccagaggatgtagagcccggaaccctagttgctatgctcactgcaatcgacgccgacctcgagcctgcttttcgactaatggactttgccattgagcggggtgatacggaggggacttttggccttgactgggaaccagacagcggacatgtcagactgcgcttatgcaagaacctgagttatgaggccgctccgtcacacgaggtcgtcgtggtcgtgcaatcagttgccaagctcgtaggaccagggccaggccccggagccaccgccacagttaccgtcctcgtagaaagggtcatgcccccccctaaacttgatcaagagagttacgaggcttccgtaccaatatccgcaccagcaggctcctttctgctgaccatacaaccgtccgatcccatctctagaacactacgatttagccttgtcaacgacagtgaggggtggctttgcattgaaaagttcagtggcgaagtgcacaccgcccaaagtttacagggggcccagcccggagacacctacacagtccttgtcgaggcccaggacaccgatcatggcctcatcgtcagtgggccaagcaaagaccctgacctggctagcggccacggtccttactcctttaccctggggccaaaccccaccgtccagcgggattggcgcctgcagacattaaacgggagccacgcatacctgactttggcgttacattgggtcgagccccgagagcatatcatccctgtcgtcgtttcccataacgcccagatgtggcagttattagttagagttatagtgtgcagatgcaatgttgagggccagtgcatgcggaaggttggccgcatgaaaggcatgccaactaaactcagtgctgtcggcattctcgttggaaccctggttgctatcggtatctttctgatcctaatatttactcattggaccatgagcaggaaaaaggaccccgaccaacccgcagattcagtcccactcaaggcgaccgtctag

SEQ ID NO: 181040 - DNA, 2199 bp, Artificial Sequence
  Description of Artificial Sequence: Synthetic coding sequence
atggtgcccgcctggctgtggctgctgtgcgtgagcgtgccccaggctctgcccaaagctcagcctgcagagctgtctgtggaggtccctgaaaattatgggggcaacttccccctttatctcaccaagttgccacttccacgggaaggcgcagagggccaaatagtgttaagtggcgattctggcaaagccacagagggaccattcgcgatggatcctgactctggctttctgctggtaacacgcgccctggatagggaggagcaggctgaatatcagcttcaggtgactttagagatgcaggacggccacgttttatgggggccacaacccgtgctagtgcatgtcaaggatgaaaatgaccaagcatccggacaccaggcgaccgccaccgtggaagtctccattatagagtctacgtgggtttcgttagagccgatccacctggctgagaacctcaaagtactctacccccaccatatggcccaggttcactggagtgggggtgacgtgcactaccacctcgagtcacacccacctggaccctttgaagttaatgctgaagggaatctgtacgtcactcgggagctcgacagggaagcccaggccgaatacctcctccaagtgcgggcccagaattctcacggcgaggattacgctgcacctctcgagttgcatgtcctcgtgatggatgagaatgataatgtcccaatatgcccgccaagggatcctaccgtcagcatccctgagttgtcgccgccgggaacagaggtgacacgcctgtccgcggaggacgccgacgcccccggatcacctaactcacacgtcgtatatcagttactctccccagagccagaggatggggttgaagggcgagcatttcaggtagatcctacctcgggaagtgtgactctcggcgtgctgcctcttagagcaggccagaacattctgctgttggtgcttgcaatggacttggccggcgccgagggcgggttttcctccacatgcgaagtggaagtcgccgtgacggacattaatgatcatgcccccgaattcatcacaagtcagattggccccattagcctgcccgaggacgtcgagcctgggactctggtggcgatgctaactgcaatagacgctgatttggagcccgccttcagattaatggatttcgccatcgagaggggtgacaccgagggcacgttcggcctggactgggagcccgattccgggcatgtgaggctgaggctgtgtaaaaacctaagttatgaagctgctccctcccacgaggtcgtcgttgttgtacaatcagttgcaaaacttgtcgggcctggaccggggcctggagcaaccgccacagtgacggttttagttgagcgggtgatgccaccacccaaactggaccaagagtcctatgaagcaagcgtgcctatttctgctcccgccggaagtttcctcttgacaattcagccatctgatccgatctcacggacattgcggttctccctggtaaacgatagcgagggctggctttgcatcgaaaaattctccggggaagttcatactgcccagtcattacaaggggcccaacctggagatacatataccgtgctggtggaggctcaggataccgacgaaccccgtctgagcgccagcgcccctctggtcatccatttcctgaaggctcccccagctcctgccttaactctggctcctgtcccaagccagtacctctgtacaccgagacaagaccatgggcttatcgtgtccggcccctccaaggatcctgacctcgcctccggacacggaccctattctttcaccctgggccctaatccaacggtgcagcgcgactggaggttgcagacattgaacggcagccatgcttacctgacgctcgctctgcattgggtggagccacgggaacacattatcccagtagtcgtgtctcacaatgcccaaatgtggcagctgctagtcagggtaatcgtgtgcaggtgcaacgttgaagggcagtgtatgcgtaaggtgggacggatgaaaggtatgcccaccaaactgtcagctgtgggtatcctagtgggaaccctggtggccattgggatctttctgatccttatcttcacacattggacaatgtcaagaaaaaaggatcccgatcagcctgctgacagcgttcccctcaaagcgacagtttag

SEQ ID NO: 181041 - DNA, 2490 bp, Artificial Sequence
  Description of Artificial Sequence: Synthetic coding sequence
atggtgcccgcctggctgtggctgctgtgcgtgagcgtgccccaggcgctaccgaaggcccagccggcagaactatctgtagaggttccggagaattatggtggcaattttccactttatctcacaaagctaccattaccacgagagggtgctgaaggtcagattgtactatcaggcgatagcggaaaagccaccgaggggccctttgccatggatccggacagtggctttctgttggtcacccgggccctagaccgtgaggagcaagctgagtaccagcttcaggttacactcgagatgcaggacggtcatgtcctgtgggggccacagcccgttctggtacatgtgaaggacgaaaacgaccaagtccctcacttcagccaggccatctaccgcgctaggctaagtcgtggtacaagaccgggcatcccattcttatttctcgaggcatctgatcgcgacgagccaggcacagcgaatagcgatctgagatttcatattctgtcgcaggctcccgcccagccctctcccgatatgtttcagctagaacccaggttaggcgctttggcattatcccccaaagggagcacctccctggatcacgccctcgagaggacctatcagcttctggtacaagtaaaagatatgggagatcaagcctctgggcatcaggccacagccacagtggaggtgtctatcatagagtccacttgggtgtcactggaaccgatccatctggccgaaaatctgaaggtgctgtacccccaccacatggcacaagttcattggtcagggggggatgtacattaccatctcgagagccatcctccaggtccttttgaagtgaacgctgaaggcaacctgtatgtgacgagggagttggacagagaagcgcaggctgaatatctgttgcaggtccgggctcaaaatagccatggagaagactacgcagcacccctggaactgcacgtccttgtgatggatgaaaatgataatgtacctatctgccctccccgtgaccccactgtcagcattcctgagctctcccccccaggaacggaggtcacacggctctcggccgaggacgccgacgcacccggctctcctaactcccatgtggtctaccaactactttcgcctgagccagaggatggtgtggagggacgcgcattccaggtggatccaacaagtgggagcgtaactctgggagtgcttccactgcgggcaggccaaaacatactgctgctggtgctggcaatggacctggccggtgcggagggaggtttttctagcacttgcgaagtagaagtcgctgtgaccgatatcaatgaccatgctcccgaatttatcacaagccagatcggtccgattagtttgcccgaggatgtggaacctgggaccctggtagccatgcttaccgccattgacgccgatttggagcctgccttccggctgatggacttcgcgatcgaacggggagataccgaaggcacctttggtctagactgggagcctgactcaggtcacgtgcgcctccgcttatgcaagaacttgagttacgaggccgcaccttcccatgaggttgtggttgttgttcagagcgttgccaaactcgttggacccgggccgggccctggggctaccgccacagttaccgtgctcgtcgagcgggttatgccacccccgaagctagaccaggaatcgtacgaggcaagtgtgccaataagtgcaccggctggttcttttctgctgactatccaaccttcagacccgatctcacgtaccctccgcttctcactggttaacgatagcgaaggctggctgtgtatcgaaaagttctcaggtgaggtgcatactgcgcaatccttgcagggggcccagccaggggatacatacaccgtgctcgtcgaggctcaggacaccgatgaaccaaggctgagcgcgtccgctcctttggtgatccatttcctcaaagccccaccagctccagccctaaccttggcccccgtgccttcccagtatctgtgcaccccgaggcaggatcatggcctgattgtgtcaggacctagcaaggatcctgacttggccagcggacacgggccttacagcttcaccctgggccccaatcccaccgtgcagagggactggaggctccagactctgaacggcagtcacgcttacctgacccttgcccttcattgggtggaaccaagggaacacatcattccagtggtcgtttcccataatgcccaaatgtggcagctgttggtgagggttatcgtctgtagatgtaatgtggaaggacagtgcatgagaaaggtgggccgtatgaaaggcatgccaacaaagttaagcgcggttggaattctggttgggactctcgtggccatcggcatctttttgatccttatttttactcattggaccatgagccgaaaaaaagatcccgatcagcccgcagatagcgttcctcttaaagccaccgtgtag

SEQ ID NO: 181042 - DNA, 2424 bp, Artificial Sequence
  Description of Artificial Sequence: Synthetic coding sequence
atggtgcccgcctggctgtggctgctgtgcgtgagcgtgccccaggccctgccaaaagcccagccagctgaactctcagtggaagtgcccgaaaactacggagggaacttccctttgtaccttaccaagttgcccttacctagagagggagcagagggccagattgtgctatcaggtgattctggtaaagcaaccgaaggtcctttcgccatggatcctgactctggatttttactggtaactcgagccctggaccgtgaagagcaggccgagtaccagctgcaggtaacactggagatgcaggacggacatgtgctgtggggtccgcagcccgttctggtgcacgtgaaggacgagaacgaccaggtgccccatttctcccaagcaatctatagggctagattgtccaggggtaccaggcctggtatccctttcttatttcttgaggctagtgaccgggatgaaccaggaactgccaattctgacttacgattccatatcttgtctcaggcccctgcccagccttcgccggatatgtttcagcttgaacctcggctgggagctctggccctttccccaaagggttctacctctctggaccacgctctagaaaggacttaccagctcctggtgcaggtgaaagacatgggcgatcaggcctccggacaccaggccacagcaaccgtagaggtgagcatcatcgaatctacctgggtctccctagaacccattcacttggcagagaatttaaaagtcctgtaccctcaccacatggcgcaggtccattggtcaggaggggatgtgcactaccaccttgaatcccatcccccaggaccatttgaggtgaacgctgaaggcaacctttatgtgacgcgtgaactggacagagaggcacaagctgagtatctgctacaagtccgcgcgcagaatagtcacggagaggattacgccgcacccctcgaactgcacgtgctggtaatggatgaaaatgacaacgtgccaatttgcccccctagagatcccacggtgtctattcctgagctgagtccgccaggcactgaagtgacaaggctctctgctgaggacgccgacgcccccggcagtcccaacagccatgtggtgtaccagctcttatcccctgagccggaggacggagttgagggcagggcattccaagttgatcctacctccggctccgtgacactgggggtgttgcccctgcgtgcaggccagaacatcttactccttgtgctggcgatggatctcgctggggctgagggaggtttctcaagcacctgtgaggtggaggttgctgtgactgatattaacgaccacgctccggaatttatcacatctcagatcggtccaatcagtttgcctgaggacgtggaacccggcactcttgtcgctatgcttacagctattgacgcagatttggagccagcctttaggctgatggactttgccatagagaggggtgacactgaggggacgtttggactcgattgggagccagacagcggccacgtgcgtctgcgcctatgtaaaaatttgtcctacgaagccgctccatcccacgaagtagttgttgtcgttcaaagcgtcgcaaagttagtgggtccaggcccgggccccggagccactgccaccgtgaccgtcctcgtggagcgagtgatgcccccccccaagttagaccaagagagctatgaagcgagcgtacctatctcagccccggccggcagctttctcctgaccatccagccgtctgatcccatctcacgtactttgcggtttagcctcgttaatgatagtgagggttggctctgcatcgagaagttcagcggcgaggtgcatacagcccaatccttacagggagcgcaaccaggcgacacctataccgtgctggtggaggcacaggacaccgccctgacgttggctcctgtaccaagtcagtatttgtgtaccccaaggcaggaccacggactcattgtctcaggccccagcaaagacccagacctcgctagtgggcatgggccgtattcattcaccctgggccccaacccgacggttcagagagactggcgactacagacgctgaatggaagccatgcttatctgactctcgccctacactgggtggagccacgggaacacattattccagtcgtcgtttcccataatgcccagatgtggcagctgctggtcagggtgattgtatgccggtgcaacgttgaggggcaatgcatgaggaaagtgggccgaatgaagggcatgcccacaaaactcagcgccgtgggcatcctagtggggactttggtcgcaatcggaatcttcctcatactcatctttacccattggacaatgtcacgtaaaaaagatcctgatcaaccagctgacagtgtacccctcaaggcgactgtttag

SEQ ID NO: 181043 - DNA, 2382 bp, Artificial Sequence
  Description of Artificial Sequence: Synthetic coding sequence
atggtgcccgcctggctgtggctgctgtgcgtgagcgtgccccaggcactgcccaaggctcagccagcggaactgtccgtggaggtgcctgaaaattacggcgggaattttcccctgtacctcactaagttaccactgcctagagagggtgctgagggccagattgtcctgtcaggcgagcaggccgaaatgcaggacggacacgtgctctggggaccacagccagtgctggtacacgtcaaggacgagaatgaccaagtcccgcacttcagccaggcaatctatagagccagactgtcccggggcacgcgtcctggtatccccttcttgttcttagaagcctctgacagggacgaaccaggcacagcaaactcagatcttcggtttcatatcttgtcccaggccccagcacagccctccccggatatgtttcagctggagcctcgactcggcgctctggccctttccccgaaaggaagcacctccctggaccatgcccttgagcggacatatcagcttcttgtgcaagtgaaggacatgggggatcaggctagtggacatcaggccaccgcgactgtggaagtctcgattattgaaagtacctgggtttctcttgagcctatccacttagctgaaaacctcaaggttctatatccacatcatatggcacaggtccattggtctgggggtgacgtacattaccatctggaaagccacccccctgggccatttgaagtaaacgcggagggcaatctatatgtgaccagagaactggatcgggaagcccaagcagaatacttgcttcaggtgcgcgcccagaattctcacggcgaagattacgctgctcctttggagttgcacgtccttgtaatggacgaaaatgacaacgtcccgatctgccccccgcgggaccccacagtctccatccccgagctttccccccccggaactgaggttactaggttatccgccgaggatgccgatgcgccgggctcaccaaatagccatgttgtctaccagctcttgagccccgagcccgaagacggagtagaggggagagccttccaagtggaccctacgagcggttcggtgactctgggagttctgcccctacgagcaggccaaaatattctgttgctggtgctcgccatggatcttgccggggccgagggcggcttttcaagcacgtgcgaagtagaagtcgccgtgactgacatcaacgatcatgctcccgaattcatcacatcccagatagggccaatcagcctgcccgaggacgtggagcctgggaccttagtggcaatgttaacggccatcgatgcagatctcgaacctgcttttcgcttaatggactttgccatcgaaaggggtgatacagagggaactttcggcctggactgggaacctgattcaggccacgtccgcctgcgcctgtgcaaaaaccttagctacgaggcagctccaagtcatgaggtggtggtagtggtgcagtcggtggccaagcttgtgggacccggacctggtccaggcgccacggccactgtcacggtgttggtcgagcgcgttatgccccctccgaaactcgaccaggaaagttatgaggcaagcgtccctatttccgccccagccggctcgttcctgctgaccattcaaccttcggaccctatctccagaactctgcgattcagccttgtcaatgattctgaggggtggctgtgcatcgaaaagttcagcggagaggtacatacggctcagtctctgcagggtgcacaacccggggacacctatacagtgttggtggaagctcaagacactgatgagccaaggctcagcgcatctgccccccttgtgattcactttctaaaggcaccacccgctcctgctctcactcttgcaccagtcccaagccaatatctctgcactcctcgccaggatcacggattaatcgtgtcagggccaagcaaggatcccgatctcgcgtccggacacgggccgtactcgtttaccctgggtcctaatccaacagttcagcgggactggaggctgcagactctgaacggcagccacgcgtacctaactctcgccctccattgggtggaacctagagagcatatcattccagtggttgtgagccataacgcccagatgtggcagctactggtgagggtgatcgtttgccgatgtaatgtggagggacagtgtatgcggaaggtcggaagaatgaagggcatgccaacaaagcttagtgccgtggggatcttagtcgggactttggtggcaattgggatctttttgatccttatcttcacacactggaccatgagcaggaagaaagaccccgaccaaccagccgactccgtgccgctgaaggcgacggtatag

SEQ ID NO: 181044 - DNA, 2499 bp, Artificial Sequence
  Description of Artificial Sequence: Synthetic coding sequence
atgatcctgcaggcccacctgcacagcctgtgcctgctgatgctgtatttagctactggctatggccaagaaggtaaattctcaggtccattgaaaccgatgaccttctctatatatgaggggcaggaaccctcccagattatttttcagtttaaggctaaccccccggcagtgacctttgagctaacaggcgaaacggacaacatctttgttattgaaagggaagggttgctttactataacagggcattggacagagaaacacgaagcacccacaacctccaggtcgcggcgttagatgctaatggtataattgtggaagggccagtgcccattacaatcaaggtgaaagacatcaatgacaacaggccaacttttctgcagtccaaatacgagggatccgtgcggcagaactcacgcccgggcaagccgttcctgtatgtgaatgcgaccgatctggatgatccagccactcctaatggccaactttattatcaaatcgtgatccagttgcccatgatcaataacgtgatgtatttccaaatcaataataaaactggagctatttccctgacgcgcgaaggaagccaagagttgaaccccgccaaaaatccatcctataacctggtcattagtgtgaaggatatgggtggtcagtccgagaattcatttagtgatactaccagtgtggatatcattgtgaccgaaaatatctggaaagcccctaaacccgtggaaatggtcgagaattcaactgacccacatcctatcaagatcacccaggttaggtggaacgacccgggtgcccaatattctctcgttgataaagaaaaactcccccggttccctttttccatcgatcaggaaggcgacatctacgtgacacagcctctggaccgcgaagaaaaggatgcatacgtattctacgctgttgctaaggacgaatacgggaagcccctgtcatacccactggaaatccacgttaaggttaaagacataaatgacaatccgccgacctgccccagtccagtcactgtgtttgaagtgcaagagaacgaaagattaggtaattctattggcactctgaccgcccatgaccgtgatgaggaaaacaccgctaactcatttctcaactacaggatagtcgaacagacacccaaattgccaatggatggactgtttttgattcaaacctacgcaggaatgctgcagttggcaaagcagagtttgaagaaacaagacactccccaatacaacctgactatagaggtctccgataaggatttcaagactctgtgtttcgtccaaattaatgtcattgatatcaatgaccagatccctatttttgagaaatcagactacggtaatctgacattagccgaggacacaaacattggttcaacaatcctgacaatccaggctaccgatgctgatgaacctttcaccgggtcctctaaaattttataccatataatcaaaggtgattcagaggggcgccttggcgtggataccgatcctcataccaacaccgggtacgtaattataaagaaacctctcgactttgagacagcagccgtatctaacatcgtctttaaggctgagaaccctgagccgctggtgtttggcgtcaagtataatgccagttctttcgctaagtttacactgatagtcacagacgttaatgaggctccacagttcagtcaacacgtatttcaggccaaggtgagcgaagacgtggcgataggaactaaggtgggaaacgttacagcgaaggaccccgagggactggatatatcttattcacttagaggagacactcgcggatggcttaagatcgaccacgtgactggtgagatcttcagtgtcgctcccctggacagggaagccgggtccccctatagggtccaggttgttgccacagaagtggggggatcatccttgtcctctgttagtgagtttcatctgattctgatggatgtgaacgacaaccccccaagacttgctaaagactatacgggacttttcttttgccacccactgtctgcccctggatccctgatattcgaagccaccgacgatgaccagcatctgtttcgaggcccccactttacgttttctctgggcagcggtagcctccagaacgactgggaggttagtaaaattaatggcactcatgcgaggctatcaactcggcacactgaatttgaggagagggagtatgttgtgctgatcaggattaatgatgggggtcgcccgccactggagggaattgtgtcactcccagtaaccttttgctcctgtgtagagggctcgtgcttccggccagcaggccaccaaaccggcattcccacagttggcatggctgttggtattctgctgacaacattgctggttatcggaattatcctcgcagtggtcttcatccggatcaagaaggataaagggaaagacaacgttgagtccgcccaggcctctgaagtcaagccattacgaagttag

SEQ ID NO: 181045 - DNA, 2499 bp, Artificial Sequence
  Description of Artificial Sequence: Synthetic coding sequence
atgatcctgcaggcccacctgcacagcctgtgcctgctgatgctgtacctggctacaggctatgggcaggaagggaagttcagtgggccactgaagcctatgacttttagcatttatgagggccaggagccaagtcagattattttccaattcaaagcaaaccccccagctgtgactttcgagctcactggggagaccgacaatatcttcgtgattgaacgggagggtttgctctattacaaccgcgcccttgatcgcgagacacggagcacccacaaccttcaggtggcagccctcgatgccaatggcatcatcgtggagggtcctgtgcccataacgataaaggtgaaagatattaacgacaatcggccgacatttctgcagtccaagtacgaggggagcgtcaggcagaactcacgtcccggaaagccttttctctacgtcaacgccacggatcttgatgatccggcgacgcccaacgggcagctctattaccagatcgtgatacagcttccgatgatcaataacgttatgtacttccagattaataacaaaacaggagctatcagtcttacccgggaaggaagtcaggagctgaaccccgctaagaaccccagttataatttagtcatctcggtgaaggacatgggcggccagagtgaaaactccttctccgacaccacatccgtagacataatagtgaccgaaaatatatggaaggctcccaagccggtggagatggtcgagaattccactgatccccaccccatcaagattacgcaggttaggtggaacgatcccggtgcacagtacagtctagtggacaaggaaaagctgccacgattccccttcagcatcgatcaggaaggagacatctatgtaacacagcccctggaccgggaggagaaggacgcatacgtattctatgctgtcgcaaaagacgagtacggcaagccactctcatatccgttggagatccatgtgaaagtgaaggacattaatgacaatcctccgacttgcccctctccagtcaccgtattcgaggtacaggaaaatgaacgtctggggaacagcattggcactctcacggcccatgaccgtgacgaggaaaataccgcaaactcgtttttgaattaccggatcgtcgagcagactcccaagctgccgatggacggccttttcctgattcagacatacgccgggatgctccaattagctaagcaaagcctaaagaaacaggatactccccaatataacctaacaattgaggtttccgacaaagatttcaagacgctgtgcttcgtgcaaattaacgtgatagatattaacgaccagattcctatcttcgagaaaagtgattacggcaatctcaccctggcggaagacacaaacatcgggtccactatactaaccatccaggcaacagatgccgacgaacccttcacgggaagctctaagatactctatcatatcatcaagggcgatagtgagggccgcctgggcgtcgacacagatccacacacaaacaccgggtatgtcatcattaaaaaacctttagactttgaaaccgccgccgtgtcaaacatagtgtttaaagcagaaaaccccgaaccgttagtgtttggggtcaagtacaatgcctccagctttgccaaatttaccctgatagtcacggacgttaacgaggcaccccagttcagtcaacacgtgttccaggccaaagtatcagaggatgtggcgattggaacaaaggtggggaatgttaccgcaaaagaccctgaggggctcgacatctcttacagcctgcgcggggacacaaggggttggcttaaaatcgatcacgttacaggtgaaattttctctgtggctcccctagatcgtgaggccgggagcccatatcgagtacaggtagtggccacagaggtgggagggagctctctttcatctgtgagtgagttccatctgattttgatggatgtaaatgataaccctcccagattggccaaggactatactggcctgttcttttgccatccgctgtctgcgccaggcagccttattttcgaggcaaccgatgacgatcagcacttatttagggggcctcactttacgttcagccttgggagcggatctttgcaaaacgattgggaggttagcaagattaatggcacacatgcccggctgagcactaggcataccgagttcgaagagagggagtacgtggtgcttatccgcataaacgatggtggacggccccctctggaaggaattgtgtcgcttcctgtgacgttttgcagttgcgtcgaaggctcctgctttcggcctgcaggccaccagactggaattcccactgtcggtatggcggtggggattttgttaactacccttctcgtcattggtattatcttggcagtcgtatttatcagaataaagaaggacaagggcaaagataacgtggagtctgcccaagcatcggaagtgaaacccctccgttcctag

SEQ ID NO: 181046 - DNA, 444 bp, Artificial Sequence
  Description of Artificial Sequence: Synthetic coding sequence
atgatcctgcaggcccacctgcacagcctgtgcctgctgatgctgtatcttgcaactggatatggccaagaggggaaattcagtgggcctctgaaaccgatgactttctctatctacgaaggccaggagcccagtcagataatttttcagtttaaagcaaacccccccgcggtgacgttcgagctgacaggagagacagataacatattcgttatcgagagagagggccttctgtactataatcgtgctctggatagagagacacgcagcactcacaatcttcaggtagcagccctggacgccaatgggatcattgtggaagggcctgtgccgattaccatcaaggtgaaagacattaacgataatcgacctacattcctgcagtcaaaatatgagggctctgtaagacagaattctcgccccggcaaacctttcctctactag

SEQ ID NO: 181047 - DNA, 2373 bp, Artificial Sequence
  Description of Artificial Sequence: Synthetic coding sequence
atgaagatcaccagcaccagctgcatctgccccgtgctggtgtgcctctgtttcgtccagaggtgttatggcacggcacatcacagctctatcaaagtcatgcgcaaccagactaaacacatcgagggcgagaccgaggttcatcatcggcccaagcgggggtgggtatggaaccagttcttcgttctcgaggagcacatgggtcccgacccccagtacgtgggcaaattgcatagtaactctgacaagggggatggcagcgtcaagtacatcctgacaggggagggagcaggaaccatctttatcatagatgatactacaggcgacatacacagtacaaagagtttggaccgagagcagaaaacccactatgtactgcacgcccaggctatagacaggaggacaaataaaccactcgaacccgagtccgagtttattatcaaggtacaagacataaacgacaatgccccaaagttcactgacggcccgtatatcgtaaccgtgcctgaaatgagcgacatgggtacatcagtgttgcaagtcacagccactgacgccgatgatcccacatatggcaactcagccagagttgtctattccattctccaaggacagccatacttctccgtggaccccaagactggggtgattcggaccgctctacataacatggaccgcgaggccagagaacactattctgttgttatccaggccaaggacatggccggccaagtgggtgggctgtccgggtcaactaccgtcaacatcacgcttaccgacgttaatgacaatccccctaggtttccccagaaacactatcaattgtatgtccctgagtccgcacaggtggggtcggccgtaggcaaaatcaaagcaaacgacgccgacacgggcagtaatgccgatatgacatacagcattattaatggcgatggtatgggcattttctccatctcaaccgacaaagagactcgcgaaggtatcttatcattgaagaagcctctcaattacgagaaaaagaagagttacactctcaatatcgagggggccaatacgcatttggatttccggttttcccacctggggccattcaaggacgccacgatgctgaaaatcatagtgggcgacgtggacgagcctcctttgttctccatgccatcctacctcatggaagtttatgaaaatgccaagattgggacagtggtgggcacagtgcttgcccaggacccagactcaacgaacagcttggttcgctattttataaactacaacgtggaagatgaccgtttcttcaacatcgacgctaacaccggcaccattcgcacaaccaaagtattagacagagaagaaaccccttggtacaacatcaccgtgaccgcttctgagattgacaacccagatctgttaagccacgtgacagttggcatccgcgttttggatgtgaacgataaccctccagaacttgcaagagagtatgatatcattgtgtgtgagaactccaaacccggtcaggtcattcatacaatatctgccacagacaaagatgacttcgctaacgggccacgttttaatttcttcttggatgaacgcttgcctgtgaaccctaatttcactctcaaagacaatgaagataacaccgccagcatcctgaccagacggcggcggttctctcggacagttcaagacgtgtattatttgcctattatgatttccgacggaggaatcccatctctgtctagcagctctacattgacgatccgggtctgtgcgtgcgagcgggacggtcgagtcagaacctgtcacgcagaggcattcctgtcaagcgctggcttaagcaccggagccctgatcgcaatcctgctgtgcgttcttatcctactggccatagtggtcttgtttataacgctccggcggtctaagaaagaacctctgatcataagtgaagaagacgtaagagagaacgtggtgacatacgatgatgagggcggaggcgaggaggacaccgaggctttcgatataaccgcattgcggaatccctccgcagcagaggaactgaagtacagaagggacattcgtccggaagttaaactgacccccaggcaccagacttcaagtacactcgagtccatcgatgtccaggagttcatcaaacagcgcctcgccgaggccgatctggatccatcagtacctccttacgattcactccagacatacgcctacgagggccagaggtctgaggcagggtctatctcttctctcgacagtgccaccacgcagagcgatcaggactaccactatctcggcgattggggacctgagttcaaaaagctggctgaactatatggcgagattgaatctgagaggaccacctag

SEQ ID NO: 181048 - DNA, 2373 bp, Artificial Sequence
  Description of Artificial Sequence: Synthetic coding sequence
atgaagatcaccagcaccagctgcatctgccccgtgctggtgtgcctctgcttcgtgcagaggtgttatggcaccgcccatcactcttcgatcaaggttatgagaaatcagacaaagcatatagagggcgaaactgaagtgcaccaccgccctaagcggggctgggtgtggaaccagttctttgttctagaagaacacatgggtcccgacccacagtacgtggggaaattgcattctaattccgataagggagacggcagtgtgaagtacattctgacgggtgaaggcgcgggcaccatcttcatcatcgatgatactaccggtgatatacacagtactaaatctctcgaccgcgaacagaaaacgcattacgttctgcacgcccaggcgatagaccgccgcactaataaaccacttgagcctgagagtgagtttatcattaaagttcaggacatcaatgacaacgctccaaagttcactgatgggccatacatcgtcacagtccccgagatgtctgacatgggcacctcagttctgcaagtgacagccaccgacgcagatgatcccacttacggaaacagcgcccgtgtggtctatagcatccttcaaggacagccctacttcagcgtagatcctaagacaggagtgatcaggaccgctctccacaacatggatagggaggcacgagaacactactccgtggtcattcaggctaaggatatggccggccaggtcggcggcctgtccggatctacgactgtcaacataacactgaccgacgtgaacgataatcctccgcggtttccacagaagcattatcaattgtatgtgcctgaaagcgcccaggtaggatctgctgtgggcaaaatcaaggccaatgatgcggacacaggctcgaacgcggatatgacctactcaataattaacggagacggaatggggatctttagcatttccacggacaaggagactcgcgagggaatcctaagcctgaaaaaaccacttaactacgagaaaaaaaagtcctatactctgaacatcgagggagccaatacccacctggatttcagattcagccacctgggtcccttcaaagatgccacaatgctcaaaataatcgtgggggacgtggacgagccacctttgttttccatgccctcttatctcatggaggtttacgagaatgcaaagatcgggacggtggtcgggactgtcctggcccaggatccggactcaacaaactcgcttgtcaggtattttattaactacaacgtggaggatgacaggttttttaatattgacgccaacacaggaaccatccggactacaaaggtccttgaccgcgaggagactccatggtataatatcactgttactgcgtcagagattgataaccccgacctgctcagccacgtgaccgtgggaatcagggtactggacgtgaatgataatccacctgaactcgcacgggagtacgacattatcgtctgtgaaaattctaagccaggacaggtgattcatacaatcagtgccaccgacaaggatgacttcgcgaacgggccccggtttaactttttcttggatgaaagattgccagttaatccaaattttacgcttaaagacaatgaagacaacactgcaagcattcttacccggcgtcgtcgtttctcacgaaccgtccaggacgtgtactatctgcccattatgatttccgacggaggaatcccgtccctaagctctagctccactctgactatcagagtgtgcgcttgcgaacgggacggccgggttaggacatgccacgcagaagcgttcctctcctccgcaggactgtcgacaggagctcttatcgccattctcctgtgtgtgctgattctcctggcaatcgtcgtactgttcatcactctccgtagaagcaaaaaagagccattaattatctctgaagaggacgttagagaaaatgtagttacatatgacgatgaaggaggcggagaggaggacactgaggccttcgatattaccgcccttcgtaatcctagtgccgctgaagagctgaagtatcgccgggatataaggccagaagttaaactgaccccccggcaccagactagctccaccctcgaatccattgatgtgcaggagtttatcaaacaacgcctagccgaggcagatctggatccatccgtacccccttatgactccctgcagacatacgcttatgaggggcagcgctccgaagccgggtccatttcttccctggactcagccacaacacaaagcgatcaagattatcactacctaggcgattgggggccagaattcaaaaagctcgccgaactgtacggtgagatagaaagtgagcggacaacctag

SEQ ID NO: 181049 - DNA, 1725 bp, Artificial Sequence
  Description of Artificial Sequence: Synthetic coding sequence
atgaagatcaccagcaccagctgcatctgccccgtgctggtgtgcctatgcttcgtccagaggtgctacggaaccgcccaccactcgtccatcaaggtgatgcgaaaccaaaccaaacacatagagggagaaacagaagtgcaccaccgtccgaagagagggtgggtgtggaatcagtttttcgtccttgaagaacacatgggcccggatcctcaatatgtgggcaagctccattccaacagcgacaagggtgacggatccgtgaagtatatactgacaggagagggcgccgggactatcttcattatagacgataccactggggacatccacagtactaaaagccttgaccgggaacagaagacccattatgtattgcacgctcaggctatcgataggaggaccaacaagccgctcgaaccagagagtgaatttataatcaaagtccaggacattaacgacaacgcccccaagttcaccgacggcccctacatcgtgactgtacctgaaatgagcgacatggggacctccgtgctacaggtcaccgctaccgacgctgacgacccaacatacggtaacagtgcccgggtggtatactcaattctgcagggacagccatacttcagtgtcgatcccaagacaggagtgattcgcaccgcactgcataacatggatagagaagcacgagagcactattcagtcgtcatccaggccaaggacatggcgggccaagttggaggattatccgggtctaccactgtgaacatcactttaaccgacgtgaacgataaccctcccagatttcctcagaaacactaccagctttacgttcccgagagtgctcaggtcggcagcgccgtcggcaagataaaggccaatgatgcagataccggatccaatgcggatatgacatatagtatcattaacggagatggcatgggaattttttccataagcaccgataaggagactcgtgaagggatcctgtctctgaaaaaaccactgaattacgaaaaaaaaaaatcgtacacattaaatatcgaaggggccaatacacatctcgatttccgcttttctcacctgggccccttcaaggacgcaacgatgctaaagattatcgtaggagacgtagacgagcccccactcttctctatgccctcctacctgatggaagtgtatgagaacgcgaagatcggcaccgtggtcggtacggtgttggcccaggacccagactcgacaaattcgttggtgcggtatttcataaactataacgtggaggacgacagattcttcaatatcgacgctaacactggcactattcgtactacaaaagtgcttgaccgggaggagaccccctggtacaatattaccgtcacggcttcagaaattgacaacccagatttgctctctcatgtcactgtggggataagggtactggatgtgaacgacaatcctccagagctggccagagaatacgacatcattgtgtgcgagaattcaaagccagggcaagtgatccatactatctctgcaaccgacaaagatgatttcgctaatggacctcgattcaatttcttcctggacgaaagactgccagtaaacccaaacttcacattgaaggacaatgaagctgctgcaccttctccaagcggttttgtgcatgcccgcgagatgggggtgtgcggccctgccatgcagaagccatcatgcccacggctcgtatag

SEQ ID NO: 181050 - DNA, 2373 bp, Artificial Sequence
  Description of Artificial Sequence: Synthetic coding sequence
atgaagatcaccagcaccagctgcatctgccccgtgctggtgtgcctgtgctttgtacagcggtgttatggcaccgcccatcactcgtctataaaagttatgcgcaaccagaccaaacacattgagggcgagaccgaggtgcaccatcggccaaagcgaggatgggtgtggaatcagtttttcgtcctcgaggagcacatgggaccggatccccaatatgtgggcaaattacactccaactcagataaaggagatggctctgtcaaatatattctgacaggagagggcgcgggtactatctttatcatcgacgatactaccggggatatccactccaccaagtcgctcgatcgcgagcagaaaacacactacgtactccacgcccaggctattgaccggcggaccaataaacccttggagcccgagtcagagttcattataaaagtgcaggacatcaacgacaatgcccccaagtttacagatggaccctatatagtgaccgtgccagagatgagcgatatgggcacttctgtgctgcaagttactgctacagacgccgacgatcccacctacggcaactccgcccgtgttgtgtacagcatactgcagggccaaccatacttcagcgtggacccgaagacaggagtgatccggacggccctgcacaatatggacagagaagcccgtgagcactactccgttgttattcaggcgaaggacatggccggccaagtggggggcctctcaggatccacaaccgtgaacattaccctgacagatgtcaatgataacccaccacggttcccccagaaacactaccaactctatgtcccagaatctgcccaggttggtagtgccgtcggaaaaatcaaggccaatgacgcagatactggctccaacgccgacatgacttactctatcataaacggagacgggatggggatctttagcatcagcaccgataaagaaacaagggagggaatattgtccttaaagaagcctctaaactacgagaagaagaagtcctatactctgaacatagaaggcgcaaacacccacctcgactttcgattttcacacctgggacccttcaaggacgccacaatgctcaagatcattgtcggcgacgtagacgagccacctcttttttcaatgcccagctatctgatggaagtttacgagaacgcaaaaattggtactgtggtgggcacggtcctggcccaggatccggattcaactaactctctcgttagatacttcattaactacaacgtcgaggacgacagattttttaacatcgacgctaacacaggcaccatcaggacaacaaaggttcttgacagagaagagactccttggtataacattacagtgaccgcttcagaaatcgacaaccccgatctactctcacacgttactgttggcatccgggtcctggacgttaatgacaacccacccgagcttgctagagaatatgacatcatagtatgcgaaaatagcaagcctggccaggttatacatacgatcagcgccacggacaaggatgattttgctaatggcccgaggttcaatttcttcctggacgagcggctacccgtgaatcctaactttaccctgaaagataacgaggacaatacagcttcaatactaactaggagacggcgctttagcaggaccgtgcaggacgtctattatcttcccattatgatatcagatggtgggattccgtcattgtcatcttcgtcgacactgactatccgcgtatgtgcatgtgagagggacggccgcgttcgcacctgccacgcagaggcctttttgagttccgccgggctctcaactggagccctcatcgccatcctgctgtgcgtcttaattcttctggctatcgtagttttatttatcactctacggcggagtaaaaaggagccactcattatttctgaagaggacgtgagggagaacgtggttacatatgacgatgaaggaggaggtgaggaggatacagaggccttcgatattactgctcttcggaatcccagcgcagcggaagagctcaagtatcgcagagatattaggccagaggtcaaactcactccaagacatcagacctcgtccacattggagagcatcgacgtccaagagtttataaagcagcggttggccgaggccgatcttgatccgagcgtgccaccatacgacagcctccaaacttacgcatacgagggccaaagatcggaagctggctccatttcatcactggattctgccacgacacaaagtgatcaggactatcattacttgggtgactggggaccagaattcaagaagttggccgagctctatggcgaaatagaatcagaaaggacaacgtag

SEQ ID NO: 181051 - DNA, 2373 bp, Artificial Sequence
  Description of Artificial Sequence: Synthetic coding sequence
atgaagatcaccagcaccagctgcatctgccccgtgctggtgtgcctttgcttcgtccagcggtgttacggcaccgctcaccattccagtatcaaagtgatgcgcaaccagacgaaacatattgaaggcgaaacggaagtgcaccataggccgaagcgcggatgggtctggaaccagttctttgtgttggaagaacatatgggcccagatccccagtacgtcggtaagctgcactcaaattcagataaaggagacggaagcgtgaaatacattctgacgggtgagggggctggcaccattttcattatagatgacaccaccggcgacatccatagcaccaagtccctcgatagagagcagaaaacacactatgtgttgcacgcccaggcgatagaccgccgaaccaataagcctctggagcctgaatccgaatttattattaaggtccaggatatcaacgataatgcccctaagtttaccgacggcccgtacattgtgaccgtaccggagatgtctgatatgggcacatcagttttgcaggtgaccgccacagacgcagatgacccaacatacgggaacagtgcacgcgtggtctattcgattctgcaggggcagccatatttcagtgtcgaccctaaaaccggtgtgattcgtacggcccttcacaacatggacagggaggccagggagcattattccgtggtgatacaggctaaagacatggccggccaggtgggcggcctgagtggatctaccaccgttaacatcacactgacggacgttaatgacaacccacccagatttcctcaaaaacattaccaattatacgttccagaatccgctcaggtgggtagtgcagtcggtaaaattaaggccaatgatgctgacacaggaagcaacgccgacatgacatactctattattaacggtgatggtatgggtatattctcaatcagtaccgacaaggaaaccagggagggaatccttagtttgaaaaagcccctgaattacgaaaaaaagaaaagctacaccctcaatattgaaggagcgaatacccatctcgatttccgcttcagccatctcgggcccttcaaggatgcaaccatgctcaaaattatcgtaggggacgtggatgaaccaccattgttttcaatgccgtcttacttgatggaagtgtatgagaatgcaaagattggcaccgtcgtcggaaccgtgttggcacaggacccggattccacaaattccctggtgcgctacttcatcaactataacgttgaagacgacaggtttttcaacattgacgccaatacaggtactatccgcaccactaaagtactggaccgggaggagaccccttggtataacatcaccgtcacagcctcggagattgataaccccgacctgcttagtcatgtgaccgtgggcatccgagtgctcgatgtgaatgacaacccccctgaactagctcgcgagtatgatataatcgtttgcgagaattccaagcctggccaggtaattcacaccatttctgccacagacaaggatgacttcgcaaacggcccaagattcaatttctttcttgatgagaggctgcccgtgaaccccaatttcactttgaaagacaatgaggacaataccgcgtcgattcttactcgacgccggcgcttctcgcggacggttcaggacgtgtattacctgcctataatgatttctgatggcgggatccctagtttaagctcatcttccacacttacaatccgtgtctgcgcttgcgagagagacggcagagttcgcacctgccatgcggaggccttcctctcctcagccggactatccaccggcgctttgattgcaatccttttgtgtgtcctaatcctcctggcaattgtcgttctgttcattaccctgagaagatctaaaaaagaacccctgatcatctccgaggaggacgtcagggaaaatgtggttacatacgacgatgaagggggcggtgaggaagacacagaagccttcgacattactgcactgcgcaatccatcagccgcggaagagcttaagtataggcgagacatccggccagaagttaaactcactcccaggcatcagacttcgagcacgcttgaatctattgatgttcaggaatttatcaagcaaaggctggctgaagccgatctggacccgagcgtacccccatacgactctctacagacgtatgcctatgagggtcagcgaagcgaggctggctctatttcatccctggactccgccactacccagagcgaccaggactatcattatctgggtgattgggggccagagtttaagaagctggccgagttatacggtgagatagagtccgagcgcaccacctag

SEQ ID NO: 181052 - DNA, 2319 bp, Artificial Sequence
  Description of Artificial Sequence: Synthetic coding sequence
atgaactgctacctgctgctgcggttcatgctgggcatccccctgctgtggccctgcctgggagccacagagaactcacagacaaagaaggtgaaacagcctgtacgctcccatcttcgcgtaaaacggggctgggtgtggaaccaattcttcgtgcccgaagaaatgaataccacttcgcaccacattggtcaactgcgaagcgacctggacaatggaaataatagctttcaatataaactgctgggggcgggggccggtagcacgtttataatcgatgagaggaccggcgacatttatgctattcagaaactggaccgggaagagaggtctctgtatatcttgcgcgcgcaggtgatcgacatcgctacgggaagggctgtggaacccgagagtgagtttgtcataaaggtcagcgatattaatgataatgagcccaagtttctggatgagccatatgaggctatcgtgcctgagatgagtcctgagggcaccctggttattcaagtgaccgcgtctgacgccgacgacccttcttccgggaacaatgcccgactcctctactcccttctgcagggacagccttacttcagcgttgagcccactactggagttatccgtatttcttcaaagatggatagagagctgcaggacgaatactgggtgatcatccaggcaaaggatatgattggccagccaggggccctttctggcaccacatccgtcctgattaaactgagtgatgtgaacgacaataagcccatctttaaagagtctttataccgcctaactgtgtccgaatcggctcctacaggaacgtcgatcggcaccatcatggcctatgataatgatattggcgaaaacgcggaaatggactactcaatcgaggaggacgattcccaaacttttgacatcattaccaaccacgaaacacaagagggaatcgtcatacttaaaaagaaagtggattttgaacatcaaaaccactatggaataagggccaaggtgaagaaccaccacgtccccgagcagttaatgaagtatcatacagaggcaagcactaccttcataaaaattcaagtcgaggacgtcgacgaacctcccctctttctgttaccatactacgtgttcgaggtgttcgaggaaaccccccaggggtcctttgttggagttgtgtccgcgaccgaccccgacaacaggaagagtccaattcgctactctattactcgctcgaaggtgtttaatattaacgataatggcaccatcaccacatcgaactctctggatagagaaatttcggcttggtacaacctctcgattaccgccacggaaaagtacaatatcgaacagattagcagcatccctctgtatgttcaagttctcaacattaatgatcacgcaccagagttttcacagtattatgagacttacgtgtgcgaaaacgctggctccgggcaggtgatacagacaatcagtgccgtagaccgggacgagtccatcgaggagcatcatttttattttaatctgtcggtggaggacactaataactcaagcttcaccatcattgacaatcaagacaacactgcagtgattctgactaaccggacagggtttaacctgcaagaggagcctgtgttctacatcagtattctcattgctgataatggaattccgagccttacatccaccaatacactcaccattcatgtatgtgactgcggtgactctgggagtacgcagacctgccaataccaggaactggtgctgtcaatgggtttcaagactgaagttattattgcaatcctcatttgtattatgattatttttggatttatttttctgacattgggtctgaaacaaaggcgaaaacaaatcttgttcccagagaaaagtgaagatttccgggagaacatctttcagtacgacgatgagggcggaggggaagaggacaccgaggcgtttgatatcgcagagttgcgctcctcgactatcatgcgcgaacgcaagacccggaaaaccacgagtgcagaaatccgcagcttgtatcgtcagtctctgcaggtcggccccgattcagcgattttccgaaagttcatcctggagaagctggaagaggctaatacggatccctgtgcccccccattcgatagcttgcagacatatgcttttgaaggcactgggagtctagccggcagcttgtctagtctggaatctgcagtttccgatcaggacgaatcatacgactatctgaatgagctgggtccgcggtttaaacgcttagcctgtatgttcggcagtgctgtgcagagcaataactag

SEQ ID NO: 181053 - DNA, 1173 bp, Artificial Sequence
  Description of Artificial Sequence: Synthetic coding sequence
atgaacaccaccagccaccacatcggccagctgcggagcgacctggacaatggaaataatagcttccagtacaagctcctgggagctggtgccggcagcacatttattatcgatgaacgtacaggcgacatctatgcaatccagaagctggaccgagaggagcgaagcttgtacatactccgggcacaggtgatcgatattgcaactggtcgggcagttgaacccgaaagcgaatttgtgataaaggtcagtgatattaacgacaacgagccgaaatttctggatgaaccttacgaagccatagtacccgagatgtcacctgaggggacattagtcatacaagtgaccgcttctgatgcagatgatccttcttcagggaataacgcccgtctgctgtatagcttacttcagggacagccatacttcagtgtggaacctacaacgggcgtcattcgaatttcatccaaaatggaccgcgaactgcaggatgagtactgggtgattattcaagccaaagacatgatcggtcaacccggcgccttgtcgggcacaaccagcgtgctgattaagctgagtgacgtcaacgacaacaagccaatcttcaaagagagtctgtaccgtctgaccgtgagcgagtccgcccctaccggcacttccataggtaccattatggcctacgataacgacatcggcgagaacgctgaaatggactactctatcgaagaggacgactcacagactttcgatatcatcacgaaccacgagacgcaggagggcatcgttattcttaagaaaaaggtggactttgagcatcagaaccactacggaatccgggctaaggtgaagaaccaccatgtgccggagcagctgatgaaataccacacagaggcttctaccactttcataaagatccaagtggaagatgtggatgaaccccccctgttcctcctcccctactacgtatttgaggtgtttgaggagacccctcagggctcctttgtgggcgtcgtgagcgctacagatcccgacaacagaaagtctcctatccgatattctattaccaggtctaaggtgtttaacatcaacgacaatggcaccatcaccaccagtaactctcttgaccgggagatctccgcgtggtacaaccttagcatcacagccaccgaaaagtag

SEQ ID NO: 181054 - DNA, 1473 bp, Artificial Sequence
  Description of Artificial Sequence: Synthetic coding sequence
atgaactgctacctgctgctgcggttcatgctgggcatccccctgctgtggccttgtcttggggctaccgagaatagccaaaccaagaaagttaagcaacctgtgcgctcccacctgcgagttaaaagaggctgggtctggaatcagttctttgtgcctgaagagatgaatacaacttcacatcatatcggtcagctcagatccgatttagacaacggtaataattcttttcaatacaaacttctaggagccggagccggatcaacatttattatcgacgaacgaacaggggatatatacgcaatccagaaactggatagagaagagcgcagcctgtacatcctgagggcccaggtgatagacatcgctacagggcgcgcagtagagcctgagtctgaattcgtgatcaaggtgagtgacattaatgataacgaaccaaaatttctggatgagccctatgaggctattgtgcccgagatgagtccagagggaaccctggtgattcaagtgactgccagtgacgcggatgacccctcaagcggcaataacgctaggctactctactcacttttacagggccagccttacttcagtgttgagccgaccaccggtgttattcgtattagcagcaagatggatagggagctccaggatgaatattgggtgatcatccaagccaaggacatgatagggcagcccggtgccctgtccgggaccactagcgtgctcatcaagctgagcgatgttaatgataataaacctatcttcaaggaaagtttatatcgactcaccgtatccgaatcagcccccaccgggacttccattggtacaatcatggcttatgataatgatattggcgaaaacgctgagatggattatagcatagaagaagacgactcccaaacctttgacatcataacaaatcatgagactcaggagggaattgtcatcctcaaaaaaaaagtggattttgagcaccaaaaccattatggcatccgcgctaaggtgaaaaaccaccatgtgcctgaacagctgatgaagtaccacactgaagcttctaccacatttattaaaatccaggtggaagacgttgacgagcctcccctgttcttactgccctactacgtgttcgaggtatttgaggagacaccacagggctctttcgttggggtcgtctctgctactgaccccgacaatcgtaagagtcccatccgttactcaatcacaaggtccaaggtgtttaatataaatgataacggaaccattactacaagtaactccctcgacagagaaatttccgcctggtacaatctgagcattacagccaccgaaaaatacaacatcgaacagatctctagcatcccgctatatgttcaagtcctcaatattaacgaccatgctcccgagttttctcagtactatgaaacctacgtttgtgaaaatgcgggctccggtcagggcttatttttctag

SEQ ID NO: 181055 - DNA, 2406 bp, Artificial Sequence
  Description of Artificial Sequence: Synthetic coding sequence
atgtggaccagcggccggatgagcaacgccaagaactggctgggcttggggatgagcctctatttttggggcctgatggacctgactacaacagtcctaagcgacacccccacgcctcagggcgagttagaggccttgctctctgacaaaccacaatcacaccagcgcaccaagcgtagctgggtgtggaaccaatttttcgtgctggaagaatatacaggaaccgaccctctttatgtaggcaagctgcacagcgatatggatcgaggagacggctcaattaaatacattctgtcaggcgagggcgccggaatcgtctttaccatcgatgacacgactggagacatccacgctattcagcgccttgatcgggaagaaagagcgcaatacactctcagagctcaagctttggacaggcggactggtagaccaatggaacctgaatccgagttcatcataaagattcaggatatcaatgacaatgaacccaaatttcttgatgggccatacgtcgcaaccgtgccagagatgtctcctgtgggtacatcggtcattcaagtgacagctacagacgcagacgatccgacctacgggaattccgcccgagtggtgtattccatattgcagggtcagccttacttttcggtggactccaagactggcgtgatcaggacagccctcatgaatatggatcgagaggccaaagaatactatgaagtcatcattcaagccaaagacatgggcggacagctgggaggcctcgcaggcactacaacagtcaacatcaccctcagcgacgtaaatgacaacccccctcgttttccacagaaacactatcagatgagcgtcctcgaatccgcccctatttcatccactgtaggtagagtcttcgctaaagacttagacgagggcattaacgccgagatgaagtacactatcgtcgacggtgacggagccgacgcatttgacatctccacggatccaaattttcaggtagggattattaccgtgaaaaaacccctcagctttgaatccaagaaaagctacactttgaaggtggagggtgctaaccctcacttggaaatgaggtttctcaacctcgggccatttcaggacactaccacagtgcacatttcagttgaggacgttgacgaaccaccagttttcgagcccggcttttactttgtggaagtcccagaggacgttgcaattggaaccaccatccaaattatctccgccaaggatccagatgtgacaaacaatagcattagatactctatcgatagatccagcgatcccggccgcttcttctatgtcgatatcacaaccggagcacttatgacagccagaccacttgatcgcgaggagttctcctggcataatatcactgtgctggccatggagatgaataaccctagtcaagttgggagcgtgccagtgactataaaagtgcttgatgtcaacgacaacgcccctgaatttcctcgattctacgaggctttcgtctgcgagaatgcaaaggcgggtcagcttatccagaccgtatcggctgttgatcaggatgacccccgaaatggtcaacacttttactacagcctcgccccggaggccgccaacaatccaaactttacaattcgcgacaatcaggacaataccgctagaattctcactagacgaagcgggttccgtcagcaggagcaaagtgtgtttcatcttcccattctgatcgcagattccggccagccagtcctcagctccactgggactctcacaatccaggtctgttcctgtgacgacgatggtcatgtgatgtcatgttcccctgaggcatatatgttgcctgtctctctctcccggggggcactgatcgcgattctggcgtgcatcttcgtgctgctcgtcttagtactgctcattttgtcaatgcgccggcataggaaacagccctacatcattgatgacgaggagaacatacacgaaaacattgtccggtacgatgatgaagggggcggagaagaggataccgaggccttcgacatcgccgccatgtggaaccccagagaggcccaagccggtgcggctccaaagacacgtcaggatatgctgccagagattgagtcactctccaggtatgtgccccagacatgtgccgtgaacagtacagtccatagctacgtgctcgcaaagctgtatgaagctgatatggacctatgggcgccaccctttgactcattgcaaacttatatgttcgagggcgacggtagtgtggcaggttctctgagctctctgcagtcagccacttccgacagcgaacaaagctttgatttcttgactgattggggacctcggttccggaagctggcagaactgtatggagctagcgaggggcctgccccattgtggtag

SEQ ID NO: 181056 - DNA, 2406 bp, Artificial Sequence
  Description of Artificial Sequence: Synthetic coding sequence
atgtggaccagcggccggatgagcaacgccaagaactggctgggcctaggtatgtctctgtacttttggggtttgatggatctgaccacgaccgtgctgagtgataccccgactccccagggcgaactcgaggcccttctatctgacaagccccagagtcaccagcgtacaaaacggtcatgggtgtggaatcagttttttgtgcttgaagaatacacgggaaccgatccactgtatgtcgggaaactccacagcgacatggacaggggagacgggagcatcaaatatatactctctggggagggggccgggatcgtgttcacaatagacgacaccactggagatatccacgctattcagcgactggaccgggaagagcgcgcccagtatacgctgcgggctcaggcacttgacagaaggacaggcaggccaatggagccggaatcagaattcattattaaaatccaggacattaatgacaacgagcccaagttcctggacggcccctacgtggcaacagttcccgagatgtctcctgtgggaacaagcgttatacaggtaacggccactgacgcggacgaccccacatacgggaattccgcgagagtggtctactcaatcttgcagggtcagccctacttttctgtcgatagcaaaactggtgtaattcgcacagccttaatgaatatggatagggaagctaaagaatattatgaggttataattcaggcaaaggacatgggcggacagctgggcgggctcgctggcactaccaccgttaatatcaccttgtctgatgtgaatgacaaccctcctcgttttccacagaaacattatcaaatgtcagttctggaaagcgccccaatctcttccacggtggggagagtgttcgctaaggacctggatgagggaattaacgccgagatgaagtatacaatcgtcgacggcgatggcgccgacgcatttgacatttcaaccgaccccaactttcaggtgggcatcatcacagtgaagaaacctctgagctttgaatcaaagaagtcctacacactgaaagtggaaggagcaaacccacacctcgagatgcgcttcctgaacttgggccctttccaggacactaccacagtgcacatctccgtggaggatgtggatgagccgccagttttcgaacctggcttttatttcgtcgaggtccccgaagacgtggcgattggtactactatccagattataagtgcgaaagaccctgatgtcaccaataattccatcagatatagcatcgaccgctcctccgacccaggcaggttcttttacgtggacattacaactggcgcattaatgacggctaggcccctggaccgcgaggagttctcttggcataacatcacggttttggcaatggaaatgaataatccgagtcaggtgggttctgtccccgtcacaattaaagtgctcgatgttaacgacaacgcacccgaatttccccggttttacgaagcctttgtctgtgagaatgctaaagccgggcagcttattcagaccgtatccgctgtggaccaggatgatccaagaaatggccaacacttctattactcactggcaccagaagccgctaataaccccaactttaccatccgggacaatcaggataatacagcgaggatcctgactcgccggtcgggatttcgccaacaagagcaatcagtcttccacctgcccattttaatcgctgactcaggccagccggtgctctccagtacaggcactctaaccattcaggtgtgtagctgcgacgacgacggccatgtcatgtcctgttctcctgaagcctatatgcttccagtaagcctcagtcggggggccctcatcgcaattctcgcttgcatttttgttctgctggtactcgtcttgctgattctgtctatgaggcgacataggaaacagccctacatcatcgatgacgaggagaacatccatgagaacatcgtgcgctacgatgatgaggggggcggcgaggaagatacagaagccttcgatatcgcagctatgtggaatccaagggaagctcaggctggagccgctccaaagaccagacaagacatgctgcccgagattgagtcgctgtccaggtacgtgccccaaacatgcgcagttaactcgaccgtccactcctacgttctggcgaaactgtacgaagcggatatggatctctgggctccgccgtttgatagcctgcaaacttacatgttcgagggtgatgggagtgtcgcggggagtctgtccagtctgcaaagcgcaacatccgattcagaacaaagtttcgacttcctcacggattggggccctcgcttccgcaagctcgccgagctttacggggcctctgagggccccgctcctctgtggtag

SEQ ID NO: 181057 - DNA, 2406 bp, Artificial Sequence
  Description of Artificial Sequence: Synthetic coding sequence
atgtggaccagcggccggatgagcaacgccaagaactggctgggcctcgggatgtcattatacttttggggcctaatggatctgaccacaacggtcctcagcgatacaccaacacctcagggcgaactggaggccctcctgtctgataagccgcagtcgcaccagcgaaccaaacggtcttgggtttggaatcagttctttgtcctggaggagtataccggaacagacccgctgtatgttggcaagctgcacagcgatatggacaggggtgacggtagcatcaaatacattttaagcggcgagggagcaggaatcgtgttcactatcgatgacaccacgggcgatatccatgctatccagagattagacagagaggagagggcacaatatacacttcgtgcccaggcgctggaccgcagaacggggcggcctatggaacctgagagcgaatttattataaagatccaggacattaatgacaacgagcccaagttcctcgacggcccctacgtcgctaccgtgccagagatgagtcccgtgggtaccagcgttatccaggtgaccgcaactgatgctgacgaccccacttatgggaattcggcacgggtggtgtactcaattttgcagggccaaccatacttctcagttgatagcaaaacaggcgttattcgcactgctttgatgaacatggatcgggaggcaaaggaatactacgaggtaatcatccaggcaaaggacatgggcggccagttgggaggcctcgccgggacaactacagtgaatatcaccctgtccgacgttaatgacaatcctccccgtttccctcagaagcactatcagatgtctgttcttgagtctgcgccgatcagctcaaccgtgggcagggtttttgcgaaggatctcgacgaaggcatcaacgcagaaatgaagtacacaattgttgacggcgatggcgccgatgcttttgatattagtaccgaccccaacttccaggttggtattatcaccgtaaagaagccactgagcttcgagagcaagaaaagctacaccttgaaagtcgagggtgcgaacccccacctcgaaatgaggtttctgaacctcggcccattccaggacaccactaccgtgcatatctccgtggaagatgtcgatgagcccccggtgttcgagccagggttctactttgtggaagtgcctgaggacgtcgcaatcgggaccactattcagatcatcagtgcgaaagatccagacgtgaccaacaattccatacgctatagtatcgatagatcgtccgatccaggtcgtttcttttacgtagatatcacaactggtgcactgatgactgcccggccattggacagggaggaatttagctggcataatatcactgtactggcaatggagatgaataatccaagccaggtggggagcgtgcccgttacaatcaaagtgctcgacgtcaatgataacgcacccgaattcccgcggttttatgaggcttttgtctgtgagaacgccaaagcaggccaactgatccagactgtctctgctgttgatcaagacgacccccgcaacggccagcacttctattatagtctagctcccgaggctgcaaataatcctaacttcaccatcagggacaatcaggacaacacagctagaatcctgacccgtagaagcggctttaggcagcaagagcagagtgtattccacctgccaatattgatcgcagactcaggccaaccggtgctttcttccacggggaccctgacaatccaagtatgcagttgtgatgacgatggtcatgtcatgtcgtgtagtccagaggcctacatgcttcccgtgagtctgtctaggggagctttgatcgcaatactggcatgcatatttgtgctattagtcctcgtcctgttgattctcagcatgcggcgacaccgcaagcagccatatattatcgacgacgaagagaacatccatgagaatattgtcaggtatgatgacgaggggggaggcgaagaagatactgaagcgtttgacatcgctgctatgtggaacccacgggaagcccaggccggagccgcccccaagacccgccaagacatgttgcccgaaattgaatctctcagcagatatgtgcctcagacatgtgcggtgaacagtacggtccactcctatgtgctggccaaactttacgaggctgacatggatctctgggcccctccctttgatagtttacaaacatacatgttcgagggtgatggaagtgtggcgggcagtttgtcttccctgcagtcagctaccagcgattcagagcagtcttttgattttctgaccgattggggacccaggttccgaaaactggcagagctctacggagctagtgaaggccccgcgccgctctggtag

SEQ ID NO: 181058 - DNA, 2487 bp, Artificial Sequence
  Description of Artificial Sequence: Synthetic coding sequence
atgcggccccggcccgagggccggggcctgcgggccggcgtggccttgtcccctgccctgctgctgctcctgctcctcccccctccgcccactctgctagggcgcctgtgggcagcaggaacaccgtccccatcagcccccggagcgaggcaggatggcgccctgggggctggccgggtgaagagggggtgggtatggaaccagttctttgtggtagaggagtacactggcacagaaccgctgtatgtgggcaaaatacactctgattctgacgagggagacggagcaatcaaatatactatctccggggagggtgccggaaccatttttctgatcgatgagctcactggagacattcatgctatggaacgtctggaccgggaacaaaagacattctataccctccgcgctcaagcacgtgatagagcgacaaatagactgctggaacctgaaagtgaatttataattaaggttcaggacataaacgacagtgaaccaagatttctgcacgggccttacatcgggagtgtcgcagagctcagtcccaccggaacgagtgtcatgcaggtcatggcctcagacgccgatgatcccacctatggcagctcggcccgcctcgtttacagcgtactggacggggagcatcatttcactgtggacccaaagaccggcgttatcagaactgccgtgcccgaccttgacagagagtcccaggaacgttatgaggtggtgatccaagcaacggacatggcagggcagctagggggcctgtccgggagtacaacggttactatcgttgtgactgacgtcaacgacaaccctcctcgcttccctcagaagatgtaccagttcagcatccaggaatctgctccgattggcaccgctgtcggccgcgtgaaagccgaagactctgacgtcggtgagaacactgacatgacgtatcacctgaaggacgaatcaagctcagggggcgacgtgtttaaggtgacaacagatagtgatacacaggaggcaattatcgtagtccaaaagcgactggactttgagtctcagcctgtgcacaccgtcatcctggaggccctaaataagttcgtggaccccagatttgctgatctgggaacgttcagagaccaagccattgtacgagtcgctgttacggacgtggacgagccaccagagtttcgccctcccagcggcctcctggaagtccaggaggatgcccaggtcggctcccttgtgggcgtggttacagctcgggatcccgacgccgccaaccggccagttcgttacgctattgacagagagagcgacctggaccagatattcgatatcgacgccgacacgggcgctattgtcacagggaaaggcctcgaccgcgagaccgccgggtggcataacattacagttctcgccatggaggcagacaaccacgcccagctttctcgcgccagtctgcgaatcagaattctggacgtgaacgataatcctccagagttggctactccgtacgaggccgcggtctgcgaggacgctaaacctgggcaactgattcagactatatccgttgtagaccgggacgaaccccagggcggccacaggttttacttcagactggtcccagaagcgccttccaacccccatttctcactgctggatattcaggataacaccgcagcggtgcacactcaacatgtggggtttaatagacaggaacaggatgtgttctttttgcccattctcgtggtggatagtgggcctccaactttgtcgtcaaccgggacactgacaatcaggatctgcggatgcgattcatccggcaccatacagagttgcaataccacagccttcgttatggcagctagcttgtcacccggcgccttgatcgctctgttagtatgtgttttgattctagtcgtgctcgtgctgttaattctgaccctcagaaggcaccacaagtcacacctatccagtgacgaggatgaggacatgagagacaacgtgattaagtataacgatgaaggtgggggtgagcaggatactgaagcatacgacatgtccgcgctgcggtctctatacgactttggcgagttaaaagggggcgatggcgggggtagcgcaggcggaggggcaggcggagggtccggcgggggagccggatctcctccacaggcccacctgcctagcgaaagacactccctcccgcagggacccccatcccctgagcccgattttagcgtcttccgcgacttcatttcccggaaggttgcactagctgacggggatctgtcggtccccccatacgatgcatttcagacttacgcttttgagggcgctgatagcccagctgcttcgctttcctctttgcacagtggctcctctggatctgaacaggattttgcctacctgtcaagttggggccctcgattccggcccctcgcagcactgtacgctggccataggggggacgatgaggcccaggcgtcctag

SEQ ID NO: 181059 - DNA, 2487 bp, Artificial Sequence
  Description of Artificial Sequence: Synthetic coding sequence
atgcggccccggcccgagggccggggcctgcgggccggcgtggcccttagcccagccttactactgctactgcttctgccgcccccgccaactttgctagggcggctgtgggccgctggtactccatcaccaagtgccccaggtgctcggcaggacggagccctgggggcagggcgcgtgaagcggggatgggtgtggaaccagttctttgtcgttgaggagtacacaggaaccgagcccctctatgtcggcaaaattcactccgattccgatgagggggacggagccattaagtatactatttctggtgagggcgcggggactatcttcttaattgacgagttgaccggggatatccatgctatggagaggttggaccgcgaacaaaagacattttacacgctcagggcgcaggcacgagatcgtgcaaccaatagattattagaaccagagtctgagtttatcatcaaggtacaggatatcaatgatagtgaaccaaggtttttgcacggcccctacattgggtctgtggctgaactcagccccacaggcacctcagttatgcaggtgatggcgagcgacgccgacgaccctacctatgggagtagcgcacggcttgtatacagcgtactggatggagagcaccatttcacagtggatccaaagacaggtgtcattcgcacggctgtgccggatttagatagagaatcacaggagagatatgaggttgttattcaagctaccgatatggccggccaattaggtggcttaagtggcagcaccacggtgactattgtggttaccgacgtgaatgacaacccccctcggtttccacagaagatgtatcagttcagcatccaagaatcagcccctatcggcaccgctgtcggtagggtgaaggctgaggacagcgatgtaggcgaaaataccgacatgacctatcacctcaaagatgagagcagctccggtggagacgtctttaaagtgacaacagacagcgacactcaggaggcaatcatcgtcgtgcagaagcggctggatttcgagtctcaacccgtgcacactgttatcttggaggccctcaataagttcgtcgatccacggtttgcagacttgggaacatttagggaccaggcaatcgttagagtggcagtgactgatgtggacgaacctcctgagttcagacctccttccggcctgctggaagtccaggaggacgctcaggtcggtagtctggttggggtagtgaccgcaagggacccagacgccgctaaccgcccagtgcgttacgctatcgaccgtgaaagtgacctcgatcagatttttgacatcgacgccgatacaggggctatcgtgacaggcaagggtctcgacagagaaacagcagggtggcataatatcaccgtcttagccatggaagcagacaatcatgcccagttaagccgcgctagtctacggatccggatactggatgtcaacgataatcctcccgagctagccacgccttatgaggctgccgtgtgtgaggacgccaagccagggcagctcattcagaccatctcagtggtggatcgcgatgagcctcagggcggacataggttctatttccggctggttcccgaagcgccatcaaatccacacttcagtctgttagatattcaggataataccgccgcagttcatacacagcatgtcggctttaataggcaagagcaagacgtgttcttcttacctatccttgtcgttgacagtggacctcctactctttcctctacaggaactctgaccatacgcatctgcgggtgtgattcgagcggcacgatccagagttgcaatactaccgcatttgtcatggcagcgtccctgagcccaggggcgttgattgcactgctggtctgcgttcttatactggtcgtgctagtcctgctaatcctgaccctgcgccgccaccataagtctcacctgtcctccgacgaggacgaggatatgcgagacaatgtaattaagtataacgatgagggcggcggagagcaggacacggaggcttacgacatgtccgcactgaggtcattgtacgatttcggcgaactcaaaggcggagacggtggcggttctgctggcggcggggcgggtggtgggtctggaggaggagcaggaagccctccacaggcgcacctgcccagcgagcgccattccttaccgcagggtcctccgagcccggagccagatttctctgtgttccgtgacttcatcagccgcaaggtcgccttggccgatggagacctctcagtgcccccatatgacgcctttcagacctacgccttcgagggggccgatagcccagccgcaagtctgtcaagcctgcattcaggttcatccggtagtgaacaggatttcgcctacttatccagctgggggccacgatttcgcccactggcagctctgtacgctggccatcgtggagacgacgaggcccaggcttcttag

SEQ ID NO: 181060 - DNA, 2490 bp, Artificial Sequence
  Description of Artificial Sequence: Synthetic coding sequence
atgggcctgccccggggccccctggccagcctgctgctgctgcaggtgtgctggcttcagtgcgccgcgtctgagccatgtagagcagtttttcgggaggctgaggtgacgctggaggcaggaggtgcagagcaggaacccggtcaagcactgggcaaggtctttatgggctgccccggacaggaacccgctttgttttcaactgataatgatgactttaccgtgaggaacggggaaactgtgcaggagcggagatcactaaaggagcgcaacccgctcaaaatctttccttccaagcggatcctgagaaggcataaaagggattgggtggttgccccaatatccgtgcccgagaatggtaagggacccttccctcagcggttgaaccagcttaagtccaacaaggacagggacactaaaattttttattctatcacgggtcctggtgccgatagccctcccgagggagttttcgcagtggaaaaggagactgggtggctattgctgaataaacctcttgacagggaggaaatcgcaaaatatgagttgtttggtcatgccgtaagtgagaacggggcatctgtggaagaccccatgaatatcagcatcattgttactgaccaaaatgaccataagccaaagttcacgcaggatacattccgagggtccgtccttgagggagtgctgcccggaacttctgtgatgcaagtcacagcaactgacgaggacgacgcaatctacacctacaacggtgttgtggcctactctattcacagtcaagaacctaaggacccgcacgatctgatgtttactattcatcgctccacaggaacgatctccgtcatcagttcagggctagaccgcgagaaagtgcctgaatacacgctgactatccaggccaccgatatggacggcgacggctcaacaacgacagctgtggctgttgtggagatcctggatgcgaacgacaacgccccaatgttcgacccgcagaagtacgaagctcacgttcccgagaacgcggtgggccacgaggtgcagaggctcactgtgacagacctggacgccccaaacagccctgcatggagggccacctatctgatcatgggaggggacgacggcgaccacttcaccatcactactcaccctgaaagtaatcagggcattttgactacaaggaagggcctggacttcgaagccaagaatcagcacaccctctacgtggaggtcaccaatgaagcccccttcgtgctgaaactccctacatccacagcaactatcgtagtgcatgttgaggacgtcaatgaggcacccgtgtttgtcccacctagtaaagtggtggaagtgcaggagggaattcccactggagagccagtgtgtgtgtacaccgcagaagatccggataaggagaaccagaaaatcagttaccgcatcttacgcgaccctgccggctggcttgccatggatccagactcgggccaggtcactgccgtggggacgcttgatagggaagatgaacagttcgtgcgaaacaacatctatgaggttatggtcctcgctatggacaacggctctccaccaacaacggggacagggacactgctgctgaccctgatcgacgtgaatgaccatggtccagtgcccgagcccagacagatcactatctgcaaccagagtcccgtacggcaagttctcaatattacagacaaagacttaagtccccacacctcgccctttcaggctcagctgactgacgatagcgatatatactggacagctgaagtcaatgaggaaggcgatacggtggtgcttagcttgaaaaagtttctgaagcaggacacttacgacgtacatttgagcctgtccgatcacgggaataaagagcagttaactgtgattagagcaacagtgtgcgactgccacgggcacgtagagacatgccctggcccttggaaaggaggttttatactgccagttctgggcgcagttttggctctcctcttccttctgctagtgttgttgctactagttaggaagaagagaaaaattaaggaaccccttctcctgccagaagacgacaccagggataatgtcttctactatggggaagagggaggcggagaggaagaccaggattacgacattacccagttacatcgcggactagaggctagacccgaagtggtgctgcggaacgatgtcgcccccacgattattcccaccccaatgtaccgtccgaggcctgctaaccctgatgagatcgggaatttcatcatcgagaacttgaaagccgctaatacagacccgaccgcaccgccgtacgacacattgctggtctttgactatgaaggttctggctcagatgctgcctcgctgtccagtttaacctctagcgcctcagaccaagatcaggattatgattacctaaacgaatggggaagccgatttaagaaactcgccgatatgtacggaggcggggaggacgactag

SEQ ID NO: 181061 - DNA, 2355 bp, Artificial Sequence
  Description of Artificial Sequence: Synthetic coding sequence
atgggcctgccccggggccccctggccagcctgctgctgctgcaggtatgttggcttcagtgtgccgcctcggagccgtgtcgggccgtattcagggaggcagaggtgacactagaggcaggcggagccgagcaagaacccgggcaggcactgggtaaggtcttcatgggatgccctgggcaagagccagccttattcagcaccgataacgatgatttcaccgtgcgcaacggcgaaacagtgcaggaaagacgctcgttaaaggagcgaaatcctctgaaaatttttcctagcaaaaggattctccggcgccacaagcgagactgggttgtagctccaatctcagtcccagagaatggaaaaggccccttcccccaaagactgaaccaattgaaaagtaataaagacagagacacgaaaattttctacagcatcaccgggcctggcgccgactctcctcccgagggagtctttgccgtggagaaggaaacagggtggctgcttctgaacaagccactggatagagaggaaattgcaaaatacgaactttttggccacgctgtcagcgaaaacggggcctcagtggaagatccaatgaatatctcaatcatcgtgaccgaccagaacgaccacaagccaaaatttactcaagatacatttagagggtctgtcctcgaaggagtgctacctggcactagcgtgatgcaggtgacggccacagacgaggacgacgccatctatacatataatggcgtcgtcgcttacagcatccattctcaagagcccaaagatcctcatgacctcatgttcaccatccaccggtcgactggaactatttcggtgattagtagtggtctagaccgggaaaaagtgccggagtacaccctgactatccaggcaaccgatatggatggggacggctcgactacaacagctgtggcagtcgttgaaatcctggacgcaaacgacaacgccccgatgttcgacccccagaagtatgaggcccacgttcccgaaaacgccgtaggtcatgaagttcaaagattaactgtgacagaccttgacgcgcctaattctcccgcttggcgggcgacctaccttattatgggtggcgatgatggtgaccacttcacaatcacgacccaccctgagagcaatcagggcattctgactacacgcaagggtctggatttcgaggcaaagaaccagcatactctgtatgttgaggtgaccaacgaggccccatttgtattgaagctccctacttccactgcaaccatcgtggtgcacgtggaagacgtcaatgaggcacctgttttcgtgccaccttcaaaagtggtcgaggtacaggagggcattccgacaggagagcctgtctgcgtgtacaccgctgaagatccagacaaagagaaccagaaaatatcctataggatcctgagggatcccgcgggctggctggcaatggaccctgactcagggcaggtgactgccgtggggacattggaccgcgaagacgagcagttcgtcaggaacaatatctacgaagtgatggtgctggccatggataatggttctccacccactaccgggacagggaccctgctcctcacactgatcgacgtgaatgaccatggacctgttcctgagccaagacaaataacaatatgcaaccaaagccctgtccggcaggtgctcaatataaccgacaaagacctttcacctcacacctctccttttcaggctcaactaacagatgattcggacatctactggaccgctgaagtgaatgaagaaggagacacagtggttctgagccttaagaagtttctgaagcaggacacctacgatgttcaccttagcctgtcagaccatggtaacaaggagcagctgacagtcattcgtgctaccgtctgcgactgccacggccacgtcgagacgtgtccggggccctggaaaggcgggtttatcctgcctgttctcggagcagtgttggcacttctttttctgctgctggtcctattgctgctcgttagaaagaagcgcaagatcaaagaaccgctcctcctacctgaggatgacacaagagacaatgtgttttactacggcgaggaaggtggaggtgaggaggaccaagattacgacatcacccaactgcatcggggacttgaggcccgccccgaagttgttctgcgcaatgacgttgcccccaccatcatcccaacccccatgtacaggcccagaccggcgaacccagacgagattggcaacttcatcatagaaggccgcggcgaacgcggatcccagcgagggaacggcggtttacaactggctcgaggccgcacgcggcgcagttag

SEQ ID NO: 181062 - DNA, 2325 bp, Artificial Sequence
  Description of Artificial Sequence: Synthetic coding sequence
atgggctgccccggccaggagcccgccctgttcagcaccgacaacgatgactttacagttcggaatggagagacagtccaggaacggagatccctgaaagagcgaaatcctctgaaaatttttccctctaaacggatcctgcgtaggcacaagagggattgggtggtggcccctatctccgtgcccgagaacggcaaaggcccatttcctcagaggttaaaccagctgaaaagtaacaaagaccgcgatacaaagatcttctactcgattaccggcccaggtgccgatagccctccagaaggcgtgttcgcagtggaaaaagagaccggctggctcctgttgaacaaacccctggatagggaagagatcgctaagtacgaactctttggtcacgccgtttctgagaacggtgctagtgtcgaggatcccatgaatatctccattattgtgaccgatcagaacgaccacaagcccaagttcactcaggatacatttcgagggtcggtactggagggagtgctgcccggaacatcagtgatgcaggtcactgccacggacgaggatgacgccatctacacttacaacggagtcgtggcgtactccattcatagtcaggaacctaaggatccccacgatctcatgttcaccattcatcgatcaacaggaacaataagcgtcattagtagtgggctggacagggaaaaagtacctgagtacacattaaccatacaagcgactgatatggacggggacggcagtacaaccaccgcggtggcagtggtggagatactcgatgccaacgataatgcccccatgttcgaccctcagaaatatgaagcccatgtgcccgaaaacgctgtggggcatgaagtgcaacgtctcactgtcaccgatctggatgcccccaattcccctgcatggagagcaacatacctcattatgggcggagatgacggcgatcacttcaccataactacacaccccgagtcaaaccaaggtatcctcacaactagaaaggggctggatttcgaagccaagaatcagcatacgctttatgtggaggtgacgaacgaagctccttttgtgctaaagctgcccacgagcactgccactatcgtggtacacgttgaggacgtgaatgaagcccccgttttcgtccctccttctaaggtggtggaagtgcaggagggcattcccactggggaacctgtctgtgtctatactgccgaggatccagataaggaaaatcagaagatatcatataggattctgcgagaccccgctggctggctggctatggaccccgatagcggtcaggtgacagcggtgggaactctggacagggaagatgaacagttcgtgagaaataatatttacgaagtcatggtgctcgccatggataacggaagccctccaaccactggaactggcactctgttacttaccctgattgacgttaatgatcatggcccagtccccgagccccgccaaatcactatctgtaatcaaagcccagtgagacaggttctcaatatcaccgacaaagacttgtcgccacacacgagtccattccaagctcaactgaccgatgactctgacatctattggacagccgaagtcaacgaggagggggacacggtcgtgctgtcgctgaagaagtttctcaagcaggacacatacgacgttcacttgtcgctctccgaccacggcaataaggagcagctcactgtgatcagagctaccgtgtgtgattgccatggtcatgtcgagacttgtcccggaccatggaaaggcggatttattctgcctgttctcggtgctgtgcttgctctgctctttctcctgcttgtccttctcctactggtgcggaagaaacgaaagatcaaggagccactgctcctgcccgaggacgacactcgcgacaacgtgttctattatggcgaggagggcggtggagaggaggaccaggactatgatattacccagctgcacagggggttagaggctagacccgaagtggtgttgcggaatgacgtggctcccacaattatccccacccctatgtatcgccccagacctgctaacccagatgagatcggaaacttcataatcgagaacctcaaagctgcgaatactgaccctaccgcgccaccttacgatactctgctggtatttgattatgaaggcagcgggagtgacgctgctagcctctcatctcttacctcttcggctagcgaccaagaccaggactatgactaccttaacgaatggggtagcagattcaaaaaactggccgatatgtatggtgggggcgaggacgattag

SEQ ID NO: 181063 - DNA, 2751 bp, Artificial Sequence
  Description of Artificial Sequence: Synthetic coding sequence
atgaccgccggcgccggcgtgctgctgctgctgctgagcctgagcggtgccctgcgtgcgcataatgaggacctgacgacccgagagacctgcaaggcggggttctccgaagatgactacactgctctgatctcccaaaacattctggaaggagaaaagctgcttcaggtgaaattttcgagttgcgttggaactaaggggacccaatacgaaaccaactctatggactttaaagtaggtgccgatgggacagtgttcgcaactagagagttgcaggtcccatccgagcaggttgcatttactgtaaccgcatgggattcacagacggccgaaaagtgggatgccgtggtgagactgcttgttgctcaaacaagctcgccacacagtggccacaagcctcagaagggcaaaaaggtggttgccctggatcccagtccacctcctaaggatacactgctgccctggcctcagcatcagaacgctaacgggctgcgacggcgtaagcgtgactgggtgataccaccaataaatgtgcctgaaaactcccgcgggccttttcctcagcaactggtccggatccggagtgacaaagataatgacattccaatccgctactccatcacaggcgttggagccgatcagccacccatggaagtgttcagtatcgatagtatgagcggcagaatgtacgtaaccagaccaatggaccgagaggaacacgcatcctatcatctgcgagcacatgctgtggatatgaacggtaataaagttgaaaaccccatagatctgtacatctacgttatcgacatgaatgataaccggcccgaattcattaaccaagtttacaacggtagcgtggacgaggggagcaagcctggcacgtacgtcatgaccgtcactgctaacgacgcggacgattctacaactgcaaacggcatggtgcgctatcgtattgttacccagaccccacagtctccaagccagaatatgtttacaatcaacagcgagacaggcgacatcgtgaccgtagcagccggtttagatcgggaaaaggtgcagcagtacactgtcatcgtccaggccacagatatggagggaaacctgaattatggccttagcaatacagctacggccataattacagtcacagacgtgaatgataacccacctgagtttacagcttcaacctttgccggcgaagtgccagagaaccgggttgagacagtagtggcgaacttaactgtgatggacagagatcagcctcacagccccaactggaatgcagtctaccgtattatctccggagatccctccgggcacttcagcgtgagaactgaccctgtgacgaacgaaggtatggtaactgtggtaaaggccgtggactacgagctcaacagagcgttcatgctgacagtcatggtttctaatcaggcccctctggcctcggggatccagatgagctttcagtcaaccgccggagtaactatctctatcatggatatcaatgaggccccttactttccctcaaatcataaactcataaggctggaagagggcgtccctcccggaacagtccttacgacatttagcgctgtggacccagaccgctttatgcaacaggcagtaagatatagtaaattgtccgacccagcatcttggctccatatcaacgctactaacggtcagatcaccacggctgctgtcctggacagagaatctctttacactaaaaataacgtctatgaagccaccttcctggctgccgataacggcattcctcccgcctctggaacagggacactacagatctatctcatcgatatcaatgataacgcgccagagctcttgcctaaggaggcacagatttgcgagaagcctaacttaaatgctatcaacattacagcagccgatgcagacgttgacccaaatattggaccctacgtatttgagctgcccttcgtaccagcggctgttcgaaagaactggaccattactaggctcaacggagactacgcccagctgagtttgagaatattatatcttgaagccgggatgtatgatgtacccataattgtgacagacagcgggaatccgccattgtctaataccagcattatcaaggtgaaggtgtgtccttgtgatgacaacggtgattgcaccactatcggggcggtggcagccgcggggctcggaacaggggctatcgtagctattctgatatgcattctgattttactcacaatggtcttactgttcgtgatgtggatgaagcgccgtgagaaggagcggcacacaaaacagctgctcatcgatccggaggacgacgtgcgcgacaatatcctgaagtacgatgaggaaggaggcggagaagaggatcaggactatgacctgtcccaactgcaacaacccgaagccatgggccatgtcccatctaaggctcccggcgtgaggcgggtggacgagcggccagttggagctgagcctcaatatcccatacggcccatggtaccacacccaggcgacatcggagattttattaatgagggccttcgggcagccgataatgatccaacagcacccccgtacgattccctgcttgtgtttgactatgaagggagcggttccactgctgggagcgtgagttcattaaatagttcctcttccggcgaccaggattatgactatctgaacgactgggggccccgattcaagaaactggcagacatgtatggaggaggcgaggaggattag

SEQ ID NO: 181064 - DNA, 2475 bp, Artificial Sequence
  Description of Artificial Sequence: Synthetic coding sequence
atgcccaagagcaccggcatgctgcacggcggccgggagaacgccggcgtcaagttctcatcctgcgtgggtaccaaaggcacccaatatgaaacatcctctcctcactccgggcataaaccccaaaagggcaaaaaggttgtcgctcttgatcccagtcctccgcccaaggacacgttgctcccctggccacagcaccagaatgccaatggccttcggcgccggaagagggactgggtgattccccctataaatgtacccgagaattcaaggggccccttcccacagcagctggttcgtattcgctcagacaaggataacgatatccctattcgctacagcattactggggtcggcgctgatcagccgcctatggaagttttttccatcgattcaatgagcggtcggatgtatgtaacacggcccatggatcgggaggaacacgcctcctatcacctgcgagcccacgccgtggatatgaatggcaacaaggtcgagaatcctattgatttgtacatctacgtgatcgacatgaacgacaacagaccggagtttattaaccaggtatataatgggagcgtcgatgagggatccaaaccaggcacttatgttatgaccgtgacagcaaatgacgctgacgacagcaccacagctaacgggatggttcggtacagaatagtgacccagacgccacagtcgccaagccaaaacatgttcactattaattccgaaacaggagacatagtgacagttgctgcaggcctggacagggaaaaagttcaacagtacacagtgattgtgcaggccactgatatggagggaaatttaaactacggtctgtccaatacagctaccgcaatcatcactgtgactgacgtaaatgacaatcctcctgaatttactgctagtacattcgcgggagaggtgcccgagaaccgcgtcgagaccgtcgtggccaatctaactgttatggacagagatcaaccgcactctccaaactggaacgcagtgtaccgtatcatcagtggtgacccaagtggtcacttttccgtgcgtaccgacccggtgacaaatgagggcatggtgactgttgtgaaagcagtagattacgaactgaatcgcgccttcatgctgaccgtcatggtgtctaatcaggcacctcttgctagcggaatccagatgtctttccagagcactgccggagttactatttcaattatggatatcaatgaggcaccttatttcccctccaatcataagctgattcggcttgaagagggagtgcccccgggcacagtactaaccacattttcagccgtcgatccagatcggtttatgcagcaggctgtgcgctactccaagctctctgacccggcatcctggctgcacataaatgcaacgaacgggcaaatcaccaccgccgctgtcctggatagggaatcattatataccaagaataacgtctatgaagctacgttcttggccgccgataatggtattccccccgctagtggcacaggcaccctacaaatctacctgatcgacatcaatgacaatgcccctgagttgctgccgaaagaagcccagatatgcgaaaaaccaaatctcaacgcaataaatatcactgccgctgacgctgatgtagaccccaatattggcccctatgtgttcgaactgccctttgttcccgcagccgtgcggaaaaactggactattacgcgcttgaacggcgactatgcccaactgtccctcagaatcttgtatcttgaggcgggaatgtatgatgtgccaatcatagtgaccgactccggtaatccacctctgagtaatacttccatcatcaaagtgaaggtgtgcccgtgtgatgataatggagactgtactaccataggcgcagtggccgccgcagggctcgggactggtgccatcgtggccattttgatctgcattttgatcttactgacaatggtgctgctgttcgtaatgtggatgaagaggcgggagaaagagcggcacactaaacagctcctgatcgacccggaggacgacgtgcgggacaacattcttaaatatgatgaggaaggcggaggggaggaggatcaggactacgacctgagccagcttcaacagcccgaggcgatgggccacgtgccaagcaaggcccctggggtgcgcagagtagacgaaagaccagtgggcgctgagccgcaataccctatcagaccaatggttcctcaccctggcgatatcggagacttcattaatgagggcttgcgagcagccgataatgaccctacagctccaccttatgatagccttctggtgttcgactatgaggggtctggcagcactgccggaagcgttagttctctgaacagcagcagctcaggcgatcaggattacgattatctgaatgattggggacctaggttcaaaaaactagctgatatgtacggtggtggggaggaagactag

SEQ ID NO: 181065 - DNA, 2529 bp, Artificial Sequence
  Description of Artificial Sequence: Synthetic coding sequence
atggacttcaaggtgggcgccgacggcaccgtgttcgccacccgggagctgcaggtgccttcggagcaggttgcctttactgtcaccgcctgggatagtcagacggccgagaagtgggacgcagtagtcagattactggtagcccagaccagctccccccatagcgggcataaaccacagaaaggaaaaaaggtggtcgcccttgacccctccccccctccaaaagatacacttctcccctggccacagcatcagaacgctaacggtcttagacggcgtaagagggattgggtgattcctcctattaatgtgccagaaaatagcagaggtccctttccacaacagttggtgcggattcggtccgacaaggacaacgatattcctatacgatatagcattaccggagtgggggccgatcagccgccgatggaagtgttttccatagatagcatgtctgggcgtatgtacgtcacgcgccccatggaccgtgaagaacatgcctcatatcacctgcgggctcatgccgttgacatgaacggcaacaaggtggagaatcctatcgatctttacatctacgtaatcgatatgaacgacaatagacctgaattcataaatcaggtttataacggttcagtcgatgaaggttctaagcctggaacttacgtaatgacagtcactgccaacgacgccgacgacagcaccacagcaaacggcatggtcagataccggatcgtcacacaaactccacagagccctagtcagaacatgttcacaatcaactcagaaaccggagacatcgtcactgtagccgccgggttggatcgagaaaaagtccagcagtatacagtgattgtgcaggctaccgatatggaagggaacttgaactacgggctatctaacacggctacagccattataaccgttactgacgttaatgacaacccgccagagttcacagcatccaccttcgcaggcgaagtcccagaaaatagggtcgagaccgtggtagccaacttaaccgtcatggaccgggatcagcctcactctccaaattggaacgccgtctatcgaattatcagcggagacccatctggacacttcagcgtgaggaccgatcccgttaccaatgaggggatggtcacggtggtgaaagccgtggactatgagctcaaccgtgcgtttatgctcacagttatggtttctaaccaggcccccctggcttcggggatccagatgtcatttcagagcactgctggcgtgacaatttccattatggacataaacgaagctccctacttcccctccaaccacaagctcataaggctggaagagggtgtgccacccggcacagtacttacaactttctctgccgtggatcctgaccgcttcatgcagcaggcagtgaggtactctaagctttctgatccagcctcttggctccacatcaatgctacaaatggccagattactaccgctgctgtattggatcgggaaagcctgtacaccaaaaacaacgtgtacgaagccacctttctggcagccgacaatgggatccctcctgccagcgggacgggtacccttcagatctacttgatcgacattaacgataacgccccagagctgctgcctaaggaagcgcagatttgcgaaaagcccaacctcaacgccatcaatattacggctgccgacgctgatgtggaccctaacataggtccatatgtttttgagttgcccttcgtgccagctgctgttcgtaaaaattggaccattacccgtcttaacggcgactatgctcagctgtcgcttagaatcctgtacctggaagcagggatgtacgacgtaccaataatcgtaaccgactccggcaaccctcccctgtcaaatacatccattattaaggtcaaggtttgtccctgcgatgacaatggagactgcaccacaatcggggctgtggctgctgccggtctcgggaccggagcgatagtggccattttgatatgtatcctgatcttgcttactatggttctcctattcgttatgtggatgaagcggcgcgaaaaagagcggcatactaagcagctgctgatcgaccctgaggatgatgtgcgtgacaatattcttaaatacgacgaggagggtggcggggaggaagatcaagactacgacctctcacagttgcagcaaccagaggctatgggtcatgttccaagcaaggctcccggcgtgagacgggtggacgagcgccccgtcggggccgaaccccagtaccctattcgacccatggtaccccatcctggggatataggcgactttatcaacgaagggctcagagcagcggacaacgatccaactgcgcctccgtacgattcccttctggtattcgactacgagggttcggggagtactgccgggagtgtgtcttcgctgaacagttcctcctctggcgatcaggactacgactatctgaacgactggggacccagatttaaaaagctcgccgacatgtatgggggtggagaggaggactag

SEQ ID NO: 181066 - DNA, 2358 bp, Artificial Sequence
  Description of Artificial Sequence: Synthetic coding sequence
atgaagctgggcaaggtggagttctgccacttcctgcagctgatcgcactttttttgtgcttctccggaatgagccaagccgaattaagtcgctccaggtccaaaccttacttccaatctggccgctcacgtacaaaaagaagttgggtgtggaatcagtttttcgtgcttgaggagtacatggggagcgaccctctttacgtgggaaagctccactctgacgtagataagggggatggcagcatcaagtatatcctgtctggggagggtgctagctcaatttttataattgacgaaaacaccggcgatatccacgcaacaaagcgattggatcgcgaagaacaagcctattacacgctgcgggctcaggccctggatcggctgacgaacaagcccgtggagccagagtccgagtttgttatcaagattcaggacatcaacgacaacgaaccaaagttcttggacgggccctatactgccggcgtgccggagatgtctcccgtgggaaccagtgtggtccaagtaacggctactgacgcagacgatcccacctacggcaacagcgcacgggtcgtgtactctatcctgcaaggccagccgtacttttccgtggaacccaaaactggggtgattaagaccgcgttgcccaacatggatcgcgaggccaaggatcaatacctcctcgtgatacaagccaaggatatggtaggtcagaatggtggcttatcaggcactaccagcgtcaccgttactctcaccgacgtgaacgacaacccaccccgatttccacgacgctcctaccagtacaacgtcccagaatctcttcccgtagcaagtgtggtagcccgcattaaagccgctgatgcagatatcggcgccaacgccgagatggagtacaaaatagttgacggggatgggttgggcatcttcaaaatctctgttgataaggagactcaagagggaattataaccatccaaaaggagctagactttgaagccaagacatcgtacacactccggatagaggcagctaataaggatgccgacccccggtttttatccctgggacctttcagtgacactactacggtgaaaattatcgtggaagacgtagacgaaccacccgttttttcctctcctctgtaccctatggaagttagtgaggccactcaggtgggcaacatcatcggaaccgtggcagctcacgatccagactcttcaaactctcccgtgcgctattctatcgaccgaaacactgacttggaacggtatttcaacatagacgctaacagtggggtgatcactaccgcaaagtctctggacagggaaactaatgcaatccataatatcaccgtgcttgccatggagtcccagaatccttcccaggtgggacgagggtatgtcgccatcactatcctagatattaatgacaacgcccccgaatttgccatggactacgagacgactgtgtgcgagaacgcccagccaggtcaggtgattcagaagattagcgccgtggataaggacgaacctagcaatggtcaccagttttatttctcccttactactgacgctactaataatcataacttcagcctgaaagacaataaggacaacacggcgtccatcctcactcgtcggaacggtttccgacgccaggagcaatctgtatactatctccccatcttcatagttgactctggcagtccaagtctcagcagcacaaacaccctgactattcgggtgtgtgattgcgatgccgacggagtggctcagacatgtaatgccgaggcttatgtactgcctgcaggattgtccacgggcgccctgattgccattttggcatgcgtgctgactctactcgtacttatcctactgattgtgacaatgcggaggcgtaagaaagagcccctgatttttgatgaggagagggatatcagagagaacattgtaaggtacgacgatgaaggcggaggagaagaggacaccgaggcctttgatatggcagccttgcgcaacttaaatgtaataagagacactaaaacccgccgagacgttacacccgagattcaattcctgtctcgccccgctttcaagtcaattcctgacaatgtgatttttcgagaattcatttgggaacgccttaaggaagccgacgttgatcctggcgccccgccatacgacagcctgcagacttacgcttttgaagggaatggtagcgtcgccgagagtctgtcatcactcgattccattagttccaactcagatcaaaactatgattatttgtcagattggggcccacgatttaaaagactcgcagatatgtacggtacaggacaagaaagtttgtactcttag

SEQ ID NO: 181067 - DNA, 2358 bp, Artificial Sequence
  Description of Artificial Sequence: Synthetic coding sequence
atgaagctgggcaaggtggagttctgccacttcctgcagctgatcgccctatttttgtgttttagcggtatgagccaggcagagctgtccagatctaggagcaaaccttacttccagtctggcagaagtcggactaaaagatcttgggtctggaatcagtttttcgtgttggaggaatatatgggcagcgatcctctgtatgtggggaaacttcacagcgacgtggataagggcgacggttccatcaagtacatcttgtccggagaaggtgcttcttctatctttattatcgacgagaatacaggcgacattcacgccacgaaaagacttgaccgcgaggaacaagcgtattacactctccgcgcccaggcactggatcgtctgacaaacaagccagttgagcctgagtcggagttcgtaatcaagatccaggatataaacgataacgaaccaaagtttctggacgggccctatactgcaggtgtccccgagatgagtccagtgggaacatctgtggtacaggtaacagccactgacgcggacgaccccacatacggaaattcggccagggtggtttactcaatcctccaggggcagccctactttagtgtggagcctaagactggtgtcataaaaacagccctcccaaacatggaccgcgaggcaaaggaccaatatttgcttgtaattcaagcaaaagatatggtgggtcagaacgggggcctgtccggtaccacctccgtgacagtcaccctgacagatgtgaacgataatccgcccagattccctcggaggtcctaccagtataatgtgccagagagcctcccagtggcctccgtcgtggcacggatcaaggccgctgatgcggacattggggctaatgccgaaatggagtacaagatagtggatggggatggactaggcatctttaagatcagcgtagataaggagacccaagaagggattattaccatccaaaaggagttagatttcgaagctaagacgagttacacccttaggatagaggccgctaataaggacgcagacccgaggttcctgtctcttgggcccttctctgacacaactacagtgaagatcatcgtggaggacgtcgatgagccacccgttttttcatcaccattataccccatggaagtgtcagaggcaacccaggtgggtaacatcatcggcacggtggccgcacacgatccagacagttccaactctcccgttaggtattccatagacagaaataccgacctcgaaaggtattttaatatcgacgctaacagtggtgttatcaccaccgcgaagtctctggatcgagagacaaatgccatacacaatatcacagtactggccatggagtctcagaacccaagccaggtgggccgggggtacgtggctataaccatcctggatattaatgacaacgcacctgagtttgccatggattacgaaacgacagtgtgcgagaacgcacagcctggtcaggtgattcaaaagataagtgccgtggataaggacgagccgtccaacggccatcaattttatttttcccttacaacggatgcgactaacaatcacaatttcagtctcaaagataacaaggacaacactgcatcaatattaacacgtagaaatggctttcggcggcaagagcagagcgtgtattacttgcccatcttcatagtcgactctggaagccccagcctcagctccaccaacaccctgaccataagggtatgtgactgtgacgcggacggtgtagcccaaacctgcaacgccgaggcgtatgtcctgccagctgggttgagtacaggggccttaattgccatcttggcctgtgtcctcacgctgctggtcctcatcctcttaatcgtgactatgcgccgacgaaagaaggaacctctgatctttgatgaggaaagggacatcagagagaacattgtgaggtacgatgacgaaggcggtggtgaagaggatacagaagcgttcgacatggccgcccttcggaatctgaacgtgattcgagataccaagacccgccgggacgtaacccccgagatacagttcctctctagaccagcgtttaaaagtatcccagataacgtcatcttccgcgagtttatctgggaacgcctgaaagaggcagacgttgatccgggagctccaccctacgattctttacagacctacgctttcgaagggaacgggtcggtcgccgagtcgctgagctccttggacagtatatcaagcaattccgaccagaattatgattatctgtccgattggggtcctcgctttaaacgcctggcagacatgtatggtacggggcaagagtcgctgtactcctag

SEQ ID NO: 181068 - DNA, 2358 bp, Artificial Sequence
  Description of Artificial Sequence: Synthetic coding sequence
atgaagctgggcaaggtggagttctgccacttcctgcagctgatcgcccttttcctctgcttttctggtatgtcgcaggccgagttgtcacggtccaggtccaaaccatactttcaaagcggtcggtccagaaccaagcggagttgggtgtggaaccagttttttgtcctggaagagtacatgggaagcgatccgctgtatgtgggtaagctacatagtgacgttgacaagggtgatggatccatcaagtacatcctgtcaggggagggcgcaagtagcatcttcataattgacgaaaacaccggggacatccacgctactaaaaggctcgatagagaggagcaggcctattacaccttgcgcgcccaagcactagatagattgacgaacaaacccgtcgaacccgaatcagagttcgtgattaaaatccaggacatcaacgataacgagcccaagtttcttgacggcccatacaccgcaggtgtccctgaaatgagccccgtgggcacatcagtggtgcaggtcaccgccacagacgcggatgatcccacgtacggtaacagtgctcgcgtggtttactcgatccttcagggccagccatacttctccgtggaacccaagacaggcgtgatcaagacagctcttcctaatatggacagagaagccaaggatcagtatctcctggtgattcaggcaaaagatatggttggccagaatgggggattatccggcactacatctgtgacagtgacgctgacagacgttaacgacaaccctccgaggttccctcgccgtagctatcagtataatgtgcctgagtctctccctgtggcttccgtcgtcgctcgaataaaggcagccgacgcagatatcggggctaacgccgaaatggagtacaagatcgttgacggcgatggactaggcatattcaagatttccgttgacaaggagactcaggagggcattattaccatccaaaaagagctggatttcgaggcgaagacttcctacacccttcgaattgaggcagctaataaagacgccgacccccgctttcttagcctcggccccttcagcgatacaactactgttaagataatagtggaggacgtggatgaaccgccagtcttcagctcaccgctatacccaatggaggtgagtgaagcaactcaagtggggaatatcataggcacagtggcagcacatgatccagactcctccaacagccccgtaagatactccattgatcggaatacagatctagagaggtactttaacatcgatgccaatagtggagtgatcacgacggctaagtctttggacagagagaccaatgccatccacaatattaccgtgttagccatggaatcccagaacccctcccaggttgggagaggatacgtagctattactattctggatattaatgataacgcccctgagtttgctatggattatgaaactacagtctgcgaaaacgctcaacccggtcaggttatccagaagatttcagccgtggataaggacgagccctccaatgggcatcagttctatttttctcttactaccgatgccacgaacaaccacaacttctccttgaaagacaacaaagacaacacagcttctatcctcacgcggagaaacggctttcgcagacaggaacaatccgtgtattatttacccattttcatagtcgactctgggtccccctcactgtcgagtacgaatacacttaccatacgggtgtgtgattgcgacgccgacggagtagcccaaacctgcaacgccgaggcgtatgtgttaccagctggcctaagcacaggagcactcatcgctattttggcctgtgtcctaacgctgctcgtcctgattttactgatagtgacaatgcgacgccggaagaaggaacctctcatctttgacgaggaacgtgacattcgcgagaatattgtgcggtacgatgacgaaggggggggggaggaggatacggaggccttcgatatggcggcacttcgcaatttgaacgtgatacgagacacaaaaacgcgcagggacgtcactcctgagatccagttcctgtcaaggcccgcatttaaaagtatccccgataatgtcatcttcagagagtttatttgggaacgactcaaagaggccgacgtggaccccggcgcaccaccatatgactcgctgcagacctacgctttcgaaggcaacggaagtgtggcagagtctctgagtagcctggatagtattagcagtaactctgaccaaaattacgactatctctcggattggggcccaagattcaagaggttagccgatatgtacgggacaggccaggaatctttgtatagctag

SEQ ID NO: 181069 - DNA, 1893 bp, Artificial Sequence
  Description of Artificial Sequence: Synthetic coding sequence
atgaagctgggcaaggtggagttctgccacttcctgcagctgatcgccctatttctgtgcttttcaggtatgtctcaggcggagctgagccgctcgcgaagtaagccatattttcagtctggccgatccaggactaaaagatcatgggtctggaaccagttctttgtccttgaggagtacatgggatccgatccgctatacgtggggaagctccatagcgacgttgataaaggcgacgggtcaatcaagtacatcttgtctggtgagggcgcttcttcaatcttcataatcgatgagaacacaggagacatacatgccacaaagaggctcgatcgggaggagcaggcttattatactctgagggctcaggctctagaccgactgacaaataagccagttgagcctgagagcgaatttgtcatcaagattcaggatatcaacgataatgaacctaagttcttggatggcccatatactgccggagttcctgagatgtctcccgtgggaactagtgtggtgcaggtgaccgctacggatgccgacgaccctacatatggaaatagcgccagggtagtctactctatcctccaggggcagccctacttcagtgtcgaaccaaaaacaggcgtaattaaaaccgctctgcccaacatggatagggaagcaaaagatcagtatctgctggttattcaagccaaagacatggttggccagaatggcggcctgagcggcaccacatcagtgacggtaactctaacggatgtgaacgataatcccccccgctttccacggaggtcctaccagtataatgtgccggagtccctccctgtggcatccgtggtcgcacggataaaagcggcggatgctgatattggcgctaacgccgagatggagtataagatcgtagatggcgacggcctgggtatctttaaaatctccgttgataaagagacacaggaaggcatcatcacaattcagaaagagcttgactttgaagccaagacctcctacactctccggattgaagctgctaataaagacgccgacccaaggttcctcagccttgggcccttcagcgatacaacaactgtgaagatcatcgttgaagatgttgatgagcctcccgtgttttcaagcccgctgtatcctatggaagtgtctgaagctacccaggtgggcaacataatcgggacggtagctgcacacgacccagatagctcaaatagtcctgtgaggtattcaatagatcgtaacacagaccttgaaagatattttaacattgacgcgaatagcggtgtgatcacaacggccaaatctttagatagggaaaccaatgccatccataacatcaccgtactggccatggagtcccagaacccatctcaggtggggcgaggctatgttgccattaccatactcgatattaacgacaacgcgccagagtttgcaatggattatgagacaaccgtctgcgaaaatgcccagccaggacaagtgatccaaaaaattagcgcagtggacaaagatgaaccatctaatgggcaccagttctattttagcttgaccaccgatgcgaccaacaaccataattttagcctaaaggacaacaaagacaatacggcaagcattctcacccggcggaacgggttccggcgccaggagcagtccgtgtactacctgccgatcttcatcgttgacagcggctctccatctttgtcctccactaatacacttacgatcagggtgtgtgactgtgacgcagacggcgttgcccagacctgtaacgctgaggcctatgtgcttccagctggcctgagcacaggagctttgattgccattcttgcttgcgttctcactcttctcgggcgatactgcttccagggcctgttatag

SEQ ID NO: 181070 - DNA, 2400 bp, Artificial Sequence
  Description of Artificial Sequence: Synthetic coding sequence
atgcccgagcggctggccgagatgctgctggacctgtggacccccctgatcatactgtggattaccctaccaccatgcatctacatggcacccatgaaccagtcccaggtcttgatgtcaggctcgcctctggagctgaattctctgggtgaggagcagaggattctgaatcgatctaagcgcggttgggtctggaaccaaatgtttgtacttgaggagttctctggcccagaacctatacttgtgggccgcttgcacacggatctggatcctggcagcaagaaaatcaagtacatcctgtcaggggacggagctgggacaattttccagataaacgatgtaactggcgacatacatgccatcaagcggctggatagggaggaaaaggcagaatatactcttaccgcacaggccgttgactgggaaacgtccaaacctctcgagccccctagtgagtttatcatcaaagtgcaggatattaacgacaacgccccagaatttctaaacggcccatatcacgcaacagttcctgagatgtctatcctggggacctctgtgactaacgtcacggcgactgacgcggatgatcccgtctacgggaacagcgctaagttggtgtatagtatcctggaggggcagccttatttcagcatcgagccagaaacggctatcattaagacagcattgcccaatatggatagagaggctaaggaggaatatctggtagtaatccaggctaaggacatgggtgggcactctggtggccttagcggaaccacaaccttaaccgtgacgctgacagacgtcaatgataatccccccaaatttgcacagtctctgtaccacttctccgtcccggaagacgtggtgttgggaacggctattggccgagtcaaggcaaatgatcaggatattggtgagaacgcccagagcagctacgatataatcgacggcgatgggaccgccctcttcgaaatcacgtctgacgcacaagcccaggacggcattattcgtctccgcaaacccttagattttgagacaaaaaagtcatatacattgaaggttgaggctgcaaatgtacatatagatcccagattttcaggaagggggccatttaaggatacagctaccgtcaagatagtagtggaggacgccgacgaacctccagtgttttccagccctacttatttgctggaagtgcacgagaatgcagctctcaactccgtcatcggtcaggtaaccgcaagagaccccgatatcacctccagccccatcagattctccatagacaggcacactgacctggagcggcagtttaatattaacgccgacgacgggaagataactctcgcaaccccactggacagggagctttcagtttggcacaatatcaccattatcgcaacagaaataagaaaccacagccagatatctcgcgtgccagtggcaatcaaggtcctggacgttaacgacaatgccccagaatttgcttctgaatacgaagcattcctctgtgaaaatgggaagcccgggcaggtgattcaaaccgtttcggcaatggacaaggatgatcctaagaacggccattactttctttatagcctgctccctgagatggtcaacaacccaaattttacgatcaaaaagaatgaagataacagcctgtcaatattggccaaacacaatgggtttaaccgacaaaagcaggaagtgtatcttctgccaatcattatctcagattccggaaacccccctctctcatctacttctacactcacaattcgggtgtgtgggtgtagcaacgacggcgttgtacaatcctgcaatgtcgaggcctatgtgctccccatcgggctgtccatgggcgcgctaatcgcaattctggcatgcattatcctgctcctggttattgtggtgctatttgtaaccctccggaggcacaaaaatgaacccctcatcatcaaagacgacgaggacgtgagggaaaacatcattaggtacgatgatgaaggcggcggggaggaagatacggaagctttcgatatagcgacactccaaaaccccgacgggattaatggttttttaccccggaaggatattaaacctgacctccagttcatgcccagacaagggctggcccccgtgccaaatggtgtcgatgtcgatgagtttatcaatgtccggctgcacgaagcagacaacgatccaaccgctccaccctacgactcgattcaaatctatggctacgagggacggggctcggtcgccggaagcctttcaagcctggagtccacgacatcggactcagatcagaactttgattacttaagcgattggggccctagatttaagagactaggagagttgtacagcgtgggggagagcgacaaggagacttag

SEQ ID NO: 181071 - DNA, 2400 bp, Artificial Sequence
  Description of Artificial Sequence: Synthetic coding sequence
atgcccgagcggctggccgagatgctgctggacctgtggacccccttgattatcctttggattactttaccaccctgcatatatatggcacccatgaatcaaagccaagtgttgatgagcggaagcccactggagttgaattccttaggcgaggaacagagaattcttaacaggagtaaacgcggttgggtgtggaaccagatgttcgtgctagaagagttctcaggcccagagccgatcttggtgggccgactgcatactgatctggatccgggctctaagaagataaagtacatcttatcaggagacggcgcagggacaatatttcagattaacgacgtgacaggggatatccacgcgatcaaacgactcgatcgggaagaaaaggctgagtacacactgactgcgcaggcagtagactgggaaaccagcaagccattagagcccccgtcggaatttatcatcaaggtgcaagatattaacgacaacgcacctgagtttttgaatgggccttatcatgctactgttcctgaaatgtcgattctcggcacttccgtcacaaacgttactgcaacggatgcagatgaccctgtctacgggaacagcgcaaaactcgtgtacagcattcttgagggccagccatatttctccatagagcctgagaccgctataatcaagacagcactgcctaatatggaccgcgaggccaaggaggagtacctcgtcgtgattcaagctaaagacatggggggacattccggaggactcagcggtactactaccctgacagtgacgctaaccgatgtgaacgacaacccacctaagttcgctcagtccttataccacttttccgtgcccgaagacgttgtgcttggcaccgcaattggaagagtgaaagctaacgaccaagacattggtgaaaacgctcaatcttcttatgacatcattgacggagacggtacggctttgttcgagatcacctcagacgctcaggctcaggatggcataatcaggttgaggaaaccactggactttgagactaagaagtcatacacgctgaaagtggaggccgcaaacgtccatatcgatccaagattctctggacggggccctttcaaggacacagcgacggtgaagattgtagttgaagacgcagatgagccaccagtgttttcctcccctacatatctcttggaagttcatgagaacgctgctctgaatagtgttattgggcaagtcacagccagggaccctgacataacgagctcaccaattcgttttagtatcgaccggcacacagatttggaaaggcagttcaacattaatgcggacgatggtaagatcacactggcaaccccgttggacagagaactgagtgtgtggcacaacatcactattattgctacagagataagaaaccatagccagatctctcgtgtgccagtcgcgattaaggtccttgatgtgaacgataatgcccccgaattcgcatctgagtatgaggcattcttgtgtgaaaacggtaagccagggcaagtcatccagactgtcagcgcgatggacaaagacgaccccaaaaatggccattatttcctgtacagcctcctgcctgagatggtcaacaaccctaatttcactatcaaaaagaatgaggacaattcactgtcaattctggccaaacataacggcttcaatcgtcagaagcaggaggtgtacctgctcccaattataatctctgacagtggtaatccacccctctcctctacttctacattgaccataagggtgtgcggatgttccaacgacggtgtggtgcagtcctgtaacgtggaggcatacgtgttgcctatagggctatctatgggagctctgatagctatcctggcatgtatcatcctactcctggtgattgtggttctattcgtgacattacggcggcacaaaaatgaacccctcatcatcaaagacgatgaagatgtgcgggagaacataatccgatacgatgatgaagggggaggagaggaggacacagaagcctttgatatagccactctccagaatcccgacggcatcaacggattcttgccgcgcaaggacatcaaacctgacctccaattcatgcctcgccaagggctggccccagtgccaaatggcgtggacgtcgacgagttcatcaatgtgaggctgcatgaggctgataacgatccaacggcaccgccgtacgattcaatccagatatatggctatgaaggcaggggcagtgtcgctgggtctctgagctcgttggaatctacgacgagcgacagcgatcagaattttgattatctctcagattggggcccgcgctttaaacgcctgggggagttatatagcgtgggagagagcgataaggagacatag

SEQ ID NO: 181072 - DNA, 795 bp, Artificial Sequence
  Description of Artificial Sequence: Synthetic coding sequence
atgaccaagttcagcagcttcagcctgttcttcctgatcgtgggcgcatacatgacacacgtgtgctttaatatggaaattattgggggtaaggaagtatctcctcacagtagaccattcatggctagcatccaatatggaggtcaccatgtctgcggcggggtgctgatcgatccccaatgggtccttactgcagctcactgtcaatacagatttactaagggtcagtctcctaccgtggtgctgggagcccattcccttagcaagaatgaagcctctaagcagacgctggagatcaagaaatttatacccttcagccgcgtgacatcagaccctcagagcaacgacattatgttagtaaaactccaaacggcagcaaagcttaacaagcacgtcaaaatgctgcacattagatctaagacctccctccgaagtgggactaaatgcaaggtaacaggatggggggctaccgaccctgatagcctgcgtcccagtgacacactgcgggaggtcacagttaccgtccttagccggaagctgtgcaatagtcagtcttactataatggcgacccctttattacaaaggatatggtctgtgcaggggatgctaaggggcagaaggacagctgcaagggtgacagcggcggtccactgatatgtaaaggggtcttccacgccatcgtgtctggcggacacgagtgcggagttgccacaaaacccgggatatacacattacttacgaaaaagtaccaaacatggattaagtcaaatctggtgcccccacacacaaattag

SEQ ID NO: 181073 - DNA, 246 bp, Artificial Sequence
  Description of Artificial Sequence: Synthetic coding sequence
atgcggacctaccactacatccccctgttcatctggacctacatgtttcacacagtcgacaccattttgctacaggagaagcctaatagctatctgtccagcaagaaaatcgccgggctcaccaaggacgatggtaaaatgcttagacgaacgaaacgtggttggatgtggaaccagttctttctcctggaggaatacaccggcaccgatacgcagtacgtcggaaagctccataccgaccagtag

SEQ ID NO: 181074 - DNA, 399 bp, Artificial Sequence
  Description of Artificial Sequence: Synthetic coding sequence
atgcggacctaccactacatccccctgttcatctggacctacatgttccacacggtagacaccattctattgcaagagaaaccaaacagctatctcagttcaaaaaagatcgcgggtctgacaaaagacgacggaaaaatgcttagacggacaaagagaggttggatgtggaatcagttctttctcctggaagagtataccggcaccgatacccagtacgtgggcaaacttcacaccgatcaggacaagggggacggaaacctgaaatacatactcactggagacggggctggctctttattcgttattgatgagaataccggagacattcacgcggccaaaaaactggaccgagaagagaagtcactgtatattctgcgtgccaaagcgatcgactag

SEQ ID NO: 181075 - DNA, 9045 bp, Artificial Sequence
  Description of Artificial Sequence: Synthetic coding sequence
atggcccccccccccccccccgtgctgcccgtgctgctgctgctggcagccgccgcagccctgcccgctatgggacttagagcagcggcatgggaacccagagttcccggcggtactcgcgcttttgcactccgcccggggtgtacctacgcagttggagctgcttgcacaccacgcgctcccagggaactgctggatgtgggccgggacggtcgcttggccggacgaagacgcgtatcgggcgccggaaggcctctccccctccaggtccgtctagtagcacgcagcgcccccacagctctcagcagacggctgcgagctcggacccatctacccggatgcggtgctcgggcgaggttgtgcgggaccggggctaggctgtgtggggccctctgttttcccgtacccggaggatgcgctgccgcacagcattccgctctggcagcccctacgactctgcctgcatgtcgatgccctccaagaccccgacctcgatgtccagggaggccaatttgtctgcctccaggcggctcagtccgcctacgcctgctctgcgccttacgtcgagctgctggagccgtgagagttggccttgctcttgaggccgccaccgcaggaaccccatcagcatcaccttcgcctagcccgcctttgcccccaaacctgccagaagctcgggcgggccccgctcggagagcaaggcgaggaacatcaggccggggatcactcaagtttcctatgcccaattatcaggttgcactgttcgaaaacgagccagccggcacactcattctgcagctgcatgcgcactataccattgagggagaggaagagcgagtgtcttattacatggaggggcttttcgatgagcgcagccggggctatttccggatcgactcagccactggcgcagtgagcactgattcagtcttagacagggagaccaaggagactcacgtcttgagagtgaaggctgtcgactactctacccccccacgtagcgcgactacgtacattaccgtgttggtgaaagacacaaacgatcactcacctgttttcgaacaatccgaatatcgagaacgcgtccgggagaacctcgaagttggctacgaggtgttaactattcgcgcctctgacagggactccccaatcaacgccaatctgaggtatcgggtgctcggaggcgcttgggatgtctttcagttaaatgagtcatctggggtcgtgtccactcgcgctgtcctagatcgtgaggaggctgcagagtatcaactcctggtggaagccaacgaccaaggacgcaacccaggcccactgtctgccaccgccactgtctatatcgaagtggaggacgagaacgacaactacccacaattctctgaacaaaactatgttgtacaggtaccagaagacgtgggcttgaatactgccgttctgagagtacaagccactgatagggatcagggccagaatgcagcaatccactattccatcctaagcggcaacgtggccggccagttctatctacactccctttcaggaatcctggatgtgatcaatccgctcgatttcgaagatgtgcaaaaatattccctgagcattaaggcacaggatggcggacggccccccttaatcaatagttcaggggtggttagcgtgcaggtcctggatgtgaacgacaatgagccaatttttgtgagcagccccttccaggctacagtgctcgagaatgtgcccctgggctaccctgtggtgcacatccaggccgtagacgccgattctggagaaaatgcaagactccactatcgactagtcgacactgcttcgactttcctggggggcggtagcgccggcccaaagaatcccgccccaacccccgatttccccttccaaatccacaacagttccggatggatcaccgtctgtgctgaactggacagagaagaggtggaacattatagcttcggagtggaagctgtcgaccacgggtcaccacccatgtcttcctctaccagtgtcagtatcaccgtcctggatgtgaacgataacgacccagtattcacgcaacctacgtacgagctgcggctaaatgaggatgcagctgtaggatccagtgttttgacactccaagcacgcgaccgcgacgccaactccgttatcacctaccagttgaccgggggtaatacccggaacaggtttgctctgagctctcaaagggggggaggcctgatcactctcgccctaccattggattacaaacaggagcagcaatacgtacttgctgtgactgcgtccgacggcactcggtcccacactgcacatgtgctgattaacgtcaccgacgccaatactcataggcccgtgttccagtcatctcactatacagttagcgtaagtgaggacaggccagttggtactagcatcgcaaccctcagcgccaacgacgaagatacgggcgaaaatgctcgaatcacttacgtgatccaggatccagtccctcagttcagaattgaccctgactctggaacaatgtacacaatgatggagctcgactacgaaaatcaggttgcctatacgctgacaatcatggcccaggacaacgggatacctcagaagtccgataccacaaccctggaaatccttatactggacgccaatgacaatgcaccccaattcctgtgggatttctaccaggggtcaattttcgaggacgcacccccatccacgtccattcttcaggtatctgctacagacagggactcagggccaaacggtcggctgctgtatacgtttcagggaggcgacgatggcgatggagacttttacatcgaacctactagcggtgtgattcgtacccagaggagattggatagagagaacgtagccgtgtataacttatgggctctcgccgttgataggggatctcctacgcccctctcagccagtgtagagatccaggtcactattctggacattaacgataacgcgccaatgttcgaaaaggacgaactggagctgtttgttgaagaaaataatcctgtcggaagcgtggttgccaagattcgcgctaatgaccccgacgaagggccaaacgcccaaatcatgtatcagattgtggaaggcgacatgagacacttcttccagttggatctcctgaacggtgatctccgcgccatggttgaactggactttgaagtccggagagaatacgtcctggttgtacaggcaacatctgctcctctcgtctcccgggcaacagtgcacatattacttgtggatcagaatgataatccacccgtgttacctgattttcagatcctgttcaacaattacgtgacaaacaagtctaactcttttcctacaggagtcattggctgtatccccgctcacgaccccgacgtctcagactctctgaattacacgtttgtacaagggaacgagctgcggctcctcttgctcgaccctgctaccggtgaattgcagctgtccagggatcttgacaataacagaccccttgaggccctgatggaggtaagtgtgtctgacggtatccactccgtaacagcattttgcaccctccgggttaccatcatcacggacgatatgctgacaaattcgatcactgtgcggctcgaaaatatgtctcaggagaagttcctgtcacctctgctggcgctcttcgtagaaggtgtggcagctgttctcagcacgacaaaggacgatgtctttgtgttcaatgttcagaatgatactgacgtgagctccaatatactcaacgtgacttttagcgctcttctccctggtggcgtccgtgggcagttcttcccaagtgaggaccttcaggagcaaatctatctgaaccgaaccctgcttacgaccatttctactcagcgtgtgctgcctttcgacgacaatatctgtctccgtgagccttgcgaaaattatatgaaatgtgtgagcgtgctgcggttcgacagctcagccccttttctttcgtctacgacagtcctgttcaggcctatccaccccatcaacggcctgaggtgcaggtgtccccccggctttaccggggattactgcgagaccgaaatcgatctttgttactctgatccctgtggcgccaacgggagatgccgtagccgcgaggggggttatacttgtgagtgttttgaggattttaccggggagcactgcgaagtagacgcccgtagcggaaggtgcgcaaatggggtctgtaagaatggcggcacatgtgtgaacctccttatcgggggttttcactgcgtctgcccgcccggggagtacgaacgcccatattgcgaagtcaccacgcggagcttccccccacagagctttgtgaccttccgcggtctgaggcagaggttccacttcaccatcagcctcacctttgcaactcaagaaagaaatgggctcctgctgtataatggaaggttcaacgaaaaacacgatttcattgctctggagatagtcgacgagcaggttcagttgactttttccgctggcgaaaccaccaccactgtggcccccaaggtgccctccggcgtgagtgacggaagatggcactccgttcaggttcaatactacaataaaccgaatattgggcatttgggactgccccacggcccatctggggaaaagatggccgtggtgaccgtcgatgactgcgacactaccatggctgtgcgcttcggcaaggatatcggcaactatagttgcgctgcccagggcacacagacgggatctaagaagagcttagatctgacaggtcctttgttgcttggcggggtacccaaccttcctgaggattttcccgtacataaccgccagtttgtcggttgtatgcggaatctttcagtggatgggaaaaacgtggacatggccggcttcatcgcaaataatggcacaagagagggatgcgccgcacgtaggaatttttgtgacgggcgccgctgccagaacggtgggacatgcgtcaacagatggaatatgtacttatgcgagtgcccactgcgttttggcgggaagaactgcgaacaggccatgccccatccgcagttattctctggggagtcagtggtgtcgtggagtgatctgaacattataatatcagtgccttggtatttggggctcatgttccgaacacgaaaggaggactccgtcctgatggaggccacaagcgggggccccacgtcctttcgcctacagatcttgaataactacctgcagttcgaggttagtcacgggccctctgacgtcgaatcagtgatgctgtcaggtctacgcgtaaccgatggggaatggcaccacctgctgatagagctcaagaacgtcaaagaagactcagagatgaaacacctggtgaccatgacactagactatggtatggaccagaataaagccgatatcggcggcatgctacctggtctgaccgtcagatccgtggtcgtggggggggcatcagaggacaaagtgagcgtccggaggggttttcgaggttgtatgcagggggtgcgtatgggagggactccgacgaatgtagctaccctcaacatgaacaatgccttgaaagtgcgggtgaaggatggctgcgacgtagatgacccgtgcacgtctagtccatgtcctccaaattctcgctgtcacgatgcttgggaggactactcttgcgtttgcgacaaggggtacctggggatcaactgcgtcgatgcctgtcatctgaacccatgcgaaaacatgggcgcttgtgttaggtccccaggcagcccccagggttatgtctgcgaatgcggcccttcacactacggcccttactgtgaaaataagctcgacttaccctgcccaagaggctggtggggaaacccagtttgcggtccatgtcactgcgctgtcagcaaaggcttcgacccagattgtaacaagactaacggtcagtgtcagtgtaaagaaaactactacaagctgctcgcccaggatacctgcctcccatgcgattgttttccacatggaagccacagcaggacctgtgacatggcgacaggccaatgtgcatgcaagccaggtgtgatcgggagacagtgcaatcgctgtgataaccccttcgccgaagtgactactttgggctgtgaagtgatctataacgggtgcccaaaggcttttgaggccggcatttggtggcctcaaaccaaattcggccagccagcggccgtgccttgtcccaaggggagcgtaggaaacgctgtgagacattgctccggcgaaaaagggtggctgcccccagaactctttaactgcaccacaatttctttcgtggacctgagagccatgaatgagaagctgtcacgtaacgagacccaggtggacggcgcaagagcgctacagctggtgagggccctgagaagcgctacccagcacacagggacactgttcggaaatgacgtcagaactgcgtaccagctgttaggccacgtgctgcagcatgaatcctggcaacagggatttgatctggcggcgactcaggacgccgattttcatgaggacgttatacattctggctcagcgctcctggctcccgccacgcgagccgcttgggagcagatccagaggagtgaaggaggcactgcacaactgctgcgcaggctggaaggctatttctccaacgtggccagaaacgtcagacgaacgtacctaaggccgttcgtcatcgtgaccgccaacatgatactcgcagtggacatttttgataaattcaatttcacgggagcccgtgtccctaggttcgacaccatccacgaggagttccccagagaactggagtcaagcgttagcttccccgccgacttttttagaccacctgaagaaaaagaggggcccctgttgcggccagccggacgcagaaccacccctcaaacaaccaggcccgggcccggtactgagagagaagcacccatctctaggagaagacgacaccctgatgatgccgggcaatttgccgtggccctggtcattatctatagaactcttggccagttgcttccggagagatacgaccccgaccgaaggtcactgagattgcctcacaggcctatcattaacacacccatggttagtaccttggtctatagcgaaggtgctccacttccccgtccccttgagaggcccgtactagtcgagtttgctctgctcgaagtggaggaacgcacaaagcctgtgtgcgtgttttggaaccacagtctggcagtgggcggtactggcgggtggagtgcacggggctgtgaattgctttcccggaacagaacacatgtggcttgtcagtgctcacacactgcaagtttcgccgtactgatggacatttctaggcgtgagaacggggaggttctccccttgaagattgttacttatgctgccgtctccctcagcctggcagcactcctagtagccttcgtcttgttgtccctggttagaatgctgaggagcaatctccatagcatccacaagcatctggcagtggcactctttctgagccagctcgtattcgtaataggaatcaatcagaccgaaaacccgtttctgtgcaccgtggtcgcaatattactccattatatatatatgtcaacatttgcctggacacttgttgaaagtttgcacgtgtataggatgctgactgaagtgcgcaacattgatacagggccaatgcggttctactatgtcgtgggctgggggatccctgctatcgttaccggacttgccgtgggcttagatcctcagggctacggcaatccggacttttgctggcttagcctgcaggatactcttatctggtcatttgccggccccatcggcgctgtgataatcatcaacactgtgacgagcgtgctgagtgccaaggttagttgccagcgcaaacaccactactacggcaaaaagggaatcgtgagtctcctgcgaaccgccttcctgctgctcctcctgattagcgctacttggctgctcggtctcctggcagtgaaccgagacgccctaagttttcattatctgttcgccatcttcagtggattgcagggacccttcgtcttgctgttccactgcgtcttaaatcaggaggtgagaaaacacctcaagggagtgctcgggggacggaagttacatttggaagatagcgctaccaccagggctaccttgctcacacgctcactcaactgcaacactaccttcggagatgggccagacatgctccggacagatttaggcgagagcacagcatccctcgacagcatcgttcgtgacgagggcattcagaagctgggggtgtcgtctggactcgtacggggatctcatggcgaacctgatgcttctcttatgcctcgttcgtgcaaagaccctcctgggcacgatagtgatagcgattcagagctcagcttggatgaacaatcttcatcctatgcgagttctcatagcagcgacagtgaagatgacggggtgggcgctgaggaaaaatgggacccagctaggggagcagtccacagtacccccaagggcgatgccgtcgccaaccatgttccagcgggctggcctgaccagagtttggccgaaagcgactccgaagacccatctgggaagcccaggctgaaggtagaaaccaaggtatccgtggagttgcaccgtgaggagcaagggagccatcggggagaatacccaccagatcaggagtctggtggggccgcccgcctcgcatcctcccagccccccgagcagcgcaaagggatactgaagaataaggtgacatatccccccccccttaccctgacggagcagaccctcaaagggcgactgcgggagaaactagcagattgtgagcagtcccctacctcatctcgaacgtccagcttgggtagcggtggccctgattgtgcgatcactgtcaaaagccccgggagagaacccggtagggatcacttaaacggggtcgctatgaacgtaagaacaggatcagcccaggcagatggctccgactccgaaaaaccctag

SEQ ID NO: 181076 - DNA, 4194 bp, Artificial Sequence
  Description of Artificial Sequence: Synthetic coding sequence
atggcccccccccccccccccgtgctgcccgtgctgctgctgctggccgcagctgcggcactcccagcgatgggcctccgcgcggccgcatgggaacctcgggtgcccggcggcactagagcgtttgcactgagacctgggtgtacttatgccgtgggagctgcctgcacccccagggcgccaagagagttgttagacgtaggtcgagatggacggctggccgggcggagacgggtgtctggcgccggccggccgttacccctacaagtgaggctggtggcccgctccgcaccaactgcactgagccgacgactgcgcgcgaggacccacctccctggctgtggtgccagggcaaggttatgtggcactggcgcacgtttgtgcggcgccctgtgtttcccagttccgggagggtgcgcggcagctcagcattccgcactagctgcccccacgaccctaccggcttgtcggtgcccccctcggcctcgccccaggtgcccgggccgtccaatatgtctgcccccgggcggttctgtcagactgagactgctttgtgcccttagacgcgccgctggggctgtccgggttgggctggccctggaagctgccaccgcaggtacacccagcgcgagcccttccccaagtccgccactccccccaaatctccctgaggctcgcgctgggcctgcaaggcgagcccgaaggggcacgagcgggcggggatccctgaagtttccaatgcctaattatcaggtggccctatttgaaaacgagccagcaggaaccctcatcctgcagttgcatgcccactacacaatcgagggcgaggaggagagagtttcatattatatggaaggtctcttcgatgaacggagcagaggatattttcgcattgactctgccacaggtgctgtctcgacagactcagtcctggatcgcgaaaccaaggaaacccacgttttgcgtgtgaaggccgtggactacagtaccccccccaggagcgccaccacatatatcaccgttctggtcaaagacacaaacgaccacagccctgtttttgaacagagcgaataccgcgaaagagtccgggaaaatcttgaagtcggatatgaagtgcttaccatcagagcttcagatagagactctcctattaatgccaatctaagataccgagtgcttggcggagcatgggatgtgtttcagttgaatgagagcagcggcgtcgtgtcaacccgagccgtgctggaccgggaggaggcagctgaataccagttacttgtggaggccaatgaccagggacggaatccaggcccactgtccgcaacagcaactgtctacatagaggtcgaggacgagaatgataactaccctcaattctctgaacagaattacgttgtgcaggtgcctgaggatgtaggccttaacactgccgtgctaagggtgcaggcgacggatcgggaccaggggcagaacgccgccatacattacagtatcctttcagggaacgtggccggccagttctacctccactcactatcaggaattctcgatgtgataaaccccctcgacttcgaggatgtgcaaaagtactctctgtctatcaaagcacaggacggcggtcggccgcctctaattaacagctctggggttgtgagcgtgcaggtgctggacgtgaacgacaacgagcctatctttgtgtcctccccctttcaagcaacagtcctagagaacgtgcctctcggatatcccgttgtgcacatccaagcagtggatgctgacagtggcgagaacgcaaggttgcactataggctggttgacacagccagcaccttcctcgggggggggagtgccggccccaagaaccccgcccccacccctgactttccgttccagatccataacagcagtggctggatcacagtttgcgccgaattggacagagaggaggtggagcattattcttttggcgtggaggcagtcgatcatggatctccacctatgtcctcaagcacctctgtcagcattactgtcctggacgtgaatgataatgacccagtctttacacaaccaacctacgaactgcggctcaatgaagatgcagctgtgggctcatctgtgttgacactccaagcccgcgacagggatgctaactcagtgatcacatatcagctgacaggcggtaatactaggaaccgattcgccttatcatcacagcggggaggaggactgataacccttgccttaccactggactataagcaggaacaacagtacgtcctagctgtgaccgccagcgacggtacgagatcccatacagcccatgtactgatcaacgtgactgatgctaatacacaccggccagtgttccaatccagtcattacaccgtatccgtctccgaagacagacccgtcgggacctctattgctacgctgtccgctaacgacgaagatactggtgagaacgctaggatcacctatgtcatccaagatccagtgccacagttcaggatcgatcctgatagcgggacgatgtatactatgatggaactggattatgagaatcaggtcgcttacacactcactataatggcacaggataatggaatcccacaaaagtctgacacgacaactttggagattctcattcttgacgcaaatgataatgcgcctcaatttctgtgggatttttatcagggtagcatctttgaggacgctccaccgagcacatctattctgcaggtgagcgctacagatcgtgattcgggacccaatgggaggctgctgtacacttttcaggggggcgacgacggagatggggacttttacattgaacctactagcggcgtcatccgtacacagcgacggctggacagggagaacgtggcagtttacaacctatgggcactcgccgtagatcggggatctcctaccccgctctctgcctctgttgagatccaggttaccatactcgatatcaacgataacgcccctatgttcgagaaagatgagttggaactgtttgtagaagaaaacaacccagtgggatcggttgtcgctaagatccgcgctaacgaccctgatgaagggcccaatgcgcagattatgtaccagatcgtggagggggatatgcgccatttctttcaactggatcttctcaacggtgacctccgggccatggtggagctcgacttcgaggtgagaagagaatatgtactcgttgtgcaagcaacatccgctcccttggttagtagagccacagtgcatattctattggtggaccagaatgataatccccccgttctacccgatttccaaatcctcttcaataattacgttaccaataaaagcaactcctttccgacaggtgtgattggatgtatacccgcacacgaccctgatgtcagcgatagtttgaattacacttttgttcaggggaacgagctgagactcctccttctggaccctgcaacgggtgagctgcaactctcccgggatctggacaacaacagaccactggaagccctcatggaagtgtctgtgagcgacggtatccactctgtgacagcattctgtaccctgcgagtgactattattacagatgacatgcttacgaactcaattaccgtccgactggaaaatatgtcacaagagaaattcctgtccccgctgctggcactgttcgtggaaggcgtggccgcggtactgtcaacaactaaagacgatgtgttcgtgtttaatgtccaaaatgacacggacgtcagctcaaatatactcaatgtgaccttttctgcactactacctggaggcgtgcgaggacagttctttcctagtgaagatcttcaggaacagatttacctgaaccgcacacttctgaccacgatatctacccaacgggtgcttccttttgacgacaatatctgtctgcgcgagccttgtgaaaattatatgaaatgtgtatctgtcttgaggtttgacagcagcgcgccatttctgtctagtactactgtactgttcaggccgatacatcccatcaacgggctgagatgtcgctgtccccccggatttacgggtgactactgtgagacggaaatcgacctgtgttactcggatccgtgcggggcaaatggacgatgtcggagcagagaaggaggctatacctgtgaatgctttgaggacttcactgccgtctcctag

SEQ ID NO: 181077 - DNA, 2319 bp, Artificial Sequence
  Description of Artificial Sequence: Synthetic coding sequence
tgagacttccccttccagatccacaacagcagcggctggatcaccgtgtgtgctgagctcgatcgcgaggaagtggagcattactccttcggcgtcgaggcggtcgaccacggatccccaccaatgagcagtagtactagtgtcagcatcaccgtgctggacgtaaacgataatgatcctgtgtttacgcagcctacctacgagctcagactcaacgaagacgctgccgtaggatcatcggttctaactctacaggcccgtgaccgggatgcaaactccgtcatcacctaccagcttacaggcggaaatacacggaacagatttgcactgtcctcccagcgtggagggggcctaatcactctggcccttcctctagactataagcaagagcagcagtacgtgttggccgtcaccgccagtgatggtactcggtcccacacagcccacgtgctgatcaacgtgaccgacgcgaatacccacaggcccgtgttccagtcatcccactacactgtatccgtgtctgaagatagacctgttgggacctctattgctaccctgagcgcgaatgatgaagataccggcgagaatgcaaggataacatacgtcatccaggatcccgtacctcagtttagaatcgatcctgactctggcacaatgtacactatgatggagctggattacgaaaatcaggttgcctacactctgaccattatggcccaggacaacgggattccacagaagagcgatacaaccaccctcgagattctaatcctcgacgctaacgataacgcacctcaattcctctgggacttttatcaggggagtattttcgaggacgcgccaccctccacctctatattgcaggtatcggcaaccgaccgcgattctggccctaatggaaggcttctttataccttccagggcggcgacgatggagatggggacttttacatcgaaccaacctctggcgttatcagaacacagagacgcctcgatcgcgagaacgtagccgtttacaatctctgggccctcgccgtagatagaggttcccccacacccctttcagccagcgtggaaatccaggtgactattctcgatatcaacgataatgctccgatgtttgaaaaggacgagctggagttatttgtcgaggaaaacaatccggtgggcagtgtggttgcgaagatccgcgcaaatgatccggacgagggacccaatgctcaaataatgtaccagatagtggagggggacatgagacacttttttcagctcgatctcctgaatggtgaccttagggcaatggtggagctggacttcgaagtcagaagggagtacgtcctggtcgtgcaagcgacaagtgcccccctggtatctagagcaacggtccatattctcctggtcgatcagaatgataatcctcctgtgctgcctgacttccagattctgttcaacaactacgtgactaacaaatccaacagcttccctacaggcgtgattggatgtattccagctcacgaccccgatgtgtctgactcactgaactataccttcgtgcaaggtaatgagttgcgcctacttctgctcgacccggcaactggagagctgcagctgtcacgggacctcgacaataaccggcccttggaggctctcatggaggtgtccgtaagcgatggcatacacagcgtgactgccttctgtacccttcgagttacgatcataactgatgacatgttgactaacagtatcactgtcagattggaaaatatgagccaagaaaagttcctgtcccccctgctggctctgtttgttgaaggggtggcagccgtgctcagcaccaccaaggacgacgtgttcgtgttcaatgtccaaaacgatacagacgttagcagtaatattttgaacgtgacattctccgcgcttctgcccggaggggttcgaggccaattcttcccgtctgaggaccttcaagagcaaatatatctcaatagaaccctgttaaccacaatttctacacagcgcgtgctcccattcgatgacaatatctgtctgcgggaaccgtgtgaaaactacatgaaatgtgtctctgtgttgcgcttcgactcaagtgcccccttcttgtcatcaaccaccgtgttgtttagaccgatccatcctatcaatgggcttcgttgtcgttgtccgccggggttcaccggcgactattgtgagactgagattgatttgtgttactccgacccgtgcggtgctaatggacgttgtcgctcaagagaagggggttacacatgtgaatgcttcgaggatttcaccgaaatcagctag

SEQ ID NO: 181078 - DNA, 8772 bp, Artificial Sequence
  Description of Artificial Sequence: Synthetic coding sequence
atgcggagccccgccaccggcgtgcccctgcccaccccccccccccctctactccttctgctcctcctcctgctgcccccgcccttactcggagatcaagtaggaccttgtaggtctttaggttcccgcggccgcggctctagcggggcctgcgcaccaatgggatggctgtgcccttcctctgcctctaatctgtggctgtatacctctaggtgtcgtgacgccggcaccgaattgaccgggcacctggtaccgcatcacgacggcctgagagtctggtgccctgaaagtgaagctcatatcccactgccaccagctcccgagggatgcccatggtcctgcaggctgctagggatcggggggcacctttctccacagggcaagctgactctgcctgaagagcacccttgcctcaaagcccctcggctgagatgccaatcctgtaaattagcccaagcacccggcttgagagcaggggagagatcaccggaggagtcattaggcggtagacgcaaaagaaacgtgaacactgccccccagttccagccccccagttaccaagccaccgtacccgagaaccagcccgccggcacaccggtggcttctctcagggcaatagatcctgacgagggcgaggccggcaggctggaatacacgatggatgccttatttgatagtcgatcaaatcagttcttctctctggaccctgtgacaggcgcagtaaccacggcagaggaacttgatagggagacaaagtccacccatgtgtttagggttacagcccaggatcacggcatgccccgccggagcgcgctggctaccctgactattctagttaccgacacaaatgatcatgatccagtctttgagcagcaggagtataaggaaagtttaagagagaacctggaggttggatacgaagtgctgactgtgagggccacggatggagacgcccccccgaatgcgaacattttgtaccggttacttgagggatctggggggagcccaagtgaggtgtttgaaatagaccctcgatccggagtcatccggactagaggcccagtggatagggaggaagtcgaatcctaccagttgacagttgaagctagtgatcaaggcagagatccaggaccccgctccaccaccgcagctgtctttctgtccgtggaggacgataacgataatgctcctcaattttccgaaaaaagatatgttgtgcaagtgagagaagacgtgacaccgggtgctccagtcctgagagtaacagcaagtgatcgtgacaaaggatctaacgccgtggtccactattcaatcatgtctgggaatgctaggggtcagttctacctggacgctcagactggggcgcttgatgttgtgagtccccttgactacgaaactacaaaagagtacaccctgagggtcagagctcaggatgggggaagaccgccccttagcaacgtgtcaggtttggtgactgtccaagtgctcgacatcaacgacaatgcacctatctttgtgagcacccccttccaggccacagtattggaaagtgtcccactgggctatctcgtattacacgtgcaggcaatagacgctgatgctggggacaacgcccgcctggagtacagattggcaggcgtaggacacgattttcctttcaccatcaacaacggcacaggatggatctctgtggccgcagagcttgaccgggaggaggtggacttttattctttcggtgtagaagcccgggaccacggaacacctgcactgacagcgtctgcaagtgttagcgtgacagttctggacgtgaatgataacaatcccaccttcacccagccggagtacactgtgcgcctaaacgaagacgcagccgtgggcactagtgttgttacagtatcagctgtcgacagagacgcccactccgtgataacataccaaataacatcgggtaacacccgcaatagattttccattaccagccagtccggaggtggcctggtcagtctcgcactgccgctggactataaactggagaggcagtatgtactcgctgttacggcatcagacgggactcgacaggacacggcgcagattgtagtgaacgttacggacgccaacacgcatcgacccgtctttcagagctcacactacactgtgaacgttaacgaggacaggcctgcaggcacaacagtcgtgctgattagtgcaaccgacgaggacacaggagaaaacgccaggattacttattttatggaagattctattccacagtttaggatagacgccgacacgggcgccgtgactactcaggccgagcttgattatgaagaccaggtgtcatacacgctagccattaccgcgagggacaacggcatcccccagaaatcggataccacgtacctggaaatccttgtgaatgacgtgaacgacaacgctcctcaatttctgcgggacagttatcaaggcagcgtttacgaagacgtgcccccttttactagcgttctgcaaatcagcgccacagacagggatagcggcctcaacgggagagtgttttacacctttcaggggggtgatgacggggacggagatttcatagtcgaaagcactagcggaattgtgcgcaccctccgtcggcttgacagggagaacgttgctcagtatgtcctgagggcctacgctgtggataaaggcatgcctccagccagaacccctatggaagtcacggtgacagtccttgatgtcaacgacaacccacctgtcttcgaacaagacgagtttgacgtgttcgtagaggaaaactcaccaatcgggttggctgtagccagggtgacagcaacggaccctgacgagggaactaatgctcagatcatgtatcaaatagtagagggcaacatcccagaggtcttccaactcgacattttttcaggggaactgaccgccctcgttgacttagactatgaggataggcccgaatacgttctggttatacaggcaactagcgctccgcttgtgtctcgcgctaccgtgcacgtgcggctgctggatcgaaatgacaacccacccgtgctgggtaattttgaaatcctgttcaataactacgtgacgaatcggagttcctcctttcctgggggcgctatagggcgggttcctgctcacgatcctgacatctcagattccctcacttactcatttgaacggggcaacgagttgtccttagtcctcctcaatgccagtactggcgaacttaaactcagcagagccctggataataatcggcccctagaggccatcatgagcgttcttgtgtctgacggagtacattccgttaccgcccaatgcgcactgcgcgtgaccattattaccgacgaaatgcttacacatagtattaccttgcggctggaggatatgagcccagaacgatttctgtccccccttctcggactgttcatccaagcggttgcggctacgcttgctactccacccgatcacgtcgttgtttttaatgtacagcgcgatactgatgctcccgggggacacatcctgaatgtgtccctctccgttgggcagccccccggcccaggcgggggacctccgttcttgccatcggaagacctccaggagaggctgtacctgaaccgctccctcttgaccgccatcagtgcccagagggtgctgccctttgatgacaacatctgcctgcgtgagccttgtgaaaattacatgcgctgtgtaagtgtgttaagattcgactctagtgcgccctttatcgcaagctctagcgtactgttccggcccattcatccggtcggcggcctacgttgccggtgccctcccggtttcactggagactactgcgagaccgaggtggacctgtgctattcccggccttgtggtccccacggcagatgccgttctcgtgagggcgggtacacttgcttgtgtcgggatgggtataccggagaacattgcgaagtgtcggctcggagcggcagatgtacacctggggtgtgtaaaaatggaggaacttgtgtgaatcttctggtggggggcttcaaatgcgactgccccagcggtgattttgagaagccctattgccaggtgaccacacgctcctttcccgcccactcattcattaccttccgaggcttgcggcagcgttttcatttcactctagccctctcttttgccaccaaggagagagacggcctcctgttgtacaatggtcgctttaatgagaagcatgacttcgtggcactggaagtgattcaggagcaggtccagctgaccttctcagctggggagagtactactaccgtcagtccatttgtgcccggcggcgtgtctgacgggcagtggcacaccgtgcaactgaagtattataataagccacttcttggccaaacaggacttccgcagggaccctctgaacagaaggtggccgtggtgacggtggatggatgtgataccggagttgccctgaggtttggctcggttttaggtaactattcatgtgcagcccagggaactcaggggggcagcaaaaagagcctcgatttgactggcccactgctgctggggggagtgcccgacttaccggaaagcttcccggtaaggatgcggcaattcgttgggtgcatgcgaaacctccaggtagactcacgacatatcgatatggccgatttcatcgctaacaatggcacggtgccaggctgcccagctaagaagaatgtttgcgactccaatacttgtcataacgggggcacctgcgtcaaccagtgggatgctttcagctgcgaatgccctcttggtttcggcggaaagagttgtgcgcaggagatggccaatccgcagcattttttgggcagttccctggttgcttggcacggattatctctgcccatttctcagccttggtacctgtcacttatgttcaggactcgccaggccgatggagtgcttctgcaggcaatcactcgcggcagatccaccattacgctccagctgagggagggacacgtgatgctctcggtcgagggaacagggctccaagcctccagcctcaggctcgagccaggtagagctaacgacggagactggcatcatgcgcagttggccctgggggcatccggcggtccaggtcacgcgattctctctttcgactacgggcaacagcgcgctgagggcaacctggggccacggttacacggtcttcacctgagtaacatcactgtcggaggaattccaggacccgctggcggcgtcgccaggggattcagaggctgcctgcagggggtccgggtgtccgacactccagaaggtgtgaattcacttgaccccagccacggcgagtctattaatgtggagcagggctgtagcctgccagatccctgcgacagcaacccatgtcctgccaactcatactgtagcaatgattgggattcctacagctgcagttgtgatcctgggtactacggagataattgcaccaatgtgtgcgacctcaacccttgtgagcaccaatctgtctgtacaaggaaaccctccgccccacatggctacacatgtgaatgcccccccaactatctcgggccctactgcgaaacacggatcgatcagccttgccccagaggatggtggggccatccaacgtgcggtccctgtaactgcgacgttagcaagggctttgaccccgattgcaacaaaacgtccggggaatgccactgcaaagagaaccattatcggccccccgggtcaccaacatgcctgctgtgtgactgctaccccaccgggagtctatcacgcgtctgtgaccccgaggacggccagtgcccctgtaaaccaggtgttattggtagacagtgcgatagatgcgacaacccgttcgccgaggtgactacaaatggatgtgaggtcaactatgactcctgtccgcgggccattgaggcaggaatttggtggcctcggaccaggtttggcctgcctgctgcagctccttgccctaagggttcatttgggaccgctgtccggcactgcgacgagcaccgggggtggcttccgcctaacctgttcaactgcacctctatcaccttctcagaactcaagggatttgccgagcggctccaacgcaatgaaagcggcctagactcaggcaggtctcagcagctggctcttctgctcagaaacgctactcagcacacggctggttacttcggcagcgatgttaaggtggcttaccagctcgctacaaggctgctcgcccacgagtcaacccagcgtggttttggccttagcgctacccaagacgtgcattttaccgagaacctactgagggtagggtcggctctgctcgacaccgccaataaaagacattgggaactgatccagcaaacagagggcggcactgcgtggttgttgcaacattacgaggcttacgcctcagctctcgctcagaatatgcggcatacatacctctcccccttcacaatcgtcacaccgaacatcgtcatcagcgttgtccggctggacaagggcaattttgccggcgccaaactgcctcgatatgaggcactgagaggagaacagcccccagatcttgaaaccacagtaatccttccagagtcagtgtttagggagactccacctgtggtgcgccccgcgggccccggtgaggcccaggagccagaagagctcgctcggcgacagcgaagacaccccgaactcagccagggtgaggctgtggcttcggtaataatttaccggaccctggcgggactgctacctcataattatgacccggataagcggtcactgcgcgttccgaagcggcctatcataaatacccctgtggtgagtatcagcgtgcacgatgatgaagagttattgccacgggccttggacaaaccagtcacagtgcaatttagactcctggaaacagaggagcgcaccaagcccatttgcgtattttggaatcatagtatccttgtgtccggcacaggcggttggtccgcgcggggctgcgaagtggtgttcaggaatgagtctcacgttagctgtcagtgtaatcacatgacctcattcgctgtgctcatggacgtgtctcgccgtgagaacggggagattcttccacttaaaacactgacgtacgtcgctctgggcgtcacactggcggcattgcttctgactttcttcttcctcacactcttacggatactgaggagcaatcaacacggaataaggcgcaacctgaccgcagcactgggactagctcagctggtgtttctgttgggtatcaatcaggcagacctcccgttcgcgtgcacagttattgccatcctcctacactttctgtacctctgcacattctcctgggctctgctggaagcactgcacctctacagagcactgactgaggtcagggacgtaaacaccggacccatgagattctactatatgcttgggtggggcgtccctgccttcattaccgggttggctgtcgggctggatcctgaaggatatggaaatccagatttttgttggctctcaatttatgacacacttatatggtcctttgccggccccgtcgccttcgccgtcagtatgtctgtttttctgtatatcctggccgcgagagcaagctgtgccgcacagagacagggctttgagaagaaagggcctgtgtcaggcctccagccttccttcgctgtgctgcttctgctgagcgctacatggctactggctctcctttcagttaacagcgacacgctacttttccactacctctttgccacgtgtaattgcatccagggacccttcatcttcctctcctacgttgtcctcagtaaagaagtgagaaaagccctgaaactggcgtgctcacgtaagcctagccccgatcctgcactcaccaccaagagcacactgacatccagttataactgtcccagtccttacgctgatgggcgactgtaccagccttacggggatagtgcagggtctctgcactcaacatcccggtccggcaagagccagccatcttatatacccttcctactgcgcgaagagtccgctctgaacccaggccagggtccccctggactgggagatcctgggagtctctttctggagggccaggatcaacaacatgacccagacacagattcggactctgaccttagtttggaggacgatcagtccggctcttacgcatccacgcacagctccgactcggaagaagaggaagaggaagaggaggaggaggctgcctttcccggcgagcagggttgggactccttactaggtcccggggccgaaaggcttcctctgcattcgactccaaaggatggagggcctgggcccggcaaggccccctggcctggagacttcggcaccaccgcaaaggaatctagcggaaacggcgcccccgaggaacgcctgagggagaatggggacgccctgtctagagaagggtctttggggcctcttcccggctcaagtgctcagccacacaagggcattcttaaaaagaaatgtctgccaaccatcagtgagaagtcgagtctcctgagattgcctctggagcagtgcactggcagctctcggggcagtagcgccagcgaagggtctcggggcgggccacctccacggcccccacctcggcagtcgctgcaggagcagttaaacggcgtgatgcccatcgccatgtcaatcaaggccggaaccgtggatgaggactcatccgggagtgaatttttattcttcaatttcctgcactag

SEQ ID NO: 181079 - DNA, 9939 bp, Artificial Sequence
  Description of Artificial Sequence: Synthetic coding sequence
atgatggcccggcggcccccctggcggggcctgggcggccggagcacccccatactcttgctgctgctattgtctctgtttccgctctctcaggaggaacttggcgggggaggccaccagggatgggatccagggctggcagcaacaacgggcccccgcgctcacatcggcggtggcgcactggcattgtgtcccgaatcgtctggggtacgggaggacggaggcccaggactgggcgtgagggagcctatctttgtcggcctaagaggccggaggcagagcgccaggaatagtcggggtcccccagagcagccaaacgaagaattaggcattgaacacggagtacagccccttggtagccgggaaagagaaacgggccaagggccaggatcagtcctatattggcgcccggaggttagctcttgtggtcggacaggacctctacagaggggatcgctgtcccccggcgccctgtcgtccggggtgccaggcagtggtaactctagtcctctgcccagtgattttcttatacgccatcatggacccaaacccgtaagcagccagagaaatgctgggactggcagccgaaagagggtcggaacagcgcgctgttgcggagagctctgggccactggctcaaagggccagggcgagcgcgccactacgtccggcgctgagcggacggccccccgccgcaactgtttgcctggcgcaagcggaagcggacctgaactcgactctgctccgaggaccgcccgaacggcaccagcatcaggctcagcaccacgcgagagtagaaccgcgcctgagcctgcaccaaagagaatgcggtcacggggtctgtttaggtgtagatttcttcctcagaggcctggacctaggcctccaggcctgccagcacgaccagaagctcgcaaagtgaccagtgccaatcgagctcggtttcgccgagccgccaaccgtcacccacagttcccgcagtataattatcagactctggtcccggaaaatgaagctgctggaaccgccgtgctgagagtggtggctcaagatccagacgccggggaggccggcagattggtgtacagcttagccgccctcatgaattcacggagcctggagctgttctcgattgatccacagtccggcctcatccgaactgccgccgccctagaccgcgaaagtatggagaggcattacctccgagtaaccgcccaggaccacggctctccgcgactgtccgccacgacgatggtggcagtgactgtggcggatcgcaacgaccacagtcctgttttcgagcaggcccagtaccgggaaaccttgcgcgagaatgtagaggaaggatatcctattctgcagctgagggcaaccgatggggacgctccgccaaacgccaatctgagatataggtttgtgggcccccctgccgccagggcagccgccgccgcagcattcgaaatagaccctagaagcggtctgataagcacctccggacgtgtggatagggagcacatggaaagttacgagcttgtggtggaggcctcagaccaagggcaggagccaggcccaagaagcgctaccgttcgcgttcacatcaccgtactggacgagaacgacaacgctccccagttttccgagaaacgatacgtggcccaagtacgggaggatgtgagaccccatacagtagttctgcgggttacagcaacggaccgcgacaaggatgcaaacggactggtacattataatatcattagcggtaattcacgcggtcacttcgctattgactccctaacaggcgaaatccaggtagtcgctcccctcgacttcgaagccgagcgagagtatgccctcagaatccgggcacaagatgccgggaggccccctctctctaataatactggactggcctcaatccaggtggtggatatcaacgatcacatcccgatttttgtgtccacacctttccaggtgtctgtgttggagaatgccccacttggtcacagtgtcatccatatccaagccgttgatgcagaccacggagagaatgctcgccttgagtactcactaacaggcgtggcccccgatactccctttgtgatcaattccgctaccggttgggtgtccgtgagtggccctcttgacagggagtctgttgagcattacttttttggtgtggaggccagggaccacggcagccctccactgagcgcaagtgcttctgtgacagtgactgtattggacgtgaatgacaaccgcccagagttcaccatgaaggagtaccacctccgcctgaacgaggatgccgccgtgggcacctctgttgtaagtgtcactgctgtggatcgggatgctaactcagcgatttcctaccagatcactggaggcaatactaggaatcggtttgcaatctctactcagggcggagttggcctggtaaccctcgctttacccctggattataagcaagagaggtacttcaaactggtccttacagcctctgacagggcactacatgaccactgctatgtccacatcaatatcacggatgcgaacacccaccggcccgtctttcagtcagctcactattccgtgtctgttaacgaagatcgacccatgggatctacaatcgttgtgattagcgcctcagatgacgatgttggagaaaacgcccggattacctacttacttgaagacaacctcccacagtttcgcatcgacgccgattccggcgcaattactctgcaggccccactagactatgaggaccaggtcacttataccttggccattaccgctagggacaacggtatcccccagaaggccgacaccacgtacgtggaggtgatggtgaacgatgtgaacgacaacgctccgcaatttgttgctagccactatactggactggtgagtgaagacgccccaccatttacttctgttcttcagatatctgcaacagatagggacgcccatgccaacgggcgtgtacagtatacattccagaatggagaagacggggatggggacttcaccatcgaacccactagcggaatcgtgcgtacagttcgcagactggatcgcgaagcagtaagcgtgtacgagctcacagcttacgcagtggacaggggcgtgcctccacttagaacgccagtaagcattcaggttatggtccaggacgttaatgacaatgcccctgtttttcctgccgaggagttcgaggttcgcgttaaggagaactcaattgtggggagcgtagtggcacagatcaccgctgtcgatccagacgaggggccgaacgcccatattatgtaccaaattgtggaagggaacattcctgagctgttccaaatggatatctttagcggcgagttgaccgctctcatcgatctggactatgaggccagacaggagtacgtaattgtagtgcaggctactagcgccccgctcgtctctcgggcaaccgtgcacgttagattggtcgatcaaaacgacaacagccccgtgctgaataacttccagatcctattcaacaactacgtgtccaataggtcagatacatttccttccgggattataggtagaatccctgcctacgatccggacgtttccgatcacctcttttattctttcgagcggggaaacgaactccagctgcttgtggtcaatcagacatccggcgagctaagactgtctaggaagctggataacaacagacccttggtagcatcaatgttggtgacagtgaccgacggcctgcatagtgttactgcgcagtgcgtgctgcgcgttgtaattataactgaagagttacttgccaattccctgaccgtgcggctagaaaacatgtggcaagaacgctttctgtcaccactgctcggtagatttctcgaaggcgtagctgctgtcttggctacacccgcagaggatgtattcatttttaatatccagaatgatactgatgtgggggggacagtgctgaatgtgtccttttccgccctggcccctcgtggcgctggagctggtgcagccggcccctggtttagtagcgaggagctgcaagagcagctctacgtcagacgggcggctctcgccgccaggagcttgctggatgtcctaccattcgacgataacgtttgcctgcgggagccttgcgaaaattatatgaagtgtgttagtgtgctgcgctttgacagttccgcgcccttccttgcgagtgccagcactttgttcagacccattcagcccattgccgggttgcggtgccggtgccccccaggatttactggagacttttgcgagaccgaattagatctttgttattccaacccttgtagaaatggcggggcttgtgctaggcgcgagggcggatacacttgcgtttgtcggccacgtttcacaggcgaagactgtgagctagatacggaagccggccggtgtgtgcccggcgtctgcaggaacggaggcacatgcacggacgcccccaacggcggattccgatgccagtgtccggctggcggcgcctttgaaggcccccgatgcgaagttgcagcaaggagttttcccccctcctcattcgttatgttccggggactgagacaaagattccatctgacccttagcctcagtttcgcaacagtccaacagtctggtttactcttctataacggtagactgaatgaaaagcatgacttcctggcactggagctcgttgccgggcaggtaaggttaacctactcaactggagagtcgaatacggtcgtgagccccaccgtgcctggtgggctgtccgatggccagtggcatacagtgcacctccggtactataacaaacccaggaccgatgcactcgggggcgctcagggcccatccaaagacaaggtggccgtactgagcgtggacgactgcgacgtggcagtcgccctgcagttcggggcagaaatcggaaattattcttgtgctgccgccggcgttcagacgtcaagcaaaaaatccctggacctgactggaccattgttactgggtggcgttcccaacctgccagagaacttccccgtgtcccacaaggacttcattgggtgcatgcgcgacctgcatattgacggccggcgtgtggacatggcagcctttgtggccaacaatggcaccatggcagggtgccaagcaaagctgcacttctgtgatagcggtccttgtaagaacagcgggttctgttcagaacgctggggcagtttctcctgcgactgtccagtgggtttcggcgggaaggactgtcagctaactatggcccacccccatcattttcgtgggaatggtaccctgtcttggaattttgggagcgacatggcggtgtccgttccttggtacttgggactcgcgttccggacccgagcgacacaaggtgttctgatgcaggtgcaagccggcccccattcaacactcctttgtcaactggatagaggcttactgagtgtgaccgtaactagaggtagcggtagagcatcccacctcctccttgaccaggttaccgtatctgacggacggtggcacgacttgagattagagttgcaagaagaacctggtgggcggcgcggtcatcatgtgttgatggtcagcctcgactttagtctgttccaggacacaatggcagtgggaagtgagctccagggtctgaaagtgaagcaactgcacgttggcggcttgccacctggtagtgctgaggaggcaccacaggggctggtgggctgcattcaaggcgtgtggcttgggagcaccccatccggcagccccgctctactacctcctagtcacagagtaaatgctgaaccaggatgcgtggtcacaaatgcatgtgcctcaggcccctgcccacctcacgccgattgccgcgacctgtggcagacctttagctgcacctgtcagcccggctactacgggcccggctgcgttgacgcctgcttgcttaatccttgtcaaaaccaggggtcatgccgacaccttccaggggctccacacggatacacctgtgactgcgtgggcggctacttcgggcaccattgcgaacatcgaatggaccaacaatgtcccagggggtggtggggatcgcccacatgtggcccgtgtaattgtgacgttcataaagggtttgatccaaactgtaacaaaacaaacggacagtgtcattgcaaagaatttcattataggccacgcggcagcgatagctgccttccttgcgactgttaccccgttggctcaacctctcggagctgcgctccgcactccgggcagtgtccttgtcgaccaggggcacttggacgtcaatgtaattcttgcgactctcccttcgccgaggtaaccgccagcgggtgtagagtgctctatgacgcctgtcccaaatcactgcggagcggcgtctggtggcctcagacaaagtttggagtgttggcaacagtaccctgccccaggggagccctgggagctgccgtacgtctctgtgacgaagcacaaggatggttggaaccagacctatttaattgtactagtcctgctttccgggagctgagtctgttgttagatggtctggaactcaataagacagcattggatacaatggaggctaagaaactagcccagaggctgagggaagtgacaggacacacagatcactactttagccaggacgtgcgcgtgacggccaggttactggcacatcttctcgcattcgaatcgcaccagcagggatttgggctgacagccacacaggatgcacattttaacgaaaacttgctgtgggccggctcagctctgctggcacccgagaccggcgacctgtgggcagcgctgggccagcgggcgcccgggggcagcccaggatcagctgggctggtccgccatctggaggaatacgccgccaccctggcccggaatatggaactcacatatctgaatcctatgggactagtgacacctaacattatgctgtcaatcgaccggatggagcaccccagctccccgagaggggccaggaggtaccctcgataccattcaaacctttttcggggacaggatgcttgggatccgcatacccatgttctcttgccctcacagtcacctaggcctagcccctctgaggtcctgcccacttcttcctcgatagagaacagcacaacgtcctcagttgtacccccacccgcccctccggaaccagagcccggaattagcatcattattctgctcgtttatcgtacactgggcgggctcctgcctgcacaattccaggccgagcgtcgcggcgctagactgcctcagaatcccgtgatgaactcgcctgttgtgtcagttgccgtgttccacggaaggaacttcttacggggcatcctggaaagcccaataagcctagagtttcgcctcttgcagacagcaaaccggagcaaggcaatttgcgtacagtgggaccccccgggactcgcagagcaacacggagtgtggactgcgcgagactgtgaactagttcataggaatgggtcccacgcccgctgccggtgcagccgcacgggcacatttggcgtgctaatggatgcaagtcctagagagcgactcgaaggcgatttggagctcctggcagtctttacgcatgtggtggtggctgtcagtgtggcggctttggtcctcaccgcagcgatcctcctaagcctccggagtctgaaaagcaatgtaaggggaatccacgctaacgttgccgcagccctgggcgtcgctgaattgttatttctcttggggattcatcgcacgcacaaccagcttgtttgcactgcggtggctattctattgcactacttctttctctccacgttcgcctggctgttcgtacaggggcttcacctctatcgaatgcaggtggagcctcggaacgtggatcgcggagccatgcgcttctaccacgcactaggatggggggtaccagcggttctccttggcttggccgtagggctggaccccgagggatatgggaatcccgacttctgctggataagcgtgcacgagccactcatttggtcctttgccgggccagtggtgctggttatcgtgatgaacgggaccatgttcctgctcgcagcgagaacttcatgctcgactggtcaacgagaggccaaaaaaacctctgccctaacactgaggtcatcttttctgctgttactgcttgtgtcagctagctggttgtttggattactggctgttaatcattccattctcgccttccactatctccatgctgggttgtgcggtttgcagggcctggcagttctactacttttctgcgttttgaatgccgacgcccgagccgcctggatgccagcctgtctggggcgtaaagccgcccccgaggaagctcgccccgcacccggtctgggcccaggggcttataataatacagccttgtttgaggagtccggcctgatccggattactctgggagcaagcacggtatcctctgtgagctcggcaaggagcggccgtactcaggaccaagatagccagagggggcgcagctatctgcgcgataacgtgctggtgcgacatgggagcgccgctgaccatactgaccattctcttcaggcccatgccggcccaaccgacttggatgtagccatgtttcatagagacgctggcgccgatagcgacagcgattcagaccttagtctggaagaagaacgcagcctgtctattccctccagtgagtccgaggataatgggcgcaccagaggaagattccagcgcccactatgtcgggctgcccagtctgagcggctcctcacccatccaaaggacgtggatgggaacgatttgttgtcgtactggccagcgctaggcgaatgcgaagctgctccctgcgcccttcagacttgggggagcgagcggcgactaggtctggacacctctaaagacgccgctaataacaaccaacccgaccccgccttaacaagcggtgatgagacttctttgggtagggctcagcgccagcggaaaggcatcctgaaaaatcggctccaataccctcttgtgccgcaaacacgcggggctcctgaactgtcttggtgccgagcagctaccttaggacacagggcagtgcccgcagcctcttatggtcgaatttatgctggaggaggcacaggctcgctgtcacagcctgcttccaggtattcaagcagagagcaattggacttactgttgcgccgccagctgagtcgggaacgcctggaggaggcgccagctcccgtgctgagacctctcagccgtcctggcagccaggaatgcatggatgcagcgcccggacgcctggaacctaaagatcgcggctcaacgcttccacggaggcagcccccccgcgattatcccggggccatggcaggcagattcgggagcagagacgcactagatctcggggctcccagagaatggctgagtaccctgccccctccccggcgcacccgtgacctggaccctcagccaccaccgcttcctctgtcacctcaacgacagttgtcacgggaccccctcctaccatcaagaccgctcgactcgttgagcaggagcagtaacagcagggaacagctagatcaggtcccctccaggcacccttctagggaagctttaggccccctgcctcaactccttcgtgctagggaagatagtgtgtcaggcccttcacatgggccctccaccgagcaactcgatattcttagttcaatactcgccagcttcaacagcagtgctttatcaagcgttcagtcctctagcacgcctcttggaccacacaccaccgctacaccctccgcaaccgcctcagtgctcggcccctctactccgcggtccgccaccagccactctatatccgaactgtcaccagattccgaggtgccgcggtccgagggacactcttag

SEQ ID NO: 181080 - DNA, 9954 bp, Artificial Sequence
  Description of Artificial Sequence: Synthetic coding sequence
atgatggcccggcggcccccctggcggggcctgggcggccggagcacacctattctgctcttgctcttactatctttgtttcctctgtcccaggaggaacttgggggtggggggcaccaggggtgggatccgggattagctgcaaccactggtccaagggcccacattggcgggggcgcactagccctgtgtccagagagcagtggcgtaagagaggatggcggccccggtttaggtgtgagggagcccattttcgtgggacttcgtggtcgccgacagtcagcaaggaactccagagggcccccagagcagcctaacgaggagctcggaattgagcacggggtccagccgcttggctccagagaaagagaaacgggccaaggcccaggaagcgttttatactggcgcccagaggtgagttcatgcggcagaacagggccgttacagcgcggttcactgagccctggggcgttgagcagtggcgtacctggctccggaaacagcagtcctctccctagcgacttcttgattcggcaccacggacccaagccagtctcctcccagcggaacgcaggcaccgggtcaaggaaacgggtaggaaccgctaggtgttgtggagagctttgggccaccggtagcaagggacagggtgaaagagctacgacaagcggggctgagcgcacagcccctcggcgaaattgcctcccaggggcatctgggagcggtccggagctggattcggcacctagaacagcacgaacagccccagcttctggcagtgcaccccgggagagcagaacagccccagaacctgcccctaaaaggatgagatctcggggcctgtttcgctgccgctttctgccacagaggccgggtcctagacccccgggtttacctgcgagaccggaagcccgaaaggtcacaagcgcaaatagagcccgcttcaggcgggccgcgaacagacatcctcagtttccacagtacaattatcagaccctggtccccgagaatgaagccgcagggacagctgtcctacgggtagtggcccaggatccagatgcaggcgaggccggtagactagtatattctctcgctgcactgatgaactcccggtctcttgagctgttcagtatcgaccctcagagcggattgatcagaactgcggccgcattagatcgcgagtcaatggagagacattacttacgcgtgacagcgcaggatcatggtagtccacgtctctctgctactacaatggttgccgtaaccgtggctgatcggaacgaccactccccggtgtttgagcaggctcagtaccgggagacactcagggagaacgtggaggaaggctaccccatccttcaattgagagctactgacggagacgcccctcctaacgctaaccttcgctataggttcgttggtcctcccgccgcccgagccgcggcggccgctgcattcgaaatagacccccgctcgggcctgatttctacatctggccgcgttgatagagaacacatggaaagctatgagctggtggtggaggcttctgatcaagggcaggaacctggcccccggagcgccacggtgagagtgcatataaccgtgctagatgaaaatgacaacgccccgcagttttctgaaaaacggtatgttgcccaggtgcgagaagacgttagaccacatacagtagtgctgcgcgtgacggcaaccgacagagataaggacgccaatgggctagtccattacaacatcatatctggaaacagcagaggccatttcgccatcgattctcttaccggggagatccaggtggtcgcacctttggattttgaagccgaacgggagtatgctctcaggattcgcgctcaagacgcagggcgacccccactttcaaacaataccggactggcttccatccaggtggtggacatcaatgatcacatccccatctttgtatcaacgcctttccaggtaagcgtcttagaaaatgcgccccttggccactccgtaattcacatccaggccgtggatgccgaccatggagagaacgcacggctggaatattctctgaccggcgtggcccccgatacccctttcgtgatcaatagtgccaccggctgggtttctgtgagcggaccactcgatagagagtccgtcgagcactatttctttggggtcgaggctcgcgatcatggatctccacctttgtctgcttctgctagtgtgacagtgacagttctggacgtcaatgacaatagacccgaatttaccatgaaagagtatcatttgaggctgaacgaggacgccgctgtcgggacctctgtggtatcagttaccgccgttgatagagatgccaattcagccatttcctaccagataaccggggggaacaccagaaatagatttgctatttctacgcagggcggtgttggccttgtgaccttagctttaccgctggactataagcaggagcggtacttcaaacttgtcctaacagctagtgatagagccctgcacgaccattgttatgttcatatcaatatcacagatgctaatacgcatcgcccagtgttccagagtgcccactacagcgtcagcgtcaacgaggatcggcccatggggtccacgatcgtggtcatctccgcgagcgacgacgacgtgggcgaaaatgctcgcatcacatacctgctcgaagacaatctcccccagtttcgcattgacgccgactccggggccataacccttcaggctcctttggactatgaggatcaagttacgtataccctcgccattactgccagggataatggtattccacaaaaggcagataccacgtacgtcgaagttatggtcaatgacgtgaatgacaacgctccacagtttgtcgctagccactacactggccttgtaagcgaggatgctccacctttcacttccgttcttcagatctccgcgacagatagagacgctcacgccaatggtcgtgtgcagtacacttttcagaatggggaagacggcgatggggactttaccatcgagcctacatcaggcatcgtcagaacagttaggcggctcgatagggaagccgtgtcagtgtacgaattgaccgcttatgcagtggaccgtggagtccctcccttgcgaacgcccgtgagcatccaggttatggtacaggatgtgaatgacaatgcacctgtcttcccagccgaggaattcgaagtacgggtgaaggaaaatagtatagtaggctcagttgttgctcagattaccgccgttgaccctgatgaggggcctaatgctcatatcatgtatcaaatcgtggagggtaacatccctgaattgtttcagatggacattttctcgggtgaactgacagctttaattgacctggactacgaggcacgccaggaatatgtcattgtggtgcaggccacaagcgctccccttgtgtcgcgggccacggtccacgtgcggctggtggaccagaacgacaatagccctgtgctgaataacttccagattttgtttaataattatgtgagcaacaggagcgacacgtttccatctgggattattggcaggataccagcatacgacccggacgtaagtgaccacctgttttactcattcgagagggggaatgagctgcagctactggtagtgaaccagacctccggagaactccgactgtcacggaagctggacaacaaccggccccttgtcgcaagcatgctggtcaccgtgaccgacgggctgcacagtgtcactgcacaatgtgtgctgcgtgtggtcataataactgaggagctgctcgcaaactccctcactgtgcggctggagaacatgtggcaggagagattcctgtctccccttctgggtcggttcctcgagggggtcgcagctgtcctagctaccccagccgaagatgtcttcatatttaatatccagaatgacactgacgtcggcgggacggtgctcaacgtgagcttttcagctctagccccccggggcgccggagcaggggctgccggaccatggttctcctccgaggaattacaagagcaactgtacgtgcgccgtgccgctctggctgccagaagtctgctggatgtgttgccgttcgatgataatgtctgtctgcgtgagccatgcgaaaattacatgaagtgcgtcagtgttcttcgcttcgatagcagcgcaccattcttggccagcgcttccacactttttcggcctatacaacctattgccggtctgcgatgcagatgtccccctggctttaccggtgacttctgtgagactgaactggatctgtgctactcgaacccatgtagaaacggcggcgcttgtgctcggagagagggaggttatacatgcgtctgtcggcctaggtttaccggtgaggattgtgagttggacaccgaggcgggacggtgcgtaccgggggtctgccgcaacggcggaacttgcaccgacgcccccaatggcggattcagatgtcaatgtccagctggcggggcattcgaaggtccacgatgtgaggtagccgcaaggagcttccctcctagctcctttgtgatgttccgtgggctgcggcaaaggtttcatctgactctgtcactgagctttgccaccgtacagcagtccggcctgcttttttacaacgggcggctcaacgagaagcacgatttccttgctctcgagctggttgctgggcaagtgcggttgacttactctacaggcgaaagcaatacagtcgtcagtcccaccgtgcccgggggcctcagcgatgggcaatggcatacggtgcacctgcgctactataacaaaccacgtaccgacgctctcgggggcgctcagggcccctccaaagacaaagtggcagtgctcagcgtggacgattgcgacgtagcggtggccctgcagttcggcgcggaaattggaaactactcctgcgcagctgcaggggttcaaactagttccaagaagagcttggacttaacaggtccactcctgctgggaggtgtccctaatctgccggaaaattttcctgttagccataaagatttcattgggtgcatgagggatcttcacatcgatggacggagagtggacatggcggcatttgttgctaacaacggtaccatggcgggttgccaggcgaaattgcacttctgcgattccggaccttgtaaaaattccggcttctgttctgaacgctggggttccttctcatgcgattgccccgtaggtttcgggggaaaggattgtcagcttacaatggctcaccctcatcactttcgggggaatggcacacttagttggaatttcggaagtgacatggctgtatcggtaccatggtacttgggactagcgtttagaaccagagcgactcagggggtcctgatgcaggtacaggctgggccacatagtactctgttgtgccagctggacaggggcctgctgagtgttaccgtaacaagaggatccgggcgagcctcacatcttttactggatcaggtaaccgtttctgatggcagatggcacgatttgcgtcttgagctgcaggaagaacctgggggccgacgtggacaccatgtattgatggtgtcgctggatttttctctgttccaggacaccatggcagtcggctcagaacttcagggactcaaggtgaaacagttgcacgtcggagggttacctcctgggagtgcggaggaagcgccccagggcttggttggttgcatccaaggcgtttggctcggctcgaccccttctggcagccccgcacttctcccgccaagtcacagggttaacgccgagcctgggtgcgtggttaccaatgcttgcgcaagtggtccatgtcccccacatgccgactgccgcgacctttggcaaaccttcagttgtacatgtcagcctggttattatggccctggatgtgtggatgcctgcctcctgaacccatgccagaatcaaggcagttgccggcatctgccaggcgcgccccacggatacacttgcgactgtgttggcggatactttggacaccattgtgagcaccggatggaccagcagtgcccccgagggtggtgggggtctccaacctgcggcccatgtaattgcgatgtccataagggcttcgacccgaactgtaacaagaccaacggccaatgccactgtaaggagtttcactaccgtcctcgggggtccgactcctgtctaccctgtgactgttatcccgtcggttccacctctagaagctgtgctcctcactctggacaatgtccttgtagacctggcgctctgggaaggcagtgcaattcttgcgactcgccatttgcagaagtgacggcctctgggtgtcgggtactatatgacgcttgtcctaagagcttgcgtagcggtgtgtggtggccccagacaaaattcggggttcttgctaccgttccgtgccccaggggtgccctaggcctcaggggggccggtgcagccgttagactgtgcgacgaggcacaagggtggctcgaacccgacctctttaactgcacaagccctgccttcagagaactttcactactgctcgacgggctcgagcttaacaagacagccctggatacaatggaagccaagaaattggcacaacggctgagggaagtgaccggccatacggatcattacttctcgcaggatgtgagagttaccgcccgtttgctagcacatctgctggctttcgaaagccaccagcaaggctttgggctgaccgcgacacaggatgctcattttaatgagaatctgttatgggccggaagtgccctactagcacccgaaaccggcgacctgtgggccgcgctcggccagcgagcccccggcgggtcacctggtagcgccgggcttgtacggcatctagaagagtatgcggcgactttggcacggaatatggaattaacctacctgaatcccatgggactggtgaccccaaacatcatgctttcaattgaccgcatggagcaccctagtagcccccgcggcgctcgaagatacccaagatatcactccaatttgttcagaggacaggacgcttgggacccccatactcacgtcctgttgccgagccagagcccacgtccttcccccagcgaggtgctccccacaagtagttcgatcgaaaattctacaacaagttccgtggtgccccctcctgctcctccagaaccagaaccaggaatcagcattattatcctcttagtgtaccggacactgggaggtctcttaccggcacaatttcaggctgagagacgaggtgcaagactgcctcagaaccctgtgatgaactccccggtggtatcagttgcggtgttccacggccgcaatttcttacgcggcattctcgagtccccgatttccctggagttcagactcctacagacagccaacaggagcaaggctatctgcgtacagtgggatcccccgggactggccgagcagcacggagtctggaccgcccgcgactgcgaattggtgcaccgtaatggaagccacgctaggtgccgatgcagccgaactgggactttcggtgtcttaatggacgcctcaccacgggagcgacttgagggcgatctagagttgctcgcggtgttcactcacgtggtagtggcagtatccgttgccgccctggtgttgaccgccgcaatcctgctgagcctcagatcactgaagtcaaatgtaaggggtatccatgcgaacgtggctgcagctcttggtgtagctgagctgctgttcctcctgggcattcataggacacataaccaactcgtgtgcaccgctgtcgctatcctcctccattatttttttttgtccacttttgcatggctgtttgtccagggactgcacctataccgtatgcaagtggagcccagaaatgtggatagaggtgcaatgcgcttctaccatgccctgggatggggggtgccagcggtgctcctcgggcttgctgtaggcctggatcccgaaggatacggcaaccccgatttctgctggattagcgttcacgaacccctgatttggagcttcgccggacctgtggtccttgtcatcgtcatgaacggaacaatgtttctcctggcagccaggacttcatgctccacaggtcagcgtgaggcgaagaagactagcgctctgaccttgcgctcgtcctttctgctgctcctgctcgtctccgcaagctggctgttcgggctattagcggtgaatcacagcattctcgcctttcactatctgcacgcaggtctatgtggactgcaggggctcgctgtactgttgcttttttgcgtcctcaatgccgatgctcgtgcagcttggatgcccgcctgcctaggcagaaaagccgctccagaagaggctcgtccagcccctggcctgggccccggagcctataacaatacagctctcttcgaagagtccggtctcattcgtatcacactgggtgcatcgaccgtcagcagcgtgtcatccgcgcgcagcggacgaacccaggaccaggactcacaaagagggcgatcctacctcagggataatgtattagtgcggcacggcagtgccgccgaccacacggatcatagcctacaggcccatgccgggccaacagatctcgacgtggctatgtttcatcgggatgctggcgctgactcagatagtgactcggatctgtcactggaagaggaacgatccttatccattcccagctcagaaagtgaggataacgggagaaccaggggaaggtttcagcgcccactatgcagggcagcccagagcgaacggcttctcactcaccctaaggacgtggatggaaatgatttacttagttattggcctgccctgggggaatgcgaggctgctccgtgcgctcttcagacttggggcagcgagcgacgtctcggtctggatacatccaaggatgccgccaacaataaccaaccggaccccgccctgacaagtggtgatgaaacctctttggggcgggcccaaagacagcggaagggaattttaaagaacaggctccaatatccactcgtgcctcagacccgaggcgccccggagctgagttggtgccgtgcggccacccttggacatcgcgctgtgccagctgcctcatacggccgaatctacgccggggggggcaccggaagtttaagccagcccgccagtagatactcctcacgggagcagctggaccttctgctgcggagacagctctctagagaacgccttgaggaagcgcccgctcccgtacttaggcccctgtcccgccctggcagccaggaatgtatggatgccgccccggggcggctggagccgaaggacagaggttcaactctccctagacggcagccaccccgagactatcctggcgccatggccgggcggttcgggtcaagagacgctctggatctaggagccccacgggaatggctgtccacccttccgccccccagaaggacccgggaccttgatcctcagccaccccccctccctctgtctccacaaagacagctgagccgcgatcctttgctgccgtcacgacccttggatagcctgtccagaagttcaaactcgcgggaacaattggaccaagtgccaagtcgtcaccccagccgggaggcactcggccctctgccacagctcctgagggctagagaagatagcgtatcggggcctagccatggtccttctaccgagcagctcgatattctgagtagcatccttgcctccttcaactctagcgcactctctagtgtgcagtctagctccacgcccctggggccccacacaactgctacgccttccgctacagcatcggtactcggcccttccaccccaagatccgctaccagccactctattagcgaattaagccctgattctgaagtgccacgaagcgaggggcactcatag

SEQ ID NO: 181081 - DNA, 1557 bp, Artificial Sequence
  Description of Artificial Sequence: Synthetic coding sequence
atggccttctgggccggcggcagccccagcgtggtggactacttccctagcgaggacttttacagatgtggctattgtaaaaacgagtcaggaagtaggagtaacggcatgtgggcacactccatgaccgttcaagactaccaggacctgattgatcgcggatggcgccgctctggcaaatacgtttacaagccagtcatgaatcagacctgctgtcctcagtacaccattcggtgtagaccactgcaattccagccaagcaagagccacaaaaaagtgctgaaaaaaatgctcaagttcttggccaagggggaagttcctaaaggaagttgcgaggacgaacccatggactccactatggatgacgctgtggcaggggatttcgccctgattaacaagttagacattcagtgcgatttgaagactctgagcgatgacataaaggaaagtttggagtcggagggcaaaaactctaaaaaggaagagccacaggaactactgcagtcccaggacttcgtaggcgagaaactgggcagcggggaaccgtcccactctgtgaaggtacacactgtcccaaagcccggtaaaggggccgacttgagtaaacccccttgccgcaaagccaaggaaatccgcaaagaacggaaacggcttaagctcatgcagcagaaccccgctggcgagctcgaggggtttcaggcccagggtcaccccccctcactttttccacccaaagcaaaatcgaaccagccgaagagtttggaagacctaatattcgaaagtctgccagagaacgcctcccataagctggaggttagggtggtgaggtcgagtcctccaagttctcaattcaaggcgacacttttagaaagctaccaagtttacaagcggtaccagatggtgatccataaaaacccccccgacaccccaacagaatcacagttcacacgattcttgtgttcttccccactggaggcagagactcctccaaatgggccagactgcggatacggctcctttcatcaacagtactggctcgatgggaaaattatcgctgtgggggtaatcgacatcttgccaaactgcgtgagctcagtatacttatattacgaccccgactacagttttctgtctctcggtgtgtactctgctctgagggagatagcttttacccggcaacttcacgagaagacttctcaactcagttactattatatgggattttacatccactcctgccctaagatgaaatacaaggggcagtataggcctagcgatctgctgtgcccggagacgtacgtgtgggtacccattgagcaatgtcttccctcactggaaaactctaaatactgcagattcaatcaagacccagaagctgtagacgaggaccgttcaaccgagccagatcgactccaggtattccataagcgggccattatgccttatggtgtctacaaaaagcagcaaaaggatccaagcgaggaggccgccgtgctgcagtacgcgagtctggtcgggcagaagtgcagcgaaagaatgcttctatttagaaactag

SEQ ID NO: 181082 - DNA, 3195 bp, Artificial Sequence
  Description of Artificial Sequence: Synthetic coding sequence
atgggccggcacgtggccaccagctgccacgtggcctggctgctggtgttgatatcagggtgttgggggcaggtcaataggttaccattcttcactaatcattttttcgatacctatcttctgattagtgaggacacacccgtaggttcgagtgtgacacaactgctggcccaggacatggataatgatccattggtgtttggagttagcggcgaggaggccagcagatttttcgcggtcgagccagacaccggagtcgtgtggcttcggcagcctctggatcgggagacaaaatcagaatttaccgtggaattcagtgtcagcgaccaccagggcgttatcaccagaaaggtgaacatccaggtgggtgacgtgaacgataacgcgcctacttttcacaaccagccgtactctgttagaatcccagaagtgggagccacaggaaacaccccggtcggtacaccaatctttatcgtgaatgctaccgatcccgatctaggagctggcggttcggtgctctacagctttcagccgcccagccaatttttcgcaattgatagcgcgagagggattgtaactgttatccgagaactggactatgagacaacccaggcctaccagcttaccgtcaatgccaccgatcaggataagacccgtcctctgagtaccctggcaaatctggccattatcatcaccgatgtgcaggatatggatccgatcttcattaacctgccatacagcacgaacatctacgaacactctcccccaggcactactgttcgaataatcacagccattgaccaggataagggcaggcctcgcggaatcgggtacacaatcgtatcggggaatacaaatagcattttcgctctggattatatctccggtgtgttaacgctgaatgggctactggatcgcgagaatcctctgtacagtcatggctttattctgacagtgaagggcaccgaattgaatgatgaccgcactccgtccgatgcgacagtgacaacaacctttaacattctggtgatagacattaacgataacgcccccgaatttaattctagtgagtattccgtggctatcactgaactggctcaggtcgggtttgcgctgcccctttttattcaggtagtagataaggacgaagggctaaattctatgtttgaggtctatctggtcggaaataatagtcaccactttatcatttcccctacgagtgtgcagggcaaggccgacattcgcatcagggtagccatccctcttgattacgaaaccgtggataggtacgacttcgacctcttcgccaatgagagcgtgccagaccacgtcggttacgccaaagtgaaaataaccttgatcaatgagaatgataacaggcctatcttctcacagcccttgtataacatttctctctacgagaatgtgaccgtgggtacctcggtcctgacggtgctggctacagacaacgacgctgggacattcggagaagtgtcttactttttcagcgacgacccggatagattctctttggataaggataccggactgatcatgctgattgctagactggactatgagctaattcagcgttttactctcacaattatcgctagagatggcggtggtgaggagacaaccggcagagtgagaattaacgtgcttgatgtgaacgataacgtgcctacatttcagaaggacgcttatgtgggagctctgagggagaacgagccctcagtcacccagctagtgagactgagagcgaccgatgaggattcgcctcccaacaatcagatcacatattcaatcgtgagcgccagtgcttttggatcgtactttgacatcagcctgtacgagggctatggagtgattagtgtttctcgccctctggattacgagcagattagcaacggactaatctacttgactgtgatggccatggacgccggaaacccaccactcaatagcaccgtgccggttacaatcgaggtctttgatgaaaacgacaatcctccaactttttccaagcccgcatatttcgtgtcggttgtcgaaaatatcatggcaggggcgaccgtgctatttttaaacgctacagacctggatcgctctcgggaatacggccaggaatctataatttatagccttgaaggatcaactcaatttaggattaacgcaaggagtggtgagattaccactacatccctgctggatagggaaactaagtccgagtatatactgattgtgagagcagttgacggtggggtaggccataatcaaaaaacaggaatcgccacggtaaacatcacgctgctagatatcaatgataaccatccaacttggaaggacgcgccttattacattaacctggtagaaatgactccaccagacagcgacgtaaccacagtggtcgcggttgatccagatcttggtgagaatgggacgctggtctattccatacagccccccaataagttctactcgctgaacagcacaaccgggaagatcaggactactcacgcaatgctcgaccgtgaaaaccccgatccacacgaggctgagctgatgcggaagatcgtggtgagcgttactgactgcggccgtcccccactgaaggccacaagttccgctaccgtttttgtaaatcttttggatctaaatgataacgatcctacatttcaaaacctgccctttgtcgcggaagtcctcgagggtattcccgccggtgtaagcatttaccaggtggttgctatcgacctggatgaaggtctcaacggactcgtctcttatagaatgccagtgggcatgcccaggatggatttcctaatcaactcatccagtggcgttgtcgtaactacaactgaactggatagagagagaatcgcggagtatcagttgagggtggtggcgagcgacgccggcacacctaccaagagctccacatctaccttgaccatacacgtgcttgatgtgaacgacgaaacaccgacattttttccggcagtctacaacgtgtccgtgtccgaagatgtgccccgggagtttagagtggtgtggctgaattgtaccgataacgacgtgggtctcaatgcggagctgagctacttcatcaccggcgccgcccccgcgtcagcccacctgtgtcgcccaccgggggcattgccccctcctctaccggacgggcagcccgattag

SEQ ID NO: 181083 - DNA, 3345 bp, Artificial Sequence
  Description of Artificial Sequence: Synthetic coding sequence
atggtgaagagccccatgaaccgggagctggtggccacctacgaggttaccctatccgtgattgacaatgctagcgatctgcctgaaaggagcgtgtccgtgccgaacgccaagttaacagttaacgtgctggatgtgaacgataataccccccaatttaaaccctttggcataacttattatatggaacgcattcttgagggtgcgacccccgggacaactctcatagctgtcgcagctgtcgaccctgacaagggactcaacgggctcgtgacttatacattacttgacctggtcccaccaggttatgttcaactggaggatagcagcgccggaaaagtaatcgctaaccggaccgtagactacgaagaggtacactggttaaattttactgtaagagcctctgacaatggcagccccccgcgggcagccgaaatacctgtgtaccttgagattgtggatattaacgataataaccccatattcgatcaacctagttatcaggaggccgtgttcgaagacgtgcccgtgggaaccatcattctcactgtgaccgccaccgacgcagattcaggtaacttcgccctcattgaatacagcttaggagacggagagtccaaatttgctattaatcccactactggcgatatttatgttctttcttcacttgacagggagaaaaaggaccactatatactaactgccctcgccaaggacaacccaggagacgttgcgagcaataggagggaaaatagcgtgcaggtggtgatacaagtgttggatgtgaacgattgccgtccacagttttcaaagccacagttttctacttctgtttatgaaaacgagcccgcgggaacatctgtaatcacgatgatggcaactgaccaggacgagggcccaaatggggaacttacctactccttagaagggcctggtgtggaggctttccatgtagacatggatagcggcctggtaacgactcagaggccactgcagagttacgaaaaattcagcctcaccgtagtagcaaccgatggtggtgaacctcctctgtggggtactactatgctactggtggaagttatagacgttaatgacaaccgtcctgtgttcgtaaggcccccaaacggcacaattctacacattcgcgaggagattcccctgcggtctaatgtctacgaagtctacgcgaccgataaagacgaaggcctgaatggagccgtgcggtatagctttctcaagactgccgggaaccgggactgggagtttttcatcatcgaccctattagcggtctgatccaaactgcccaacgactggacagggaatctcaagcagtctactccctcatcctcgtcgcaagcgacctcggacagcccgtgccttatgagaccatgcaacccctgcaagttgccctagaagacatagatgataatgagccactcttcgtgagacctcccaagggtagcccccagtaccagctgctcaccgtgccagagcactcccctcgcgggaccctcgtgggcaacgtcactggggccgtagatgcagacgaagggcccaacgccattgtgtactattttatcgccgccgggaacgaggaaaagaactttcatcttcagcccgacggctgtttgctcgtgttgcgggatcttgatcgtgagcgggaggcaatcttttcatttatagttaaggctagctctaacaggtcatggacgccacctagggggcccagccctacactggacttggtggccgatctaacactgcaggaggtccgggttgtactggaggacatcaatgatcagcctccgcgatttacgaaggcggagtatacggccggcgtggccaccgacgctaaggtgggttctgagttgatccaagttctggccctcgacgccgacataggcaacaatagccttgtgttctattctattcttgcaatccactacttccgtgcactggcgaatgacagtgaagacgtagggcaggtattcaccatggggagcatggatggtatcctgcggacctttgacctcttcatggcatactcacccggctatttcgtggtggacattgtcgccagggaccttgcaggccacaacgataccgctattattgggatatacattctcagagacgatcagcgggtgaaaatagtgattaatgagatacctgacagagtcagagggttcgaagaagagtttattcacttactttccaacattactggagctatcgttaatacagacaacgttcagttccacgtggacaagaagggcagagttaattttgcccagacagaactacttattcacgtcgtcaaccgggacaccaatagaatcttagacgtcgaccgagtgatccaaatgattgacgagaataaggaacagttaaggaacttatttcgaaattacaacgttctagacgtgcagcccgctatatcagttagacttcctgacgatatgagcgctctccagatggccattatcgtgctggctatactgcttttcctggccgctatgctcttcgtactcatgaactggtattatcggacagtccacaagcggaagctcaaggccattgtggctgggagtgcaggtaatcgcggatttatagatattatggatatgcccaacactaacaagtattcgttcgatggggccaaccctgtgtggcttgaccccttctgccgcaatctggagctagcagcgcaggcagaacacgaagatgacctgccagaaaatctgtcggagatagcagacctgtggaacagccctactagaacgcacggcactttcggcagagaacctgccgccgtgaagccagatgacgaccgctacctgagggccgccatacaggagtatgacaatattgcgaagctgggccagatcatacgagaaggaccaatcaaggggtcgctcctgaaggtggtgctggaagactaccttcgcctgaagaagctcttcgcacagaggatggtgcaaaaggcaagtagttgtcattcgagcataagtgagttgatacagaccgagttagacgaggagccaggggatcactcccctggtcagggcagtctccgtttccgccataaacctcctgttgagcttaaaggcccggatgggatccacgtggtgcatggaagtacaggaactttgctggccactgaccttaatagcctccctgaggaagatcaaaaagggctgggtagatcactcgaaacacttacagcagcggaggcaacagcctttgaaagaaacgctcggaccgagtctgccaagagtacgcctctccataagctgagagatgtcattatggaaacaccactcgagatcactgaactgtag

SEQ ID NO: 181084 - DNA, 1368 bp, Artificial Sequence
  Description of Artificial Sequence: Synthetic coding sequence
atgcgggccagcctgggcgtgtgcggcaccgccagcagcatggtgattgtgtatgtggaggacattaacgatgaagcacctgttttcacgcagcagcagtacagccgcttgggcctgagagagacagccggaattgggacatccgtaatcgtagtgcaggccactgatcgggattcaggagacggtgggctggtcaattacagaattctgagtggggccgaagggaaatttgaaatagatgaatccacaggcctcatcatcaccgtaaattatctagattacgagaccaagacgtcctatatgatgaacgtttcagccacggatcaggcccccccattcaaccagggattttgcagcgtatacattactcttcttaacgagcttgacgaggcagtgcagtttagtaacgccagctatgaggccgccatacttgagaatctggccttgggcacagaaatcgttcgggtgcaagcttactctattgacaatctcaatcagatcacataccgcttcaacgcatacacaagcacgcaggctaaagccctgttcaagatagacgccataactggggtaatcaccgttcaggggctagttgatcgcgagaaaggggatttttataccctgaccgtggtggccgacgatggcggtccaaaggtggatagcaccgttgtctacattactgttttggatgaaaatgataatagccctagatttgacttcacttccgactccgcagtgtcaatccctgaggactgtcccgtgggccaacgagtcgctacagtgaaggcttgggatcctgacgcgggcagtaacggccaggtggtgttctcactggcatccgggaatatcgccggggcctttgagatcgtcaccacaaatgatagcattggagaagtgttcgttgcgagaccgttggacagggaggagcttgaccactatattttgcaggttgttgcctctgacagaggaacccctccccgaaagaaagaccatattctgcaggtgactatcctcgacattaatgacaatccaccggtcattgaaagtccttttggctacaacgtgagcgttaacgaaaacgtcgggggaggcacagccgtggtgcaggttagagcgactgaccgcgacattggaatcaactctgtgctgtcctactatatcacggaaggtaacaaagacatggcctttagaatggaccggatttctggagagattgctacccggcctgcaccacctgatcgcgagaggcaatcattttaccacttagtggctacagttgaagacgaagggacacccaccctaagcgtgagcgatggtgggggccatcgcgaggagcgcgtgggtcaagggtcatccgcctctgaatag

SEQ ID NO: 181085 - DNA, 1593 bp, Artificial Sequence
  Description of Artificial Sequence: Synthetic coding sequence
atgggccggcacgtggccaccagctgccacgtggcctggctgctggtgttgatttcaggttgttggggccaggttaaccgtcttccctttttcacgaatcatttctttgacacatacctgctgatcagcgaggacacacccgtgggctctagcgtgacccagttgttagcacaggatatggacaacgacccactggtgtttggcgtttctggggaggaggcctcaagattctttgcagtggaaccagatacaggcgttgtttggctcagacagcctctggatcgagagactaagtccgagttcaccgtagagtttagtgtgagcgaccaccagggcgtgatcactagaaaggtcaatatccaggttggcgatgttaacgacaatgcccccacctttcacaatcagccttattccgtaagaatcccagagaatacacctgtcgggactccaatctttattgtcaacgccactgatccagacctgggggcaggcggctccgttctgtatagttttcagcccccatcccaatttttcgcgatcgatagcgcgagaggcatagtcactgtcatccgagagctcgattacgagactacccaggcttatcaactgacagtcaacgcaacagaccaagataagactcggccactctctactctcgctaatctcgccatcatcattaccgacgtacaggacatggaccctatctttattaacctgccctacagcactaacatctacgagcatagcccccctggtacgaccgtgcgcattatcacagcgatcgaccaggacaagggcagacctaggggtatcgggtatacaatcgtaagcgggaatactaatagtatatttgctttggactatatctcgggggtgctgaccctcaatggtcttcttgatcgcgagaatccactgtactctcacggtttcatcttgacagtgaagggcaccgagcttaacgatgatcgaactccctcagatgccaccgtgaccactactttcaatattttggtcatagacatcaacgataacgctcccgaatttaacagtagcgaatattctgtcgccattacggaactggcgcaggtcgggttcgcccttcccctgtttatccaggtagtggataaggacgagaatctggggttaaattctatgttcgaggtctatcttgtaggcaataactctcaccatttcattatcagcccaacaagtgtacaggggaaagcagacattagaattagagttgcaattcctctcgattatgaaaccgtggatcgatatgacttcgatctttttgccaacgaaagtgtgcccgatcacgtgggctacgccaaagttaagataacccttatcaatgaaaatgacaaccgacctattttcagccagcccctgtataatataagcctctacgaaaacgtaacagtcgggacgtcagtgttgactgtgcttgtttcacccaggttcacagctggccctctgagcagccccgggccaacagtggttcgccatccggaaggattttgccctagagacttatccaatcaagggcgtagacacccccagattcccgagttatgtctacttgtctactag

SEQ ID NO: 181086 - DNA, 3639 bp, Artificial Sequence
  Description of Artificial Sequence: Synthetic coding sequence
atgggccggcacgtggccaccagctgccacgtggcctggctgctggttttaattagtggctgctggggacaggtcaacaggttacccttcttcaccaaccactttttcgacacgtatctactgatcagcgaggacaccccggtgggctcatccgttacacagctgctcgcccaagatatggataacgatccactcgtgttcggcgtgtcgggcgaggaagcaagccgcttttttgccgttgagcctgacactggggtggtgtggctgagacagcccctggacagagaaactaaaagcgaattcaccgtggagttctctgtcagtgatcatcagggcgtcattacccgaaaagtcaatatccaggtgggcgatgtaaatgataatgcgccgaccttccataatcagccatactccgtgcgtattccagagaatacgcctgtcggcacgcccattttcatagtgaacgctaccgacccggacctgggggcgggagggtccgttctctatagctttcagccgccctctcagttttttgcaatagatagcgcacgtggcatagttaccgtcatacgcgagcttgactacgagacaacccaggcctaccaactgactgtgaacgctaccgatcaggataagactcgcccgctctcgacactggcaaacctagctatcatcatcaccgatgtgcaggatatggatcccatattcataaacctgccatacagcacaaatatctatgagcactctccacccgggaccaccgttagaattataaccgccattgatcaggacaagggtcggccaaggggaataggctatacaatagttagtgggaatacaaactcaatcttcgccttagactatatttcaggggtcctaacattgaacgggttattggaccgcgagaatcccctgtattcccacggctttatcctcacggtcaaggggactgagctgaacgacgatcgaacacccagcgacgccaccgtcaccacaactttcaacattctggtgatagatataaatgacaatgcacccgagtttaactccagcgagtactctgtggcgattactgaacttgcccaggtgggtttcgcactaccactattcattcaggtagtggataaggatgagacacaaggcctgaactcaatgtttgaggtgtacctggtcggcaataactcacatcactttataatctcccccacatccgtgcaaggcaaagctgatattaggatccgggtcgccataccacttgattacgagaccgtcgatagatacgactttgatctctttgctaacgaaagtgtccccgaccatgttggttacgcaaaggttaagattacgctgataaatgagaacgataacaggccaatattttcccagcctctgtacaatatctccctgtacgagaacgttactgtgggtacttccgtactgactgtgcttgccacagacaacgacgcaggaacttttggcgaggtctcctatttcttctccgacgaccccgaccggttttcccttgataaggacacgggactgattatgcttatcgcccgcctggattacgaacttatccagaggttcacactcactatcatagcaagggatggcgggggtgaggaaacaactggacgcgtccgaatcaatgtgctcgacgttaatgataacgttcccaccttccagaaggatgcatatgtgggggccttgcgtgaaaatgagccctctgtgacgcagctggtgcgcctgagagccactgacgaggacagcccgccgaataaccagatcacttacagcatcgtctctgccagcgcttttggctcctattttgacatctctctatacgagggttatggggtaatctcagtgtctagaccactggactacgagcagatctccaacggactcatctacctgaccgtgatggccatggatgccgggaatcctcccctgaattctacggtgcccgttacgattgaagtgttcgatgagaacgacaatcctcctactttttctaagcccgcctatttcgtgagcgtcgtcgaaaatatcatggccggggctaccgtgctttttctgaatgccactgacctggacaggtccagagagtatgggcaagaaagcattatctactctctggagggctcaacgcagttccggatcaacgccaggtccggtgagatcactaccacaagcctgcttgaccgggagaccaaatctgagtacattctgatagtacgggcagtagacggaggagttggacacaatcagaagaccgggattgccacagtaaatattaccctattagatattaacgataatcatcctacttggaaagacgccccatactatattaacctcgtggaaatgacgccgccggattccgacgtcactacggtggtggcagtggatcccgacctgggtgaaaacggcaccctcgtatacagcattcagccacccaacaaattctattctcttaactcaaccactggtaagatcaggactacacacgcaatgctggatcgggagaaccctgaccctcatgaggccgaactcatgcgtaagatcgtggtgagcgtaaccgattgcggtcgtcctcctctgaaagccaccagttcagccacagttttcgtgaacttgttagacctgaatgacaatgaccccaccttccagaatctgccatttgtggccgaggttcttgaaggaatccctgcaggggtgtctatctaccaagttgtcgccatcgacttggacgagggactgaatggattagtgagctatagaatgccagtgggcatgccgcgtatggattttttaatcaactcttccagcggcgtcgtcgtgaccactactgagcttgaccgagagagaatcgctgaatatcagctccgggttgtggcgtccgatgctggcactccgaccaaaagctctaccagtactctgacaatccacgttctggatgtgaacgacgaaactcctacattcttcccggctgtgtacaatgtcagcgtgtcagaagacgttccacgggaattccgggtcgtatggttgaactgtacagataatgacgtgggcctgaatgctgagctgtcttattttattactggtgggaatgtagacgggaagttcagcgtaggttatcgcgacgccgtggtgcgtacagtcgtaggcttggacagagagaccactgccgcttacatgctgatcctggaagccatcgataacggacccgtcgggaaaaggcacaccggaacagcaactgtgtttgtgacagtattggacgtgaacgataaccggcctattttcctccagtcttcctacgaggcctctgtccccgaagacatccccgaaggacacagcatcctgcaggaggaagaccttgctagcccctgcattagcccggcaccccctagacgcgcctttcagtctagcggggaaaaggagacaagccagtttcccgggaaagagctccggagggagccgggaccgtccaaggcgcagaatagagctgcctttaccgaaccactcgctgaggctcctttattggggagtaaacaggctcaggaggaaagagctccactcccaagagagcaggcacagcagctccagggaagcgaaggggagaaggggggcccatag

SEQ ID NO: 181087 - DNA, 1593 bp, Artificial Sequence
  Description of Artificial Sequence: Synthetic coding sequence
atgggccggcacgtggccaccagctgccacgtggcctggctgctggtgctgatatcagggtgctggggtcaggtcaacaggttgcccttcttcaccaatcactttttcgatacctacctgctgattagcgaggacactcctgtcggatcctcagtgacccagctcctggcccaggatatggacaacgacccactcgtctttggcgtgagcggcgaggaagccagcagattttttgcggtggaacctgataccggagtggtgtggctgcgtcagcctttggatcgcgagaccaagagcgaatttactgtcgagttctcagtgtcggatcatcaaggtgtcattacaaggaaagtaaacatacaggtgggcgacgtgaacgataatgcccctacttttcataaccagccttactctgtacggattcccgaaaacacacccgtcggaacacctatcttcattgtcaatgccacagatccggacctgggtgctgggggcagtgtgctttattcatttcagccgcccagccaattcttcgctatcgactccgcgcgaggaatcgtgaccgttatcagggaattagattatgagacgacgcaagcgtaccagctgaccgtaaacgcaactgaccaagataaaacccgccctctcagtacattggctaatttggccatcatcataactgatgtccaggatatggatcccatatttatcaaccttccgtactctactaacatatacgaacattcgccacctgggaccactgtgaggatcatcaccgcgatagaccaagacaaaggaagaccacgtggtattggttataccatagtgagcggaaataccaattctatcttcgctctagattacatttcaggggttttgacgcttaacggcctcctggatcgggagaatcccctctactctcacggtttcatcctgactgttaaagggacggagctcaacgacgaccgaacaccctccgacgccaccgtgactactacttttaacattctcgtgatcgatattaacgacaacgcccctgaattcaattcctctgagtattccgtggctataacagagctagcccaagtgggctttgccctacccctcttcatccaggtggttgacaaggatgagacttggggcctgaacagtatgttcgaagtgtatcttgtcgggaataatagccatcatttcataatttccccaacctccgtgcagggcaaggccgatatccgaatcagagttgcgatcccactggactacgagacagtcgatcgctatgattttgacctctttgccaacgaatcagttcctgatcacgttggctacgccaaagtcaagatcactctgattaacgagaacgacaacagacctatctttagccagcccctctataatatcagcctgtacgagaatgtgaccgtggggacaagtgtcctgaccgttctggtgtcaccgcggttcacagccggtcctctcagcagcccaggtcccactgtggtgagacacccagaggggttctgtcctcgggatctgtctaaccaaggaagaagacacccccagataccagaactctgcttactcgtgtattag

SEQ ID NO: 181088 - DNA, 9960 bp, Artificial Sequence
  Description of Artificial Sequence: Synthetic coding sequence
atgggccggcacgtggccaccagctgccacgtggcctggctgctggttctgatctctggctgctggggtcaggtcaaccggctgccattcttcacaaatcactttttcgatacatacctcttgatcagtgaggatacacccgtcggctccagcgtgacccagttgctggcacaggatatggataatgacccactggtgttcggagtgtctggtgaggaagctagcagattcttcgctgtcgagcccgacaccggagtagtttggctgaggcagcctctcgatagagaaaccaagagtgagttcaccgtagagttttccgtgtccgatcatcagggagtgatcactagaaaggttaatatccaggtgggcgatgtgaatgacaacgcgcctactttccacaaccagccatatagcgttcgcattcctgagaatacacccgtcggtacccccatattcatcgttaatgctaccgatccggaccttggcgccggaggtagtgtgttatatagcttccagcccccaagccaatttttcgccatagattcggctcgtggaattgtgacagtgatccgagaactcgattatgagaccacgcaggcctaccagttgactgtaaacgcaacggatcaggacaagactcggccactaagtaccctcgctaatcttgccatcatcattaccgacgtgcaggatatggaccctatcttcatcaacctgccatattcgacgaatatctatgagcacagcccccctgggacaactgtgcgcattattaccgccattgatcaggacaaagggcgaccgcgaggaatcggttatacaatcgtgtccggtaataccaatagcatcttcgctctggattacatatctggggtgctcactcttaatggtctgctagacagggaaaatcccttgtactcccacgggttcatcctaactgtgaagggaacagaattgaatgacgatcgaaccccatcagacgctaccgttactacaacctttaacatcctagtaatcgatatcaatgataatgcacctgagtttaactcctctgaatactccgttgccatcacagagctcgctcaggtcgggtttgccttaccactgttcatacaggtggtggataaagacgagacccaggggctaaacagcatgtttgaagtctacctcgtcggcaacaacagccaccatttcattatatcacccacatcagttcaaggtaaagctgatatccgtatcagggttgccattccccttgattatgagaccgtcgatcgctacgactttgacctctttgccaacgaaagcgttcctgatcatgtcggctatgctaaggtcaagatcacactcattaacgaaaatgacaaccggcctatcttctcccaaccactgtacaacatctccttgtacgagaacgtgaccgtggggacatcagttctgactgtccttgccaccgacaatgacgccggtacctttggggaagtgagctactttttttcagacgatcccgacaggttcagtctcgataaagatacgggactaattatgctcatcgcaaggttagattatgaattgatacagagattcaccttaacaataattgccagggacgggggaggcgaggaaacaaccggacgtgtgagaataaatgtgctggatgtcaacgataacgtgccaacctttcagaaagatgcctatgtcggtgctttgagagagaacgagcctagcgtgacacagctggtgagattgcgcgcaaccgacgaagattcccccccgaacaatcagatcacatattccatcgtgtccgcctccgcattcggatcatatttcgatatcagcctctacgagggctacggagtgatctctgtttctagacctctcgattatgagcagattagtaatggactgatctacttgacagtgatggctatggacgccggtaacccacccctgaatagcactgtccccgtgacgattgaagtctttgacgagaacgataaccctccaacttttagtaagcccgcttatttcgtttcagtggtcgagaatatcatggcaggggctacggtactgttcctcaatgctacggacctggatcgttcaagagaatacgggcaagagtctataatatacagcttagaggggtctacccagtttagaattaacgcaagatcaggtgaaataacaactactagtctgctggatagggaaacaaagtccgaatacatacttattgtgagggctgtggacggcggcgtgggtcacaaccagaagacaggaatagcaaccgtaaatatcacattgttggacatcaatgataaccatcctacctggaaggatgctccctactacattaacctggtggagatgaccccacctgacagcgatgtgaccacagtggttgccgtggatccagacctgggggagaacggtacactggtgtatagcatacaaccgccaaataagttctactccctgaacagcacgacaggtaaaatccgtactactcacgcgatgctggatagggaaaaccccgatccccacgaggcggaactaatgcgcaagatcgttgtgagcgtcacagattgcgggagaccacccctcaaagctaccagctctgctaccgtgtttgtaaaccttctggacctgaacgacaacgaccccaccttccagaatttgccattcgtggctgaggtactggaaggtatcccagccggcgttagcatctaccaggttgttgcaatagatctggacgaagggctcaatggcctggtctcatatcgaatgccggtgggtatgccacgcatggattttctcattaacagctccagcggagtggtggtgacaactacggaacttgatagagaacgtatcgctgaataccaactccgggtggtggcctccgatgcgggcaccccgactaaaagcagcacaagtactctcactatccacgttcttgatgttaacgacgaaacgccaactttctttcccgcggtgtacaatgtgtccgtgtccgaggacgttccgcgggagtttcgagtggtttggctgaactgcaccgataatgacgtaggccttaacgccgagctatcatattttattactggaggtaacgtggacggaaaattttcagtcggatatcgtgacgccgtcgttcgtacagtggttggccttgaccgtgagacaaccgcagcctatatgctgatacttgaggctattgacaacggcccagtgggaaagcgccatacaggtaccgccactgtctttgtaaccgtcctagatgtcaacgacaacagaccaatcttcctccagagctcctatgaggcatctgtgccagaggatatccctgagggccattcgatattacagctgaaagctacggacgccgacgagggagagtttgggagggtgtggtatcgaatcctacatggcaatcacggcaataacttccggatccatgtgtcaaatggcctgctgatgcggggccctcgcccactcgaccgggaacgaaattctagccatgtactcattgtcgaagcttacaaccatgacctgggacctatgcgtagtagcgttcgggtcattgtgtacgtagaggatatcaacgatgaggcccctgtgttcactcagcagcaatactcacggctggggctgagggaaacagctgggatcggaacctcagtgatcgtggtgcaagccactgaccgggacagcggcgacggtggactggtgaattatagaatattgtctggtgctgaagggaagtttgaaatcgacgagagcactggcctgattataaccgtgaactacctggattacgagaccaagacatcctacatgatgaatgtctcagctacagaccaagccccacctttcaaccaggggttctgtagcgtctacatcacacttttaaatgagctcgacgaagccgtccagttctccaatgcaagttatgaggcagcaattctggaaaatctggcgctcggtacagaaatcgttcgagtccaggcatactccattgataaccttaaccagattacctaccggtttaacgcctacaccagcacccaggccaaagccctattcaagattgacgccatcacgggagtgatcactgtgcagggtctcgttgatcgggagaagggagacttctacaccctgacagtggtggctgacgacggcggtccaaaggtagattctaccgtgcaagtgtatataactgtcctcgacgagaatgacaattcaccacgcttcgactttacatctgatagcgcagtttccatacccgaagactgccccgtcggacaacgggtcgctaccgtcaaggcttgggacccggacgccggctccaacggccaggttgtatttagtctggcctctggtaacatcgcaggggctttcgagattgttacaaccaatgactccatcggcgaagttttcgtggccagacctctggatcgtgaagaactggaccattacatcctgcaggtcgtagcctccgacagaggcactcctccccggaaaaaagatcacatcctccaagtcaccatcctagacattaacgacaatccgcccgtaatcgagtcaccattcggctacaatgtgtcagtgaacgagaatgtaggtgggggcacagctgtggtgcaggtccgcgccactgacagggatattgggattaacagcgtcctctcttactatattactgaggggaataaagatatggccttccgaatggaccgtattagtggggaaatcgcaactcgcccagctcctcctgacagggaacgacagagtttctaccacctggtggccaccgtggaggacgagggaactcccactctcagcgcgaccactcatgtatatgtgactatcgtcgatgagaatgataatgcgcctatgttccagcagccccattacgaagtgctgctggatgaaggtcccgacaccttaaatacatccctgataacaatccaggctcttgatctggacgagggcccgaatggcacggtcacatacgctatcgtggccggcaatatcgtcaacacatttagaattgaccgacacatgggggtgattaccgccgcgaaggagctcgattacgaaatttcacacggcaggtatacgcttatcgtaaccgcaactgatcagtgccccatcctcagccaccgtctgacctccaccactaccgttcttgtgaatgtcaatgacattaacgataatgtgcccacatttccgcgagattatgagggacccttcgaggtcactgaaggacagcccggaccacgcgtctggacattcttagcccatgaccgcgattccggaccaaatgggcaagttgagtacagcataatggatggagaccctctgggcgagtttgtcatcagccccgtggagggcgtgctgagagtcaggaaggacgtcgagcttgatcgggagacaattgcattctataatttgacaatctgtgcaagagatagaggcatgccccctctctcttcaaccatgctcgtaggtatcagggtcttggatatcaacgacaacgatcccgtgcttttgaacctcccaatgaacatcacaatcagcgaaaattccccagtctcttcctttgtggcccacgtactggcatcggatgccgattccggttgtaatgctcgcctaacattcaacatcactgctggtaatcgagagcgcgccttcttcatcaatgctacaacaggaattgtcactgtgaaccgcccgctcgatcgtgagagaattcctgagtataaactaacgatttccgtcaaagataatcccgagaatccccgcattgctcgtagggactacgatctactcctgatcttcctaagtgatgagaacgataaccatccgctgttcaccaaaagcacttaccaggccgaagttatggaaaacagtcctgctggcacaccacttactgttctgaacggaccgatcctggcactggacgccgaccaggacatctacgctgtcgtgacatatcagctcctcggggcacagtccggactcttcgatataaacagcagcacaggtgtcgtgaccgtgcggtccggggttataattgaccgcgaggcattttcacccccaatactggagttgctgctgttggcggaggacattgggctgctgaatagtactgcccatctgctgatcacaattttggacgacaacgacaaccgcccaaccttctctccagccaccttgaccgtccatcttctcgagaattgtcctcctggcttttctgtccttcaggtgaccgcaaccgacgaggatagcggtctgaatggagaattggtgtacaggatcgaagccggggcgcaggatcgctttctcatccatcttgttacaggggtgattagggtgggaaatgccacaattgatagagaggaacaggaaagttacaggctgacagtggtcgccactgacaggggcacggtcccgttgagtggtaccgccatcgtaaccatccttatcgacgacatcaacgatagtcggccggagtttctgaatcccatccaaacagtcagtgtgcttgagtcagccgaaccgggaactgtcattgccaatatcactgccattgatcatgacctgaacccaaagctggaatatcacatcgtaggaatagtggctaaagacgatacagacagacttgttccaaaccaggaagatgcctttgcagttaatatcaatactggaagcgtgatggtgaaaagccccatgaacagggaactggtagccacttatgaagtgacactatctgtcatcgataatgcctccgacctgcctgagaggtcagtctccgtgccgaatgccaaattgacagttaacgttttagacgtgaacgataatacgccacaatttaagccgttcggaatcacgtactatatggaacggattttagagggtgctacaccaggaactactctcatcgcggtggccgccgttgatccggataagggtctcaacgggttggtcacatatactctgctggatctagtaccccctgggtacgttcagctcgaggatagttcggctggaaaagtcattgcaaatcggacagtcgattacgaggaggttcactggctcaatttcaccgtcagggcatcagacaatgggtccccccctcgggcagctgaaatacccgtgtatcttgaaatagttgatattaatgataacaaccctatctttgaccaaccttcttatcaagaagccgtgttcgaagatgtccccgtggggacaatcatcctgactgtaactgcgacagacgctgactctggcaacttcgccctgatcgagtactctctcggtgatggagaatccaaatttgctattaaccctactacaggggatatctatgtgttgagtagcctcgacagggagaagaaggatcactacatcctcaccgctctggccaaagacaacccgggcgacgtcgcaagtaaccggcgggagaactccgtccaggtagtaatccaggtgctggacgtcaacgattgtaggccccaattctcaaaaccacagtttagcaccagtgtgtacgagaacgaacctgctgggacctcagtgatcaccatgatggctacggatcaggatgaaggccctaacggagaactcacatactctctggagggacccggcgtggaggccttccatgtggacatggattccggactggtgacaactcagcgcccgcttcagagctatgaaaagttcagtctcaccgtggtggcaactgacggtggggagcctccattgtgggggactacaatgctactggtcgaagttatcgatgtaaacgacaataggcccgtgttcgttagacccccaaatggcacaatactgcatattagagaggaaatccccctgcgcagcaatgtgtacgaggtttacgcgaccgacaaagacgaaggcctcaatggagctgtgaggtacagctttctgaagactgcaggtaaccgcgactgggagttttttattatagaccccatcagcggacttattcagaccgcacagcgcctggacagggaatcccaggcagtctactctttgattctggtcgcctccgacttgggccagcccgtgccctatgagacaatgcagcctttgcaggtagcacttgaggatatcgatgataatgaaccactatttgtacgcccacccaagggtagtccgcaatatcagttgttaacggtcccagagcactcccctaggggcactctcgtgggcaacgtgacaggtgcagtggatgcggacgaaggtcccaacgccatcgtatactactttatcgcagcaggaaatgaagagaaaaacttccacctccagcccgatggatgtctcctcgtgctcagggacctggacagagagagggaggccattttcagtttcatcgtgaaggcttcgagcaacagaagctggacaccacccagaggaccttcgccaactctcgatttggtcgctgatctgacattacaagaagtgcgggtggtactagaggatattaacgaccaaccaccaagatttacaaaggccgagtatactgcaggcgtggcaacggatgcgaaagtcggatccgagctgatccaagtacttgccttggatgctgacatcggaaataattcacttgttttttactcaatcctggcaatccactattttagggcacttgctaatgattccgaagacgttggccaggtatttactatggggtccatggatggcattttacgtactttcgacctttttatggcctacagccccggatactttgttgtcgacatcgtggctagggaccttgctggccacaatgacaccgcaatcatcgggatctacatactgcgggatgatcagcgggttaaaatagtgatcaatgagatccccgatagagtgcgtgggtttgaggaggagttcatccacctcctctctaacatcactggggctatagtgaatacagacaatgtgcagttccatgtggataaaaaaggaagagttaattttgctcagacagagctgctgatccatgttgtgaacagggatactaatagaatactcgacgtcgatagggtcatccagatgattgacgaaaacaaagaacaattaaggaatctgttccgcaactacaacgtcctggacgtgcaaccagccatcagtgtcaggctgcccgatgacatgagtgccctgcaaatggctattatcgtgctggctatactcctgttcctggctgctatgctgttcgtgctgatgaactggtactaccggaccgttcataagagaaagctgaaggccatagtggcaggctcagccggaaacagagggttcattgacattatggacatgcctaacactaacaaatactcgtttgacggagccaaccccgtttggctagacccattttgtcgtaaccttgagctggccgcgcaggcagaacatgaagacgaccttccggagaatctgtccgagatagccgacctctggaactcccctaccagaacgcacggtactttcggccgtgagcccgccgccgtgaagccagatgacgatcggtaccttagggctgcaatccaggaatatgacaatatcgcaaaactgggtcagatcattagagagggacctattaagttgatccaaaccgagctcgatgaggagcctggggaccattctcctggccagggttccttgcgatttcgccacaaaccgcctgtggagctgaaaggcccagacggaatacatgtcgtgcatggttctaccgggaccctgctcgccacggatttgaactctctgccagaagaagaccagaaggggctgggccggtcgcttgaaacacttaccgcggctgaagccacagcgttcgagcgaaacgcaaggactgagagcgcaaaatccaccccccttcacaagctgcgcgacgtgatcatggagaccccgcttgaaattaccgaactctag

SEQ ID NO: 181089 - DNA, 10080 bp, Artificial Sequence
  Description of Artificial Sequence: Synthetic coding sequence
atgggccggcacgtggccaccagctgccacgtggcctggctgctggttttaatctccggctgttgggggcaggtgaataggcttcctttcttcacaaaccatttttttgatacatacttactgatttcagaggacacaccagtcggttcttccgtcacccaactcctagcacaggatatggacaatgatccgcttgtttttggagtgagcggggaggaagccagcagatttttcgccgttgagcccgacaccggtgtggtctggcttaggcaaccactagatagagaaacgaagagcgagtttactgtggagtttagtgtatctgaccatcaaggggtgattacaagaaaggtgaatatccaggtcggcgatgtgaacgacaacgcaccgacattccacaatcaaccgtattccgtcagaatccctgaggtgggcgcaacgggaaacacaccggtcggcacacccatctttatcgtgaatgcaacagatccagacctgggcgccggaggtagcgtgctgtattctttccaacccccctctcagttcttcgcaatcgattcagctagaggtatagttaccgttatccgcgaactggattatgagacaacccaggcctaccagttaaccgtgaatgcgactgaccaggacaagacccgacctttgtccactctggctaacctggcgatcattatcactgatgtgcaggatatggatcccatcttcataaatctcccttactccaccaatatttatgagcattctcctccaggaacaaccgtacgcattatcaccgctattgaccaggacaaggggagacctcggggcattggttatactatcgtgtcagtcgccggtaacacaaactcaatctttgcgctggactatatatcaggtgtattaacactgaacgggctgttagacagggagaacccattatactcacacggattcatcctgaccgtgaaaggaactgagcttaacgatgaccggacacccagtgatgccacagtgaccacgacgttcaatatcttagtgatcgatattaatgataacgcacctgaattcaattcctctgagtatagtgtggcgattaccgagttggcccaggtgggattcgccctacctctgtttatccaggtcgtggataaggatgaggggctgaacagtatgtttgaggtctacctggtgggcaacaactcccatcactttattatctcccccacctctgtccaaggtaaagctgacatacgcatacgggtcgcaatccctttggattatgagactgtcgaccggtatgatttcgatctgttcgcgaacgagagcgttcctgaccacgttggatatgctaaggtcaagataactctcattaacgagaacgataaccgaccaatttttagtcagccactgtacaacatctcactgtatgaaaacgtcaccgtcggaacaagcgttctgactgttctcgccaccgataacgatgcaggtacttttggcgaagtctcttacttcttctccgatgaccccgaccgcttctcgctggacaaggatacaggcctgattatgcttatcgccaggctggattacgaacttattcagcgatttacactgacgatcatcgctagagacggtgggggtgaagaaacaactggtcgcgttagaataaatgtgctggacgtaaatgataatgtgcctaccttccagaaagatgcttacgtcggggcgctgcgggagaacgagccgtccgtgacccagctggtccgactgcgggcgactgacgaggacagtccaccaaataaccaaattacatatagcattgtgagcgcctctgcatttggatcttatttcgatatatcactttacgagggatacggcgtgatttctgtctccagaccattggactatgaacaaatctctaacggcctgatataccttacggttatggcaatggacgccggcaatcctccccttaacagcaccgtacctgtgacaattgaggttttcgatgaaaatgacaatcccccgacttttagcaaacccgcgtactttgtgtcagtggtagagaacatcatggctggagcaacagttctcttcctgaatgctactgacctggatcggagcagggaatatggtcaggagtcaatcatctacagcctcgagggatctacccagtttagaattaatgcacggagcggtgaaatcaccacaaccagcttgctagatcgggagacaaaaagcgaatacatcctgatcgtccgtgctgtagacggaggagtgggccataaccaaaagaccggtatcgcaacagtcaacattactttgttagatataaacgataatcacccaacgtggaaggatgccccttactacatcaaccttgtagagatgactccccccgatagcgatgtgaccacggtagtggccgtagatccagatctcggcgagaacgggacactcgtctactccatacaacctcccaataaattttactcgctgaactccacgaccggcaagatcagaacaactcacgcgatgctagatcgcgagaacccagacccccatgaagctgagttgatgcgaaaaattgtcgtcagcgtgactgactgcggccggcctcccctgaaagcgacgtcttccgctaccgtcttcgtcaatctgctcgatctgaatgataatgaccccaccttccaaaatctgccctttgtggctgaggtccttgaaggaatcccagccggggtatccatttatcaggtggtagccattgatctggatgagggactgaacggtctcgtttcataccgaatgcctgtgggtatgcctaggatggactttctgatcaactcgtcatctggtgtagtggtcactacaacggaactcgacagggagcggatagccgagtaccagttacgcgtggttgccagtgatgccggcacacctaccaagtctagcacgtctacactgactatacatgtcctggacgtcaacgatgaaacccccacattctttccggccgtatacaacgtgtccgtgagcgaggacgtccctcgtgaattcagagtcgtgtggctcaactgcacagacaacgacgtagggttgaacgctgagctgtcgtacttcatcacaggcggcaacgtcgacggtaagttttctgtggggtacagagacgccgtggtgcggaccgtagtggggttggatagagagacaactgcagcctatatgctgattctagaggcaatcgataatggccctgtgggaaaaagacacactggcacagccactgtctttgtaacagttttggacgtcaacgacaatagacccatcttcttgcagagcagttacgaagctagcgtgcccgaagacatccccgaggggcattcaatcctacagcttaaggctaccgatgcggacgagggcgagtttggacgggtttggtataggatattgcatggcaatcacggaaacaactttaggatccacgtgtccaacggcctccttatgcgagggcctaggccccttgacagagagaggaactctagtcacgtcctgatcgtggaggcttacaaccacgatttaggccctatgagaagctctgtgagggtcattgtatacgtcgaggatataaacgatgaggctccagtattcactcaacaacagtactctcgattgggtcttcgagagactgccggcatcgggactagcgtgatcgtggttcaggcaacggatcgcgattccggcgatggcggtttggtgaattatcgaatccttagtggagctgagggcaagttcgagatcgacgaatccactggcctgatcattacagtgaactatttagactacgagacgaaaactagttacatgatgaatgtcagtgccaccgaccaggcacctccgttcaaccagggattttgtagcgtgtatattaccctgctgaacgaattagatgaagccgtgcaattttccaacgcatcctacgaagcagccatcctggaaaatctcgcccttggaacagaaattgtgagggtccaggcttattctattgacaatcttaaccagatcacctataggtttaatgcatacacatctacccaggccaaggcactgtttaaaatagacgctatcactggcgtgatcaccgtccaaggactagtcgacagagagaagggagatttttacaccttaacagtggtagccgatgatgggggccctaaggtcgattcaactgtgcaagtgtacattacagtgctggatgaaaatgataattccccgcgcttcgattttacatctgactctgccgtctccatccctgaagactgccctgttgggcagagggttgctaccgtgaaagcgtgggaccccgatgccggctccaacggacaagtggtcttttctctggcctcaggtaacatcgctggagcattcgagattgtgaccactaacgactcaatcggggaggtgttcgtagcacgtcccctggacagggaggagctagaccactatattctgcaagttgtggcttccgatcgcggcacccctccccgtaagaaagatcacattctgcaggtgacaattctggacattaacgacaatccccccgtgattgaatctcctttcggctacaatgtgtctgtaaacgagaacgtaggaggtggcaccgccgtggtccaggttagagcgacagatcgagacatcggcattaactcagtcctgtcctactatatcacagaaggtaacaaggacatggcatttcgcatggataggatttcaggcgagatcgccactaggccagcccccccagacagggagcgacagtcattttaccacctggtggcgactgtggaagatgaaggaaccccgactctgagtgccaccacccacgtgtacgtcacaatagtggatgagaatgacaacgcacctatgttccaacaacctcattatgaagtgctcttggacgaaggccctgatactttaaatactagcctaatcaccatccaagccctggacttggatgagggccccaacggcacagtcacctacgcaattgtggctggcaacattgtaaatacttttcgaatcgatcggcatatgggtgtgataaccgctgccaaagaactggactacgagatatcgcacgggcgttataccctcattgtgaccgctactgaccaatgccctatcctgtcccataggctgacatccactacgaccgtgctggttaatgtgaacgatattaacgacaatgtgcccacatttccccgagattatgagggaccattcgaagtgaccgaaggtcagcctggtccccgcgtgtggacattcttggcacatgacagagatagcgggccaaacgggcaggtggaatattcaatcatggatggcgacccactgggcgagtttgtcatttctcccgtcgagggggttcttagggtcaggaaagatgtggaactcgatagggaaacaattgctttctataatttaaccatctgcgccagggataggggaatgccacccctgtccagcactatgctcgtggggattagggtccttgacatcaatgacaatgatccagtgttgctgaaccttccgatgaacattactatctccgaaaattcaccggtgagctcttttgtggcgcatgtgctcgcctcagacgctgactctggctgtaacgctcgattgactttcaatattactgcggggaaccgcgagcgggcattttttataaacgctacaactggcatcgtgacagtgaacagacctctggatcgagagcggataccagagtacaagttgaccatttcagttaaagacaacccagaaaatcctagaatagccagacgggattacgaccttctgctcatttttctctctgatgagaatgataaccatcccctgttcaccaagtctacatatcaagcagaagtgatggaaaacagtcccgctggaacccctctgactgtcctcaatgggcccattctggcgctggatgctgaccaggacatctatgcagtggtgacctaccagctgctgggagcacagtcaggtcttttcgatatcaatagctctactggagtggttacagtacgttctggcgtgatcattgatcgggaggcattctcaccaccaattctggagctgctcctgctggcagaggacatcgggctcctgaatagcactgcgcacctgctgatcaccattctggacgataatgacaaccggcccacctttagtcctgccacgttaacagttcacttgctcgagaattgtccccccgggttctcagtcctgcaagtcactgcaaccgatgaggattccggactaaatggggaactggtttatcggatagaagccggcgcccaggatagattcctgattcacctcgtgacgggtgtgatccgcgtggggaacgccaccatcgaccgcgaggagcaggagtcttataggcttacagtggtggcaactgatcgtggtaccgtgcccctgtccgggaccgcaattgtgaccatcttgatcgacgacataaatgattcccggccagaatttctgaatccgatacaaacggtatctgtgctggagagcgctgagcctggtaccgttattgccaacataaccgctattgatcacgatctgaacccaaagcttgagtaccatattgtgggcatcgtggctaaagacgacacagaccgcttggtgccaaatcaggaagacgcttttgctgtgaatatcaatactggaagcgtcatggtaaaatctcctatgaaccgcgagctcgtggccacctacgaggtaacactgagcgtgatcgacaacgcctccgacctaccagagcgcagtgtgtcggtgcctaacgccaagttgacagtcaacgtactggatgtgaacgacaatactccacaattcaagcctttcggcatcacctactatatggagagaatccttgagggggctaccccaggcactactctgattgcagtcgctgctgtggatccggataaggggcttaacggactggtgacatatacccttctggacctcgtccccccgggttacgtacagctggaagacagctccgccgggaaggttatcgcaaataggaccgtggattacgaggaagtccattggctcaacttcacggtaagggcctcagacaatgggtctccccccagggccgcagagattccagtctacctggagatagtggacattaatgataataatcccattttcgatcaaccgtcctaccaggaggccgtgttcgaggacgtccctgtgggaactattatcctgacggtgacggccactgatgcggactccggtaatttcgccttaatcgaatatagtctaggggacggagagagcaagttcgccattaaccccaccactggggatatttacgtgctatcctccctcgaccgagaaaagaaagatcactacatactgacagccctcgccaaagacaatccgggtgacgtcgctagcaaccgaagggagaatagcgtgcaggtggtaattcaagtgctggacgtgaatgattgtaggcctcagttctctaaaccacagtttagcaccagtgtatacgagaacgaacctgccggaacatccgtgattaccatgatggctacggatcaggacgagggtcctaacggcgagttgacttacagcctggaaggacccggggtcgaagcctttcatgtcgacatggatagtggtctcgtgaccacccagcgcccactgcagtcctatgagaaatttagcctaaccgtcgtggccaccgatggaggagagccacccctctggggcaccaccatgctgttggtggaagtaatagatgtgaacgataatcgccccgtgtttgtccgacctccaaatggaaccatactccacatccgagaggaaatacctctgcggtccaatgtgtatgaagtgtatgcgacagacaaagacgaagggctcaatggcgcagtcaggtactcgtttctgaaaactgccggaaaccgagactgggaatttttcatcattgacccaatctctggtttaattcagacagctcagagattggaccgggaaagtcaggctgtctacagcctgattttagtagcatctgaccttggtcagcccgtgccatacgaaacaatgcaaccgctgcaagttgctttggaggatatagacgacaatgagcccctgtttgtgcgccctcccaagggaagtcctcaatatcagcttctcactgtgccagagcacagccccagagggacgctggtgggcaacgtcacaggcgccgtggatgcggatgagggccccaacgccatcgtttattatttcattgccgctgggaatgaagagaaaaacttccacctgcagcccgatgggtgtcttcttgtactgagggacctcgaccgtgaaagggaggccatcttcagttttatcgtcaaagcgagcagcaataggagctggacacccccacgcgggccctctccgacactagacctcgtcgccgacttgactttgcaagaagttcgcgttgtgctggaagacattaacgaccagcccccgaggttcactaaggctgagtatactgccggcgtcgctacggatgctaaggtaggatccgaattgatccaggtcctcgctttggacgccgatattgggaataattcactggtgttttactccatcctggctatacactacttccgagcactcgccaacgacagcgaagacgttgggcaggtatttactatgggtagcatggacggcatcctccgaacgtttgacctgttcatggcttactctcccggttatttcgtcgtcgatattgtagctagagatctagcgggccataacgacaccgccatcatcgggatctacatcctgagggacgaccagagagtgaaaatcgtcataaacgaaattccagaccgggtgagggggttcgaggaagagttcatacatctcctgagtaacattacaggcgccatcgtcaacacggacaacgttcagttccacgtagacaagaaaggacgggtcaactttgcacagactgaactgttgattcacgtcgttaaccgggacactaacagaattttagacgtagacagggtgatccagatgatagacgaaaataaggagcaactgagaaatctattcaggaactataatgtacttgacgtccagccagccattagcgtccggcttcccgacgacatgtctgctctgcaaatggccatcattgtcctggccattctcttgttcctggctgcaatgctctttgtcctgatgaattggtactacagaacagtgcataagagaaagttgaaagcgatcgtcgcgggatcagctggtaatcgggggttcattgacattatggatatgcctaatactaataaatactcctttgatggagcaaacccagtctggctggacccgttctgtcgcaacctggaactagcagcccaggccgaacacgaagacgaccttcctgaaaacttgtccgaaatagcggacttatggaactcacccaccaggacacatggcacatttggacgcgaacctgctgccgtgaaacccgatgacgaccggtacctgcgcgccgctatccaggagtatgacaatattgcaaaactaggccagatcattcgagagggcccgatcaagggatcgttactaaaggtggttctggaggattacctcagactcaaaaagctcttcgcccagaggatggtgcagaaggcaagcagctgtcattcctctatttccgagttgatccagacagaattagacgaagaacccggtgaccactctccagggcagggcagcctccggtttcgtcacaaaccaccagtggaattgaaggggcccgatgggatacacgtggtgcacggtagtacagggactttacttgctactgacctcaattctctgccagaagaagaccagaagggactgggcaggtctttagagacactgacagctgccgaagccacagctttcgagcgaaatgcgcgaactgagagcgccaagtccactcccctgcataagctgcgggacgtgatcatggagaccccactggagatcacagagctatag

SEQ ID NO: 181090 - DNA, 1338 bp, Artificial Sequence
  Description of Artificial Sequence: Synthetic coding sequence
atggacaacgaccccctggtgttcggcgtgagcggcgaggaggccagccgattctttgccgtggagccggataccggcgtggtgtggctgcggcagcccctcgatagggagacaaaaagtgagttcaccgtagaattcagcgttagtgatcatcagggggtcattacaaggaaggttaacattcaggtcggagacgtcaacgacaacgctcctacgttccacaaccagccttacagcgtgaggatccccgagaacactcctgtaggaacaccaatatttatcgtcaacgcaacagatcccgacttgggtgccggagggagcgtgctctattccttccagcccccatcacaattttttgccattgactccgcgagaggaattgtgacagtcataagggaattagactacgagacgacacaggcctatcagttaacagtcaatgcactggccattatcatcacaaatctgccctatagcactaacatctatgaacatagcccgccaggcacaaccgttagaatcataacagcgattgatcaagataaagggcggccaaggggaataggatataccatagtgtctggaaatacaaactctatttttgcgttggattacatctcaggtgtgctcactcttaatggcctcctggacagggagaatccactgtacagtcacggcttcattttaaccgtcaagggtacagagctgaacgacgaccgcactccaagtgatgctacagtgactacaacatttaatatcttggtgatcgacatcaatgacaacgctcctgagtttaacagctcagagtactctgtggctataactgaacttgcgcaggtaggattcgcccttccgcttttcattcaggtggtggataaggacgagggccttaacagcatgttcgaggtgtacctcgtcggcaacaactctcatcacttcatcatctcccccaccagcgtccagggtaaggcagacattagaataagggtggctatcccgctcgactacgaaacggtggacaggtacgactttgacctcttcgcaaatgaaagcgtgcctgatcatgtagggtatgctaaagtgaagattaccctgattaatgagaatgacaaccgacccattttctcgcagccgctgtataatatatctctttacgaaaacgtgactgttgggacctctgtccttacggtgttggtttccccccgcttcacagctggtccactcagctcacccggaccaacagtagttcgccacccggagggcttctgtcctcgggacctatccaatcaggggaggagacacccacagatccctgagctatgtttgctggtgtattag

SEQ ID NO: 181091 - DNA, 2187 bp, Artificial Sequence
  Description of Artificial Sequence: Synthetic coding sequence
gccaccgacaacgacgccggcaccttcggcgaggtgagctacttcttttctgacgacccagacagattctcgcttgataaagacactgggttgattatgctgatcgccaggctggactacgagctgatacaaagattcaccctcaccataatcgcacgcgacgggggcggcgaagagaccacaggtcgcgtgaggataaacgtgctggatgttaatgataatgtgcccacattccagaaggacgcttatgtgggcgcccttcgcgaaaatgagccctctgttactcagctggtcaggttaagagccacggacgaggactctccgcctaataatcagatcacatactctatcgtctccgcttccgcttttggatcctacttcgacatcagcctttacgaaggctacggggtgatttccgtctcgcggcctctagattacgaacagatcagcaatggtctcatctacctcactgtaatggctatggacgccggcaacccccctctcaacagcaccgtgcctgtcactattgaggttttcgatgagaacgataatccgccaacattttcgaagcccgcctatttcgtgtccgtggtagaaaatattatggccggcgcaaccgtgctgtttcttaacgccaccgacttagaccggtctagggagtatggccaggagagcattatctattcacttgagggcagcacccagttcaggattaacgctcgatcaggggaaattaccaccacatcactcctcgatcgggagacaaagtccgaatacatactgatcgtgagagctgtggacggcggggtgggccataatcagaaaacagggatcgcgacagtgaatattacgttgctcgatatcaatgataatcacccgacctggaaggacgctccatactatattaacctggttgagatgacgcctccggactcggacgtgacgactgtcgtggccgtggatcctgacctgggagagaacggcacactcgtgtactccattcagcccccaaataagttctattccctcaacagtaccaccgggaagatccgtacaacccacgccatgctcgaccgtgagaacccagacccgcacgaagcagagctcatgcggaagattgtggtgagcgtcacagattgcggcaggccccccttgaaagccacttctagtgccaccgtgtttgtgaacctgctggatctgaatgataacgaccctacttttcaaaatctgcctttcgtcgctgaagtgctggagggtataccggctggtgtaagcatctatcaggtcgtggccattgacctggacgaggggcttaacggcctagtgagttacagaatgcccgttggcatgcctagaatggatttccttatcaatagcagcagtggagtggtggttacaacgacagaattggatagggaacggattgccgagtatcagttgagggttgtcgcttctgatgccgggacccccacgaaaagctccacttctaccctgacaatccatgtccttgacgtaaatgatgaaacccccaccttcttcccggcagtgtataacgtctccgttagtgaggacgtgcctcgcgagtttagagtagtgtggttgaactgtaccgacaacgacgtgggtttaaatgcagagctgtcttatttcatcactggcgggaatgtggacggaaagttcagcgtggggtacagagacgctgtggtaagaacagttgtcgggcttgaccgagagactaccgctgcgtatatgctgatactggaggcaatcgacaatggaccagtcgggaaaagacacaccggcaccgccactgttttcgtgacggttctagatgtcaatgacaacagacccatctttctgcagagtagctatgaagcatccgtacccgaggacattcctgaagggcactccattttgcaggaggacttggcctcaccttgtattagccccgcccccccgaggcgcgcttttcagagctccggcgagaaggagacctcccagtttcccggtaaggaactgcgcagagaaccgggaccttctaaggctcagaacagggcagcctttacagaacccttggccgaggctccactcctgggcagtaaacaggcgcaggaggagcgggctcctcttcctcgagaacaggcccagcaactccaaggaagtgaaggcgaaaaggggggtccctag

SEQ ID NO: 181092 - DNA, 2238 bp, Artificial Sequence
  Description of Artificial Sequence: Synthetic coding sequence
atgcggcggtgccggtgggccgccctggccctgggcctgctgcggctgtgtctggctcaggctaatttcgccccccatttttttgacaacggtgtcggttccaccaacgggaatatggccttgttttcattacccgaggacacaccagtgggatctcacgtgtacaccctgaatggaaccgacccagagggagaccccatttcgtatcacatatcttttgacccttcaaccaggtcagtcttctcggtagatcctacgtttggaaatataactttggtcgaagaacttgatcgcgagagggaggacgagattgaggccattatctcaatttctgacggcctgaacctcgtcgccgagaaggtcgtgatcctagtcacagatgccaatgatgaggctccgaggttcatacaagaaccgtatgtcgccctggtgccggaagacatcccagccggctccattatcttcaaagtgcacgcggtcgaccgggacaccggctcaggcggctcagtgacttatttcctgcagaacctgcactctccgttcgccgtggacagacacagcggtgtcctgagactgcaagctggtgcaaccttggattacgagaggtccaggacgcattatataaccgtcgtcgcaaaggacggcgggggccgccttcacggcgccgatgttgttttcagcgctaccactaccgtgacagttaacgtggaggacgtgcaggacatggcaccagtgtttgtaggtactccttattatggatacgtgtatgaagacactctgccaggctcagaagttctcaaagtggtcgccatggatggagatcgtggcaaaccaaatagaatcttgtacagccttgtgaacggcaacgatggagcattcgagattaatgagacctccggagctatctctattactcaaagtccggctcagctgcagagggaggtatacgagcttcacgtacaggtaacggagatgtcacctgctggatcgcctgccgcccaggccaccgtcccagtcacaattcgcattgtggatttgaataatcatcctccaaccttttatggtgagtcaggccctcagaatcgatttgagctaagcatgaatgaacacccacctcaaggcgaaattctccgaggcctgaagattacagtcaacgactccgaccagggcgctaatgcaaagttcaacctgcagttagtgggaccacgggggattttccgtgtggtgccacagacagtgctgaacgaggcacaggtcactattatcgtggagaacagcgctgcaatcgatttcgagaagagcaaggtgctgacattcaagcttctagcggtagaagtcaatacgcctgagaagttcagctccacagccgacgtggtgattcaactgctcgataccaacgacaacgtcccaaagttcgattccctgtactatgttgcaaggattccagagaacgcccccggcggatccagcgttgtggctgttacagccgttgaccccgacaccggcccatggggggaggtgaaatatagtacatatggcacgggcgccgatctctttcttatacacccgagcacagggctgatttacacgcagccttgggccagccttgacgctgaggccactgcccgatacaacttctacgtcaaagccgaagacatggaaggaaagtattcggtggcagaagttttcataaccctgctcgacgttaatgaccatcctcctcaatttggtaagagtgtgcagaaaaagactatggtgctcggcacgcccgtcaaaatcgaggccattgacgaggacgcagaggaaccaaataatcttgttgattatagcatcacccacgctgaacctgccaatgtgttcgacataaacagccacaccggggaaatttggctgaaaaactcaatccggagccttgacgcattacacaacattacccccggtcgtgattgcctgtggagcctcgaggtccaggccaaagataggggcagcccctctttctccacgaccgccctccttaagattgacattaccgatgccgaagtgaggcggcttcgatacatgaaaaattccaatttccctgggactactaagtccgtccggaagcctaaattcaagcctaaaaagcctcattcctcacagggcctattcctgcacccccattgtgagatcgcactgttcaacctatccaatgttaacctctactcccgcgtgttccagggagctgcacaggcctcctag

SEQ ID NO: 181093 - DNA, 2580 bp, Artificial Sequence
  Description of Artificial Sequence: Synthetic coding sequence
atgcggcggtgccggtgggccgccctggccctgggcctgctgcggctgtgtttagcccaggctaatttcgcccctcacttctttgacaacggcgtgggtagtaccaacgggaatatggccctttttagcctaccggaagataccccggtgggatcccacgtgtatacacttaatggtactgaccccgagggcgacccaatcagctaccatatctccttcgacccatccacccgctctgtcttctcagtggacccaacatttggcaacatcactctagtggaggagcttgaccgggagagggaggatgagatcgaagcaattattagtatatccgacgggctgaacttagttgcagagaaggtcgtaattttggtgacggacgcaaacgacgaggcgccccggttcattcaggaaccatacgtggctctggtgcctgaagatatacccgccggctccatcattttcaaggttcatgccgtggatcgcgacactggatctgggggttctgtgacatacttcttgcagaacttgcacagccccttcgccgttgatcgccactccggggtgctgcgcctgcaggctggtgctacactcgattacgagaggagcagaacacattatatcactgtggtggctaaagatggaggcgggcgcctgcacggtgcagatgtcgttttttccgcaactaccacggtgaccgtcaatgtcgaggatgttcaggatatggcgccggtattcgtgggcaccccatattatggatatgtttacgaagatactctccccggaagtgaagtgttaaaggtggtcgctatggacggtgaccgaggaaaaccgaatcgcattctgtatagcctcgtcaatgggaacgacggtgcatttgaaattaacgaaacgtcgggcgctatttccatcacacaaagtcccgctcagttgcagagggaagtctacgaactccatgtgcaagtgaccgagatgagtcctgcggggtcacctgccgcccaggccacagttccagtgaccattagaattgttgaccttaacaatcatcccccaacgttctacggtgagagcggaccgcagaaccgattcgaactcagtatgaacgaacatccaccgcagggggaaatccttcgcggcctcaaaattacagtcaatgactcagatcagggggctaacgccaaatttaacttacagttggtgggcccccgcggcattttcagagtggtcccacagacagttctgaacgaggcccaagtcacaatcatcgttgagaacagcgcggcaatcgactttgaaaaatcaaaagttctgaccttcaagttgctggctgtggaagttaacacacccgaaaagttttctagtaccgctgatgtcgtgattcaactcctggacacaaatgacaacgttcccaagtttgactccctctactatgtggcccgcatccctgagaatgcccccggagggtcatcagtggtggcggtaacggcagttgatcccgatacaggcccttggggggaggtcaaatattctacttacggaaccggcgctgatctcttcctgattcatccttcaacaggcctgatttacacacagccatgggccagtctcgacgcagaagctactgctcgctacaacttttatgtaaaggccgaagacatggaaggtaaatactctgttgccgaggtgtttataacattgctcgatgtgaacgatcatccaccccaatttggtaagtctgtgcagaagaagaccatggtccttgggacgccagtgaaaatcgaagctatcgatgaggatgccgaggaacccaataatctggtggactactcaatcacccatgctgagccagctaacgtcttcgacattaacagtcacactggcgaaatctggctgaagaactcaatacgcagtttggatgccctgcacaacatcacacctggaagggactgtctgtggtcgttagaagtacaggctaaagatcgcggctcgccaagcttcagcactactgctctgcttaagattgatataactgatgccgaaactttgagtcggagcccaatggccgcatttcttattcagacaaaagacaatcccatgaaagccgtgggcgttcttgctgggaccatggcaaccgtggtggccatcacagttttgatcagcaccgcgacgttttggagaaacaaaaaatccaataaagtgctgcccatgaggcgcgtgttgaggaagagaccaagcccagctcctcggaccattcgcatcgagtggctcaaatcaaagtcaacaaaggcagccacaaagttcatgctcaaggaaaagccaccaaatgagaattgtaataataactctccagaaagctcactgctgccgcgggcgcctgccctgcccccccccccgagcgtagctccttccaccggggccgcgcaatggactgttcccacggtctccggttccctgacaccacagccgacccaacccccgccaaaaccaaaaaccatgggttcaccagtgcagagcacactgatttccgaacttaagcagaagtttgaaaaaaagtctgtgcacaacaaagcttacttctag

SEQ ID NO: 181094 - DNA, 1692 bp, Artificial Sequence
  Description of Artificial Sequence: Synthetic coding sequence
atggcccccgtgttcgtgggcaccccctactacggctacgtgtacgaagacaccctcccaggttcagaagtcttgaaggtcgtggcaatggacggagatagaggtaagccaaaccggatactgtactctttagtaaacggaaacgatggggcgttcgagataaacgagacctctggagccatcagtatcacacagtcacctgcgcagctgcagagggaggtgtatgagctccatgttcaggttactgagatgtcacctgccggatcgcctgctgcccaggctactgtaccagtgacgatccggatagtggatcttaacaaccaccccccaacattttacggggaatctggtccacagaaccgctttgagttgtcaatgaacgagcacccccctcagggggagatactgcgagggttaaaaatcacagtcaatgactcagaccaaggagcaaacgcaaagttcaatctccagctcgtggggccaaggggaatctttagggtggttccccagaccgtgcttaacgaagctcaagtcacaatcatcgttgaaaattctgccgctatcgacttcgagaagagcaaggttctgacctttaaggctgtggaccccgacaccggaccatggggcgaggtgaagtattcaacatatggtaccggcgcagacctgtttctcatccatccgtccactggcttgatctacacccaaccatgggcttccctagacgccgaggcaacagctcggtacaacttttacgtgaaggccgaagacatggagggaaagtactctgtggccgaggtgttcatcacgctgttggatgtgaatgatcaccccccacagttcggcaaatccgtgcagaagaaaactatggttctggggactcccgtcaagatagaggccattgatgaagacgcagaggaacccaataacctcgttgactactcaattacacatgctgagcccgccaacgtctttgacatcaatagccatacaggagagatctggcttaagaattccattaggtcgctggacgcattgcataacattacccccggtagagactgcctgtggtctctggaagttcaggctaaggatagagggtcgccctctttctcgacaactgctctcctgaaaatcgacattactgatgctgagaccctctccagatccccaatggctgcctttctgatccagaccaaggacaacccaatgaaggcagtcggcgtgttggcggggaccatggctactgtcgtagcgatcacagtcctgatcagcaccgccaccttctggcgcaacaagaaatctaacaaggtgcttcccatgagacgagtgcttaggaagcgcccctcccctgctccacggaccattagaatagaatggcttaagagcaaaagcactaaggccgccactaagttcatgcttaaagagaaaccgcctaatgagaattgcaataataactcccctgaaagctcacttctgcctcgtgcccccgcccttcccccccctcccagcgtcgcgccgtcaacgggcgctgcccagtggactgtgccaaccgtatctggatccttgactccacaaccaacgcagcccccccctaaaccaaagacaatggggagcccagtgcagtccaccctaatttccgagctgaagcagaagttcgaaaagaagtccgttcacaataaagcctacttttag

SEQ ID NO: 181095 - DNA, 1464 bp, Artificial Sequence
  Description of Artificial Sequence: Synthetic coding sequence
atgggcagctgggccctgctgtggccccccctgctgttcaccggcttgctggttagaccccctggcaccatggcccaggcacagtattgctcagtcaacaaagatattttcgaagtcgaagagaacactaacgtaaccgagccacttgttgatatccacgttccagagggacaagaagtaactctgggtgcactcagcacacctttcgcttttcgcatacagggcaaccagctgtttctgaacgttacccccgactatgaggaaaagtccctactggaagctcagctgctgtgccagagtggaggaactctggtaacacagctgagggtcttcgtatccgtcttggacgtaaatgataatgcacctgagtttccttttaaaacaaaggagattagggtggaggaagataccaaagtgaactctaccgtgatccctgagacacagctgcaagcggaggatagggataaggacgacattctgttttataccttacaggaaatgacggcaggcgcttctgactatttctcccttgtgtcagtgaacaggccagctctgcgactggataggccacttgatttctacgagcgtcctaatatgacgttctggctgcttgtgcgggatacccctggcgaaaatgtggaacctagtcacacggccacagccactcttgtgctaaacgttgttcctgcagatttgcgacctccctggtttttaccatgtacattttcagacggttacgtctgtatccaggctcagtaccacggtgctgtcccaaccggtcatatcctgccctctcccctggtgcttagacccggacctatttatgctgaggatggggacagagggatcaaccaacctataatctactcgatcttccgagggaacgtcaatggcaccttcattatccaccccgatagtgggaacctgaccgtggcgcgcagtgttcctagtccgatgacattcctgctgcttgttaagggacagcaggccgatcttgcccgctactccgtgactcaagtgacggtagaggctgtggctgctgcaggctcccccccccgattcccgcagcgcctgtatagaggtaccgtagcgaggggagcaggagccggagtggtcgtgaaggatgcggccgctccgtcccagccactccgtattcaagcacaggaccccgagttctccgacctgaactccgccatcacttatcgaatcactaatcatagccactttcggatggaaggggaagttgtcctcaccacgactactctggcacaagccggcgccttttacgcggaaccgccaacatgtaccggtgatctgcggcatcctgcccacctgcggcctcctgcacctgatcctacacagcggcttcccggagaggccgaggagcctatgcaaacccccaaggccactcatctcggcgccgggggacttaaacatttgcctggtgttctggtgcccttttag

SEQ ID NO: 181096 - DNA, 1956 bp, Artificial Sequence
  Description of Artificial Sequence: Synthetic coding sequence
atgggcagctgggccctgctgtggccccccctgctgttcaccggcctgttggtgaggccacctggcactatggctcaggctcagtactgctccgtgaacaaggatatattcgaagttgaggagaacaccaatgtgacggagcccctggtggacatccatgtccccgaggggcaggaggtcaccctgggagccctgtcaacccctttcgcctttcgcattcagggaaaccagctcttcctgaatgtgacccctgactacgaggagaaatccctgctggaggcccagctgctatgtcaatccggtggtactctagtaactcaactgcgggtttttgtctcagttctggatgtgaacgataacgcaccagagttccctttcaagaccaaggagatcagggtggaggaggatacaaaagtaaacagcaccgtgatccctgagactcagctgcaggctgaggaccgagacaaagacgacatcctgttctacaccctgcaggagatgacagccggggcttctgactacttctcactggtttcggtaaatagaccggcgctaaggctcgaccggcccctggatttctatgagaggccaaacatgacattttggcttctcgtgcgcgacacccccggcgagaacgtggagcctagccatacggctaccgcaacattagtattaaatgtcgtgcccgcggacctccggcccccttggtttctcccttgtacgttcagtgatgggtatgtgtgtatccaggcccagtatcacggtgccgttcctaccggccatatcctgccctcccccctggttctgaggcctgggccgatttatgctgaagacggagaccgcgggatcaatcagccaatcatctattcaatttttaggggtaacgtcaatggcacctttatcattcaccccgatagtggcaacttgaccgttgctagaagcgtaccaagtccgatgacattccttctgctggtcaaaggacagcaggccgatctggcccgatattcagtcacccaggttaccgttgaggccgtcgccgccgcgggctctccccctcggttccctcagcgcctctatcgcggcactgttgccagaggcgccggcgcaggggtggtcgtgaaggatgcagcggccccttcccagcctctccgcattcaggctcaggaccccgaattttctgacctgaattccgccatcacgtaccggattaccaaccattctcacttccgcatggagggggaggtagtgcttactaccaccacacttgctcaggcaggagcattttatgctgaggtggaggctcacaatactgtcacctcaggaactgcaacgaccgttatcgagattcaggtctctgaacaagaaccgcccagcacaggcgggggaccctccgaagacaagcgcttctcagtggttgacatggcagccctggggggggtgctgggagctctgcttctcctcgctctgctcggcctcgccgtgttggtccataaacattacggccctcgcctcaaatgttgttgcggcaaggcccctgagccacagcctcaaggattcgacaatcaggcctttctgcccgaccataaggcaaattgggcccctgtgccctcgcccacacacgaccccaaacctgctgaggctcctatgccagccgagcccgccccacctggacccgccagtccaggaggagctccagagccacccgccgcagctagagctgggggcagtcccaccgctgtccgaagtatcctgacgaaggagcggaggcctgagggtggctacaaggcggtttggttcggcgaggacatcggaacagaggctgacgtggtagtcttaaacgcccccacactcgatgtggatggtgcctccgattctggctcaggggatgagggtgagggcgccgggaggggcggaggcccatatgacgcacctggcggtgacgacagttacatatag

SEQ ID NO: 181097 - DNA, 2538 bp, Artificial Sequence
  Description of Artificial Sequence: Synthetic coding sequence
atgggcagctgggccctgctgtggccccccctgctgttcaccggcttactcgtgaggcctcctggaacaatggcccaggcccaatattgcagcgtcaacaaggatatcttcgaggtagaagaaaatactaacgtgacagaaccactggtcgatatacatgtcccagagggacaggaagtgactttaggcgccttgagcaccccattcgctttccggatccagggcaatcaattgttcctgaacgtgactcctgattacgaagaaaaaagcctcctcgaggctcaacttctgtgccagtccggaggtaccctggtgacccagctccgggtgtttgtgagtgtactcgacgtcaatgataacgctcccgagtttccttttaagactaaggagatcagagtggaggaagacaccaaagtgaattccaccgtgatcccagaaactcaactccaggcagaagatagggacaaggacgacattctcttctacacacttcaagaaatgaccgctggcgcctccgattatttctcactagtgagtgtgaatcgccctgctctgagactcgatagaccacttgatttttacgagagaccaaacatgacattttggttgctggttagagatacacccggtgagaatgttgaaccatcccatacagctaccgctacgctggttctgaatgtggtgcccgcagatcttcgcccaccgtggtttctgccgtgcacatttagtgatggatacgtttgtattcaagcccagtatcatggagccgtcccaaccggtcacattctaccaagccctttagtcctgcgaccaggtccgatctacgccgaggacggagatagagggatcaaccagcctatcatttactccatctttcgcggcaatgttaatggcaccttcatcatccaccccgactctgggaacctcaccgtggccaggtcagtccccagccccatgactttcctcctactggttaaagggcagcaggctgacctcgcacgttatagcgtcacacaggtgactgtagaggccgtggctgcggcaggaagtccaccgcggtttccacagcggctttatcggggaacagtggcccgcggcgcgggcgcaggggtcgtggtaaaggacgcagctgctccatcccagccgctgaggattcaggcccaggaccctgagttctcggacctcaattcagccattacatacagaatcacgaaccacagtcactttcgtatggagggagaagttgtgctaaccaccacaacattggcacaggcgggtgccttctacgctgaggtcgaagcacacaacaccgtgacctctggcacagcaactacagttatagagatccaggtctcggaacaggagcctccaagcacagacgtgcccccatctcccgaggcagggggcacaacagggccatggacatccaccacgtcagaggtcccgcgcccccccgagccctcgcagggaccttcaactacctcttccggaggcggtactggacctcaccccccttctggcactactctcagacctcctacctcctccacgccagggggccctccaggtgcagagaatagcacgtctcaccaacccgcaacacccggaggagacaccgctcagacgccgaagccgggtactagtcagcctatgcctcccggggtcggtaccagcactagccatcagccagccaccccaagtgggggcacggcccagaccccagaaccaggaacctctcagccgatgcccccgtctatgggaacttccacttcccaccaacccgccaccccaggagggggcaccgcccagacaccggaagcagggacctcgcagcccatgccgccggggatggggacctctacaagtcaccagcctacaacgcccggagggggcaccgctcaaacgccggaacctggtacctcacagcccatgccgctctctaagtccacacccagctctggcgggggccctagcgaagataagcgcttcagtgtcgtggacatggcagcgttaggtggcgtgctcggagcacttcttctactagcactgctgggcctggccgtgctcgtgcacaagcactatggcccccggctcaaatgctgctgtggaaaggccccagagccacagccacaaggcttcgacaaccaggcatttctgcctgatcataaagcaaattgggctcctgtgccgtcccccactcatgaccccaaacccgctgaggctccaatgcccgccgagcccgcgcctccaggtcctgcatcacctggaggtgcaccagagcctccagctgcggcacgtgcgggagggagccccacagcggtaagatcaatcttaacaaaggagcgaagaccggagggagggtacaaagcagtttggttcggagaggatatcggaacagaggctgatgtggtcgttttaaacgccccaacactggacgttgatggcgcttccgactctggcagcggcgatgagggcgagggcgcgggacgaggaggcggcccctatgacgcacctggaggggatgactcctacatctag

SEQ ID NO: 181098 - DNA, 2538 bp, Artificial Sequence
  Description of Artificial Sequence: Synthetic coding sequence
atgggcagctgggccctgctgtggccccccctgctgttcaccggcttgttggttcgcccccctggaacaatggctcaggcacagtactgttctgtcaataaggacattttcgaggtggaagaaaacacaaatgtgaccgagcctctggtcgacatccatgtcccagagggtcaggaagtgaccctgggagccctatccacacccttcgcctttcggattcagggcaaccaactattcctcaacgtgactccagactatgaagaaaagagcctcttagaagcccagctgctttgccaatcagggggtactcttgtcactcagcttcgggtgttcgtgagtgtactcgacgtgaatgataatgccccggaatttccatttaagactaaagagattcgggttgaggaggataccaaggtgaactccacagtgatcccagagactcagttgcaagcagaggatagggacaaggatgatatccttttctacaccctgcaagagatgaccgccggggctagcgattacttttctctcgtgtcagtgaacagaccagccctgcggttagaccggcctctcgatttttatgaacggcccaatatgaccttctggctgctggttagggacacgcccggtgaaaatgttgaaccctcccacactgcaacagctacacttgtgttgaacgtggtgcccgccgatttgcgccccccctggttcttgccttgtacgttttccgacggctatgtgtgtatccaggcccaataccacggagcagtgcccaccggccatatcctgccctctccccttgtgctgcggcccggccctatctacgcagaagacggggatagaggtattaaccagccaattatttacagtatctttcggggtaacgttaacggaaccttcatcatccaccctgacagcgggaatctgacagtcgctcggagcgtcccctcccctatgacattcctcctgcttgtgaaaggccaacaagccgacctggccaggtacagcgtgacccaggtgacggttgaggccgtggccgccgccggctctcctccaagattcccccagaggttgtacagaggaaccgtcgccaggggggccggagccggggtagtcgtgaaggacgctgctgcacctagccagcctctgaggattcaagcacaggaccccgagttctccgacctaaactcagctataacctacagaattactaaccacagccacttcagaatggaaggcgaagtcgtactgactaccaccactctcgcgcaggcgggagccttttacgctgaagtggaagcacacaatacagtcacctcaggcacggccacgactgtcatcgaaattcaagtttccgagcaggagccaccgagtacagacgttccaccatcaccagaggcggggggcactaccggaccttggactagtaccaccagtgaggttcctagacctccggaaccgagccaggggccgtcaaccacctcttccgggggtggtacagggccccaccctccctccgggaccaccctccgaccacctacgtcaagcactcccggtgggccgcctggtgcggaaaactccaccagccaccagcctgcaacaccaggcggggacacggcccagacacctaagccaggcacaagtcagcccatgcccccgggggtgggtaccagcaccagccaccagcccgccactccgtccggcggaaccgctcagacccctgaaccaggcaccagccagccgatgcctcctagcatgggcacaagtacctcccaccaacccgcgacacccggaggcgggacagcccaaacccctgaagcaggaacctctcagccaatgccacctggtatggggacctccacctctcaccagcctacaactccaggagggggcaccgcacagactccagaacctgggaccagtcaacctatgcctctctccaagtctacgccctccagcgggggtggtccatccgaggataagcgatttagcgtggtcgacatggctgcacttgggggcgttctcggcgcgttgttacttctggccctgcttggactcgccgtgctggtgcataaacattacggccctagactgaagtgctgctgcggcaaggcgccggaacctcagcctcagggctttgacaaccaggccttcctccctgaccataaggccaattgggctcccgtgcctagtccaacccacgacccaaaacctgcggaggctcctatgccggccgagccagctcctccaggcccagcttcgccaggcggagcaccagagccacctgcagccgctcgcgccggagggtcacctacagccgtgcgctctatcctcaccaaagaaagaaggcccgagggcggatacaaggcagtatggttcggcgaggacatcggaaccgaggcggatgtggtggtgctcaacgcacctacactggatgtagatggagcatctgatagcggttcaggcgatgagggagagggagcaggacgcggtggcggtccatatgatgcccccggaggtgatgatagctatatttag

SEQ ID NO: 181099 - DNA, 786 bp, Artificial Sequence
  Description of Artificial Sequence: Synthetic coding sequence
atggccgagagccacctgcagagcagcctgatcaccgccagccagttttttgagatctggctgcatttcgacgctgacgggagcggttatctcgagggcaaagaacttcagaatctcattcaggaattgcaacaagcacgcaaaaaagccggcctggaactgagtcccgagatgaagacatttgtggatcaatacggccagagggatgacggtaaaatcgggattgtcgagctggcccatgtgcttcctaccgaggagaacttcctgctgctgttcagatgtcaacagttgaagtcctgtgaagagttcatgaaaacctggcgtaagtacgatacagaccacagtggcttcatcgagactgaagaactcaagaactttcttaaagaccttctagagaaggcaaataaaacagtagatgacaccaagctggcggagtatactgatctaatgctcaaactttttgacagcaataacgacgggaagctggagctcaccgaaatggctaggcttctccccgttcaagaaaatttcctcctgaagtttcaagggataaagatgtgcggtaaagagttcaacaaagctttcgagctgtatgatcaggatgggaatggctatatcgatgagaatgagctagacgcacttcttaaagacctctgtgagaaaaacaagcaggacctagatataaacaatatcaccacctacaagaaaaacattatggccctgtcagacggtggaaaactctaccgcacggacctggcactgatcttatgcgcgggtgacaattag

SEQ ID NO: 181100 - DNA, 615 bp, Artificial Sequence
  Description of Artificial Sequence: Synthetic coding sequence
atgaagaccttcgtggaccagtacggccagcgggacgacggcaagataggaatcgtcgagttggcacatgtgttaccaacagaagaaaactttttgctgctctttcggtgtcagcagctcaaatcttgcgaggagttcatgaagacctggcggaagtatgataccgaccatagcgggtttatcgaaacagaagagttgaagaattttctgaaagacctgctggaaaaagcgaacaagactgtggatgacaccaagttggcagaatacaccgacttgatgctcaagcttttcgactctaataacgacggtaagctcgagcttactgagatggcaaggctgttgcccgtacaggaaaattttctgcttaagttccagggtataaagatgtgtgggaaagagtttaacaaggcgtttgaattgtatgatcaagacggtaatggctacatcgatgagaacgagttggacgccctgcttaaagacttgtgcgagaagaataaacaagacctggacatcaataacatcacaacgtacaagaagaacatcatggcactatcagatggcgggaagttatacaggaccgatttagccctgatactgtgcgctggggataactag

SEQ ID NO: 181101 - DNA, 816 bp, Artificial Sequence
  Description of Artificial Sequence: Synthetic coding sequence
atggccggcccccagcagcagcccccctacctgcacctggccgagctcaccgctagccagtttcttgagatctggaaacattttgacgccgacggaaatggctatatcgaggggaaggagctggagaatttttttcaggaactggaaaaggcacgcaagggatccgggatgatgtccaaatcagacaattttggtgaaaagatgaaggaattcatgcagaaatacgataaaaattctgatggaaagatcgaaatggcggagctagcccagattctgccaaccgaggagaactttttgctgtgctttaggcaacacgttggttcttcggctgagtttatggaggcctggcgtaagtacgatacagataggtcagggtacattgaggctaatgaactgaagggcttcctaagcgaccttttgaaaaaggctaacaggccttacgatgagcccaaactgcaggaatacacacagactatcctgcggatgttcgaccttaacggcgacggtaagctgggactgagcgagatgtcacggctgctgcctgttcaggaaaactttctcctcaagttccaagggatgaaactcacatccgaggagttcaacgcaatctttaccttttatgacaaagacaggtccgggtatattgatgaacacgagcttgacgcccttctgaaagatctatacgaaaagaacaagaaggagatgaacattcaacaactgacgaattatcgcaaaagtgtcatgtccctcgctgaagcaggtaagctatacaggaaagacctcgaaattgttttatgctcagagcctcctatgtag

SEQ ID NO: 181102 - DNA, 579 bp, Artificial Sequence
  Description of Artificial Sequence: Synthetic coding sequence
atggccggcccccagcagcagcccccctacctgcacctggccgagctcaccgcatcgcagttcctagagatctggaagcattttgatgccgacggcaatggatacatcgaaggaaaggaactcgaaaacttcttccaagagctggaaaaggcacggaaaggtagcggtatgatgtccaagagcgataactttggtgagaagatgaaggagttcatgcaaaaatacgacaagaattcggatgggaaaatagagatggctgaattagctcaaatactaccaacagaggaaaacttcctactatgcttccgacagcacgtgggcagttccgctgagttcatggaggcttggagaaagtacgatacagatcgctccggctacattgaggccaacgaactgaaggggtttctgtcagacctactgaaaaaagctaacaggccttacgacgaaccgaagctgcaggagtatacccagactatcttaagaatgtttgacctgaacggtgatgggaaactggggctgtctgaaatgtcgcgaattgaggccgcaaccttaacatccatgtcatggatgcctttttag

SEQ ID NO: 181103 - DNA, 6663 bp, Artificial Sequence
  Description of Artificial Sequence: Synthetic coding sequence
atgatccggatcgccgccctgaacgccagcagcaccatcgaggacgaccacgaagggtcattcaaatcacacaaaacccagacaaaggaagctcaggaggctgaagcattcgctctctatcataaggccctggacttgcaaaaacacgaccgcttcgaagaaagtgccaaagcctatcatgagctccttgaagcctccctgctgcgggaggccgtctctagcggagacgagaaagagggcttgaaacatcccggactgatcctcaaatactctacttacaagaatctggcccagttagcagcgcagagagaagacttggagacagcaatggaattttacctggaagccgttatgctggacagcactgacgtcaacttatggtacaaaataggccacgtggccctgcgcctcatcaggatccctctggcgcgccacgcttttgaagagggccttcgttgtaacccggatcactggccctgtctagacaacctgatcactgtgctgtatacgctctctgactacaccacctgtctgtacttcatttgtaaagcacttgagaaggactgccgctattccaaaggccttgtccttaaagaaaagattttcgaagagcagccatgtcttcgaaaagactctctgcgtatgtttctgaagtgtgatatgtctattcatgacgtgagtgtgtcagccgctgagacacaggccattgtggacgaggccctgggcttgcgtaagaagcgccaggccttaatcgtgagagagaaagagcctgacttgaagcttgtgcagcctattccgttctttacgtggaagtgcctgggggagtctcttttggctatgtacaaccaccttacaacctgcgaacctcctcgccccagcctggggaaaaggatcgacctgagcgactaccaggacccatcacagcccctcgagagcagtatggtggtcacacctgtgaatgttatccagccgtctaccgttagcaccaatccggccgtcgctgtcgcggaacctgttgtcagttatacatccgtcgccacaacctcctttccactccacagtcccgggttgctggagaccggcgctcctgtcggggacatctccggtggggacaagtccaagaaaggggttaagcgcaaaaagatcagcgaagaaagtggcgaaaccgccaagcgcaggtcggcacgggtccggaacacaaaatgtaagaaagaagaaaaggtcgatttccaagaattactgatgaagtttctacctagccgactgaggaagctggaccctgaagaagaggacgactcattcaataactacgaggtacaaagcgaagctaagctggagagcttcccttccattggccctcagcgactctcttttgattccgctacgtttatggaatcggagaaacaggatgtgcatgagtttctcctagagaacttgaccaacggcgggatactggaactgatgatgaggtatctcaaggcaatgggacataaattcctcgttaggtggcccccaggcctggcggaggttgtcctgtcagtctaccatagttggcgaaggcatagcacgagtctgcctaatcccctgctccgagactgcagtaataaacatattaaggatatgatgttgatgagcttgagttgcatggaactgcagcttgaccagtggctccttacgaaaggacgctcctcggccgttagtccgcgaaattgccctgcaggcatggttaatggcaggtttggcccggacttcccaggcactcattgtctgggagacttgcttcagttatcatttgccagtagccaaagagacctgttcgaggacggctggctggaattcgttgttcgcgtttactggttgaaagcccgattcctggccttacagggggatatggagcaggccttagaaaactatgacatttgcacagagatgttgcaatcttcaaccgcaattcaagttgaggctggtgctgaacgaagggatattgtcatacgacttcctaatctgcacaacgattccgtagttagcctggaagagatcgataagaacctgaaaagtctggaacggtgccagtctctggaagagatccagcggctctacgaggccggcgattataaggccgtagtacacctcctgcgccctactttgtgtactagtgggttcgatagagccaaacatctcgaattcatgactagcatccctgagaggcccgcccagctgctcctgctgcaagatagcctcctgaggttgaaggattatcggcagtgttttgagtgcagcgacgtggccctgaacgaagcagtgcagcagatggtgaattcaggcgaggcagcagcaaaagaagagtgggtagccactgtgacccagctgttaatggggatagaacaagccctttctgctgatagctcaggttcaatcctcaaggtgtcttccagtacaactgggctggtgcgcttaaccaacaatctcatacaggtgatcgactgctccatggctgtgcaagaagaggcaaaagaaccccacgtaagctccgtgctgccttggataatcttacaccggatcatttggcaggaggaggatacctttcactctctgtgccaccagcagcaacttcagaaccccgccgaagagggaatgagcgagactccgatgctacccagttcgctgatgctcctcaacacagctcacgaatatttagggaggcgttcttggtgctgcaactcagacggtgctcttctgcggttttacgtgagggttcttcaaaaggagctggccgcttccacaagtgaggacacgcacccttacaaggaggaactagagactgcgttggaacagtgcttttactgtctctatagcttcccttcgaaaaagagcaaagcgaggtatctggaggagcacagtgcacaacaggtggaccttatttgggaggatgctctgtttatgttcgagtatttcaaaccaaaaacacttccagagtttgatagctacaagacctctacagtgagcgccgatctggctaacctcttgaagaggatagccacaattgtccctcggaccgagcggccagcactgagtctggacaaggtttcagcatacattgagggaaccagcacagaggtcccgtgcctcccagagggagcggacccatcgccacctgtggtgaatgagttgtactatctgcttgcagactaccattttaaaaataaagagcagagcaaggccattaagttctacatgcatgatatttgcatctgccctaacaggttcgattcctgggcaggcatggcactcgctagggcatcccgcattcaagacaaactgaactcgaacgagctcaaaagcgacggacccatttggaaacacgccacccccgtcctgaactgctttcgaagagccctggagatagatagctccaatctttcactgtggattgaatacggaacaatgagttatgccctccactctttcgcctctcgccaactgaagcagtggcgtggcgagctgccccccgaactggtacaacaaatggagggccgaagagactccatgttggaaaccgccaaacactgcttcacttcagcggcccggtgtgagggtgatggcgatgaagaagagtggttgatccactacatgctgggtaaggtggccgagaagcagcagcagccgcccacagtctacctgcttcactatcggcaggcaggccactatctccacgaagaagctgctcggtatcccaagaaaattcattatcacaatccccccgaactggccatggaggcactggaggtgtattttagactccacgcaagtatcttaaaactcttggggaaacctgacagcggggttggcgcagaagtgctggtaaacttcatgaaggaagccgctgagggcccttttgctcgcggagaggaaaagaacaccccaaaagcctccgagaaagaaaaggcgtgtcttgtggacgaggactctcattcgagcgcggggactctgccgggcccaggcgcctcactgcccagctcctccggtcccggccttacttcgcctccttatacggccacacctattgaccacgattatgttaaatgtaaaaagccccatcagcaggctacacctgacgataggagtcaggactcaaccgcggtggccctttcggatagttctagcactcaggatttctttaatgagcctacctcccttttggaagggagcagaaagtcctataccgaaaagaggctccctatcttatcttctcaagctggggctacagggaaagacttgcagggtgccacggaggagcgaggtaagaatgaagagtctctggagtctactgagggtttcagagccgcagagcaaggggtccagaaaccagcagctgaaactcccgccagtgcttgtatccctggcaagcctagtgcaagtacccctacactgtgggatggcaaaaagaggggcgacctcccaggtgagccggtggcttttccccagggcctgcctgcaggcgctgaggaacagaggcagtttcttacggaacaatgcattgcgtcattcaggctttgcctgtctagattcccacagcactacaagagtctctatagactagcctttctatacacttattctaaaacccatcgaaatttgcagtgggcaagagacgtgcttctggggtcatcaatcccttggcagcagctgcagcatatgcctgcacagggccttttctgcgagcgaaataagacaaattttttcaatggtatttggagaatccctgtcgacgaaatagataggccaggatcatttgcttggcacatgaatcggtccatcgtgcttctattgaaagtgttggcccaactgagagaccactcaaccctgctgaaggtcagctccatgttgcaacgaaccccagaccagggcaagaaatacctcagggacgccgaccgacaagtactcgcacagagagctttcatattgacggtgaaagtgttggaggatacgctgagtgaactcgcagaagggtccgaacgccctgggccaaaagtatgcggactgcccggggcaaggatgaccactgacgtttctcataaagcctcacctgaagatggacaggaagggctgccgcagcccaaaaagcctcctttggctgacggaagcgggcccggtccagagcctggcgggaaagtggggttgcttaaccacagacccgtagctatggacgcaggagacagcgccgatcagtctggcgaacggaaagacaaggaaagtccacgggctggcccaactgagcctatggatacaagcgaggctacagtgtgccattccgatctcgaacggacgcctccactcctgcctgggcgtcccgcaagggatcgaggacctgagtccaggccaaccgagctatcactggaggagctgagtataagtgccaggcagcagcccactccactgacccctgcacagccagcacctgcgccagcaccagcaactacaacggggaccagagccggcgggcatcctgaggagccactttccagattgtcacgcaaacgcaagctgctcgaagataccgagtcgggcaagacccttctcctggacgcgtatagagtgtggcagcagggccagaagggggtggcatacgatctggggcgggtcgagagaatcatgtcggaaacatacatgctgatcaaacaagtcgatgaggaggccgcattagagcaggccgtgaaattctgtcaggtgcatttaggtgctgcagcccagcggcaagcctctggcgatactcctactacacctaagcaccccaaggactcaagagaaaacttttttcctgttactgttgtgcccacggctcccgatcccgtccctgccgacagcgtgcagagaccgtcagatgcccacactaagcccagacctgcattggccgcagccaccacaatcatcacctgtcctccaagtgcaagcgcatctaccttggaccaaagcaaggatcccggcccaccgagaccccaccgccctgaggctaccccctctatggcatcgctcgggccagagggcgaggagctggctagagtcgcagaaggtacttctttcccaccccaggaacccaggcactcacctcaggttaaaatggccccaacatctagtcctgcggagccgcattgctggccagccgaggcagctctcgggaccggagctgaaccgacctgttcccaggagggcaagctgcgccccgaaccccgacgggatggggaggcccaggaagcagcttccgaaactcagcctctgtcgtcacctcccacagcagcctcctctaaggcaccttccagtggaagcgctcagccacctgaaggtcacccaggcaagccagagccctcccgggccaagagccgtcctctccccaatatgcctaagttggtgatcccctcagccgccaccaaattccctcctgagattactgttacgccacctaccccgactctcctgagtccgaaaggcagcatcagcgaagaaactaaacagaagctgaagagcgccatcctgtccgcacagagcgccgccaacgtccggaaggaatccctctgtcaaccagctctggaggtcctcgagacttccagccaggagtcctccctggaatcggaaactgacgaggacgacgattatatggacatctag

SEQ ID NO: 181104 - DNA, 6663 bp, Artificial Sequence
  Description of Artificial Sequence: Synthetic coding sequence
atgatccggatcgccgccctgaacgccagcagcaccatcgaggacgaccatgagggtagttttaagagtcataagacacagacaaaggaagcccaggaggcagaagcgttcgctctgtatcacaaagcccttgatctgcagaaacatgacagattcgaagagtctgctaaggcgtatcatgagctcttagaggcatcacttctgcgagaagctgtgtcatcaggtgatgaaaaagagggactgaaacacccaggacttatcttgaagtactccacctataagaaccttgcccaactcgccgcgcaacgtgaggacctggagaccgcaatggaattttatctggaagctgtgatgctagatagtacagacgtcaacctgtggtacaaaatcggtcacgttgcgttacgcctgattagaatccctctcgcaagacatgcgttcgaggagggcctaaggtgtaacccggatcattggccatgtcttgacaacctcattaccgtcctctatacactttcggattacactacttgcctctatttcatatgtaaggccttggagaaagactgccgttactccaaggggcttgttttaaaggagaagatatttgaggagcagccatgcctgcgcaaagattccctgaggatgttcttaaaatgtgacatgtccattcatgacgtgagtgtctccgctgcagagactcaggcaattgtggacgaggctcttgggcttagaaaaaagcggcaagccctgatagtcagggaaaaagagcccgacctgaaactggtacaaccaatccccttctttacctggaagtgcttgggggaatccctgctggccatgtataatcacctcactacctgtgaacctccgcggccttccctggggaaacgtatcgaccttagcgactatcaggatccaagtcaacccttagaaagctccatggtggtgacgccagttaatgtgatacagccaagcacagtgtctactaaccccgcggtcgcagtcgccgagcccgtggtaagttatacatctgtggccaccacttccttccccttgcactctccgggcctgcttgagactggagcaccggtgggcgacatttccgggggagataagagtaagaaaggagtgaaaagaaagaagatcagcgaagaatctggagaaacagccaagcgcaggtccgcaagagtgcggaacacgaaatgcaaaaaagaagagaaagtggattttcaggaactactgatgaaatttttgccatctaggctccgaaagctggatcctgaagaggaggatgattcattcaacaactacgaggtgcaatctgaggcgaagcttgagtcattcccaagtattggacctcaacggttaagttttgactcagcaacatttatggagagcgaaaagcaggatgtgcatgagttcctgctggaaaatctgactaacggggggatcctggaacttatgatgcggtatctgaaggccatgggacacaagttcttggtacggtggccccccggccttgccgaagttgtactgtccgtgtaccactcttggcggaggcactctaccagcctacctaatccattgcttcgtgactgctcaaataagcatataaaggatatgatgctcatgtctctctcttgcatggaactacagttagaccagtggctgctaacgaagggacggtcatctgcggtaagtccaagaaactgccctgccggtatggtgaatggtaggtttggcccagattttcccggaactcattgtttgggcgacctcctgcagctgtcgtttgcctcctctcaacgcgatctttttgaagacggatggctggagtttgttgtgcgtgtatattggctgaaagcccgattcctagcgctccaaggggacatggagcaggccctcgagaattacgacatttgtaccgaaatgctacagtccagcacggccatacaggtcgaagcgggagcagaacgccgggatatagtcatccggctgcccaacttgcacaacgattcagtggtgtctctggaggaaatcgacaagaacctaaaatccctggaacgatgccaatctctggaggaaatccaacgtctctatgaggcaggagactataaagccgtcgtacacctgttgaggcccaccctgtgcacctccggattcgacagagctaagcacctagagttcatgaccagcataccagaaagaccagcccagctgctgcttctacaggattcattgctacgcctgaaggactaccgacagtgttttgaatgttcagacgttgcccttaatgaagccgtgcagcagatggtgaattccggtgaggcggccgcaaaagaggaatgggtggcaaccgttacccagttgttgatgggcattgagcaggctctgtctgccgattccagtggttccatcttaaaggtcagcagctcgacaaccgggctggtgaggctcaccaataacctgattcaggttatcgattgtagtatggccgtacaagaagaggctaaagagccccacgtctctagtgtgctaccctggattatactgcacagaatcatctggcaggaagaagacactttccacagcctttgccaccaacagcagctgcagaaccctgccgaggagggaatgtctgagacaccgatgctgccaagtagtttgatgttactgaataccgcgcacgagtatcttggccgccgtagctggtgttgtaatagtgacggggccttgcttaggttctatgtgcgcgtgctgcaaaaagaacttgctgcgtctaccagcgaggacacccatccctataaagaagaactggaaacagccctggagcagtgtttctattgcctgtatagttttccttctaagaaatctaaagcgcgatacctagaggagcattcagctcagcaagttgacttgatctgggaagacgccctgtttatgttcgagtacttcaaacccaaaactctgccggagtttgatagttataagacctctaccgtcagcgccgatttggctaacctgttaaagagaatagccacaattgttcctcgaacggagcgccccgcactgtctttggacaaggtgtctgcgtacatcgagggtacatctaccgaggtaccgtgcctgcccgagggcgccgatccatccccgcccgtggtgaacgagctgtactatctactcgccgattaccattttaaaaataaggaacagtcaaaagctatcaagttttacatgcacgatatctgcatctgtccgaaccgtttcgacagctgggccggaatggcactggcccgagcctctagaattcaggataagctgaactccaacgaattgaaaagcgatggccccatctggaagcatgccacaccagtcctaaattgctttcgcagagcgctggagatcgactcaagtaacttaagtttatggatcgagtacggaaccatgagctatgctttgcattcctttgcctcccgccagctgaaacagtggcggggtgaacttcctccagagttggtgcagcagatggaggggcgccgggattctatgctggagaccgcaaagcactgctttacatccgcagcccggtgcgagggtgacggcgatgaagaggaatggctgatccactacatgctaggtaaggttgcagagaagcagcaacagcccccaacagtctaccttctgcactacagacaagctggacattatctccacgaggaagccgcacgttaccccaagaagatccattatcacaacccccccgagctggccatggaagctttagaggtctacttccgtttgcacgcaagcatacttaagctcttgggcaagccagattccggggtgggtgccgaggtgctggtgaactttatgaaggaagccgccgagggcccttttgcacgtggcgaggaaaaaaatacgccaaaggctagcgaaaaggaaaaggcctgcctggtggatgaagactctcactcctctgcagggacgctgcccggcccaggcgccagcctcccttcttcttctggtcccgggttaaccagccctccatacactgctacgcccatcgatcacgactacgttaagtgtaagaagccacaccagcaggcaacccctgatgaccggagccaagattccactgcggtggccctgtcggattccagctctactcaagacttcttcaatgagcccacatccctgctggaggggtccagaaagtcatacaccgagaaaagattacccatcctgagtagtcaggcgggggctactggcaaggatttgcagggagctacagaggagaggggcaagaatgaggaaagcctcgagtctaccgaagggtttcgggccgcggagcagggggtccagaaacctgccgccgaaacgccagcatcagcctgtattcccgggaagccatcagcttctacacctaccctctgggacgggaaaaagcgaggcgatttgcccggtgaacctgtggccttccctcagggcctgcctgcaggagcagaggagcagaggcagtttttaactgaacagtgtatagcctcatttaggttgtgcctctcgcggttcccgcagcattacaagagcctttatcgccttgctttcctgtacacatattctaagacccaccgaaatttgcagtgggcccgggatgtgcttctgggcagctccattccttggcaacagctgcagcacatgccagctcaagggctattctgcgaaagaaacaaaaccaatttctttaacggcatctggagaattcccgtggacgaaatcgatcgcccgggttcttttgcgtggcatatgaatcgaagcattgttctacttttgaaagtcctggcacagctgagggatcactccaccctgctgaaagtctcaagcatgctgcagcggacccctgatcaaggcaagaaatacctgcgggacgctgacaggcaagtgctggcacaacgggcatttatactgacagtgaaagtcctagaggatactctgtctgagctcgccgaggggtccgagaggcctgggcctaaggtgtgcggactgcccggcgctcgcatgactactgatgtgagtcacaaggcctctccagaggatggacaggagggactccctcagccaaagaagcctcctctcgccgatggctcaggcccaggaccagagccaggggggaaggtgggccttctgaatcaccgtcccgtggctatggacgcaggcgatagcgctgaccaatccggagaacgtaaggataaggaatcaccacgcgcaggccccactgagcccatggacacgagtgaagcgactgtatgccactctgatctagagcgtacccctcccctgttgcctggccgcccagctagggatcgcggtccagagtcaaggccaacagaactgtccctggaagagctttccatcagcgccaggcagcagcccaccccactgacccccgctcaaccggccccagcgcccgcaccagccactaccacggggacacgggcagggggtcatccggaagaacctttatctagactgtcccggaagagaaagctcctcgaggacactgagtccggcaagactctactactggatgcctatagggtgtggcagcaagggcagaaaggtgtggcctatgacttgggacgcgtggagaggatcatgtccgagacctatatgctgattaaacaggtggacgaggaagctgcgctggagcaggctgtcaagttttgccaagtccacctgggtgccgctgcacagcgacaggcgtccggcgacacgccaacgacccctaaacatccgaaagactcaagagagaacttctttcccgtgactgttgtcccaaccgctccggaccccgtgcccgctgactccgtgcagcggccttccgatgcccatacaaagcctagacccgcactcgccgctgcgacaaccatcatcacctgcccccctagcgcgagcgcctccacattggatcaatcaaaagacccaggtcccccccggccacaccgtccagaggcaactccaagcatggcttctctcggacctgaaggagaagaactagcgcgggttgcagagggtacgtcttttcctcctcaggagccacgccattcaccacaggtgaaaatggcacccactagttctcctgccgaaccccactgctggccggccgaagctgctctggggaccggcgctgaaccaacctgcagtcaggaagggaaactgcggcctgagccaagacgagacggggaagcacaagaagctgctagcgagacacagcctctgagttcacctccaactgccgcctcatctaaggctccttcaagcggttctgcccaacctcccgaaggccacccgggtaaacctgagccatcaagggccaagtcacgcccccttcctaacatgcctaaactcgtaatcccgtcagctgcaacgaagttccctccggagatcactgtaactccaccaacccccactctcctgtccccaaagggttctatcagcgaagagacaaagcagaagctgaagtctgccatcctgtctgcacagtccgccgcaaacgttcgaaaggagtctttgtgtcagcccgccttagaagttctggagacatcatcacaggaaagttcccttgagtctgaaaccgatgaagacgatgactatatggacatatag

SEQ ID NO: 181105 - DNA, 1770 bp, Artificial Sequence
  Description of Artificial Sequence: Synthetic coding sequence
atgccccggcggagccggcggggcatctggcggatccccgtggacgaaatcgatcgacctggcagcttcgcctggcacatgaaccggtcaatcgttcttctactgaaggtgctagctcagctgagagatcattctactctgctcaaggtttcctccatgttgcaaaggacacccgaccaggggaagaagtaccttcgcgatgcagaccgtcaagtgttggctcaaagggcctttatcttgactgtaaaggttttagaggataccctcagtgagctagccgagggcagcgagagaccggggccaaaggtctgcgggctaccaggggcccgtatgacaaccgacgtgagccacaaggccagcccagaggacggccaggagggcttgccacagccaaaaaaaccgcccctggccgacggctccgggcctgggcccgagcctgggggtaaagttggcctcctgaatcaccgacctgtggcaatggatgccggtgattctgccgatcagtctggagagaggaaggataaggagtccccaagggccggaccgacggaaccaatggacacctcagaggcgacagtctgccactcagacctggaaagaacccctcctctgctccccggccgccccgctcgcgaccgcggccctgagtccaggcctactgagctatccctcgaggaactgagtatttccgcacgccaacagccaaccccactgacccctgcccagccggccccagccccggcccccgctacgactaccggaacacgggcaggtggacatccagaggagcctctcagccgcctctcaagaaagcgcaagctgctggaagataccgaaagcggaaaaactctcttgctggacgcctatcgagtctggcagcagggacagaagggcgtggcttatgatttgggccgagtagaacggataatgtctgagacctacatgctgataaagcaggtagacgaagaggctgcccttgagcaggctgtgaagttctgtcaggtgcatctcggactaccaccacgggatcggccacgtgatacgccaactactcccaaacatcccaaagattcccgagagaacttcttcccagtgactgttgtaccaaccgcccctgaccctgtgccagcagactcagtccagagaccaagtgacgcacacaccaaacccaggcccgccctggctgcggccaccacaatcatcacatgccctccctctgctagtgcctctactttggatcagagcaaggatccgggcccccctagaccccaccgtcctgaggctaccccgtctatggcaagtttgggccccgagggcaaactgcgccccgagccccggcgtgacggtgaggcccaggaggcagcgtccgagacccagcctctgagttctccgcctaccgcagcttcctctaaagccccatcatccggaagcgctcagccgcctgagggccatcccggcaagcctgagccatcacgcgcaaaatcccgcccgctccctaatatgcccaaactggtgatcccttccgccgcgaccaagttccctcccgaaatcacggtcaccccccctaccccaactctcctgagtcctaagggttctatctccgaagagaccaagcagaaactgaagtctgctatcctctcagcccagagcgctgcgaacgtcagaaaggagtcactctgtcagccggctctggaggtgctcgagacgagttcccaggagagctcactggaatcagagacggatgaggacgatgactacatggatatctag

SEQ ID NO: 181106 - DNA, 1224 bp, Artificial Sequence
  Description of Artificial Sequence: Synthetic coding sequence
atgatccggatcgccgccctgaacgccagcagcaccatcgaggacgaccacgagggttcttttaaatcgcacaagacccagaccaaggaagcacaggaggccgaggcctttgccctatatcacaaggccttggatctgcagaagcacgatcggttcgaagaatcggccaaagcctaccatgagctcctggaggccagcctcctgcgtgaggccgtatccagcggggacgagaaagagggccttaaacatcctggcctgatcctcaaatactcaacctataaaaatctggcacaacttgctgctcagcgtgaagacttagagactgcaatggagttttacctcgaagctgttatgctcgacagcaccgacgtgaacctgtggtacaagatcggtcacgtagctctcaggctaatccgtattccgctcgcccgacacgcatttgaagaaggccttcgctgtaacccagaccattggccgtgcttagataacttgatcaccgtgctgtacacgctctccgattacacgacttgtctatatttcatatgcaaggcactcgagaaagattgtcgttattcaaagggactggttctaaaagagaaaatctttgaagagcagccttgtcttagaaaggattcactacgtatgttcttgaagtgtgatatgagcatccacgacgtttccgtttcagccgccgaaacccaagccatcgtggatgaggccttagggcttcgtaaaaagcgccaggcgcttatcgtgagagagaaagagcctgatctgaaactcgtgcagcctatccccttcttcacttggaaatgcttgggagagtctctgctggcaatgtacaatcaccttaccacttgcgagcctcctcgtcccagtttgggaaagcgaatcgacttaagcgattaccaggaccctagccagcctctggagtcaagcatggtagtcacacctgtgaacgtgattcaaccatcaactgtgtctaccaatcccgccgtggctgtggccgaacccgtggtttcatacacttcggtggcaaccacgtccttcccactgcattctcccgggctgttggagaccggagcaccggtgggcgacatatctgggggggacaaatcaaaaaagggcgtgaaacgcaagaaaattagcgaagaaagcggggagacagccaagagacgctccgcccgcgtgcggaacaccaagtgtaaaaaagaggaaaaatag

SEQ ID NO: 181107 - DNA, 1527 bp, Artificial Sequence
  Description of Artificial Sequence: Synthetic coding sequence
atgcagttcagcggcgagaagatcagcggccagcgggacctgcagaagtcaaagatgcggttcactttcacctctagatgcctcgcactgttcctcctcctgaaccatccgactccaatactccccgccttctccaaccagacataccctacaattgagcctaaacctttcttatatgtggttggaaggaaaaagatgatggacgcccagtacaaatgttatgatcgcatgcagcagctgcctgcgtaccagggagagggtccctactgtaacaggacatgggacggctggctgtgctgggatgacacccccgctggagtgctgagctaccaattctgccccgattactttcctgacttcgatccatccgaaaaggtgactaaatactgtgatgaaaagggtgtttggtttaaacacccagaaaataaccgcacatggagtaattacacgatgtgcaacgccttcacacccgagaagttaaagaatgcttatgtactgtactatttggccattgtaggacactcactgtctatctttacccttgtcatttctttgggaatcttcgtcttcttccgcaagttgactacgatttttccgctgaactggaagtacagaaaggctctgtcgctgggctgtcagcgagtgaccctgcataagaacatgttcctgacttacatcttgaattccatgattattattatccatctcgtagaagtggtccccaatggcgagctggttcgcagagatccggtctcttgtaaaatcctacacttctttcatcagtatatgatggcgtgcaattacttttggatgctgtgtgaaggaatatacttgcatacgttgatagtcgtggccgtattcactgagaaacagcgacttcgctggtactatctcctgggctggggcttccccctagtgccaactactattcacgctattaccagagctgtatattttaatgataattgctggttatctgtcgagacccacctgctgtacattattcacgggccagtcatggctgctctggtggtcaacttcttttttttgctgaatatcgtgagggtactcgtaaccaagatgcgcgaaacccacgaggcagagagccatatgtatctcaaagcggtcaaggcgacaatgatattagtgccccttctaggcattcagttcgtcgtgttcccttggcgtccatctaacaagatgttgggcaaaatatatgattatgtgatgcactccctgatccactttcaggggttctttgtcgccacaatttactgtttctgtaataacgaggtccagactaccgtgaagaggcagtgggcccaatttaaaattcagtggaaccagcgctggggcaggcggccatccaacaggtcagccagagctgctgctgccgcagccgaagccggcgatataccgatctatatttgccatcaggaactgcggaatgaacccgctaataatcaaggcgaggagtcagcggagattatcccccttaacattatcgagcaggagagctcagcatag

SEQ ID NO: 181108 - DNA, 1473 bp, Artificial Sequence
  Description of Artificial Sequence: Synthetic coding sequence
atgcggttcaccttcaccagccggtgcctggccctgttcctgctgctgaaccaccctactcctatcctccctgcatttagtaaccagacgtatcctacaattgagcccaaacctttcctgtatgttgttgggaggaaaaagatgatggacgcacagtataaatgttacgaccgcatgcaacagcttccagcgtatcagggtgagggtccatactgcaacaggacatgggacggatggctctgctgggatgatacccctgctggcgttctgtcttaccagttttgccctgactattttcctgattttgatccaagtgaaaaagtaactaagtattgcgatgagaaaggggtgtggtttaagcatccagaaaataatcgaacatggtcgaattatacgatgtgcaacgcgtttacacctgaaaagctgaaaaacgcttacgtgctctattacctcgccatcgtagggcacagtctgtcaatttttactctcgtgatcagcctggggatattcgtattcttccggaagctcaccacaatctttcctctgaactggaaatatcgcaaggccctatcccttgggtgccaacgcgttacccttcataagaacatgttcttgacgtacattctgaactcaatgatcattattatccaccttgtagaggttgtacctaacggggaattagtgaggagagatcccgtctcttgcaaaatcttacattttttccatcagtacatgatggcatgtaactatttctggatgttgtgcgaaggaatatacctccatactctcatagtggtcgctgtgtttaccgagaagcaacggctgcggtggtattacctgctcggctggggtttcccactggtgcctaccaccatacacgccattactcgcgcggtctactttaatgacaactgttggttgagtgttgaaacccacctactgtatataattcatggccccgtcatggctgccctggttgttaattttttttttcttctaaatatcgtgcgagtgctggtgactaagatgcgggagacccacgaggccgaaagtcatatgtatctgaaagccgttaaggcgacaatgatcttggtgcccttactgggaatccaattcgtggttttcccctggaggcccagcaataaaatgcttggcaagatctacgattacgtgatgcatagtctcatccactttcagggatttttcgtggctacgatatactgcttctgtaataatgaggtgcagacaacagtgaagcgccagtgggcccagttcaaaatccagtggaatcaacgatggggacgcaggccaagtaacagatctgcacgggctgctgcagccgccgccgaggctggagacatccccatttatatttgtcaccaggagctgcgtaacgaaccggcaaacaatcagggggaagaaagcgctgaaatcattccgcttaatattattgagcaggagagtagcgcatag

SEQ ID NO: 181109 - DNA, 1425 bp, Artificial Sequence
  Description of Artificial Sequence: Synthetic coding sequence
atgcggttcaccttcaccagccggtgcctggccctgttcctgctgcttaaccatccaacacctattctgccagctttcagtaaccagacctatcccacaatcgaacccaaaccgttcctatacgtcgttggcaggaagaaaatgatggatgcccaatacaagtgctacgatcggatgcagcagttgccggcatatcagggcgaggggccctactgtaatagaacttgggacggctggctatgctgggacgatacccccgcaggcgtgctgtcatatcagttttgtccagattacttccctgatttcgacccttctgaaaaggtcaccaaatattgtgatgagaagggggtctggttcaaacatccagaaaataaccgcacctggtccaattacactatgtgtaatgcgtttacccctgagaagctgaagaatgcctatgtactgtattatctcgcgatcgtgggccactctttgagtatattcactctcgtcatcagtctgggcatttttgtcttcttccgctccctaggttgtcagagggtaaccctacacaagaacatgtttctgacatacattctgaattcaatgattattataattcatttagtcgaggttgttcccaatggcgagctggtccgcagagacccagtgagttgtaagattctgcacttcttccatcaatacatgatggcctgcaattatttctggatgctgtgcgaaggcatctatttgcatacgttgatcgtggtggctgtattcacggagaagcagcggcttcggtggtactatctcctcggatgggggttccccctggtaccaacaaccatccacgcaatcacacgggctgtgtatttcaacgacaattgctggctgtctgtagagacccacctgctgtacatcattcatggaccggtgatggccgcccttgtggtgaacttcttcttcctgcttaacatcgtgagggtattagtgaccaagatgagggaaactcacgaggccgagagtcatatgtatctgaaagcggtcaaggcaaccatgattctggtgccattgctggggattcagtttgttgtgttcccctggcgtccatccaacaagatgctaggaaagatctacgattatgtgatgcacagcctcattcactttcaaggtttttttgtagctacaatctattgcttttgtaacaatgaggttcagacaaccgtgaagcgccagtgggcacaattcaagatacagtggaatcagcgatggggaaggagaccatccaaccgcagcgcaagagctgcagccgcagcagctgaggccggcgatatccccatctacatttgccatcaggagcttagaaacgagccagcaaacaaccaaggggaagagagcgccgaaatcatcccactgaacattattgagcaagagtcttccgcatag

SEQ ID NO: 181110 - DNA, 825 bp, Artificial Sequence
  Description of Artificial Sequence: Synthetic coding sequence
atgcggttcaccttcaccagccggtgcctggccctgttcctgctgctgaatcacccgacccccattctccccgctttttctaatcagacgtatcccaccatcgaacctaagccttttctctatgtggtcgggcgtaaaaaaatgatggatgcccagtacaagtgctacgatcgaatgcagcagctccctgcctatcaaggggagggcccgtactgcaaccggacgtgggacggatggctttgctgggatgatacgcccgccggtgtgctgtcctaccaattctgtcctgactattttcccgacttcgatccctccgagaaggtgacaaagtactgcgatgagaaaggcgtgtggtttaaacaccccgagaataatagaacatggtcaaactacacaatgtgtaatgccttcacccccgagaaactcaaaaatgcctatgttctctactatctcgccattgtaggacacagcctgtcaattttcacgctggttatcagccttggcattttcgtcttcttcagaagtctaggatgccagcgcgtgacactgcacaagaatatgttcctgacttacattctgaatagtatgatcataatcattcatctcgtggaagttgtgcctaatggcgagctcgttaggagagaccctgtgtcttgcaagatactgcacttttttcaccagtatatgatggcttgtaattatttttggatgctctgtgaagggatctacctgcacaccctgatcgtggtggccgtctttaccgagaagcagcggctaaggtggtattaccttttgggatgggccccagccttccaccgggactag

SEQ ID NO: 181111 - DNA, 1473 bp, Artificial Sequence
  Description of Artificial Sequence: Synthetic coding sequence
atgcggttcaccttcaccagccggtgcctggccctgttcctgctgttgaaccacccgacacctatcttgcctgccttctctaatcagacttaccccacaatcgagccaaagccattcctttacgtagtaggtcgcaagaaaatgatggacgctcagtataagtgctacgacaggatgcagcagctgcccgcttaccagggggaagggccgtactgcaaccgtacatgggacgggtggctatgttgggacgacacacccgcgggtgtgcttagttatcaattttgtcccgactactttccggactttgatccctccgagaaggttaccaagtattgcgacgagaaaggcgtctggttcaagcaccctgaaaacaacaggacctggtcaaattacacaatgtgcaacgccttcacgccagaaaaactcaagaatgcatatgtcctgtactacctggccatcgttggacattctctaagtatattcactttggtgatttctctgggaattttcgtgttttttcgaaagcttacaacgattttcccgttgaactggaaatatcggaaagccctgagcttggggtgtcagcgggttaccttgcacaaaaatatgtttttaacatatatcctgaactccatgattataatcatacacttggtggaggtggtacccaatggtgaactggtacgcagagaccccgtctcctgcaagatcctacacttcttccatcagtacatgatggcatgcaattatttctggatgctgtgtgagggaatctacttgcataccctgattgtggtggctgtctttactgaaaaacagagactccggtggtactacctcttgggatggggcttcccattggtacctacaacaatacacgcgatcacccgtgcagtctactttaacgataattgctggctcagcgtggagacccacctgctctatataatacacggcccagtgatggctgcgttagtcgtcaactttttctttttgctcaacattgtcagggtgctggtgaccaaaatgagggagacccatgaggctgagtcccacatgtatctcaaagccgtcaaggccacaatgattctggtgccactgctgggaatacaatttgtggtgtttccttggcgtccttccaacaagatgctgggtaaaatctacgactatgttatgcacagcctgatccactttcaaggattcttcgtggccacaatctactgtttttgtaacaacgaagtccaaacaaccgtcaaacgccagtgggcccagttcaagatccaatggaaccagcgctggggccggcggccctccaatcgcagcgcacgcgccgcagcagccgccgcagaagcaggcgacatacccatatatatatgccatcaggagctccgaaacgaaccagctaacaaccagggcgaagaatctgccgaaataataccactgaacattatcgaacaggaaagctcagcttag

SEQ ID NO: 181112 - DNA, 873 bp, Artificial Sequence
  Description of Artificial Sequence: Synthetic coding sequence
atgcggttcaccttcaccagccggtgcctggccctgttcctgctgctaaaccatccaacacccattctccctgcctttagcaatcagacctatcctacaatcgaacctaaaccctttctatacgttgttggcagaaaaaagatgatggacgctcaatataagtgttacgatcgtatgcaacagttgccagcctatcagggcgagggaccgtactgtaaccgtacctgggacggctggctttgttgggacgacaccccggccggagttctgagttatcaattttgtcccgattattttcccgatttcgacccaagcgagaaggtgacgaagtactgcgatgagaagggtgtctggttcaaacatcccgaaaacaatcgcacatggtccaactacactatgtgtaatgcatttacacccgagaagctaaagaatgcctatgtgctgtattaccttgcaatcgtggggcattctctgtctatctttaccctggtgatttctctcggaatcttcgtcttctttaggaagctgacaactatcttccctttgaattggaagtaccgtaaggccctatccctcgggtgtcagagagttacactgcataaaaacatgttcctgacatacattctcaattcaatgatcatcatcatccacttggtcgaggtcgttccaaatggcgagctggtgaggcgggacccagtctcttgcaagatcctgcatttcttccatcagtacatgatggcctgtaactacttctggatgctatgtgaaggaatatacttgcatacgctgattgttgtggccgtcttcactgaaaagcagcgtctgcgctggtactatctcctcgggtgggctcctgccttccatagggattag

SEQ ID NO: 181113 - DNA, 1425 bp, Artificial Sequence
  Description of Artificial Sequence: Synthetic coding sequence
atgcggttcaccttcaccagccggtgcctggccctgttcctgctgctaaatcaccctacccctattctgcccgccttctccaatcagacatatcccactatagagcccaagccgtttctctacgtggtaggccgaaagaagatgatggacgctcagtataagtgctatgaccgtatgcaacagttacctgcataccagggcgaaggtccatactgcaaccgcacctgggatggttggctgtgctgggatgacacccctgccggagtgctcagctatcagttctgtcccgactattttccagatttcgatccgtctgagaaagtaacaaaatactgtgatgagaagggcgtctggtttaagcacccagaaaataatcgcacctggagtaactatacaatgtgcaacgcgttcacacctgaaaaactgaaaaacgcttatgtcctctattacttagcaattgtcggccactccctgagcatttttacactagtgataagtctggggatcttcgtcttcttccgcagcctgggttgccaaagggtgactctgcacaagaacatgttcctcacctacatcctgaactcgatgatcatcataatacacttggtggaggtggtaccaaatggagagttagtgcgacgtgatcctgtgagctgtaagatcctgcacttcttccaccagtatatgatggcttgcaattacttctggatgttgtgtgagggcatctatctgcatactcttatcgttgttgctgtttttacggaaaaacagaggctgcgttggtactacctgctgggctggggcttccctttggtacctacaaccatccatgcaatcacccgcgcggtttattttaatgacaattgctggctatccgtcgaaacgcatctgctctatattatccatgggccagtgatggcggctttggtcgttaatttcttctttcttctgaatatagttcgggtcctggttacaaagatgagggagacgcatgaagccgagagccatatgtatctcaaggctgtgaaggccacaatgatacttgtgccgctcctgggaattcaatttgtagtctttccctggcgcccatcaaataagatgctcggaaaaatctacgattatgttatgcactcactaatacatttccaaggtttttttgttgccactatatactgcttttgtaacaatgaagttcagacgacggtcaaacggcagtgggcccagttcaaaatacagtggaaccagaggtggggcaggcgtcctagcaatagaagcgcccgcgccgctgctgcagccgccgaagcgggtgatatcccaatctatatctgccaccaggaactgaggaacgagccggccaataatcaaggtgaagagtctgccgagatcatccctttaaacatcatcgaacaggaatctagcgcttag

SEQ ID NO: 181114 - DNA, 489 bp, Artificial Sequence
  Description of Artificial Sequence: Synthetic coding sequence
atgcggttcaccttcaccagccggtgcctggccctgttcctgctgctgaatcacccaactcccatcctcccagccttctctaatcagacgtatccaacaatagaaccaaaaccctttctttacgtcgtcgggcgaaagaagatgatggatgctcagtataaatgttatgataggatgcagcaactgcccgcttatcaaggtgagggaccatattgcaacagaacttgggatggatggctgtgctgggacgatacaccagccggcgttttgagctatcagttttgccctgattattttccagatttcgatcccagcgaaaaggttacgaaatactgcgacgagaaaggcgtgtggttcaaacaccctgaaaacaatagaacatggtccaattataccatgtgcaatgcctttactcctgagaagttaaagaacgcctacgtgctatattatctggcgattgtgggccattcttgccagtttagcccatag

SEQ ID NO: 181115 - DNA, 1386 bp, Artificial Sequence
  Description of Artificial Sequence: Synthetic coding sequence
atggagaagaagtgcaccctgaacttcctggtgctgctgcccttcttcatgattttggtcacagccgagcttgaggagtcacctgaggactcaattcagctcggcgttactcgcaacaagatcatgacagctcaatacgaatgctaccagaagatcatgcaggatcccattcaacaggccgaaggcgtgtattgtaatagaacttgggatggatggctgtgctggaatgacgttgccgccggcacagaatccatgcagttatgtcccgattactttcaggattttgatccgtcggaaaaagtgaccaagatctgcgatcaagatggtaactggtttcggcatcccgctagtaaccggacctggactaattacacccagtgcaacgtcaatacacacgagaaggtgaaaactgccttgaacctgttttatctgacaatcataggccacggcctgtccattgcttcactgctaatctccctaggaattttcttttacttcaagagcctgtcatgccagcggattactctgcataaaaacttattttttagtttcgtgtgcaacagtgtggttacaattatccacctgacagctgtcgcaaataatcaagctctggtcgcaacaaatccagtctcttgcaaagtcagtcaattcatccatctgtatttgatgggctgtaactatttttggatgttatgcgaaggaatatacttgcataccttgatagtggttgcagtatttgcagaaaagcagcatctgatgtggtactatttcctggggtggggtttcccccttatacccgcctgcattcacgccatcgcccggagcctttattacaacgacaattgttggatttcatcggatactcacctcctgtacatcatccacggacccatttgcgctgctctcttggttaaccttttttttctgctgaatattgtgagagttctgataacaaagctgaaagtgactcatcaggctgagtcgaacctttatatgaaggcggtacgcgcgaccctgatcctcgtccccctgttaggcatcgaatttgtccttattccttggaggcctgaaggaaagatcgcagaggaagtgtacgactacattatgcacatcctgatgcacttccagggactgcttgtgtccaccattttctgttttttcaatggcgaggtgcaggctatcctgaggcggaactggaaccaatacaagattcagtttgggaattcattttctaatagcgaggcgctgaggagcgcctcttatacagtgtcaactatctcagatggacctggatactcccacgactgtcccagcgagcacctgaacgggaagagcatacacgatatcgagaatgttctgttaaagccggagaacctctacaactag

SEQ ID NO: 181116 - DNA, 1386 bp, Artificial Sequence
  Description of Artificial Sequence: Synthetic coding sequence
atggagaagaagtgcaccctgaacttcctggtgctgctgcccttctttatgattctcgtgaccgccgagctcgaggaaagtcccgaggatagcatccagctgggcgttacgcgcaacaagataatgaccgcccagtacgaatgctaccagaagatcatgcaggacccaatacagcaagcggagggcgtctattgcaacagaacttgggatgggtggctgtgttggaacgatgtggccgctggtacggagagcatgcagctctgtcctgattactttcaggacttcgatccttcggagaaagtgactaagatctgtgatcaggatgggaattggtttcgtcatccagccagcaataggacctggacaaactacacacagtgcaacgtgaacacacacgaaaaagtgaaaaccgctctcaacctgttctaccttaccattatcgggcacggcctgtcaattgcttcgctgctgatctcactgggtatttttttctacttcaagtccctgagctgccagaggattaccctacataagaatctgttcttttcattcgtgtgcaacagcgtggtcaccattatacatttgacggccgttgccaacaatcaggccctggtagccaccaatcctgtgtcatgcaaggtcagccagtttatccatctgtacctgatgggctgtaattacttctggatgctctgcgagggtatctacctccacacattaattgtcgtagcagtctttgctgagaagcaacatcttatgtggtattactttctagggtggggttttcccctaattcctgcctgtatccacgcaatcgctcgcagtttgtattacaatgataactgctggatctcatctgacactcaccttttgtacattattcatgggccaatctgtgctgcactgctggtcaatctctttttcctcttaaacatagttagagttctgatcaccaagctcaaggtgactcaccaggccgaatcaaatctgtacatgaaggccgtgagggccacccttatcttagtgcccttgctgggcattgaattcgtgctgatcccttggagacctgaagggaaaatcgctgaggaggtgtatgactatattatgcacattctgatgcatttccaaggtttgctggtgagcacaatcttttgcttctttaatggcgaggtccaggcaatccttcgccgtaactggaatcaatataagatccaatttggaaactctttcagcaactcagaagcgctgaggagcgcttcttacaccgtatccaccatctctgatggcccaggatactcccacgactgccctagcgagcacttgaatggcaaatcaatccacgacatcgaaaatgtgctactaaagcctgagaacctgtacaactag

SEQ ID NO: 181117 - DNA, 1386 bp, Artificial Sequence
  Description of Artificial Sequence: Synthetic coding sequence
atggagaagaagtgcaccctgaacttcctggtgctgctgcccttcttcatgatcctggtgacagccgagctggaagagtcacctgaagactccatacagctgggcgtgactagaaacaaaatcatgaccgcccagtacgagtgttatcagaagataatgcaggacccaattcagcaggctgaaggcgtatattgcaatcgcacttgggacgggtggctctgctggaatgacgtagccgcgggaaccgagtctatgcagctatgccctgattattttcaagattttgacccttccgagaaggtgacgaaaatttgcgaccaggacgggaattggtttcggcatcccgcaagcaatcgaacatggactaattacacccagtgcaatgtgaacacccacgagaaggtcaaaactgctctgaacctgttctatctcactattattggccacggtctgagtatcgcatctttgctgatctctctggggattttcttctactttaagtctctttcctgtcagcggatcacgctgcataagaatttatttttcagtttcgtgtgcaactccgtcgttacaattatacatctgactgccgtggccaataaccaggccttagttgcaacaaaccctgtaagctgtaaggtgtcacagtttatccatctgtatctgatgggctgcaactatttctggatgctctgcgaaggcatttatctgcacacactcattgtcgtggctgtgttcgctgagaaacaacacctgatgtggtattacttcctcggatggggcttccctctgatcccagcttgcattcatgccatcgcacgatccctttattataacgacaattgctggatctcgtccgatactcatctgttatatattattcacggtcctatttgcgctgcgctccttgtgaacctcttcttcttactaaacatagtgagggtactcatcaccaaattgaaagtaacgcatcaggctgagagtaatctgtacatgaaggccgtgagggccacactgattttagtgcccctgctgggcattgagtttgtcctaataccctggaggcccgaaggtaagatagccgaggaagtctacgattatattatgcatatactgatgcacttccagggtctgttggtgtctactatcttctgctttttcaatggggaagtacaggcgattttgcggagaaattggaatcagtacaagatccagtttggcaactcattttctaacagcgaggcgctccgatccgcatcgtacacagtaagcaccatttcagatggcccaggttatagccacgactgtccttcagagcacttgaacggcaaatcaatacacgatattgaaaacgtgctgctgaagcccgaaaacttgtacaattag

SEQ ID NO: 181118 - DNA, 114 bp, Artificial Sequence
  Description of Artificial Sequence: Synthetic coding sequence
atggagaagaagtgcaccctgaacttcctggtgctgctgcccttctttatgatcctcgtgacagctgagcttgaagagagccccgaagacagcattcagctcggcgtcacatag

SEQ ID NO: 181119 - DNA, 237 bp, Artificial Sequence
  Description of Artificial Sequence: Synthetic coding sequence
atggagaagaagtgcaccctgaacttcctggtgctgctgcccttctttatgattctggtcacagccgagctggaggagtcacccgaggacagcattcagctcggagtgaccaggaacaagattatgactgcccaatatgagtgttaccaaaagatcatgcaagacccgattcagcaggccgagggcgtgtattgtaataggacctgggatggttggctgtgttggaatgacgtgtag

SEQ ID NO: 181120 - DNA, 426 bp, Artificial Sequence
  Description of Artificial Sequence: Synthetic coding sequence
atgggcttccagaagttcagccccttcctggccctgagcatcctggttctgctgcaagctgggtctcttcatgcggcgccattcagatcggccttagagagtagtcccgccgatcctgccaccctctcagaggatgaagcaagattgcttcttgcagcactggtacagaattatgtccaaatgaaggctagtgaactggaacaagaacaggagcgggagggatcttctctggactctcctcggtcaaaacggtgcgggaacctctccacgtgtatgcttggaacatatactcaggactttaacaaattccatacattcccccagaccgccatcggagtcggggctcctggaaaaaaaagagacatgagcagcgacttggaaagggaccacagacctcacgtgtccatgcctcagaatgcaaactag

SEQ ID NO: 181121 - DNA, 426 bp, Artificial Sequence
  Description of Artificial Sequence: Synthetic coding sequence
atgggcttccagaagttcagccccttcctggccctgagcatcctggtactgctacaagctgggtcactccacgccgctcctttccgttcagcactcgaaagttccccagcggatcccgcgactctgtctgaagacgaggccagattgctgctggctgcccttgtgcagaactatgtacagatgaaggccagcgaattggaacaggagcaagagcgagaaggcagttccttagatagtccgaggagtaaacgttgtggcaatttgagtacatgtatgcttgggacatacacgcaagattttaacaagttccacacctttccccagactgcaattggcgttggagcacctggaaagaaacgggacatgtcttccgatctggagcgcgatcacagacctcataatcactgccccgaggagagtctgtag

SEQ ID NO: 181122 - DNA, 387 bp, Artificial Sequence
  Description of Artificial Sequence: Synthetic coding sequence
atgggcttccagaagttcagccccttcctggccctgagcatcctggtgctcctccaggctggatccctgcacgcagcgccgttccggtcagctcttgagtcttcgcctgccgatcccgctaccctgtccgaggacgaagctcgtctgctgcttgctgcgctcgtgcaaaattatgttcaaatgaaggcctctgaactggagcaggagcaagagcgcgaagggtcccggattatcgctcagaaacgcgcgtgcgatactgccacgtgcgtgacccatcgactggccgggctgcttagccggtctggaggagtggtgaaaaacaattttgttccgaccaatgtcggtagtaaagcatttggccgcaggagaagagacctccaggcttag

SEQ ID NO: 181123 - DNA, 426 bp, Artificial Sequence
  Description of Artificial Sequence: Synthetic coding sequence
atgggcttccagaagttcagccccttcctggccctgagcatcctggttctcctccaagccggctcacttcacgcagcaccgttcagaagtgccctggagagctctcctgcagatcctgccacattgagcgaggatgaagcccgattattgctcgccgctctggtgcagaactatgtacagatgaaagcatcagagttggagcaggaacaagagcgtgagggctcttcacttgactctcctcgcagcaagcgctgcggaaatctctcaacttgtatgttggggacttacacacaggactttaacaaattccacacttttcctcagacagccatcggggtgggggcacccggcaaaaagagagatatgagcagcgacctggagagggatcataggcctcatgtcagcatgcctcagaacgcgaattag

SEQ ID NO: 181124 - DNA, 387 bp, Artificial Sequence
  Description of Artificial Sequence: Synthetic coding sequence
atgggcttccagaagttcagccccttcctggccctgagcatcctggtcctgctccaggccggctctctgcacgctgcacccttcaggagcgccctggaaagcagccctgctgatcccgccacactctctgaggatgaggcgcgcctgttgcttgccgcactcgtgcaaaattatgtccagatgaaggcatcagaactcgaacaggaacaagagagagaagggtccagaatcatagcacagaagagggcttgcgacaccgcaacatgcgtaactcatcgcctggctggtctgctcagcaggagcggcggcgtggtcaagaataatttcgtgcccacaaatgtcgggagtaaggcattcggcaggaggagacgagacctgcaggcatag

SEQ ID NO: 181125 - DNA, 384 bp, Artificial Sequence
  Description of Artificial Sequence: Synthetic coding sequence
atgggcttccggaagttcagccccttcctggccctgagcatcctggtgctatatcaggccggaagtttacaggccgctccttttcggagcgccctggagtcaagcccagatccagctaccttatctaaagaggacgcccgcctactactcgcagctttggtccaagattatgtgcaaatgaaagccagcgagctgaaacaagaacaggagacacaagggtcatcatcagctgcccaaaaacgggcctgtaatactgctacttgtgttactcatcggctggccggtctcctgagtcggagtgggggcatggtgaagtctaatttcgtccccactaatgtcggctcaaaggcgtttgggagacgcaggagagatctacaagcatag

SEQ ID NO: 181126 - DNA, 417 bp, Artificial Sequence
  Description of Artificial Sequence: Synthetic coding sequence
atgaagaaggaggccaacctgcagcggggcggcatgggcttccggaaattcagccctttcctggctctgtccatcctggtgctttatcaggccggatcattgcaggctgcgccatttagatctgcgttggagtcttcacccgatcctgccactctaagcaaggaagacgcacggttgttgctggctgccctggtgcaagactacgtgcagatgaaagccagcgagttaaaacaggagcaagaaacacagggttcctcatcggcagcccagaaacgcgcctgcaacaccgcaacgtgtgttacgcatcggttggccggattactttcgcgtagcggtggaatggtgaaatctaatttcgtgcctacaaatgtgggcagcaaagcgtttggcaggaggaggcgggacttgcaagcctag

SEQ ID NO: 181127 - DNA, 384 bp, Artificial Sequence
  Description of Artificial Sequence: Synthetic coding sequence
atgggcttccggaagttcagccccttcctggccctgagcatcctggttctctaccaggccggttccctccaggccgccccgtttaggagcgcattggagtccagtccggacccagcaacactctccaaagaagatgcgaggttgctgcttgcggccctcgtgcaggattacgtccagatgaaagcctccgagctgaaacaagagcaagaaacccagggcagctcatctgccgcccagaaacgagcatgtaacacagcaacctgtgttacccacagactggccgggcttctgtcccgctccgggggtatggtaaaatccaatttcgtcccaacaaacgttggtagcaaggcatttggccggcgccggagagatttacaggcctag

SEQ ID NO: 181128 - DNA, 1206 bp, Artificial Sequence
  Description of Artificial Sequence: Synthetic coding sequence
atgcccgtgcagctgagcgagcaccccgagtggaacgagagcatgcattccctccgcatatcagtcggaggcctccccgtgctcgcgagcatgaccaaagcggctgacccgagattcagacccaggtggaaagtcattctgacttttttcgtgggcgctgccatcttgtggctgttgtgttcccacaggcctgctcctgggagacccccaacccacaacgcacacaattggcggctgggccaggcgcccgccaactggtacaacgacacctaccctctgtctccaccacagcggacccccgctggtatccggtacagaatagccgttattgccgacctcgataccgagtctcgggctcaagaggagaacacctggttctcatatctaaaaaagggttatcttacgttgtctgactccggtgataaggtggcggtggaatgggacaaagatcacggtgtgctcgagagccacttggcagaaaagggaagaggcatggagctgagcgatcttattgtgttcaacggtaagctgtattccgtggatgaccgcacaggagttgtttaccaaatagaaggatctaaggctgtgccgtgggtcatattgtccgatggcgatggcacagttgagaaaggcttcaaggccgagtggttagcagtgaaggacgagcgcctgtacgtgggaggcctgggcaaggaatggaccacaacgacgggcgacgtcgtgaatgaaaaccccgaatgggtgaaagtcgtgggctataagggctctgtagaccacgagaattgggtgagtaactataacgcactccgcgccgcagctggaatccagcccccaggttacctcattcatgaaagcgcttgctggtcagacactctccagcggtggttcttccttccacggcgcgccagtcaagagcggtactctgaaaaggatgacgaacgcaagggggccaatctgctgctcagtgctagtccagacttcggggacatcgccgttagccatgtgggagcagtggtgccaacgcacgggttttcttcttttaagtttatcccaaataccgatgatcagatcattgtggccctgaagtctgaagaagattccggccgagtcgcaagctacattatggctttcacactggacggccggtttctcctgcccgagactaagattggatccgtcaagtatgagggaatagaattcatctag

SEQ ID NO: 181129 - DNA, 1053 bp, Artificial Sequence
  Description of Artificial Sequence: Synthetic coding sequence
atgcccgtgcagctgagcgagcaccccgagtggaacgagagcatgcacagcctgagaattagtgtgggtggcctgccagtgttagccagtatgacaaaggccgctgaccccaggttccggcccagaagtccaccacagagaacaccagctggcatacggtataggatcgccgtgattgctgatctggacaccgagtccagggctcaggaagagaatacgtggttttcttatctcaagaagggttatctgacactgtcggatagtggagataaagtggcagtcgagtgggataaggatcacggcgttctggagagccacctggctgagaagggcagagggatggagctatctgatctgattgtttttaacggcaaactgtattctgtggatgacagaacgggcgtagtctatcagattgagggctctaaggctgtgccatgggtgatactctccgacggcgacgggaccgtggaaaagggcttcaaggccgagtggctcgctgtgaaagacgaacgcctttacgtcggaggtctgggaaaggagtggactacgacgacgggagatgtggtgaacgaaaacccggaatgggtgaaagttgttgggtataagggtagcgtggaccacgagaattgggtctccaactacaacgcccttagagccgccgctggcatccagcctcctgggtacctgattcacgagagcgcctgctggtccgacacactgcaacggtggttttttttaccacggcgagcaagtcaggagcgctactccgagaaggacgatgagcgaaaaggcgctaacctgctactgtcagcatctcccgactttggggatatcgcagtcagtcatgtgggggctgtggtccctacccacgggttctcatcgttcaagttcatacctaacactgacgaccagataatagtggcacttaagagtgaagaagattctggtcgtgttgcctcttatatcatggcatttaccctggatggccgatttttgctccctgagaccaaaattgggagcgtaaagtatgaaggaattgagtttatttag

SEQ ID NO: 181130 - DNA, 1206 bp, Artificial Sequence
  Description of Artificial Sequence: Synthetic coding sequence
atgcccgtgcagctgagcgagcaccccgagtggaacgagagcatgcacagtctacgcatcagcgtcggaggtctcccggttttggcctccatgaccaaagccgccgatccaaggttcaggcctcgctggaaagtgatactgaccttttttgttggagccgctatcttgtggcttctgtgttctcatcgccccgctcccggacgacctccgacccacaatgcccataattggcggctgggccaggctcctgccaattggtacaacgacacataccctctttctcccccgcaacgcacccccgctgggatacgatacagaattgcagtgattgcagatttagacacagaatcaagggcccaagaggagaacacttggttctcctatctgaaaaagggctaccttacactctctgacagtggggacaaggtggccgtggagtgggacaaggatcacggtgtcttagagtctcacctggctgagaagggccggggtatggagctcagcgatctgattgttttcaatggaaagttatattccgtggacgacagaacaggagttgtgtaccagatcgaagggagcaaagccgtcccttgggtcatcctgagtgacggtgacggaacagtggaaaaaggattcaaggctgaatggctggctgtaaaggatgagcggctgtacgttggtggtttggggaaggaatggaccacaaccaccggcgacgtggttaacgaaaaccccgaatgggtgaaagtcgtgggctacaaggggtctgtggaccatgaaaactgggtaagtaactacaatgcactgcgcgcagctgccggaattcaaccacctgggtacctaatccacgagtcggcctgctggtctgacacgcttcagaggtggttttttctgccaagaagggcctcacaggagagatattctgaaaaagatgacgagcgcaagggagctaacctcctgctgtccgcctcacctgattttggagatatcgctgtctcccatgttggcgccgtggtgcctactcacgggttctcttctttcaaattcatcccaaacaccgacgaccaaatcattgtagccttgaagagtgaggaggattctggtagggtggctagttatatcatggcattcactttggacggaaggttcctgctgcccgagacgaagatcgggtctgttaaatacgaaggcatcgaattcatctag

SEQ ID NO: 181131 - DNA, 738 bp, Artificial Sequence
  Description of Artificial Sequence: Synthetic coding sequence
atgcccgtgcagctgagcgagcaccccgagtggaacgagagcatgcattccttgcggatctccgtgggtggcctgccggtccttgcaagtatgaccaaagccgcggatcctcgatttcggccgagatggaaagtgattctgaccttttttgtgggtgctgcaatattgtggcttctgtgtagtcatcggccggcacctggcagacctccgacacacaatgctcataactggcgactcggccaagcacctgctaattggtacaacgacacttatccattgagtccccctcagcggacacctgccggaattcgatacagaattgctgtgattgccgacctggacacagagagtagggcccaggaagagaacacatggtttagttacttgaagaaggggtatctgacactgagcgatagcggagacaaagtggccgtcgagtgggataaagatcacggcgtgctagaatctcacctggctgaaaagggtcgcggaatggaactatcagatctgatagtctttaacgggaagctgtattctgtcgatgatcggacgggggtggtctatcagattgagggatcaaaagccgtgccctgggtgattttgtcggatggcgatggaacagtagaaaagggcgtgggtggggagtgggaagcagtgagggaaatcgtgcgcaagcgctggcggctcgtgaagcaggtgagccacgtgggcgtcttgggccaatggatccagagatag

SEQ ID NO: 181132 - DNA, 663 bp, Artificial Sequence
  Description of Artificial Sequence: Synthetic coding sequence
atgggcaactgcgccaagcggccctggcggcggggccccaaggaccctcttcagtggctaggctccccacccagaggatcatgccctagcccaagtagctctcctaaagagcaaggcgaccccgcccccggagtgcagggctactccgtgttgaattccctggttggcccggcttgcatctttctacggccgtcaattgctgccacccaactggatagagaactgcgccccgaggagattgaagaacttcaggtggcattccaagagttcgatagagacagagatggttatatcggctgtcgcgaactcggagcctgcatgcgcaccttgggctacatgccgaccgaaatggagctgattgagatctctcagcaaatcagtggtggcaaggtggattttgaagattttgtagaactcatggggcccaaactgctggccgagacagccgatatgataggcgtaagagaattgagagacgcattccgtgagtttgacactaacggagacggtagaatttctgtgggggaactgagggcagctcttaaggccctgctaggtgaacgcctgtctcagagagaggtggatgagattctgcaagacgtggacctcaatggggacggcttggtggactttgaggaatttgttagaatgatgtccaggtag

SEQ ID NO: 181133 - DNA, 1026 bp, Artificial Sequence
  Description of Artificial Sequence: Synthetic coding sequence
atgcccttccccttcggcaagagccacaagagccccgccgacatcgtcaagaacctaaaggagagtatggccgtgctcgagaagcaggacatcagcgacaagaaagcagagaaggccaccgaggaagtgtccaagaacctagttgccatgaaagagatcctgtatgggacgaacgaaaaggaaccacaaacggaggccgtcgcccagttggcccaggaactatacaactcaggtctgctgagcaccctggtggctgatctgcagctgatcgatttcgagggaaagaaagacgttgcacagattttcaacaatatcctccgtagacagattggaaccaggacaccaacagtggagtacatctgcacacagcaaaacatcttatttatgttgctgaagggctacgaatcacccgagatagcactcaattgtggcatcatgctgcgcgagtgcatacgacacgaacccctggcgaaaatcattctctggagtgagcaattctacgacttttttcggtatgtggagatgagcaccttcgatatcgccagcgacgcttttgctaccttcaaggatttactgacgaggcataaactcctgtcagccgagtttctggaacagcattatgaccggttcttttctgaatacgagaagctgctgcatagcgagaattacgttacgaaaaggcagagcctaaaactcctgggggaactcctgctggatcgacataatttcacaatcatgactaagtacattagcaaacctgaaaacctgaagttaatgatgaacttactacgggacaagtcacgcaatatccagttcgaagccttccacgtctttaaagtgtttgtggctaatccaaataagacgcagcctattctcgacatcctgctgaagaatcaggcaaagctgattgagtttctgagcaaattccaaaatgacagaacggaagacgaacagttcaacgatgaaaagacatatctggtgaaacaaatcagggacctcaaacggcccgctcagcaggaagcatag

SEQ ID NO: 181134 - DNA, 1026 bp, Artificial Sequence
  Description of Artificial Sequence: Synthetic coding sequence
atgcccttccccttcggcaagagccacaagagccccgccgacatcgtcaagaatttaaaagaatctatggccgtgcttgaaaaacaggatataagcgacaaaaaggctgaaaaggccaccgaagaagtgtctaagaatcttgttgcgatgaaagaaattttatatggaaccaatgaaaaagagccacagaccgaagcagtcgcccaattagcccaggaactgtataatagcggtctgctatcaacactggtcgccgatctccagcttattgactttgaaggcaaaaaggacgtagcgcaaatctttaacaatatcctgcggagacagatcggcacacggacgcccacagtcgagtacatctgtacccaacagaatattctatttatgctgttgaagggctacgagagcccggagatcgcactgaactgtgggattatgctgcgtgaatgtatcaggcatgaaccacttgcaaagattattctttggagcgagcagttctatgacttctttcgatacgtcgaaatgagtacattcgatatagcgtctgatgcattcgcaacgtttaaggacctccttactcgacacaagctgctctccgctgaatttctcgagcagcattacgacagattcttttctgaatatgagaagctgcttcattcggagaactatgtaactaaacgccaatccctaaagctgctgggggagttacttctggacaggcacaattttaccatcatgacaaagtacattagtaagcccgagaatctgaagcttatgatgaacctgctgagagacaagtcccggaacattcagtttgaagccttccatgtcttcaaggtgtttgtggccaacccaaataaaacacagcccatccttgacattctcttaaagaatcaggcaaaactaatagaattcctgtctaaatttcagaatgacagaaccgaagacgaacaattcaatgatgagaagacctatcttgtgaaacagattcgtgacctaaaacgccctgcccagcaggaagcctag

SEQ ID NO: 181135 - DNA, 1026 bp, Artificial Sequence
  Description of Artificial Sequence: Synthetic coding sequence
atgcccttccccttcggcaagagccacaagagccccgccgacatcgtgaaaaatctcaaggaatccatggctgtgctcgagaaacaggacatctccgacaagaaggctgaaaaggccacagaggaggtgtcgaaaaacttagtcgctatgaaagagatcctgtatgggacgaacgaaaaagagccacagacggaggctgtcgctcaactagcccaggagctctacaatagcggtctattatctaccttagtggccgatctgcagctcattgactttgagggaaagaaggatgtggctcagatttttaataatatcctccggcggcaaattggaacccggactcccactgtggaatatatctgtacccagcagaacatactgtttatgcttctcaaaggatacgagtcacctgagatcgcactcaattgcggaatcatgctgagagaatgtatacgtcacgagcctctggctaagatcatcctttggtccgaacaattctatgatttcttcagatacgtcgaaatgtcaacttttgacatcgccagtgatgcttttgccacattcaaggacctactgacaaggcataagctgctttcagcagaatttctggagcagcattatgataggttcttttccgagtacgaaaagctgctccattcagagaattatgtcacgaaacgccagagcctgaagctgctgggtgagctcctgctggataggcacaatttcacaattatgaccaagtacattagtaaaccagagaatctaaagttgatgatgaatctgcttagagataagagcagaaacatccagttcgaggcatttcatgttttcaaggtttttgtggctaaccctaataaaacacaacccatcctcgatattctcttaaaaaaccaggctaaactaattgagttcttgtccaagttccagaacgatagaactgaagatgagcagttcaatgatgagaagacctacttggtcaagcagatccgcgacctaaaacggcctgcgcagcaggaagcctag

SEQ ID NO: 181136 - DNA, 1014 bp, Artificial Sequence
  Description of Artificial Sequence: Synthetic coding sequence
atgaagaagatgcccctgttcagcaagagccacaagaaccccgccgagatcgtcaagatcctcaaagataacttggctattctcgaaaagcaggataagaaaactgacaaggcttctgaggaagtgtcgaaaagtctgcaggccatgaaagaaatcctgtgcgggacaaatgagaaagagccacccaccgaggccgtggcacagttggctcaggaattatactctagtggactcttggtcaccttgatcgccgacctgcagctcattgacttcgaaggaaagaaggatgtgacccagatctttaacaacatactcaggcggcagatcgggacccgctcccccactgtagagtatatctcagcccatccccacatcctcttcatgctgttaaaaggatacgaggcgcctcagatcgcgctgcgatgcggcatcatgttgcgtgagtgcattcggcacgagccgcttgcaaagattatcttgtttagcaatcagttccgggactttttcaagtatgttgaattgtccactttcgacatcgcatcagatgccttcgcaacatttaaagacttgctcacccgccacaaagtgctggtggcggactttctggagcagaattatgataccatcttcgaagattacgaaaagctgttacaatccgagaactacgtaaccaaaaggcagtcactgaaactgctgggcgaactcatactagataggcacaattttgctataatgaccaagtacatttcaaaaccagaaaatttaaagctcatgatgaacctgctgcgcgacaaatcccccaatattcagttcgaagcattccatgtgtttaaggtgttcgtcgccagtcctcataaaacacagcctatcgttgagatcttactcaaaaatcaaccgaagctgattgagttcctgtcctccttccaaaaggagcgtactgacgatgagcagttcgcagacgaaaagaactacctgatcaagcagattagagacctcaaaaaaacagcgccctag

SEQ ID NO: 181137 - DNA, 1014 bp, Artificial Sequence
  Description of Artificial Sequence: Synthetic coding sequence
atgaagaagatgcccctgttcagcaagagccacaagaaccccgccgagattgtgaagatactcaaagacaacttagctatcttggagaaacaggataaaaaaaccgataaggcttcagaggaggtgtctaagtcactccaggcaatgaaggaaatactgtgtggcaccaatgaaaaagagccacccacagaagcggtggcccagctagcccaggagctgtattcaagcggcctgttggtcaccctcattgccgatctccagctgatcgactttgaagggaagaaggacgtaacacaaatattcaataatatccttaggagacagatcgggacccgatcgcccactgtagaatacattagcgcccaccctcatattctttttatgctgctgaagggctatgaggccccgcagatcgcgctcaggtgtgggattatgctccgcgaatgtattagacacgaaccactggccaagattatcctgttttccaatcagttccgggacttttttaaatacgttgagctttctacattcgacatagcctcagatgcattcgcgaccttcaaggacctgttgactcgtcataaagtccttgtcgccgactttctggagcagaactatgataccatcttcgaggattatgaaaaactcctgcagagtgagaattatgttactaagcggcagtcattgaagctcctgggggagcttatcctggaccggcataacttcgctatcatgacaaaatacatttccaagccagaaaatctcaagctgatgatgaatcttctgagagataagtccccaaacatccagttcgaggcttttcacgtctttaaggtgttcgtcgcatccccacataaaacccagcccattgtagaaattctgctcaagaatcagcccaagctcatcgagtttctgagcagctttcagaaggagcggactgacgatgagcagtttgcagacgaaaaaaattacttgattaagcagatccgtgacttgaaaaaaacagctccatag

SEQ ID NO: 181138 - DNA, 945 bp, Artificial Sequence
  Description of Artificial Sequence: Synthetic coding sequence
atgcccctgttcagcaagagccacaagaaccccgccgagatcgtgaagatcttgaaagataatttagcgattttagagaagcaagataagaaaacggataaggcctctgaggaagtgtctaagtccctccaggcaatgaaggagattctttgcggtaccaatgaaaaggaacctcccacagaagccgttgcacagctggctcaggaactctactcttccgggctgttggttacactgatcgccgatctgcagctaatcgacttcgaggggaagaaggacgttacgcagatatttaacaatatcctcagacgccagattggtactcgttctccaacagtggaatatatctccgcacacccacacattcttttcatgctcctgaagggctatgaggcgccgcagatcgccctgaggtgcggcattatgctgcgtgaatgcatacgtcacgaaccactcgcgaagattatcttgttctcaaatcagtttagggatttcttcaagtatgtggagttaagcacctttgacattgcatcagatgccttcgccacgtttaaaatatttgaagactacgagaagttgttacagtccgaaaattatgtcaccaaaagacagtccctgaaactgttaggcgaactgatcctggatcgccacaacttcgctattatgacaaagtacatttccaaacccgagaacctaaagctgatgatgaatctgttacgcgacaagagcccaaacatccaatttgaggcattccacgtgtttaaagtgttcgtggctagtccccacaagacccagccaatcgtggagattctgttgaagaaccagcccaagcttattgagttcctatcttcattccagaaagagaggacggatgacgagcaatttgctgacgaaaagaactatctcattaaacaaatccgggatcttaaaaaaacagctccctag

SEQ ID NO: 181139 - DNA, 282 bp, Artificial Sequence
  Description of Artificial Sequence: Synthetic coding sequence
atgaagaagatgcccctgttcagcaagagccacaagaaccccgccgaaatagtcaagattctcaaggataacctcgctattttggaaaagcaagataagaaaaccgacaaggcatcagaagaggtgtcaaagtctcttcaagccatgaaagagattttatgcgggacgaatgaaaaagaacctccgactgaggccgtggcgcagctggcgcaagaactttactccagtggtctgctggttacgttaattgcagatctgcagctaatagatttcgaggtttag

SEQ ID NO: 181140 - DNA, 1014 bp, Artificial Sequence
  Description of Artificial Sequence: Synthetic coding sequence
atgaagaagatgcccctgttcagcaagagccacaagaaccccgccgaaattgtgaaaattttgaaagataatctcgctattttagagaagcaagacaaaaaaaccgacaaggcttccgaggaagtgtcaaaaagcctccaggctatgaaggaaattttgtgcggaactaatgagaaggaaccacccactgaggccgtggcccagttagctcaggagctttactcctctggcctgctagtcacccttatagccgacctccagttgatcgacttcgaaggcaaaaaggatgtaacacagatttttaacaatatcctcagaagacaaatcggtacacgctctcctactgttgaatatatttctgcacatccacatatactctttatgctgctaaaaggttatgaggcccctcagatcgccctccgctgcgggattatgttgcgcgaatgtatcaggcacgagccactggctaagattatactgtttagcaatcaattccgcgatttttttaaatacgtggaactcagtacctttgacattgcctccgatgcgtttgctaccttcaaagatctgcttaccagacacaaggtactagtggcagacttcctcgagcaaaattatgacactatctttgaggactacgaaaaactccttcagtcagaaaattacgtcacgaaaaggcagagcttgaagctgctgggagagttgatcctggatcgtcacaattttgctatcatgaccaagtacatatcgaaacccgagaacttaaaactaatgatgaacttgctcagagacaagtctcccaacatacagtttgaggcctttcatgtttttaaagtctttgtggcaagcccccacaaaacgcaacccatcgtggaaatcctgctcaagaaccagcccaaactgatcgagttcctctctagcttccagaaggagcgcaccgatgacgaacagtttgccgacgagaagaactatttgattaaacaaattcgggatctcaaaaaaacggccccgtag

SEQ ID NO: 181141 - DNA, 1014 bp, Artificial Sequence
  Description of Artificial Sequence: Synthetic coding sequence
atgaagaagatgcccctgttcagcaagagccacaagaaccccgccgagatcgtcaaaatcctcaaggataacctggctatcctagagaagcaggacaaaaaaacagacaaggcgtctgaagaggtatcgaagtccctccaggctatgaaggaaattctatgtggcacaaatgagaaagaacctccaactgaggctgtggctcagctggctcaggagctttattcctcaggcctcctggtgaccttaatcgctgatctccagctcattgactttgaggggaagaaagacgtgacccagatctttaataacatactcaggaggcaaattggaactagaagccccaccgtcgaatatattagcgctcacccacacattttattcatgctgctcaaaggctatgaagctccacagatcgccctgcgttgcggcattatgctccgagagtgtattcggcacgaaccgttagctaaaatcatcctgttctctaaccagttcagggacttcttcaaatacgtcgagctctcaacattcgacatcgcctccgacgccttcgcaacatttaaggacctccttacgcggcacaaggtgctggtggctgattttttagagcagaactatgatactattttcgaggactatgagaaacttctgcaaagtgagaattacgtcactaagcggcagtctctgaaactactcggagagctcatcctggaccgacataatttcgccatcatgacaaaatacatctcaaagccagaaaacctcaaactcatgatgaatctgcttcgtgataagtcccccaatattcaatttgaggcttttcacgtatttaaggtcttcgttgcatctcctcacaagactcagcccatcgttgagattcttcttaaaaaccaaccgaaattgatcgagttcctgtcttcctttcagaaggaacggactgacgatgaacagttcgcagacgagaagaactacctcatcaagcagatccgagacctaaagaagactgcgccctag

SEQ ID NO: 181142 - DNA, 387 bp, Artificial Sequence
  Description of Artificial Sequence: Synthetic coding sequence
atgaagaagatgcccctgttcagcaagagccacaagaaccccgccgagatcgtcaaaatccttaaagacaatctggccatcctcgagaaacaggacaaaaagaccgataaggcctccgaagaggtttcgaagtccctccaagcaatgaaagagattttgtgtggcaccaatgagaaagagccgccgactgaggccgtggcccagctggcccaggagctgtactctagcggtctgttagtcacactcatcgccgacctgcagttaattgattttgaagggaagaaggatgtcacccagatcttcaataatattctgcgacggcagattggtactcggagtcctacagtggagtacatttccgctcacccacatatcctttttatgtag

SEQ ID NO: 181143 - DNA, 567 bp, Artificial Sequence
  Description of Artificial Sequence: Synthetic coding sequence
atgaagaagatgcccctgttcagcaagagccacaagaaccccgccgaaatcgtcaaaatcttgaaagataatctggccatacttgaaaagcaagacaagaagaccgataaagcctctgaagaagtctcaaagtccctgcaggcgatgaaagagatcctgtgcggcactaatgagaaggagcccccgactgaggccgtagctcagcttgcccaggaattgtactcaagcgggttgttggttaccctgattgctgacctacaacttatcgactttgagggcaagaaagacgtgacccagatatttaacaacatcctccgcaggcagattggcacgagaagccccactgttgagtacatctccgcgcacccccacattctgttcatgcttctgaaggggtacgaggcgccacaaatagctttgaggtgtggcattatgctgcgagaatgtatcaggcacgagccgctggcgaagatcatcctgttcagcaaccagttccgggattttttcaagtacgttgaactgtccacattcgacattgcatctgacgcattcgctacttttaaatag

SEQ ID NO: 181144 - DNA, 828 bp, Artificial Sequence
  Description of Artificial Sequence: Synthetic coding sequence
atgaccaccgagcaggcccggggccagcagggccccaacctggccattggtaggcagaagcctcccgcaggcgttgtgactcctaaaagtgacgcagaggaacctcccttgacgcggaaacggagcaagaaggaacgggggttgaggggcagccgcaaaagaacaggatcctctggtgaacagaccggacccgaggcccccggctccagcaataatcctccaagtaccggggaaggtcccgctggggctcctccagcctcacctggacctgcgagtagcagacagagtcacagacaccgcccggattctctgcacgatgccgcccagcggacctatggacccttgcttaaccgtgtttttggtaaggaccgtgaactaggccctgaggagctcgacgagttgcaagcggccttcgaggagttcgacactgaccgcgacggatatatatcccatcgcgaactcggtgactgtatgcggaccttgggctacatgccgacggagatggaactgctagaagtcagccagcatatcaaaatgcgtatgggcggaagggttgactttgaggagtttgtggagctgattgggcccaagctgcgcgaagaaaccgcacacatgctgggtgtgagagagcttcgcatcgctttccgagaattcgacagagatcgggacgggcgcattactgttgcagagcttagggaggctgtccccgcactactgggggagcccctggcaggcccagaactggacgagatgttgcgggaagtagacctcaacggtgacggtacagtcgactttgatgaattcgtcatgatgctctcacgccattag

SEQ ID NO: 181145 - DNA, 513 bp, Artificial Sequence
  Description of Artificial Sequence: Synthetic coding sequence
atgaccgagccctggctggccctgggcaccagctggaccctgcccctacaggaccgcgaactgggacctgaggagctcgatgaactgcaggccgccttcgaggagtttgacaccgatcgggacgggtatatctctcaccgcgaactgggtgattgtatgcgcactctcgggtacatgccaactgagatggaactgctcgaggtgtcccagcacatcaagatgcgaatgggtggccgagtcgactttgaggagttcgtggaactcatcgggccgaagctccgtgaagagaccgctcacatgctcggtgtccgagaactgaggatcgcctttcgcgagttcgatcgggaccgcgatggacggatcacagtagccgagcttagagaggctgtgcctgcgctgttaggcgagcccttggccggtccagaactggacgagatgttacgcgaggttgacctgaacggtgatggtacggtcgacttcgacgagttcgtcatgatgttgagcaggcactag

SEQ ID NO: 181146 - DNA, 522 bp, Artificial Sequence
  Description of Artificial Sequence: Synthetic coding sequence
atgcagttccccatgggccccgcctgcatcttcctgcggaagggcatagctgagaagcaacgggagagaccgctcggtcaagacgaaattgaggaactgcgcgaggcctttctcgaatttgataaagacagggacggcttcataagttgcaaggatttgggaaatcttatgagaacgatgggctatatgcccactgagatggagctcattgagctcggccaacagatccggatgaatcttggtggacgggtggatttcgacgatttcgtggaattaatgaccccaaaactgctggcagagaccgccggaatgataggtgtgcaggagatgagggacgctttcaaagagttcgatactaacggagatggcgaaatcaccctggtggagctgcaacaggccatgcagcgattgcttggtgagcgattgacaccccgagaaatctcagaggtcgtcagagaagcagatgtgaatggggatggcaccgtcgactttgaggaatttgtcaagatgatgtcccgatag

SEQ ID NO: 181147 - DNA, 846 bp, Artificial Sequence
  Description of Artificial Sequence: Synthetic coding sequence
atggagaagagcaccgacaccgacgaggacaacgtgacccggaccgagtacagcgataaaactacacagtttcctagtgtgtatgcggttcccggcacagagcagactgaggctgtcggaggactgtcatctaagccagctaccccgaagacaaccaccccaccttctagtcccccacccacggcagtgagtccagaatttgcatacgtacccgcagatcccgcccaactggccgcccagatgcttgccatggcaacttctgagaggggccaacctcccccatgctctaatatgtggaccttgtactgtttgaccgataaaaatcaacagggccacccttctccacctccggcccccggcccctttccacaagccaccctgtacctgcctaaccccaaagatcctcagtttcaacaacaccccccgaaggttacttttcccacgtatgtgatgggcgataccaagaagacttcagctcctccattcattctagtgggctctaatgtacaggaggcacaaggctggaaacctctgcctgggcatgccgtggtgtcgcagagcgacgtccttagatacgtggccatgcaagtgcctattgcagtaccagccgatgaaaagtaccagaagcatactctgagcccacagaatgccaacccgccaagtggccaggatgtgccacggcccaagtcgcccgtcttcctgagtgtagcttttcccgtggaggatgtcgcaaagaagagttcggggtcaggggacaaatgtgccccctttgggagctatggtatcgctggggaggtgactgtgactactgcacataagcgccggaaggctgaaacagagaactag

SEQ ID NO: 181148 - DNA, 1188 bp, Artificial Sequence
  Description of Artificial Sequence: Synthetic coding sequence
atggagaagagcaccgacaccgacgaggacaacgtgacccggaccgaatattctgataagaccacccagttcccatcagtttatgccgttccgggtacagagcagactgaggcagtgggtggtctgagctcaaagcccgctacaccaaaaactaccacccccccgagttccccgccaccaactgcagtttcccctgaatttgcctacgtccccgccgatcctgcccagctggccgcccagatgctgggtaaagtgagttccattcattctgaccagagcgacgtgcttatggtggacgtagccacctccatgcccgtcgtgattaaggaagtcccctcctcagaagctgccgaagacgtgatggtggccgcccctctcgtctgttcaggcaaggttttggaagttcaggtagtaaaccagacatcagttcacgtcgacctgggctcacagccaaaggagaacgaggcagaaccttctactgcaagctccgtcccactgcaggacgagcaggagccacctgcatatgatcaggccccagaagttacactgcaagctgatatcgaggttatgtcaaccgtccacattagcagcgtgtacaacgacgtccctgttacagaaggagtggtatacatcgaacagctgcccgagcaaatcgttatcccatttactgatcaggttgcgtgcctcaaggagaatgaacagagcaaggagaacgaacagtccccgagggtttcacctaagtcggtggtagaaaagacaacatctggaatgtctaagaaaagtgtggagtcagtgaagcttgcccaactcgaggagaatgctaaatatagcagcgtgtacatggaagctgaggcaacagcacttttatctgataccagtcttaaaggacaaccagaagtgcccgctcagctgctcgacgcagagggggccatcaaaatcgggagtgagaaatcgctgcacctcgaggtcgagattactagtatcgtcagcgataacaccggtcaggaggaatctggagagaactcagttccacaggaaatggagggcaagcctgttctcagcggggaggcagctgaagctgtgcattcaggtacttcagtgaagagcagcagtggcccctttccgcccgcaccagagggcttaacagctccggaaatagaacctgagggagagagcactgccgagtag

SEQ ID NO: 181149 - DNA, 1140 bp, Artificial Sequence
  Description of Artificial Sequence: Synthetic coding sequence
atgatcagcagcaagccccggctggtggtgccctacggcctgaagaccctgctcgaaggcatctctcgagcagtgctgaaaacaaatccctcaaatatcaatcagttcgctgccgcttatttccaggagcttactatgtacaggggtaatactacaatggacataaaagacctggtaaaacagtttcaccagattaaagtggagaagtggtccgaagggactacacctcagaaaaagttggagtgtctaaaggagcctgggaagacctcggtagaatcaaaagtgccaacacagatggagaaaagtaccgatactgacgaagacaacgtaacacgcactgagtactcagataaaaccacgcagttcccaagcgtttacgccgtccccggcaccgaacagaccgaagctgttggtggactctcttcaaaacccgccaccccaaaaacaaccacgcctccatccagtccccccccgactgcagtctcacctgaatttgcctacgttcccgctgaccctgctcagctcgctgcccaaatgcttgccatggcaacgagtgagcggggacagccgcctccctgctctaacatgtggactctctactgcttaactgataagaaccaacagggccatccaagtcctccccccgcccccggacctttcccccaggccaccctttatcttcccaatcctaaagaccctcagtttcagcagcacccccccaaagtgacgttcccaacctatgtgatgggcgatacaaagaagactagcgcccccccctttatcttagtcggaagcaatgttcaggaggcccaggggtggaagcctctgccgggacatgctgttgtcagccagagcgatgtcttgcgctatgttgctatgcaggtgcccattgctgttcccgccgacgaaaaataccaaaagcacacactctctcctcagaacgccaatcctccaagtggccaagacgtccctcggcccaagtcacccgtattcctgagtgtggctttcccagtggaggacgttgcaaagaagtccagcggcagtggcgacaaatgcgcccctttcggctcatacggtatcgcaggagaagtcaccgtaactactgcccacaagaggcgtaaagcagagacagaaaattag

SEQ ID NO: 181150 - DNA, 1140 bp, Artificial Sequence
  Description of Artificial Sequence: Synthetic coding sequence
atgatcagcagcaagccccggctggtggtgccctacggcctgaagaccctcctggaagggatttcccgggcagtactcaagaccaacccttcaaatatcaatcaattcgcggctgcttatttccaagaactcacgatgtaccgcggcaatactaccatggatatcaaagatctagtgaaacagttccaccaaataaaagtggagaaatggagcgaggggacaacgccccagaaaaaacttgaatgcctgaaagaacctgggaaaacttctgtggaatccaaggtgccgacacaaatggaaaagagtaccgatacagatgaggacaacgtgacaaggactgagtacagcgataagacgacacaattcccgtcggtgtacgctgtgccaggcacagaacagaccgaggcagtaggcggcctgagcagcaagcccgccacgccaaaaacaacaacaccaccgtccagtcctcccccgactgccgtctctccagaatttgcctacgtgccagccgaccccgctcaacttgctgctcaaatgctggcgatggcaacttcagagcgaggacaacctcccccttgtagcaatatgtggacactgtactgcttgaccgataaaaaccagcagggacaccccagtcctcccccggcccctgggccctttccacaggctacgctgtacctcccgaaccccaaagacccacagtttcagcaacatccgcctaaagtaacgttcccgacttatgttatgggcgacacaaaaaagacctccgcacctcctttcattttggtggggtctaacgtccaagaagcacaaggctggaaaccactgcccgggcacgctgtagtgtcccagagtgacgtcctgcgctacgtagccatgcaggtgcccattgctgtccctgcggacgagaagtatcaaaaacacacactaagcccgcaaaacgcaaatcctccttccggccaggacgtgcccagaccaaagagtcctgtctttctctccgtcgcctttccagtcgaagacgtggctaaaaagagcagcggctccggagataagtgtgcacccttcggctcctacggcatagccggcgaagtgactgtcactacagcacacaagagaaggaaggcagagactgagaactag

SEQ ID NO: 181151 - DNA, 666 bp, Artificial Sequence
  Description of Artificial Sequence: Synthetic coding sequence
atgatcagcagcaagccccggctggtggtgccctacggcctgaagacccttttggaagggattagccgggccgttctgaagaccaatccatcgaatatcaatcagttcgccgcagcctacttccaggagctgactatgtaccgagggaacacgacaatggacatcaaggatctagttaagcagttccaccagatcaaggtggagaagtggtccgaaggcaccacaccacaaaagaaactggagtgtttgaaagaacccgggaaaacaagtgtggaaagtaaagttcctacccagatggagaagtcaacggataccgacgaagacaacgtgacgcggaccgagtacagcgacaaaaccacgcaattcccaagcgtgtacgccgtaccagggacagagcagacggaagcagtgggggggttatcaagcaagcctgccaccccaaaaacaacaacccccccctcctcccctcccccaacagctgtgagccctgaattcgcctacgtccctgccgatcctgcccagctcgcagcccagatgctggaggacgtcgcaaaaaaaagcagtgggtccggcgataagtgcgccccctttggctcctacggtatcgccggtgaggttaccgtcacgacagcccataagcggcgcaaagccgagaccgagaactag

SEQ ID NO: 181152 - DNA, 1482 bp, Artificial Sequence
  Description of Artificial Sequence: Synthetic coding sequence
atgatcagcagcaagccccggctggtggtgccctacggcctgaagactctgctggagggcatctcacgggccgtgctaaagaccaacccttccaatattaaccaattcgcagctgcctatttccaagaactcacgatgtaccggggaaacaccacaatggacattaaagaccttgtaaaacagtttcatcagatcaaagtagaaaaatggtcggaggggaccactccgcagaaaaaactcgaatgtctcaaggaaccaggcaagaccagcgttgaatcaaaggtgcctactcagatggagaaatcaaccgacactgacgaagataatgtcaccagaacggaatattcagacaagactacacagtttcccagtgtgtatgctgttcccggcacagaacagaccgaagctgtgggaggactgtcttccaagcccgcaacacccaagacaaccacacccccatcttccccccctcccacggctgtgtctcctgaattcgcatacgtgccagccgaccctgcacagctcgccgctcagatgctggggaaagtctctagcattcactctgatcagtctgacgtgctcatggtggacgtcgctaccagcatgcccgttgttatcaaagaggtgcccagctccgaagccgctgaggatgttatggtagccgccccacttgtatgttctgggaaggtgctggaggtgcaggtggtgaaccagacctccgtgcatgttgacctgggatctcagccaaaagagaatgaggccgaaccctcgactgccagttcggtgcccttgcaggatgaacaggagcccccagcctacgatcaggctcccgaagtgacactccaagcggatatcgaagtgatgtccactgtgcacatcagctctgtgtataatgacgtgcctgttacagagggagtcgtctacatagaacagttacccgagcagatcgtgattccttttacagaccaggtggcttgtctcaaagagaatgagcaatcgaaggagaacgagcagtctcctcgggtgtcgcccaagtctgtcgttgagaagaccacttccggcatgagtaaaaagtctgtcgaatctgtcaaactggcccagcttgaggaaaatgctaaatacagttccgtgtatatggaagccgaggcgacagccttgctcagcgatacctcgttgaaggggcaaccggaagtgccagctcagctgttggacgccgaaggcgccatcaaaattgggtctgagaaatctctccatttggaggtagagattacaagtattgtctctgacaacacgggtcaggaggagagtggcgaaaatagtgttccacaagagatggaaggaaagcccgttctgagcggcgaggccgcagaggcagtgcattcagggacctcggtgaaatctagtagtggcccattccctccggccccagaaggtttaaccgcaccagaaatcgagccggagggtgagtcaactgccgaatag

SEQ ID NO: 181153 - DNA, 1428 bp, Artificial Sequence
  Description of Artificial Sequence: Synthetic coding sequence
atgatcagcagcaagccccggctggtggtgccctacggcctgaagactctccttgagggaatctcacgggcagttctgaagacaaacccctcgaatattaatcagttcgctgcagcatacttccaggagttaactatgtacagagtagagaagtggagcgaaggcaccacacctcagaaaaagctcgaatgtctgaaagaacctggcaaaacaagcgttgagtcaaaggtacctactcagatggaaaagtcaactgacacagacgaggacaacgtcactaggaccgaatatagcgacaagacaacacaatttccctctgtctacgccgtccctggaactgagcagaccgaggccgttgggggcctgtccagcaaacctgccactcccaagaccactacccctccttcctctccccctccaacggcggtgtccccagaatttgcttatgtcccagccgatccagcccaactggccgcccagatgctgggtaaggtatccagtatccacagcgatcaatctgatgtcctgatggtcgacgtggcaacaagcatgcctgtcgtgattaaggaggtcccatcaagtgaggctgcagaggatgtgatggtggctgccccattagtatgttccggtaaggttcttgaggtgcaagtcgtgaaccaaactagtgtccatgtagacttgggatcccaacccaaggaaaatgaggctgagcctagcacggcttcgagtgttcccctccaggacgaacaggagcctcccgcctacgatcaggcacccgaggttacacttcaggccgatatcgaagtcatgtccacagtgcacatcagctccgtgtataacgacgtcccggtgactgagggcgttgtatacatagaacagttgcccgaacagatcgtaataccgttcaccgatcaggtcgcgtgcctgaaagaaaacgagcagtccaaggagaacgaacagtctcctagagtatccccaaagtccgttgtggagaaaacaacctcaggcatgtccaaaaaatccgtagaaagcgtgaaactggcacagctggaggaaaatgccaagtatagttcggtgtacatggaggccgaggctactgctctactgagcgatacctccctgaaagggcagcctgaggtccctgcacagctgcttgatgcggaaggcgccatcaagattggtagcgagaagagtctccatctggaggtagaaatcacgtcaatagtgagcgacaacacaggtcaggaagagagcggcgaaaatagcgtgccccaggagatggaagggaagccagtgttaagcggtgaagctgccgaagctgttcacagcgggactagtgttaagagcagttctggcccctttccccctgcccccgagggacttacagcacccgaaatcgagcctgagggtgaatctacagcagagtag

SEQ ID NO: 181154 - DNA, 1452 bp, Artificial Sequence
  Description of Artificial Sequence: Synthetic coding sequence
atgagcttcagcgacagcagcgccaccttcctgctgaacgagggcagcgctgattcgtacacatcccggccctcgcttgactcagatgtgagcctggaggaggaccgtgagtctgctcgcagggaagtcgagtcacaggcacaacagcaactggagagggccaagcacaagcccgtcgccttcgccgtccgaaccaacgtcagttattgcggtgtgctagacgaggagtgccctgtccaggggagcggcgttaactttgaggccaaggacttcctgcacattaaggaaaaatattcaaacgattggtggatagggcgcctggtgaaggagggaggggatattgcttttataccgtcaccgcagcgtctggagtccatcagactaaagcaggaacaaaaagcccgtaggtccggcaacccctcctctctctcagatatcgggaacagacgttctcccccccctagcttggccaaacaaaagcaaaagcaagcagaacatgttcccccttatgacgtcgtgcccagcatgcgccctgtggtgctggtcgggccgtccttgaaaggctatgaggtgaccgacatgatgcagaaagccctgtttgactttcttaagcaccgttttgacggtaggatctccatcaccagagtcactgctgacctgtcccttgctaagcgctccgtactgaacaatccaggcaagcgaactatcattgagcgtagctcagctcgatccagtattgcagaagtccagagtgagattgagaggatctttgagcttgccaaaagcctgcagctggtagtcctggacgccgatacgatcaatcatcccgcccagctggccaaaacctcgctagccccaataatagtttttgtgaaggtctcttcccccaaggtgctgcagcgtctgatccgctccagggggaagtcccagatgaagcacctgacggtccagatgatggcctacgataagctggtccaatgcccgcccgaaagcttcgatgtgattcttgacgaaaaccagctggaagatgcctgcgaacacttggccgaatacttggaggtttactggcgggccacgcatcatccggcccccggccccggcctgctcggccccccaagcgcaatcccaggactgcaaaatcaacagctcctgggcgagaggggggaagagcactcccccttggagagggactctcttatgccttctgacgaggctagtgagagctcacgacaggcctggacaggatcgagtcagcgcagttcccgacatcttgaagaagattacgcagatgcctaccaagacttataccagcctcaccggcaacatacctcaggtttgccctccgctaacggtcacgacccacaggaccgactgctggcacaagattcagaacataaccattctgatagaaactggcagcggaatcggccatggcccaaagactcctactag

SEQ ID NO: 181155 - DNA, 1416 bp, Artificial Sequence
  Description of Artificial Sequence: Synthetic coding sequence
atggagggcagcgccgacagctacaccagccggcccagcctggactcagatgtgtctttagaagaagatcgcgagtcagcaaggcgcgaagtggagagccaagcccagcagcagctggaaagggccaagcacaagccagtggcgtttgcggtgcgcaccaacgtaagttactgtggagtgctggatgaagaatgccccgttcaggggagcggcgttaattttgaggctaaggatttccttcatattaaagagaagtactcaaatgactggtggatcggaagactggtgaaagagggaggtgatatcgcattcataccaagcccccagcggctagaatctataaggctgaaacaggagcaaaaggctcgccggtcaggcaatccaagctctctaagtgacataggtaatagacgatccccaccacctagtcttgctaagcaaaagcaaaaacaggccgaacatgtcccaccatatgatgtcgtgccatccatgcgccctgtggtcctggttgggcccagcctcaagggttatgaagtcacagatatgatgcagaaggccctatttgattttttaaagcacaggtttgacggacggatctccattactcgtgtgactgctgacttatccctcgctaaacggtccgttttgaataatccaggcaaacggaccataatagagaggtcttcagctcggtccagtatcgctgaagtgcaatctgagatcgaaaggatcttcgaactggcaaagagcctgcagcttgtggttctggatgctgatactatcaaccaccctgctcaactggcaaagacctctctggcccccattatagtcttcgttaaggtttccagccctaaggtgctgcagcgactgatccggagccggggaaaatctcagatgaagcacctcacggttcagatgatggcctatgataaacttgtccagtgccctcccgagtccttcgacgtcattctggatgagaaccaactcgaggacgcatgcgagcatctggcggagtatctcgaggtctattggcgtgctacacaccatcctgctcctgggcctgggctgctgggccccccttctgcaattcccggtttacaaaatcagcagctcttgggcgagcggggagaggagcacagccctcttgagcgggactcattaatgccttccgacgaggccagcgaatcttcgcgtcaagcttggactggcagcagtcaaaggtcgtctcgtcatctcgaggaagattacgctgatgcctaccaggatctttaccagccccatcgacagcacactagcggtctgccatccgctaacggacatgaccctcaggaccgcctgctagcgcaggactccgaacacaaccactctgatagaaattggcaacggaaccgcccctggccaaaagacagctactag

SEQ ID NO: 181156 - DNA, 1332 bp, Artificial Sequence
  Description of Artificial Sequence: Synthetic coding sequence
atgtacgacgacagctacgtgcccggcttcgaggacagcgaggccggctccgccgacagctatacctcacggccgagcctggatagcgacgtttccctggaagaagatagggagtctgctcgaagagaggtagaatctcaagcccagcagcaactggagcgtgcgaagaagtacagtaatgattggtggattggcaggctggtcaaagagggaggtgacattgccttcatacccagcccacagcggctggaaagcatccgcctgaaacaagagcagaaagcacgtcgctcaggaaacccaagctcgttgtctgacattggtaacagacgatcccccccccctagtctggcgaagcagaagcagaaacaggccgagcatgttcctccctacgacgttgtgccatctatgaggcccgtggtgctggtcggaccgagtctaaaagggtatgaggtgacagacatgatgcagaaagccttattcgacttccttaaacataggtttgatggaagaatttcaataacacgcgtcacagccgatttgtctctcgccaaacggagcgtgctgaacaaccccggcaaaagaaccatcattgaaagaagctctgcaaggtcttccattgcagaggtgcagtctgagattgaacgcattttcgaactggctaagtctctgcaactcgtggtgctggacgctgacacgatcaatcatcctgctcagttagctaaaacttctcttgcccccattatcgtatttgtcaaagtgagttcccccaaagtgctgcagcgactgatacgaagtcgtggtaagtcccaaatgaaacatctcaccgttcagatgatggcatacgacaaacttgtgcagtgcccacctgaatcatttgatgtgatcctggatgagaatcagctggaggacgcatgcgaacacctagcggagtatttggaggtgtactggcgcgccacacaccatccggcccccgggcctggccttcttggacctccctccgctattccaggactacagaatcagcaactcctgggcgaaaggggagaagaacactctcctctagagcgcgattcactaatgccatcggacgaagccagtgagagcagccgtcaggcctggacggggagttcacagcgcagctcacgacacctcgaagaggactatgcagacgcctaccaggatctttaccagcctcaccgccaacacactagcggactcccctcagctaacggccatgacccccaggatcgcctgctagcccaggatagtgaacacaatcacagcgatcggaattggcaaaggaacaggccctggcccaaagactcatactag

SEQ ID NO: 181157 - DNA, 1377 bp, Artificial Sequence
  Description of Artificial Sequence: Synthetic coding sequence
atgagcagcagcagctacgccaagaacggcaccgccgacggcccccacagcccaacttctcaggttgcccggggcactactactaggcggtcccgcttgaagaggagcgacggatcaaccaccagcacttcatttatattgcgacaggggtccgctgactcgtatacctcacgccctagcgactcagacgtcagccttgaagaagacagagaggccatccgccaggagcgggagcaacaggctgctattcagctggagcgcgcgaagtcaaaaccagtggccttcgcagtgaagacgaatgtgagctattgcggcgccctggatgaagatgtgcctgtgccatccaccgctatctcatttgacgctaaggactttctacacattaaggagaaatacaataacgactggtggattgggcggttggtgaaggaaggctgcgagataggatttatcccctcaccgctgcgtttggaaaatatccgcatccaacaggagcagaaaagaggaagattccacggcggtaagtcaagcggaaattcctcttcatcattaggcgaaatggtgtctggaacctttcgggccacaccaactagcaccgctaaacaaaagcaaaaggtaaccgagcatattcctccctatgatgtggtaccttcgatgaggccagtggtgttggtcggtccatctctaaagggctatgaggtaactgacatgatgcagaaagctctcttcgacttcctgaaacacagattcgatgggcgtatctctatcacccgggttaccgccgatatcagtctcgccaaacgctcagttctgaacaatccaagcaagcgcgctattatagaacgttccaacacgaggtcaagcctggctgaggttcaatctgagatagaaagaatctttgaactggcccgctctctccagcttgtggtgctggacgctgatactattaatcacccggctcagttaattaaaacctcactggctccaataattgtccacgtgaaggtgtcttcgcccaaggttctgcagagactgatcaagagtcgcggcaagagtcagtctaaacacctgaatgtgcagctggtggccgccgacaaattggcacagtgtccaccaagtcagcgaatgaggcacagcaatcactcaacagaaaatagccctatagaacgacgtagtctcatgacgagtgatgagaattatcacaatgaacgcgctcgaaagtctcgtaaccgactgtcctcttcctcacagcacagccgggaccactaccctctagtggaggaggattaccctgatagctaccaggatacatataaacctcacagaaatcgtggctcgcccggaggctatagccacgatagccgccaccgtctctag

SEQ ID NO: 181158 - DNA, 1509 bp, Artificial Sequence
  Description of Artificial Sequence: Synthetic coding sequence
atggacgtggtggcccggggcaccaccacccggcggagccggctgaagaggtccgatggctccacaacgtcgaccagttttatcttacgacagggttccgccgattcctatacaagtcggccctccgattcagatgtcagcctcgaggaagatcgagaagccattagacaggagcgggagcagcaggccgccatccaactggagcgcgcaaaatcaaagccagtggccttcgctgtgaagacaaacgtcagctactgtggagcgctagacgaggacgtgccggtcccatccaccgcaatcagctttgacgcaaaagatttcctccacattaaggagaaatacaataacgattggtggatcgggcggctagttaaagaagggtgtgagatcggctttatcccctcacccctgaggctcgagaatattcgcatacaacaggaacaaaagcggggccggttccatgggggcaagtcctctggaaacagctcatcttcattaggggaaatggtaagcggtaccttccgcgcaactcccacctccactgccaagcagaagcaaaaagtgaccgaacatatccccccatacgatgtagtgccttcaatgcgccccgtggttcttgtgggaccctcgctgaagggctacgaggtaacggacatgatgcagaaggctttatttgacttccttaagcaccggttcgacggccgcatctcaatcacccgagttaccgcagacatcagcttagctaagcggtcggtgttaaataacccatctaagagagcaataatcgaaaggtccaacaccagaagctccctcgcagaggtgcagagcgagatcgaaaggatcttcgaactggcccgcagtctccagctcgtagtgttagacgccgataccatcaatcaccctgctcaactgatcaagacctctttggcacccattattgtgcacgtgaaggtgtcatccccaaaagtgttacaaagactgatcaagtctagaggtaagtctcagtcgaaacatctgaacgtccagcttgttgctgccgacaagctagcccaatgtccaccagaaatgttcgacgtgatcctggatgaaaatcagctcgaggatgcgtgtgaacacctcggtgaatacctagaggcctactggagggctacacacaccacttcttccacacccatgacaccccttctcggtcggaatcttggtagtaccgctctttctccttatcctaccgcgatatcaggcttgcagtcccagcgcatgcgccatagtaaccattctacagagaatagcccgatcgagcgtcgcagtctgatgacctccgacgagaactatcataacgaacgagccaggaaaagcaggaatcgcctgtcctcgagttcccagcactccagggatcattacccactggtggaggaagactaccctgactcataccaggatacttacaagccacacagaaacagaggctcaccgggaggctattcccatgactccaggcatagactttag

SEQ ID NO: 181159 - DNA, 3438 bp, Artificial Sequence
  Description of Artificial Sequence: Synthetic coding sequence
atggccgtgcccgcccggacctgcggcgccagccggcccggccccgcacgcaccgctaggccttggcctggatgtggacctcatcccgggcctggaacacgcagacccaccagtggacccccacgacctctttggctactgctgcccctgctcccgctgctcgctgctcccggggcttctgcctacagtttcccacagcaacacacgatgcagcactgggccaggcgactggaacaggaggttgatggtgtgatgcgcatattcggcggcgtccagcagctgcgtgagatctacaaggacaacaggaacttgtttgaagttcaggaaaacgagccgcagaagctcgtcgagaaagtggcaggcgacattgaatccctcctggacagaaaggtgcaagcacttaagcgactggctgacgcagctgaaaatttccagaaggcccataggtggcaagacaacatcaaagaggaagatatagtatactacgacgccaaagcagacgccgaactggacgaccctgagtcggaggatgtagagcggggatctaaagcctcgactcttcgcctggatttcatcgaggatcccaactttaaaaataaggtgaattactcctatgccgcggtgcagatccccaccgatatctacaagggatcgactgtcatcctgaatgagctcaactggacagaggctctggagaatgtatttatggagaacaggagacaggaccccacactcctgtggcaggtgttcggtagtgccaccggagttactcgctactacccagcaacgccttggcgggcccccaagaaaattgatctgtacgacgtgcgccgacggccttggtatatccagggggccagctctcctaaagatatggtgatcattgtggacgtctctggtagcgtgtcaggcctgactctcaagctaatgaagactagcgtgtgcgaaatgcttgacaccctgagtgatgacgattatgtgaatgtagcttctttcaacgagaaagcccagccagtttcatgcttcactcatctagtacaggccaatgtacgaaacaagaaggtctttaaagaagcagtccaggggatggtggctaagggcactactggttacaaagctgggttcgagtacgcctttgaccagttacagaacagcaatatcactcgagcgaactgcaacaagatgattatgatgtttaccgatggaggcgaggatagggtgcaggacgtgttcgagaaatacaactggcccaatcgaaccgttagagtattcacttttagtgtgggccagcataactatgatgtcactccactccagtggatggcatgcgcaaataaaggttattattttgagattcccagcattggcgcaatcaggatcaatacacaggagtacctcgacgttctggggagaccaatggtcctcgctgggaaggaagcaaaacaagtgcaatggaccaacgtttacgaggacgccctgggattagggcttgttgtcacgggcacgctgcctgtcttcaacctgacacaggatgggccaggtgagaagaaaaatcagcttatactgggtgtaatgggcattgatgtggcgctaaacgacataaaaaggttaacccctaattacaccctgggggccaacgggtacgtgtttgcaattgacctgaacggatacgttctgctgcatccaaaccttaagccacagactaccaacttccgcgaaccagtaaccctggatttcctcgatgcagagctggaggacgaaaataaggaggaaattcgcaggtctatgattgacggcaataaggggcataaacagatccgtaccttggttaaaagccttgatgagcgctacattgatgaggtgacccggaactatacttgggtgccaatcagatccaccaattattcacttggtctggtactgccaccttattccactttttatctccaggcgaacctgagcgatcaaattctccaggtaaagtacttcgagtttttactgccatctagctttgaaagtgagggccacgtttttattgccccgcgggagtattgcaaagatctgaacgcaagtgataataacaccgagttcctcaagaattttatcgagctgatggaaaaagtcacgcctgacagtaaacagtgcaataactttttactccataacctgattcttgataccgggatcacacaacagctggtggagcgcgtatggcgcgatcaagacctaaacacctacagcctgctggctgtgttcgccgctactgacggtggcatcacgagggtgttcccaaataaagcggcagaggactggactgaaaacccggagccatttaatgcatcattttatcggcgttcactggacaatcatggctatgtgtttaagcccccgcatcaagacgccctcctgaggccgctggagttggaaaatgataccgtgggtattctggtctccacggctgttgagctaagtctcgggagacggacgctgcgaccagcagtcgttggtgtcaaacttgatctggaggcctgggctgaaaagtttaaggttctggccagtaatcgcacacaccaggatcaaccccagaagtgcggtcccaacagccactgcgagatggactgtgaagtcaataacgaagatctcctgtgtgtcctgattgacgatggtgggtttttagtgttgtcaaaccagaatcatcagtgggaccaggtgggcaggtttttttctgaggttgatgcgaatctgatgcttgccctatacaataactctttctatactcgtaaagagtcttatgactaccaggctgcctgtgcaccccagcccccaggtaaccttggggcagcgcctagaggcgtgtttgtcccaactgtggccgacttcctgaacttagcttggtggacaagtgctgcagcgtggagcttgtttcaacagctgttgtacggacttatttatcactcatggtttcaggctgaccctgcagaggctgagggcagccccgaaacccgcgaaagctcttgcgtgatgaaacagacccaatattattttggtagcgtgaacgcctcttacaacgcaattatcgattgtggtaactgttccaggctcttccatgcccagcgcctcacgaatactaatctactgttcgtcgtcgctgaaaagccgctctgctcacagtgtgaagcagggcggctgctgcagaaggaaactcattgcccggccgatggaccagagcagtgcgaattggtgcagagaccacgttatcggcgaggaccccacatctgcttcgattataacgcgaccgaggataccagtgactgcggaaggggtgcatccttccccccttccctaggggtactggtgtccctgcagctattgctgctgctcgggcttccgcccaggccacaaccacaggtcctggtgcatgcatctcggcggctgtag

SEQ ID NO: 181160 - DNA, 3231 bp, Artificial Sequence
  Description of Artificial Sequence: Synthetic coding sequence
atgcagcactgggcccggcggctggagcaggaggtggacggcgtgatgcgcatttttggtggagtgcagcagctgcgcgagatttacaaggataataggaatttatttgaagtccaagaaaacgagcctcagaaactggttgaaaaagtcgcaggtgacatcgagtctttgctggatcgaaaagtccaggcacttaaaaggctagctgatgctgcggagaattttcagaaagcccaccggtggcaggacaacattaaggaagaggacattgtttactacgacgccaaggccgacgccgaactcgatgacccagaatctgaggacgtcgaacgcggcagtaaggccagcactctgcgtctcgacttcatcgaagatccgaacttcaagaacaaggtgaactatagctatgcagcagttcagatccccactgacatctataagggctccaccgtgattttgaacgaactcaattggacagaggccctggaaaacgtgtttatggagaaccggcgccaagaccccacgctgctctggcaggtgttcggctcagccaccggcgttacaaggtattatccagcgaccccttggcgcgctccaaaaaagatcgatctctacgatgtcaggagaagaccatggtacattcagggggcatcttcccccaaggacatggtcatcatagtggacgtctcagggtcagtaagcggtctaaccctgaagttgatgaagacctcagtgtgtgagatgttggatacactctctgatgatgattatgtcaacgtggcatccttcaatgaaaaggcgcagccagtatcatgttttacccatcttgtccaggcaaacgtgcgcaacaaaaaggtgttcaaagaagccgtacaaggcatggtggcaaagggcaccactgggtataaagccggattcgagtacgcctttgatcagctccagaatagtaatattacgcgcgcaaactgcaacaagatgattatgatgttcacagatggaggagaagacagggtccaggatgttttcgaaaaatataattggcctaatcgcactgtgagagtcttcactttctcagtggggcagcacaattatgacgtgactcccctacaatggatggcatgtgctaataagggatattattttgaaatcccctccatcggagcaattaggattaatacccaggagtatctggatgtgcttggacgacctatggtactcgcaggcaaggaggcgaagcaagtgcagtggactaatgtgtacgaagacgccctggggcttgggctcgtggtgacgggtaccctgccagtgtttaatttgactcaagacggtcctggcgagaaaaaaaatcagctcatcctgggtgttatgggaatcgatgtggcacttaatgatatcaaaagactgacgcctaattatacactaggagcaaatggctatgtttttgccattgacttgaatggatacgtgctactgcacccaaatctgaaaccccagacgacaaattttagagagcccgtcactttggacttcttagacgccgagctcgaggacgaaaacaaagaggagattcgcagatctatgatcgacgggaacaagggccacaaacagattaggaccctggtgaaaagtctggatgaaaggtatatagatgaggtcaccagaaattatacctgggtgcctatcaggtcaacaaattatagtctgggcctggttctgcccccgtactccaccttttacctccaagcaaatctgtcggaccagattctccaagtcaaatacttcgagttcctgctgccatcgtcatttgagagcgaaggccatgtattcattgcaccaagggaatactgtaaggatcttaatgcctcagacaataacacagaatttctcaagaacttcatcgaactgatggagaaggtgacccccgatagcaagcagtgcaataacttcctgttacacaacctcatccttgacactggcataacacagcagctcgtcgagagagtgtggcgggaccaagatctaaatacttacagcttgctggccgtgttcgccgctaccgacggcggcatcacccgggtgtttcccaataaggctgccgaggactggaccgaaaatccagagcccttcaatgccagcttttatcggagatccctcgacaatcatggatatgtgttcaagccccctcaccaggatgcgttacttcgacccctggaactggagaacgacactgtcggcatcctggtaagtacggccgtggagctgtctcttgggagacgcaccctgcggccagcagtcgtcggcgtgaagctggatttggaggcatgggcagaaaagttcaaggtattagcatcgaatcgtacccaccaagatcagccccaaaagtgcggccccaattcgcattgtgaaatggactgcgaagtgaacaacgaagatctgctctgtgtcttgatcgacgacggcggcttcctggtcctctccaaccagaatcatcagtgggatcaagtgggccggtttttctcagaggtggatgctaatctaatgctggcactttacaataattctttttacacaagaaaagaatcatatgactatcaggctgcctgtgctccccagcctccaggaaatctcggggctgctcctcgaggggtgttcgttcctaccgtcgccgatttcttgaatttggcttggtggacgtccgctgctgcctggagtctttttcagcaattactgtatggcctcatatatcactcttggttccaggcggatcctgcagaggccgagggttcccctgaaactcgcgagtcgagctgcgtgatgaagcagacacagtattattttggcagtgtgaacgcctcctataacgctatcatagactgcggaaattgttcccgtctctttcacgcccaaagactcactaacaccaatctgctctttgttgttgccgagaaacctctgtgttcacagtgcgaggccggaagacttctgcaaaaggagacccactgcccagccgacggaccggagcaatgcgagctggtccagaggccgcggtaccgcagggggccacacatttgttttgactacaatgccacagaggacacctccgactgcggtcgcggcgcctccttcccccccagcctgggggttttggtttctctacagctcctgctgctcctgggtttaccacctcggcctcaaccacaggtattggtacatgctagcagacggctctag

SEQ ID NO: 181161 - DNA, 3441 bp, Artificial Sequence
  Description of Artificial Sequence: Synthetic coding sequence
atggccgtgcccgcccggacctgcggcgccagccggcccggccccgctcggacagctcggccttggcccggatgcggcccgcatcctggaccaggcacaagacgcccaacgagcgggcctccccgccccctctggctcttgttgcccttgctccccttgctggcagcccccggcgccagtgcttacagctttcctcagcagcatactatgcagcactgggccagacggctggagcaggaagtcgacggggtgatgcgtatatttggaggtgttcagcagctgagagagatctataaggataacagaaacctgtttgaggtgcaggagaatgagccccagaagctggtagagaaggtagcaggcgacattgagtctttgttagatcgcaaagtgcaggcactgaaacggctggcagacgccgccgagaacttccaaaaagctcataggtggcaggacaacattaaagaggaggacatcgtgtactacgatgcaaaagctgacgcagagttggatgatccagaatctgaagacgtcgagcgggggagtaaagcttccaccttgagacttgattttattgaggatcccaactttaaaaacaaagtgaattactcttacgccgccgtacagattcctaccgatatatataagggctctaccgtgatactgaacgagctgaattggacagaggcccttgagaacgtcttcatggaaaatcgccgccaggaccctaccctgctgtggcaggttttcggtagcgccaccggagtgaccaggtactatcctgccacgccttggagagccccaaagaagattgacttgtacgacgttagaaggcggccctggtatatacagggagcatcatcccccaaggatatggtcataatagttgatgtcagcgggtccgtgtccggcctgaccctgaaacttatgaagaccagcgtatgtgagatgcttgacacccttagcgacgatgactacgtaaatgtggcctctttcaacgagaaggcacaacccgtcagttgttttacacacttagttcaggccaacgtgcgcaataagaaagtctttaaggaggctgtgcagggcatggtggctaaaggcacgactggctacaaagctgggttcgagtatgccttcgatcagctccagaacagcaacatcacccgggcgaactgcaataaaatgatcatgatgttcaccgatgggggcgaagaccgtgtacaagacgtgttcgagaaatataattggcccaaccggactgtgagggtctttacattctcagtgggacaacacaactacgatgttacgccgttgcagtggatggcttgtgctaataagggatactactttgaaattccgagtatcggagctattcggataaacacacaggagtacttggatgtgctgggacggcccatggtgctggccggtaaggaggccaagcaggtgcagtggacgaacgtgtatgaggacgccctaggactcgggctcgtggttaccggtaccttacctgtgttcaatcttacccaggacggcccaggtgagaaaaaaaatcaactcatactcggcgtcatgggaattgatgtagccttgaacgacatcaagaggctgaccccaaactacaccctgggggccaatggatacgtctttgccattgatctgaatgggtacgtgttgctgcaccccaacctgaaaccccaaacaaccaactttagggaaccagtaaccctggacttcctggacgccgagctggaggacgaaaataaggaggaaatcagaagatctatgatcgacggcaacaaaggccataagcagattcgaactttggtgaaatctctcgacgaacgttacatcgatgaagtgacacggaattatacatgggtgcctatacggagcaccaattatagcctgggacttgtcctgcccccatattccacattctatctacaagcaaacctgtctgaccaaatcttgcaggtaaagtacttcgagtttttgttgccctctagttttgaatcggagggccatgttttcatcgcacctcgggaatactgtaaggatctgaatgcctccgataacaataccgagttcctcaaaaactttatcgagctgatggagaaggtgacccccgactctaagcagtgtaataactttctcctgcacaatctgattctggatactggcattactcagcagctggtggaacgagtctggcgtgatcaggacctgaatacctatagcttgctagctgtcttcgcagccaccgacggcggcataactcgtgtcttcccaaataaggctgcggaggattggaccgaaaacccagagcccttcaacgctagtttctacagacggagcctagataatcatgggtacgtgtttaagcctccccaccaggacgctctgcttcggcccctggagttggaaaacgacacggtgggcatactcgtctcaaccgcggtcgagctttccctcggtcgacggacactgagacccgctgtcgtcggcgtgaaactggacttagaggcctgggcggaaaaattcaaagtactcgcctctaacagaactcaccaggaccagccccagaagtgtgggcctaatagtcactgcgaaatggactgtgaagtcaataacgaagacttgttatgtgtcctgattgacgacgggggatttttggttctctccaaccaaaaccatcaatgggaccaggtgggcaggtttttttccgaggtggatgcgaatctaatgctggccctttacaacaactctttttacacaagaaaagaatcttatgattaccaagccgcctgcgcaccccagcctcccggtaatttaggtgcagcacctaggggagttttcgttcccacagtcgcggacttcctcaatctggcttggtggacgagtgccgctgcctggtctttatttcagcaactgctttacggtctgatataccactcctggttccaagccgaccctgctgaagccgagggctcacccgaaaccagggagagctcatgcgtcatgaaacagacacaatactattttggctctgtgaatgcctcttataatgcaattattgattgcgggaattgcagccgtctctttcatgcacaaaggcttactaataccaatctgctatttgtggtagcggaaaagccactttgttcccagtgcgaggcagggcgtctgcttcaaaaagagacccactgttgccctgcagacggccccgaacagtgtgagcttgtgcagcgccctcggtataggcgcggtccacatatctgcttcgattacaacgcgactgaggatacctcagattgcggaaggggggcttcgtttcctcccagtctcggggtgcttgtgagtctccaactgcttctcctcctggggttgcctcctcgaccccagccacaggtgttggtgcacgccagccgccgtctttag

SEQ ID NO: 181162 - DNA, 3432 bp, Artificial Sequence
  Description of Artificial Sequence: Synthetic coding sequence
atggccgtgcccgcccggacctgcggcgccagccggcccggccccgctagaaccgcccgcccctggcctggctgcgggcctcaccccggtcccggaaccaggaggcccactagcggccctcccagacctctgtggctgctactgcctctgctaccgctgctggcggcccctggagccagtgcttactcctttccccagcagcacaccatgcagcattgggcgaggagattggagcaggaagtggatggggtaatgcgcattttcggcggtgtgcagcagctgagggagatctataaagacaatcggaacctgtttgaggtccaggaaaacgaaccgcagaagctggtagagaaagttgccggggacatcgaaagcctacttgatcggaaggtgcaggccctcaaacgcttagctgatgccgccgagaactttcagaaagcccaccgatggcaggataacataaaagaggaggacatcgtgtactatgacgccaaagccgacgccgaactcgacgatcccgaatctgaggatgtcgaaagaggttccaaggcaagcactctgagattggattttatcgaagaccccaacttcaaaaacaaagttaactatagctacgctgctgtccaaataccaaccgacatctataagggctcaacagttattttgaatgagcttaactggactgaggccctcgagaacgtgtttatggagaatcggcggcaggatcctacattactctggcaggtattcggttcagctaccggagtcacccggtactatcccgccacaccctggcgggcacccaagaagatcgatctatacgacgtccggcggcgtccgtggtacattcagggagcttcctctcctaaggacatggtcataattgtggatgtgtccgggagcgtaagcggactcaccctcaagctgatgaaaacttccgtctgtgaaatgctggataccttaagcgatgacgactacgttaacgtcgcctccttcaatgaaaaggcccagccagtcagctgcttcacacatctggtccaagcaaacgtaaggaacaagaaagtgttcaaagaagcggtgcagggaatggtagccaaggggaccactggatacaaagccggtttcgagtatgccttcgaccagctgcagaacagcaatattactcgcgccaattgcaataaaatgatcatgatgtttaccgacgggggggaggatagagttcaagatgtgttcgaaaagtataattggcccaaccgcactgttagggtattcaccttctccgtcggtcagcacaattacgacgtgacacctctgcagtggatggcatgtgcaaataagggttattactttgagatcccgagcatcggcgccattaggataaacacccaggaatatctcgacgtcctcggccggcctatggttctcgcggggaaggaggctaagcaagtccagtggaccaatgtgtacgaggacgctctggggctaggcctggtcgtgacaggcaccttacctgtcttcaatcttactcaggatggaccaggtgagaagaaaaatcaattgatcctgggcgttatggggattgatgtcgctcttaatgacattaagcgcctcacccccaattatacactgggtgcgaatgggtacgtgttcgccattgacctcaatgggtatgtgctgttacacccgaaccttaaacctcagacaacaaacttcagagaacccgtgacgctagattttctcgacgcagaattggaggatgagaacaaggaagagattagaaggtctatgattgacggtaacaagggtcataagcagatccgtacactggtgaaaagtttggatgaacgttatattgacgaagtgacacggaattatacgtgggtgccaatcaggagtacaaattatagcctgggcctggtgcttcctccctacagcaccttctatctccaagctaacctgagcgaccagatactccaggtgaagtactttgagtttctgctcccttccagtttcgagtctgaaggacacgtgttcatcgcccccagagagtactgtaaggatctgaacgcatcggataacaatacagaatttctgaaaaatttcatcgaactgatggaaaaagtgaccccagactcaaagcagtgcaacaactttctgctgcataacctcattctcgacacgggaattacccagcagctggtggaacgcgtatggcgggatcaggaccttaacacgtattccctcctggctgtgtttgccgccacggatggtggtattactcgcgtgtttccaaacaaggccgcagaagactggactgagaatccagagccttttaatgctagcttctaccgcaggtctctcgataatcatgggtatgtcttcaagcctccgcatcaggacgcattgttgcggccattggaattggaaaacgatactgtgggtatcctggtgtccaccgcagtggaactctcactgggacgtagaacactcaggcccgctgttgttggcgtgaaactagaccttgaggcctgggcggaaaagtttaaggtgctagcctccaaccgcacacaccaggatcaaccccaaaaatgtggaccgaacagccactgtgagatggattgtgaggtgaacaacgaagacctcctatgcgtgctaatagatgatggaggtttcttggtgctctccaaccagaatcaccagtgggatcaagtgggccgattcttttccgaagtcgacgcgaacctcatgttggccttatacaacaatagtttttacacacggaaagagagttatgattatcaagccgcctgtgctccacaacctcctgggaacctgggtgctgcccccagaggggtttttgtccctaccgtggccgattttttgaatctggcctggtggacttccgcggctgcttggagtcttttccagcagctgctgtacggcctgatctatcacagctggttccaggccgatcctgccgaggctgagggaagtcccgagacccgagaatcttcatgcgtgatgaaacagactcagtattattttgggtccgttaatgcttcttataatgctatcatcgactgcggaaactgtagtcgattgttccacgcgcagcgcctgacaaataccaacctcctgttcgtggtggccgagaagccactctgctcacagtgcgaggccggacgcctcttgcagaaggagacgcactctgatggaccggaacagtgtgaactagtgcagagaccacgttaccgacggggaccccatatctgcttcgactataacgcaacagaggatacttctgattgtggtcggggcgcaagtttccccccctcactcggcgtgctggtgtccctgcagcttctgttactgcttggcttacctcctagacctcagccgcaggtcttggtgcacgcaagccgacggctttag

SEQ ID NO: 181163 - DNA, 3462 bp, Artificial Sequence
  Description of Artificial Sequence: Synthetic coding sequence
atggccgtgcccgcccggacctgcggcgccagccggcccggccccgccagaacagcaaggccctggccaggctgtggaccgcatccagggcctggaactcgccgcccaacctcaggccccccacggcctctctggttactgctgcctttgcttcctctgctggccgctcccggggcctctgcttacagctttccccagcaacacactatgcagcactgggctaggcgcttggagcaggaggttgacggtgtaatgcgtatcttcggcggagtccaacagctgcgtgaaatctataaagacaaccggaaccttttcgaagtgcaggagaacgaaccacagaagctagtggaaaaagtagccggcgacattgagagcttgctagacagaaaggtccaggctctcaagcgtctcgcagatgctgcagagaattttcaaaaggcacatcgatggcaggataacattaaagaggaagatatcgtgtactacgacgccaaggcggacgctgagctggacgaccctgagtctgaagatgtggagcgcggcagcaaggctagcaccctccgccttgattttatagaagacccaaatttcaagaacaaggtgaactattcctatgctgcagtgcagattcccacggacatctataagggctctaccgtgatcctaaacgagctgaattggactgaggccctggagaatgtgtttatggagaacaggcgccaagacccaacgctcctgtggcaggtcttcgggagcgcgactggggtgacccggtattacccagcgacaccctggagagcacctaagaagattgatttatacgacgtgaggcgcaggccctggtatatccaaggcgcctcctcaccaaaagatatggttataattgtcgatgtgagcggttccgtcagcgggctaacactgaagctcatgaaaaccagtgtctgcgagatgctggatactttaagcgatgatgactatgtcaatgttgcctcctttaacgaaaaagcccagcccgtcagctgtttcactcacttggtgcaagcaaacgtgcgaaataaaaaagtcttcaaagaagctgttcagggaatggttgcaaaaggaaccaccggctataaggcagggttcgaatatgcctttgaccagttgcagaattccaatatcacccgcgctaattgtaataaaatgattatgatgtttaccgatggcggggaggaccgtgtgcaggatgtgttcgaaaaatataactggcccaatagaaccgtccgggtgttcactttctccgtgggacaacacaattacgacgtgactccgttgcaatggatggcttgtgcgaacaagggatactatttcgaaattcctagcatcggagccatccgtatcaatacacaagagtatctggacgtgctgggccggccaatggtccttgctggaaaagaagcaaagcaggttcagtggactaatgtgtacgaagacgccctgggtctcggcctggtagtgacaggaacactacccgtgttcaatctgactcaggatggccccggggaaaaaaagaatcaacttattctcggagtgatgggaattgatgtcgccttaaacgacatcaagcgcctcacacccaactacacactgggcgcgaatggttacgtttttgcaattgacctgaatggctacgtgctactgcatcctaatcttaagccacagacaaccaactttcgggagccagtcaccctcgatttcctggatgccgagctcgaagacgagaacaaggaagagattcgacggagcatgattgacggcaacaagggacacaagcaaatacggaccttggtcaagtcactggatgagagatacattgacgaagtcactagaaactacacatgggtgccaatcagatcgactaattattctctcggccttgtgctccccccttattccaccttctacttgcaggccaatttgtccgatcagatattgcaggttaaactgccgatctctaaactgaaggacttcgaatttcttctgccgagctctttcgagtcagagggccacgtcttcatcgcccctagggaatattgtaaagacctgaacgccagtgacaataacaccgagtttttaaaaaacttcatagagctgatggaaaaggtgacacctgacagcaagcagtgcaacaacttcctgctgcataatctgattctggacactgggatcacacagcagctggttgaacgtgtgtggcgcgaccaagatctcaacacatactcattgctggccgttttcgccgccaccgacggcggtattactcgcgtatttcccaacaaagctgccgaggattggaccgaaaaccccgagcctttcaatgccagtttctatcgccggtcgttagacaaccatggttatgtcttcaagccacctcatcaagacgcgcttctgcgaccactggaactggagaacgataccgtcggaattctggtctccacggcggtggagctgtccctgggcagacgcacgctgaggccagcagttgtgggagtgaaattggacctcgaggcctgggccgagaaattcaaagttctggcttccaatcgaactcatcaggatcagccacagaagtgtgggccgaacagtcattgcgagatggattgcgaagtcaataacgaggacttgctttgcgttctgatcgacgacggaggttttcttgtgttatccaatcagaatcaccaatgggatcaggtaggcaggtttttttctgaggtggatgcaaatcttatgctggctctgtataacaactcattttataccaggaaagaatcatacgattatcaggccgcctgtgctcctcagccccctggaaacttaggcgccgccccccggggcgtttttgtgccgaccgtcgctgatttcctgaatcttgcctggtggacatcagccgccgcgtggagtttgttccagcagctcctttacgggctgatttaccactcttggttccaggccgaccctgcagaggccgaaggctccccagagacgcgggagtcaagttgcgtgatgaagcagactcagtactactttgggtcggtcaatgcgtcctacaacgccataatagactgcggcaattgctcccgcttgttccacgcccagagactgactaataccaacttactgttcgtcgtggcagagaagcctctctgcagccagtgcgaggctggacgtctgctgcagaaggagacgcattgttgcccggctgatggacccgaacagtgtgaactggttcagagacccaggtaccgcagaggcccacatatctgttttgactacaacgccacagaagatactagtgactgtggtcgaggagccagttttcccccttcactcggggtgctagtgtccctccagctgcttctactgttgggcttgcccccccgaccccagccacaggtgctggtgcatgcatcacgaaggctgtag

SEQ ID NO: 181164 - DNA, 3453 bp, Artificial Sequence
  Description of Artificial Sequence: Synthetic coding sequence
atggccgtgcccgcccggacctgcggcgccagccggcccggccccgcaaggaccgcccgaccttggcctgggtgcgggcctcaccccggcccagggaccaggcgacctacatctgggccacctcggcccctgtggttgctgctccctctattgccactgttggccgcgccgggagccagcgcttacagcttcccacagcagcatactatgcagcattgggcaagaagacttgagcaagaggttgatggcgttatgcggatttttgggggcgtgcagcagctgcgggagatttacaaggataaccgcaacctgtttgaagtccaagaaaatgagccacagaaactggtcgaaaaggtggccggcgacatcgaatctcttctcgaccggaaagtgcaggcattgaagcgtttagctgatgcggccgagaattttcagaaagcacacaggtggcaggataacatcaaggaagaagacattgtttattatgacgcaaaagcagacgcagaactcgatgatcccgagagtgaagacgtggagagggggtcgaaagcctcgacacttcgcctggactttatcgaggatcctaatttcaagaacaaggtcaattacagttatgccgccgtgcaaattcctactgacatatacaaaggcagcactgtgatcttaaacgagctcaactggactgaagccctcgaaaacgtgttcatggagaatcggaggcaagatccgacccttttgtggcaagtgtttggcagtgctactggagtaactaggtactaccctgctacaccgtggagggccccaaagaaaattgacttatatgacgtccgccgaagaccatggtatatccagggcgctagttcgcctaaagacatggttattatcgtcgacgtttccggctccgttagtggcctaactctgaagttaatgaagacctccgtgtgtgaaatgctagacaccttgtccgacgatgattacgtaaacgtggcatcattcaacgagaaggctcagccagtgagttgcttcacacatctagtgcaggcaaacgtccgaaacaagaaggtgtttaaggaggcagtccagggaatggtcgcaaaaggaactaccggctataaagcaggcttcgaatacgcctttgaccagctgcagaattccaacattactcgagcaaattgtaataagatgattatgatgtttactgatggtggagaggatagggttcaggacgttttcgagaaatataattggccaaaccgcacagtaagagtgttcacattttctgtgggccaacacaactacgacgtgaccccattgcaatggatggcttgtgccaacaagggctactattttgagattccctctattggcgctattaggattaatactcaggagtatctcgatgttcttggccgcccgatggttcttgcaggaaaagaagccaagcaggttcagtggactaatgtttacgaagacgccctgggattggggctggttgtaacaggtacattgcccgtgttcaacttgacacaagacggaccaggggaaaagaaaaatcaactgatcttaggagtgatgggcattgacgtcgcattaaacgatattaaacgccttacgccaaattatacattgggtgccaacggctatgtgttcgctattgatctgaacggttacgttctgctccatcccaacctcaaaccgcaaaccaccaacttcagggaacctgtcaccttggacttcctggatgcagaactggaggatgaaaacaaggaagagattaggcgatccatgattgacggaaacaaaggccacaagcagatcaggaccctcgtaaagtctctggacgaaaggtatatagacgaggttacgcgcaactacacctgggtgccaatccgtagcacgaactactcactcggcctcgtcctccctccatactctaccttctatcttcaggcgaacctgagtgaccaaatcctgcaggttaaactgcctatttcgaagttaaaagacttcgaattcttactcccgtcctccttcgagagcgagggtcacgtatttattgccccacgagagtattgcaaagatctgaatgcatcagacaacaacaccgaatttctgaaaaattttatcgagttaatggagaaggtgaccccagactctaaacagtgtaacaactttctgctacataacctgattcttgacaccgggatcacgcagcagcttgtcgagagggtgtggagagatcaggacctaaacacttactccctgctggcagtttttgccgcaacagatggcggaatcacaagggtgttccccaacaaggccgccgaggactggacagagaaccccgagccattcaatgccagcttttataggcgatcgctggataaccatggctacgtgttcaaacctcctcaccaggatgcattgcttagacccctggagctggaaaacgatacggttggcatcttagtgtcgaccgccgtggagctgagtctgggtagaaggacgcttcgtcccgccgtcgttggtgtgaaacttgacctagaggcgtgggcagaaaagtttaaagtgttggctagcaacaggactcatcaagaccaaccgcagaagtgcggtcccaacagccactgtgaaatggactgtgaggtcaataacgaagatctgctgtgtgtgcttatcgatgatggcggctttttggtacttagtaaccagaaccatcaatgggaccaggtgggacgattcttcagtgaggtggatgctaatctgatgctagccctgtataataactcattttacacgaggaaggagtcgtacgattaccaggcggcgtgcgctccacagcccccgggcaatctgggagccgcccctagaggggtgttcgttccaacagtcgccgacttcctgaatcttgcgtggtggacatctgcggccgcctggagtctgttccagcagctcctgtacggcctcatctatcactcatggtttcaggccgatccagctgaggcagaaggcagtcctgaaacgagggagtcctcttgcgtgatgaagcagacacaatattatttcggctcagtaaatgccagttataacgcgattatagattgcgggaactgcagcagattgtttcacgcccagcgcctcacaaatacaaacctcctgttcgttgttgcagagaaacctctgtgctcccagtgcgaggcaggccgactgctgcagaaggagacccattcagatggtcctgagcagtgcgagctggtgcagagaccacgttatcgccgcgggccacacatttgctttgactacaatgcaacagaggacacaagcgactgtgggagaggtgcttcatttcccccatcccttggggtgctcgtttccctgcaattgctactactgctaggactgccccccaggccacagccgcaggttctcgtgcatgcctctagacgactttag

SEQ ID NO: 181165 - DNA, 3276 bp, Artificial Sequence
  Description of Artificial Sequence: Synthetic coding sequence
atggccggccccggcagcccccggcgggccagccggggcgccagcgccttgctggcagcagccctgctatacgcagccttgggcgacgtcgtgcggtcagagcagcagattccgctgtccgttgtgaagctttgggcatccgcgtttgggggagaaataaaatccattgccgccaagtactccggaagccagctcctgcagaagaagtacaaggaatacgagaaggacgtggccattgaggaaatcgacgggttgcagcttgtcaagaagctcgcgaagaatatggaagagatgttccacaagaaatccgaagccgtgaggaggctggtggaggcagccgaggaggcccatcttaagcacgaattcgatgccgaccttcagtatgaatacttcaacgccgttctgattaacgagagagataaggacggaaatttcctggagctgggtaaggagtttatcctggcgccaaatgatcactttaacaacctgcctgtcaatattagtttgtccgacgtgcaggtgcctacaaacatgtataataaggatccagccattgtgaacggggtatactggtctgaatcactgaacaaggtgttcgtcgacaattttgatagagatccttccctgatatggcaatattttggctccgccaagggcttcttccggcaatacccaggaattaaatgggagccagacgagaacggtgtgatcgcgttcgactgccgtaacagaaaatggtacatccaggccgcgacatctccaaaggacgtggtcattttagtggacgtaagcggatccatgaaaggactcaggctgactatcgcaaagcaaaccgttagttctattctcgatacacttggggatgatgacttctttaacatcatcgcatataacgaagagctgcactacgtggagccttgcctgaatgggaccttggtccaggccgatcgaaccaacaaagagcatttccgcgaacatctagataagttgttcgctaaagggataggaatgctcgacatcgccctgaacgaggcattcaacatcctgtccgacttcaaccacactggacagggctctatatgcagccaggccattatgcttattaccgacggtgccgttgacacctatgacactattttcgcgaagtacaactggcctgaccggaaggtgcgtatcttcacatatttgattgggcgggaagctgcctttgccgataatcttaagtggatggcttgtgccaacaagggcttttttacccaaattagcacgctggccgacgtgcaagaaaatgtcatggagtaccttcacgtgctgtcacgccccaaagtcatcgatcaggagcatgacgtggtgtggacggaagcttacatcgattctacgttgcctcaggcccagaagctcaccgacgaccagggaccagtcctcatgactactgtcgccatgccggtgttttctaaacaaaatgagacccggtctaagggaatcctcttgggagtggtggggacagacgtacctgttaaggagctgctgaagacaatccctaagtacaagcttggtatccatggttacgcatttgccatcacgaacaatggctatattctgactcacccggaactccgtcttctgtacgaggaaggtaagaaaagaagaaaaccgaattacagttccgtggatctgtcagaagtggaatgggaggacagggacgatgtgttacgcaatgctatggtcaaccggaaaaccgggaagttctccatggaggtcaagaaaaccgtggacaaaggaaaaagagtacttgttatgacaaacgactactattacacggacattaaaggaaccccctttagcttgggtgtggctttgagtcgcgggcacggaaaatatttctttcgtggcaatgtcaccattgaggaagggttgcacgacctggaacacccagatgtttccctggcggatgagtggtcctactgtaatacagaccttcatcccgaacaccggcacctgagtcagctcgaggccatcaagctgtacctcaaaggaaaagagccacttctccagtgcgacaaagagttaattcaggaagtcctgtttgatgccgtggtgtctgcaccgattgaggcctattggacctcactggcccttaataaaagcgagaactcagataagggggttgaagtggcatttctgggcacccgaacaggtttgagcagaataaacctgttcgtgggcgccgagcaactgactaaccaggacttcctgaaagcaggagataaggaaaatatttttaacgccgaccactttccactttggtatcgccgagccgctgagcagatccctggcagctttgtatactccatcccctttagtaccgggcctgtgaacaaatccaatgtagttacagcttctacgtccattcagctccttgacgaacggaagtcccctgtggtcgctgccgtcggaatccaaatgaaactagagttttttcaaagaaagttttggacggcgtcgagacagtgtgccagtctggacgggaaatgttcaatatcttgtgacgatgagaccgtcaactgctacctgattgacaacaacggcttcatcctcgtgtcagaggactatacccaaactggcgatttctttggcgagatcgagggggcagtgatgaataagctgctgactatgggttcattcaaaaggataactctctacgactaccaggccatgtgcagggccaataaggagtctagcgacggtgctcacggtcttctggacccttataatgccttcttatccgccgtcaaatggattatgacagagttagtcttgttcctagttgagttcaatttatgttcctggtggcactcggacatgaccgccaaggcccagaagctcaagcagactcttgaaccttgcgataccgaatacccagcatttgtgtccgagcgaactatcaaggaaacaacaggcaacatcgcgtgcgaggactgctcaaaatcatttgtgatccagcagatcccctcttcaaatctttttatggtagttgtggatagctcctgtctgtgcgaatctgtggcccccatcacaatggcgccaatagaaatccgctacaacgaatcgctgaaatgcgaaagactcaaggcacaaaagatcaggagaagacctgaatcctgccatggcttccacccagaagagaacgcccgagaatgcgggggcgccccatcattacaggcgcagaccgtgttactgttgctgccactgcttttgatgttgtttagtagatag

SEQ ID NO: 181166 - DNA, 2997 bp, Artificial Sequence
  Description of Artificial Sequence: Synthetic coding sequence
atgggcgagctgcggcaggagcggagcaccgccctgcagcggctggtggaggcagctgaagaagctcacctaaagcacgaatttgatgccgatctgcagtacgagtatttcaacgcggtgttaattaatgagcgcgataaagatggtaactttttggaacttgggaaggaatttatccttgctcccaacgatcatttcaacaacctgcctgtgaatatttccctcagtgacgttcaggtacctaccaacatgtataataaggatcccgctatcgtgaatggggtgtattggagcgagtcgctcaacaaagtctttgtagacaatttcgaccgagatccaagtctgatttggcaatattttggctccgccaagggattctttcgccaataccccgggattaaatgggagccggatgaaaatggcgtgatagctttcgattgtcggaacaggaagtggtacatacaggccgcaactagcccgaaagacgtcgtgatcctggttgacgtgagcggttctatgaaggggctcaggcttacgatcgctaagcagactgtgtccagtatattagacactttgggggatgatgacttctttaatattattgcctacaatgaagagctgcactatgtggagccctgtctaaatggaacactggttcaggccgatcggaccaataaggagcactttcgcgagcatctcgacaagctgtttgccaaaggtatcggcatgctggacattgccctcaacgaagcctttaatatcctttcagattttaatcacacgggccaggggtcaatctgttcgcaagctattatgctcattaccgatggggccgtggatacttatgataccatctttgcaaagtacaactggcctgatcggaaagtcaggatctttacatatttaatcggacgcgaagcagctttcgcggataatctaaaatggatggcgtgcgcgaataaaggattcttcacccaaatctccaccctggcagatgtgcaagaaaatgtgatggaatatctccatgtgctgagccgacctaaagtaattgaccaggagcacgatgtggtgtggacagaggcatacatcgattccactgtgtcccaggcggagcagctcaccgatgaccagggacctgtgctgatgacaaccgtcgccatgcctgtgtttagtaagcagaatgagactcgctctaagggcattctgctgggagtggtggggactgacgtgccagttaaagaactgctgaagacaattcccaagtataaactcgggatccatgggtatgcctttgccattactaataacggatacatcctaacacaccccgagctacggctgctgtacgaagaggggaagaagcgacgcaaaccaaactactcttcagtagacctctctgaagttgagtgggaagaccgcgatgacgtgctgaggaacgcaatggtcaaccgcaagacaggcaaattctcaatggaagtgaaaaagaccgttgacaaggggaaacgggttctggtcatgactaacgactactactatacagatattaaaggcaccccgttttctctaggagtggcactttcgcggggccacgggaaatatttcttccggggtaatgtgactatcgaggaagggctgcacgatctggagcaccccgacgtgagcttagccgatgagtggagctattgtaacacggacctgcatcccgaacacagacacttgtctcagcttgaggcaataaaactctaccttaaaggcaaagagcccctgctgcagtgcgacaaagagctaatccaggaggtgctctttgacgccgtggtgtctgctcctattgaggcgtactggacctccctcgccctgaataaatccgaaaattccgacaaaggcgtagaggtggcttttttgggcaccagaacgggtctttctagaatcaatctgtttgtgggcgcagaacagcttactaaccaagactttcttaaagcaggagacaaagaaaacattttcaatgctgatcacttccccctgtggtacagaagagcagccgagcagataccgggatcctttgtgtactccatccctttttcgaccggccccgttaacaagtctaacgtggtcactgcctccacatccatccagctgctcgatgagcgcaaaagtcccgtcgtggccgctgtgggcatccagatgaagctggagttttttcagcgcaagttctggacagcatcacgccaatgcgctagtctggacgggaaatgctcaattagctgtgacgacgagactgtgaactgctacctcattgataataatggatttatcctcgtcagcgaggactacacccagactggagacttctttggagagatcgaaggtgccgtgatgaacaagctgctcactatgggctcatttaaacgcataacactgtacgactatcaggcaatgtgccgggccaacaaagaatcctctgacggcgcccacggcctgctagacccttataatgcctttctcagtgcggtgaaatggataatgaccgaactcgttttgtttctggtggagttcaatctctgtagttggtggcattccgacatgactgcgaaagcgcagaagttgaaacagaccctcgagccctgtgataccgagtatccagcctttgtgtctgagagaactattaaagagacgacaggtaatattgcctgtgaagactgctcaaagtctttcgtgatacagcagatcccttcttcaaaccttttcatggtggtagtggatagttcctgtctctgtgagtccgttgcgcccataactatggcccctatagagatttcccagcataacgagagcctcaagtgtgagaggttgaaagctcagaagattcggcgtaggcccgagagttgccacggattccaccctgaagaaaatgccagggagtgcggcggggccccttcacttcaggctcagacggtgttactgctgcttcctctgctcctaatgctgtttagccgttag

SEQ ID NO: 181167 - DNA, 3276 bp, Artificial Sequence
  Description of Artificial Sequence: Synthetic coding sequence
atggccggccccggcagcccccggcgggccagccggggcgccagcgccctgttggccgccgctctcttgtacgccgcacttggggacgttgtgcggagtgaacagcagatccccctgagtgttgtgaaactgtgggcctctgcatttggcggtgagataaagtctatcgcggccaagtacagcggatctcagcttctgcagaaaaagtacaaggaatatgagaaggatgtggcgatcgaagagatagacgggctgcaattggtgaaaaaattggccaaaaacatggaagaaatgtttcacaaaaaatcggaggccgttcgccgcttggtggaagctgctgaggaagctcatcttaaacacgagttcgacgccgacctgcagtacgagtacttcaacgcagtactgattaacgaaagggacaaagatggcaactttctggagcttgggaaggaatttatcttagcccccaacgatcatttcaacaatctgcctgtcaatatcagcctgagcgacgtgcaagtgccaaccaacatgtataataaggaccccgccatcgtcaacggtgtgtattggtctgagagtttgaacaaagtgttcgtggacaattttgaccgcgaccctagcctgatttggcaatatttcggctcagccaagggcttcttccgtcagtatccgggaattaagtgggagccagatgaaaacggtgtcatagccttcgactgccgcaatcgaaagtggtacatacaggccgccacatcaccaaaagacgtcgtgatcctggtggatgtgtcagggagcatgaagggactccggcttaccatcgcaaagcagacagtttcttcaattctggacactttaggcgatgatgattttttcaacattatcgcatataatgaagaacttcattacgtcgagccatgcttgaacgggaccctcgtccaggccgaccgaaccaataaggaacacttccgcgagcacctggataagcttttcgctaaggggattggcatgctggatatcgccttaaatgaagccttcaacatcctgtctgacttcaaccacaccgggcagggcagcatttgttctcaggctatcatgctgatcaccgatggggcagtcgatacttacgataccatcttcgctaaatacaattggccggacagaaaagtgaggatcttcacatatcttatcggcagagaggcagccttcgcggacaatctcaagtggatggcatgcgctaataaagggtttttcacgcaaatcagtacattagcagacgttcaggaaaacgtcatggagtacctgcacgttctctcgcgacctaaagttatcgatcaggagcatgatgtggtatggactgaggcatatatcgactcgaccctgccgcaggcccagaaactgacggatgaccaaggaccggtcttaatgacaaccgtggcaatgccggtgttttctaaacagaatgagaccaggagcaagggaatcctgctcggagttgtgggaaccgatgtgcctgtaaaagaactgttgaagacaattccaaagtacaagctggggattcacggttacgctttcgcgatcacaaataatgggtacatcctgacccaccctgaactccggctcctgtacgaggagggcaagaaaaggagaaagccaaattactcctccgtcgacttgtcagaagttgaatgggaagacagagacgacgtcctgcgtaacgcaatggtcaatcgaaaaacgggtaagtttagcatggaagtgaagaagaccgttgataagggcaagcgtgtactggtgatgacaaacgattactattataccgatatcaagggcaccccattttcgctaggagtggcactgtccagagggcatggcaagtatttctttcgagggaatgtaaccatcgaagaggggttacatgacctggaacatcccgacgtgtcattggcagatgagtggtcatactgtaacactgacttacacccagaacatcgccacttgtctcaactggaagcgattaaactgtacctgaagggtaaggaacctctgcttcagtgtgacaaggagctgattcaggaggttctgttcgacgccgttgtgtccgcacctatcgaagcttattggaccagcctggctttgaataagtccgagaactctgacaaaggcgtcgaggtggcgttcctgggcaccaggaccggcctctctcggatcaatctgttcgttggggcagagcagctgaccaatcaagactttctcaaggccggcgacaaggaaaacatttttaacgcagaccacttcccactctggtatagacgcgccgctgagcagatccccggatctttcgtgtatagcattcccttctcgaccggacctgtgaataaaagcaacgtggtcacagcttctaccagtatccaacttcttgatgaaagaaagtccccagtcgtggccgccgttggcattcaaatgaagttggaattttttcagcggaaattttggacggcgagtcgtcaatgcgcatcacttgacggtaagtgtagcatttcttgcgatgatgagacagtgaattgttacctcatagacaacaacggtttcatcttggtgagtgaagattatacacaaacgggggacttctttggcgaaatagaaggggcggttatgaataagttactgaccatgggaagcttcaagagaattaccctctatgactaccaggccatgtgcagggctaataaagagtcatctgacggcgcccacggcttactggacccgtacaatgcatttctgtccgccgtgaagtggattatgaccgagcttgtgctattcttagtggaattcaatctctgttcttggtggcattcggatatgacggctaaagcccagaagctgaaacagacattggaaccatgcgatactgaataccccgccttcgtgtctgaacgtacaatcaaagaaactactgggaacatagcatgtgaggattgtagtaaatccttcgtaattcagcaaatcccgtcttcgaacctctttatggttgtagtggactcttcttgtctgtgcgagagtgtggctcccattaccatggcacccatcgaaatacggtataatgagtcattgaagtgcgaaagactgaaagcccagaaaattagaaggagaccggaaagctgccacggctttcacccagaggagaatgcccgagagtgtggtggggcccccagcctgcaagcccaaacagtgctgttgctcctgcccctactgcttatgctgttcagtcggtag

SEQ ID NO: 181168 - DNA, 1557 bp, Artificial Sequence
  Description of Artificial Sequence: Synthetic coding sequence
gagatcctgttccaccagatgcagaaccagatcaagcggctggtggaggcggccgaggaggcacatttgaagcatgaatttgatgcagacctgcaatatgagtattttaacgctgtactgatcaatgagcgcgataaagatggcaacttcctggaactggggaaggaattcatcctggccccgaatgaccactttaataacctgcctgtcaatatcagtctgtccgatgtacaggtccctaccaatatgtacaataaggatcctgccattgttaacggggtgtattggtccgaaagcctgaataaggtgttcgtggacaacttcgacagagacccttccctcatctggcagtatttcggaagcgctaaaggtttcttccgccagtatcccggaattaagtgggaacccgatgaaaacggagtgatcgcctttgattgtagaaaccgcaaatggtatattcaggccgctacaagccctaaagatgtggtgattctcgtggacgtgtccggaagcatgaagggattgcgactaaccatcgcaaagcagacggtcagcagcatcctggatactctgggggatgatgacttcttcaacattatcgcctataacgaggaactgcactatgtcgagccctgtctaaatggcactctggtgcaggccgacagaactaataaagaacactttcgtgaacatttggataaactgtttgctaagggcattggcatgctagacatcgccctgaacgaagccttcaatattctgtccgattttaaccacactggtcagggaagcatctgctcacaggcaatcatgctgattactgacggtgccgtcgacacatacgacacgatcttcgccaagtataactggccagatagaaaagtgcgaatatttacttatttgatcggaagggaggcagcctttgcggacaatttaaagtggatggcttgcgccaacaagggtttctttactcagatctccaccctcgctgatgtccaggagaatgtgatggagtacttgcacgtgctgtcacgccccaaagtcattgatcaggagcacgatgtggtttggacagaagcctacattgactctacactcacagatgaccagggacctgtcctgatgaccactgtcgctatgccagtgttttcaaagcagaatgagacacggtctaaagggattctgctgggggtcgtcggaactgacgtccccgtaaaggaattgttgaaaaccattccaaagtacaagttaggcatccacggctacgccttcgccataacgaataacggatacatcctaacccaccctgagctgcggctgctgtacgaggagggcaaaaagagaaggaagcccaattattcctcagtggacctctctgaggtcgaatgggaagatcgagacgatgtcttgcgaaatgctatggtcaatagaaagaccgggaagttcagcatggaggttaaaaagaccgtggacaagggctttcgctgtggcgcgtttcagcggtcttgggaaattttcctgcctagagagtgcaatcacaggcgtcgtcccgcttag

SEQ ID NO: 181169 - DNA, 3276 bp, Artificial Sequence
  Description of Artificial Sequence: Synthetic coding sequence
atggccggccccggcagcccccggcgggccagccggggcgccagcgccttgctcgccgctgctttactctacgccgcactgggggatgttgtgcgtagcgagcagcagatccccctgagtgtggtgaagctgtgggcttcagcttttggaggcgagattaaatctattgccgccaagtatagtggaagtcagcttctgcagaaaaagtacaaagagtatgaaaaggacgttgcgatcgaggagattgatggtctgcagctggtcaagaagctggccaagaacatggaagagatgtttcacaagaagtctgaagcagtgcggcggctggtggaggctgccgaggaagctcacctgaagcatgagtttgatgcagacctccagtacgagtattttaatgccgtgctgatcaatgaaagagacaaggacggaaatttcctggaactggggaaggaatttatcctggccccaaatgatcactttaacaatctcccagtaaacatatcactctccgatgtgcaggtcccaaccaatatgtataacaaagatcccgcaatcgtaaatggcgtttactggtctgagagcctgaacaaagtgtttgtggacaattttgatagagatcccagtctgatctggcagtattttggtagcgctaaggggttcttcagacagtaccccgggatcaagtgggaaccagatgagaacggtgttatcgccttcgactgccgaaacagaaagtggtacattcaggcggcaacttcacccaaagacgtcgtgattcttgtagacgtgagcggaagcatgaaagggcttcggttaacgatcgccaagcagactgtctctagtatccttgataccctcggtgacgatgattttttcaacattattgcatataatgaagaattgcactacgttgagccctgtctgaacggaactctcgttcaggctgatcggaccaacaaagagcacttcagagagcatctcgataagctgttcgctaaaggcatcggaatgttagacatcgcactgaatgaggccttcaacatcctgtccgattttaaccacactggacagggcagcatatgttctcaggcaatcatgctgattaccgatggggcggtcgacacatacgatacgatctttgccaagtataactggcccgaccgcaaggtaaggatcttcacatatctgatagggagggaggcagccttcgccgataatcttaaatggatggcatgtgcaaacaagggattctttacacaaatctccacgttggctgacgtgcaggaaaatgtcatggagtacctccatgttctcagcagacctaaagtcattgaccaagagcatgacgtagtctggacggaggcctatatcgactcaacactcccccaggctcaaaaattgacggacgatcaaggtccggtgttgatgaccaccgttgcgatgccagttttctcaaagcagaacgaaaccaggtctaagggaatcctcctgggtgtcgtcggaaccgacgtgccagtgaaagaactgctaaaaacgatacctaaatacaaattgggcattcatgggtatgcatttgccattactaacaatggttacatcttgactcacccagagctgcgcttgctttacgaagaggggaagaagcggagaaagcctaactatagttctgtcgacctgagcgaagtcgaatgggaggatcgtgacgacgtactgagaaacgccatggtgaaccgtaagactggaaagttcagtatggaggtgaaaaagactgtggacaaggggaaacgggtcctcgtgatgacaaacgattactactataccgatatcaaggggacaccattctccttaggagttgcactaagcaggggccacggtaagtatttctttcgggggaatgttactatcgaggagggacttcatgatttggagcaccctgatgtctccctcgcagacgagtggagttattgcaatacagaccttcatccagaacatagacacctcagtcagctggaggctatcaagctttacctcaaggggaaggagccactgctgcagtgcgataaggagctaatccaggaagtactctttgacgcagtggtcagcgctccaatagaggcttactggactagtttagccttaaataagtccgagaactccgacaagggcgttgaggtggcgttcctgggaactagaactggtttgagtagaattaacctgttcgtgggcgccgaacaactgactaatcaagactttctcaaggccggggacaaggaaaatattttcaatgccgatcacttccctctgtggtacagaagggccgccgaacagattccaggcagcttcgtttatagcatcccctttagtacaggcccagtaaataaatcaaacgtggtcactgcttcaacatctatccaactgctggacgaaaggaagtccccagtggtagctgccgtgggtatccagatgaagctggagttctttcaaagaaagttctggacagcgagtcgccagtgtgcaagtctggatggtaaatgctccatctcctgtgacgatgagaccgtgaactgttacctcatagacaacaatggctttatcttagtcagcgaagattatacccagactggagatttttttggtgagattgagggagccgttatgaacaagctactgacaatgggcagctttaagcgaatcaccctgtatgactatcaggctatgtgtagagctaacaaggagtcctctgatggcgcacacggtctattggatccttacaacgcttttttgtctgcggtgaaatggataatgactgagctggttctgttcctagtagaattcaatctgtgcagctggtggcactctgatatgacagccaaggcacagaaactgaagcagaccctggagccctgtgatactgagtacccagcattcgtttccgagagaacaatcaaggaaactacgggcaacatagcctgcgaggattgtagcaaatcattcgtcattcagcagatcccctcctcaaacctcttcatggtcgtcgtggactcatcatgtctttgcgagtcagtagcacctatcaccatggcacccatcgagattaggtacaacgaaagccttaaatgcgagcggctcaaagcgcaaaagatcagaaggaggccagagtcctgccacggctttcaccctgaggaaaatgctcgagagtgcggcggagccccgtcactgcaggcacagaccgtgttactgttattaccacttctattaatgttgtttagcaggtag

SEQ ID NO: 181170 - DNA, 1578 bp, Artificial Sequence
  Description of Artificial Sequence: Synthetic coding sequence
atggaggagatgttccacaagaagagcgaggccgtgcggcggctggtggaagcggctgaagaggctcatctcaaacatgaatttgacgcggatctccaatacgagtatttcaacgcagtcctgatcaacgaacgcgacaaggatggcaacttccttgagctgggcaaagaatttatactggcgcccaatgaccacttcaacaacctcccagtcaacattagcctgtctgacgtacaggtgcccacaaatatgtataacaaggaccccgccatcgtgaatggagtctattggtccgaaagcctgaataaagtgttcgttgataattttgaccgagatccctctcttatatggcagtacttcgggtccgctaagggcttctttcgccaatatcccggaatcaagtgggaacctgatgagaacggagtgatcgccttcgactgtcggaacagaaaatggtacatccaggccgccacaagtccgaaagatgtcgttattctagttgacgtgtctgggagtatgaaagggttgcgattaacgatcgccaaacagacggtgtcttctatcctcgatacactcggagacgatgattttttcaatatcattgcttacaacgaggaattacactatgtggaaccatgccttaatgggacacttgtgcaggctgatcgcacaaacaaggaacatttccgggaacaccttgacaaacttttcgccaaaggtatagggatgttggatatcgccttgaacgaagccttcaacatcttgtccgatttcaaccacaccggtcagggatccatttgcagtcaggccattatgctgatcactgatggagcagtggatacatatgacaccatcttcgctaagtataactggcccgaccgtaaggttaggattttcacatatctgattggtcgagaagctgcattcgctgacaatctcaagtggatggcctgcgccaacaaaggcttctttacccagatttccacccttgctgatgttcaggagaacgtgatggaatacctgcatgtgctgagccggccgaaggtgatcgatcaggagcacgatgtggtgtggaccgaagcatatatcgattccacccttccgcaggcccagaaactgacagatgatcagggcccggtgttgatgacaactgtggccatgcctgttttttcaaagcagaacgaaaccaggagcaagggaattttattaggggtggtgggaacggacgtgcctgtgaaggagcttttgaaaaccattcctaaatacaaactcgggatccatgggtatgccttcgccattactaacaatggctatatactgacccaccctgaactccgactgctctatgaagagggcaaaaagcgccgaaagccgaattacagctcagtcgatttatctgaagtcgaatgggaggaccgcgatgacgttctcaggaacgccatggtgaatcgaaaaactggcaaatttagtatggaggttaagaagacggtcgacaaggggttcagatgtggtgcctttcaacgatcctgggagatcttcctgcctcgagagtgtaaccacaggcgcaggccagcctag

SEQ ID NO: 181171 - DNA, 2994 bp, Artificial Sequence
  Description of Artificial Sequence: Synthetic coding sequence
atggaggagatgttccacaagaagagcgaggccgtgcggcggctggtggaggcagccgaggaagcacacctcaagcatgagttcgacgcagatctacagtatgaatattttaacgctgttctgattaacgagagggataaagacgggaatttcttggagctgggtaaggagttcatcctggctcccaacgatcatttcaataaccttcccgtgaatatttccctttcggacgttcaggtccccactaatatgtacaacaaggatccggctatcgtgaatggagtctattggagcgagagtctgaacaaggtgtttgtagacaactttgacagagacccatccttaatttggcagtattttggtagcgcaaaaggtttctttcggcaatatcccggaataaagtgggaaccagacgagaatggagtgatcgctttcgactgtcgcaacagaaagtggtatattcaggcagccacatcccccaaggatgtcgtgattttagtggatgtcagcggcagcatgaaaggactgcgcttgactatcgccaaacagacggtatcgtcaatcctggatactttgggggatgacgacttctttaacattatcgcttataacgaggagctgcactatgtcgagccctgtcttaatggtacgttggtccaggcagacagaactaacaaggagcacttccgggaacatctcgacaagttgtttgctaaaggtataggaatgttagatatagctctgaatgaagcattcaacatcctgtcggacttcaatcatactgggcagggatcaatttgctctcaggcaatcatgctgatcaccgatggcgccgtcgatacatatgacaccattttcgccaagtacaactggcctgacagaaaggtgcgcatcttcacttacctcattgggagagaagctgcgttcgcggataacctaaagtggatggcctgtgctaacaagggcttttttacccagatcagcacactagctgacgtgcaggaaaacgtgatggaatacctgcacgtgctcagccgacccaaagtcattgatcaggagcatgatgtggtgtggacagaggcgtacattgattctacactgcctcaggcccagaagctaacagacgatcaaggtccagtgctgatgaccacagtagccatgcctgtgttttctaaacagaatgagacccgctcaaaggggatccttcttggagtggtggggactgacgtgcccgtgaaagaacttttaaagaccattccgaaatataagctagggatccacggttacgctttcgccatcaccaataacgggtacatcctgacccatcccgagctcaggctgctgtacgaggagggaaagaagagacggaaacccaactattctagtgttgatctctctgaagtggaatgggaggacagggatgacgtcctgcggaacgctatggtaaatcgcaagactggtaaattctctatggaagtgaagaagacagtggataaggggaagcgcgtgctggtgatgacgaacgactactattatacagatattaaaggaacccccttctccctgggggttgccttgagcagagggcatggtaaatattttttccggggaaatgtgacaattgaggagggcctgcatgatctggaacatccagatgtaagtctggctgacgaatggtcttactgcaataccgacctccaccccgagcatcggcacctgtcacagttggaagcgatcaaactctacctgaaaggaaaagaacctctacttcaatgtgataaagaactgatccaggaggtgctgtttgacgcagtcgttagtgcaccgattgaagcatactggaccagtctcgccctcaacaaatccgagaacagcgataagggtgtggaagtggcgttcctaggaacaaggacaggcctctcaaggatcaacctgtttgtgggggccgagcagctgactaaccaggacttcctaaaggcaggtgacaaggaaaatattttcaacgcagaccactttccactgtggtatcgcagggctgccgagcagatcccgggtagcttcgtgtacagcataccatttagcactggacctgttaataaatcgaatgtggtgacagcgtctacatctattcaattacttgacgaacgaaaaagccctgttgttgccgcggtgggtatccagatgaagctcgaattcttccagcgcaagttttggaccgcttccaggcagtgcgcttctctggatgggaagtgcagcatatcctgcgacgacgagactgtgaactgctatctaatcgataataacgggtttatccttgtgagcgaggattacacacagaccggagatttctttggcgagatcgagggcgccgttatgaataaactgcttacaatggggagctttaagcggatcacactctatgattaccaggctatgtgtagagccaacaaagagtcatctgacggagcgcacggtttgctggatccctacaacgcattcctctctgcggtgaaatggattatgaccgaattggtgttgtttctggtagaattcaatctgtgctcatggtggcacagcgatatgacagccaaagcccaaaagttaaagcagaccctggaaccttgtgacactgagtatccagcattcgtgtctgaaagaaccatcaaggagaccacaggcaatatcgcttgcgaagactgctccaagagctttgtcattcaacagattccgagctccaacttgttcatggttgtggtcgactcaagctgtctctgtgagtcagtcgcacccatcacaatggcccctattgagattaggtataatgaatcccttaagtgtgaaagactcaaggcccaaaaaattcgcaggcgacccgagagctgccacggttttcaccctgaagagaatgcccgggagtgtggaggggccccctctctgcaggctcaaacagttctccttctgctaccacttcttctgatgctcttcagcaggtag

SEQ ID NO: 181172 - DNA, 381 bp, Artificial Sequence
  Description of Artificial Sequence: Synthetic coding sequence
atggaggagatgttccacaagaagagcgaggccgtgcggcggctggtcgaagcggccgaggaggcccacctgaagcacgagtttgacgccgacctgcagtacgagtatttcaacgccgtactgattaacgagcgtgataaagacggtaacttcctcgagctgggcaaagaatttatcttggccccaaatgaccacttcaacaacctgcccgtcaacatctcattgagcgatgtccaggtgcctaccaacatgtacaataaggaccctgctattgtgaatggagtctactggtctgagagtctgaacaaggtcttcgtagataacttcgacagagaccccagtctgatttggcagtatttcgggagtgctaaaggtttttag

SEQ ID NO: 181173 - DNA, 2925 bp, Artificial Sequence
  Description of Artificial Sequence: Synthetic coding sequence
atggtgtgcggctgcagcgccctgctgcccctgcccaacccccggcccaccatgccagctacacctaacttcctggctaatcctagctcctcttccaggtggattcccttacagccaatgccggtcgcctgggcctttgttcagaagaccagtgctctgctgtggctcctgctgctgggtacttccctgagccctgcctggggtcaggcgaagatacctctcgagactgtgaagttgtgggcagatacgttcggaggagatctttacaataccgtgaccaaatattcaggctcattgctgctccagaagaaatacaaggatgtggagtcctctttaaagattgaagaggttgacggacttgagcttgtcaggaagttctccgaagacatggagaatatgctgcgtaggaaagtagaagccgtgcagaacctggtggaagccgcagaagaagctgatttaaaccatgagttcaacgagtctctggtgttcgattactacaattctgttctgatcaacgagcgtgatgagaagggcaatttcgtggagcttggcgccgagttcctgctcgagagcaatgcccatttctccaatctgcctgtaaatacttcaatctcctcagtgcaattaccgacgaatgtgtacaacaaggacccggatattctgaacggcgtctatatgtcagaagcactgaacgctgtgtttgtggagaactttcagagggatccaacacttacgtggcagtattttgggagcgcaacagggtttttcagaatctatcccgggattaagtggacacctgacgagaacggggtgatcacatttgattgcaggaacagagggtggtacattcaggccgctaccagccctaaagacatcgtcattttggtcgacgtctcagggagtatgaagggactgagaatgacaattgccaagcataccataactactattctagacaccttaggagaaaacgactttattaatattatcgcctataacgactatgtgcactacatcgagccctgcttcaaaggaatcctcgtgcaggctgaccgcgacaatagggagcactttaagctcctggtagaggaattaatggtcaaaggcgtgggggtggtggaccaagctctcagggaggcctttcaaatactcaaacaattccaggaggctaagcagggaagcctctgtaaccaggcaattatgttaatctccgacggggcagtggaggactacgagcccgtatttgaaaaatataactggcccgattgcaaggtgcgggtgttcacatatcttatcggacgagaagttagttttgctgataggatgaaatggatcgcttgtaataacaagggatattacacccaaattagtaccctggctgacactcaggagaacgttatggagtatctccacgttctgagtcgccccatggtaatcaaccacgatcacgacattatctggacagaggcctacatggattccaagctgctgagctctcaggcccagtccctgacccttttgactacagttgccatgccagttttctccaaaaaaaatgaaacacgcagccacggaattctgctgggcgtggttgggtcagatgtggccttgcgggaattgatgaagctcgccccgcgttacaagctgggggttcatggctacgcttttcttaacacaaataacgggtatattctgtcccatcctgatctgcggcctttatatcgcgaagggaagaagctgaagcctaaacctaactataactctgttgatctgtctgaggtggagtgggaggatcaggccgagtctttgagaacagccatgatcaatagagaaacgggcactctgagcatggatgtcaaagtgcccatggataaaggtaagagagtgttgttcctgacgaacgattacttctttactgatatcagcgatactcccttctctctgggcgtggttctctcacgagggcatggggaatatattctcctggggaatacctcggtggaagaagggctgcacgatctattacaccccgatctagcactggccggggactggatctactgcatcaccgatattgatcccgaccacagaaaactcagccagctggaagcaatgatccgctttttgacgcggaaagacccagaccttgagtgtgacgaagaacttgtcagggaggtcttgtttgatgccgtagttaccgcgcccatggaggcgtactggacggctctggctctgaacatgtctgaagagagtgagcacgtggtggacatggcattcctggggacgcgggccgggctgctgcgctcttctctcttcgttgggagcgagaaagttagcgacaggaaatttctgactcccgaggacgaagcctctgtgtttacgctggatagatttcctctctggtaccggcaggcctcagagcatccagcaggcagcttcgtctttaatctccgctgggcagaggggcctgagagtgctggtgagccgatggtggttactgcttcgactgccgtggccgttacagtggacaaaaggaccgccatcgctgctgcagcgggtgtgcagatgaagctcgaatttctccagagaaagttttgggcagccacaagacaatgctcaacagtcgatggaccctgcacacagtcctgtgaagactctgacctagactgttttgtgatcgacaataatggattcatactgatcagcaaacgatcgagagagactggcagatttctgggcgaggtcgacggggctgtcctgacccaactgcttagtatgggggtgtttagccaggtgactatgtacgactaccaggccatgtgtaagcccagctcccaccatcactcagcggcccagcccctcgttagccctatcagcgcatttttgactgcgacaaggtggttgcttcaggagttggtcctgtag

SEQ ID NO: 181174 - DNA, 3414 bp, Artificial Sequence
  Description of Artificial Sequence: Synthetic coding sequence
atggtgtgcggctgcagcgccctgctgcccctgcccaacccccggcctacgatgccagcaaccccaaattttctggcgaaccccagctcttcatctcggtggatccctctccagcccatgcccgtggcatgggcatttgtgcagaaaacctccgcactgttgtggctgctgctcctgggcacatctctctcgcctgcatggggccaagccaaaatccccctggagacagtgaagctctgggctgacacttttggcggggatctgtataacacggttacaaagtattctgggtcccttttgctccaaaagaagtacaaggacgtggagagttctctcaagattgaagaggtagatgggcttgaactcgtgaggaagttttctgaggacatggagaatatgttgcggcgcaaagttgaagccgttcagaacctggttgaggccgcagaagaggccgaccttaaccacgagtttaatgagtctcttgtgttcgactactacaatagtgtcctgatcaacgaacgggatgagaagggaaatttcgtggagctaggagcggagttcctgttagaatctaacgcgcactttagcaatctgcccgtaaatacaagcatcagctcagtccagctgcccacaaatgtatacaacaaggatcccgacatcctcaacggggtgtatatgagcgaggcgctcaacgccgtcttcgttgaaaattttcaacgggatcccaccttgacatggcagtatttcggctctgccactgggttcttcaggatttacccaggaattaagtggactccggacgagaacggagtgatcacgttcgattgtagaaaccgcggctggtatatccaggccgccaccagcccgaaagatatagtcattttggtcgatgtctccggctccatgaaaggcctccggatgaccatcgccaaacacacaatcaccaccattcttgatacgctgggcgaaaatgacttcattaatatcattgcgtacaacgactacgtccattacatagaaccttgttttaaaggtatcctagtccaggctgatcgggataaccgggagcatttcaaactgctggtagaagagctgatggtgaagggtgtgggagtggttgatcaggctctgcgtgaggccttccagattctgaagcagtttcaagaggccaagcaaggatctctgtgtaatcaggctattatgcttattagcgatggggctgtagaggattacgaaccggtattcgaaaaatacaattggcctgattgcaaagtacgtgtatttacatatctcattgggagggaggtctcattcgcagaccgtatgaaatggatcgcatgcaataataagggttactatacacagatctccactctggcagatacacaggaaaacgttatggaatatttgcacgtactctctcggcccatggtgatcaaccacgaccatgacataatttggactgaggcatatatggatagtaagctcttgtcgtcgcaggctcagtcactgacactcctaacaactgttgcaatgccagttttcagtaaaaaaaacgaaacacgtagtcatggcatactgttgggcgttgtcggaagcgacgttgccctgagggagttgatgaagttagctccaagatataaactcggcgtccatgggtacgcgttcctgaacaccaacaatggctacatcctgagccatcctgatctgaggcctctctatcgggaggggaaaaagctcaagccaaaaccaaattacaacagcgtcgacctttcggaggttgaatgggaggaccaggctgagtcactgcgtacagcaatgatcaatcgtgaaacaggaaccttatcgatggatgttaaagtgccaatggataaaggcaaaagggtcttattccttacaaatgactatttcttcacagacattagtgacaccccctttagcctgggcgtggtactctcccgcggtcacggagaatatatcttgctgggaaacaccagtgttgaggagggcctgcacgacctcctgcatcctgaccttgcattggctggcgactggatttactgtatcacggatattgacccagaccacaggaaacttagtcaattagaggcgatgattagatttctcacgcggaaggatcccgatctcgaatgtgatgaggaactagttcgagaggttctgttcgacgctgtggttaccgccccgatggaggcttattggaccgcacttgccctgaatatgtccgaggaaagtgagcacgtggtcgatatggcatttctcgggacccgggctggtctcctgcggtcatcactctttgtcggatctgaaaaggtatccgatcgtaagtttctaacaccggaggatgaggccagcgtgttcacactcgaccggttccccttgtggtatcgccaagcatccgaacatcccgctgggtcgtttgtctttaacctcagatgggccgagggccctgagtcggccggcgaaccaatggtagtgactgcctctaccgcggtggccgttaccgtagataaacggacggcaattgcagctgcggccggagttcagatgaaacttgagttccttcagcgcaagttctgggcggctactcgccagtgtagcacagtggacggtccatgtacacaatcgtgtgaagactcagatctggattgcttcgtgatcgataacaacgggtttatccttatctccaagcggtccagagaaactggccgttttttaggcgaggtggatggggccgtcctcactcagttgctgagtatgggagtcttttcgcaggtaaccatgtatgattatcaggccatgtgcaagccatctagccaccaccattcagctgcccagcctcttgtcagccccatctcagcttttctgactgctacgcggtggttgctccaggagttagttctgtttctgctcgaatggtccgtgtggggttcttggtacgacaggggagcggaggcaaaatctgtgttccatcactcccataagcataaaaagcaggaccctttacagccgtgcgacaccgagtaccctgtgttcgtttaccagccagcaattcgcgaggcaaacggtatcgttgagtgtggtccctgtcaaaaggtgtttgtggtgcaacaaataccgaactccaacctgctgttgcttgtgacggatcccacctgcgattgctctatttttcctccggtgcttcaagaagccactgaggttaagtataacgctagcgtcaaatgtgacagaatgaggagtcagaagctccggaggcgtcctgactcttgccacgcatttcacccagaagagaatgcccaggactgtgggggagcttctgacacctccgcaagcccccctctgttactgttgcccgtctgtgcttgggggctcctgccccaactgctgaggtag

SEQ ID NO: 181175 - DNA, 3222 bp, Artificial Sequence
  Description of Artificial Sequence: Synthetic coding sequence
atggccgtggccctgggcacccggcggcgggaccgggtgaagctgtgggctgataccttcggcggcgacctgtacaacaccgttacaaagtattcgggaagcctgctcctgcagaagaagtacaaggacgtagaatcttccctgaagatcgaagaggtggacggcctcgagttagtaagaaagttttccgaggacatggaaaacatgttgagacgtaaggtggaagcagtgcaaaacctcgtcgaggcggccgaagaagcagacctgaatcacgagttcaacgagagcttggttttcgactattataacagcgtcctcatcaacgagcgagatgaaaagggtaacttcgtggaattgggcgccgaatttctcctggagtctaacgcccacttctccaacctaccagtcaatacgagcatctctagtgtacagctgcccactaacgtctataataaagacccagacatcctgaatggcgtgtacatgagcgaggccctaaacgccgtgttcgtcgagaacttccaacgagatccaaccctgacctggcagtacttcggatcagccacagggttctttcggatctatccaggtatcaagtggacccccgatgagaacggagtcatcactttcgattgcagaaaccgtggatggtatatccaagcggccaccagtcctaaggatatcgtgattcttgtggacgtcagcgggtcgatgaaagggttgagaatgacaatagcaaagcacacaatcaccaccatcctggatacccttggtgaaaacgacttcatcaacattatcgcatataacgattatgtgcactacattgagccatgttttaaaggcatcttggtgcaggccgaccgtgataaccgggaacatttcaaactgttggtggaagagctgatggtcaagggtgtgggtgtcgtcgaccaggcacttagggaagccttccagatcctcaagcaattccaagaggccaagcagggcagtctgtgtaatcaggcaatcatgctaatctcagacggagcagtggaggactatgagcccgtctttgaaaagtataattggccggactgcaaagttcgcgtctttacgtatttgatcggacgcgaggtttcgtttgccgacaggatgaagtggatagcgtgcaataacaaaggatattacacgcagatcagtaccctggctgacacgcaggagaatgtgatggagtacttgcatgttctttccaggcccatggtgattaaccacgaccacgacattatctggacagaggcctatatggactctaaactgctttcctctcaggctcagtctttaaccctgctgaccacggtggccatgcccgttttcagcaagaagaacgagacccgcagccacggaatcctcctaggtgtagtcggctcagatgtggcgcttagggagttaatgaaactggctcctcgttataagttgggagtccatggatacgccttcctgaacaccaacaacggttacatcctttctcaccctgatctgcgccccctctaccgcgagggcaagaaactgaagcctaagccaaattacaatagcgtcgatctaagtgaggtcgaatgggaagatcaagccgaaagccttaggactgcaatgatcaaccgggagaccggcaccttgagtatggatgttaaagtgcctatggataaaggtaaacgagtgctcttcctgactaatgactactttttcaccgacatttccgatactcctttttcattgggtgtagtgctttctaggggtcacggtgaatacattcttttgggaaatacgtccgtcgaagaaggcctgcatgatctgctgcaccctgacctcgccctcgcaggagactggatctattgcattactgacattgatcccgatcatagaaaactgtctcagctagaggcaatgatccggttcttgactagaaaagatccagacctggaatgcgatgaggagctcgttcgcgaggtgctgtttgatgccgtcgttaccgcaccaatggaagcctattggactgcgttagctctgaacatgtccgaggagtccgagcacgtggtagatatggcattccttgggactagggcaggtctgctccggtcctccctattcgtgggctctgaaaaagtgtcagaccgtaaattcctgacccctgaggacgaagcttcagtgttcacattagatagatttcccctttggtaccgacaggctagtgagcacccagccggaagttttgtattcaatctgcgttgggccgaggggcctgagtccgcgggagaaccaatggtagtgacagccagcactgccgtggctgtaaccgtagacaagaggactgccattgcagccgccgctggtgtgcaaatgaagctggaatttctgcagagaaaattctgggccgcgacccgacagtgctctacggtggatggaccctgcacccagagctgcgaagactcagacctggattgctttgtcattgacaacaatggattcatcttaatttccaagcggtccagggaaaccggcaggtttctaggggaagtggacggggccgtactgacacagctgttaagcatgggcgtttttagccaggtgaccatgtatgactaccaggccatgtgtaaaccatccagccatcaccactccgctgcccagcctttggtgtcacctattagtgctttcctgaccgccacccggtggcttctgcaggaacttgtgctcttcttgttagaatggtcagtttggggctcatggtatgataggggagccgaagccaagagcgtgttccaccactctcacaaacacaaaaaacaggacccactccaaccttgcgataccgaataccctgtgttcgtgtaccagccggccatcagggaagcaaacggaatcgtggagtgcgggccatgtcagaaggtctttgtggtgcaacagatccccaacagtaatcttctgctgttggtgacagatcctacttgcgactgcagcatctttcctcctgtgcttcaggaggccactgaagtgaaatacaacgctagcgttaaatgtgatagaatgcgatctcagaagctccggaggcggcccgactcctgtcatgcttttcaccccgaggaaaatgctcaggactgcgggggtgcatccgatacttcagctagtccacccctccttctgctgcctgtttgcgcctggggcctgctgccacagcttctccgatag

SEQ ID NO: 181176 - DNA, 615 bp, Artificial Sequence
  Description of Artificial Sequence: Synthetic coding sequence
atgtacgactaccaggccatgtgcaagcccagcagccaccaccacagcgccgctcagcccctcgtcagccctatcagtgcattcttgaccgccacccgttggctgctccaggagctcgtactgtttctgctcgagtggtctgtatggggttcttggtatgaccgtggagctgaagcaaaaagtgtctttcaccactcccacaagcacaagaagcaagatcctctgcagccttgcgacaccgaatatcccgtcttcgtgtaccagccagctatccgagaagcaaatggcatcgtggagtgtggaccatgccagaaagtattcgtggtccagcagatcccaaattctaacctgcttctcctggtcacagaccccacctgtgattgcagcatcttcccaccagttctgcaggaagctacagaggttaagtacaatgcttcagtgaagtgtgataggatgcgtagccagaagctccggcgcaggccggactcttgccacgccttccatcctgaagagaatgctcaggactgcggtggagctagtgacacatccgcttctcctccgctacttctactgcccgtctgcgcatgggggttattaccccaactacttcggtag

SEQ ID NO: 181177 - DNA, 615 bp, Artificial Sequence
  Description of Artificial Sequence: Synthetic coding sequence
atgtacgactaccaggccatgtgcaagcccagcagccaccaccacagcgccgcccagcccctcgtttccccaatcagcgcttttctgacagccacacgctggttgctgcaggagcttgttctgtttctcttagaatggagcgtgtggggcagttggtacgatcgcggtgcagaggccaagtctgtctttcaccattcccataaacacaagaagcaagatcccctgcaaccgtgtgataccgagtatcccgtttttgtatatcagccggcaataagagaagctaatggtatagtggagtgtggcccatgccaaaaggtgttcgtggtgcaacagatccccaactccaacctgctactcttggtcacagaccccacctgcgattgctcaatctttccccctgttttacaagaggccactgaggtgaagtacaacgcaagcgtgaaatgcgatcgtatgcgaagtcaaaaacttaggaggcgccccgacagctgccatgcttttcatccggaggaaaatgcccaggactgtgggggtgcttccgatactagtgcatctcccccactgctgcttcttcccgtttgtgcctggggcctgctgcctcaactattgcgatag

SEQ ID NO: 181178 - DNA, 804 bp, Artificial Sequence
  Description of Artificial Sequence: Synthetic coding sequence
atgaagctggagttcctgcagcggaagttctgggccgccacccggcaggatctcgactgtttcgtgatcgacaacaatgggtttattttgataagcaagcgctccagagaaactggtagatttctcggggaagtggacggcgccgtccttacacagctgctgtccatgggcgtattctctcaggtgaccatgtacgactatcaggcgatgtgcaagcccagttcgcatcaccactccgccgcccagccccttgtgagtccaatttccgccttcttaacagcaacacggtggttattgcaggagcttgtcctgttccttctcgagtggtcagtttgggggagctggtatgatcgaggagcagaggcaaaaagtgttttccatcattcacacaagcataaaaagcaggaccctctgcagccttgtgataccgagtacccagtgtttgtctaccagccagcaatcagagaagctaacggcattgtcgaatgcggcccatgtcagaaggtgttcgtcgtgcagcagatcccaaactcaaatctgctgttgttggtgacagaccccacgtgtgattgtagcattttcccgcctgtcctgcaggaagccaccgaggtaaaatacaatgcttctgtaaagtgcgaccgaatgagaagtcagaaactgcgtcgccggccagactcttgccacgcctttcacccagaggagaatgcacaggactgtggtggggccagcgacacatctgccagcccccctctcttgctgctgcctgtgtgcgcatggggtctgctgccccaacttctccgctag

SEQ ID NO: 181179 - DNA, 615 bp, Artificial Sequence
  Description of Artificial Sequence: Synthetic coding sequence
atgtacgactaccaggccatgtgcaagcccagcagccaccaccacagtgctgcacagccgctggttagccccatttccgcatttctgaccgctaccagatggctgctgcaggaattggtgttattcctgctcgagtggtccgtgtggggatcttggtacgatcggggcgctgaggccaagagcgtgtttcaccatagccataagcataaaaagcaggacccgctacaaccttgcgacactgaatatccagtcttcgtttatcagcccgcaatcagggaggcaaatggaattgttgaatgcggcccgtgtcagaaggtgttcgtcgtgcagcagatccccaactcaaatcttctcctgctggtgaccgaccccacatgcgactgtagtatcttcccacccgttttacaggaggcgaccgaggtgaagtacaatgcgagcgtcaagtgcgaccggatgagatcacagaaattgcgtcggcggccggatagctgccacgcctttcatcctgaggagaacgcccaggattgtggaggcgcgtcagacacgagcgcttcccctccccttctactgttgcccgtgtgcgcttggggtctgctgccacagttgctgcgatag

SEQ ID NO: 181180 - DNA, 1572 bp, Artificial Sequence
  Description of Artificial Sequence: Synthetic coding sequence
atggtgcagaagaccagcatgagccggggcccctacccccccagccaagagatccccatggaggtgttcgacccttcaccccagggcaaatatagcaagcggaaagggagattcaagcggtctgatggatccacgagttccgataccacaagcaactcgttcgtgcggcagggaagcgccgaaagctatacgagccgccctagcgatagtgatgtgagtctggaggaggacagggaggccctcaggaaggaagccgagcgacaggcccttgcccagctcgagaaagccaagacaaagccagtggccttcgccgtgagaacaaacgtgggttataacccgtcacctggagacgaagtgccagttcaaggcgtggccatcacatttgagcctaaggactttttgcacattaaggaaaagtataataatgactggtggattggtcggctagtcaaagaaggctgtgaagtgggtttcattccttcccctgtcaagttggacagcctaagactcttacaggaacagaagctgcgtcagaatcggctcggctcctccaagtccggagacaactcctcgagttccctgggcgatgttgtcactggcactagaaggcccaccccacccgcctctgggaacgagatgaccaacttggctttcgagctcgaccccctcgagcttgaagaggaggaagcggaactgggggagcaatctggcagtgctaaaacaagcgtgagttctgttaccaccccgcctccccacgggaagaggatcccgttctttaagaaaacagaacacgtacctccatatgatgtggtgccctccatgcgcccaataatcctggtagggccttcactgaaggggtatgaggtgaccgatatgatgcagaaagcgctctttgatttcctgaagcataggtttgatgggcgtatttccatcacccgggtaacagccgatatctccttggcgaaacgctccgtgctcaacaacccttccaaacacatcattattgaacgttcaaatacccgctcctctctggcagaggtccagtccgagatcgagagaatttttgagctggctagaacactgcagctcgtggcactggacgcagatacgatcaatcaccctgcccaacttagcaagactagcctggccccaatcattgtatacatcaaaatcacctcacccaaggtgcttcagcggctgatcaagtcacggggcaaaagtcagagcaaacacctgaacgtgcagattgcagcctcggaaaaactggcccagtgtcccccagaaatgttcgatatcatcctcgatgagaaccagctcgaagacgcatgcgaacatttggcagaatatctggaggcatactggaaggccacacatccgccatcttcaacacccccaaatccactccttaatcgaaccatggcaaccgccgcactggcagcttcccccgcacctgtgagcaatctgcaggtgcaagtgcttacatcccttcgaagaaatttgggattttggggcgggctcgagagctctcaaaggggctctgttgtgccccaggagcaggagcatgctatgtag

SEQ ID NO: 181181 - DNA, 1797 bp, Artificial Sequence
  Description of Artificial Sequence: Synthetic coding sequence
atggtgcagaagaccagcatgagccggggcccctacccccccagccaagagatcccaatggaggtgttcgatccttccccccagggaaaatattccaagagaaaggggcggttcaaaagaagcgacggatccacctcgagtgacaccacctccaacagctttgtccggcaaggcagtgcagagtcttatacaagccggccatctgattccgacgtgtccctggaagaagatagagaggcgttaagaaaagaagcagaaaggcaagctttggctcagttggagaaggcgaaaaccaaaccggtggcattcgccgtgaggaccaacgtaggctacaatcctagcccgggagatgaggttcctgttcagggtgtggcgatcacgtttgaaccaaaagatttcctacatatcaaagagaaatacaacaatgactggtggatcggccgactggtgaaggagggttgcgaagtgggcttcataccctcaccagtgaagttggatagtcttagattactacaggaacagaaactgcgacagaacagacttggaagcagcaagagcggcgataattcatcctccagtctgggcgatgtggttactggaacaagaaggccgacaccacccgcctcagcaaagcagaaacaaaagagtaccgagcatgtgcccccctatgatgtggtgccctcaatgaggccaattattcttgtggggcccagcttaaaaggatacgaagtcactgacatgatgcaaaaagccttgtttgactttctgaaacaccgctttgatggccgaattagcattacccgcgtcacagcagacatttctctcgccaagagatctgtgctcaacaacccatctaaacatattattatagaacggtcaaatacaagaagttctctggctgaagttcagagcgaaattgagaggatttttgagctggctcgcactttacagttggtggcactggatgcagacactatcaaccaccctgcccagctaagtaagacctccctggcccccatcattgtctatattaagattacctcccccaaggtcctgcagcgtctcattaagagtcgaggcaaatcccagagtaagcacttgaacgtccaaatagctgcaagcgagaagctggcacagtgccctccagagatgtttgacattatactggatgaaaatcagctcgaagatgcttgtgagcacctggctgagtatctggaagcatactggaaggcaactcaccctcctagtagcactcctcctaatcctttgctgaatcgcacgatggctaccgcagccctcgctgcctcacccgcgcccgtgagtaatctgcaaggaccctatctggcctcaggtgaccagcctctggaacgtgctactggtgagcatgcctccatgcatgagtatcccggtgaactgggccagccccccgggttgtacccttcttcccacccccctggtagagcagggactctgcgcgctctctctcgacaggacaccttcgatgctgatactcccggaagcaggaactcagcctacacagaactgggtgacagttgcgtggatatggagacagacccaagcgagggacccggacttggtgatccggcggggggaggtacgcctccggctcggcaaggatcttgggaggacgaggaggaggattatgaggaggagctgaccgataaccgaaaccgtggaaggaataaagcgcgatactgcgcggaaggaggcggccctgtccttgggcgcaacaagaacgaattggaagggtgggggaggggcgtgtatatccgctag

SEQ ID NO: 181182 - DNA, 1437 bp, Artificial Sequence
  Description of Artificial Sequence: Synthetic coding sequence
atggtgcagaagaccagcatgagccggggcccctacccccccagccaggagatccccatggaggtatttgacccaagcccccaggggaaatatagcaaacgtaaagggcgctttaagcggtccgacggatcaacctcatctgataccacctctaactcttttgtgcggcagggttctgccgagagctatacatccagaccttcggattccgatgtgagcctggaagaagatcgcgaggccctccggaaagaggctgagcgccaagccctcgcacagcttgagaaagcaaagacaaagcccgtggccttcgcagtgaggacaaacgtgggctacaaccccagcccgggcgatgaggtccctgtgcagggagttgccatcacctttgagcccaaagactttttgcacattaaggagaagtataacaatgactggtggataggacgtttagttaaagaaggctgtgaagtgggatttattcccagtccagtgaagcttgattctctgcgactactgcaggaacagaaacttaggcaaaaccgactgggatcctcaaagtcaggtgacaattccagtagctcactcggagatgtcgtcacaggaacgaggcggcccacccccccagcaagtgctaaacaaaagcaaaagagcaccgagcacgtccctccctacgacgtggtaccgtccatgcgccccatcatcttggtgggtcctagcctgaagggttatgaggtaacagatatgatgcagaaggcactgttcgatttcctcaagcacaggttcgacgggcgtatctccatcacaagagtgacagcagacatcagtttggctaagaggtcggtgttgaataacccttcgaagcatatcatcatcgaacgctccaatacccgaagctccctggccgaggtgcaatctgagattgaaaggatttttgaactggcgaggactttgcaactggtggctctggacgccgacaccattaaccacccagcccagctgtccaagacttctctcgccccgatcatcgtgtatattaagattacaagcccaaaggtgttgcagaggctcataaaatcgcgtggtaagtcccaatccaagcacttaaacgtgcagatcgccgcaagtgagaagctggcgcagtgcccgccggaaatgttcgacatcatcctggacgaaaatcagttagaggacgcatgtgagcatctggccgagtaccttgaagcctactggaaggcaacccacccacccagcagtactccccctaacccactgcttaatagaaccatggccacggctgccctcgcagcctcgccagcacctgtgagcaatctgcaggtgcaggtcctgacttccttacggcggaacctcggattctggggggggctggagagctctcagaggggatctgtggttcctcaggaacaggaacatgccatgtag

SEQ ID NO: 181183 - DNA, 1290 bp, Artificial Sequence
  Description of Artificial Sequence: Synthetic coding sequence
atggaggcccccagccggaccgtggtggtgggcagcgccgagagctacaccagccggccgagtgattccgatgttagccttgaagaagacagggaggcgctcaggaaggaagcagagaggcaagcactcgcccaactcgaaaaggcgaaaaccaaacccgtcgccttcgcagtgcgtactaacgtagggtacaacccgtcccctggagatgaagtcccggtccaaggcgtggccatcacctttgagcctaaagattttctgcacattaaggagaagtataacaacgactggtggatcggaaggctcgtgaaggagggatgcgaggtcgggttcattccctcacctgtgaagctcgacagtttgcggctgttgcaggagcagaagctaagacagaatcggctgggcagttccaaaagcggtgataactcctcttcctctctgggagacgtcgtgacaggtacacggcggcccactcccccagcctctgactcccccgtccagaccgaacatgtgcccccttatgatgtagtgcccagcatgcgcccaattatcttggtgggcccctcattgaaggggtatgaggtgactgacatgatgcaaaaggctctcttcgattttctaaagcaccgcttcgacgggaggatctctatcacaagagtcaccgcagacatctctctggctaaaaggagtgttctcaacaatccgtctaagcacataatcattgagcggagcaatacccgtagcagtcttgccgaggtacaatcagagatcgagcgcatattcgagttggcccggacacttcagctggtggccttggacgctgacacaatcaatcaccccgcccagttaagcaagacgtcccttgcccccattatcgtatatataaaaatcacctctcctaaggtgctccaaagactgatcaaaagccgcgggaaaagccagtccaagcatttaaacgtgcaaatcgcagcctctgagaagttagctcagtgccccccagagatgttcgacattatcctggatgagaaccaattggaggacgcttgcgagcacctggcagaatatctggaggcttactggaaggccacgcatccgccaagttctaccccccccaaccctttacttaaccgtactatggccactgccgcccttgccgcctcccctgctccagtgagcaacctgcaggtccaggtgcttaccagtctcagaagaaacctcgggttctgggggggtctcgaatccagccagagaggctcagtggtgcctcaggagcaggagcatgctatgtag

SEQ ID NO: 181184 - DNA, 1647 bp, Artificial Sequence
  Description of Artificial Sequence: Synthetic coding sequence
agcggcagcctgtacttccagggcagcgccgagagctacaccagcaggccgtcagactccgacgtgagtctcgaagaagatagggaagctctcagaaaagaagcggaacggcaggccctggcacagttagagaaggccaagactaagcctgtggcattcgccgtgagaaccaacgtcgggtacaacccaagccccggtgacgaagttcccgtgcaaggagtggctatcaccttcgaaccaaaagacttcctgcacatcaaggagaagtataacaacgattggtggattgggcgactggtgaaggaagggtgcgaggtaggatttatcccttctccggtgaaactagactccctgaggctcctgcaggagcagaagttacggcagaacaggctggggagctcaaagtcaggggataactctagctccagcctcggcgatgtggttacagggacacgccgtcccactccccctgccagcggcaaaagccacagacatgcgaccgaacacgtaccaccgtacgacgtggtgccatctatgaggcccattatcctcgtcggaccttctttaaaaggctacgaggtaacagatatgatgcagaaagcccttttcgactttctgaagcaccgattcgacgggcggatttccatcacaagagtgactgccgacatcagcctggcaaaaaggtctgtgctgaacaacccttcgaagcatataatcatcgagcggagcaatacgaggtcaagcctggcagaggtgcagtcggagatcgaacgcattttcgagctcgcaaggactttgcagttggtcgcgctggacgctgacaccatcaatcaccctgctcagctctctaagacttcgttagcgccaattatcgtctacataaagatcactagccccaaagtcttgcaacggctaatcaaaagtcgtgggaaatcccagtccaaacacttgaacgtgcagatcgccgcctctgagaaattggcacaatgcccacccgagatgtttgatatcatcctggacgagaatcagctggaagacgcttgcgagcacttggcagaatatttagaggcctattggaaggccacacatcctccctcttctacccccccaaaccccctcctgaacagaaccatggctaccgcggctctcgctgcttcccccgctcccgttagcaacttgcagggtccttacttagccagtggcgatcagcccttagagagagctaccggcgaacacgcttctatgcatgagtacccaggcgaactcggccagcccccggggctttatccgtcctctcatccccccggtagggctggaaccctgagggcattgtcgagacaggacacatttgatgctgacacccctggatccaggaactctgcctatactgagctcggcgattcctgtgtagacatggaaacggacccctctgagggccccgggctgggcgaccccgcaggtgggggaactcccccagcacggcagggaagctgggaggatgaagaggaagattacgaagaagaactaacagacaatcggaacagagggaggaataaagctcggtattgtgctgaggggggaggccccgttcttgggcgtaacaagaacgaactggaaggttggggccgaggcgtctacatcagatag

SEQ ID NO: 181185 - DNA, 1899 bp, Artificial Sequence
  Description of Artificial Sequence: Synthetic coding sequence
atgaaccagggcagcggcctggacctgctgaagatcagctacggcaagggggcaaggagaaaaaatcggttcaaaggcagcgatggctccacaagctctgacactacaagtaacagttttgttcggcagggaagcgccgactcttatacctctaggccatccgactctgatgtgagtctggaagaggatagagaagctgtcagaagggaggcggagagacaagcacaggcccaactcgaaaaagccaagacgaaacctgttgccttcgcagtgcgaactaacgtgagctattccgccgctcatgaagatgacgtgcctgtgcctgggatggctatctcctttgaggcaaaagactttctgcacgtcaaggagaaatttaataacgactggtggataggtcgcctcgttaaggagggatgcgagattggttttatcccatctcccgtgaagcttgagaatatgagattacagcacgaacagcgggctaagcagggtaagttttattcaagtaaatcaggagggaacagttcttcctctctgggagatatcgtcccatcgtccagaaaaagcacgccacccagttccgctatagatatcgacgctaccggccttgatgccgaggagaatgatatacccgctaaccacagaagccccaaacctagtgccaacagcgtcacctctccacatagcaaggaaaagaggatgcctttctttaagaagacagagcacacacccccatatgatgtcgtgccatctatgcgccctgtggtactcgtggggccatctctcaagggatacgaggtgacagatatgatgcagaaggccctgttcgacttcttgaaacacagattcgagggcagaatatccatcacaagagtgacagcagacatctcgctggctaagcgctcagtgctgaacaatccctcaaagcacgccatcatagagagaagtaacacccggtccagcctcgccgaggtccagtccgaaattgaacgaattttcgaattggcccgcaccctgcagctcgtcgttttggacgcagataccattaatcatcctgcccagctgtctaagacctccctcgctccaatcatcgtttatgtcaagatctcttcccccaaggtgctgcaacgacttatcaagagtcgagggaagagccaggcgaaacacttgaacgtccagatggtcgccgccgacaagctggcgcagtgccccccggagctttttgacgtgattctcgacgagaaccagctcgaggacgcgtgcgagcacctggcagactacttagaggcctactggaaggcgactcacccaccgtcttccagcttgccgaaccctctgctatcgagaacgcttgctacatcttccttgcccttatctcctacactggccagcaattcccaaggctctcagggggaccagcgcacggatcgtagtgcaccaatacgctctgccagccaggccgaagaggaaccctctgttgaacctgtcaaaaagtcgcaacatagatcctccagtagcgcaccacatcacaaccacagaagtgggacgtctcgtggcttatcgagacaggaaacctttgactcggagacacaagagagccgggattctgcctatgtggagccgaaggaggattattctcacgaccacgtcgatcattacgccagtcacagagaccacaaccaccgagatgagacacacggtagctccgatcaccggcatagagagagtagacaccgcagccgggatgttgatcgggagcaggaccataacgagtgcaacaagcagcgtagcaggcataagtctaaagaccgctactgcgaaaaggacggcgaagtgatttctaaaaagcggaatgaggctggggaatggaatcgggacgtgtacatacgccagtag

SEQ ID NO: 181186 - DNA, 1983 bp, Artificial Sequence
  Description of Artificial Sequence: Synthetic coding sequence
atggtgcagcgggacatgagcaagagcccccccaccgccgccgccgccgtggcacaggaaattcagatggagcttctggagaacgttgccccggccggagctctgggagctgccgcacaaagttatgggaaaggcgctcgacgcaagaaccggtttaagggcagcgatgggtcaacatcttcagataccacgagcaacagtttcgtgagacagggatccgcagatagctacacttcaaggccatcggattcggatgtgagcctcgaggaagaccgagaggctgtgagacgcgaagcagaaagacaggcacaggcccaactcgagaaggccaaaacgaaacccgtcgcgttcgcagtgcggacaaacgtgagctatagcgctgctcatgaggacgacgttcccgttccagggatggctatcagcttcgaggctaaggacttcttacacgtgaaagagaaatttaataacgactggtggattggccgactggttaaagagggctgtgagattggtttcatcccaagcccagtcaaactggagaatatgcgtctccagcatgagcagagagctaagcaaggcaagttctactcgtccaaatccggagggaactcctcaagttccctgggggacatagtacctagttctcgcaaaagtactcccccctcctcggcgatcgatatcgacgccaccggactggacgcagaagaaaatgatatccccgccaatcatcgcagccctaaaccatccgccaactccgtcacctcacctcatagcaaagagaagcgcatgccgtttttcaaaaaaaccgaacatacgcctccctatgacgttgtgccctccatgcggcctgtagtactggtgggtccaagcctcaaggggtatgaagtcacagatatgatgcagaaagccttgttcgactttcttaaacatcgttttgagggaagaatatcgatcacgcgggtaacggctgacatcagtttagctaagcgcagcgtcttgaataatccaagtaagcacgcgattatcgagcggtccaacactagaagcagtctagccgaagtgcaatctgagatagaacggatctttgagttggcccgcacgctgcagcttgtcgtgctcgatgcagatactattaatcaccccgcacagctgagtaagacctcattagccccaatcatcgtctatgtcaagatctcttcaccaaaagtcttgcaaaggctgattaaaagccggggcaagtcccaggccaaacacctcaatgtccagatggtcgccgccgataagctggctcagtgtccacccgaactgttcgacgtgatcctggacgaaaaccagctcgaggatgcctgtgagcacctggcagattacctggaggcctactggaaggcaacacaccctcccagctctagcctgcctaacccactgctaagcaggacattagcaacttcctccctgcctctctcgccgacactggcgtctaattctcaagggtcacagggagatcagagaactgaccggagcgctcccattaggtcagccagccaggctgaagaagaacctagtgtagagcccgtgaagaaatctcagcatcggagcagctcatctgctccccatcacaatcaccgctccggaacttctagggggctctctcgccaggagactttcgatagtgaaacacaggaatctcgcgacagcgcttatgtggaaccaaaggaggactattcccatgaccacgtcgaccactatgcatcccaccgcgatcacaaccatagagatgagacacacggatcctccgaccatcggcatcgggaaagtagacataggtctagagatgtcgatagggaacaggatcacaacgagtgtaataagcagcgaagccgacataagtctaaggaccgctactgtgaaaaggacggcgaagtgatttcaaaaaagaggaatgaggccggcgagtggaacagggacgtgtacatcagacaatag

SEQ ID NO: 181187 - DNA, 1911 bp, Artificial Sequence
  Description of Artificial Sequence: Synthetic coding sequence
atggtgcagcgggacatgagcaagagcccccccaccgccgccgccgccgttgcgcaagagatccaaatggagctcttggaaaatgtcgcaccagctggagccttgggtgcagctgcacagagctacggcaagggtgcgagaaggaagaaccgtttcaaagggagtgacggctcaactagctccgacaccacctcaaatagctttgtgaggcaggggagtgccgacagctataccagcaggccaagcgattcagatgtctccctggaagaagatcgtgaagccgtaaggcgagaggcagaacgccaggcacaggcacaactagagaaggcaaagacaaagccagtcgcctttgccgtgcgcacgaatgtgtcttactccgccgcccatgaggatgacgtcccagtccctggtatggccatttctttcgaggctaaagacttcctgcatgttaaagagaaatttaataacgattggtggatcggcaggctggtcaaagaaggttgcgagattgggttcatcccgtctcctgtgaagctagaaaacatgagactgcaacacgagcagcgtgccaagcagggcaaattctatagttccaagagcggggggaatagtagctcatcattgggggacatcgtgccttcatctagaaagagcacacccccctcttctggcgctaagtctgctgatgaacaggaccaatggaaaactgcgggacttttctggcgtttcactactgagcacaccccaccctatgatgtggttccgtcgatgcggcccgtagtgcttgttgggccttctctcaaggggtacgaggttaccgatatgatgcaaaaggccctgtttgatttcttgaagcacagattcgagggaagaattagcattaccagagtcacagcggacatttccctcgctaagcgctccgtgctgaacaatcccagcaaacatgccatcattgaacgtagtaatacccgctcctccctggctgaggtgcaatccgaaattgagaggatattcgagcttgctcgtaccctgcagctggtggtgctggacgctgataccatcaaccaccctgctcaactgtctaagaccagtttagctcccattatcgtctacgtgaagatttcaagtcctaaggtcctacagcggttgataaagtccagaggcaagtcccaggccaagcatctcaacgtgcagatggtggccgctgataagttggctcagtgcccacctgagctgtttgatgtgatcctcgacgaaaaccagctggaagacgcctgcgagcacctcgctgactatttggaagcttactggaaagcaacgcacccccccagttctagtctgccaaacccactcctctcacgtacactcgccacctcaagcctgcctttatccccaacattggcatccaactcacagggatcacagggggatcagagaactgacaggtctgcaccaattcgttccgcgagccaggcagaggaagagcccagcgttgagcctgtcaagaaatctcagcaccgatcttctagctccgcccctcaccataaccatagatccggcacttcccggggtctgtccagacaggagacattcgactcagaaacgcaagagagccgggactccgcatacgtggagcccaaagaggattactctcatgaccacgtcgaccattacgcctctcaccgggaccacaatcaccgggatgaaacacatggctcgagcgaccatcggcaccgggagtcgcggcataggtcgagggatgtggacagagaacaggatcataatgagtgcaacaaacagagaagtagacacaaaagtaaggatcgttactgcgagaaggacggtgaagttattagcaagaaaagaaacgaagccggcgagtggaaccgggatgtatatattcgtcaatag

SEQ ID NO: 181188 - DNA, 1839 bp, Artificial Sequence
  Description of Artificial Sequence: Synthetic coding sequence
atgaaggccacctggatccggctgctgaagcgggccaagggcggcaggctgaaaaacagtgatatatgcggaagtgctgatagctacacatccaggccgagcgactcagacgtgtctctggaggaggaccgtgaagccgtacggcgcgaggcggagaggcaggcccaggcccagttggagaaggccaagaccaaacccgtcgctttcgccgttcggaccaatgtatcctacagtgctgctcacgaagatgacgttccagtgcctggcatggcaatcagttttgaggcgaaagacttccttcacgtcaaagaaaagtttaataatgattggtggattgggcgactggtaaaagaagggtgcgagatcggcttcatcccctcccctgttaagctggagaatatgcgcttacagcatgagcagcgggccaagcagggaaaattttactcttcaaagagcggaggcaattccagttctagccttggggacatcgtcccctcttcaaggaaatctacaccgccgtcttccgcgatcgatatcgatgcgaccggcctggatgcagaggaaaacgatattcctgctaaccacaggtcccccaaaccatccgcaaatagcgtcaccagccctcatagcaaggagaagaggatgcctttcttcaaaaaaactgaacacacacctccttatgatgtggttccctccatgaggcctgtggtgctggtcggtcctagcctgaaaggatacgaggtgaccgacatgatgcagaaagctctcttcgattttttaaagcaccgatttgaaggcagaatctcaattactagagtgacagccgatatttctttagccaagaggtccgtgttgaataacccttccaaacatgcgatcattgaacgtagcaacacgcgatcatctcttgctgaagtgcagagcgaaattgagcggatattcgagctcgccaggaccctgcagctagtggttctggacgcggacacaattaaccatcccgcgcaactctccaaaacaagcctcgcacctatcatcgtatatgtaaagatcagttctcccaaagtccttcaacgcctgataaaaagtcgggggaaatcacaggcaaagcacttgaacgtgcagatggtcgccgccgataagctggcccagtgcccgcccgagttatttgacgttatactcgatgagaatcagcttgaggatgcatgtgaacacctggctgactatcttgaggcatactggaaagccacacaccccccaagtagctccctaccgaatcctcttctcagcaggaccttggccacctcgtccttgccgctgtccccaacactcgcgtctaattcccaaggatcccagggagatcagcgcacggatcgcagcgccccaattcggtccgcctcccaggctgaagaggagccttctgtggaacctgtaaaaaagtcccagcacaggagcagttccagtgcaccccaccacaaccataggagcgggacatcccggggattgtccaggcaggagacatttgattcagagacacaagagagtcgagattcggcatatgtcgaacctaaggaggactatagccacgatcatgtcgaccattacgcatcccatcgcgatcacaatcatagggacgaaactcatggatcctcggatcatcgacatcgggagtcccgccatcgcagtagagacgttgatagggagcaggatcataacgagtgcaacaagcaacggagccgccacaaaagtaaagaccgctactgcgagaaggatggagaagtaatctccaaaaaacgtaatgaagctggcgagtggaaccgagacgtctacattcgccagtag

SEQ ID NO: 181189 - DNA, 1704 bp, Artificial Sequence
  Description of Artificial Sequence: Synthetic coding sequence
atgcagtgctgcggcctggtgcaccggcggcgggtgcgggtgagctatggatccgccgactcttacacatccagaccgagcgactcggacgttagtctcgaggaggatcgcgaggcagtgagacgtgaggctgaacgccaagcccaggcacaactggagaaggctaagacaaagcccgtcgccttcgctgtacggacgaacgttagttacagtgccgcacatgaggacgacgtccccgtgccaggaatggcaatatcttttgaagccaaggactttcttcacgtcaaagagaagtttaataatgactggtggatcggtagactggttaaggagggctgtgaaatcggcttcatccccagcccggtgaaattagaaaacatgaggctccagcacgagcaacgtgcaaagcagggcaaattttattcctctaaatccggaggcaattccagttcttccctgggtgacattgtgcccagctctcgtaagtctacaccgccaagctccgcaaagcagaagcagaagtctacggaacacacacccccttatgacgttgttcccagtatgagaccagtggttctagtgggcccgtccttgaaagggtatgaggtgacagacatgatgcagaaagctcttttcgacttcctcaaacaccgttttgagggaagaattagtatcactcgagtcactgccgacatcagtttggccaaacgttctgtgctgaataacccatccaaacacgccattatcgagaggtctaataccagatcttctctggccgaggtccagagcgagattgagagaatttttgaactcgctcggactctgcagctggtcgttctggacgccgacactattaaccatcctgcccagctctctaagaccagtctggctcctattattgtttacgttaagatcagcagccctaaggtgctccaaaggcttataaagagccgcgggaagagccaggctaaacaccttaatgtacagatggtcgccgctgacaagctggcccagtgcccccccgagttgtttgatgtgatactcgatgagaaccagcttgaagacgcctgcgagcacttggccgactatctcgaagcatattggaaagcaacacatccaccgagtagtagcttgccaaatcccctactttcccggacactagctacaagttcattgcctttgtctcctacacttgcgtccaatagccaagggagtcaaggcgatcagcggactgatcggtccgccccaatccggagcgcttcacaggccgaagaggaaccctccgtggaaccggtgaaaaaaagccaacatcggtccagctcaagtgcaccacatcataatcaccgcagcgggacaagccggggcctgagccgacaggaaacatttgacagcgaaactcaggaatcccgcgactccgcctatgtcgagcccaaagaggactacagccacgatcacgtggatcattacgcgagtcatcgagatcacaatcatcgtgacgagacacacggttccagtgaccaccgccacagggaatccagacaccgtagccgcgacgtcgatcgtgaacaagaccataatgagtgcaataagcagcgcagtcgacataaatcgaaagaccgctattgtgagaaagacggcgaggtgatatctaagaaacgaaacgaagccggcgagtggaatcgtgacgtctacatcagacagtag

SEQ ID NO: 181190 - DNA, 1821 bp, Artificial Sequence
  Description of Artificial Sequence: Synthetic coding sequence
atgctggaccggcggctgatcgccccccagaccaagtacatcatccccggtggatccgccgatagctacacgagtcgaccctctgatagcgacgtatccctggaggaggaccgtgaggccgtgcgtagggaagctgaaagacaggctcaggctcagctggaaaaggctaaaaccaagcccgtcgcattcgctgtccgtacaaacgtctcttacagcgctgctcacgaggacgacgtgcccgtacctggtatggccatcagtttcgaggccaaagatttcctccacgttaaggagaagttcaacaacgactggtggattgggcgactggtgaaagagggttgtgaaatcggcttcattccatccccagtgaagttagagaacatgagattgcagcatgagcaacgcgccaaacagggcaaattttattcatccaagagcggcggaaacagcagtagctctctgggtgacatcgttccaagcagtcgcaagtctacgccgcctagttctgccattgatatagatgccaccggcctcgatgcggaagagaacgacatcccagcgaaccacaggtctcccaaacccagcgcaaatagtgtcacctcacctcactcgaaagagaaaaggatgcccttttttaagaagaccgaacatactcctccatatgacgtggtacccagcatgcgcccagttgtgttggtgggcccaagcctaaagggctatgaagtaacagacatgatgcagaaggccctgtttgacttcctgaaacatagatttgaggggaggatctcgattaccagagtcactgccgatatctcgttagcgaaacgatctgtacttaataacccaagcaagcatgccattattgagagatcaaacacacgcagcagcctcgccgaagtccagtctgaaattgagcggattttcgagctagcccgaactctccaacttgtcgtgctcgacgctgacacaataaatcatccggcccagctttctaaaacaagcctcgcccctattatcgtttatgtcaagatctccagtccaaaggtgctgcagaggctgatcaagtcccggggaaaaagccaggccaagcacttgaatgtgcaaatggtggcggccgataagctggctcagtgtcctcccgagctgtttgacgtcattctggacgagaatcagttagaagatgcctgcgagcatttggctgattatctggaggcctactggaaagctacgcatccaccctctagctccctgccgaacccactattaagtaggactctggcaacgtcatcactgccgctgtccccaactctggccagtaacagtcagggatcccagggggatcagcggactgatcggtccgcgcctatccgtagtgcgagtcaggccgaagaggagccttcagttgaacctgtaaagaagtcgcagcacagatcttcttcttctgctccccatcacaaccaccgatccggcacaagtcgggggctgtcgcgccaggaaacatttgatagcgagacacaagagtccagagattccgcttatgttgagcccaaggaggattactctcatgatcatgtggaccactacgcttcccatcgcgaccataatcatcgtgacgagacacacgggagctcagaccaccgccatcgggagtctcggcatcgatctcgcgacgtggaccgggagcaggaccacaacgagtgcaataagcagcgatcccgacacaagtcaaaggatcgttattgtgagaaagatggagaagttatctctaaaaagaggaacgaggctggcgaatggaatagggacgtctacatacgtcagtag

SEQ ID NO: 181191 - DNA, 1827 bp, Artificial Sequence
  Description of Artificial Sequence: Synthetic coding sequence
atgaaccagggcagcggcctggacctgctgaagatcagctacggcaaaggcgctaggcgtaaaaacagattcaagggatccgatggcagcacaagcagcgacaccaccagtaattcctttgttagacaaggttcagctgactcctatacctctcggcctagcgattctgatgtcagccttgaggaagatcgtgaggcggtgagacgtgaagccgagagacaagcccaagctcaactcgagaaagctaaaactaagccagtagcgtttgccgtacggactaacgtgtcctatagcgccgcccatgaggacgacgtgccggtgcctggaatggctataagctttgaagccaaggacttcttacacgttaaagagaagttcaataatgattggtggattggacggcttgtgaaggagggctgtgagatcgggtttatacccagtcccgtgaaactggaaaatatgcgactgcagcacgagcagagggcaaaacagggcaaattttactccagtaagagtggcggcaatagtagcagcagcttaggcgatatcgttccttcttcaaggaaatctaccccaccttcttctggggctaagtccgctgacgagcaggaccagtggaagacggctggtcttttctggaggttcactaccgagcacacgccaccttacgatgtggtgccatccatgcggcctgtcgtgctagttggccccagccttaagggctacgaagtgactgacatgatgcagaaagctctgtttgactttttgaaacacaggttcgagggcagaatttcaatcacgcgggttaccgccgatatctctctggccaagagatcagttctgaacaacccttctaaacacgccataattgagcgaagtaatactcggtcatcactggccgaggtacaatccgaaatcgaacggatctttgagctcgcccgcacactgcagttagtggtgctcgacgctgatactattaaccatcccgcgcagctatctaaaacctcgttggcccccattattgtctacgtgaagatctcttcccctaaagtgttacagagattaatcaagagcaggggcaaatctcaagccaagcacctcaatgtgcagatggtagcggcagataagctggcacagtgtccccctgaattgttcgacgtgatactagacgaaaatcagctggaggacgcttgcgagcacctggcagactatctggaggcttattggaaggccacccacccacccagttcctctctccccaaccctctgttgtcccgtactttggccacttctagccttccacttagtccaacactcgcaagcaacagccagggctcccaaggagatcagcggaccgaccgctcagccccaatccgcagcgcaagtcaggccgaggaggaaccttccgtcgagcccgtgaaaaaatcccagcaccgatcctccagctcagcaccgcatcataaccacaggagtggtacgagtcggggcttgtcacgacaggaaacattcgatagtgagactcaggagtcccgcgactccgcctacgtggagcctaaagaggactacagccacgaccacgttgatcattacgcctcacaccgcgaccacaatcaccgggatgagacccacgggtcctcagaccaccgccatcgggaatccaggcatagatcaagagatgtcgaccgcgaacaagaccataatgagtgcaataagcaacggagtagacacaaatctaaggatagatactgcgagaaagacggcgaggtgatttccaagaagaggaacgaagctggggagtggaaccgcgatgtatatatccgccagtag

SEQ ID NO: 181192 - DNA, 1818 bp, Artificial Sequence
  Description of Artificial Sequence: Synthetic coding sequence
atgcagtgctgcggcctggtgcaccggcggcgggtgcgggtgagctacggatctgcagactcatacactagtcgtcctagcgactcagatgtatcactcgaggaggatcgcgaggccgtcagaagggaggctgagaggcaggcccaagcccagctcgaaaaggccaagactaagcccgttgcctttgcggtacgcacaaatgtctcttattccgcagcccatgaggatgacgtgccggtcccaggaatggcgatctctttcgaggctaaagactttcttcatgtgaaagagaaattcaataatgattggtggattggcaggcttgttaaggagggttgcgagattggattcattcctagcccagttaagctggaaaatatgcgtcttcaacatgaacagcgcgctaagcagggcaagttctactcctccaaatccggcggaaattctagctccagtctcggagacatagtccccagctccaggaaatcaacaccaccatcttccgctatagatatcgacgcaaccgggctcgacgctgaagaaaacgacatccccgcaaatcatcgatctcctaagcctagcgccaactccgtaactagcccccactccaaggagaagagaatgccttttttcaagaaaactgaacatacgccaccctatgatgtggttcccagtatgcgaccagtcgtgctcgtcgggcccagtctgaaggggtatgaggtgacagatatgatgcagaaggcactcttcgacttcctgaagcacaggtttgaaggtaggatttctataacaagagtcaccgccgatatctctctcgccaaaaggagtgtgttgaacaacccctcaaaacacgcaattattgagcgttctaacacccggtcttcactggccgaggtgcagtccgagattgagagaatctttgagctagcaaggactttacagctggtggttctggacgccgataccataaatcatcctgctcagctaagtaagacatccctggcccccatcatcgtgtacgtaaagatctcttctcctaaggtcctgcagaggctgattaaatcccgcggaaaatcgcaagcaaagcaccttaacgtgcagatggtcgccgcggataaattggcccagtgtccccctgaactatttgacgtaatacttgatgagaatcagttagaggacgcatgtgagcatttagctgactatctcgaagcgtactggaaagctacacatcctcccagctctagcttaccaaaccctctactctccagaacactcgcaacctcttctctgcccttatctccaacactggcctcaaactcacaaggaagtcagggggatcagagaaccgaccgcagcgccccgatacgctccgcctcgcaggcagaagaagaaccctccgtggagcccgtcaaaaagagccaacacaggagcagctcatcagcaccccatcacaaccatcgcagcggtacttcccggggcctctcccggcaggagacttttgattctgaaactcaggagtccagagacagtgcctacgttgaaccaaaggaggactacagtcacgatcatgtggatcattatgcctcccacagagatcataaccatagggacgaaacacatggctcttctgaccatcggcaccgggagagccggcacagaagccgggacgttgatcgcgagcaagaccataatgaatgcaacaaacagaggtctcgccacaaatctaaagaccgttattgcgaaaaggatggtgaagtcatttctaagaagagaaacgaagccggcgagtggaatagggacgtgtatattagacagtag

SEQ ID NO: 181193 - DNA, 1455 bp, Artificial Sequence
  Description of Artificial Sequence: Synthetic coding sequence
atgtacgacgacagctacgtgcccggcttcgaggacagcgaggccggtagtgccgactcgtatacatcccgcccaagcctggatagcgatgtatctcttgaggaggacagagaatcagctcgacgggaggtagagtcacaggcccagcagcaattagagcgggcaaaacacaagcccgtagctttcgctgttaggaccaatgtgtcctactgcggcgtgttggacgaggagtgccccgttcagggatccggagtgaactttgaagcgaaagacttcctgcatatcaaggaaaagtatagcaatgattggtggatcgggaggttggtgaaggaaggcggcgatattgccttcatcccatcgccccagaggctggagagtatcaggttaaaacaggagcagaaagccagaagaagtggcaacccctcttctctgagcgatataggcaaccggaggtccccccctccatcacttgctaaacagaagcaaaaacaagccgaacacgtgccgccatacgacgttgttccctctatgaggccggtcgttctggtcggccccagtctcaaaggctatgaggtaacagatatgatgcaaaaggctctgttcgattttttaaaacatcgcttcgacggtcgcatcagcattacacgcgtcacggccgacttaagccttgcaaagagaagtgtccttaacaaccctggaaaacggacaataattgaacgatctagtgctaggagtagcatagctgaggtccagtccgagattgagcggatttttgagctggcaaaaagtctccagttggttgtgctcgatgcagacaccatcaaccatccggcacagctggcaaaaacgagtttggcccctattatcgtgtttgtcaaagtttccagtcctaaagtgctgcagcgcctcattagaagtagaggaaagagccagatgaaacacttaacagttcaaatgatggcttatgataagcttgtgcagtgtccacccgaatcattcgacgttatacttgacgagaaccaacttgaagacgcctgcgagcaccttgcagagtatctcgaagtctactggagggctactcaccacccggcaccagggccaggacttctcggaccgccgtctgccatccccggcctacagaaccagcagctgttgggagaacgaggggaggagcatagtccattggagcgcgactccctgatgcctagcgacgaggcctccgaatcctccagacaggcatggactggctccagccagagaagttcgcggcaccttgaggaagactacgcggatgcataccaggatctgtaccagccacatcgacaacacaccagtggtttgccatccgccaacggccatgacccgcaggacaggttactagcacaggactctgagcacaaccactctgacaggaattggcagcgcaacaggccatggcctaaggactcgtactag

SEQ ID NO: 181194 - DNA, 1566 bp, Artificial Sequence
  Description of Artificial Sequence: Synthetic coding sequence
atgagcagcagcagctacgccaagaacggcaccgccgacggcccccacagtccgacatctcaggtggcgcgcggaacaacaacccgccggtcgcgcctgaagagatcggatgggtcaaccacgagtacatccttcatcttgagacaggggtcagccgactcatacacttcaaggcccagcgacagtgacgtgtcgctcgaggaagacagggaggccatcagacaggagcgggagcagcaggccgccatccagttagagcgtgccaaaagcaagcccgtggccttcgccgtgaagactaatgtcagttattgtggtgctctggacgaggacgtgcccgttccaagcacagcaattagctttgatgccaaggacttcctccacataaaggaaaagtataataatgactggtggataggtcggttggttaaagaggggtgtgaaataggcttcatcccatctccgctcaggctagaaaacataagaatccagcaagagcagaagcgcggccggttccacggcggtaagagttcagggaattcgtcgtcatcactgggagagatggtgagcggtactttcagagctacccctacgtctaccgtaaagatggtactgaaaatccataccgagcatatacctccatacgatgtcgtgccatccatgcggcctgtagtgctggtgggccctagcctcaagggctatgaggtgactgacatgatgcaaaaagcgctgtttgacttccttaagcatcgtttcgacggcagaatcagtattaccagggtgacagctgacattagcctcgcgaagagatcagtcctgaacaacccatcaaagcgcgcaatcatcgaacgaagcaatacccggtcctcccttgccgaagtgcagtcagaaatagaacggatatttgagctggcacgttcactacagctggtggtactggatgcagatacaatcaaccacccagcccagctgataaagaccagcctcgcccccatcattgttcatgtcaaggtatcttctcctaaggtcctgcagaggcttatcaagagccgaggtaagagccagtctaagcaccttaacgtccagttagtggcagcggacaagctcgctcagtgccccccggaaatgttcgacgtaatcttagatgagaaccaattggaggacgcctgcgagcatcttggcgaataccttgaggcctattggagagccacccacaccacctcttctaccccgatgacaccacttctaggtagaaatcttggttcaaccgctctcagcccctaccccacagccatcagtggcctgcagagtcaacgcatgaggcacagcaaccatagtaccgagaattcgccaatcgagaggcggtccctgatgaccagcgatgaaaactaccacaatgagcgggcccgcaaaagccgtaatcgtctgtcctccagctcccagcatagccgcgatcattatcctctcgtcgaagaagattatcccgatagctatcaggacacttacaaacctcatcggaatcgaggttccccaggcggctacagccatgattcccgacatagactgtag

SEQ ID NO: 181195 - DNA, 1464 bp, Artificial Sequence
  Description of Artificial Sequence: Synthetic coding sequence
atgtacgacaacctgtacctgcacggcatcgaggacagcgaggccggatcagctgattcgtatacctccagaccctccgatagcgatgtgagtttggaggaggaccgcgaggccattagacaggaaagggagcagcaggctgcaatccagctcgaaagagctaaatctaaacctgtggcgttcgccgtgaagacaaatgtgtcatactgcggcgcccttgatgaggatgtcccagttcccagcacagctatcagttttgacgccaaagattttctccacatcaaggaaaaatacaacaacgattggtggatcgggaggctggtcaaggaagggtgtgaaattggatttatcccctcccctcttaggctcgagaacattaggatccaacaagaacagaaaaggggacggtttcacgggggaaaatcaagcgggaactcgagcagtagcctcggagagatggtctcagggacgttccgagctacgcccacctctacggtgaagatggtcctgaagatccataccgaacatatccccccatacgatgtagtgccctccatgaggccagtcgtgctggtcgggccttctctgaaaggatatgaggttacagacatgatgcagaaagctctgtttgattttctaaaacacagattcgatggtagaatctcaattaccagagtgacggctgatattagtctggctaagcggtcggtactgaataaccccagcaagagagcaataatcgagaggtctaacacgcggtccagcctcgcagaagtgcaaagcgagattgagcgtatctttgaacttgcgcgtagcttgcagcttgtcgtgctggacgctgatacaatcaatcacccagcccagctaatcaagacctcccttgcccccataattgtacatgtgaaggttagcagccctaaagtgctccagagactaattaaaagcagagggaagtcccagtcaaagcacttaaatgttcagctcgttgctgcagacaaactcgcccagtgccctcctgagatgttcgatgtcatactggacgaaaaccagctcgaagacgcctgcgaacatctcggagagtacctcgaggcatactggcgcgctacacacactacatcgtccacccctatgacacccctcctgggccgcaacctcgggagtaccgcactctccccctacccgacagcaatctccggtctgcagagtcagcgcatgcgacactccaatcattcgacagagaattcccccatcgagcgacgaagtttgatgacttctgacgagaactatcataatgagcgggccaggaaaagccgaaatcggctttcatcgagctcacagcattctcgggaccactatccactcgttgaagaggattaccctgacagctaccaggacacctacaagcctcatcgcaacagaggtagccccgggggatattcacacgactcgaggcaccgcttatag

SEQ ID NO: 181196 - DNA, 1461 bp, Artificial Sequence
  Description of Artificial Sequence: Synthetic coding sequence
atgtacgacaacctgtacctgcacggcatcgaggacagcgaggccgggtctgcagattcgtatactagcaggccttccgactctgacgtctccctagaggaggacagggaggccattagacaggaacgtgagcagcaggcggcaatccagctggagagggccaaatctaagccagtggccttcgcagtgaagactaacgtcagctactgcggagcactggacgaagatgtgcccgttcccagcactgccatctccttcgatgccaaagatttcctgcacatcaaggagaaatataacaatgattggtggatagggcgtcttgtcaaagagggttgtgagattggttttattccgtcccccctgagattggaaaatatccgcatccagcaggaacagaagcggggacgatttcacggtgggaaaagtagtggcaactcgtcaagttctttgggggaaatggtgtccggaaccttccgagccacacccacatccaccgcaaaacaaaaacaaaaggtcacagagcatataccaccatatgacgttgtgccctctatgcgcccagttgtactcgttggcccctctctgaagggctacgaggtgaccgacatgatgcagaaggccttgttcgatttcctgaaacatcggtttgacggtcgaatcagcatcacccgagtgactgcagacatctccctggccaaaagaagtgtcctcaacaacccctctaagagagccataattgagagatcaaatacacgctcatcccttgctgaggtccagagcgagattgagagaatctttgaactcgctagatcgcttcagctcgtggttctggatgccgacaccatcaaccaccctgctcaactcattaaaacttccttagctcccatcattgtgcacgtgaaagtcagttcacctaaagtacttcagaggctgatcaagtcaagagggaagtctcagtccaaacatcttaatgtgcaattggtagcggccgacaagctggctcagtgccccccagagatgtttgatgtgattctcgatgaaaatcagctggaggatgcttgtgagcacctgggagagtaccttgaggcatattggcgggccacacacactacttctagtactccaatgactccactgctgggtagaaatctgggcagcactgctctcagcccatatccaaccgcaattagcggcctccagagtcaacgcatgagacacagtaatcattccactgaaaactcgccaatcgagaggaggtcccttatgaccagcgacgagaactatcacaacgaaagggcccgaaaaagtagaaaccgcctcagcagcagctcccagcattcccgcgaccactaccccctagtcgaagaagattatcctgacagctaccaggacacatacaaaccacatagaaacagggggtctcccgggggctattcccatgattccagacacaggttgtag

SEQ ID NO: 181197 - DNA, 1563 bp, Artificial Sequence
  Description of Artificial Sequence: Synthetic coding sequence
atgagcagcagcagctacgccaagaacggcaccgccgacggcccccacagcccaacaagccaagtggcacgagggaccactacacgacggtccagattaaagcgttccgacggaagtacaaccagcaccagctttatattacggcaagggagcgcggattcatatacctcacgaccaagcgattccgacgtgagcctggaagaagaccgggaagccattaggcaggagcgggagcagcaagccgccatacagcttgaacgggctaagtccaaaccagtggccttcgctgttaagacaaacgtgagttactgtggggcccttgatgaggacgttcccgtccctagcactgcgatttcattcgacgccaaagattttcttcatattaaggagaagtataacaatgattggtggataggaagactggtgaaggagggttgcgaaatcggctttattccctcacccctgcgccttgaaaatattcggatccagcaggagcagaagcgggggaggtttcacggggggaagagctctggaaacagttctagcagcctaggcgagatggtgagcggaactttcagggctacaccaacctcgactgccaagcagaaacagaaggtcacagagcatattcctccctatgatgtggtgccgtctatgaggccagtggttctcgtgggaccttccctgaagggatacgaggtgacagacatgatgcaaaaggctctgtttgactttctgaagcaccggtttgacggacgcatcagcatcaccagagtgacggctgacatcagtctggcgaagagatctgttctgaacaatcccagcaagagggccatcatcgagaggtccaatacgcgcagttccctggcagaggtgcaatcagagatcgagcgcatttttgaactagctcggtctctgcagctggtggtactcgacgccgacacaattaatcatcccgcccagttgattaaaaccagcttggcgccaattatcgtccatgtcaaagtgtcctcaccaaaggtgctccagcggctaatcaagtctcgtggtaagtcgcaaagcaaacacctcaatgtccaactagttgctgccgataagttggcgcagtgcccccctgagatgttcgacgtcatcttagatgaaaaccagctcgaggatgcctgcgagcacctcggcgagtacctagaggcttactggcgtgccacacacactacttccagcacacccatgacccctctgctcgggagaaatctcgggagcaccgcactgtcgccctatcctacggccatttcaggcttacagagccaacggatgcgtcattccaaccattctactgagaacagcccgatcgaacggaggagcttgatgacaagcgacgagaactatcataatgaacgggctcgtaaatccaggaacaggttaagttctagcagccagcactcccgggaccattaccctctggtagaagaagattacccagactcttatcaggacacatacaagccacataggaaccgtggatcccctggcggctacagccacgatagcagacatagattatag

SEQ ID NO: 181198 - DNA, 1248 bp, Artificial Sequence
  Description of Artificial Sequence: Synthetic coding sequence
ttctacttcctgtgccagggcagcgccgacagctacaccagccggccttcagacagcgatgtgtctctggaagaagatcgggaggcgattcgtcaggaacgcgaacagcaagctgcaattcagctggagcgcgccaagagtaaaccggtcgcattcgccgtcaaaaccaacgtgtcctattgcggcgccctggatgaggacgttcccgtgcctagcactgccatctccttcgacgctaaagatttcctgcatataaaggagaaatacaacaatgattggtggatcggccggctcgtaaaggaaggatgtgagatagggttcattcccagcccccttagactagagaatatccggatccagcaggagcagaagaggggccgctttcatgggggcaaaagcagtggaaatagctccagtagtcttggggagatggtgagcggtacctttagagccaccccaacatctaccgctaaacaaaagcagaaggtcacagaacatatcccgccttatgacgtggtcccaagcatgcgcccagtggtcctggtgggaccgtctctgaaaggctacgaggtgactgacatgatgcagaaggcattgtttgactttctcaagcatcggttcgacggcagaatctcaataacccgagttaccgccgacattagtcttgccaagcgctccgtgctgaacaatcccagcaagcgggcgattatagaacgcagcaacacacggtctagtttagctgaagtgcagtcggaaattgagaggatcttcgagcttgccagaagcctgcagctggtcgtcttggacgcagacacaatcaatcatccagcgcaactgatcaagactagcctggcgcctatcattgtccacgttaaggtaagcagcccaaaggtgttgcagcgcctgattaaaagtcgcgggaaatctcaaagcaagcatctgaatgtgcagcttgtagccgctgataaacttgcacagtgccccccttctcaaaggatgaggcacagcaaccactctacagagaattcaccaatcgaacggaggtccctcatgacttctgatgagaactatcacaatgagagagcacgaaaatctcgtaatcggctctcctcaagcagccagcactctcgggatcattaccctctcgttgaggaggattaccctgacagctatcaagatacttacaagccacacagaaacaggggctcgcctggaggatactctcacgattcccgtcaccgtctctag

SEQ ID NO: 181199 - DNA, 558 bp, Artificial Sequence
  Description of Artificial Sequence: Synthetic coding sequence
atgagcggcagcttcgagctgagcgtgcaggacctgaacgacctgctgtcagacggctctggatgctatagcttgccatcccaaccatgtaacgaggtgacccctaggatctatgtgggcaacgcctcagttgcacaggatatacctaaactccaaaaactgggtatcacacacgtcctgaatgcagcagaaggacggagcttcatgcacgtgaataccaatgctaatttttacaaagacagcggcatcacctatttgggaatcaaggctaatgatactcaagaatttaatctcagtgcatacttcgagcgagccgcagactttattgatcaggcactagcacaaaaaaacggacgggtgctggttcactgccgcgagggctattctcggagccctactttggtgatcgcctatctgatgatgcgtcagaaaatggatgtcaagagcgctctgagcatcgtgcgccagaaccgagagatcggtcccaacgacggctttcttgctcagctatgccagttaaatgatcgtctggcaaaggagggaaaactcaagccatag

SEQ ID NO: 181200 - DNA, 972 bp, Artificial Sequence
  Description of Artificial Sequence: Synthetic coding sequence
atgggcctgttcgaccggggcgtgcagatgctgctgaccaccgtgggcgcgtttgctgcattcagcctgatgaccattgcagttggaacagactattggctgtatagcagaggcgtatgtaagactaaaagcgtgtccgagaatgagacaagcaagaaaaatgaggaggttatgacccattcgggtctgtggagaacctgctgcttggagggaaacttcaaagggctctgcaagcaaatcgaccacttccccgaggacgctgactatgaggctgataccgcagaatacttcctgcgggccgttcgggctagctcgatcttccctattttgagcgtcatcctcttattcatgggcggcttgtgcatcgctgcatcagagttttataaaacaagacacaatataattctgagtgccgggattttcttcgttagtgccgggctaagcaatatcatcggcatcattgtgtacatctcagctaacgccggagatccgtcaaaaagtgattccaagaagaacagttatagctatggctggagcttctattttggtgccctttccttcatcatcgcagagatggttggggttctcgccgtgcacatgtttattgatcgccacaagcaattaagggccaccgcaagagcaaccgactatttgcaggcatcagctatcacgcgaataccctcatatcggtaccgctaccagaggcggagtcgatctagcagtcggtcaacagaaccttctcattcccgggatgcgtcacccgtgggtattaagggtttcaataccctgccctcgactgaaattagtatgtacaccctgtcccgtgacccgcttaaggcggccactactcctactgccacctataactccgaccgagataactccttcctgcaggtccacaattgcatacaaaaggaaaacaaagactcactgcactctaacaccgctaacaggagaactacacctgtttag

SEQ ID NO: 181201 - DNA, 948 bp, Artificial Sequence
  Description of Artificial Sequence: Synthetic coding sequence
atgcggatgtgcgaccggggcatccagatgctgatcaccaccgtgggggcattcgccgcctttagcctgatgacgatcgccgtgggcacagactattggctgtatagtagaggagtctgccgtactaagtccaccagtgacaatgagacaagtcgcaagaatgaggaggttatgacgcattctggattatggcgcacctgctgtctggagggagcttttcggggcgtttgtaagaagattgatcacttccccgaggatgctgactacgagcaggacaccgcagaatatttactgcgtgctgtgagagcatcctcagtgtttccgatcctgagcgtgacgctgttatttttcggtggcctgtgtgttgccgccagtgaatttcaccgcagccgccataacgtcatccttagcgctggcatattttttgtcagtgctggcctatcaaatatcatcggcatcatcgtgtacatctcagccaatgcaggggatcccggtcagagggattccaagaaatcctactcatatggttggtctttttattttggcgctttctcctttatcatcgctgaaatcgtgggggttgtcgcggtgcacatatacattgagaagcaccagcaactgcgggctaagagtcatagcgaatttctcaagaagtcaacgtttgcccgccttccaccctaccggtatcggttccgtcggcgttcatcctcaaggtccacagaaccacggtcccgggacctgtctccaatatccaaagggtttcacaccataccctcgacggatatcagtatgtttacactctctagagacccttctaagattactatgggcacactgctaaacagcgacagagaccacgccttcctccaatttcacaatagtacccctaaggagtttaaagaaagcctgcataacaaccccgctaaccgccgtactactcctgtgtag

SEQ ID NO: 181202 - DNA, 891 bp, Artificial Sequence
  Description of Artificial Sequence: Synthetic coding sequence
atgagcgcctgcggccggaaggccctgaccctgctgagcagcgtgtttgcagtgtgcggactgggattgttggggatcgcggtttctactgattattggctgtacctggaagaaggcgtgattgtacctcaaaaccagagtacagaaatcaaaatgtctctgcactctgggctctggcgggtgtgcttcttggcgggggaggaacggggccggtgcttcaccatcgagtacgtgatgccaatgaatactcagctgacaagtgaatccacggtcaacgtgctaaagatgattagatccgccactccttttcctctggtcagcctatttttcatgtttattggctttatactgaataatattggacatattaggccacatcgcaccattctcgctttcgtttctggtatttttttcatcctgagcggcctgtccctggttgtgggtcttgtgctgtatatctcaagtatcaatgacgagatgctgaaccgcactaaagacgcggagacgtatttcaattacaagtatggctggtcatttgctttcgccgctatcagtttcctgttgacagaggtgaaacccgtcacattgtcgatggatcgcctggggctgggcacagcaccactgagcaggggagagtggggctggggaaggcgcgacatcccacagccgttttggaccccagaccacccattatatttcccctcttcttctcagaatgtatctttaagttatttatcgggatctcccccggctcgcatgagtcctggaccctgttcttgtccacatgtgcatttcccaccgcattctagctgtgtgctgtgtcgtcctcaaccccgtgagatgcgacaggcacccgccgcatccccctcatccgctgtattctctctctag

SEQ ID NO: 181203 - DNA, 828 bp, Artificial Sequence
  Description of Artificial Sequence: Synthetic coding sequence
atgagcgcctgcggccggaaggccctgaccctgctgagcagcgtgttcgctgtctgcggcctgggcctgttaggcattgctgtgtcaaccgattactggctctatctggaggaaggtgtcattgtgccacagaatcagtcaacagaaatcaaaatgtccctccattccggcctctggagagtgtgcttcctcgctggcgaggaacgcggacgttgctttaccatcgaatacgtgatgcccatgaatactcagctgacatccgagtctactgtcaatgtgctgaagatgattcggtctgccaccccctttcccctggttagtctgttttttatgtttattggatttatactcaacaacatcggccacattcgcccgcatcgaacgattcttgcttttgtgtctgggattttcttcatcctgtccgggctctcactggtagttgggttggttctgtatatcagttcaataaacgacgaaatgctcaatagaaccaaggatgctgaaacctactttaactataagtacggctggagctttgctttcgctgcgatttcattcctgctgaccgaatccgctggagtgatgtctgtctacctgtttatgaagcggtacacagccgaggacatgtacagacctcatcctggcttctatagaccccgcctgagtaactgcagtgattactctggccagttccttcatccagatgcctgggtgcgagggcgcagtccgtcagatattagctcagaggcctctctacagatgaatagcaactaccctgcactgctgaaatgcccagattacgaccagatgtcttcctcaccctgttag

SEQ ID NO: 181204 - DNA, 828 bp, Artificial Sequence
  Description of Artificial Sequence: Synthetic coding sequence
atgagcgcctgcggccggaaggccctgaccctgctgagcagcgtgtttgccgtctgtggtctgggcctcttggggatcgccgtgtctactgattattggctgtacttagaggaaggagttatcgttccccagaaccagtccaccgagattaaaatgtctctgcattctggactttggcgagtatgttttctggctggggaggagagagggcggtgcttcaccattgaatatgtcatgcctatgaatactcagctcactagcgagtcaacagtgaatgtgcttaagatgatccgaagcgctactccatttcctctggtcagcctgttcttcatgttcatagggtttattttgaataatatcgggcacattcgccctcacagaaccatcttggcctttgttagtggaattttcttcatcctgtcaggactgagtctggtggtgggactggtgctctacatatcaagtatcaatgacgaaatgttgaaccgaaccaaagacgcagagacttacttcaactacaaatatggttggtcctttgcattcgcggccataagtttcctccttaccgaatcagccggtgtcatgtctgtgtacctgtttatgaagcggtacaccgctgaggacatgtacaggcctcacccaggattctacaggccccggctcagcaattgcagtgattactcagggcaattcctgcaccctgacgcatgggtgcgagggagatcaccctccgatatcagctccgaggcctcattacagatgaactccaactatcctgctctgctcaaatgtcccgattacgaccagatgtcttcatctccatgttag

SEQ ID NO: 181205 - DNA, 783 bp, Artificial Sequence
  Description of Artificial Sequence: Synthetic coding sequence
atgatgtggagcaacttcttcctgcaggaggagaaccggcggcggggcgccgccggacggaggcgggcgcacggccagggtagaagtgggctcacccctgaacgtgaggggaaggtgaagctcgctctcttgctagctgcagtcggagccaccctagcggtgctctctgtcgggacggaattttgggtggaactcaacacttacaaagccaacggctcggcagtgtgcgaggctgcgcacttgggactgtggaaggcgtgcactaaacgactctggcaggccgatgtgccggtggaccgtgacacctgcggtcccgccgaactgcccggcgaagccaactgtacttacttcaagttttttactacaggggagaacgcacgtatctttcagaggacaactaaaaaggaagtgaacttagccgctgcggttatcgccgttctgggtctggctgtgatggcgctgggatgcttgtgcatcataatggtcctttccaagggagccgaattcctgcttcgcgtaggcgcagtttgcttcggtctcagcggacttcttctcttagtgtccctggaagttttccgtcacagcgtgcgcgccctcctacagcgcgtttcacctgaaccaccacccgcgcctaggttgacatacgagtacagctggagcctgggctgtggcgtgggagctggactgatactcctgctgggggctggttgttttctgctgttgaccctgccatcctggccatggggcagcttgtgccccaaacggggacacagggcaacctag

SEQ ID NO: 181206 - DNA, 645 bp, Artificial Sequence
  Description of Artificial Sequence: Synthetic coding sequence
atgatgtggagcaacttcttcctgcaggaggagaaccggcggcggggtgccgctggcagaagacgggcgcacgggcagggacgctctgggctgacacctgaacgcgaaggaaaggtgaaactggcgctcttgctcgccgcggtgggggcaacactcgcggtcttgtccgtgggtaccgagttctgggttgagctaaacacttataaggccaatggttcagccgtttgtgaggccgcccacctaggcttatggaaggcttgtacaaagcggctgtggcaagccgatgtgcccgtggacagggacacatgcggccccgcagagttgcctggggaagctaattgcacttactttaaatttttcaccacaggcgaaaatgccaggatctttcagcgtacaactaaaaaagggctgttattgctggtgtctctcgaagtgtttcgacattccgtccgtgctctgttgcagagagtgtcccctgagcccccacctgcaccgcgactaacgtacgaatatagttggtcactgggctgtggagtgggcgctggcctgattctcctcttgggcgcagggtgtttcctcctgctgacgctcccatcttggccttggggaagtctctgccccaaaagaggtcaccgggcaacttag

SEQ ID NO: 181207 - DNA, 570 bp, Artificial Sequence
  Description of Artificial Sequence: Synthetic coding sequence
atgatgtggagcaacttcttcctgcaggaggagaaccggcggcggggggccgctggccgaagaagggcccacggtcagggcagatcaggcttaactcccgagcgcgaaggtaaggttaaactcgcactcctactggctgccgtgggcgctactttggctgtgcttagcgtgggaaccgaattttgggtcgagctgaatacctataaagctaacggctcagcagtttgtgaggccgcccacctggggctttggaaagcttgcactaagagactgtggcaagccgacgttcccgtggacagagacacatgcggccctgcggaacttcctgggggactcctcctgctggtgagtttggaggtatttaggcactccgtgagggccctgctgcaacgagtttcccccgaacctccccccgcgccccgcctgacatatgagtatagctggtctctgggatgtggcgtgggggcaggactcatccttctgttaggagcgggttgtttcctacttctgaccctcccatcctggccttggggatctctttgtcctaagcgcgggcaccgggctacctag

SEQ ID NO: 181208 - DNA, 321 bp, Artificial Sequence
  Description of Artificial Sequence: Synthetic coding sequence
atgagcaccaacaacatgagcgacccccggcggcccaacaaggtgttaagatataagcccccaccctcagagtgtaatcctgcgcttgatgaccccacgcctgactacatgaatttactggggatgatattcagcatgtgtgggcttatgcttaagctgaaatggtgcgcctgggtagctgtctactgtagcttcatttccttcgccaacagcaggagctctgaagacacaaaacagatgatgagctcctttatgctgagtattagcgcagtagtgatgtcatatctccaaaaccctcagccaatgactcctccatggtag

SEQ ID NO: 181209 - DNA, 828 bp, Artificial Sequence
  Description of Artificial Sequence: Synthetic coding sequence
atgagccactgcagcagccgggccctgaccctgctgagcagcgtgtttggcgcttgtgggcttctgttagtgggcattgccgtgagcacagactactggctttatatggaggaaggcacggtgctaccccagaaccagaccaccgaggttaaaatggccctgcatgcaggactgtggcgcgtctgctttttcgccggcagagagaagggacgttgcgttgcaagcgagtattttctcgagccagaaataaatctggtaacagagaatacagaaaacattctgaaaacagtgaggacggcgacacccttccccatggtgtcattatttttagtgttcaccgcctttgttataagtaacattggccatatacggccccaaagaacgatcctggcgtttgtgtcagggatcttcttcatcctatccggtttatccttagtggtggggctggtgctgtacatttcttctatcaacgacgaagttatgaaccgtccatcttcgtctgagcagtactttcattacagatatggctggtcctttgcctttgccgcttcatcttttttactgaaagaaggtgcaggagtgatgtccgtctacctttttacgaagcggtacgccgaggaagaaatgtatcgaccgcatcctgccttctataggcctcgccttagcgactgtagtgattactctgggcagtttttgcagcctgaggcgtggcgcagaggccggtcgccatcagacatctcatccgatgtctccattcagatgactcagaactatcctccggccattaagtacccagatcaccttcatataagcacttctccctgctag

SEQ ID NO: 181210 - DNA, 1278 bp, Artificial Sequence
  Description of Artificial Sequence: Synthetic coding sequence
ctggagagcctgaagcggtggaacgaggagcggggcctgtggtgcgaaaagggggtccaagtgctgctcacaacggtcggcgcattcgccgcatttggtctcatgactatagctatatccactgattattggctctacacaagggcccttatttgcaatacgaccaacctgactgcggggggtgatgatggcacccctcatcggggtgggggcggagcgtcagaaaagaaagatccaggagggttgactcatagcggtctgtggcgcatctgttgcctggaaggcctcaagaggggtgtgtgtgtgaagataaatcacttccccgaggacacagactatgatcatgacagtgccgagtacctcctgcgggtagttcgggctagctcaatctttccaatactgagcgctattctgctattgctgggaggcgtgtgcgttgctgccagccgtgtttacaagtcaaagagaaacattattctaggtgctggcatcctctttgtggctgcaggcttatctaacataattggcgttattgtgtacatctccgctaatgcaggggaaccaggacccaagagagacgaggaaaagaagaaccactattcgtatggatggtctttctacttcggtggtctgagtttcattctggctgaggtgattggcgttctagccgtcaatatctacatcgaacgtagcagagaggcccattgtcagtcgaggtcagaccttctgaaagcaggtggcggtgccggcggttcaggtggatctggcccctctgccatcttgaggttaccttcctatagattccgctaccgtcgcaggagccgctcgagtagtcgctcctctgaacccagtccatccagagatgcatccccagggggcccggggggacccggcttcgcatccacagatatctctatgtatacactgtccagagacccttcaaagggctctgtggctgccggtctggctggagcaggtggcggaggtggcggtgctgttggcgctttcgggggggccgccgggggcgccggtggaggcggcggagggggggggggagcaggggctgagcgggatcggggtggagcctccggattcctcacactccacaatgcttttcctaaagaagccggcggcggtgtcaccgtcaccgttactgggcctccagccccaccggcgcctgcccccccagcacccagtgcaccggcgccagggacgctggcaaaagaagccgcggcatctaacaccaacacattaaaccgaaagactactccagtctag

SEQ ID NO: 181211 - DNA, 6540 bp, Artificial Sequence
  Description of Artificial Sequence: Synthetic coding sequence
atggtgaacgagaacacccggatgtacatccccgaggagaaccaccagggctccaactacggctccccccggccagcccacgctaatatgaatgcaaacgcagcagcaggcctggcacccgagcatatacctacacccggcgccgccctgtcatggcaggctgctatcgacgctgcccgacaggctaaattgatgggtagcgctggcaatgctacaatcagcaccgtgagtagcactcagcgaaagcgacaacagtacggaaagcccaaaaagcaaggttcaactactgcaactagaccaccacgggctctgttatgtctcaccttaaaaaaccctattagacgtgcctgcattagcattgtcgaatggaaaccttttgaaattatcatcctgctaactatctttgcgaactgcgtcgccctggccatctatatccccttcccggaagatgactctaacgcaaccaattctaatttggagcgggtggagtatctgtttctcattatctttacagtggaggctttcttgaaggtgatcgcatatggactcctgttccatccaaatgcctacctgcgtaatggttggaatctcttggacttcatcatcgtggtagtcggactgtttagcgctattttggagcaagccacaaaggccgacggcgctaatgccctgggcggcaagggtgcaggctttgatgttaaggcgctgagagcttttcgagtactgcggccgcttcgtctggtgagcggagtcccttcgctgcaagtggtcttgaattccattatcaaagcgatggtccccttattacatattgccctgcttgtgctatttgtaattatcatctacgctatcatcggcttagagcttttcatgggcaaaatgcataagacgtgctataatcaggaagggatcgccgatgtccccgcggaggacgaccccagcccctgcgcgcttgagacaggccatggtcgccagtgtcaaaacgggaccgtttgcaaaccaggctgggatggacctaaacacggcatcaccaacttcgacaattttgcttttgccatgctcaccgtatttcagtgcatcactatggaaggctggacagatgtcctgtactgggtcaacgatgccgtcggaagagactggccatggatctactttgttactctcattataatcggatcttttttcgttttgaatctggttttgggtgtacttagcggcgaattcagtaaggaacgggaaaaagcgaaagcaaggggcgatttccagaaattaagggaaaagcaacagctcgaagaagatctgaaaggatatctcgattggatcactcaggccgaggacatcgatccagagaatgaggacgagggcatggacgaagagaaaccacggaacatgtcaatgccaacatctgaaaccgaaagtgtcaacacagaaaatgttgcaggaggggacattgaaggggaaaattgtggagccaggctggcccaccgaatctctaagtccaaattcagtcgctattggcgaagatggaatcggttttgccggaggaaatgcagagctgccgtaaagtctaacgttttttattggcttgtaatctttctggtatttttaaacactctgaccatcgcaagcgaacactacaatcaacctaattggctgactgaggtgcaggatacggcgaacaaggcgctgttagccttatttaccgcggaaatgttactgaaaatgtattcactgggcctgcaggcttatttcgttagcctgtttaaccgctttgattgttttgtcgtctgcgggggcatcctcgagacaattctggtcgagaccaaaatcatgtctccactgggcatttcagtcttgcggtgcgtccgtctgcttcggatattcaaaattacccgatactggaatagcttgtccaatctcgtagcttcccttctgaactctgtacgctccatcgcaagcctattgctcctacttttcttgttcatcatcatcttcagcttgctgggaatgcagctgttcgggggaaaattcaacttcgacgagatgcagacgcgacgctccacctttgataatttcccccagtcattactaacggtcttccagatcctcactggtgaggattggaactctgtgatgtacgatggcatcatggcttatggcggaccctccttccccggtatgctcgtttgcatctattttataatcctgtttatctgcggaaactatatccttctgaacgttttcctagcaatcgctgttgacaatttggctgacgccgagtccctgaccagcgctcagaaggaagaagaagaagaaaaagagcggaagaaactggcgcggaccgcatctccagagaaaaagcaagaattagtggaaaagcctgccgttggcgaatcaaaggaggagaagatcgagcttaagagcattaccgctgatggtgaatctccacctgccactaagataaatatggacgatttgcagcctaatgaaaatgaagataaatctccatacccgaatccggaaaccacaggagaggaagatgaagaagagccagaaatgcccgtgggaccacggcctaggcctttatcagaactccaccttaaggagaaggccgtccccatgcccgaggcttctgctttttttatttttagttcaaacaacaggttccggctccagtgccacagaatcgtgaatgacacgattttcacgaatctcatcctctttttcattttactgagttctattagcttggccgccgaagatcccgtccagcacacgagcttcagaaaccatattttgttctattttgacatagtcttcacgacaattttcacaatcgaaatcgcattaaagatgaccgcatacggcgcttttctgcacaagggcagtttttgcagaaactacttcaacatcctagatctgctggttgtgagcgtgtctttgatctcattcgggatccagagttccgcgattaatgtggtcaaaattctgcgcgtccttcgcgtgttacgtcccctgagggctattaatagggcgaaggggctgaagcatgtcgtccaatgcgtgttcgtggctataaggacgatcgggaatatcgttattgttaccaccctccttcagttcatgtttgcctgcatcggagtgcagctgttcaagggtaaattgtatacttgtagcgacagtagcaagcagacagaggccgagtgtaaggggaattacatcacgtacaaggatggggaagtggaccatccaataattcagccaaggtcttgggagaacagcaagtttgacttcgacaatgtgcttgcagccatgatggctctattcacagtgtctactttcgagggatggcccgaactcctgtaccgctctatagacagtcatacggaggacaagggcccaatctacaactatagggtcgagatcagcatcttctttattatttacattattattatcgccttttttatgatgaacatctttgtcgggtttgtgatcgtgactttccaggaacagggcgagcaggaatataaaaattgcgagcttgataagaaccaacgccaatgtgtcgaatacgcgttgaaggccagacctttgcgtcgctatatccccaagaaccagcatcaatataaagtttggtatgtggtcaactccacttatttcgagtacttaatgtttgtattgatcctgctgaacaccatttgtctggccatgcaacattatggacagagttgcctcttcaaaatcgctatgaacatactgaatatgctcttcaccggtcttttcaccgtggagatgatcctgaagctgatcgcctttaaacccaaacattatttttgcgatgcctggaatacattcgacgcactgatagttgtcggctcaatagtggatatcgccattacggaggtcaatcctgcagagcacacccaatgttccccatctatgggcccttcatgctcccaccctcccctcgcagtgttgaccgcccctcctgtggccgatggctttcagaatgctgaggagaattcacgaatctccatcacattcttcaggctcttcagggtaatgcggctagtcaaactgctctcccgcggggagggcatccggactctcctctggaccttcattaagtcatttcaggcgctgccttacgtcgccttgttaatcgttatgctgttcttcatttacgccgttatcgggatgcaagtgtttggcaaaattgccttgaacgacacaacagagattaacagaaataataacttccagaccttccctcaggctgtactcctcttgttccggtgcgcaaccggagaagcctggcaggacatcatgctggcttgcatgcccggtaagaaatgcgcgccagagtcagagcccagcaatagcacggaaggggaaacaccttgtgggtcctcctttgcggtgttctacttcatcagtttctacatgctgtgcgcctttcttataatcaacctgttcgtcgctgtcatcatggataactttgattacttaaccagggattggagcattttgggccctcaccatctcgatgagtttaaaaggatttgggcagaatacgacccggaggccaaaggtcgtattaagcacctggatgtcgtgacgttgcttcgccgtattcagccgcccctcggattcgggaaactgtgtccccaccgagtcgcatgcaagcggctggtatccatgaacatgcctttaaacagcgacgggacggtcatgtttaacgcaacactgtttgccctggttcgcacagccctccgcataaaaactgaagaaggtcctagtccatccgaagctcaccagggcgctgaagacccatttagacccgccggcaaccttgaacaggctaatgaggaattgagagcaattattaaaaagatatggaagcgtacgtccatgaaactactggaccaggtggtgccaccggcaggtgacgatgaagtcacagtcggtaagttttacgctacctttctgattcaagagtattttaggaagtttaagaaacgaaaggagcagggcctcgtgggcaaaccatcacagagaaatgcactgagcctgcaggccggactcaggacccttcacgatattggacccgagatcagaagggctatcagtggcgacctgactgccgaggaggagctggataaggctatgaaggaagcagtgtccgcggcttcagaagatgatattttcaggcgtgcgggggggctttttgggaaccacgtctcatattatcaaagtgatggaaggtcagcttttcctcagaccttcacaactcagcggcctctacacattaataaggctgggtcctctcaaggcgacaccgagtcaccaagtcatgaaaaactggtggatagcacctttactccctccagttatagttccacaggcagcaacgcaaatattaataatgccaacaacacagcactgggtaggctgccaaggccagctgggtatccctctactgtaagcactgttgagggacacgggccaccgctgtccccagctatcagggtacaggaagtggcgtggaagctcagctctaaccggtgccactcgcgtgaatcccaagccgcaatggctggacaggaagagacatcccaggacgaaacctacgaggttaagatgaatcacgacaccgaggcctgcagcgagcccagcctgctgtcaaccgaaatgttgtcttatcaagatgacgaaaaccggcagctgacgctgccggaagaggacaagagggatatccggcaaagtccaaagcgtgggttcttgcgctccgcctctttgggacgaagggcgtcattccaccttgagtgcctcaaaaggcagaaagatcgaggaggggatatttcccagaagacagttctgccgttgcacctcgttcaccatcaggcccttgccgtggcagggctaagtcccctgctacagaggagccattcccctgccagttttccccgcccattcgccactcctcctgctaccccagggtctcgcggctggccccctcagcccgtgcctactctgcggctggaaggagtagaaagctcggaaaagctgaatagctctttcccttctatccactgcggctcctgggccgagacaacacccggcggcggggggtcatctgcagcccgaagggtacggcctgtgtctcttatggttccctcgcaagctggcgctcccggcagacaatttcatggatctgcttcttctctggtggaggctgtcctcatcagtgaaggcttagggcagtttgcgcaggacccaaagtttattgaggtgaccacgcaggagttggccgatgcttgcgacatgacgatcgaagagatggagtccgccgccgacaacatcttatcaggcggcgctcctcaaagtccgaatggagctctgctgccctttgtcaactgccgcgacgctggtcaggatcgagcaggcggggaggaggatgcgggttgcgtgcgggcgcgcggccgtccttctgaggaagagctccaggactctcgggtgtacgtatcgagtttgtag

SEQ ID NO: 181212 - DNA, 6561 bp, Artificial Sequence
  Description of Artificial Sequence: Synthetic coding sequence
atggtgaacgagaacacccggatgtacatccccgaggagaaccaccagggatccaactacggatcacccagaccggctcatgccaatatgaacgcaaacgctgcggctgggctcgcccccgaacatatccctactccaggcgccgccctgagctggcaggctgccatcgacgccgctcggcaagccaaactcatgggctcagccggtaacgccacaattagtaccgtttcttctactcagcgcaagaggcaacaatatggtaagccgaaaaaacagggtagtactactgcaaccaggcccccccgagccttgctctgcttaactcttaaaaaccccatccgtcgagcctgcatcagcatcgttgagtggaagcccttcgaaatcatcatccttctgaccatctttgccaactgcgtggccctggctatatatatccccttcccagaggacgattccaatgcaaccaacagcaaccttgaacgggtggaatatttgttcctgattatctttaccgtagaagccttcctgaaagtgattgcctatggccttctttttcaccctaacgcatatctaaggaacggctggaatctgctggactttattattgtggtagtgggcctatttagcgctattctggaacaggcaacaaaagccgacggagccaatgccctcggcggcaagggagccggcttcgatgtgaaggcactgcgggcttttagggttctgagacctttgcgccttgtgtctggtgtgcccagtttacaggtggtactgaattccattataaaggcaatggtgccactcctccatatagctctcctcgttctattcgtgatcattatatacgccatcatagggctggagctgtttatgggcaagatgcacaagacgtgttataaccaagagggaattgccgacgtccccgcagaggacgaccccagcccgtgtgcactcgagacaggtcatggccgccagtgccaaaatggtactgtatgtaagccgggttgggatggccccaaacacggcatcacaaatttcgacaactttgcgttcgcaatgttaacggtcttccagtgtatcacgatggagggttggaccgacgtgctgtattgggtgaacgacgccgtgggaagggattggccctggatctactttgtcacccttattataattggatctttcttcgttctgaatctggtactgggtgttctctctggtgagttctctaaagagcgagagaaggccaaggccagaggcgattttcagaaactgagagaaaagcagcagctggaggaagacctcaaagggtacttggactggatcacccaggcagaggatatagaccctgagaacgaggacgaaggcatggatgaagaaaagccccgaaatatgagtatgccaacgagcgagaccgagtccgtcaacacagagaatgtcgctggtggtgacatagagggagagaattgtggggcgcgcctggctcatcggatcagcaaaagcaaattctcacggtattggcggagatggaatcggttctgcagacgcaagtgtcgagcagccgtgaagtcaaacgtcttctactggctagttatctttctggtgttcctcaacacattgacaattgcatccgaacattacaaccagcctaattggctcaccgaggtacaagataccgccaacaaggccctgctcgccctgtttacggccgaaatgcttctgaaaatgtatagcctgggactgcaggcgtattttgtgagcctgtttaaccgctttgactgtttcgtcgtgtgtggcgggattctagagacgatcttggtggagaccaagattatgtccccactcgggatctcagtgttgcgatgcgttcgcttactccgcattttcaaaataacaaggtattggaactcactaagcaacttggtggccagcttgctgaattccgtgcgaagcattgcctctttattgctgctcttgttcctgtttatcatcattttctctttgctgggaatgcagctttttggaggtaaattcaactttgatgaaatgcaaacgcgcagaagcactttcgataattttccacagtctctcctcacagtgttccagatcctgacaggcgaagactggaactctgtcatgtatgacggtattatggcctacggcggtccttcatttccgggaatgctggtatgcatttattttattatactgttcatatgtggcaactatatcctccttaatgttttccttgcaattgctgtggacaacctcgccgatgctgagagtttaaccagcgctcaaaaagaggaggaagaagagaaagaaagaaaaaagttggctaggaccgcttctccagagaagaagcaggagctggtggagaagccagctgtgggagaaagtaaagaggagaagatcgaacttaagtccattaccgcagacggcgagtcgccacctgccaccaagatcaacatggatgaccttcaacctaacgagaatgaggataagtcaccataccctaatcccgagactacgggcgaagaagacgaggaggagcccgagatgcctgtggggccccgtccgaggccactcagcgaactgcatctaaaagagaaagctgtgcccatgcctgaggcgtcagcgtttttcatcttctcctccaacaatagatttcgactgcagtgtcaccggatcgtgaatgatacaatattcactaatcttattttatttttcattctactgtccagcatttccctggccgccgaggacccagtgcagcacacgtcctttcgtaaccatatactgttttactttgatatcgtctttacaacaatatttactatcgaaattgctctgaagatactcgggaacgctgattacgtgtttaccagtatctttaccctcgagattattctgaaaatgactgcttacggcgctttcctgcataagggctcgttctgccgcaactattttaacattctagacctgctagttgtttccgtatctctgattagcttcggtatccagagtagcgccataaacgtagtgaaaattctgcgcgtgctcagagtgctgagaccactgcgggcaataaacagagcgaaaggattgaagcacgttgtgcaatgcgtgttcgtcgccatcaggacgatcggcaacatagtcatagtgaccacactgttgcaatttatgtttgcttgtatcggagttcaattgttcaagggcaagctgtatacttgctctgactccagcaaacagaccgaggccgagtgtaaggggaactacatcacctataaggatggcgaagtcgatcatcctatcattcaacctagatcatgggagaattccaagttcgacttcgataacgtgcttgccgctatgatggccttgtttacagtgagtacctttgagggctggcccgaactcctctaccgatctatcgattcccacacggaggacaaaggaccaatctataactatcgagtagaaatctccatcttttttattatttacattattattatagccttctttatgatgaacatcttcgtagggtttgtaatcgtcacatttcaggagcagggcgagcaggagtacaaaaattgtgaactggacaaaaatcagagacagtgtgtagaatacgcactgaaagctaggcccttacgacgttacatcccgaagaaccagcatcagtataaagtatggtacgtggtgaacagtacttatttcgaataccttatgttcgtccttattctactgaacaccatctgcctcgcaatgcagcattacgggcaaagctgtctttttaagatcgctatgaacatcttgaatatgctgttcactgggttgttcacagttgagatgatcctcaagctgatcgctttcaaaccgaagggctactttagcgatccctggaacgtgttcgactttctgatcgtgatcggaagcatcatcgatgtcatcctctcagagactaatcactacttttgcgacgcctggaacacctttgacgccctcattgtggttgggagtatcgtcgacatcgccatcacagaggtgaaccccgcggaacatacacaatgttcaccctccatgaacgccgaggaaaattcacgaatctccattacatttttcagactcttcagagtcatgcgccttgtgaagctgctgtctaggggggaaggcatcaggacactgctttggacctttataaagtctttccaggcgcttccgtatgtggcgctgctcatcgttatgttgttctttatctacgcagtgatcggaatgcaggtgttcggcaaaattgctctgaatgataccacagagatcaatcgcaacaacaactttcaaacgtttccgcaggccgtcctcctattgtttaggtgtgcaactggagaggcttggcaggacataatgctggcctgcatgcccggcaagaagtgtgctcctgagagcgaaccgtccaattccactgaaggggaaacaccatgcgggtcctcgtttgcagtgttctatttcatatcattctacatgctttgcgctttcctcatcatcaacctgttcgtggccgtgatcatggacaattttgactatctcactcgagactggagcattctggggccacaccacttggacgagttcaagaggatatgggccgagtacgaccctgaagccaaggggcgcataaagcatctggatgtcgtgacactcctgcgaaggatacagccacctctggggtttggcaaattatgtcctcacagagtggcctgtaagaggctcgtgagcatgaatatgccccttaactctgacgggaccgtcatgttcaatgcgactttgttcgctctggtgcgcacggccctgcgcataaagacagagggaaacctcgagcaagccaatgaagagttgagggccatcatcaaaaagatatggaaacgaacaagtatgaagctactggaccaggtggtacccccggccggggatgacgaggtgactgtgggcaagttttacgccaccttcctgatacaggaatactttagaaaatttaagaagcgaaaggaacaagggttagttgggaaaccaagccaaaggaacgctctcagcttgcaggctggccttcgaaccctgcatgacattgggcctgagatcaggcgtgcaatttcgggagacctgacggccgaagaggagttggataaggcgatgaaagaagctgtcagcgctgcgagtgaggacgatatattccggcgtgcaggtggtcttttcggcaaccacgtgtcatactaccagtctgacggccgttccgcgttccctcagacgttcaccacccagcggccgctgcacatcaataaagcggggtcatcccagggcgatacagagtcaccttcccatgaaaagctagtagattctaccttcactccctcgtcctatagctctacaggatctaacgccaacattaacaatgccaacaacaccgccctcggccggctgcctcggccagctgggtatccctccaccgtaagtactgtggagggtcatggtcccccgttgagcccggcaatcagagtccaggaggtggcctggaagctctcttctaacaggtgccactctcgcgagtcacaggccgccatggccggtcaagaagagacaagccaggatgaaacctacgaggtgaagatgaaccatgacacggaagcatgttcggagcccagccttctgtccacggagatgctgtcctaccaggacgacgagaaccggcagctgacgctgccggaagaggacaagcgggacatcaggcagtctcccaagagaggcttcttgcggtccgcctccctcggaagacgggcgtcattccacctcgaatgtctcaagcgccagaaggataggggcggggatatctcacagaagactgtcctgcccctccacctggtgcaccaccaggcactggccgtggctggactttcccctcttctccagcggagtcattccccggcaagctttccgagaccttttgccactccacccgctactcccggcagccggggatggccaccccagcccgtgcctactctgcggcttgagggcgtcgagagttctgagaagctgaatagcagcttcccttccattcattgcgggtcatgggctgagacaacaccagggggcggcggatcatctgcagcacgacgggtgcggccggtgtctctaatggtgccctcccaagcaggcgcccctggtcgccagttccacggatccgccagttctctagtagaagcagtcctcatcagcgagggacttggtcagttcgcccaggatcccaagttcattgaggtgaccacacaggaactggcagatgcttgcgacatgactattgaagaaatggaaagcgcagccgacaatatcttaagcggcggcgccccgcagtcgccaaacggggcactactgcctttcgtaaattgccgagacgcaggacaggaccgcgcaggcggtgaggaggatgccggctgcgttcgggccagggggcgcccctcagaagaggaattgcaagacagccgggtgtatgtgagctcattgtag

SEQ ID NO: 181213 - DNA, 6441 bp, Artificial Sequence
  Description of Artificial Sequence: Synthetic coding sequence
atggtgaacgagaacacccggatgtacatccccgaggagaaccaccaggggtcgaattatggttctccccggccggctcacgcaaatatgaatgctaacgctgccgctggcctcgccccagaacacatccctactcctggagccgcgctatcatggcaagccgcaattgatgcagcccgccaagccaaactcatgggctcagccgggaatgctactatctctacagtcagctccacccagcgtaaacggcagcagtatggtaaacctaagaagcagggaagcacgaccgcaactcggccccccagagctctcctttgcctgactctgaagaacccaatccgaagggcatgtatttcgattgtcgaatggaagcccttcgaaattatcattctccttacgatatttgccaattgcgtggccctggcaatatacattcccttcccggaggatgattccaacgctactaactcaaatcttgagcgggtcgagtatttatttttgatcattttcacagtcgaggccttccttaaagtcatcgcgtatggattactgttccaccctaatgcttatcttcgtaacgggtggaatctcctggatttcattattgtagtggtcggcctcttcagcgctattctggaacaggcaaccaaagcggacggagctaacgctctgggaggcaaaggagctggcttcgatgtgaaggctcttcgcgctttcagagttctgagacctcttcgcttagtaagcggggtaccctcactgcaggtcgtgttaaactcaatcatcaaggctatggttcctttactgcacattgccctgctggtactgttcgtcatcatcatttatgccataatcggtcttgagctgtttatgggcaaaatgcacaaaacatgttacaatcaagaaggaatcgcggacgtgcccgcagaggatgatccctcaccctgtgctctggagactgggcatgggagacaatgtcagaacggcacagtctgtaaaccaggttgggacgggccaaagcacggaattactaactttgacaactttgccttcgctatgcttaccgtgttccagtgcatcaccatggagggttggactgatgtgctctattgggtcaatgatgccgtcggacgagactggccttggatttacttcgtcaccctgattataattggttcgtttttcgttctcaacctcgtcctcggcgtgttatcaggcgagttctctaaggagcgcgaaaaagccaaggccaggggggattttcagaagttgcgggagaagcagcagttggaggaggacttgaaggggtacttggattggatcacgcaggcagaagacatcgatccggagaacgaggatgaaggcatggacgaggagaagccacggaacatgtccatgcctaccagcgagacagagtccgtaaacaccgagaatgtcgccgggggagacattgaaggcgagaattgtggcgctcggcttgcgcaccggattagcaagtccaaattttcacgctattggcggcggtggaatcggttctgtcgacgaaaatgccgggccgccgtcaagagcaatgtcttctattggctggtgattttcctagtctttctgaacacactcactattgcctctgagcactataaccagccaaactggctgactgaagtacaggatacagctaacaaggccttacttgccctgtttacggctgaaatgttgcttaaaatgtattcgctgggtttgcaggcttactttgtgtcactcttcaataggttcgattgttttgtcgtgtgtggtggtattctggagaccatcttagtggagaccaagatcatgtctcccttaggaatttctgtgctgaggtgcgttaggcttctgcgcattttcaagatcacacgatattggaactctctctcaaatttagtagccagcttactgaacagtgtccgaagcatcgcaagcctgcttttattattgttcctctttattatcattttttcgcttctcggaatgcagctctttggaggcaagtttaatttcgacgagatgcagacacggagaagcaccttcgacaacttcccccagtcattgctaactgtgtttcagatcctcaccggagaagactggaatagcgttatgtatgacggcatcatggcctacggggggccctcttttcccgggatgttggtgtgtatttattttatcatactctttatttgcggaaactacatcttgttaaacgtgtttcttgccattgctgtcgataatttagcggacgctgaaagcctgacctctgctcaaaaggaggaggaggaagagaaagaacgtaagaagctggccaggaccgcttctcctgagaagaaacaggagctggtcgaaaagccagctgtcggtgagtcaaaggaggaaaaaattgagttgaagtccatcaccgccgacggggaatctccacctgcaacaaagataaacatggatgacctgcaacctaacgaaaacgaggataagagtccctacccaaaccctgaaacaactggcgaggaagacgaggaggaacccgagatgcccgttggtccacgaccccgccctctaagtgaactgcaccttaaggagaaggctgtgcctatgcctgaagccagtgcattttttatcttctcctctaacaataggttcaggttgcagtgtcacaggattgtaaatgacacaatttttactaacctcatcctgtttttcatcctgttgtcatccatctcgctggcagccgaagatcctgtgcagcatacctcatttagaaaccatattttaggtaacgctgactatgtgtttacgtccatcttcacgcttgaaattattttaaaaatgacagcctacggcgcttttcttcataaagggtcattttgcaggaattatttcaatatacttgatttgcttgtggtgagcgttagtctcattagctttggtatacagagctccgccattaatgttgttaagatcctgcgcgtgctgagagttctgaggccccttcgtgccattaaccgggcgaaaggactcaaacatgtagtacaatgtgtgttcgttgctatccgaaccattggcaacatcgtgattgtcaccacacttctccagtttatgtttgcttgcatcggggtgcaactgtttaaaggtaagctatacacctgcagcgactcctccaagcaaaccgaggccgagtgcaaggggaactacatcacctacaaggacggcgaggtggaccaccctatcattcaaccaagatcttgggaaaattcaaagttcgactttgacaatgtcctagcagccatgatggctctatttacagtgtctaccttcgagggatggcccgagctgctgtacaggagcatcgattctcatactgaggataagggacctatctacaactacagggtcgagatttcaatcttttttatcatatacattatcattatcgcattttttatgatgaacatctttgtaggattcgtaattgttacgttccaggaacaaggggaacaagagtacaagaactgcgagctggacaaaaaccaacgccaatgcgttgagtatgcccttaaggcacgcccgttacggagatatatccctaagaatcagcaccagtacaaagtttggtatgtggtgaacagtacatattttgagtaccttatgttcgtgcttatactgctcaacacaatctgtctcgcaatgcagcattacggccagagctgcctcttcaagattgcgatgaatattctgaacatgctgtttactggattgtttaccgtggagatgatcctgaaactgatcgctttcaaaccaaagcactatttttgcgacgcctggaacaccttcgacgccttgattgtcgtgggctctattgtagacatcgcaatcaccgaagttaataacgctgaagaaaatagcagaatttctatcacctttttccggctgtttagagtgatgcgtctagtgaaactactctctcgaggggagggcataaggactctactgtggactttcattaaatcctttcaggcattaccctatgtcgctctactaattgtgatgcttttcttcatctacgcggtcatcggcatgcaggtctttggcaagattgctcttaatgacaccactgagatcaataggaataacaattttcagacattcccccaggcagtcctgttactctttcgatgtgccaccggggaagcatggcaagacatcatgctggcctgtatgcctggcaagaaatgcgcacctgaaagtgaaccctcaaattccaccgagggggagaccccatgtggcagctcgtttgcagtgttttacttcatctccttctatatgctgtgtgccttcctgatcattaatctgttcgtagcagtaatcatggataactttgactacttgacccgtgactggagcatcctcgggcctcaccatctcgacgaattcaaaagaatctgggcagaatatgatccagaggctaaaggcagaattaaacacttagatgtggttactctgctgcggcggatccagccaccactaggctttggaaagctttgccctcatcgcgtggcatgtaagcggcttgtcagcatgaatatgccgctgaactcagacggcaccgtgatgttcaatgcaaccctgtttgcccttgttcgaactgcactgcggattaagactgaagaggggccatccccctcagaagcgcaccagggcgctgaagacccttttaggcctgctgggaatctggagcaggcaaacgaagagcttcgggcaattatcaaaaagatatggaaaaggacaagcatgaagttgctcgatcaagtggtacctcctgccggtgacgacgaagtaacggtgggcaagttctacgcgaccttcctgattcaggaatactttagaaaattcaagaagcggaaagaacaaggcctggtgggaaaaccctcccagcgaaatgctcttagcctgcaggccggactcaggactttgcacgacatcggtcccgagattaggagagcgattagcggcgacctgacagccgaggaagaactcgataaagccatgaaggaagccgtgtccgcggcaagcgaggatgacattttccgccgtgctggtggcctgttcggcaaccatgtgtcttactaccaatcagatggcagatcggccttccctcaaacattcacaactcaaaggcctctgcacatcaacaaagctggaagcagtcagggtgacacagaaagcccatctcatgagaagcttgtggacagtacatttacaccctcttcatactcttccacaggatctaatgctaatatcaataacgctaataacactgcacttggtcgactgcccagacctgccggctatccttctacagtcagcactgtggaaggccatggcccgccattgtcccccgctatccgcgttcaagaggtggcctggaagctatccagtaaccggtgccatagcagagagagccaggcagcaatggccggccaggaagaaacgtcccaggatgagacctatgaggtaaagatgaatcatgataccgaggcttgtagtgaaccaagcttgctctctaccgaaatgctgagctatcaagatgatgagaaccggcaactgacactgcccgaagaggataaaagagacatcagacaaagtccaaagagaggcttcctgcgcagcgcgagcttgggacgtagagcgagctttcacctcgagtgtctgaagcgccagaaagaccgcgggggggacataagtcagaagaccgtgctgccgctgcacctcgtacatcatcaagcccttgcagtggcagggctgtccccgctgttgcagagatctcatagcccagcctcattccctcggccattcgccactccgcctgcaacacctggatcacgcggctggccaccccaacccgtgcctacacttcgccttgagggcgtggagtctagcgaaaagctgaacagctcttttccttcaatccactgcgggagctgggctgagacaacacccgggggcggtggcagcagcgcagcccgtagggtgcgccctgtgtccctcatggtgccgtcacaggctggggcacctgggaggcagttccacgggagcgcgagcagccttgttgaagcagtcctgatcagcgaggggttgggccagttcgcacaagatcccaaattcattgaggtgaccacacaggagctggccgatgcatgcgatatgaccattgaagaaatggaaagtgccgccgataacattcttagcgggggcgcgcctcaaagtcctaatggagctctgttgccatttgtgaactgccgtgacgctggtcaggaccgagctgggggtgaggaggatgctggatgtgtacgggcccggggccggcccagcgaagaagagctgcaggattcacgtgtgtatgtgtccagcctctag

SEQ ID NO: 181214 - DNA, 6441 bp, Artificial Sequence
  Description of Artificial Sequence: Synthetic coding sequence
atggtgaacgagaacacccggatgtacatccccgaggagaaccaccaaggctcaaactatggctccccccgacccgctcacgctaatatgaacgccaatgctgccgcaggccttgctccagaacatatccctacaccaggggcggcgttatcatggcaagcagctatagacgctgccagacaggcaaagctcatgggctccgctggcaacgctacaatcagcacagtctcttctacccaaagaaaacgtcagcagtatggtaagcccaagaaacagggcagtaccacagccacccgacctccaagagctctattgtgcttgactcttaagaatccaataagacgggcctgcatctccattgtggagtggaaacccttcgaaatcataattctcctgaccatctttgcaaactgcgtcgctctcgcaatatacatcccttttccggaggatgacagtaatgcgaccaattccaacctcgaaagagtggagtatctctttttaataattttcactgtggaggcctttctgaaagtgattgcatacgggctgctttttcaccccaatgcctaccttcggaacggctggaacctgctggacttcattatcgtcgttgtggggctgttctccgccatcctggaacaggccacaaaggctgacggagccaatgctcttggcggcaaaggcgcaggatttgacgttaaggctctcagggctttccgcgtcctcagacctctgcgcctcgtaagcggtgtcccatctcttcaagtggtgctgaacagcatcatcaaagcaatggttcccttattacacatcgctctgcttgtactgtttgtgattatcatatatgctatcattggactcgaactgtttatgggtaagatgcataagacatgttacaaccaggagggcatcgccgacgtgcctgctgaagacgacccaagtccctgcgccctagagaccggtcacggaaggcagtgccagaacggcaccgtatgtaaacctggctgggatggccctaaacatggcatcactaatttcgataatttcgcttttgccatgctcactgttttccagtgcatcaccatggaagggtggactgatgttctctactgggttaatgatgccgtaggccgtgactggccttggatctacttcgttaccctgattataatcggaagtttcttcgtcctaaatttggtgttgggggtgctgtctggcgagttcagcaaagagcgggagaaggccaaggcacgaggtgatttccagaagctgcgagaaaaacaacagctagaagaagacctaaagggctatctagattggattacacaggctgaagacatcgacccagagaacgaagacgaaggcatggacgaagagaaacctcgcaacatgagtatgcccacttctgagacagagtccgtcaacacagagaacgtagcgggaggagatatcgaaggggaaaactgcggagcacggctagcccatcgcatctcaaaatcgaagtttagccgctactggagacgttggaaccgcttctgcaggcgaaagtgccgtgccgccgtgaagagcaacgttttttactggctggtgatctttctggtattcctaaacaccctcaccattgcctccgaacattacaatcagcccaactggttgaccgaagtccaggacacagcaaataaagctcttcttgcactgttcaccgctgaaatgctcctaaaaatgtactctctcggtctgcaggcctacttcgtcagcctgttcaacagattcgattgcttcgtggtgtgtggaggaatcttagagaccatactggtggaaacaaagatcatgtcacccttaggtataagcgtcctgaggtgcgtgcggctgctccgcatttttaaaattactcgatattggaattcactgagcaatctcgtggcatcgttactgaactctgtcaggtccatcgctagcctgcttcttctgctctttcttttcattatcatcttctccttgctcgggatgcagctgtttggcggaaaattcaacttcgatgagatgcagacaagaaggagtacatttgacaacttcccccagtctctgctgactgtgtttcagatcttgacaggcgaggactggaacagtgtgatgtatgacgggataatggcctatggagggccgagctttcccggcatgctcgtgtgtatctactttattatcctgtttatatgtggcaactatatcctgctcaatgtctttcttgccattgctgtcgacaatttggcagacgccgagagcctgacctcagctcaaaaagaggaggaagaagaaaaagagcggaagaaactagccaggacagcctctcccgaaaagaagcaggaattagtcgagaagccagctgttggcgagtcaaaggaagagaaaattgaactcaaaagtattacagcagacggtgaatccccaccagcaaccaagatcaacatggatgacctccaacctaatgagaatgaagacaaatctccataccccaaccccgagactacaggcgaggaagatgaggaggaacctgaaatgcccgtaggacctcgtcctcggcccctgtcagaactgcacctgaaggagaaggctgtgcccatgcctgaagccagcgccttctttattttttcctctaacaaccgattccggctgcaatgccatagaattgttaacgatacaatctttaccaatttgattctctttttcattttgcttagttccatttccctggcggctgaggatcccgtgcagcacacaagcttcagaaaccatatcctgttttatttcgatattgtgttcactactatctttaccattgaaatcgccttgaaaatgactgcttacggtgccttcctgcataagggctcattttgtagaaactacttcaacatccttgacctacttgttgtttcagtgtcgttaatcagttttggcatccagagctcagctatcaacgttgtcaagatcctccgcgtgctgagggtgctgcgccccctaagagctatcaaccgcgccaagggcctgaaacatgtagtgcagtgcgtgtttgtcgcaattaggacgatagggaatatagtaatcgtgacgacactgttgcaattcatgttcgcatgcataggcgtccagctgttcaagggaaagctgtacacctgcagcgatagctctaaacagacagaggccgaatgcaaaggtaattacataacttacaaggacggcgaggtagatcaccctataattcaacctagatcttgggaaaattcgaagttcgacttcgataatgtgctggctgccatgatggctctgttcacggtctcaacctttgaagggtggccggagctgctataccgctcaatcgactcccacaccgaggacaaagggccaatctacaattacagggtagaaatctcgattttttttattatttatatcatcatcattgctttcttcatgatgaacatttttgtagggtttgtgattgtcacttttcaggaacagggtgaacaagagtacaaaaactgcgaactggataagaatcaaagacagtgtgtggaatatgccttgaaagcacgccctctccgccgatacatacccaaaaaccagcatcaatacaaggtgtggtatgtagtcaactctacctattttgaatacctgatgttcgtgttgatactactaaataccatttgtctggcaatgcagcattatgggcaaagctgcctgttcaaaatagccatgaatattctaaacatgttatttacaggtttatttactgtggagatgatactgaagctgattgccttcaagccaaagcattatttttgtgatgcatggaataccttcgacgcccttatcgttgtagggtccatcgtcgacattgccatcacggaggtcaacaatgccgaagaaaattcccgcattagtatcactttttttaggcttttcagggtgatgagactagttaagctgttgtccaggggggagggcattcggactcttctctggacatttatcaagtcattccaggctctgccatatgtggccctcctcatcgtcatgttgttcttcatctacgctgtgataggcatgcaggtgtttggcaagatcgccctcaatgataccaccgaaatcaatagaaacaacaattttcaaaccttcccgcaggcagtactgctactcttcaggtgtgctaccggtgaggcctggcaggacataatgcttgcttgcatgcccggcaagaaatgtgctccggaatcagagccaagtaacagtaccgagggcgagactccttgtgggtctagcttcgccgtcttttacttcatttccttttacatgttatgcgcattcttgatcatcaacctcttcgtcgccgtgatcatggacaacttcgattatcttacccgtgactggtctatccttgggccccaccacctggatgaattcaagaggatctgggcagaatacgaccccgaagccaagggaaggatcaaacacctggatgttgtcaccctgcttagacggatccagcctccccttggctttggaaagttgtgtccccaccgagttgcttgcaagcggctggttagcatgaatatgcctttaaatagtgacgggaccgtgatgttcaacgccaccttgtttgcgctggttcggaccgccctccgcattaaaaccgaggagggtccatccccgagcgaggctcatcagggcgctgaggacccttttcgtcctgccggcaatcttgagcaggctaacgaagaactacgcgccatcattaagaagatctggaagcgtacatccatgaagctgctcgatcaggtggtgccgcccgcgggcgacgatgaagtcaccgtgggcaaattttatgcgacattcctgattcaggaatacttcagaaagttcaagaaaagaaaggagcagggcctcgtggggaagccgtcccagcgcaacgccctatctctccaggcaggcttacgcaccctccacgacattggccccgagatccgcagggcgattagcggcgacctgacggctgaagaggagctcgacaaggcaatgaaagaggctgtctccgctgctagcgaggatgatatatttcgacgagccggcggcctgttcggaaaccatgtatcatactatcagtcggatggacggtccgcttttccgcagacattcaccacacaacggccactgcacataaacaaagcggggagctcccagggtgatactgagtccccctcccacgagaaactggttgatagcaccttcaccccctcatcttactctagcaccggctccaatgctaatatcaacaacgcaaacaacaccgctctcggcagactgccgcggccggcaggatatcccagcactgtgtccaccgttgaaggacatggcccgccacttagtccggctatccgagtgcaggaggtagcttggaagctctcaagtaacaggtgccatagccgcgaatcccaggctgctatggcaggtcaggaggagaccagccaggacgagacctatgaagtgaaaatgaaccacgacacagaggcatgcagtgaaccctcgctcttgtctactgagatgttgtcatatcaggacgacgaaaatcgccagttgacactgcccgaggaagacaagagggacatccggcagtctcccaaaagaggcttccttcggagcgccagcttagggaggagagcctcttttcacctggagtgtctgaagcggcagaaggacaggggcggcgatatcagccaaaaaaccgtactgcctctccacctggttcatcaccaggcactggccgttgcgggactgtcaccgctcctgcagcgttcccacagtcctgctagtttcccgagaccttttgcaacacctcctgcaacccctgggtctcggggatggcccccccagccggtgcccacgcttaggttagagggcgtggagagttctgagaagttgaatagctctttcccatctatacactgcggctcctgggccgagactacaccaggaggagggggatctagtgccgctcgtagagtacgacctgtgtctctgatggttccttcccaggcaggggcccccggtcggcagttccacggctcagcctccagtctggtcgaggccgtactaattagcgaaggactggggcaattcgcacaggatcccaaatttattgaggttacaacacaggagctcgcagatgcttgtgacatgaccatcgaggaaatggaatctgctgccgataatattctatcaggcggagccccacagagcccaaacggggcactactaccattcgtaaactgccgagacgcaggacaagaccgggctggcggggaggaagacgcaggttgtgtgcgggcgaggggccggccttccgaggaggagttacaggactctagggtctatgtgagcagtttgtag

SEQ ID NO: 181215 - DNA, 6417 bp, Artificial Sequence
  Description of Artificial Sequence: Synthetic coding sequence
atggtgaacgagaacacccggatgtacatccccgaggagaaccaccagggatccaactacggtagcccgcgcccagctcatgccaatatgaatgcgaatgctgctgccggcttggcccctgagcacattccgaccccaggcgcggccttatcctggcaggcagcgatcgatgccgcccgtcaggctaaactcatggggagcgccggaaatgcaactatttctactgtgagctctactcagcgcaaacgtcagcagtacggaaaacctaaaaaacagggcagcacaacagctacccgacccccccgtgcgttgctctgtttgaccttgaagaaccccataagacgcgcgtgtatcagcattgtggagtggaagccgtttgaaattataattcttctcaccatcttcgcaaactgcgtggctctcgctatttacattccattcccagaagatgacagcaacgccactaatagcaacctggagcgtgtggagtacctatttcttattatcttcactgtcgaggctttcctcaaagtgatcgcttacggattactcttccatcctaatgcctatctgcggaacggctggaacctgctcgactttattatcgtcgtggtggggctcttcagtgctattctcgaacaagccacaaaagccgacggggctaacgcccttgggggcaagggggccggctttgatgtaaaggctctccgcgccttccgagtgcttcgtcccttgcggctggtgtcaggcgtcccaagtctgcaggttgtgctcaacagtatcattaaggcaatggtacccctgctgcacatagccctgctggtgctattcgtgattatcatctacgcaattataggactggaactgtttatgggcaaaatgcataagacatgttataaccaggagggcattgcagatgtgcctgcggaggacgacccctccccttgtgccctggaaaccggacacggccggcagtgtcagaatggcactgtgtgcaaacccggatgggatggcccaaagcacggcattactaacttcgataactttgcctttgccatgttgacagtgtttcaatgcatcactatggagggatggaccgatgtgctctactgggtaaacgacgccgtgggccgggactggccatggatatactttgtaacactcattattataggaagctttttcgtactcaatctcgtgcttggggtcctaagcggagagttctcgaaggagagggagaaggctaaggcgcggggtgactttcagaagctgcgtgaaaagcagcaactggaagaagacttgaagggatacctggattggatcacccaggctgaagatatagacccggagaacgaggatgaggggatggatgaagagaaaccccgcaacatgtcaatgccaacctcagagacagaaagcgtcaacacggagaacgtcgccggtggtgacattgagggtgagaattgtggtgcgcgccttgcccacaggatttcaaaatctaaattttctaggtactggcgccgctggaatcgtttttgccgcaggaagtgccgagcagctgttaaatccaacgttttctactggttagtgatcttcctcgtgttccttaatacactgacgattgctagtgagcattacaaccagccaaattggctgactgaagtacaggacaccgctaataaagctctcctggctctattcaccgctgagatgctcctcaagatgtatagcctgggcctgcaagcctattttgtttccctgttcaaccggtttgattgcttcgtggtctgtggaggaatcttggagaccatactggtagaaacgaaaatcatgtctcccctgggaatttctgtgttgcggtgcgtgcggctgctcaggatttttaagataacaaggtactggaatagcctgagcaacttggtggcatcattgctcaactcagttcgaagtattgccagcctgctgttacttctgttcctttttattataatattcagcctgttggggatgcaactgttcggtggaaagttcaatttcgatgagatgcaaacacggcggtcaaccttcgataatttcccccagagtctccttactgtgtttcagattctcacaggagaggattggaactccgtgatgtacgacggtatcatggcctacggcggtccctcctttccggggatgctagtgtgcatttacttcattatcttattcatatgtggcaattatatccttctgaatgtctttctcgcaatagccgtggacaacctggccgatgccgagtctctgacaagcgcacagaaggaagaagaggaggaaaaagagaggaaaaagcttgcaaggacagcatctcctgagaaaaagcaagagctggtcgaaaaaccggctgtcggcgagagcaaagaagagaagatcgaactgaagtccattacagccgacggggagagcccgccagcaaccaaaatcaacatggacgatctgcagcccaatgagaatgaagataaatccccgtatccaaaccccgagactactggcgaggaggatgaagaggaaccggaaatgcctgtgggccctcggcctcggcccctatcagaactccaccttaaggaaaaggccgtgccaatgccagaagcctctgccttcttcatattcagttccaataatcgatttaggcttcagtgccatcggatagtgaacgatactatcttcaccaatctcatcctctttttcatcctgctgtcaagcatttccctggccgccgaagatcccgttcagcacacttcgtttcgcaaccacattctgttttattttgacatcgtgttcacaacaatcttcacaattgagatagccctaaaaatgactgcttacggcgcctttcttcacaagggcagtttctgtcggaactattttaatattctggaccttctggtggtgtctgtttcactgatcagtttcgggatccagagctcagccataaacgtggtgaagatcctgcgagttctcagagtgctgaggccgctgcgcgccatcaaccgggctaaaggcctcaagcacgtcgtgcaatgcgttttcgtagctatcaggactatcggaaacatagttatcgtgactacattactccaattcatgttcgcgtgcattggtgtgcagctgtttaaggggaagctttatacctgtagcgacagtagcaagcaaaccgaagctgaatgcaaagggaactacatcacgtacaaagatggagaagtggaccaccccatcatacagcctagatcctgggagaattccaagtttgatttcgacaacgtgctggccgccatgatggccctcttcacggtgagtacttttgaaggatggcccgagcttctctacagaagtatcgactcccacactgaggataagggtcccatttataactacagagtggagatttcgatatttttcatcatttacattatcatcatcgccttcttcatgatgaacatattcgtgggcttcgttatcgtcacattccaggaacagggagaacaagaatacaaaaattgcgaactggacaagaaccagaggcagtgtgtggagtacgcattgaaagctcgcccgctgcggcgatacatacctaaaaatcagcaccagtacaaggtttggtatgtcgtaaattctacgtacttcgaataccttatgtttgtgcttatcctcctgaataccatttgtctagcaatgcaacactacgggcagtcatgcctgttcaagatagccatgaatatcctgaacatgctctttacaggcctgtttacggtggaaatgatcctgaagctgatcgcctttaaaccaaagggctatttcagtgacccgtggaatgttttcgactttctgatcgtcattggcagcataatcgacgtgatccttagtgaaacaaatcctgcagagcacacacaatgcagcccttccatgaacgccgaggaaaatagtcgtatttcaatcaccttcttcagactctttagggtcatgaggcttgtcaagctacttagcaggggcgagggcattaggacgttgctctggacctttatcaaatcctttcaggccctcccatatgtagcactgctcatagttatgctgttcttcatctacgcggtcatcggtatgcaggtgttcggaaagatcgcactcaatgatacaactgagataaaccggaataacaattttcagacatttccccaggccgtgctgctcctgttcagatgtgcaaccggggaagcctggcaggatataatgctcgcatgtatgcccggtaagaaatgtgctcccgagagtgagccctccaattccaccgaaggcgagaccccttgcggcagcagttttgcagtgttttatttcatctccttttacatgttatgcgctttcttaataattaatttatttgtggccgtgatcatggataactttgattatctcacacgggattggtccattcttggcccacaccatctggacgaattcaagagaatttgggccgagtacgatcccgaagccaagggaaggatcaagcacctggacgttgtgacactcttgcgcaggatacagccacccctggggttcggcaaactgtgtccccaccgtgtggcctgcaagaggctggtcagtatgaatatgcctttaaactccgatgggaccgtgatgtttaatgcaaccttgtttgcactggtgcgcactgcactgcgcatcaagacagaggggaatttagagcaggccaatgaagaactccgcgcaattatcaagaaaatttggaagaggacgtccatgaaactattggatcaagtcgtcccgcctgctggcgatgatgaagtcaccgtggggaaattttatgctaccttcctgatccaggagtactttaggaagttcaagaagcgcaaggagcagggacttgtcgggaaaccctctcagaggaatgccttgagcctccaggccggcctccgcacattgcacgatatcggcccagagatcagacgggctatctccggggacctgactgcagaggaagagctggacaaagctatgaaggaggctgtgtcggctgcctctgaagatgacatatttcgccgggccggcggactgtttggaaaccatgtcagctactatcagtctgatggccggtctgcctttccccaaacatttactacacagagaccgctccacatcaataaggctggttccagccagggagataccgagagccccagccacgagaagctggtggattccacatttacgccatcctcctatagcagtacgggatctaatgctaatataaataatgccaacaatacagcactgggtcgactgccaaggccggctggttacccatcaactgtctccaccgtcgagggccatggccctcctttaagtccagcaattcgggtgcaagaggtggcttggaaactttcaagcaatcgatgccattctagagaatctcaggccgccatggccggtcaggaggagaccagtcaggatgagacctacgaggtgaagatgaaccacgacaccgaggcatgctcggaacctagccttctaagcacagagatgctcagctatcaggacgatgagaatcgtcagcttacacttcccgaggaggataagcgggatatccggcagtcccccaagcgtggatttctgagatccgcttctttaggtagacgcgcgtcgttccatttggagtgcttaaaacgacagaaggaccgggggggagatatcagccagaagactgtcctgcctttgcacctagtccaccatcaggccctggctgtcgcggggctctctccccttttgcagcgatctcacagtcccgccagcttccccaggcccttcgcaaccccacccgccaccccaggaagcagagggtggccacctcagccagtgccaactctgcgtttggagggagttgagtctagtgagaaactaaattcttcattcccctcaatccactgcgggtcctgggcagagaccactcccggcggcggtgggtcctcagcagcaaggcgggtcagaccagtctcgcttatggtccccagtcaagccggtgccccgggtcggcaatttcacgggagtgcgtcatcactcgttgaggcagtgctgatcagcgaaggattaggccagttcgctcaggatcctaaatttatagaagtaacaacccaggagctggccgatgcttgcgacatgacaatcgaggaaatggagtcagctgccgacaatatattgagcggcggcgccccgcagtctcccaacggagcactgttgccgttcgtgaactgcagggatgcaggccaggacagggccggcggagaagaagatgctggctgtgtaagagcgcgcgggcgtcctagcgaagaggaactgcaggattctagggtgtacgtgagttctctgtag

SEQ ID NO: 181216 - DNA, 6417 bp, Artificial Sequence
  Description of Artificial Sequence: Synthetic coding sequence
atggtgaacgagaacacccggatgtacatccccgaggagaaccaccagggtagcaactatgggagcccgagaccggcacatgcaaacatgaacgctaatgccgctgcaggccttgcgcctgagcatattcccacacccggtgctgcactcagctggcaggccgccattgatgcagcacgccaagctaagctgatgggttccgccggcaacgcaacgatttcgaccgtgtctagcacccaaagaaagcggcaacagtatgggaaacccaaaaaacaagggagcacaacggcaacgcggcccccccgcgccttgctgtgtttgactctgaaaaatcccatcagacgggcctgcatcagcatagtagaatggaaaccattcgagatcattattcttttgacaatctttgccaactgcgtggcattggccatttatattccatttcccgaagatgacagtaacgccactaacagcaacctcgaaagagtagagtacctgtttctgatcatttttaccgtggaggcctttttaaaagtaattgcttatggcttgctcttccacccgaacgcttatctgcgaaacggatggaatctgctggactttattattgttgtggttgggctgttttccgctattctcgagcaggcaactaaagctgatggggcaaatgctcttgggggcaaaggagctggctttgacgtgaaagcgctccgcgcatttcgcgttctccgccccttgcgcctggtctccggagtgccatcgctgcaggtcgttctcaattctattatcaaagctatggtgcccctgctccacattgcattactggtcctattcgttatcattatatacgcaataataggcttagagctattcatgggaaaaatgcataagacttgttacaatcaggaaggaattgcagacgtgccagctgaagacgacccctccccctgtgcactggagacaggccatggcaggcagtgccaaaacggcacagtgtgcaaaccagggtgggacggccctaagcatggaattacgaactttgacaacttcgcctttgccatgctgacagttttccaatgcatcaccatggagggctggacggacgtactgtactgggttaatgatgcggtgggacgagactggccttggatctacttcgtcacccttatcatcatcggatcgttctttgtactcaatttagtgctgggagtgctctccggcgagttttcaaaagagcgggagaaagcaaaagcccgcggcgactttcaaaagcttcgcgaaaaacagcagctcgaagaagatctgaaggggtatttggactggatcactcaggcagaggatatcgatcctgagaatgaagacgaggggatggacgaagagaagccccgcaacatgagcatgcccaccagcgagacagaaagtgtcaacaccgaaaatgttgccggcggcgacatcgagggagagaactgcggggctagattagcccatcgaatctccaagtccaaattctcgaggtactggcggcgttggaaccgtttctgtagacgaaaatgtcgcgcagcagttaaaagtaatgttttttactggctcgtcattttcttagttttcttgaataccctgaccatcgccagcgagcattataatcagcccaactggctgactgaagtacaggacaccgccaataaggcgctactggcccttttcacagccgaaatgcttctgaagatgtacagcctaggccttcaggcgtacttcgtatccctgttcaatcggtttgactgtttcgttgtatgtggcggcatcctggaaaccatcctggtcgaaacgaaaatcatgagccctctcggtataagcgtgcttcgctgtgtcagattgctgcgcatttttaaaatcacaaggtattggaactcattgtctaatctggtggctagcctgcttaactccgttcgatccatagccagtctccttttgctattattcctgttcattatcatattcagtcttctgggcatgcagctatttgggggtaagttcaactttgacgagatgcagactcggagatctacctttgataacttcccacagtctctgctgacagtctttcaaattctgacaggggaggactggaactctgtgatgtacgatggtatcatggcatacggggggccaagtttccctggtatgctcgtgtgcatctattttatcatactctttatttgcggaaactacatcttgctgaacgttttcctggccatagccgtcgacaacttagccgatgcagaatccctcacctccgcccagaaggaagaagaagaagagaaggagaggaaaaagctcgctagaacggctagtccggaaaaaaagcaggagctggtggagaaacctgccgtaggtgaatcaaaggaggaaaaaatagaactgaagtctataaccgccgatggggaatcgccccccgcaaccaaaatcaacatggacgatctgcagccgaatgaaaacgaggacaagagcccatatccaaatccggaaactactggcgaagaggacgaagaagaaccagagatgccggtcgggccccgtccaagacccttgagcgagctgcatctcaaggagaaggcggtgcctatgccagaagcgagcgctttcttcatctttagctcaaataacaggttcagactgcagtgccacaggatagtgaatgacacaatctttaccaatctgatcctgttcttcatactgttgagcagcatatcactcgccgcagaggatcctgtccagcacacttcgtttaggaatcacatactgggtaacgctgattacgtatttacctccatatttaccctggagatcatccttaaaatgacagcttatggtgcgttcttgcacaagggcagcttctgtaggaactactttaacattctagatcttctagtagtctccgtgagcctcatctcctttggaatacaaagctcagccatcaacgtagtgaagatactccgggtgctcagggttttgcgcccactccgagccataaaccgcgccaaaggcctgaagcacgttgttcaatgcgttttcgtggcaatccgcacaattgggaatatcgtgattgtcacaactctgctgcagttcatgtttgcctgcattggtgtgcaactgttcaagggaaaactctatacatgctcagattcatctaagcagaccgaggctgagtgcaagggcaattacattacgtataaagacggtgaagtggatcacccaataattcagccccgatcatgggaaaatagtaagtttgattttgacaatgttctggccgcgatgatggctctgtttacggtgagtactttcgaaggatggcccgaactgctgtaccgcagcattgatagccataccgaggataaaggccccatttacaactaccgggttgagatctccatctttttcataatatacatcatcataattgccttctttatgatgaacatcttcgtgggctttgtgatcgttaccttccaggaacagggggaacaggagtacaagaactgcgagctcgacaaaaaccagcggcaatgcgtggagtatgctctcaaggcccggcccctacgcagatatatcccaaagaatcagcaccagtataaagtttggtacgtggtgaactcaacttactttgagtatcttatgtttgtactgatcttgctgaacactatttgcctcgccatgcaacactacggacagagttgcctcttcaaaattgccatgaatattctgaacatgttgtttacaggcctgttcaccgtggagatgattctgaagttgattgcttttaagcctaaacactacttttgcgatgcttggaatacctttgacgcccttattgtcgtaggcagtattgtcgacattgcgattacagaggtgaacccagccgagcacacccaatgctctccgagtatgaacgccgaagaaaactcacgcatcagcattacattcttcaggctgtttcgagttatgaggctagtgaaactacttagccgtggggaggggatccgaaccctgctgtggacatttattaaaagtttccaagcccttccatacgtggctttgcttattgtcatgctgttctttatttacgcagtcattggtatgcaggtgttcggtaaaattgcacttaacgacacaacagagattaacaggaataacaattttcagactttcccacaggctgtgctgctgctctttcgctgcgccaccggcgaagcctggcaagacatcatgttggcgtgtatgcccggcaagaaatgcgccccagagtccgaacctagtaacagcaccgagggcgaaaccccttgtggcagctcattcgcagtcttctactttatttctttctacatgctttgcgccttcctgatcataaacctgtttgtggctgtcattatggataactttgactacctcaccagagattggtcaattctcggaccccatcatctggatgagtttaaaagaatttgggctgaatacgatcccgaggccaaagggagaataaagcatctcgacgtagtcaccctgcttaggcggatccagccccccctgggcttcgggaaactgtgcccgcaccgcgtagcctgcaaaaggctcgtgtctatgaatatgccgttgaacagcgacgggacagtcatgtttaatgctaccctgtttgcactagtccggactgcactccgtattaagacagaaggcaacctagaacaggccaatgaagagctgcgcgctattataaagaaaatctggaagcgcacatcaatgaagttattggaccaggtcgttccccctgctggcgacgacgaagttacagtcggtaagttctatgccacttttctgatccaagaatactttagaaagtttaagaagcgcaaggagcaagggctggtgggcaagccatcgcagaggaatgccctgtcactccaggctggactcaggaccttacacgacattgggccagaaatcaggcgagcaatttctggcgatctaacagccgaagaagagttggacaaggcgatgaaagaggccgtttccgccgcttcagaggacgatatcttcagaagagccggggggcttttcggaaatcacgtttcatattaccagtctgacggaagatctgcctttccccaaacattcacaacacagagacctctccatataaacaaagcagggtcatctcagggcgacacagaatctccatctcacgaaaaactcgtggatagcacatttacccctagttcctatagtagtacgggcagtaacgccaacatcaacaacgcgaataatacagctctcggtcgcctcccccgacctgctgggtaccctagcacggtctctaccgtggaaggccacgggcctcctctgtcaccagcaatccgggtgcaagaagttgcatggaagctctcctccaatagatgccactctagagagagccaggccgctatggcagggcaggaagagactagtcaggatgagacatacgaagtaaagatgaaccatgacacagaagcctgctccgagccctctcttctttctacagagatgttgtcatatcaagatgacgagaaccgccagctcactcttccagaagaggacaagagagatattcgacagtctccaaagagggggtttctccgcagtgcaagcctaggccggagggcaagtttccacctcgaatgcctgaagaggcagaaagatcggggtggagacatttcacaaaaaactgtgttgcctttgcatctggtgcaccaccaagcgctcgcagtcgcaggcctctcaccactcctgcagaggtctcacagtcccgcaagtttcccaaggccgttcgctaccccacccgctactcccgggagcaggggttggccccctcaacctgtgccaaccctccgccttgagggagtagagtcctcggagaagctgaatagtagcttcccaagtatccattgcgggagttgggccgagacaactcccggcggcggaggcagctctgccgccaggagggtccggcccgtttctctgatggtcccttctcaagctggcgctcccggcagacagttccacggtagcgcttcaagcctggtagaagctgtgctcatcagcgaaggactgggccaattcgcccaagaccccaagttcatcgaagttaccacgcaggaactggcagacgcctgcgatatgactattgaggaaatggagagtgccgccgataatattctgtcaggaggagctccacaatctccgaacggagcactacttcctttcgtgaattgtcgggatgccggacaggatcgcgcaggtggcgaggaggacgcaggttgcgtgagggccagaggcagacccagtgaagaggaacttcaggacagccgcgtttacgtctcatccctttag

SEQ ID NO: 181217 - DNA, 6417 bp, Artificial Sequence
  Description of Artificial Sequence: Synthetic coding sequence
atggtgaacgagaacacccggatgtacatccccgaggagaaccaccaggggtctaactatggatcacctaggcccgcgcacgcaaatatgaatgcaaacgcagctgccggtctagcaccagaacatatccccacccccggagcagcactctcttggcaggccgccatagacgccgccagacaggccaaactcatgggctctgcgggaaatgcgactatctccaccgtgtcaagcacacaaaggaaacggcagcagtacggcaagccgaagaaacagggttccacaactgcaacgcggccccctagagctttgctgtgtctaacccttaaaaaccccattcggcgtgcttgcatttccatagtcgagtggaagccattcgagattattatccttctcacaatctttgcgaactgcgtagctttagcgatatacattccctttcccgaggacgattcaaatgccaccaattccaatttagagcgcgttgagtatctttttttgatcatcttcaccgtggaggcctttctgaaggtgatcgcctacggattgctgtttcatccgaacgcctacttaaggaacggttggaatttgctggattttatcattgtcgtcgtcggcctgttttctgcaatactcgagcaggcgacaaaagccgatggggcaaacgccctaggcggcaagggagccggttttgatgttaaagctctgagagccttcagagtgctgagacctctgcgcttggtctcaggtgttccatccctccaagtggtcctgaactccatcatcaaagccatggttccactgctgcatatcgcgctgcttgtgctttttgtgattataatatacgccatcatcggactggagctgttcatgggtaaaatgcataaaacatgctataaccaagaggggatagctgacgttcccgccgaggacgatccaagtccctgcgcactggagacaggtcacggccgacagtgtcagaacggaacagtctgcaagcccggatgggacggccccaaacacggtattaccaatttcgacaattttgcgttcgccatgctcactgtgtttcagtgcataactatggaaggctggactgacgtgctgtattggatgcaggacgctatggggtacgagctgccttgggtgtatttcgtgtctttggttattttcggctccttttttgtattaaatctggtgcttggcgtgctgtcaggggagttctctaaagaacgcgagaaagccaaggctagaggagattttcaaaagttacgtgaaaagcagcagctcgaagaagatttgaagggttacctggattggattacgcaggcagaagacatagacccagagaatgaagatgaaggtatggatgaggagaaaccacgcaacatgtcaatgcccactagtgagactgagtccgtgaatacagaaaatgtagcgggcggcgatatcgagggagaaaattgcggtgccaggcttgctcaccggatcagtaagtctaagttttcacggtattggcgaagatggaatcgcttctgcagaagaaagtgtcgtgctgcggtgaaaagtaacgtgttttactggctagtgatctttctggtattcctgaacaccctgactatcgctagcgagcactacaaccagccaaactggcttactgaggtccaagacacagcaaacaaggctcttttggccttgtttactgctgagatgcttctcaagatgtactccctgggactgcaggcttactttgtatctctctttaaccgatttgattgctttgtcgtttgcggcggcatcctcgagactattcttgtcgagacaaaaattatgagtcccctgggaatttctgtgctgaggtgtgtgcgtctcctacgcattttcaaaatcacaagatattggaatagcctgtctaacctcgtcgccagcttactcaactcagttcgctccatcgcttctttgctgctgctcttgtttcttttcattatcatctttagcctgcttggtatgcaactgtttgggggaaaatttaacttcgacgagatgcagaccagaagatcaactttcgataactttccacagtcattgctgactgtttttcagatcttgacgggcgaagattggaactctgtcatgtatgatggcatcatggcttatggagggccctcatttcctgggatgctggtgtgtatctactttataattctttttatctgcgggaactatatcctcctgaacgtatttttagcaattgcagtggataatttggctgatgcggaaagcttaacatctgcgcaaaaagaagaggaagaagaaaaggagagaaagaaactggctcggacagctagtcctgaaaaaaaacaggagctagtggaaaaacccgcggtcggagagtccaaggaggagaaaatcgagctgaaatccatcaccgctgacggtgaatcacctcccgctacaaaaataaacatggacgacctccagcccaacgagaatgaagataaatcaccgtaccctaaccccgaaacgaccggagaggaagacgaagaagagccagaaatgccggtgggccctagacctagacccctgtctgagctgcacctgaaagagaaggcggtacctatgcccgaggcctccgctttcttcatcttctcttctaacaataggttccggctgcagtgccacaggattgtcaatgataccattttcactaatctcattctattttttatcctcctctcctccatcagcctcgctgccgaggaccctgtgcagcatacttcctttcggaaccatatcctgttttacttcgacatcgtgtttacaacaatattcactatcgagattgccctcaaaatgacagcatacggggctttcctacacaaggggtctttctgccggaattattttaatatccttgatctgcttgttgtgtcggtctctctcatttcttttggaattcagagctcagctattaatgttgttaagatcttgagggttctcagggtgctgagacccttacgggccatcaaccgggccaaagggcttaagcacgtcgtgcagtgtgttttcgtcgcaatccgaactataggcaacatcgtgatagtgacgactctgctgcagttcatgtttgcttgcatcggggtccagctgtttaagggcaagctgtatacgtgctccgactccagcaagcagacagaggctgaatgtaagggcaattatattacatataaggatggcgaagtggaccatcctatcattcagccccgctcatgggaaaattctaagtttgattttgataacgtgttagccgcgatgatggcactgttcacagtgagcacgtttgagggttggcccgaacttctataccggtctatcgacagccataccgaggataaagggccaatctataattatcgggtagagatctccatcttttttatcatctacatcatcatcattgctttctttatgatgaacattttcgttggcttcgtgatcgtgaccttccaggaacagggtgagcaggagtacaagaattgtgagttagacaagaaccaaagacagtgtgtcgaatacgctctgaaggctcggccactgaggaggtacatccccaagaatcagcaccagtataaggtgtggtacgtcgtgaattctacttactttgaatacctgatgtttgttctaatcctactgaacaccatctgtctggcaatgcagcactacggccaatcttgtcttttcaaaatcgctatgaacattctcaacatgctcttcaccggtctgttcactgtagagatgatcctcaaattgatcgcgtttaaaccaaagggctatttttctgacccctggaatgtcttcgattttctgattgtgatcgggtccatcatcgacgtcattttgagtgaaacaaacccagctgaacacacacaatgctctcctagcatgaacgccgaggagaatagccgtatttcaataaccttctttagactatttagggtcatgcggctggtcaagctgctgtcccgaggagaaggcatccgcactctgctgtggacatttataaagtcttttcaagccctgccatatgtcgccctgctgattgtgatgttgttttttatctatgccgtcatcgggatgcaggtcttcgggaaaatcgcattgaatgataccaccgagatcaaccgcaataataattttcagacatttccacaggctgtgctccttctgtttagatgcgctacaggtgaagcttggcaagatattatgctcgcttgtatgccgggcaaaaagtgtgcacctgaatccgaaccttcgaattccaccgaaggggagacaccttgcggctcatcctttgcagtgttctacttcatcagtttctacatgctgtgtgcatttctgatcatcaatctttttgtcgcagttatcatggataatttcgactatctgacacgcgattggtccatcctggggccccaccacctcgacgaattcaaaagaatttgggcggagtacgaccctgaggccaaaggccgcatcaagcacctggacgtggtaactctgctccggcgcatccagcctccactaggtttcggtaagctttgcccgcacagagttgcctgtaaaagattagtgagtatgaatatgcctctcaatagcgatggaaccgttatgtttaacgccaccctgttcgccctggtcaggacagccctgcgcattaagactgagggtaacctggagcaggccaacgaggagttaagagccattataaagaagatatggaaacggacctctatgaagctcttggaccaggtcgtgccacctgccggggacgacgaggtaactgtaggaaagttttacgccacattcctgatccaagagtacttccgcaaattcaagaaaagaaaggaacagggactggtaggcaagccaagccagcgtaatgcactgtctctgcaggccgggttgagaacattgcacgatatagggcccgagattaggagggccatcagcggggatctaactgccgaagaggagttggacaaagccatgaaggaggccgttagtgcagcttcagaggatgacattttcagaagagcaggcgggctatttggaaaccatgtgagctactaccagtccgatggaaggtccgcgtttccacagacctttaccactcagcgacccctgcacataaacaaggctggctctagccagggggataccgagtcccctagtcacgaaaaattggtggactctacttttaccccatcaagttacagcagtaccggttcgaacgctaatattaataacgccaacaacaccgcattgggccgactacccaggcctgcgggctatccgtctaccgtcagcacagtggaaggacatggtccccctctgtccccagcaatcagggtccaggaagttgcctggaaacttagcagcaaccgttgtcactctcgtgagtctcaggcagctatggccggacaggaggaaacttcacaggacgaaacctacgaggtgaaaatgaatcacgatacagaggcctgtagcgagcccagtctcctgagcacagagatgctcagttaccaggacgatgagaatcgacaactgaccctgcccgaagaggataagcgcgatatcagacagtcacccaaacggggcttccttagatctgctagcctgggtcgtcgagcctcattccacctggagtgtctaaagcggcagaaggatagaggaggagatatctcacagaagacagtcttgcctctgcatcttgtgcatcaccaggcactcgcggtagccgggctcagtccactgcttcagaggtcccattccccagctagtttccctcgccccttcgccacacctcctgccacccccggaagccgcggctggccacctcaacctgtgccaaccctgagactggagggcgtcgaaagttctgagaagcttaatagctcattccctagcattcactgtggctcgtgggcagagaccacccccggtggaggcgggagcagtgctgcacgccgtgtgcgaccagttagcttgatggtgccctcgcaggccggcgccccaggacgacagtttcatggttccgcgtcaagcctcgtggaggccgtcttgatatctgaaggcttgggacaatttgcacaggatcctaaattcatagaggtgactacccaagagctggcagacgcttgcgacatgacaatcgaggagatggaaagcgccgcagacaacatcctcagcgggggagccccccagtccccaaacggagccctcttgccctttgtgaactgtcgggatgccggacaggatagggctggtggtgaggaggacgctggttgtgttagagccaggggtcgaccctccgaggaggagctgcaggacagtcgggtatacgtgtccagcctgtag

SEQ ID NO: 181218 - DNA, 6477 bp, Artificial Sequence
  Description of Artificial Sequence: Synthetic coding sequence
atggtgaacgagaacacccggatgtacatccccgaggagaaccaccaggggtccaattatggctcgccacggcccgctcacgcaaatatgaatgctaacgctgcggccggtttggctccggagcacattcccactcctggggccgcactgtcctggcaggctgccatcgatgctgcccggcaagccaaactaatgggttcagcaggaaatgcaaccatcagcacagtgagttccacacagcgaaaacgccagcagtatggaaagcctaagaaacagggcagtacaacggctacccgaccccctagagcactgctgtgcctgaccctgaagaaccctattcggagggcatgcattagcatcgtagaatggaagcccttcgaaataatcatcctcctaaccatatttgctaactgcgtcgcacttgccatttatataccctttccagaagatgatagtaacgctaccaacagcaatcttgagcgcgtcgaatacctgttcctcataatttttacggtcgaggcctttcttaaggtcattgcctatggcctgttatttcatccaaacgcgtatctgcgtaatggatggaatctcctagactttatcattgtagtggtcggcctattttccgccatactggagcaagccactaaggcggacggcgctaatgctcttggcggaaagggagccggattcgacgtgaaggccttgcgggcatttagagtgctcaggcctctgcgtctagtcagcggcgttccttcccttcaagtggtgctcaattctatcattaaggccatggtgcctctgctgcatattgctctgctggtattgttcgtaatcatcatttatgcaattatcggcctggagctctttatgggcaagatgcataagacgtgttataaccaggaaggtatcgcagacgtacccgccgaggacgacccctccccctgcgccctggagactggtcacgggcgccagtgtcagaatggaactgtttgtaaacctggttgggacggccctaagcacgggattacgaacttcgataattttgcattcgctatgctgacagtcttccagtgtattaccatggagggatggactgacgtgctgtactgggtcaatgacgccgtgggtagagattggccctggatctacttcgtcactctaatcattataggttctttctttgtcctcaaccttgttctgggcgtgttatcaggcgagttctctaaagagagagagaaagcgaaggctaggggcgacttccagaagctgcgtgagaagcaacagcttgaggaagacctgaaagggtacctcgattggatcacccaggcagaagatattgaccccgagaacgaagatgagggtatggatgaggagaagcccagaaacatgtcaatgccaactagcgaaaccgaaagtgtgaatactgaaaacgtggccggtggggatatagaaggagaaaactgcggcgcgagactggcacacaggatttctaagtctaaattttcacgctactggcgaaggtggaaccgcttttgcaggaggaaatgccgtgcagccgtgaaatcaaacgtcttttattggctcgtaatctttcttgtattccttaacacgttaactatcgctagcgagcattataaccagccaaactggctcaccgaggtgcaggacacggccaataaggcccttctggccctgtttaccgccgagatgttactgaagatgtactctctgggtctgcaagcgtatttcgtcagcctcttcaaccggtttgattgctttgtggtgtgcgggggtatcctcgaaaccatcctggtcgagactaagataatgagccctctcgggattagcgtgctgagatgcgtgagattgcttcgaatttttaagatcacccgatactggaatagcttgtcaaatctcgttgctagcctgttgaactcggtccgcagcatagccagcttacttcttctgctctttttattcatcataatattttccctgttgggcatgcagttgttcggcggcaagtttaacttcgacgagatgcagaccagacggtctacattcgataactttcctcagtccctcttgaccgtctttcagattctgaccggggaggactggaacagcgtgatgtatgacggcataatggcctacggcggtccgtcttttcctggcatgctcgtctgtatttatttcatcatactgtttatctgtggaaattacatcctgctgaacgtcttcctcgccatcgccgtggataatctggctgacgctgagagcctgacatccgcccagaaagaggaagaggaagaaaaagaacgtaaaaaacttgccagaactgcgtctcccgaaaagaagcaggagctggtagagaagccagccgtcggtgagagcaaagaagaaaagattgagttgaagtctatcaccgccgatggggagagccctcccgccactaagattaatatggacgacctccagcctaacgagaatgaggataagtctccatatcccaatccagagaccactggagaggaggatgaggaggaaccagagatgccagtcggcccccgcccaagacccctgagtgagctgcaccttaaagagaaggccgttccgatgcctgaagccagtgcctttttcattttcagtagcaacaatcgcttcagactgcaatgccaccggatagtgaacgacacaattttcaccaacctgatacttttttttatcttattgtcttctatttcactggccgctgaagatcccgtgcaacatacctcttttcgcaatcatatacttttttactttgatatcgttttcacaacaatcttcactatagaaatcgcattgaagatcctggggaatgccgactacgtgtttaccagcattttcactctggagattattctgaaaatgactgcttacggagcttttctgcacaagggctcgttctgtcgaaattatttcaacattcttgatctattagtcgtgagcgtcagtttgatttccttcggcattcagtcttcggccatcaatgtggttaagattctgcgagtgctcagagtgctgagacctctgcgcgcaattaatcgcgccaagggcctcaaacatgtggtgcagtgtgtcttcgtggcaatccggacaatcggcaatatcgtcatcgttaccaccctgctccagttcatgtttgcctgtatcggcgtccagctgtttaaaggaaagctttacacctgtagcgattcctcaaagcaaaccgaagcagagtgtaagggaaattatatcacgtacaaagacggcgaagttgatcatcctatcatccagccgcgatcctgggagaattctaagtttgatttcgacaatgtgctagctgcaatgatggcgcttttcactgttagcacctttgagggctggccggagctcctatatcgaagtattgactcgcacacagaggataagggacctatctataactacagggtggagataagcatttttttcataatatacatcattataatcgccttctttatgatgaacatttttgtgggtttcgtaattgtgacgttccaagaacagggagagcaagagtacaaaaattgcgaactggataaaaaccagcgccagtgcgtggagtacgcgttaaaagcccgcccacttaggcggtatataccaaaaaatcaacaccaatataaagtttggtacgtggtgaattcaacttactttgagtacctgatgtttgtccttatcctgttgaatacaatctgcctcgcgatgcagcattacggacagtcatgcctttttaagatcgctatgaacattttaaatatgttgtttacgggcttgtttacggttgagatgatactgaaactgattgccttcaaacctaagcactatttctgcgacgcatggaatacctttgatgcacttatcgtggtgggctctattgttgatatcgcaataacagaagtgaatcccgctgagcatacccagtgcagcccttccatgaatgctgaggagaattctcggatttccatcacttttttcaggctgttccgcgtgatgaggctcgttaaacttcttagtagaggagagggcattcgcacactgctctggacctttattaaatccttccaagccctgccttacgtagccctgcttatcgtgatgctgtttttcatttatgccgtaattggcatgcaggtcttcggcaagattgccttaaatgataccaccgaaattaaccgtaataacaatttccaaaccttcccacaggctgttcttctcctctttcgatgcgcgaccggagaggcctggcaggacatcatgctggcatgcatgcctgggaagaaatgcgcgcccgagtccgaaccaagtaatagcacggaaggggagactccctgcggcagcagctttgccgtcttctactttatcagcttttacatgctgtgtgcatttcttattatcaacctgttcgtcgccgttatcatggataatttcgactatctgacaagagactggagcattctggggccccatcatctcgatgaattcaaacgtatttgggctgaatacgatcctgaagccaaggggcggataaaacatcttgatgtggtgaccctcctgcgccgcattcagccccctcttggctttggcaaactatgtccccatagggtggcctgcaaacgtctggtgtctatgaacatgccgctgaacagcgacggaaccgtgatgtttaacgctacactgttcgccctggttaggaccgccctgaggatcaaaactgagggaaacctcgaacaggccaatgaggagctgcgggcgattatcaagaagatctggaagcgcaccagtatgaaactgttggaccaggtggtgccaccagctggagatgacgaagtgactgtgggcaaattctatgccacctttcttatccaagaatactttcggaagtttaagaaacgcaaagaacagggcctagtggggaaaccttcccagagaaacgctcttagtctgcaggctgggctcaggactttacacgatataggccctgagatcagaagggctatcagtggcgatctgactgcagaagaggagctcgacaaagctatgaaggaagctgtgagcgccgcctcggaggacgacatttttaggagagctgggggcctgttcggaaatcatgtctcttactaccagtccgatggaaggagtgcttttccacagacgtttaccactcagagaccgctacacatcaataaggctggctctagtcagggcgatactgagtcccccagccacgaaaagctggtcgactcaacattcacgcctagttcctactcctcaaccggttccaacgctaacataaacaatgccaacaataccgccctgggaaggctgccccgcccagctggctacccctctactgtctcaaccgtggaaggtcacggaccccctctgagcccagctattcgagtccaggaagtggcgtggaagctgtcttccaatcggtgtcacagtagggagagccaggcagccatggccggacaagaggaaactagccaggacgagacttatgaggttaaaatgaatcacgacacggaagcgtgttctgagccctccctcttgagtaccgagatgctttcgtatcaagacgatgagaatcggcaattgacgttgccagaagaggacaagagggacattcggcagagccctaagcgcggcttcctccggtctgccagcttgggacggagggcgtcttttcatctcgaatgtttgaagcgacaaaaggaccggggcggtgatatctcccaaaagacggtcctgcctttgcaccttgtccaccaccaggctctcgccgtggcaggcctctcccccctgttacagagaagccatagccccgctagcttccctagacccttcgccacaccacctgcgacgcccggttctcgcggttggcctccccagccggtgccaacattgcgcctggagggtgtagagagttcagaaaaactgaacagttcatttccttccattcattgcggtagctgggctgagacgactcccgggggcggcggcagctctgctgcccggcgcgtgcgccccgtgtcattaatggtgccaagccaggccggtgctcccgggcgccaattccacggtagcgcatctagcctggtggaggccgtcctgatctcagaagggttgggacagttcgcacaggaccccaagtttatcgaagtgacaacacaggagttggctgatgcctgtgacatgacaattgaggagatggagagcgctgccgacaatatcctgtctggtggagccccacagtcccccaatggagcccttctccccttcgtgaattgtagagatgccggacaggatcgcgccggcggtgaggaggacgccggctgtgtgagagctcgcggacgcccttcagaggaagagcttcaggactctagggtctacgtgtcatctctctag

SEQ ID NO: 181219 - DNA, 6522 bp, Artificial Sequence
  Description of Artificial Sequence: Synthetic coding sequence
atggtgaacgagaacacccggatgtacatccccgaggagaaccaccaggggagcaactatggtagtccccgccctgcgcatgcgaacatgaacgctaatgccgccgcaggcctagcccctgaacatataccaactcctggggccgccctcagttggcaggccgcgatagatgccgcaagacaggccaaattgatggggagcgctgggaacgccactatttccaccgtcagtagcacccagaggaaacgacagcagtacggcaaaccgaagaaacaaggatccacaacagcaactaggcccccgagggccctattgtgtcttaccttgaagaaccccatccgtcgagcgtgtatttccattgttgaatggaagccctttgaaatcattattctgttaacaattttcgccaattgtgtggccctcgccatttatatcccctttccagaggacgactccaatgcaaccaactccaatctcgaaagagtcgagtatctgttccttattatctttaccgtcgaggcctttctgaaggtcatcgcctatggtctgctgttccatcctaatgcttacctccgaaatgggtggaacctgctggacttcattatcgtggtcgtcggcctattctccgctatcctcgaacaagctacaaaagccgatggcgccaatgcactaggaggcaagggtgccggttttgatgttaaggccttaagggccttcagggtcctgcgcccgctccggcttgtgagtggcgtgcccagcctccaggttgttctcaattccattattaaggccatggtcccactgcttcacatcgcgctgttggtgctgttcgtcattatcatctatgcaatcatcggcttggaactgttcatgggaaaaatgcataagacctgttataaccaagaagggatcgccgacgtgcccgctgaagatgatccaagtccatgcgccctcgagactgggcatggccgccagtgtcagaacggaacagtctgcaaaccgggctgggacggccccaagcatggaatcactaatttcgacaacttcgcctttgcgatgctgaccgtcttccagtgcattacgatggaggggtggactgacgtgctgtactggatgcaagacgccatgggctatgagctgccttgggtgtactttgtgtcccttgtcatcttcggctctttcttcgttcttaatctggtgctcggggtgttgagcggcgagttttcaaaggaacgggagaaagccaaggctagaggcgacttccagaaacttcgtgaaaagcagcagctggaagaagacctcaagggctatttggactggatcacccaggccgaggacatcgaccccgagaacgaggatgaaggaatggacgaagagaagcccagaaacatgtcaatgccaacaagcgagacagagagtgtgaacacagaaaacgtggccgggggagacatcgagggggagaactgcggtgcgcgcctggcccatagaatcagtaagagcaagttttctcggtactggaggcggtggaacagattctgcagacggaagtgcagagctgccgttaaaagcaatgttttctactggttggttatctttctggtgttcttaaacacacttacaatcgcttcagagcattataaccagccaaactggcttactgaggtgcaggacaccgcgaataaagccctattggcactgttcaccgccgaaatgcttctgaagatgtactctttgggcctgcaggcttattttgtgtcactgttcaaccggtttgactgttttgtggtctgcgggggtatcctggaaaccatcctggttgaaacaaaaattatgtccccactgggtattagcgtcctgcgctgtgttcgcctgctgaggatcttcaaaatcacccgttattggaacagtctctctaacctggttgcctcccttctgaattccgtacgcagcatcgcgagtctgctcttactgctgtttctctttatcatcatcttctcactgttaggaatgcagctcttcggggggaaattcaactttgatgagatgcagacccgacggagtaccttcgataacttcccacagagcctgctgaccgtgtttcagatactgactggcgaagactggaattccgttatgtatgacggaatcatggcctacggcggacccagctttcccgggatgctcgtttgcatatactttattatcctttttatatgcggcaactatattttactgaatgtgttcctggctatcgccgttgataacctggctgatgcagaaagcctgacatccgctcaaaaagaggaggaagaggaaaaggagcgcaagaagctggcccgaactgcgagcccagagaaaaagcaggagctggtcgagaagcctgcagtgggcgaaagcaaggaggaaaagatcgaactgaaatctatcacagctgacggcgagagtccccctgccacaaaaattaatatggacgacctgcagcccaatgagaatgaagataaaagcccgtaccccaaccccgagactaccggagaagaggatgaggaagaacccgaaatgcccgtgggtccccggcctaggcctcttagtgaattgcacttaaaagagaaagcggtgcccatgcccgaagcatccgccttttttatcttctccagtaacaatcgcttcaggctacagtgccatcgcattgttaatgataccatctttacaaacctcattctgttttttatattgctttctagcataagtcttgccgctgaggacccagtccaacacacaagtttccggaatcatattctgttttacttcgacatcgtgttcactactatcttcacaatcgagatagcactgaagatgacggcctatggggctttcctgcataagggcagcttctgtagaaactattttaatattctggacttattggtcgtctccgtgtctctgatctcctttggtattcaatcaagcgccataaacgtggtgaagatactgcgcgtgctccgggtccttagacctcttcgagcaattaacagagccaagggcttgaaacacgtggtccagtgcgtgtttgtggcaattaggaccattgggaatattgtgatagttaccactctattgcaatttatgtttgcctgcataggcgtccagctctttaagggcaagttgtacacctgttctgacagctcgaagcagaccgaggccgagtgtaaaggtaattacatcacatataaggatggagaggtcgaccacccaatcattcagccgcgcagctgggagaactcaaaattcgactttgataatgtgctggcggccatgatggcactattcaccgtctccacattcgaggggtggccagagcttttgtacagatccattgatagccacaccgaggataaaggcccgatctacaattacagagtcgagatctctatatttttcattatctacattatcatcatcgcatttttcatgatgaatatcttcgttggctttgtgatcgtgacatttcaggaacagggagagcaggagtataagaattgcgagctggataagaaccaacgtcaatgcgtagaatacgctttaaaagcccgccctttaaggcgctacatccctaaaaatcagcaccagtacaaggtgtggtacgttgtgaactcaacatattttgaatatttgatgtttgtgctcatcctgttaaatacaatctgcctcgctatgcagcattatggccagtcttgcctgtttaagattgccatgaatattctaaatatgctttttactggactgttcactgtggagatgatcttgaagctaattgcattcaagcctaagggatatttctccgacccatggaacgtgttcgacttcttgatagttatcggtagcattatagatgtgatcctgagtgagaccaatccagcggagcatacccagtgttccccgtcgatgaacgccgaggagaattccagaatctctattactttttttcgactgtttagggtcatgagactggtcaaactgctcagtcgtggggagggcatccgaaccctgctgtggacctttatcaaaagttttcaagccctcccttacgtggcattgttgatcgtgatgctcttttttatttacgccgtgataggcatgcaggtcttcggcaagatcgccctgaatgacacgacagagattaatagaaacaataacttccagacctttccacaggcggtgttgctccttttccgatgcgctaccggggaagcctggcaggatatcatgctcgcttgcatgcctgggaagaagtgtgcgcccgagtcagaaccttctaacagcaccgagggtgaaacgccctgtgggagcagtttcgcggtgttttactttatcagtttctatatgctttgcgcattcctgatcatcaacttgtttgttgctgttatcatggacaattttgactatctgacccgcgactggtctatcctgggaccccaccatctcgacgagtttaaacgtatttgggccgagtacgatcccgaagctaaaggccgaatcaagcatctcgacgtcgtgacgctgctgcggcgcattcagccccctctcggcttcggcaagttgtgtccacatcgagtagcctgcaaacgtctggtctctatgaacatgccccttaacagcgatggcactgtcatgttcaatgccacattgttcgctctggtccgcaccgctctgcgaataaagaccgaaggaaatttagagcaggctaatgaggagctcagagcgatcattaagaagatctggaagcgaaccagtatgaagctgctggaccaagtcgtgccaccggccggagatgatgaggtgacagtcggaaagttctacgcaacatttctcatacaggagtatttccgaaaattcaaaaaaagaaaagagcaggggctcgtcggaaagcctagccagcgcaatgccctgagcctccaggctggcctgcgaacgctgcacgacattggccccgagataagacgtgcaatctctggagatctgacggccgaggaggaattagacaaagctatgaaggaggcggtttcagcagcgagtgaagacgacatcttccgtcgggccggcggcctattcggcaatcatgtgtcttactaccagagcgatggccgatcagcattcccacagacattcaccactcagagacctctgcacattaataaggctggatcttcccaaggagataccgaaagtcccagccacgagaagttagttgactcaactttcactcctagttcatattccagcactggatcaaacgcaaacataaataatgccaacaatacagccttgggccgcctcccgaggcccgcgggataccccagtacagtttcaacagttgagggtcacgggcctcctttgtctcccgccatccgcgtccaggaagttgcctggaagcttagttctaatagggagagacacgtccctatgtgtgaagatttggagctgcgtcgggattctggcagcgcagggacccaagcacattgtttgctgctacgcaaggcaaaccccagtcggtgccattccagagagtcccaagccgcaatggcaggacaagaagagacttcacaggacgaaacctacgaggttaaaatgaatcatgataccgaggcctgcagtgaaccttcgctgctgtccaccgagatgcttagttaccaggacgacgaaaaccggcagcttacattgccggaggaagataagcgagacatccggcagtcccctaaacgaggatttttgagatctgcctccctgggccgccgtgcgtctttccacctagaatgcttaaaacgacagaaagatcgaggcggcgatatatcacagaaaaccgtgctgccactacatctcgtgcaccaccaggctctggccgttgcgggacttagccccctgctccagaggagccactcaccagcctctttccccaggccctttgctacgccccccgcaactccgggctctcgcggctggcccccgcaacccgtaccgactctgagattggagggggtggagtctagcgaaaaattgaactcttcatttcctagcatccactgcgggtcttgggctgagactactccaggagggggcggcagcagtgccgcgaggagagttcggcctgtgtccctgatggtaccctcccaagccggcgctcccggtcggcaattccacggatcagcttctagcctggtagaagccgttttaatctccgagggcctgggacagttcgcccaggaccctaagttcatagaagtgaccactcaggaattagccgacgcgtgtgatatgaccatcgaggagatggagagtgcggccgacaatatactatcaggcggtgctccgcagagtcccaatggcgcactactcccttttgtgaactgtagggacgcagggcaggatagagctgggggggaggaggacgcgggatgcgtgcgggccaggggtagaccatccgaggaggagctacaggactctagggtctacgtaagcagcctctag

SEQ ID NO: 181220 - DNA, 6474 bp, Artificial Sequence
  Description of Artificial Sequence: Synthetic coding sequence
atggtgaacgagaacacccggatgtacatccccgaggagaaccaccagggcagcaactacgggtcccctagacccgcccacgcaaatatgaatgcgaacgcagcggccgggttggcccccgagcacatacctacccctggcgcggcactgagctggcaagctgccattgatgccgcccgtcaggctaaactgatggggtctgcaggaaatgccactatttcaacggtatcctccacgcagagaaagcgacaacaatatggcaagccaaagaagcaagggtcgactactgccaccaggcccccacgggctctcttgtgcctcacactgaaaaaccctattcgtagagcctgcattagcattgtcgagtggaaaccttttgagatcattattctcctgacaatcttcgccaattgtgtcgccctggctatttacatcccatttcctgaagacgattctaacgcgacaaatagcaacctcgagcgcgtggaatatttgtttctcattatctttaccgtcgaggcctttcttaaagtaattgcatacgggctgcttttccatcccaacgcctatttacgcaatggatggaaccttttggacttcattatcgttgtggtcggcctcttttccgcaatactcgagcaggcaaccaaagcagacggagccaacgcactgggcggcaagggggccgggtttgatgtcaaggcactgagagcctttagggtgctccggccgctgagacttgtcagcggggtaccctcgctccaggtggtgctcaatagcattatcaaggcgatggttccgctgctgcacatcgccctgctggtactgttcgtaattataatttacgccatcataggcctcgaactttttatgggcaaaatgcataaaacctgttacaaccaggagggaatcgcagatgtgcctgccgaggacgacccctcaccgtgtgcactggaaactggccatgggaggcagtgtcagaatgggacagtgtgtaaacctggctgggatggtccgaagcacggaataaccaatttcgacaactttgccttcgcaatgttgaccgtctttcaatgcattacaatggagggctggactgacgttctctactgggtcaacgatgccgtgggccgagactggccctggatctactttgttacgctgattatcataggctccttctttgtgctgaatctagttttaggcgtgcttagcggcgagtttagcaaagagagagagaaagcaaaggccaggggagactttcagaagctgcgggaaaagcagcagctagaagaagacctgaaaggctatctggactggatcacccaggccgaagacattgacccagaaaatgaggatgagggaatggatgaggagaaacctaggaacatgtcaatgcctacctcggagactgaatcagtcaatacggagaatgttgcagggggcgacattgagggggaaaactgcggcgcaaggctggctcacagaatctccaagagcaaattcagtcggtactggaggagatggaaccgattctgtcggcgaaagtgccgtgccgctgtgaagagtaatgtgttttattggctggtcattttcctggtgtttttgaataccctgacaattgcaagcgaacactacaatcagccaaactggctgaccgaagtccaggacacagccaataaggcactgttggctctgttcaccgcagagatgctgttaaagatgtactctctgggcttgcaagcttacttcgtgtcactgttcaaccgattcgattgtttcgtcgtgtgtggaggcatactggagaccattcttgtcgagactaaaatcatgtcccccttggggatcagcgtacttcgctgtgtccggctgttgcggattttcaagattaccagatattggaatagcttaagtaatctcgtggcgagcctccttaatagcgtccgcagcatcgcaagtcttctcctcctgctgtttctgttcataatcatcttttctctcctgggaatgcaacttttcggaggtaaattcaatttcgacgaaatgcagacccggaggtctacattcgataacttcccacaatctctgttgactgtctttcagatactgaccggcgaggattggaactcggtgatgtatgatgggattatggcttatggaggcccttccttccctggcatgctggtgtgtatctatttcatcattctgtttatctgcggaaactacattctgctgaacgtgttcctcgccatcgcggtcgacaacttggcggatgcagagtcacttaccagcgcccagaaggaagaggaggaagaaaaagagcggaaaaagctcgcccggaccgcaagtcccgagaaaaaacaagagctcgtcgagaaaccagcagtgggtgagtctaaggaggagaaaatcgaattaaaaagcataaccgccgatggagagtcacccccagccaccaagataaatatggacgatcttcagccaaatgagaatgaggacaaatccccctatcccaatcccgagaccaccggagaggaggacgaagaggaacccgagatgccggttggcccaagacctaggccattgtcggagctgcacctaaaggagaaggctgtgcctatgccagaggcttctgccttttttatatttagtagcaacaatcgcttcaggttgcagtgtcaccgcattgtaaacgacaccatatttactaatcttatcctgttcttcattctgctgagttctatctctttggctgcagaggatccagtgcagcacacctctttccggaatcacattctcttttattttgatatcgtgtttacgactatcttcactattgagatcgcattaaagatgacagcctacggagctttcttgcacaagggatccttctgcaggaactactttaatattctagacctattggtcgtgtccgtgagcttaatctcctttggtattcagtcatccgcaatcaacgtcgtcaaaatcctcagagtgttacgggtgttacgccccctgagagccatcaatagagccaagggcctgaagcacgtggtgcaatgcgtctttgtggccattagaactattggtaatattgtcattgtgactactctgttgcagttcatgttcgcatgcattggggtgcagttattcaagggcaaactctacacttgctctgattctagcaagcagacagaagctgaatgtaaaggcaactatattacttataaggatggcgaagtcgatcacccaattattcagcccagatcatgggagaattctaagttcgattttgataacgttctggctgctatgatggccttattcaccgtgtcaacgttcgaaggatggccagagctactataccggagcatcgacagccatactgaggataagggtcccatttacaattaccgcgttgagataagtattttcttcattatttatataatcattatcgccttttttatgatgaacatatttgtcggtttcgtcattgtgaccttccaagagcagggagaacaagagtataagaactgtgagctggacaagaatcaaaggcagtgtgtggagtatgccttgaaagcccgccctctgagacgttatattcccaaaaaccagcatcagtataaggtctggtacgtggtaaattcaacctactttgagtacctgatgttcgttcttatactactcaatacgatatgtctagcaatgcagcactacggtcagagctgcctctttaagatagctatgaacattttgaacatgttgtttactggactgttcacggtggaaatgatcttgaagttaattgctttcaaacccaagcattacttctgcgatgcatggaataccttcgatgcgctgatagtggtgggttcaatcgtggacatcgctatcacggaggtgaatcccgctgagcacacccagtgtagcccttcaatgaatgctgaagagaacagtcgcatttctattactttctttcggctgtttagagtaatgcggcttgttaagttactctcgcgaggcgaagggatccgtactctactatggacgtttattaagtctttccaggcattaccttacgtggccctgttgattgtgatgctgttctttatttacgcggtgattggcatgcaagttttcggcaagattgcacttaatgatactacagagataaaccgaaataacaacttccaaacgttccctcaggccgtgttgttattattcagatgcgctacaggagaggcctggcaggatattatgctggcatgtatgcccggtaaaaagtgcgctccggagtctgaaccaagcaacagcacggagggagaaaccccttgcggcagttcatttgctgtgttctactttatttctttctatatgctgtgtgctttcctcataatcaatttgtttgtggcagtcatcatggataacttcgactatctgaccagagattggtccatcttgggtccccaccatctcgatgagttcaaaagaatctgggcagagtatgaccccgaagctaagggaaggatcaaacacctggacgtggtgacactactaagacggatccagccaccgttgggttttgggaagctgtgcccacatcgcgtagcttgtaaacgtctcgtctcgatgaatatgcctctgaactctgacggtaccgtcatgttcaacgccaccctgtttgccctggtccggaccgccctgcgtatcaaaaccgaggaagggcctagcccctcagaggcccaccaaggggcggaggatccatttcgacccgccggtaacttagagcaggccaacgaggaactcagggccatcattaagaaaatctggaagcgcacatcaatgaagcttttggaccaggtagttccaccagccggcgacgacgaggtcacagtgggcaagttctacgccacatttctgatacaggagtactttcggaaattcaaaaagaggaaagagcaggggctggtggggaaaccgagccagcggaatgcactgtctctacaagctgggcttcgaaccctgcacgatattgggcctgagatccgtagggcaatctctggggatctcactgccgaggaggaactcgacaaagctatgaaagaggccgtgagcgctgccagcgaagacgatatcttcagacgtgccggcggtcttttcggaaatcacgtgtcgtattatcagagtgacggtcgttctgcctttcctcagacctttactacccagaggccactgcatatcaacaaggccggtagctcacaaggcgacacagagagcccttctcatgagaagcttgttgactccaccttcacaccgtcttcatacagttccaccggatccaatgcgaacataaataatgcaaataatacggccctgggcaggctgcccagacccgcaggctatccttctacagtgtccaccgtggagggtcacgggccccccctgagtcccgcaattagagtacaagaggtcgcttggaaattgagttcaaaccgctgccatagccgagaatctcaggccgccatggctggccaggaagagacttctcaggatgagacctatgaggtcaaaatgaaccatgacactgaagcctgttccgaaccctccctgctatccacagaaatgctgtcataccaagatgacgagaaccggcagcttacactgccagaggaagacaaaagggacattcggcagtcccccaagcggggctttctgagatccgcctctttagggcgccgtgcctccttccatctagaatgtttgaaaagacagaaagacaggggaggcgacattagccagaagactgttctgcccttgcatttggtgcatcatcaagccctggcagtggcgggcttgagccctctccttcagagatctcattctcctgccagcttcccaaggccattcgctaccccgcccgccacgcctggctcaagggggtggccaccgcagccagtgcctacactccgtttggagggcgtggagagctctgaaaaactgaactcgtctttccccagtatccactgcggatcctgggcagaaaccactccaggagggggaggctcctctgctgcccgcagagtgcgccccgttagtcttatggttccttcgcaggccggcgcccctggtcgccagtttcatggctccgcttctagcctggtggaagccgtcctaatctctgagggcctgggacagttcgcccaggaccccaaatttatcgaggtcactactcaggaactcgccgacgcatgtgatatgacaattgaagaaatggaatccgcggctgacaacatactttctggcggcgctccccaatccccgaatggggctttactcccatttgtaaactgccgtgatgctgggcaggaccgtgctggcggagaagaggacgcgggctgtgtgcgggcgagaggccgtccctcagaggaggagctgcaggattctcgcgtgtacgtgtcatcactgtag

SEQ ID NO: 181221 - DNA, 6468 bp, Artificial Sequence
  Description of Artificial Sequence: Synthetic coding sequence
atggtgaacgagaacacccggatgtacatccccgaggagaaccaccagggcagcaattacggctcacctcgccccgcacacgctaacatgaatgccaatgccgcggccggactggctccagagcacatccctacacctggagccgcactgtcgtggcaagccgctattgacgcagctaggcaagccaagcttatggggtccgcaggcaatgcaacaattagcacagtctcaagcactcagcggaagcgtcaacaatatggaaagcccaagaagcagggttcaactacagctaccagacctccacgggccctgctatgccttacactgaagaatcccatcaggagggcatgtatttccatcgtggaatggaagccctttgagatcattatactgcttacaatattcgccaactgtgtcgctctagctatctacattccatttcccgaagatgattccaacgctacgaacagcaacctggaaagagtggagtatctctttcttataatcttcacggtggaagcgttcctgaaggtaatcgcctacgggctgctgttccaccccaatgcttatctcagaaatggatggaatctcctggatttcataatcgttgtggttggcttgttttccgccatccttgagcaggcaaccaaggcagacggcgccaacgctctgggcggtaagggagctgggttcgatgtcaaggccctcagagccttccgagttctacgcccccttaggctcgtgagtggcgtgccttccctgcaggtcgtcttaaatagtataattaaggccatggttccacttctgcatatagccctgctcgtcttgtttgtcatcatcatttacgcaatcataggactcgagctcttcatgggcaaaatgcacaagacctgctataaccaagaggggattgccgacgttccggccgaagatgaccccagcccctgcgccctggaaacaggacacggtaggcaatgccaaaacggcacagtttgtaagccgggttgggacggccctaaacacggaatcactaacttcgataatttcgcttttgcgatgctcacggtcttccagtgtatcaccatggagggctggacagatgtgctgtattgggtgaatgacgcagttgggagggattggccttggatctactttgttaccctaattatcattggcagctttttcgtactcaacctggtgctcggcgtattgtcaggcgagttttccaaggagcgggaaaaagccaaagcccgtggcgatttccaaaagctgcgagaaaagcaacaactggaagaggacctgaagggctatcttgattggattacacaggcagaagacatcgaccccgagaatgaggatgaaggtatggatgaagagaagccgcgaaatatgtctatgccaaccagcgaaactgagagcgttaacaccgagaacgttgccggcggggacatcgaaggagagaattgtggcgcccgcctcgctcacagaatttccaaatccaagttttccaggtattggcgacggtggaataggttttgtagaaggaaatgccgcgccgctgtcaagtctaatgtcttctattggctggtgatatttcttgtgttcctgaataccctgaccatcgctagcgagcactacaaccagccaaactggctcactgaagtacaggacactgccaacaaggcattactggctttattcaccgcagagatgttgcttaaaatgtatagcctggggctgcaggcctacttcgtcagcctgtttaatagatttgactgttttgtggtatgcggggggatactggagacaatactcgtggaaacaaagataatgtcaccattgggaataagcgtgttgcgctgcgtgcgcctgcttcggattttcaaaatcacaagatattggaatagcttgtcaaacctcgtagcaagcttgctgaattcggtgaggtctatagcttcattactgctgctcctgtttctatttatcattatttttagcctcttgggaatgcagctgttcggcggcaagtttaatttcgacgagatgcagacgagacggtctacctttgataattttccacagtctctgctcacagtgtttcagatcctcaccggagaagactggaactcagttatgtatgatggcattatggcatacggcgggccttcattccctggcatgctagtgtgtatatactttattattctcttcatttgtgggaactacattctcttgaacgtcttcctggccatagccgtggataatttggcggacgccgaatcacttacctcggcacaaaaggaagaagaggaggaaaaagaaaggaagaagctggctcgtaccgcttcaccggagaagaaacaggagcttgtcgagaaaccggccgtgggggaatcgaaggaggagaaaatcgaattaaagtctatcaccgccgatggcgagagcccacccgctactaagataaacatggacgatttgcagccgaacgaaaatgaggacaagagcccctacccaaacccggagaccacgggcgaggaagacgaagaagaacctgagatgccagtgggcccgcggccccggccactgtcagaactccacctgaaagagaaggcagtcccaatgcccgaagccagtgcattctttatattctcctctaataacagatttagactccaatgtcacaggattgtcaacgatactattttcaccaatctcatcctattcttcatacttttaagctcgatcagtttggccgctgaggatccagtccaacacacaagttttcgcaaccacattctaggaaatgcagactacgtgttcacttccatctttacactggagatcatactgaagatgacagcatacggtgctttcctccacaagggctctttttgcagaaactactttaatatactggacctgctggtagtgtctgtctctcttatctcattcggcattcagtcaagcgcaatcaatgttgttaaaattctgcgcgtcctccgcgtgttgcgccccctgagagcaatcaacagggcaaaggggcttaaacacgtcgtccagtgtgtgttcgttgccatcaggacaatcggaaatattgttatcgtgacaaccctactgcagttcatgttcgcttgcatcggagtgcaactttttaagggcaaactgtatacctgttccgatagctccaaacagacggaagcggagtgcaagggaaactatatcacctataaagatggtgaagttgatcatccgataattcagcctcgtagctgggaaaactcgaagttcgactttgacaacgtgctggctgcaatgatggctctgttcaccgtgtcgacttttgagggatggcctgagctgctgtatagaagcatcgacagccataccgaggataaagggcccatatacaactaccgggtggaaattagcattttcttcattatttacatcattatcattgctttctttatgatgaatatttttgtaggatttgttatcgttacattccaggagcagggtgagcaggagtacaagaattgtgaactcgacaagaaccaaaggcaatgtgtggagtacgcactcaaagcccgccctctgagaaggtatattccaaaaaaccagcatcaatataaagtctggtacgttgttaactctacatatttcgaatacctaatgtttgtgctgattctgctgaacaccatttgcctggccatgcagcactacgggcaatcgtgtctgttcaagattgctatgaacatactgaacatgctctttacagggctatttactgtggaaatgatactcaaactgatagccttcaagccgaaagggtactttagcgatccttggaacgtatttgacttcctgattgttatcgggagcatcatcgacgtgatcctatccgagactaatcattatttctgtgatgcttggaatacattcgatgccctgatcgttgtgggcagtattgtggacattgcaatcacggaggtcaacaatgccgaggagaatagtaggatttcaattacctttttccgtctgtttcgcgttatgaggctggtgaagctcctgagtaggggcgaggggatccggaccctgctatggactttcattaaaagtttccaggccctgccatacgtggcactgctaattgtcatgctgtttttcatatacgctgttatcggtatgcaggtgtttggaaagatcgcactgaatgacacgaccgaaataaacagaaacaataatttccaaacgtttccacaggcggtgctgttactctttcgctgtgcgactggcgaagcttggcaggatattatgctggcctgtatgccgggcaaaaagtgtgcacccgagagtgagccatccaattccacagaaggggagacaccttgtggctcatcttttgcagttttttacttcatcagtttctacatgctgtgcgcctttttaattataaacctcttcgtggctgtgattatggataatttcgactacctcaccagggactggagcattctgggccctcatcatcttgatgaatttaaacgcatctgggctgagtacgaccctgaagctaaaggacgcatcaaacacctcgacgtggtgaccctgctacgtcgaattcagcccccgttgggctttggtaaattatgccctcatagggtcgcgtgcaagcggctggtctcaatgaatatgcctctcaacagcgatgggaccgttatgttcaacgccacactttttgctctcgtaagaaccgccctgcgcataaaaaccgagggtaatctggagcaggccaatgaggaacttagagctatcattaaaaaaatatggaagcgtacatccatgaagttactggaccaggtggttcccccggcaggagatgacgaagtaaccgtgggaaaattctacgcaacctttctcattcaggagtatttccgaaaattcaagaaacgaaaggaacaggggcttgtcggcaagcctagccaacggaatgcattgtcattacaggctggactgcgcaccctgcacgacatcgggccagaaatccgacgggcaattagcggggacctgacagccgaagaagagctggacaaggccatgaaagaagccgtcagcgccgcctccgaagacgatatattcagaagggctggcgggctctttggaaatcatgttagctactaccagagtgacggccggtctgctttccctcagaccttcacaacccagaggcccctgcacatcaataaggccgggtcatctcagggggataccgaatcacctagccatgaaaagctggtcgactccacatttacgccttcatcctacagctccaccggctccaacgccaatatcaataacgccaataacaccgctctgggcagacttcctagacctgctgggtatccgagtaccgtctccaccgtggagggccacggacccccactttcacctgctatacgcgtccaggaggttgcctggaaattgtcaagcaatcgatgccactcccgtgaaagccaagcagccatggcagggcaggaggaaacctcccaagacgagacatacgaggtcaaaatgaatcatgacacagaagcatgttcagagccgagcctgctgtccaccgagatgttgtcatatcaggatgatgaaaatcggcaactgacccttcctgaggaagacaagcgggacattcggcagtccccgaagaggggcttcttgcggagtgcatctctaggcagaagggcctccttccatctcgaatgtctgaagagacaaaaagataggggaggggatatctcacagaaaaccgttctccccctccacttggtccatcatcaggcactcgccgtggccgggctctcgccactactgcagagatctcatagccccgcttcttttccaagaccgttcgccacacctcctgccacccctggttccaggggctggcccccccaacccgtaccaaccttaagacttgaaggggttgagtctagcgaaaaactgaactcatctttcccctccattcactgtggatcttgggcagaaactactcccggcggaggaggctcatccgcggctcgaagggtaaggccagtgtcccttatggtaccctctcaggcaggggcccctggcaggcagttccatggttccgcatcatctttagtggaagccgtgctgatctcagagggattaggccagttcgcgcaggatcctaaattcatcgaagtgactacccaagaacttgccgatgcatgcgatatgaccatcgaggaaatggagtccgctgccgacaatattctgagtggaggggctccacaatctcctaacggagcactcctgccatttgtgaactgcagagatgctggtcaagacagggccgggggcgaggaagacgctggctgcgtgcgggctagagggcggcctagcgaagaggagctgcaggactccagggtttacgtgtcctcactctag

SEQ ID NO: 181222 - DNA, 6630 bp, Artificial Sequence
  Description of Artificial Sequence: Synthetic coding sequence
atggtgaacgagaacacccggatgtacatccccgaggagaaccaccagggcagcaattacggctctccccggcccgcacatgcaaacatgaacgcgaacgccgccgccgggttggctcctgaacacatccccaccccaggagccgccttatcctggcaggctgccatcgacgctgctcgccaggctaaattaatgggatcggcgggaaatgctacaatctcaaccgtctcatccacacaacgcaagaggcagcagtatggcaagcccaaaaagcagggcagcactaccgccacccggccaccaagggccctgctttgtcttacactcaagaatcccatacggcgagcctgcatttctatcgtggagtggaagccctttgaaatcatcatcctccttaccatttttgcaaactgtgttgcacttgcaatttacatcccttttcccgaggacgattctaatgccacaaactcaaacttggagcgggtggaatatctgttcctaatcatttttacagtggaggcctttctcaaggtaattgcttacggtcttttattccatccaaacgcataccttcggaacggctggaacctcctcgattttatcattgtagttgtgggcttattttcggcgattctggaacaggccactaaagctgacggtgccaatgccctggggggtaaaggggcaggctttgacgttaaagcgctgcgggctttccgggtcttgcgcccactgaggctggtgagcggcgtcccctcactccaagtggtgctcaactctattatcaaagccatggttcccctcctgcatatagcgttacttgtgctgtttgttatcattatatacgctattattgggttagagctgtttatgggcaagatgcacaagacctgttataatcaggaaggtatcgccgacgtcccggcagaagatgatcccagtccttgtgcactggaaacaggccacgggcgacagtgccaaaatggcactgtctgtaagcctggttgggatggaccaaagcacggcattactaacttcgacaattttgctttcgctatgttgacagtctttcagtgcatcactatggagggttggactgacgttctgtactggatgcaggatgccatgggttacgagctgccatgggtttattttgttagtctcgtgatttttggcagcttcttcgttctgaatttggtccttggggttctgtctggcgaattttctaaggagcgagagaaagccaaggcccgaggtgattttcagaagcttagggagaaacaacaactggaggaagatctgaagggctatctcgattggatcacccaagctgaagacatcgaccctgaaaatgaggatgagggaatggatgaggaaaaacccaggaatatgtcgatgccgaccagcgagaccgagtccgtcaatacagagaacgttgccggcggagacatcgaaggcgagaattgcggggcacgccttgcccatcgtatttctaagtctaagttctccagatactggagaaggtggaataggttttgtagacgcaagtgtagggccgccgtcaaatccaatgtgttctattggcttgtgattttccttgtcttccttaacaccctgactatcgcttcggaacattataaccagccaaattggcttacagaagtccaggataccgccaataaggccctgctggctctgttcaccgctgaaatgctactgaaaatgtactccttgggcttgcaggcctatttcgtgtctctgttcaatcggtttgactgcttcgtcgtctgcggcggaatcctagagactattctcgtagagacaaaaatcatgtccccactcggcatttcagtcctgcgatgcgtcaggctgctgcggatattcaaaataacacgttattggaatagtctgtctaacctggtggcctcactcttgaactcagtcaggtcaatcgcctctctgctgctcctcctattcctttttatcatcatcttcagtttgctgggcatgcagttattcggcggcaagtttaacttcgacgaaatgcaaactcgcaggagcactttcgataattttccccagagtttactgactgtcttccaaattctgaccggagaggactggaacagtgttatgtacgatggcattatggcctatggcgggccctccttcccagggatgttagtttgtatctatttcatcatactgttcatctgcggaaattacattcttttgaatgtgtttctggcaattgccgttgataaccttgcggacgccgagtcattgacatccgcgcagaaggaggaggaggaggaaaaggagcgcaaaaaactagcccgaaccgccagcccagaaaaaaagcaggaactggtggaaaagccagctgtgggagagtccaaagaggagaagattgaactcaagagtataacggctgacggcgagtcgccccccgctacaaaaatcaacatggatgatctccaacctaatgagaacgaagacaagtcgccctacccgaacccagagaccacgggcgaggaggacgaggaagaacctgagatgcctgtgggccctcgcccccgccccctttctgaactgcatcttaaggagaaggcggtcccgatgcccgaggcatcagccttttttatattcagctccaataatcgcttcaggttgcagtgccatcgcattgtgaatgacactatctttaccaatctcatactgttcttcattctcttgagttcaatttctctggccgcagaagacccagttcagcacacatcttttcgcaaccatatcctgttctactttgatatcgtcttcacaacaatctttacaatcgagatcgccctgaagatgacagcctacggcgcatttctgcataagggaagcttctgtcggaattactttaacatcctggatttgctggtggtctccgtcagtctgatcagcttcggaattcagagttccgcaattaatgtagtgaagatcctgagggtgctcagggtgcttagacctttgcgcgccatcaacagggccaagggactgaaacacgtggtgcagtgtgtattcgtggcaattcgcacaataggaaatattgtgatcgtgaccacgcttctgcagtttatgtttgcatgcattggagttcagctcttcaagggtaagctgtatacatgttcagatagttcaaagcagacagaggccgaatgtaagggaaattacatcacatacaaagatggagaagtggaccatcctatcatacagccacgaagctgggaaaactctaaattcgatttcgataatgtcctggctgccatgatggcactgtttaccgtgagtactttcgagggctggcctgagcttctgtaccgcagcattgattcccatacagaagacaagggcccaatctataactaccgcgtggagatatctatattcttcattatctacattattataatcgcattttttatgatgaacatctttgttgggttcgtgattgtgacgttccaggagcagggcgaacaagaatataaaaactgcgaattagataaaaatcagcgtcagtgtgtcgagtacgccctgaaggctaggcccttgagaagatatatcccaaaaaaccaacaccagtataaagtttggtacgtcgtcaacagtacgtattttgaatatctgatgtttgtcttgattctgctcaacaccatttgccttgccatgcagcactacggccagtcatgtctgttcaaaattgctatgaacatcctgaacatgctcttcaccgggcttttcactgtcgaaatgatactgaagctgattgccttcaagcccaagcattacttctgcgatgcctggaacacattcgatgcattaattgtcgtgggaagcattgtggatatagctatcaccgaggtgaaccccgcggaacacacccaatgttctccatccatgaatgcagaggagaattcaaggattagtatcacttttttcagactcttcagggttatgaggcttgtcaaattgcttagcaggggcgagggtattaggacgctgttgtggactttcattaagtctttccaggcactcccctacgtcgccttattgattgtgatgttgtttttcatatacgccgttattggcatgcaggtcttcgggaaaatagctctgaatgataccacggaaattaaccggaacaataattttcagactttcccccaagccgtattgctgctgttcaggtgtgccactggagaagcctggcaggacatcatgcttgcatgcatgcccggcaagaaatgcgcaccagagtccgagccttcaaactcaacagaaggcgagaccccctgtgggtcctcatttgcggtgttttattttatctccttttacatgttatgcgcttttctcattattaaccttttcgttgcagttatcatggacaattttgactacctcactagagactggagcatactggggccgcaccacctggacgaatttaagaggatctgggccgagtatgaccccgaggctaagggtcgaatcaagcacctggacgttgtgaccctcctacgacgaatccaaccccctttagggttcggcaagctctgtccccatcgcgtggcatgtaagcgcttggtgtcgatgaatatgcctctgaatagtgatggcaccgtcatgttcaatgccacattgtttgccctggtgaggaccgcacttcggattaagaccgagggaaacctggaacaggctaacgaagagctgcgggcaatcatcaagaaaatttggaagcgcacctctatgaagttgctcgatcaggtcgtacctcccgctggcgacgatgaggtcacagttggtaaattctatgccaccttcctgatacaagagtacttccgaaagtttaaaaaaagaaaagagcaaggcctggtgggcaaacccagccagcggaacgccttgagcctgcaggccggcttgcgcaccctgcatgacattggccctgagattaggcgagcgatttccggagacctcaccgccgaggaggaattggataaagcaatgaaggaggccgtctccgccgcctcggaagacgatatttttaggcgcgccggcggcctgtttggcaaccatgtctcatactaccagtctgatggacgcagcgcattcccccagaccttcaccacccagagaccccttcacatcaacaaggcgggttcttcccaaggggacacagagagtcctagccacgagaagctagtggactctaccttcaccccatccagctactcttcaaccgggagtaacgctaatattaacaacgcaaacaacactgccctaggtcgcctgccgcgacctgctggatatccaagtactgtttctaccgtggaagggcatggcccaccattgtcccccgctatacgcgtgcaggaggttgcctggaagctgagcagcaaccgaatgcactgctgcgatatgctggacggtggaacattcccaccagctctcgggccacgccgcgccccaccctgcctgcaccagcaactgcagggatctttagctggcctaagggaggacacaccttgtatagttcccggccatgcatccctgtgctgcagtagcagagtcggcgagtggctcccagccggatgtacagctccccagcacgccaggtgtcactctagggagtcacaggccgccatggcgggtcaagaggaaacctcccaagacgaaacgtatgaagtcaagatgaatcatgacaccgaggcgtgttctgagccgtcccttctctcaacggaaatgttgagttatcaggacgacgaaaacaggcaactcactctgccagaggaggacaaacgggatatccggcaatcccccaaacgtgggtttctaagaagtgcctccctgggtcgaagggcttctttccacttagagtgtctgaagcgtcagaaagataggggcggagatatttcacagaaaaccgttcttccgctgcacctggtgcatcaccaggcattggcagttgcgggcctttcaccgcttttgcaaaggagtcactcgccagcttctttcccccgaccattcgccactccccctgcgactcctggctcgaggggatggccaccacaaccagtgcctaccctgcggctcgagggtgtcgagagttcagagaagttgaatagctctttcccctccattcactgcggttcatgggcagaaacaacgccaggaggcggcggatcaagcgccgcgagacgagtgaggcctgtgtccttaatggttccttctcaagccggggcccctggaaggcagttccatggttcagcatcctccctcgtagaggccgtgttgatttccgaaggtctcggacagttcgctcaggatccgaagtttattgaagtcaccactcaggaactggccgacgcgtgcgacatgacaattgaagagatggagagcgccgccgacaacatcctctctggaggggcaccacagtcccctaatggcgctctgctgccattcgtgaattgccgcgacgcggggcaagacagggcagggggcgaggaggacgctggctgcgtacgagcacggggacgtccttctgaagaggagcttcaagacagccgggtctacgtcagtagcctgtag

SEQ ID NO: 181223 - DNA, 6474 bp, Artificial Sequence
  Description of Artificial Sequence: Synthetic coding sequence
atggtgaacgagaacacccggatgtacatccccgaggagaaccaccagggctcaaattacgggagtcctcggccagcgcacgccaatatgaatgccaacgcagccgcagggctagcccctgaacacatcccaacgccaggcgctgctttgtcttggcaggcggccattgatgccgctcgccaggcgaaacttatgggtagcgctggaaatgccacaatctctaccgtcagttcaacacaacgtaagagacagcaatacggcaagcctaagaagcaggggtcaaccaccgcaactaggcctcccagggccctgctttgtctgaccctgaaaaatcccattcgtcgtgcatgcatctcaattgtcgagtggaagccctttgaaataatcatcttgctgactatcttcgctaattgtgtagcccttgccatttatataccctttcccgaagatgattctaatgcgactaactccaatctggagcgcgtggaatacttgttcctcatcatatttacagtggaggcttttctaaaggtgatcgcctatggactgctatttcaccctaacgcctatctgcgtaatggctggaatctgttggactttatcatcgtggtggtgggcctgttttccgccatcctcgagcaggccacgaaagctgatggggctaatgctctgggaggaaaaggcgcgggttttgacgttaaagcgctgcgagctttcagggtcctgaggccgctgcggctagtgagtggagtcccttccctgcaggtagtactcaacagtatcattaaagccatggttccactgcttcacatagcacttcttgtcttgtttgtaatcataatttacgccatcatcggtcttgagctgttcatggggaagatgcataagacatgttataaccaagagggcatcgcagacgttcctgctgaggacgatccatccccctgcgcactggaaacaggtcatggacggcagtgccagaacggaaccgtttgcaagcccggttgggacggcccaaagcacgggattaccaactttgacaatttcgcttttgcaatgctgactgtgttccagtgcatcaccatggagggctggaccgatgtgctatactgggtgaacgatgccgtggggcgggattggccttggatctactttgtgaccctgattatcatcggaagctttttcgtactcaacttagtgctcggcgttctgagcggcgaattttcaaaggagcgagagaaggctaaagctagaggcgattttcagaagctgcgggagaaacagcagttggaggaggatctgaaaggatatctggattggatcacacaggctgaggacatcgaccctgaaaatgaagacgagggcatggatgaggagaagccaaggaatatgagcatgccaacgagcgagaccgagtccgttaacacagaaaacgtcgcaggcggcgatatagagggcgaaaactgcggagcgagactggctcaccggatttctaagagtaaattctctcgatattggaggcgctggaaccgattctgtcggagaaaatgtagagctgccgtaaagtccaatgtattttactggctcgtaatcttcctggtatttctaaatacccttacaatcgcaagtgaacattataatcaaccaaactggttgactgaggtccaagataccgccaacaaagccctgctggcgttattcacggccgaaatgctgctcaaaatgtacagcttgggtctccaggcctacttcgttagtttattcaatagattcgattgcttcgtggtgtgcggtggaatcttagagacaatcctggttgagaccaagatcatgtctccactggggatctccgtgttgagatgtgtgcggttgctccggatttttaagataactaggtactggaatagtctgagtaacttggtggcctcattgttaaatagtgtgcgcagcatcgcctcacttctgctgctactgtttctattcatcatcatcttcagcctgctgggcatgcagctgttcggcggtaaatttaacttcgacgagatgcaaaccaggagaagtaccttcgacaatttcccccagagcctgctgacagtctttcagatcctgactggagaggactggaattcagttatgtacgatggtataatggcatacgggggcccctctttcccaggcatgttggtgtgcatctatttcatcatcttatttatatgtggcaattacatcctgctcaatgtgtttctagctattgccgtagacaacctggctgacgcagaaagtcttacttcggctcagaaagaagaggaggaagagaaggaaagaaagaagctggcccggaccgccagccctgagaaaaaacaggagttggtggagaagccggccgtgggagaatctaaggaggagaaaatagaattgaaaagcatcacggctgatggtgagtcaccaccagctacaaagattaacatggatgacctgcaacccaacgagaacgaagataagagcccgtatcctaacccagagaccaccggagaggaggacgaagaagagcctgaaatgccggtgggacctcggccccgtcccctgagcgaacttcacttgaaggagaaagccgttcctatgcctgaggcatctgcattcttcatattcagctccaacaacagatttcgactgcagtgccatagaattgtcaacgacacaatcttcactaatctgatcctattttttatcctgctttcctcaatctctctggcagcagaagaccccgtgcaacacactagctttaggaaccatattctgggtaatgctgactacgtgttcacgagcattttcactctagaaataatccttaaaatgacagcatacggtgcatttctccacaaagggtctttctgtaggaattacttcaacatcctggatctactcgtagtgtcagtgagtctgatatccttcggcattcagtcatccgcgatcaacgttgtgaaaattctgagggtgttacgagtgttgcgtccactgcgcgccataaacagggccaaaggactaaagcacgtcgtgcagtgcgtctttgtggccatcaggaccattgggaacatagtcatagtgacaactctgctgcagttcatgtttgcctgcataggcgtgcagctctttaagggaaaactctacacgtgtagcgactcaagtaaacaaaccgaggcggagtgtaaggggaactatattacctataaggacggcgaggtggaccatcccatcatccagccaaggagctgggaaaactctaagttcgactttgacaacgtgttagcagctatgatggccttgtttactgtttccacattcgaggggtggccggagctgctgtatcgaagtatcgatagtcacactgaggacaaagggcctatttacaattaccgcgtggagattagtattttcttcattatttacattatcattattgctttcttcatgatgaacatctttgtcggctttgtcattgtgaccttccaggaacagggtgagcaagaatataagaactgcgagctggacaaaaatcagagacagtgcgtggaatatgccctgaaggcgcggccactcaggcgctatatccctaagaatcaacaccagtataaagtctggtatgtggtgaactccacttattttgagtatctgatgttcgtgttgatcctgttgaacacaatctgtctagccatgcagcactacggccagagttgcctcttcaagattgcaatgaatatcctcaacatgctgttcacgggactcttcaccgtcgagatgatcctgaagctgatagccttcaagcccaaacactacttctgcgacgcctggaatacattcgacgcgctcatcgtcgtggggtccattgtcgatatcgcaatcaccgaagtaaacccagcagagcacacccagtgtagcccctccatgaatgcagaggaaaacagcaggatctctattaccttttttagactctttcgggtgatgcgccttgttaagctcctgtccagaggcgaaggcatccggacactcctctggacctttattaaatcctttcaggccttgccatacgtggccctgctgatcgtgatgctgttttttatctacgccgtgatcggcatgcaagtgtttggaaagatcgctctgaacgatacaactgagattaacagaaataacaattttcagacgttcccacaagctgttctcctgctgtttcgatgcgctacaggggaggcatggcaggacattatgttggcgtgtatgcccggaaagaagtgcgctcccgagagcgaaccaagcaactctactgagggagagaccccctgtggtagtagttttgctgtgttctacttcatctctttttatatgctgtgtgcctttttgattatcaacttgttcgttgcagtgatcatggacaacttcgattatttgactcgcgactggagcatcttgggaccacaccatctagacgagttcaagcggatctgggcagagtatgacccagaggcgaagggccggatcaagcacctggatgtggtgactctgctgcgtcgcattcagcctcccctgggatttgggaaactatgtccccacagagtagcctgtaaaagattggtgtctatgaatatgcccctgaatagcgatggaaccgtgatgtttaacgctaccctatttgcactggttcggacggctctcaggattaagacggaagaaggcccttcaccctccgaagcccatcagggagccgaagacccatttaggccggccggaaacctggagcaggcgaacgaagaactgcgtgcaataatcaaaaagatctggaaaaggacctctatgaagctgttagatcaggtcgtaccccctgccggggatgacgaagtgaccgtgggcaagttttatgccactttcctcattcaagagtatttcaggaagtttaaaaagcggaaagaacaggggttggtgggaaagccttcccagcggaatgcattgagcctccaagcaggactccgcactctacacgatatcggaccagagattcggcgcgccatatcaggcgacttgacagcagaggaggagcttgataaggccatgaaggaggctgtgtccgctgcatctgaggacgacatatttcggagggcagggggactgttcggtaaccacgtcagctattatcagtcagacgggcggtctgctttcccgcagacttttaccactcagcggccactgcatattaataaagcaggatcgagtcagggtgacaccgagtcaccgtctcatgaaaagctagtagacagcacctttaccccatcctcatatagctcaaccggcagcaatgccaacatcaataacgcaaacaataccgccctgggccgcttgccccgtcccgccggatatccatctactgtttccacagtcgaaggccacggcccccccctgagcccggccattcgggtgcaggaagttgcatggaagctgtcctctaatcggtgccactcccgggaaagccaggcggctatggcgggccaggaagagacatctcaagacgagacatatgaagtcaaaatgaaccatgatacagaagcgtgctctgagccgtcccttctctccacggagatgctgtcttaccaggacgacgaaaatcgccaactgacgcttcccgaagaggacaaacgggacattagacagagccccaaacggggcttcctaagaagtgccagtctgggtaggcgcgcaagctttcatttggaatgtttgaaacgccaaaaagaccgagggggggatatctcacaaaagactgttctgcctctgcacttggttcaccatcaggcactagccgtcgccggtcttagcccgctgctgcagcgtagtcatagccccgccagtttccctcggccttttgccacacctcccgccaccccaggctcaaggggatggccccctcagccagtgcccactctcaggctcgagggggtggaaagcagtgagaagcttaactcatcatttcctagtattcactgcggatcttgggcggagaccaccccaggggggggcggaagctctgcagctaggcgagtccggcccgtgtctctgatggtgcccagtcaggccggggcacccgggcggcagttccatggtagtgctagctctctcgtggaagcagtgctgatctccgagggtctggggcagtttgcacaggatcccaagttcatagaggttactacacaggagctcgccgacgcgtgcgatatgaccattgaggagatggagtcggcggctgataacatcctgtctgggggcgccccccagtcccccaacggcgcgctgctccctttcgtaaattgccgggacgccgggcaggaccgggctggaggcgaggaagacgctggatgtgtaagagctagaggccgtcccagcgaagaagagctccaagatagccgggtctatgtgagctctctctag

SEQ ID NO: 181224 - DNA, 6501 bp, Artificial Sequence
  Description of Artificial Sequence: Synthetic coding sequence
atggtgaacgagaacacccggatgtacatccccgaggagaaccaccaagggtcaaattacggcagcccccgtcccgctcatgccaatatgaatgccaacgctgccgcgggtctcgcacctgagcacattcccaccccaggagctgccctctcttggcaggccgctatcgacgcggccaggcaagccaagttgatgggaagcgctggcaatgccacgattagtacagtgtccagcacccaacggaagaggcagcagtacggcaagcctaagaaacaggggtccactactgcgacacgacccccaagggcacttctgtgtctaactctgaagaatccgattagacgagcctgtatcagcatagtggaatggaagcctttcgaaataatcatcctactgacaatttttgctaattgcgtcgccctggcaatctacataccatttcctgaggacgattctaacgctactaactctaacctcgagagggtcgagtatctgttcctaattatcttcactgtagaagcgttccttaaagtcatcgcctatggcctgctgttccatcctaatgcttacctgcgcaacggctggaatctcctggactttatcatcgtcgtggtggggctcttctctgctatcctcgagcaggctacaaaggccgacggggccaacgccctcggggggaagggagcaggcttcgacgtcaaggcattacgcgccttcagagttctgcgcccactccggctcgtgtccggagtgccttcactgcaggtggtcctgaattcgattattaaagccatggtcccattgctgcacattgcgctcctggtacttttcgttattatcatttacgcaatcatcggtctcgaactgtttatgggcaagatgcataaaacttgttataaccaggagggcattgctgacgtcccagcagaggacgacccgtcaccctgcgcccttgagactggccacggacgacaatgtcaaaacggaaccgtgtgcaaacccggctgggacggtcccaagcatgggataaccaactttgacaatttcgcctttgccatgctgacggttttccagtgcattactatggagggttggaccgacgtgctgtattgggtcaacgacgcagtgggccgggactggccctggatctacttcgtgacactgattatcattggatccttctttgtgcttaacctcgtgctcggcgtgctgtctggggagttttctaaggaacgagagaaggctaaggcccgcggcgacttccagaaactcagagaaaagcaacaattggaggaagacttaaaaggttaccttgattggattactcaagctgaagacattgacccggagaatgaggacgagggaatggatgaggagaaacctcggaacatgagtatgcccacctctgaaaccgagtcagtgaacacagagaatgtggcaggaggggatattgagggagaaaactgtggagcccggctcgctcacagaatcagcaaaagcaagttttcacgctattggaggcgctggaaccgcttctgcaggcgcaagtgtagggccgccgtgaagtctaatgtgttttattggttagtgatttttttggtctttctcaacacattgaccatcgctagcgaacattacaaccagcccaattggttgacagaagttcaagacaccgccaacaaagcgctcctcgccctattcaccgcagaaatgctgcttaaaatgtactctctggggcttcaggcttacttcgtcagcctgtttaacaggttcgactgctttgttgtgtgtgggggaattctggaaacaattctggtggagactaagattatgagtccattgggaatctcagtgctgaggtgcgtgcgacttctgcggatctttaagataaccagatattggaacagcctctcaaacctcgtagcatccttattaaactcagttcggtccatagcctctctgctattacttctctttctgtttattataattttctctctgctgggcatgcagctgttcgggggaaaattcaactttgatgaaatgcagacacgccggtccactttcgacaactttccccagagcctcctcacagtgtttcaaattcttaccggggaggactggaattctgtgatgtacgacggtattatggcctacgggggacctagcttcccaggtatgctggtgtgcatttatttcatcatcctttttatctgtggcaattatattctgctgaacgtattcttggccattgccgtcgacaaccttgctgacgctgaatccctcacaagcgctcagaaagaggaggaagaagagaaggaaagaaaaaaactagcgaggaccgctagtcccgagaaaaaacaagagctggttgagaagcccgccgttggggagtcgaaggaagagaaaattgagctgaaaagcatcacagcagacggggaaagcccgcctgccactaagataaatatggatgatttgcagccaaatgagaatgaggataaaagtccgtaccctaaccccgaaacaacaggtgaggaagatgaagaagagcccgagatgccagtggggcctcggcctagacctctatctgagctgcacctcaaagaaaaggctgtacctatgccagaagcctcggccttcttcattttttcctctaataacagatttagattacagtgccaccgcattgtcaacgacaccatcttcacgaacctaatacttttctttattctactctcatccattagtctcgcggcggaagatcctgtgcagcacacttcctttcgcaatcacatcttgttttattttgatatcgtgtttaccaccatctttacgatcgagatcgccttgaaaatgaccgcttacggtgcctttctccataagggaagcttttgccgcaactatttcaacatcctggatttgctggtggtgagcgtgagcctcatttcatttgggatccagtctagcgccattaatgtggtaaagattcttcgggtactgcgagtgctccggccgctgagggcaatcaacagagcgaaagggctgaaacatgtcgttcaatgcgtgtttgttgctatccgaacgattgggaacatcgtgatcgtcaccaccctcctccagtttatgtttgcttgtataggcgtccagttgtttaaaggcaagttgtatacgtgttctgactccagcaagcagacggaagctgagtgcaagggcaattatattacgtacaaagacggcgaagttgaccatcccatcattcagcccagatcatgggagaactcaaagttcgacttcgataatgtgctggccgcaatgatggccctatttaccgtgagtacattcgaggggtggccggagctactgtaccggtctattgactcccatactgaggacaaggggcccatctataactatcgcgtagaaatctcaatattcttcataatttatattatcataattgccttttttatgatgaatatcttcgtaggttttgtaatagtaacgtttcaggagcagggcgaacaagagtacaagaattgtgagttggataagaatcagcgccagtgtgttgaatacgctctcaaagcacggccgctccggaggtatatcccgaagaatcagcatcaatacaaggtgtggtatgtggtgaacagtacctactttgagtacctgatgttcgtgttgatcttactgaacactatatgcctggcgatgcaacattatggacagagctgtctttttaagattgcgatgaatatactgaatatgcttttcactgggctttttaccgtggaaatgattctcaaactcatagcgttcaagcccaaagggtacttcagcgacccctggaatgtcttcgatttcttgatcgtgataggcagcattattgatgttatcttgtctgagaccaaccactacttctgcgacgcctggaatacatttgacgcgctgattgttgttgggagcatcgtcgacatcgctataactgaagtcaaccccgccgagcatacgcagtgttcaccttctatgaacgctgaagaaaactccaggatcagcataaccttcttccggctctttcgggttatgcgattggtcaagctgcttagccgaggcgaaggcatccgaacgctactttggacatttattaaatcattccaggccctgccatatgtggccctgctgatcgtgatgctgttctttatttacgcggtgattggaatgcaggtgtttggcaaaatagccctaaatgacacaaccgaaattaacagaaataataatttccagactttcccacaggccgtactgctcctcttccgctgtgcaactggcgaggcttggcaggacattatgttggcttgtatgcccggaaagaagtgtgcccccgagtcggagccctctaactctactgagggagaaacgccatgtggtagttctttcgcagttttctacttcattagcttctacatgctctgcgccttcctcatcatcaacttgttcgtagctgtgatcatggataacttcgattacttgacacgcgactggagcatcttggggccccatcatctggacgagtttaaacggatctgggccgaatatgacccagaggcaaagggcaggatcaaacatttggatgtggttaccctgctacgccggatccagcccccactgggttttgggaaactgtgcccacatagagtcgcatgcaagcgcctggtgtcaatgaatatgcctcttaacagcgacggcaccgttatgttcaacgccaccctcttcgcactggtccgaactgcccttaggataaagaccgaaggtaacctggaacaggctaatgaagaactccgcgctatcatcaagaagatctggaagagaacctccatgaagctcttggatcaggtggtaccgccagccggggatgatgaggtcacggtgggcaagttctatgccacttttctgatccaggagtactttcgcaagttcaaaaaacgcaaagaacaaggtctcgtgggcaagccctcccagcgcaacgcactgtccctgcaggccggcctgcgcaccctgcacgatatcggaccagagatacgtcgagccatctctggcgacctgaccgctgaggaagaactggacaaggcaatgaaggaggccgtgtctgcagcctcagaggatgacattttccggcgtgccgggggactgtttggtaaccatgtgagctactaccagtccgatggccggtcagccttccctcagacctttacaacccaacgcccactgcatattaataaagctggatcttcccagggagatactgagagcccttcccatgagaagttagtggacagcacctttacaccaagttcttatagttcgactggcagcaacgccaacataaacaacgccaacaatacagcattgggcagactcccacgtccggctggatacccgtccactgtcagtacagtggaagggcatggacctccattatctccagccattcgggtgcaagaagtggcgtggaagctttctagcaaccgatgccacagccgggagtcccaggcggcaatggctggacaagaggaaacctctcaagacgagacctatgaggtgaagatgaatcacgataccgaagcttgttccgaaccctccctgctgtctacagaaatgctaagctaccaggacgacgaaaatcggcaattgacactgccagaagaagataagcgggatatccggcagagcccgaagcgcgggttcctgcgctctgcgtcgctcggccgccgcgcaagtttccatctagagtgcctgaagcggcagaaggacaggggcggggatatctcccagaagacagttctgcccctgcatttagtacatcatcaggccctggccgttgccgggctttctcccctgctgcagagatcacactctcctgccagctttccgcgcccgttcgccacccctccagccacccctggcagcaggggctggcccccccaacctgtccctaccctcagactggaaggtgtcgagtcctctgaaaagctgaactcctccttcccatctatccattgtgggagttgggccgagacaactccaggagggggtgggagttccgccgcaagaagagttcgaccagtctccctcatggttccttctcaggctggagcaccaggccggcagttccatggatctgcttctagtctggttgaagccgtcctcataagtgaaggtctgggacaatttgctcaggaccccaaattcattgaggtcacaactcaagagctcgcagacgcctgcgacatgacgattgaggaaatggagtctgcagctgacaatatcctctcaggaggcgcccctcaatcgccaaacggtgcactgctcccctttgtgaattgccgggatgcgggccaggatcgtgctgggggagaggaggacgcgggctgcgtacgagcccggggcagaccctcagaggaggagctccaggacagcagagtgtatgttagtagtctgtag

SEQ ID NO: 181225 - DNA, 6417 bp, Artificial Sequence
  Description of Artificial Sequence: Synthetic coding sequence
atggtgaacgagaacacccggatgtacatccccgaggagaaccaccaaggttccaactacggctcgccccgtcctgctcacgcgaatatgaacgcaaacgcggccgctggactggcacctgagcacatcccgactcccggggccgcactcagttggcaagccgctatcgacgcagctagacaagccaaactgatgggctcagctggcaacgctacaatatctaccgtcagcagcacacagcggaagaggcagcagtacggaaaacctaagaagcagggatcaactactgccactcggcccccacgagctctgctctgtctaacacttaagaaccccatccggcgggcctgcattagcattgtcgaatggaagccttttgagatcatcatcttgttgacgattttcgctaactgcgtggccttggctatctatatacctttcccagaagatgacagtaacgccactaactctaacctggagagggtggagtacctgtttctgataatcttcaccgtggaagccttcttaaaggtgatcgcttacggactcctatttcatccaaatgcgtacctcaggaatgggtggaatcttctggatttcatcatcgtggtagtgggactgttttctgccattctggaacaggccaccaaagccgatggcgctaacgccctgggcggcaagggagctggcttcgatgtaaaggccctccgcgctttcagggtcctgaggcccctacggctcgtctccggagttccgtctctgcaagtggtactgaattccattatcaaagcaatggtgccactgttgcacatcgccttactcgttcttttcgtgataatcatctatgctatcataggtctcgagttatttatgggtaaaatgcataagacctgttataaccaagaaggcatcgccgatgtcccagctgaagacgacccttctccctgcgcgctcgaaacaggacatgggaggcagtgtcagaacggcacggtctgcaaacccggatgggatggccccaagcacggtataaccaacttcgacaactttgcatttgccatgttaaccgttttccagtgtattaccatggaaggctggacggatgtcctctattggatgcaggatgctatgggctacgagttaccgtgggtctacttcgtgagcctcgtgattttcggctcgttcttcgtcttgaatttggtgctgggagtgctgtcaggcgagttttctaaggagagggagaaagcaaaggccaggggggatttccagaagctgcgggagaaacaacaacttgaggaggacctgaaggggtatctggactggataacccaggctgaggacattgatccggaaaatgaggacgagggcatggacgaagagaagccaagaaatatgtcgatgcctacaagtgaaacagagtcagtgaatacagagaatgtggcgggaggcgacatcgaaggcgagaactgcggagcacgcctggcacatcggatttctaagagcaaattctccaggtactggagacggtggaataggttttgccgccgaaagtgccgcgcggctgtcaaatctaatgtcttctattggctggtgatctttctggtgtttctgaacacgttgacaatcgcttctgagcactacaatcaacccaattggctgactgaggtgcaggatactgccaataaggctctgttggccctgtttactgccgagatgctccttaaaatgtattccctgggtctccaggcttattttgtgtccctgtttaatcggttcgattgctttgtggtgtgcggcggcattttggagaccatattggtagagactaaaattatgtctcctctcggaatcagcgtgttgagatgcgtgaggctccttcgcatttttaaaattacacgctactggaattcactgtccaacttggtggcctcgcttctgaactctgttcggtcaatcgctagtttgctgctgctcctgttcctgtttattattatctttagcttgttgggcatgcagctgttcggcggtaaattcaattttgatgagatgcagactcgccgaagcacctttgataatttcccccagtcccttcttacagtgttccagatcctgactggcgaggattggaactccgttatgtatgacggcattatggcctatgggggccctagctttcccggaatgctggtgtgcatctacttcatcatcctcttcatttgtggcaactatatcctgctgaatgtgtttctggcaattgccgtagacaatctagccgatgcagaatctctgactagtgcacagaaggaggaagaggaagagaaagaacgaaaaaagctcgctcggacagcctccccggaaaaaaaacaagaattggtagaaaagcctgccgtcggtgagagtaaggaggaaaagatagaactgaagagtattaccgccgacggggagagtcctcccgccaccaaaattaacatggacgacctacagccgaatgaaaatgaggacaagtctccttacccaaatccggagacgacaggagaagaagacgaggaggaacctgagatgcctgtgggtcccagacccaggcctttatctgagctccatctcaaggagaaggccgtgcccatgccggaagcttcggctttttttatcttttcgtcaaacaatcgctttcgcctgcaatgccatcgcatcgtcaacgacactatattcactaacctgatcctgttttttattctgctttcttccattagcctagcagcagaggaccctgtccagcacactagtttcaggaatcatatcctgggaaatgccgattacgttttcacctctattttcacactagagatcattctgaagatgacggcatatggagccttcctgcataaaggctccttttgccgaaattattttaatattctggacctactcgtggtgtctgtgtccctgatctcatttggaattcaaagctcagctatcaacgtggtgaagattctgagagtgttgagggtcctcaggcctctgcgcgccatcaaccgcgcgaaaggcctgaagcatgtcgtgcagtgtgtatttgtcgctattcgaaccattggaaacattgtcattgtcacaactctactgcagttcatgttcgcgtgcataggagtgcagttatttaagggtaagctctacacatgctctgacagcagtaaacagacagaggcggagtgcaaaggaaattatataacttataaggacggcgaggtcgatcacccaattatccaacctaggtcctgggaaaacagtaagttcgatttcgacaacgttctggccgccatgatggctcttttcactgtttcgaccttcgaaggttggcccgagctgctgtaccggtccatcgacagccacaccgaggacaagggacctatctataattaccgggtagagatttccattttcttcattatctacatcataatcattgcatttttcatgatgaatatctttgtcggctttgtaatcgtcacatttcaggaacagggggagcaggagtacaagaattgcgagctggataagaatcagagacagtgtgtcgaatatgcattgaaggccaggccactgcgccgttacatacctaagaaccagcaccaatacaaggtttggtatgttgtcaacagtacatatttcgagtacctcatgtttgtcctgatcctcctgaatactatctgtctcgccatgcagcactatggccaaagctgtctgttcaaaatagcgatgaacatcctgaacatgctgtttaccgggctctttaccgtggagatgatcctgaaactgatcgccttcaagccgaaacactatttttgcgatgcatggaacacctttgatgcactgatagtggtcggatccattgtcgacattgctataactgaagtgaatcctgctgaacacacccagtgtagcccatcaatgaatgcagaggagaacagtcgtatttctattacttttttccgcttgtttcgcgtcatgagactcgtgaagcttctgtctcgaggcgaagggatccgaactttgctgtggacattcataaaatctttccaggctctgccatatgtcgccttgttgatcgtgatgctgtttttcatttacgccgtgattggcatgcaggtgttcggaaaaattgccctgaacgatacgacagaaatcaaccgcaataacaactttcaaaccttcccgcaggctgtactgctgcttttccggtgtgccaccggcgaagcctggcaagacatcatgctggcgtgcatgccaggcaaaaagtgtgcgccagagtcagaaccatctaacagcacagagggagagactccttgcggttccagttttgccgtgttctattttatctcgttttatatgctgtgcgcattcttgattataaacttattcgtcgccgtcattatggataattttgattatctcactagggactggtccattctgggccctcaccatctcgatgagtttaaacggatctgggcagaatatgaccccgaggcgaaggggcggataaagcaccttgacgtggtgaccttgctgagaagaatccaaccaccattgggcttcggcaagctctgtcctcatcgggtcgcttgcaaaagattagtgagtatgaacatgcccctgaacagcgatggcacagtgatgtttaacgctactttgtttgctttagttagaacagccctccgcatcaaaaccgagggaaacttggagcaggccaatgaggagttgcgagccatcataaagaagatctggaagcgtacctccatgaagctccttgaccaagttgtgccccccgctggggacgacgaagttaccgtgggcaaattctacgcaactttcttgattcaggagtactttcgtaagttcaaaaagcgcaaggagcagggcctcgtgggtaagccctctcagcgaaacgccctgtctttacaagccggcctacgaacccttcatgatattggtccagagatccgaagagccatctctggcgacctgacagcggaagaagagctggataaagctatgaaggaagcagtctcagctgcaagcgaggacgatatcttccgaagggctgggggcttattcggtaaccatgtttcctattatcaatcagacggcagatcagccttcccgcagacgtttaccacgcagaggcctctccacattaacaaagctggatcttcacaaggcgacaccgaaagcccctcacacgagaagcttgtagacagtacctttacaccatcgtcctactctagtacaggaagtaatgctaatataaacaatgccaacaataccgctctcggtaggcttccgaggcccgcggggtacccttctaccgtatcaaccgtggaggggcatggacctcctctgtcaccagctattagagtgcaggaggtcgcctggaaactgtcctcgaaccgatgccacagtcgggaaagtcaggctgcaatggccgggcaggaagagacctctcaggacgagacttacgaggttaaaatgaaccacgacaccgaagcctgttccgagccatccctgctcagtactgaaatgctgtcatatcaggatgacgaaaacagacagctgaccctgccagaggaagataaacgcgacatccgccagagccccaagagggggtttctaaggtccgcatccctgggccggcgagcatcctttcatctggagtgccttaaacggcagaaagaccggggaggcgacattagccaaaagacagtcctgccactgcatctggtgcaccatcaagccctcgccgtggcaggactcagccccttattgcagcgctcgcattctccagcttctttccctcgaccgtttgctactcctccggctaccccaggaagccgggggtggccccctcaaccagtgcccacgcttcgcctggagggagtggaaagtagcgagaagttaaacagttcgtttcccagtatccactgtggttcgtgggccgagaccactccaggtggcggggggtcctccgccgctaggagagtgcgtcctgtgtcactgatggtgccttcccaggcaggagcccctggacggcagttccatggatccgcttcctctttggtagaagccgtgctgatatctgaaggactggggcagttcgcacaggaccccaagttcatcgaagttaccacccaggagttggctgacgcctgtgatatgacaatcgaggagatggagtccgcagccgataatatcctctccggcggcgcaccccagtcccccaatggagccctgcttcccttcgttaactgtcgggatgccggccaggatagagccgggggtgaggaagatgctggttgtgtcagagctagaggtcggccctcagaagaggagttacaggattccagagtttatgtgagttcgctctag

SEQ ID NO: 181226 - DNA, 6417 bp, Artificial Sequence
  Description of Artificial Sequence: Synthetic coding sequence
atggtgaacgagaacacccggatgtacatccccgaggagaaccaccaaggttcaaattacggaagtccaaggcccgctcacgcaaacatgaatgccaacgctgcagctgggctggcccccgagcatatcccaactccgggcgcagcactctcttggcaggctgctatcgacgcggcgcgacaggcaaagttgatgggaagcgccggtaacgcaacaatctccaccgtcagctctacccagcgaaagaggcagcagtacgggaaacccaagaaacaaggaagcactactgctacccggccccccagggcattactctgccttacactgaagaatcctataaggcgggcctgcatttccatcgtggaatggaaacctttcgagatcattatcttgctgacaatttttgcgaattgcgtcgctctggcaatttatattccgtttcccgaggatgatagtaatgccactaactcaaacctcgagagagttgaatatctgtttctcataatcttcactgtcgaggccttcctcaaggtgatagcatacggcctgttgtttcatccaaacgcatatctgagaaatggctggaacctactggactttatcatcgtggtggtagggctttttagtgccatcctggagcaggcaacgaaagctgacggtgctaacgctctgggcggaaaaggtgccgggttcgacgtaaaagcgctgagagcatttcgcgtcctgcgcccactacggctggtgagtggcgtcccgagtctgcaggtggtgcttaattccataatcaaggccatggtgcctttgttgcatatcgcgctactcgtgctatttgtgatcattatttatgctatcattggtttagagcttttcatgggaaagatgcacaaaacctgctacaatcaggagggcatcgcagatgtgccagccgaagatgacccatcgccgtgcgccctggaaacgggacacggccggcagtgccagaatggtaccgtttgcaaaccagggtgggatggcccaaaacacgggattacgaattttgacaacttcgcgtttgctatgctaacagtattccaatgtattaccatggagggatggaccgacgtcctgtactgggtgaacgatgcagtcggacgagattggccctggatatatttcgtgaccctaataatcattgggtcattcttcgtgttaaatcttgtgcttggggttctgtccggagaattttctaaagagcgcgagaaggctaaggccagaggagacttccagaagctgcgtgagaagcagcagctagaagaagacctgaagggctacctcgattggattacacaggcagaagatatcgacccagaaaacgaggatgagggtatggatgaggagaagcccagaaatatgtccatgcctacttctgaaactgagtccgtgaatacagagaacgttgccggcggagatatcgagggcgagaactgcggcgccagactggcacatcgcattagtaagagcaagttttcacggtactggcgcaggtggaaccgcttttgtaggcggaagtgtagagctgcagtcaaatctaacgtgttttactggctggtcattttccttgtgttcctcaatactcttacaatcgcgagtgaacactataatcagccaaattggttaacagaagttcaggacaccgccaacaaagcgctcctggcccttttcacggccgaaatgctcctgaaaatgtactccctcggtctccaagcttatttcgtgtccttgttcaataggtttgattgcttcgtcgtgtgcggcggcatactggaaactattctggtggagaccaaaattatgtcccctctgggaatttcagtgttgcgctgtgtgagactgctgagaattttcaagattacgcggtactggaattctttgtctaacctcgtcgccagcctgctgaactctgttcggagtatagcttcgcttctcctactgctgtttctgtttattattattttttctttactaggcatgcaactgtttggagggaaattcaatttcgacgagatgcagacacggaggtctaccttcgataactttccccaatccctgctgacggtgtttcaaatcctgacaggtgaggattggaattccgtaatgtatgatggcatcatggcttatgggggcccaagctttcccggtatgctggtttgcatctactttatcattctttttatctgcggcaactacattctgcttaacgtgtttttggctatcgctgtcgataaccttgccgacgcagaaagccttaccagtgcccaaaaagaagaggaggaagaaaaagagaggaagaaactagctcgaacagcttcccccgaaaaaaagcaggaacttgtcgagaagccagccgttggagagagtaaagaggaaaaaattgagctgaagagtattacagcagatggagaaagtcctccagcaacgaaaataaatatggacgacctccagcccaatgagaatgaagacaaaagcccctatccgaatcctgagaccaccggggaggaggatgaggaagagcctgaaatgcccgtggggccgagacctcgccccttgagtgagctgcacctcaaggaaaaggcagtgcctatgcccgaggcctcggccttctttattttcagctccaataaccggtttcgccttcagtgccacagaattgtgaatgatacaattttcacaaatctgatcctgttctttatcctgctcagttcaatcagcctggctgccgaggaccccgttcaacacacgtcctttcgcaaccatattctgggtaacgccgactatgtttttacaagcatatttaccctcgagataatcctgaaaatgactgcctacggggcctttctccataagggtagcttttgtcgtaactacttcaatatcctggacctcttggtagtcagtgtatcacttatcagcttcggcatccagagttctgctatcaatgtagtcaaaatattacgggtactgcgcgtgctgcgtcccttaagagctattaaccgagctaaaggactgaaacatgtggtacaatgcgtttttgtggcgatccgaaccatcgggaatattgtgattgtgacaaccttactgcagttcatgtttgcatgtatcggcgtgcagctgttcaagggtaaactgtatacctgttctgacagcagtaaacagaccgaagccgagtgtaagggcaactatatcacctacaaggacggcgaagtggatcaccccatcatccaaccaaggtcatgggagaattctaagttcgactttgataacgttttagccgctatgatggcactgttcacagtgagtacttttgaagggtggcctgaactcctgtatcggtctatcgactcccatactgaagacaagggccctatttacaactatagagttgaaatctctatatttttcatcatctacattattatcattgctttctttatgatgaacattttcgtgggcttcgttatcgtcacattccaggagcagggcgagcaagagtacaagaactgcgagctggacaaaaatcagcgccagtgcgtggagtatgccttaaaggcccgtcccctccgaaggtacatcccaaagaatcaacatcagtacaaggtttggtatgtcgtgaactcaacctacttcgagtacctcatgtttgttctaatcttgttaaataccatatgcctcgccatgcagcactatggacagagctgcctctttaagattgccatgaatattttgaacatgctgttcacggggctgtttactgtagaaatgattctgaagcttattgctttcaagcccaagggctacttctctgatccttggaatgtatttgacttccttattgtgattggctctatcattgacgtcatattgagtgagactaaccccgccgagcacacgcagtgctctccatccatgaatgccgaggagaacagccgcatctctatcactttcttccggttgtttcgagttatgcgcctggtcaagcttctcagcagaggcgaagggattagaacgctgctgtggacttttattaagtcatttcaggccctgccgtatgtagctttgctgattgttatgctgtttttcatctatgccgtgattggcatgcaagtcttcggcaagatagccttaaatgacaccactgagatcaaccgcaataataactttcagacctttccccaggccgtgctgctcctattccgctgcgcgactggtgaggcttggcaagacatcatgcttgcgtgcatgccagggaaaaaatgcgcgcccgagagcgagcccagcaattctactgaaggggaaaccccctgtggttctagcttcgcagttttctactttatcagcttttatatgctgtgcgctttcctgattattaatctgtttgtggctgtgattatggataattttgattacctgacccgcgactggagcatccttggtccgcaccacttggatgaattcaagagaatttgggctgagtacgaccctgaagcaaaaggccggatcaagcacctcgatgtagtgacattgctgcggaggattcagccacccctgggattcgggaaattatgtccgcacagagttgcctgtaaaagactggtgtctatgaacatgcctcttaactctgatggcaccgtcatgttcaacgcaaccctgttcgctctggtgcgcaccgcactccggatcaaaaccgagggtaatctagaacaagccaacgaggaactgcgggctataatcaagaagatctggaaacgcacctcgatgaagctgctcgatcaagtcgtgcctcccgccggggatgacgaggtaactgtgggaaagttctatgcaacatttctgattcaggaatacttccgaaagtttaagaagaggaaggaacagggtctcgttggcaagccaagtcaacgaaacgcactgtcgctgcaggccggactaaggacgctgcacgacataggtcccgaaattcgcagggctatatctggggacctgacagcagaggaggagctcgacaaggctatgaaagaggccgtgtccgcagcctcggaggatgacatctttcggcgggccgggggcctattcggcaatcacgtgtcatattatcagagtgacggtcgctctgctttccctcagactttcaccacacagcggcctctgcacattaacaaggccggcagcagccagggtgatactgagagcccaagccacgagaagctggtggattcaactttcactcctagttcatacagctctacaggtagtaacgccaacattaacaatgcaaacaacaccgccctgggtcgcctcccacggccagctgggtacccttccactgtaagcaccgtggagggacatggaccgcctctgagtccggccatccgggtgcaggaggtcgcgtggaagttaagctccaataggtgccattcaagggagtcacaggccgcaatggctggacaagaagaaacgagccaagatgagacctacgaagtcaagatgaatcatgataccgaagcctgctcagagccctcattactgagtaccgagatgctttcctaccaggatgacgagaatagacaactcacactgccagaagaagataagcgcgatatccgacaaagtcctaagcggggttttctgcggagcgccagtctgggacggcgggcatcatttcatttagagtgcctcaagaggcaaaaagacagggggggcgacatttcacaaaagaccgtattacctttgcacctggtgcatcaccaggcgttggccgtggctggcttgtctccactgctgcaacgttcacactcgcccgcctccttcccccgaccttttgcgacacccccagctacacccggaagccgaggctggccaccccagcctgtgcctacccttagactggagggggtcgagtcgtctgaaaaattaaatagctcatttccatcaatccattgtggctcctgggctgagaccacaccagggggaggcggaagcagtgccgccaggagggtcagacccgtctccctcatggttcctagccaagccggggcccccggaagacaattccatggctctgcttcttccctcgtggaggctgtgttaattagcgagggattagggcaattcgcccaggacccaaaatttatcgaggtcaccacgcaggagctggccgacgcttgcgacatgaccattgaagaaatggaaagtgcggctgataacatcctgtccggaggcgccccgcagtctcccaacggcgcccttttaccatttgtgaactgccgcgatgcagggcaggacagggccgggggggaggaggacgcaggctgtgtgcgggcgcggggcagacctagtgaagaggaactgcaagactcgcgcgtctacgtatccagtctttag

SEQ ID NO: 181227 - DNA, 6435 bp, Artificial Sequence
  Description of Artificial Sequence: Synthetic coding sequence
atggtgaacgagaacacccggatgtacatccccgaggagaaccaccagggctctaactatgggagcccacgcccagcacacgcaaacatgaacgcgaatgccgccgccggccttgcacccgagcatattcccacaccgggcgctgctctttcctggcaggctgcgatcgacgccgcccggcaggctaaactaatgggctccgcaggcaacgcaacaatttccactgtgtcctcaactcaaagaaagcgccagcagtacggcaaacctaagaagcaggggtcgactaccgcaactcgtccaccaagggcgcttctatgtctgacattgaagaaccccatcaggcgcgcctgcatctctatcgtggagtggaagcctttcgagatcattatcttgcttacgatctttgccaactgcgtcgccctcgccatttatataccatttcctgaggatgactcgaacgcaaccaacagtaatcttgaaagagtcgagtaccttttcctgattatctttacggtggaggcttttctcaaggttattgcttatggtcttctgttccaccctaacgcctacctgaggaacgggtggaacctgctggatttcattattgtggtggtcgggctgttttctgccatcctggagcaggccaccaaagctgacggagcaaatgcactggggggtaaaggcgctggtttcgacgtaaaagcactgagagcatttcgcgttctgcgtcccctcagactggtgtctggggtgccaagtcttcaggtggtcctgaacagcattattaaagctatggtgcctctcctacatattgctctacttgtactgttcgtaatcatcatctatgctatcattggactggaactctttatgggcaaaatgcataaaacctgctacaatcaggagggcatcgctgacgtgcccgctgaggacgatccatcaccatgcgctcttgagacaggtcacggtaggcaatgtcagaacggaactgtatgtaagccaggctgggatggacctaaacacggaatcaccaacttcgacaatttcgccttcgcgatgctgacggtcttccaatgtataacgatggagggttggacagacgtcctctactgggtgaacgacgccgtcggaagggattggccctggatctatttcgtcaccctcatcataataggctccttcttcgtgctgaatcttgttttgggagtcctgagcggagaattcagcaaagagcgtgagaaagctaaagctcgcggagactttcagaagttaagagagaaacaacaactagaggaggacctgaagggttatctagattggattacgcaggccgaagacattgatcccgagaacgaggacgaaggaatggacgaggagaaacctcggaacatgagtatgcccacaagcgagacagagtctgttaacactgaaaacgtggcaggaggggatatcgagggggaaaactgcggtgctaggttggcccatcgcatcagcaagtcaaaattctccaggtactggcggaggtggaacagattttgtcgtcggaaatgccgggctgcagttaaatccaacgtgttctactggctggttatctttttagttttcctgaacacactaaccatcgcctctgagcattacaatcagcccaactggctgacagaagttcaagacactgctaacaaagctctgctggcactgtttactgcggaaatgttactaaaaatgtactcactgggcttgcaggcctatttcgtaagtctatttaaccgctttgattgttttgttgtgtgtgggggtattttggagaccatactagtggagaccaagatcatgtcacccctggggatttcagtgttgaggtgcgtacggctgcttcgtattttcaaaattacaaggtactggaactcccttagcaatttagtggcttcacttttgaattctgtccggagcatcgcttctttgcttctgctgttattcctcttcattatcatcttttctcttttgggcatgcagctcttcggcggtaaatttaatttcgatgaaatgcaaacacgtaggtcaacctttgataactttccacagagtctcctaactgtcttccagatcctgaccggtgaggactggaattccgtgatgtacgacgggattatggcctatgggggccccagcttccccggaatgctagtgtgcatctactttatcattctttttatttgtgggaactatattctgctgaatgtctttctggcaatcgccgtggataatctggcagacgccgaatctctcactagcgcccagaaagaagaggaggaggagaaggagcggaaaaaacttgcaagaactgcgtctccagaaaagaaacaggaactggttgaaaagccggccgtgggagaaagtaaagaggaaaagatcgagctgaagagcattacggcggacggcgaatctccccctgctaccaagattaacatggacgacttgcagcccaatgaaaacgaagacaagtccccatatcctaacccggagaccacaggcgaagaggacgaggaggaacccgaaatgcccgttggccccaggccaaggccgttgtcagagcttcacctgaaagagaaggctgtgcctatgccagaagccagcgctttctttatcttcagctctaacaacaggttccgacttcaatgtcaccgcatagttaacgataccatttttactaatcttatcctatttttcattctcctgtcttctatcagcttggcagctgaggacccagtgcagcacacgtcctttaggaaccatatcttattctacttcgatattgttttcacaactatttttactatagagatcgctctgaaaatgacagcgtacggcgccttcctgcacaaggggagtttttgtcggaattattttaatatcctagacttattagtggttagcgttagcttgatttctttcgggatccaatctagcgccatcaacgttgtgaagatactcagggttctgagggtcttaaggcccctgcgcgccatcaaccgcgcgaagggactcaaacacgttgttcagtgcgtgtttgtcgcgataaggaccatcgggaacattgttatagtgacaaccctgctccagttcatgttcgcttgtattggcgtgcaacttttcaagggaaaactgtatacatgctcagatagctctaagcaaacagaggcggaatgcaagggtaactacatcacgtacaaagacggggaggttgaccacccgattattcagccccggtcttgggagaactccaagttcgactttgacaacgtgttggccgccatgatggctctgttcacagtctcaactttcgagggatggcctgagctgctgtacagaagtatagatagtcacaccgaggacaaggggcccatttataactatcgggtggagatctcaattttcttcatcatctacatcatcatcatcgcattctttatgatgaacatcttcgtgggctttgtaattgttacctttcaggagcagggggaacaggagtacaagaactgcgaacttgacaagaaccaaaggcagtgtgtggagtacgccctgaaggcccgaccgttgcgacgctatatcccaaaaaaccagcaccagtataaagtgtggtatgtggttaactcaacatatttcgagtaccttatgttcgttctgatcctcctcaatactatctgtctggcgatgcagcactacggacaaagctgtctctttaagattgctatgaacatcctgaacatgctctttaccggccttttcacagttgagatgatccttaagctgatcgcctttaaacctaaacactatttctgtgatgcctggaacacctttgatgctcttatcgtcgtgggtagtattgtagacatcgcaataaccgaaaacgccgaagaaaatagccgtatctccattacgttctttcgtttatttagggtgatgcggctagtgaaactcttaagtagaggtgagggaatacggaccttactgtggacatttattaagtcgttccaggctctgccttatgtggccctcctaattgtgatgctctttttcatctatgccgtcattggaatgcaggtgttcggcaaaattgccctgaacgacacgaccgaaatcaatcgtaataataattttcaaacctttcctcaggctgttcttctgctctttaggtgtgcaaccggagaggcttggcaggatatcatgctagcctgcatgcccggcaagaagtgcgcacccgaaagcgaaccgagtaatagtactgaaggcgagaccccatgtgggtcatcttttgcagtcttctattttatttccttttacatgctttgcgccttcctaatcataaatctctttgtggccgtcatcatggataattttgattatctgacgagggactggtccatcctggggccgcaccatctagatgaattcaagagaatttgggcagaatacgatcccgaagctaaaggacgaatcaagcacctggatgtggtaaccctcctgagacgcatccaaccccctctgggctttggaaagttatgtcctcaccgcgtcgcttgcaaacgtctcgtttcaatgaatatgccactcaacagtgatgggacggtcatgttcaacgcaacattgttcgccctggtgaggacagcactcagaatcaaaaccgaggagggtccttccccgtctgaagcccatcaaggtgccgaggatccattccgccccgctggcaacctagaacaggccaacgaagagctcagggctatcattaaaaaaatttggaaaaggacctctatgaaacttctagatcaggtggttccacccgccggagatgacgaggtgacagtgggtaagttttacgcaaccttccttattcaagagtattttcggaaattcaaaaaaagaaaagagcagggattggtgggaaaaccaagccagagaaatgccctgtctttacaagctgggcttagaaccttgcatgacattgggccagaaattcgaagagcgatatccggggacttaaccgccgaagaggagttagacaaggccatgaaggaagccgtgtctgccgcatccgaagacgacatcttccggcgagccggcggcctcttcggcaaccatgtttcctactatcagtctgatggccgaagcgcgttccctcagacattcacaacccaacgccctctacatatcaataaggccggatccagtcaaggcgacaccgaatcaccttcgcatgaaaaattggtggactccacctttacacccagcagttattcaagcactggatctaatgccaatattaacaatgctaacaataccgcactggggcgattgccaaggcccgcagggtacccctctacggtgagcacagtggagggccatgggccaccattgagtcctgccatccgggtccaggaggtggcgtggaagctctcatcgaaccgctgccacagcagggagtcacaggccgctatggccggccaggaggagacctctcaggatgagacatacgaagtcaaaatgaatcatgatactgaggcatgcagcgaaccttctctattgagcaccgaaatgctttcgtaccaggacgacgaaaatagacagttgacactaccggaagaagacaagcgggatattaggcagtcaccgaaaagagggtttctccgctccgccagtttaggccggcgggctagttttcatcttgagtgcctgaaaaggcagaaggacagaggaggcgacatatcccagaaaaccgtgttgcccctgcatctggtccaccaccaggcactggccgtcgctggccttagtcccttgctccagaggtcccattcccccgctagcttccccagaccattcgctacacctccggccacgcctggatcacgcggatggccaccacagcctgtccctaccctgcggcttgagggagtcgagtcatcagaaaagctaaacagctcatttccctcgattcattgtggtagttgggcagaaaccacccctggcggaggtgggtcctcagccgcgcgaagagttcggccagtgagcctcatggtacctagccaggctggtgcgccaggaaggcagttccatggtagcgcatcctcactggtggaggctgtactgatatcggagggattgggccagttcgcacaggaccctaagttcattgaggtgactacgcaggagctggcagatgcctgtgacatgacaattgaggagatggagagcgccgcagacaatatactgtccgggggcgcaccacagagtcccaacggcgcgctgttgcctttcgtgaattgcagagatgccggacaggatcgcgctggaggggaggaggacgcaggctgtgtccgcgcccgggggaggccttccgaggaggaacttcaggatagccgcgtgtatgtttccagcctctag

SEQ ID NO: 181228 - DNA, 6417 bp, Artificial Sequence
  Description of Artificial Sequence: Synthetic coding sequence
atggtgaacgagaacacccggatgtacatccccgaggagaaccaccagggttcaaattacggctccccgcggccagcacatgcaaatatgaacgctaatgctgccgccgggctggcccctgaacatattcctactccgggggccgccctgtcctggcaagccgcgattgatgcggctcgacaggccaagctcatggggtcagcgggcaacgccacaatctccacagtgagctccacacagagaaagcggcagcaatacggcaagcccaaaaagcaaggctcgacaaccgcaactcggccgccgcgggccctattgtgcctgaccctgaagaatcctatccgccgggcgtgtatcagcatcgtggaatggaagccattcgagattattatcctcctcacaatctttgccaactgcgtcgcgctggccatctatatccctttccccgaagacgactcgaatgctaccaatagcaatctggagcgcgtcgagtacctgttcctgatcatcttcaccgtggaagccttcctcaaggtgattgcctacgggctcttattccaccccaacgcttatcttaggaacgggtggaatctgctcgattttattatcgttgtggtgggtctgttctccgccattcttgaacaggctactaaggccgatggagctaacgcgctgggcggcaaaggagccggctttgatgtgaaagcattgcgggctttccgcgtacttagacctctccgcctcgtaagtggggtgccctcacttcaagtcgttctgaacagcataattaaggcaatggtgccactgttgcacattgctttgctcgtgctgtttgtcatcatcatatacgccataattggtctcgaattgttcatgggtaagatgcataaaacatgctataaccaggaaggtatcgcagacgtacctgccgaggacgatcctagcccgtgcgctttagagaccggacacggaaggcagtgtcagaatggcaccgtctgcaagccaggctgggatggccctaaacatggaatcaccaatttcgacaattttgccttcgccatgctgacggtcttccagtgtattactatggagggatggactgatgtgctgtactgggtaaacgatgccgtcggccgtgattggccctggatttattttgtcactttgatcatcatagggtccttctttgtactaaatctggtgctgggagtgctctctggagaattctccaaggaacgggagaaagccaaagcacgcggagattttcagaaactgagagagaagcagcagctggaagaggacctgaaaggctacttggattggatcacccaagcagaggatattgatcccgagaacgaggacgagggcatggatgaagagaagcccaggaatatgagtatgcccacgtccgagactgaatcagtgaacacagagaacgtggcaggaggggatattgagggagaaaattgcggcgcgcggctggcgcatagaatttcaaaatccaagttctcacggtactggaggagatggaacaggttctgtcggagaaagtgtcgagccgcagtgaagagtaatgtgttctactggctggttattttcctggtttttttgaacactctgacgatcgcttctgaacactataatcagcccaactggctcacggaagtacaggataccgccaataaggcacttctggcactgtttaccgccgaaatgctgcttaaaatgtactccctcggactccaggcatattttgtctccctttttaataggttcgactgcttcgtagtgtgtgggggcattctcgaaactatattggtcgagaccaagatcatgtcacccctggggattagcgtactgaggtgcgtgaggctcctgagaatcttcaagattacaagatactggaattccctttccaacctcgtcgcttcgctgctcaatagcgtgcgctctatagcatccctgctgcttctgctcttcttatttattatcattttctccctgttagggatgcagctcttcggtggaaagttcaatttcgacgagatgcagacaaggagatccacattcgacaattttccccagagcttactgacggtgtttcaaatcttaaccggagaagattggaactcagtcatgtacgacggcataatggcatatggcggcccttcctttcctggaatgctggtgtgcatttattttatcatcctgtttatttgcgggaactacatcttgctgaacgtgtttctggctatagcagtggataacttagccgacgccgagtccctgacatccgcacagaaagaggaagaagaagagaaagaaaggaagaagttagctcgcactgctagcccagagaagaaacaggagctggtagaaaagccagcggtcggcgaatccaaagaggaaaagattgagcttaagtcaattacggcagacggggagtctccccctgcaaccaagattaacatggatgacttgcagccaaatgaaaatgaagacaagagtccctacccgaatcccgaaacgactggcgaggaggacgaggaagagcctgagatgccggtgggcccccgccctcgtcctctatctgaattacatttaaaggaaaaagcggttcccatgcccgaagcctccgccttttttatcttttcatcgaataacagattcaggttgcagtgccaccgcatcgtgaatgatacaatttttactaatctgatactcttttttattctactttcttccatctcactcgcagccgaggaccctgtccagcacacctcatttaggaatcatatcttgttttacttcgacatcgtctttaccacaatcttcacgatcgagatcgcactaaaaatgactgcttatggcgccttcctccataaaggatcattctgtcgcaactattttaatatccttgatttgctcgtggtgagtgtttcactgatcagctttggcattcagtcatcagctataaatgtcgtgaagatcctgcgcgtgcttagagtgcttcgcccactaagggctataaacagggccaaaggattaaaacacgtagtccaatgcgtcttcgttgccattagaactatcgggaacatcgtgatcgtaacgaccttgttgcagttcatgtttgcttgtatcggggttcagctattcaaagggaaattatacacctgtagcgacagcagcaagcagacagaggccgagtgtaaagggaactatatcacctacaaggacggggaagtcgaccaccccattatccaacctaggagttgggaaaatagcaagttcgatttcgacaacgtgcttgccgccatgatggcattattcaccgtgtctactttcgaggggtggcctgagttactctatagatctatagatagccacactgaggacaagggtcccatctataactatcgagtggagatatctatcttctttatcatatatatcattataatcgctttctttatgatgaacatcttcgtgggctttgtgatcgtgacatttcaggaacaaggagaacaggagtacaaaaattgtgagctcgataaaaatcagaggcaatgcgtggagtacgccctgaaggcccgacctctcaggagatacattccaaaaaatcagcaccaatataaagtgtggtatgtggtgaattccacctacttcgagtacctcatgttcgtcctgattctcctaaatacgatctgtcttgcaatgcagcactatggtcagtcatgcttgttcaaaattgcaatgaatatactgaatatgctgtttacaggcctgtttaccgtcgaaatgatactaaagctgatcgcttttaagcctaagcactacttctgtgacgcttggaataccttcgacgcgctaattgtggtagggagcatcgtcgacattgcaattacggaagtgaaccccgctgagcatactcagtgcagtccaagtatgaacgcggaggagaattccagaatctctattacttttttccgattattcagagtgatgcgactggttaagcttctctcccgcggagagggaatcaggacgctgctctggacattcatcaaatccttccaagcactgccatacgtggcactactgattgtgatgttgttctttatttacgccgtaatcggaatgcaagtgttcggcaaaatcgcactcaacgatactaccgaaataaaccgtaacaataattttcagacttttcctcaagcggtgctgttattgtttaggtgcgctaccggcgaagcatggcaggacatcatgctggcctgcatgccaggtaaaaaatgtgcgcctgaatccgaacctagtaattcaaccgaaggtgagacaccctgtggctcttccttcgccgtgttttacttcataagtttctacatgctgtgcgcatttctgatcattaacctatttgtggccgtgatcatggacaatttcgactatctaaccagagactggagcattttgggcccacaccatcttgacgagttcaaacgaatttgggctgagtacgatcccgaagcaaaaggacgaatcaaacacctcgacgtggtgacgcttctgcgacgcatccagcctcctctgggtttcgggaagctgtgcccccaccgggtggcctgcaaacgactggtctccatgaacatgccattaaactcagatgggaccgtgatgttcaacgccactctgtttgcacttgtaagaacagcactgcgcataaaaaccgaagggaacctggaacaggcaaacgaagagttgcgggccatcatcaaaaagatctggaagcggacttccatgaaactgctcgatcaggtggtacccccagccggcgatgatgaggtgacggtcgggaagttctatgcaacatttttgatccaggaatactttaggaaatttaagaagcggaaagagcagggattagtgggaaagccaagtcagcggaatgccctcagtcttcaggctggcttgcgcactctgcacgacatcggtccagagatccggcgtgccatctccggtgatcttaccgcggaggaggaactggataaagcaatgaaggaagcagtgtcagccgcaagcgaagacgatattttccgccgggcaggtggcctgttcggtaatcatgtgagttactatcaaagcgatggccgatcagcttttccgcagacatttacaacacagagacccctgcatattaataaagcaggaagctcacaaggcgatactgagagcccttcgcatgagaaactggtcgactcaacattcaccccaagttcctactcctctacagggagtaatgccaacattaacaatgcaaataataccgctctaggccgcctgccaaggcccgcaggatatccctcaactgtgagcaccgttgaggggcacggtccgcccctcagtcctgccatccgcgtccaggaggttgcatggaagctatcaagtaacaggtgtcactcccgggagtcccaagcagctatggctggacaggaagagacctcacaagatgagacatacgaagtgaagatgaatcacgacaccgaggcctgctctgagccctccctattgtctacggaaatgctatcttatcaagatgatgaaaaccgtcagctaactttacctgaagaggacaagcgagatatccgccagtcccccaagagaggtttccttcgctccgcttctctaggcaggcgggccagcttccacctggagtgcctaaaacggcaaaaggatagaggaggggatatatctcagaagaccgtgctgcccctgcacttggtgcatcaccaagccttggcggtcgcaggtctgagccccttgctccaaagatctcattctccggccagcttccctaggcccttcgcaactccccccgccacccctggcagccgaggctggccacctcagcccgtgccaacactgcggctcgaaggtgtcgagagttcagagaagctcaactcaagttttccgagtattcactgtgggtcttgggcggagactacccctggcggcgggggcagttcagccgctcgccgcgtgcggcctgttagcctgatggtgccctctcaagccggtgcaccaggacgccagttccacgggtctgcctctagccttgttgaggcggttctgatctccgaaggattaggacagttcgcacaggatcccaagtttattgaggtgaccacacaggagttagccgatgcatgtgatatgacaattgaagagatggaatctgcagccgataatatcctttcaggaggagcaccccagtccccaaacggcgcactgctaccattcgttaactgccgggacgcaggccaggatcgtgctggtggcgaggaagatgcagggtgtgtacgggctagaggacggccttccgaagaagagctgcaggatagccgggtgtatgtgtcttctctgtag

SEQ ID NO: 181229 - DNA, 6474 bp, Artificial Sequence
  Description of Artificial Sequence: Synthetic coding sequence
atggtgaacgagaacacccggatgtacatccccgaggagaaccaccaagggtccaattatggctcacccagacctgcccacgccaatatgaatgcaaatgctgcagcaggcctggcaccagagcacattcccaccccgggcgcagccctatcttggcaggccgcaatcgacgccgcaagacaggccaaactgatgggctctgcgggcaacgcaactatctctactgtgagttctacacagaggaaaagacaacagtacggcaagccaaagaagcagggttctactacagcgacaagacctccacgcgccctgctgtgtctgaccctgaagaatcctatccggagagcttgcatttcaatcgttgagtggaaacctttcgagatcatcattctactcacaatcttcgccaactgtgtggccctggcaatttacattcctttcccagaggatgactcaaacgcaaccaattcaaatctggagcgcgtagagtacctgtttctgataatctttactgtggaggctttcctcaaggttatcgcctatgggctgctgtttcatcccaacgcctacctacgcaatgggtggaatcttcttgattttataattgtcgtggtgggactgttcagcgcaattttggagcaagcaaccaaggcagatggagcgaatgctcttggagggaaaggggctggattcgacgtcaaggccctccgcgcattcagagtcctgcggcctctacgacttgtctctggggttccatccctacaagttgtgcttaatagtataataaaagcaatggtcccattactgcatatcgcacttttggtcctctttgtcatcattatctatgcaattattgggctcgagctctttatggggaagatgcataaaacctgttataatcaagaggggattgccgatgttcctgcagaggacgacccatctccctgtgctctagagaccggacatgggcggcagtgtcaaaacgggactgtgtgtaagcctggatgggacggaccaaaacacggaataaccaattttgacaatttcgcatttgctatgctgaccgtatttcagtgcatcacaatggaggggtggacagacgtcctgtactgggtcaacgacgctgttggtagggactggccgtggatttattttgtcacgctgataatcatcggttcgttttttgtactgaacctggtcctcggggtgctgtcgggcgaattctctaaggaacgcgagaaggcaaaagcgcgcggagatttccagaagctccgcgagaagcaacagttagaggaggacctgaaggggtacctggactggataactcaggctgaggacatagacccggagaacgaagatgaggggatggacgaggaaaagcctcgcaacatgtcaatgccaactagcgagaccgagtctgttaatacagagaacgtggctggcggcgatatcgagggggagaactgcggagccagactcgcccatcgaatcagcaagtctaagttctcgcggtactggcggaggtggaaccggttctgcaggcggaaatgccgcgccgcagtaaaaagcaacgtgttctactggctcgtgattttcctggtgtttcttaatacacttaccatcgcatcagaacattacaaccagcctaactggcttacggaggtccaagacacagctaacaaagcccttctcgctctcttcactgccgagatgctgcttaaaatgtattctctcggtctgcaggcgtactttgtgtccctgtttaacaggttcgactgttttgtggtttgtggtgggattttggaaacaatcttggtcgagaccaaaattatgtctccgctcggaatctcagttctcaggtgcgttcgccttctgcggatcttcaagatcacaaggtactggaactccttaagcaatctggtggcttctctgctgaactccgtcagaagcatcgcttctctgctactgcttttgttcctctttatcattatcttctctttgctcggaatgcagctattcggcggtaagtttaacttcgacgagatgcaaacccgccggagcacattcgacaattttccacaaagcctcttaacagtttttcagattttgacaggggaggattggaactcagtgatgtatgatggcatcatggcctatggcggtcctagcttccccgggatgttggtctgcatctatttcattatactgtttatttgcggcaattacatcttgcttaatgtgtttctcgcgatcgctgttgataatcttgccgatgcagagagtctgacttccgcccaaaaagaggaagaagaagagaaggagcggaaaaaactcgcgagaaccgcttctcctgagaaaaaacaggagctcgtggagaaacccgcggtgggcgagagcaaagaagaaaagattgaactgaaatccatcaccgcggatggagaatcaccaccagcaaccaaaatcaacatggacgacctacaacccaacgagaatgaagacaagtcaccttacccgaatcccgaaaccacaggagaggaggatgaagaagagcctgagatgcctgtgggacccaggccacggcctctaagtgagttgcaccttaaggagaaggctgttccaatgcctgaagcttctgctttctttattttcagttcaaacaatcggtttcggctgcagtgtcatagaatagtcaacgatacaatatttaccaatctgatcttgttcttcattttactgtcttctatatcactcgctgccgaagaccccgttcagcacacgtcctttcggaatcacatcctgttctatttcgacatcgtgtttaccactattttcaccatagagattgccttaaaaatgacagcatacggcgccttcttgcataagggttctttctgccgtaactacttcaatattcttgatctgctggtcgtctctgtgtcgctgatctcattcggcatccaatcttcagccattaatgtggtcaaaatcttaagagttctccgagtgctgcgcccactgagggcgattaatcgcgccaagggtctaaaacatgtggtgcagtgtgtatttgttgctatccgcaccatcggcaatatcgtaattgtaaccacactgttgcagttcatgtttgcatgtatcggcgtgcagctttttaaggggaaattgtacacctgctcagacagttccaaacagacagaagctgaatgtaaagggaactacatcacttacaaagatggggaagtcgatcacccaatcatccagccccgctcttgggagaactctaaatttgacttcgataacgtgttggcagcaatgatggcattatttaccgtgtcgacttttgaggggtggccggagctcttgtaccgaagcatcgatagccacacggaggacaagggacccatctacaattaccgcgtggagatatccatctttttcatcatctacattatcattattgcattttttatgatgaacatcttcgtaggtttcgttatcgtcacatttcaggagcaaggagaacaggagtataaaaattgcgagctggataagaatcagaggcagtgcgtggaatatgcactcaaggcccgccccctgaggcgctatataccaaaaaaccagcaccagtacaaggtgtggtatgtcgtcaacagtacgtacttcgaatatctgatgttcgtgttgatcttgctgaacacaatatgtctggctatgcagcactacggacagagctgtctttttaaaattgctatgaacatcctgaatatgttgttcacaggtctctttaccgttgagatgatcttaaagctcatcgcattcaagccaaagggctattttagtgacccctggaacgtgttcgactttctaatcgtgatcggctcaatcattgatgttatcctttcagagactaatcctgccgagcacacacagtgtagcccgtcaatgaacgcggaggaaaactcccgtattagcatcaccttttttcgactgttcagggtgatgcgcctggtgaaactgcttagtaggggtgagggcatccgaacgctgctgtggactttcatcaagtcctttcaggcattgccttacgtagcattgctgatagtgatgcttttcttcatttacgccgttatcggaatgcaagtgtttggaaaaattgcgttgaacgacacaaccgagattaacagaaataacaatttccagaccttcccccaggcagtattattattgttcaggtgtgcgaccggcgaagcctggcaggatataatgctcgcttgtatgcctgggaaaaagtgtgcccctgaatccgagccctcaaatagcacagaaggagagaccccttgcggctccagctttgccgtgttctacttcatcagcttctacatgttatgcgcatttctcatcatcaatcttttcgttgctgtgattatggataacttcgactatctgacccgcgactggtccattctcggaccgcaccatctagacgagtttaaaagaatttgggccgaatacgaccccgaggccaagggccggattaagcacctggacgtagtcactctcttgcggaggattcaaccccccctgggctttggcaagttgtgtccgcatagagtcgcttgcaagcggttggtctcaatgaacatgccactgaacagcgacggaactgtgatgtttaacgctactctattcgccttggtccgcaccgccctaaggattaagaccgaagaaggtccctcccctagtgaggctcaccagggcgccgaagacccattcaggcctgctggcaacctggagcaggccaatgaggaacttagggccattatcaaaaagatctggaagagaacctctatgaagctcctggatcaggtggtacctcctgccggggacgacgaagtgacggtcggtaaattctatgccacttttctgatacaagagtacttcaggaaattcaagaagagaaaggagcagggacttgtgggcaaaccctcccagagaaatgcgcttagccttcaagcaggcctccgtacactgcatgacatcggccccgaaattaggcgggccatcagcggagatctcaccgcagaggaagaactcgacaaagccatgaaagaagccgtgagcgcagctagtgaagatgatatctttcggcgcgctggaggattatttgggaaccatgtcagctactaccagagcgacggacggtcagcctttccacagacgttcacaacacaacggcccctccacatcaacaaggcaggatcatcgcagggggatactgaatctccctcacatgaaaaactggttgacagcacattcactcctagttcctatagctccaccgggagcaatgctaatatcaataacgccaataacactgctctcgggcgccttccgaggccagcaggttacccttccactgtgagcacagtggagggccacggtccaccactttcaccagctatccgtgtgcaggaggtggcatggaaattatctagtaataggtgtcacagcagagagtcacaggcagctatggcgggccaggaggaaaccagtcaggatgagacatatgaggttaaaatgaatcatgatacggaggcatgctctgagccatcactgttgtcaacagaaatgctctcgtaccaggatgatgaaaaccggcagctgacactcccagaggaggataaacgtgatatccgccagagtccaaaacgcggattcttgcggagcgccagccttggcaggcgagcatctttccatctggagtgtctgaaaagacagaaagaccgcggcggcgacatatcccaaaaaaccgtgttacctttacacttagtccaccaccaggccctagccgtcgccggcctgtcccctctattgcagagatcccactcgcctgcttcctttccacgaccattcgccaccccccctgctacacccggcagccgcggctggcccccgcagcctgtaccgactctgcggctggaaggagtggagagctccgaaaagctgaactcttcgtttccctcaatccattgcgggagctgggccgagaccactcctggcggcgggggtagcagcgcagccagacgcgtgcgccctgtttccctcatggtgccatctcaagctggcgcccccggccggcagttccacggttctgcctccagtctcgtggaagcggttcttatctcagaaggattaggccagttcgctcaggatccgaaatttattgaggtgaccacccaagagctagccgatgcatgcgacatgacgatcgaggagatggaatccgcggccgataatatccttagtggcggcgccccacagtctcctaatggtgctcttctgcctttcgtgaattgcagagatgctggacaggacagggccggaggcgaggaggacgcaggttgcgtacgtgcaagaggcaggcccagcgaagaggagttacaggacagccgggtgtacgtcagttcactctag

SEQ ID NO: 181230 - DNA, 6630 bp, Artificial Sequence
  Description of Artificial Sequence: Synthetic coding sequence
atggtgaacgagaacacccggatgtacatccccgaggagaaccaccagggaagcaactacggatcacccaggcctgcgcatgctaatatgaacgctaatgctgccgccggactggcacccgagcacattcctacgccgggcgcagccctttcctggcaggctgcaattgatgctgcaaggcaggcaaagctgatgggctctgcagggaacgcaaccattagcaccgtctccagcacccagcgcaagaggcagcaatacggcaaacctaaaaagcagggaagcacaactgccacaaggccccctagagcactcttgtgcctcaccctcaagaatcctatcagaagagcctgcatcagcatagtggagtggaagcccttcgagatcattatactccttacaatcttcgccaattgcgtcgctctcgcgatctatattccgttcccagaggatgatagtaacgcaactaattcaaatctcgaaagagtcgagtatttatttttgataattttcaccgtggaggcttttcttaaggtgatagcttacgggcttcttttccacccaaatgcataccttagaaatggctggaacctgctggactttatcatagtcgtcgtaggccttttttccgcaatcctcgaacaggctaccaaggcagatggagctaacgcactcggtgggaagggagcaggatttgatgtaaaagccctgagggccttccgggtgctacgcccccttcggctcgtaagtggcgtcccaagcctacaggtagtactgaactcgatcataaaagctatggtgcctctgttgcatattgcgttgctggtgctgttcgtaataatcatttacgccatcattggattggaactgttcatgggaaagatgcacaaaacatgttacaaccaagaggggattgctgacgtgcctgcagaggacgatccctccccctgtgctttggagactggtcacgggcgtcagtgccagaatggcacagtgtgtaaacccggctgggacggccccaaacatggcatcacaaacttcgacaatttcgcattcgcaatgctgacggtgtttcagtgtatcaccatggaaggctggacagacgttctgtattggatgcaggacgcgatgggctacgagctaccttgggtctactttgtcagcctggtcatcttcggaagcttctttgtgctcaacctggttctaggggttcttagcggtgaattctctaaggagcgcgagaaggcaaaggcgaggggggatttccaaaagctgagggaaaaacagcagctggaggaggacctcaagggataccttgattggatcacccaggccgaggatatcgatccagaaaatgaggatgagggcatggacgaggaaaaaccacgtaatatgtctatgcctacctccgagactgagtcagtgaacacagagaacgtggctggaggagatattgagggggagaattgcggcgcccgtctggctcatcggattagcaagagcaagttttcccggtactggcggcgatggaatagattttgtcggagaaaatgtcgcgcggctgttaaatcaaacgtcttttactggttggtcatctttctcgtctttctcaacaccctgacgatcgcttcagaacactacaatcagcctaactggctaacggaggttcaggatacagcaaacaaggcactactcgctctgtttactgccgagatgctgctcaagatgtacagtctgggtctccaggcttactttgttagcctgtttaacagatttgattgttttgtcgtgtgcggggggatcttagagaccattctcgtcgagacaaaaataatgtcacccctgggcattagtgtattgcggtgcgttaggttattgcgcattttcaagattacgaggtactggaatagcctgtccaatctggtcgcatccctcctgaacagcgtgaggtccattgcttccctgttattactgctttttctcttcattattatattttctctactcggaatgcagctgtttgggggaaagtttaactttgacgaaatgcagacccgaagatctactttcgataactttcctcagagtctccttactgtgttccagatcctgaccggggaggactggaatagcgtaatgtacgatggaatcatggcatacggaggcccctcttttcctggcatgctggtttgtatctacttcattatcctcttcatctgtggcaactatatcttgttaaatgtgttcctggcaattgctgtggacaaccttgctgacgcggaatcgctgacatcagcccagaaagaggaggaggaagaaaaagaacggaagaaactggcaagaaccgccagccctgagaagaagcaagagctggtcgaaaagccggcggtcggagagtccaaagaggaaaagatcgagctcaaatctatcacagccgatggggagtcacctccagccacgaaaataaacatggatgaccttcagcccaacgaaaacgaagataaatcgccatatcccaatccagagaccaccggggaagaggacgaggaagagcccgagatgccggtaggcccccggccaaggccgctgtccgaacttcacctcaaagaaaaagctgtccccatgcctgaagcttctgctttcttcatcttcagctcgaataaccggttcaggctccaatgccataggattgtcaatgacacaatctttaccaatctaattctgttctttatacttttgagctctattagcctggctgctgaagacccggtgcagcacacatcgttccggaatcacatcctcttctacttcgacatcgtgtttaccaccattttcaccatcgaaatcgccctcaagatgacagcttacggagccttcctccacaaagggtcattttgcagaaactacttcaacattctggacctgctggtcgtgagtgtgtcgttgatcagcttcggaatccagtcgagtgcaatcaacgttgttaagatcctgcgggtgctgagggtgctcaggccccttagagccattaatcgcgccaaagggcttaagcacgtagtccagtgcgtctttgttgccattcgtacaattggaaacatagtgatcgttactacgctcttgcagttcatgttcgcgtgcatcggagttcagcttttcaagggcaagctatacacatgttctgattcttcaaagcagacagaggccgagtgtaagggaaattacatcacatacaaagatggagaagtggaccatcccatcattcagcctagatcatgggaaaatagcaagttcgattttgacaacgtgttggctgccatgatggcattgttcaccgtatctaccttcgagggctggcctgagctcctgtatcgtagcatcgactctcataccgaggataaaggacccatttacaattatcgagtagagatatcaattttttttataatatacatcatcataattgccttttttatgatgaatatctttgtcggttttgtgatagtcacgttccaggagcagggggagcaggagtacaaaaactgcgagctcgacaaaaatcagcgtcagtgcgttgagtacgccttgaaggcaagaccactgcgtaggtacatccccaaaaaccagcaccaatataaggtgtggtatgtggtaaacagtacctatttcgaataccttatgtttgtactgatcctgctcaacacaatttgtctagcaatgcaacattacggacagtcttgcctgtttaagatagcgatgaatattctaaacatgctgtttacagggttattcaccgtcgagatgatcctgaaacttatagccttcaagccaaaggggtacttctccgacccctggaacgtgtttgatttccttattgtcataggctctataattgacgttattttgtccgagaccaacccagccgaacacacccagtgcagtccctctatgaatgctgaagagaactcccgcattagcattaccttctttcgcctcttcagagtgatgagactggtgaagcttctgagtagaggggaaggaattcggactctcttatggactttcataaaatcctttcaggcactgccgtatgtggcccttctgatcgtgatgctcttctttatctacgctgtgatcggaatgcaagtgttcgggaagatagcccttaacgacaccacagaaattaatcgaaataacaatttccagacttttccacaggcggtcctgctgctcttccgatgcgcaacaggcgaggcttggcaggacatcatgttggcatgcatgcccgggaagaagtgtgccccggagtccgaaccaagcaatagcacagaaggcgagaccccctgtggatccagcttcgcagtattctatttcatttctttctacatgctgtgcgcattcctgatcattaatctgtttgttgccgtgattatggacaacttcgactatctgactcgcgattggtctatccttggacctcaccatctcgacgagttcaaacgtatttgggcagagtacgaccccgaggcgaaaggccgcattaagcacctggacgtggttacacttctccgaagaattcagccacctctgggtttcggcaagttgtgccctcatcgcgtggcctgcaagcgactcgtgtcaatgaacatgcccttgaattctgatggtacagttatgtttaacgctaccttgtttgccctcgtgcggacggcccttcgtatcaagactgaagggaacctggaacaagccaacgaagaactgagggctataattaagaagatatggaaaaggacatctatgaaattgttagatcaggttgttccgccggccggggatgatgaagtgacagtgggcaaattctacgccacttttctcatccaggaatattttagaaagtttaaaaaaagaaaagagcaagggctcgttgggaagccatctcagagaaacgccttgtctctacaggcaggcctccgcacgttacatgatataggccctgaaatcagaagagccatctcaggggacctcacagcagaggaggagctggataaggcaatgaaagaagctgtaagcgcggcaagcgaggacgatatctttaggagagcggggggtctgtttggaaatcacgtatcctattaccagtctgatggaaggtccgcttttccccaaactttcaccactcagagacctctgcacattaacaaagctggcagctctcagggtgacacagaaagtcctagccacgagaagctggtcgatagtacctttactccgtcaagttattcttcaactgggagcaatgctaacatcaataacgcaaataacaccgccctaggtcgtttacctcgccctgccggatatccttccactgtgagcactgttgagggccacgggcctccactatccccagcaattagagtccaagaagtcgcctggaaattgagttcgaaccggatgcattgctgtgacatgctcgatggtggcacgtttccccccgccttgggccctcgcagagccccgccatgcctccatcaacagcttcaaggttcgctggcagggttgagagaggatacaccttgtattgtccccggacatgcgtctctatgttgctcttcaagggttggtgagtggcttccggccggttgtacagctccacagcacgcgcggtgtcacagccgcgagagccaggcagcaatggcaggccaggaagagacctcccaagatgaaacttacgaggtcaagatgaaccatgatactgaagcatgtagtgagccgtccctcctgtcaaccgaaatgctctcataccaggatgatgaaaataggcagctcacactgcccgaggaagataaacgcgacattagacagagtcctaaacgggggttcctcagaagcgccagcctaggccgtcgggctagttttcaccttgaatgtctcaagcgacagaaggaccgaggaggtgacatatcacagaaaacagtcctgccacttcacctcgtccaccatcaagccctggccgtggccgggctctcacctctactgcagcggtcacacagtccggccagcttccctaggcccttcgccactccgccagcaactcccgggtctcgggggtggcccccacaacccgtgccaaccttgaggctcgagggcgtagaaagtagcgaaaaattgaatagtagtttccctagtatacactgcggctcttgggccgagactacccccggtggcggagggtctagcgccgcccggagggtgcgcccagtgtccctgatggtgccatctcaggctggggcccccggccgccagtttcacgggtctgcctcatccctcgtggaagctgttcttataagcgaaggcctgggacagtttgcccaggaccccaagtttatcgaagtaacaacacaggaactggcggatgcatgcgacatgacaatagaagagatggagtcagctgcggacaacatcctttccgggggggcacctcaaagcccaaatggcgcactgctccctttcgtgaactgtcgcgacgctggtcaggacagagcaggcggtgaggaagacgcgggatgcgttcgggctaggggccgaccatccgaggaggaattgcaggacagccgggtttacgtgtcctccctttag

SEQ ID NO: 181231 - DNA, 3840 bp, Artificial Sequence
  Description of Artificial Sequence: Synthetic coding sequence
atggtgaacgagaacacccggatgtacatccccgaggagaaccaccaggggtctaattacgggagtccacgcccagctcatgccaacatgaatgccaatgctgcggctgggttagcaccagaacacatccctacacccggtgccgccttatcctggcaagcagccattgatgccgctagacaggccaaattaatgggcagcgcgggcaacgccacgatctccaccgttagcagtacacaacgcaagagacagcagtatggaaaaccaaagaaacagggtagcacaactgctaccagacctccgcgagccctgctttgcctgactcttaagaatcctatcagaagagcttgtattagcatcgtggaatggaaaccattcgaaattataattctcttaaccatattcgctaattgcgtcgccctggcgatttatatccccttccccgaggatgattcgaacgcgactaattctaatctcgagagagtggaatacctcttcctcatcatcttcaccgtggaggctttcctgaaggtgatcgcatatggattgttgttccaccccaatgcatacctgaggaacggttggaatctgcttgattttatcattgttgtggtgggcttgtttagtgctatcttggagcaggcaaccaaagccgacggcgccaatgcactgggaggcaagggcgcaggatttgacgttaaggctctcagggctttccgggtgctgagacctctgaggctcgtgtctggagtgccttccttgcaagtagtgcttaattccataattaaagctatggtgccactgctccacatagctctgctggtgctattcgtgattattatctatgcaattataggattagagctctttatgggtaagatgcataagacttgctacaatcaggagggcattgccgatgttcctgcggaagacgacccaagcccatgcgctctggaaacagggcacggtcggcagtgccaaaatggtaccgtgtgcaaaccaggctgggacggccctaaacacgggattacaaacttcgataattttgcgtttgcaatgctcaccgtcttccagtgcataaccatggaagggtggacagacgtcctatactgggtcaatgacgccgtcggaagggactggccgtggatttacttcgtcacccttatcatcatcgggagctttttcgtgctcaacctggtgctcggcgttctgtctggggaattttctaaagagcgcgaaaaggccaaagccagaggagatttccagaagttgcgcgagaagcagcagctagaggaggacttaaaagggtacctggactggatcacacaagccgaggacatcgatcccgagaatgaggatgaaggtatggacgaagagaaacctaggaatatgagcatgcccacatctgagaccgaatccgtgaacaccgagaacgtggcgggcggcgacattgaaggcgaaaattgcggtgcccgtctggcccatcgaatatcaaaatctaagtttagtcgctactggcgtcgctggaatcgtttttgccgccgtaaatgcagagccgcagtgaagagtaatgtattctattggctggtgattttcctggttttcttaaataccctcacaatcgcgagtgagcattacaaccagcccaattggcttacggaagtgcaggataccgccaataaagctctgctagcattgtttaccgccgagatgctcttaaagatgtactcactgggcctacaggcctactttgtttccttattcaaccgcttcgattgctttgtggtgtgcggaggcatcctcgaaactattcttgtggagaccaagataatgagtccgctcgggatcagtgtccttcgctgcgtgagactgctccgcatcttcaagattacccgatattggaattcgttatctaatttggtagcttctctgctgaactcggtcagatccatcgccagcctgctcctgctcctcttcttattcataatcatcttcagtcttttgggcatgcagctctttggcggtaagttcaatttcgacgagatgcagacgcgacggtcaacgtttgataactttccccaatctcttttaaccgtgttccagattttaacgggcgaggattggaactctgtgatgtatgacggtatcatggcctacggcgggccatcattccccggcatgctggtgtgtatctactttatcatcttattcatctgcggcaattacatccttcttaacgtgttcctcgctatcgctgtagataacctggcggatgccgaatccctgactagtgctcagaaagaagaggaagaggaaaaggagcgcaagaagctagcccggaccgcctcgccggagaagaagcaagaactcgtcgaaaaacctgcagtgggggaatcgaaggaggagaagattgagctcaagtccataactgcagacggggagtcaccaccggccaccaagattaatatggacgatctgcagccaaacgagaatgaagataagtccccttatcccaatccagagacaacaggggaggaggacgaagaagagcctgaaatgccagtcgggccacgacccagacccctgagcgagctgcacctgaaggagaaggcagtcccgatgcccgaagccagcgctttcttcattttttcctccaataacagatttagactacagtgtcataggatcgtgaatgataccattttcaccaacctgatcttattttttattctgctgagctccatcagcctggctgctgaggaccctgtccaacacacctctttcagaaatcatatacttggaaatgctgattacgtgtttacctcaatttttacgcttgagataatactcaaaatgactgcctacggtgcctttctgcataaagggagtttctgccgcaattactttaatatccttgacctgcttgtggtgagcgtgtctttgatctcctttggtattcagagttctgcgattaacgtggtcaagattctgcgtgtcctccgggtgctgcggcctttgagggcgattaaccgggccaaggggttaaaacatgtcgtccagtgcgtcttcgtggcgattaggaccatcggcaatatagttatcgtgactactctgttgcagttcatgtttgcctgcattggtgttcagcttttcaagggaaaactctacacttgttccgactcgtctaaacagacagaggcggagtgtaaagggaattatatcacgtacaaggacggggaggttgaccacccgatcatccagccaaggtcctgggagaattctaaattcgatttcgacaatgtcctagccgccatgatggccctgttcaccgtgagtacatttgagggatggcccgagctcctttacaggagcatcgactctcatacagaggataaagggcctatctacaattacagagtggagatctcgatttttttcattatttatatcatcataattgcgttcttcatgatgaacattttcgtcggcttcgtaatcgtcactttccaggaacagggggagcaggaatataaaaattgcgaactcgacaaaaatcaacgccagtgcgtggaatatgcgcttaaagcgaggccacttcgtcgctatattcccaaaaatcaacaccaatataaagtatggtacgtggttaacagtacatactttgagtacctgatgttcgttttgatactgttgaacactatctgtttggccatgcagcactatggccagtcctgcctgttcaaaatagctatgaacatcctcaatatgctgtttacaggtctgtttaccgtcgaaatgatcctgaaactcattgcgttcaaacccaaagtggggctgtag

SEQ ID NO: 181232 - DNA, 6546 bp, Artificial Sequence
  Description of Artificial Sequence: Synthetic coding sequence
atgatgatgatgatgatgatgaagaagatgcagcaccagcggcagcaacaggctgaccacgcgaatgaagcaaactacgctcgaggaaccagattgcctctgagcggcgagggccccacgagtcaacctaacagttcaaagcagacagtcctgtcatggcaagcagctattgatgccgcccggcaggctaaagcagctcagaccatgagtacatctgccccacctccggtcggatcgttaagtcaacgcaagagacagcagtacgccaagagcaagaagcagggtaattcctccaactcccgcccagccagagcgttattttgtttatcactcaacaatcctatacgtagagcttgcatttccatcgtggaatggaagccttttgacatctttatcctgctggccattttcgccaattgcgtggctctggccatctatatcccatttcccgaggatgactcaaatagtacaaatcataaccttgagaaggtcgaatacgctttcctgatcatctttacagtagaaaccttcctgaagatcatcgcttacgggcttttacttcacccgaacgcctatgtgcgtaatgggtggaacctgttggatttcgtcatcgtgatagtgggcttgttttctgtgattttggaacaactaactaaagaaacggagggcggtaatcattcatcgggaaagtccggcggattcgacgtaaaggccctgcgtgccttccgcgtgcttaggccattacggctggtttcaggagttccatcgctgcaggtagtcctcaactcaataataaaagccatggtgcctctgcttcatattgcactattggttctgtttgtgattataatttacgctatcatcggcctagagcttttcattggaaaaatgcataagacatgtttctttgctgacagcgatatcgtcgcagaagaagatcctgcgccctgtgctttcagcggcaacggccgtcagtgcacggccaacgggacagagtgccggtccggatgggtaggtcccaacggggggatcacaaactttgataactttgcgtttgcgatgctgacagtattccaatgtatcactatggaggggtggacagatgtcttgtattgggtaaacgatgcaattggctgggaatggccatgggtctactttgtttctctgatcatactgggctccttcttcgtcctgaaccttgtgctgggagtgttatcaggagaatttagcaaggagagagagaaggccaaagcacggggagattttcaaaagctcagagagaaacagcagctggaagaggacttaaaagggtacctggactggatcacccaggccgaggatatcgaccctgaaaacgaagaagaagggggcgaggagggaaagcgtaatacaagtatgcctacttccgagaccgaatcggttaacacggaaaacgtgtccggtgagggcgagaatcggggctgctgcggttccctctggtgttggtggcgtcgacggggagccgcaaaggcaggaccgagtgggtgccgccgatggggacaggccatcagcaaatccaagctgtcaaggagatggcggcgatggaaccgattcaataggcgtcggtgtagagctgcagtgaaatctgtgaccttctactggcttgtcatcgtgctcgtatttctgaacactctgacaatcagcagcgaacattacaatcagcccgactggctgacccagattcaggatattgctaacaaggtccttctggccctgtttacctgcgagatgctggtcaagatgtattcacttggtcttcaagcttacttcgtgtccctgtttaatcggttcgactgcttcgtggtctgcggtggaatcactgaaacaattttggtggagctagagattatgtccccacttgggatcagcgtgtttcgctgtgttagactgctgaggatctttaaggtcactcgccactggacctctttgtcaaacttggtggcttccctcctcaattctatgaagtctatagccagtcttctgttactgctctttcttttcattattattttttccctgctcggcatgcagctcttcggtgggaagttcaatttcgatgagactcagacaaaacgaagcacgttcgacaacttcccccaggctctgctgaccgtgttccaaatcctgacgggggaagattggaatgctgtgatgtacgacggaatcatggcttacggcggtcccagttcatctgggatgatcgtctgtatctacttcatcatcttatttatctgcggaaactacattctcctcaacgtattccttgctatcgctgtcgacaacttggcagacgcagaaagcctcaacaccgcacagaaggaagaggccgaagaaaaagaacgcaagaaaatcgctcgcaaggagtcgctggagaacaagaagaataacaagcctgaggtgaatcagattgcaaactccgacaacaaagtcaccattgatgattaccgggaggaagacgaggataaagacccctatccaccgtgcgatgtgccagtgggagaagaggaagaagaagaagaggaagatgagccagaggtgcccgccggccctaggccaagaagaatatccgaactcaatatgaaggaaaagatagcccctatccccgagggcagcgcctttttcatcctctcaaagacgaatccaatcagagtggggtgtcataaactaattaatcaccacatttttacaaatctgattcttgtatttattatgctaagctcggctgcacttgccgcggaagacccaatccggagtcattcttttcgcaatacaattttgggatactttgattacgcattcactgctatcttcacggtcgagatcctgttaaaaatgaccacctttggggcttttctgcacaagggcgccttctgccgcaactatttcaaccttctcgacatgcttgtcgtcggcgtgtctctcgttagttttgggattcaatctagcgctatttctgtggtgaaaattctgagagtacttagggtcctcagaccactacgagctatcaatagggctaaagggcttaaacacgtggtccagtgcgtttttgtggcgatccgcaccattgggaatattatgatcgttaccacactgcttcagtttatgttcgcatgcatcggcgtgcagttgttcaaaggcaagttctaccggtgcacagatgaagccaagtctaaccctgaggagtgtcgcggcctgtttatcctgtacaaggatggggatgtggactcaccagtggttagggagcgtatttggcaaaatagtgacttcaatttcgacaatgtgctgtctgctatgatggcactgtttacggtatctacctttgagggatggcccgcactcctgtataaggccattgattccaatggcgagaatatcgggccaatctataatcacagggttgagatttccattttttttattatctacattatcatcgtggcctttttcatgatgaacatttttgtgggtttcgtcatcgtcacattccaagagcagggagaaaaggaatacaagaactgtgagctcgataagaaccagcggcagtgtgtggagtacgcgttaaaagctaggcccttgaggcggtatatacctaaaaatccgtatcaatacaaattctggtacgtggttaattcgtctccttttgagtatatgatgttcgtgctgatcatgttgaataccctttgccttgccatgcagcattatgagcagagtaaaatgttcaatgatgctatggatattctgaacatggttttcacaggcgtctttaccgtagaaatggtgctgaaagtcatagctttcaagcctaagggttatttttccgacgcgtggaatacattcgattccctgattgttattgggtcgatcatcgatgtggcactgagtgaggctgacccgaccgagtctgaaaacgtgcccgttccaacagccactcccggcaatagcgaggaatcaaatcgtattagcattaccttttttcggctgttcagggtgatgaggctggtaaaactgttaagtagaggtgaaggcattagaacgctcctttggacattcatcaagtcctttcaggccctgccatatgtcgcacttctgatcgctatgctcttctttatttatgcagtgataggcatgcaaatgttcggtaaagtagcaatgcgagacaataaccagatcaacaggaataataactttcagacattcccccaagccgtgttgctgctctttcggtgtgccactggagaagcctggcaggaaatcatgctcgcctgcttgccaggcaaattgtgcgatcccgagagcgactacaatccaggagaggaatacacatgcggaagcaactttgccatcgtgtattttattagcttttatatgctatgcgcctttctgataattaacctattcgttgctgtgataatggacaacttcgactacctgacccgtgactggtctattttgggtccacaccacctggatgagtttaaaagaatctggagcgagtacgatccagaagcaaagggccgtatcaaacatctagacgtggtgaccttgttgcgccgcattcaacccccacttggattcggcaagctctgcccacatcgggtggcttgtaaaaggttggtagctatgaatatgcctctaaacagtgacggtacagtgatgttcaatgctacattgtttgctctggtgagaaccgcattaaagatcaagacagaaggcaacttagagcaggctaacgaggaactgcgagcagtcataaagaaaatctggaagaaaacaagtatgaaactcctggatcaagtcgttccccccgcgggcgacgacgaagtcactgttggaaagttttatgcaacgtttctcatccaagactatttccggaagtttaaaaaaaggaaggagcaaggtttggttggaaaatacccagccaaaaacaccactatcgcactgcaagccggtcttagaactttacatgacattggccccgagatacgtcgcgccattagttgtgatcttcaggacgacgaaccagaggagacaaaacgtgaagaagaggacgacgtgtttaagcggaatggagcccttctgggcaaccacgtgaatcacgttaattcggaccggagagattcactacagcagacaaatacaacccaccgtcccctgcacgtgcaaaggcccagcatccctcctgcaagcgatactgaaaagccactgttccctccagccggtaactctgtctgccacaaccatcacaaccataactcgattggaaaacaggtgccaaccagtacaaacgcaaacctaaataatgctaacatgtccaaagctgcccacgggaagcggccaagtatcggcaatctggaacatgtgagcgaaaacggccaccattcctctcataaacacgaccgtgaacctcagcgccgctcctccgtgaaaagaaccagatattatgagacctacattagatccgattccggcgacgagcagctcccaacaatctgtcgagaagatccagaaattcatggatattttcgcgatccgcattgcttaggggaacaagaatattttagtagtgaggaatgttatgaggacgacagcagtcccacatggagtcgtcaaaactatgggtattacagtagataccctggccgaaatatagatagtgaacgccctcgcggataccatcatcctcaggggtttcttgaggacgacgactctcctgtgtgttatgacagtagacgcagccctcgcagaagactgctcccaccaacaccggcctcccaccgtagaagtagcttcaattttgagtgtctccggaggcaaagcagccaggaggaagttccatcttcccccattttcccccacaggactgccctccccctgcacctgatgcagcagcagatcatggcggtagctgggctggacagtagcaaggctcagaaatattccccgagccatagcacacgctcctgggctacacctccagccacaccaccgtatcgtgattggacaccgtgttacaccccattgattcaggttgaacagtctgaagccctagaccaggtgaatggttctctgcctagcctgcaccgctcgagttggtacacagacgaacccgacataagttacaggactttcactcctgcttcactgactgtgccttcctctttccgaaataaaaattcagacaagcagcgttctgcagattccctcgttgaagcagtcctgataagtgaggggctgggtaggtatgcacgtgaccctaaattcgtgtctgccacgaaacacgagatagctgacgcttgcgacctgacaatagacgaaatggagtcagccgcctctactctgttgaacggtaacgtccggccaagggcaaatggagacgtgggcccgttgtcccaccgccaagactatgagctccaagatttcggccccggctactcagacgaagagcccgacccaggccgtgacgaggaggatctggcagacgagatgatctgcattacgacactgtag

SEQ ID NO: 181233 - DNA, 6486 bp, Artificial Sequence
  Description of Artificial Sequence: Synthetic coding sequence
atgatgatgatgatgatgatgaagaagatgcagcaccagcggcagcagcaggctgatcacgccaacgaggcaaattacgccagaggcactcgcttaccactttccggcgagggtcccacttctcagcccaactcgagcaagcagacagtcctatcctggcaagctgccatcgacgcggctaggcaggccaaagcagcccagacgatgtcaacaagcgcgccccctccagtcggaagcctttctcagcgcaaaaggcagcagtatgccaagtctaagaaacagggaaactcgtccaattctaggccggcaagggccctgttttgtcttagcctgaataatcccatccggcgggcctgcatctcaatcgttgaatggaaaccgtttgacatcttcatcttactggccatatttgctaactgtgtcgccctcgcaatttacataccttttcccgaagacgattcgaacagcacaaaccacaacttggagaaggtggaatacgcgttcctcattatttttaccgtggaaacgttcctcaaaatcattgcttacggactgctactgcatcccaacgcgtatgttagaaatgggtggaacctgctggactttgtaatcgtgatcgtgggattattctcggtcatcctcgagcaactaactaaagaaacggaaggtggcaatcacagctctggaaagagtggtggtttcgacgttaaagcactgagggcattccgggtgctgaggccacttcgactcgtcagtggagtgcccagcctccaggttgtacttaattccatcattaaagccatggtacccctgctgcacattgctcttcttgtgttgttcgtcatcattatttatgctattattggtctggaactctttattggcaagatgcacaaaacttgcttcttcgccgacagtgatattgtagctgaggaagatccggcaccttgcgcattttccgggaacgggcgccaatgcactgctaacgggaccgaatgcagatctggttgggtcggcccaaatgggggtatcacaaattttgacaactttgcgttcgcaatgctgacagtgttccagtgtataactatggagggctggacagatgtactgtactggatgaatgacgctatgggctttgagcttccctgggtgtattttgtcagccttgtgattttcggctcttttttcgttttgaacctggtgctcggagtattgtctggggaattcagcaaggaacgtgaaaaagccaaagctagaggggattttcagaagttacgcgaaaagcagcaactagaggaggatctgaagggctacctggactggatcacccaggcagaggacatcgatccagaaaacgaggaagagggtggggaggagggcaagcgtaacacatccatgcctacatcagagacagagtccgtgaataccgaaaatgtatcaggagagggagaaaatcggggctgctgtggttccttgtgccaggctatctccaaatctaagctgtcccggcgctggcgtagatggaaccggtttaacaggcggcggtgccgcgcagctgtgaaaagtgtaacattctattggttagttatagtcctggtgtttctaaacactcttaccatctcatcagaacattacaatcagcctgactggttgacccagatacaagacatcgctaacaaggtactgcttgccctcttcacctgtgaaatgctagtgaagatgtattcccttggtctgcaggcttattttgtgtctctgttcaaccgattcgactgtttcgtggtatgcggtgggataaccgagaccatcctggtagagctggaaatcatgtcccccctgggcatatccgtgttccggtgcgtgcggttactacgaatcttcaaagtgacaaggcactggactagcctgtctaacctagtggcctcgttgctgaacagcatgaaatcaattgcctccctgctgctgttgctgttcctgttcatcattatcttttccttactgggaatgcagttgtttggcggaaagtttaacttcgatgagacgcagacaaagcgttccacatttgacaactttccacaggcgctcttgactgtctttcaaatcctcactggggaagattggaacgccgtgatgtacgatggaatcatggcatacggtggcccctcatcaagtggtatgatcgtgtgcatttacttcattatactattcatctgtggaaattatattttgcttaacgtgtttttagctattgccgtggataatttagcggacgctgaaagcctgaacaccgctcagaaggaagaggctgaagagaaggagcggaaaaagatagcccggaaggagagcctggaaaacaagaagaataataagcccgaggtcaatcagattgcaaattccgacaacaaggtgacgatcgatgactatcgagaggaagacgaagacaaggacccgtacccaccatgcgacgttccagtgggagaggaggaagaagaggaggaggaggacgagcccgaagtccctgcaggccccaggccacgaagaatctcagagcttaacatgaaagagaaaattgcccccattcctgaaggttctgctttttttatcctgtcgaaaaccaatcctatacgggtgggctgccacaagctaatcaatcatcacatattcacaaacctcattctggtgttcatcatgctgtccagtgccgctttggccgcggaggatccaatccgatctcactcattcagaaatactattcttggttattttgactatgcttttacggccatatttaccgttgaaattctccttaaaatgacaacctttggcgccttcctgcataagggggcgttctgtcgtaactattttaatctgctggacatgctggtggttggggtctctttggtcagctttggaatccaatctagcgccatctcagtggtaaagatactgcgcgtcctccgggttctgagacctctgcgtgcaataaaccgagcaaaaggcctgaaacacgtcgtgcagtgtgtgtttgtcgccattcgtacaattggtaatattatgatcgtcaccactctcctgcagttcatgtttgcctgtattggagtgcagctcttcaaaggcaagttttaccgctgtaccgacgaggcaaaatccaatccagaggagtgcagaggactctttatcctgtacaaggatggagacgtggattccccagtggtgagggagcggatctggcagaattctgacttcaactttgacaacgtgctgtcagccatgatggcactgtttactgtgagtaccttcgaaggctggcccgccctcctgtataaggccatcgactccaacggagaaaacatcggccctatctataaccatcgggttgagatctctattttttttattatatacatcatcattgtggctttcttcatgatgaacatttttgtcggcttcgtgatcgtgacctttcaggaacagggggaaaaagagtataagaattgtgagctggacaaaaatcagcgacagtgcgtggagtatgctctcaaggctaggcctttaaggagatatattcccaaaaacccatatcagtacaagttctggtatgtggtgaattcatctcctttcgagtacatgatgttcgtgctgataatgttaaataccttgtgtcttgcaatgcagcactacgaacagagtaagatgtttaatgatgcaatggatatcctcaatatggttttcaccggagtgttcacagtcgaaatggttctcaaggtcattgcctttaaacccaaaggttacttctctgacgcttggaatacatttgactcacttatcgtgataggctctatcatcgacgtggcactcagcgaggctgaccccacagaatccgaaaatgtgcccgtgccaacagcaacacccggcaattccgaggagagcaacagaatttccattacattttttcggctctttagagtcatgcgcctcgtgaaactcctgagcagaggggaaggtattaggacactgttgtggacattcattaagtcatttcaggcactaccttatgtggcgctgctgatcgccatgctctttttcatttatgcagtgattgggatgcagatgttcggcaaggtggcaatgagagataacaaccagatcaatcgcaacaacaactttcagacatttccacaggccgtgcttctgcttttcagatgtgccaccggagaggcctggcaggagattatgttagcctgtttgcccggcaaactctgcgaccctgagtctgattacaatccgggagaagaatacacctgcggtagcaatttcgccatcgtgtatttcatcagcttctacatgttatgtgccttcctcattatcaacctattcgtcgccgtaatcatggacaatttcgactacctgactagggactggagcatcttgggtccccatcacctcgacgagttcaagcgaatctggagtgagtatgacccagaagccaaagggcgtatcaagcaccttgacgtagtgacactcctgcgccgaattcagccccctctcggtttcgggaagctgtgtccccatagagtggcatgtaagagattggtcgctatgaacatgccgctgaattctgatggcaccgtgatgtttaacgccacccttttcgcactcgtgcgaactgctctcaagattaaaactgagggcaacctcgagcaggctaatgaggaactgagggcagtcatcaaaaagatatggaagaagacaagcatgaagctgctggatcaggtcgtgccacccgctggtgatgacgaagttaccgttggtaaattctacgccaccttcttgattcaggactattttaggaaattcaagaaaaggaaagagcagggacttgttggcaagtacccagcaaagaacacaacaattgctctgcaggcaggactgcgcacacttcacgacattggtccagagatccggagggctatatcttgcgacctccaggacgacgagcctgaggagaccaagagagaagaagaggacgatgtgtttaagcgcaatggcgcactactggggaatcacgtgaatcatgtaaattctgaccggcgcgacagcctgcagcagacaaatacaactcatcgacctctgcacgttcagcgcccgagtattccgccggctagcgatacagaaaagcccttgttcccccctgctgggaattcggtgtgccataaccatcacaaccataactccattggaaagcaggtacctacgtctacaaacgccaatctcaataacgctaacatgagcaaggccgcccatgggaagagaccctcgataggcaatctggagcacgtctcggaaaatggccaccactccagccataagcatgatagggagccccagagaaggagctctgtcaaaagaacacggtactatgagacctacatcagatctgacagcggagacgagcagttaccaaccatttgtagggaggatccggagatccacggttacttcagagacccccattgtcttggagagcaggagtacttctcgtcagaagaatgctatgaggacgattcctccccaacttggtcgcggcaaaactacggatactacagtcggtacccaggacggaacattgattccgagaggcccagaggttatcatcatccccagggctttctggaagatgacgactctcctgtgtgctacgatagtaggaggagcccccggcgcagactccttcctcccacccctgcctcacaccgacgcagcagtttcaattttgaatgcctcaggcggcagagctcacaagaagaggtcccaagcagtcctatttttcctcatcgaactgccttgcccctgcacctgatgcaacagcaaatcatggccgtggctggcctggactctagtaaggcccagaagtatagcccgagccactcgactagaagttgggcgaccccccctgccacccccccatacagagattggaccccttgttacacccccctgatccaggtggaacagtctgaagccctcgaccaggtgaacggatcccttccctcgttgcatcgctcatcttggtacaccgacgagcccgatatcagttataggacattcacgccagcaagcctgaccgtgccctcgtccttcaggaataagaactcagacaaacaacgaagcgccgattctcttgtcgaggccgtacttatcagtgagggattaggccggtacgctcgggacccaaagtttgtatccgcgactaaacatgagattgcggacgcttgcgatctgactatcgacgaaatggagtctgctgcgtccaccctccttaacggaaatgtcaggcctcgagccaacggagacgtcggacccctgtcccacagacaagattacgaactgcaagacttcgggcccggatacagcgacgaagaaccagatcctggacgggatgaggaggacctggccgacgagatgatctgtatcactactctgtag

SEQ ID NO: 181234 - DNA, 6414 bp, Artificial Sequence
  Description of Artificial Sequence: Synthetic coding sequence
atgatgatgatgatgatgatgaagaagatgcagcaccagcggcagcagcaggctgatcacgccaacgaagctaactatgctcgcggaacaagactgccattgtctggcgaagggccgaccagtcaacctaatagtagtaaacagacggtgttgtcttggcaagctgctatagacgcggctcgccaggccaaggctgcccaaaccatgtccacgtccgcacctccgcctgtggggtccctgtctcagcgcaagcggcagcagtacgcgaagtccaagaagcaaggcaatagttccaacagcagaccagcacgcgccctcttttgcctgagcctaaataatccaattcgaagggcttgtatcagtattgtggagtggaagccttttgatatcttcatcttgctagctatctttgccaattgtgtggcattagcaatttatattccctttcctgaagatgatagcaactcgactaaccataatctggagaaggttgagtacgcctttcttataattttcacagtcgagacttttcttaagatcatcgcatatggactgttgcttcatcccaatgcatacgtgagaaatggctggaatctactggatttcgtgatcgtgatagtggggctcttttccgtaattctggaacagttaacaaaagaaactgagggaggaaatcatagtagcggtaagtccggcggatttgacgttaaagccctcagagccttccgtgtgcttaggccactgcggctcgtgtccggcgttcccagtcttcaggtggtgctcaacagcatcatcaaagccatggtgccgttgttacacatagcgctgctagtactgtttgtgattatcatctacgccattattgggctggaattatttattgggaagatgcataagacatgcttcttcgctgattcggacatcgtggcagaagaggacccagccccctgtgcattcagcgggaacggaagacaatgcactgccaacggcactgagtgccggagcggctgggtgggacctaacggcggcatcacaaacttcgataacttcgccttcgctatgttgactgttttccagtgcattactatggagggttggacagatgtcctgtactggatgaatgacgctatgggctttgagctgccgtgggtgtatttcgtctccctggtcatatttggcagtttttttgtgcttaacctggtcctcggggttctctccggtgaattctccaaggagagagagaaggccaaggctcggggtgactttcagaaacttcgggaaaagcagcagctcgaggaggacctcaagggctatctggactggatcacacaggctgaggacatcgaccctgagaatgaagaagaaggcggagaagaaggaaagcgcaacacctctatgcccaccagcgaaacagagtccgttaacacagagaacgtgagcggtgagggtgagaatcgaggctgctgcggaagcctgtgccaggccataagcaagtccaaactgagtcgaaggtggaggcgatggaatcgttttaaccggcggcgatgccgggccgctgtgaagtccgtcactttttactggcttgtgattgtgctcgtgttccttaatacactgaccatatctagtgagcactacaatcagccggactggttaacacaaattcaagacatagcgaacaaagtcctcttggccctgttcacatgcgaaatgctcgtgaagatgtatagcctgggccttcaggcttacttcgtttctctcttcaacaggtttgattgtttcgtggtctgcggcgggattactgagaccatactggttgagctagagattatgtctcccctaggaattagcgtgttcagatgcgttcgtctcctgagaattttcaaagtgactagacactggacgtccctctctaacttggtagctagtctcttgaatagcatgaaaagtattgcctctctgctgctcctcctttttttgttcattatcatcttctctcttctggggatgcagctgtttggaggaaagttcaactttgacgagacacagaccaaacgctcaacttttgataattttccacaggccctcctcactgtgttccagatcctgaccggcgaagactggaacgccgtaatgtacgatgggatcatggcctatggaggtccttcctcatcaggcatgattgtttgtatatactttattatattattcatctgtgggaactacattctattgaacgtgtttttggccattgctgtcgacaacttggctgacgctgagtcccttaacacagcccagaaagaagaagcagaggagaaagaaaggaaaaagatcgctcgcaaggagtctctggagaacaaaaaaaacaacaagcctgaggtaaaccagattgcaaacagcgataataaagtgaccatagatgactaccgcgaggaggacgaggacaaggacccataccctccatgcgatgtgcctgtgggcgaagaagaggaagaagaagaggaagacgagcccgaagtcccagccggccctaggccccgccgaatcagtgagctgaacatgaaggagaagattgcacctatcccagagggatcggcattcttcatcttgagcaaaacgaacccgatacgcgtaggctgtcacaagttgattaaccatcatatcttcacgaatttgatcctggtctttataatgctttccagcgcagccctggccgcggaggatcccatacggagtcactccttcagaaatacaatcctgggatatttcgactacgcatttacagccattttcacagttgaaatactcctgaagatgaccacttttggcgcctttcttcataaaggcgccttttgcagaaattatttcaatcttctggatatgctggtggtcggcgtgtctctggtgtcattcggcatccagagttctgccatttctgtggttaaaatcctaagagtactccgggtcctgcgcccactgcgcgcaattaatcgtgcaaagggcctgaaacatgtggtgcaatgtgttttcgtggccattcggacaattggcaacatcatgatagtgaccacgctgctgcagtttatgttcgcatgtatcggcgtgcagttgtttaaggggaaattttacaggtgtaccgacgaggccaaatccaacccagaagagtgccggggcctgtttattctttataaagatggcgatgtggactctccagtcgtccgggagagaatatggcagaatagcgattttaactttgacaacgttcttagtgctatgatggccctctttacagtttcaacatttgaaggctggcccgctctgctgtacaaagctattgattccaacggagaaaacatcgggcctatatataatcaccgggtggaaatatctatcttctttatcatatacattatcattgtcgccttcttcatgatgaacatttttgtggggttcgttatcgtgactttccaggagcagggtgaaaaagaatacaaaaactgcgagctagataaaaatcagcgtcagtgtgtcgagtatgccctaaaagctaggcccctccgcaggtatatccctaagaacccctatcagtacaaattttggtacgttgtgaacagtagccccttcgagtacatgatgtttgtactaatcatgctcaacacactgtgccttgcaatgcaacactacgaacagagcaagatgtttaatgacgccatggacatcctcaacatggtatttacaggcgtgttcaccgttgaaatggtgctgaaggtgattgcttttaaaccgaagggatacttttcagacgcatggaacacatttgactccctaatagttatcggctccatcatcgatgttgctctgtccgaagccgacaatagcgaggaatctaacagaatcagtattactttctttcgtctattcagggtgatgagactggtcaagttgttgagcaggggagagggaatccgtacactgctgtggaccttcatcaagtcctttcaggcgctgccatacgtggctcttttaatcgctatgctgttctttatttacgcggtgatcggcatgcaaatgttcggcaaggtggccatgagagataacaaccagatcaaccgcaataataattttcaaaccttcccgcaagccgtccttctgctattccggtgcgccactggagaggcatggcaggagatcatgctggcatgcctacctggaaagctgtgtgatcccgaaagtgactacaacccgggcgaggaatacacgtgtggaagtaacttcgctattgtctatttcattagtttttatatgctgtgcgcatttcttatcattaatttgtttgtcgccgtgatcatggataacttcgattatttaaccagggattggagcattctcgggccacaccaccttgacgagtttaagaggatttggtctgaatacgatcccgaggcaaaggggcgcattaaacacttggacgtggttactttactcaggagaatccagcccccgctgggatttgggaaactgtgcccccatcgcgtagcttgcaagagacttgttgccatgaatatgcccctcaattccgacggcacagtgatgtttaatgcaacattattcgcgttggtgagaaccgcgttaaaaatcaagactgaaggcaatttagaacaggccaatgaagagctgcgcgcagtcatcaagaagatctggaagaagacctcaatgaagttactggaccaggtggtaccccccgctggagatgatgaggtcacggtgggcaaattttatgccaccttcctgattcaggactacttcaggaagtttaagaagaggaaagaacagggacttgtgggaaagtaccctgccaagaataccacgattgctctgcaggcaggacttcgaaccctccacgacatcgggcctgaaatccggagagccatctcgtgtgatttgcaggacgatgagcctgaggaaactaaacgtgaggaagaagacgatgtgttcaaaaggaatggcgccctgctgggcaaccatgtgaaccacgtgaattcagatcggagagactcgctgcagcaaacaaatacgacgcaccgtcccctgcacgtgcagcgtccttccatcccccccgcatccgatactgaaaaaccccttttccctccagcaggcaacagcgtgtgccacaaccaccacaaccacaattcaatcggcaagcaggtgcccaccagcaccaatgccaatttgaacaacgcaaatatgtccaaggccgcccacggaaaacggccctccatcgggaatttggaacacgtttcagagaatggtcatcattctagccacaagcacgatagagaaccacagcgcaggagcagcgttaaaaggtccgactcaggagatgagcagctgccaacaatctgtcgggaagacccagagattcacggctattttcgtgacccacattgcctaggagagcaggaatatttctccagcgaggaatgttacgaagatgacagtagccctacttggtctcgccagaactatggctactactcgcgttacccagggagaaatatcgatagtgaacggccgagggggtaccaccatcctcagggctttctcgaagatgacgattcaccggtctgttatgacagcaggaggtcgccacgacgcaggctgctgcctccaaccccagcctcccatcgaaggtcctcgtttaacttcgaatgcctgcgtcgccaaagctcacaggaggaagtgccttcgtccccaattttccctcaccgaaccgccttgccactgcacctcatgcagcagcagattatggccgtcgcaggcctggactcttccaaggctcagaaatattccccttcacattctacacgatcctgggcgaccccgcccgctacccccccatatcgggactggacaccctgttatacccccctaatacaggtggagcagagtgaggctcttgatcaagtaaatggaagtctcccgtctctccacagatcctcatggtacaccgatgaacctgatatctcatataggaccttcacaccagccagtttgactgtcccgtcctcttttcgaaataagaatagcgataaacagcggtctgccgactctttagtcgaagctgtactgatcagcgagggcttaggccggtacgcgagagaccccaaatttgtttcagccacaaaacacgagattgcggacgcctgtgatcttactatcgacgagatggagagcgccgcctccactctcctgaacggcaatgttcgccctcgcgctaatggggatgtgggccctttgagccatagacaagactatgagctgcaggattttggacccggctattcagacgaagagcctgatccaggtagggatgaggaagacctggctgatgaaatgatttgcatcacaaccttgtag

SEQ ID NO: 181235 - DNA, 5565 bp, Artificial Sequence
  Description of Artificial Sequence: Synthetic coding sequence
gccaacggcaccgagtgccggagcggctgggtgggccccaacggcggcattacaaatttcgacaattttgctttcgcgatgttgacagtcttccagtgtatcactatggagggctggacggacgtgctatactggatgaacgacgccatgggcttcgaattgccatgggtctacttcgtttcgctggtcatttttggctccttctttgtgctgaatctggttctcggtgttctttcgggcgagtttagtaaggagcgagagaaggcgaaagcccgtggcgatttccaaaagctgagagagaaacaacagctggaagaggatcttaaaggctaccttgactggattacccaggccgaggacattgaccctgaaaacgaggaagaaggaggggaggaaggtaagaggaacaccagcatgccgacgtctgaaaccgaatcggtaaatacagagaatgtttccggagagggcgagaataggggttgttgtggatccctgtggtgctggtggcgcagaaggggagctgcgaaggcgggaccctcaggttgccggcggtggggacaagcgatttctaaatccaagctctctaggagatggcgacggtggaatcgattcaaccgtaggcgatgtcgagccgcggtgaaaagcgtcacgttttattggttggttattgtcctcgtgttcctgaacacgctcaccatctcctcagagcattataatcaacctgactggctgacacagatccaggacatagccaataaagtcctcctggccctctttacctgtgaaatgctcgtgaaaatgtatagtcttgggcttcaggcctactttgtctcccttttcaatcgcttcgactgcttcgtcgtatgtggaggtatcacagaaactatcctagtggaactagaaattatgagccctctggggatttcagtgttccggtgtgtgcgactgctgcgtatcttcaaggtcacacgacactggacttccctgtctaatctggtagccagcttgcttaatagcatgaagagtattgcctccctcttgctactgctctttctattcattataattttcagcttactgggcatgcaattgttcgggggcaaatttaactttgatgagacacaaaccaaaagaagtacgtttgacaactttccccaagccctgctgactgtctttcagatactgaccggcgaagattggaacgctgttatgtatgatggcattatggcttacggggggccctcctcttcgggcatgatagtatgcatctatttcattatactctttatttgtggcaattacattttactcaacgtctttttagccattgcagttgataatcttgcggacgcagaatcgctcaataccgcccaaaaggaggaagccgaggaaaaagagcggaaaaaaatagccagaaaagagtccctcgagaacaagaaaaacaataaaccggaggtcaaccagatagcgaatagtgataacaaggttacaatcgacgattacagggaggaggatgaggacaaggatccataccctccctgcgacgtccctgtcggggaagaggaagaggaggaagaagaggatgaaccggaggtgcccgccggtccaagaccaagaaggatcagtgagctgaacatgaaagagaagattgctccaatccctgaaggttcagcctttttcatcttatccaaaaccaatcctatccgggtgggctgccacaaactcatcaatcaccacattttcaccaaccttatccttgtgttcattatgctttcatccgccgctctcgccgccgaggatcccattcgtagccacagttttagaaacacaatactcggctacttcgactacgcgtttacagctatttttaccgtcgagattctgctaaaaatgactaccttcggggcttttctccacaaaggcgccttttgccgcaattatttcaatctgctggacatgctcgtagtcggtgtctccctcgtctcattcggaatccagagctccgcaattagtgtggtaaagatattgcgggtccttcgagtcctccggcccctgagggcaattaacagagccaaaggactcaaacacgtggtgcagtgcgttttcgttgctatacgcaccattggcaacattatgatcgttacaacacttctgcagtttatgtttgcctgtatcggcgttcagctcttcaagggaaagttttacaggtgtactgacgaggctaagagcaatccagaggagtgccggggactctttattctctataaagatggcgacgtcgactcccccgtcgtccgcgaacggatctggcagaattccgactttaactttgataacgtactgtccgcgatgatggcactgtttaccgtgagcacctttgaaggttggcccgctctgctttataaggctatcgattctaacggggaaaatatagggccaatttataatcacagggtggagattagtattttctttataatctacataatcatcgtcgcattcttcatgatgaacatatttgtggggtttgtaattgtgacttttcaagaacagggagagaaggaatataagaattgcgagctggataagaatcagagacagtgcgtcgagtatgctcttaaagcccggcctcttagacggtacataccgaagaatccatatcagtacaagttctggtacgttgtaaattccagtccatttgaatacatgatgtttgtactcatcatgctgaataccctgtgcttggcaatgcaacactacgagcagagtaagatgttcaacgacgcgatggatatcctgaacatggtctttacaggagtgttcactgtggaaatggtgctgaaggtcattgccttcaagccaaaacattattttacagatgcttggaacacctttgacgcactgattgtggtgggatctgtggtggacattgccatcactgaggtgaatcctactgaatcggagaatgttccagtgccgaccgcaactccaggtaactcagaagaaagtaatagaatatcaatcacattctttagactctttcgggtaatgagattagtgaaactcctttccagaggtgaaggtatccgaactctattgtggacatttatcaagagcttccaggccttaccctacgtagctctgcttatcgcaatgttgttctttatctacgctgtcatcgggatgcagatgttcgggaaagttgctatgcgggacaacaatcaaatcaacaggaacaacaacttccagacgttcccacaggccgttcttctactgttccgttgcgccacaggagaggcttggcaggagatcatgctggcatgcctgccaggcaaactctgcgatcctgagtcagactacaaccctggcgaggaatatacctgtggaagcaatttcgcaattgtgtacttcattagcttctacatgctctgcgcattcttgattattaacttatttgtcgctgtcatcatggacaattttgattatctgacccgggactggagtatcctcgggccgcatcacctggatgaatttaagaggatttggtcggaatacgaccctgaggccaaagggcgcatcaagcatctggacgttgtgacactgttgcgacgaatccagcctccactaggctttggaaaactgtgtccacacagggtggcctgcaaacgtttggtggcaatgaatatgcccctgaatagcgacggtacagtgatgttcaatgcaaccctgtttgcactagttcgtactgctttgaagattaagaccgagggaaacttggaacaagcaaacgaagagctgcgggcggtgattaagaagatttggaaaaagacctccatgaagcttctggaccaggttgttccgccagccggcgatgatgaagtgacagtcgggaaattctacgccactttccttattcaggattactttagaaaattcaaaaaaagaaaggaacaggggttagtcggtaagtatcccgccaagaatacgaccattgcattgcaagccggactgcgcactcttcatgacatcggccctgagattagacgtgccattagctgtgacttacaggatgatgagcccgaggaaacgaaaagggaggaagaggacgacgtgttcaagaggaatggcgctctgctggggaaccacgtgaatcacgtgaattccgacaggagggattcattgcagcagaccaacaccacccacaggccccttcatgtgcagcgcccctcaattcccccagcatcagataccgaaaagcccctgttcccacccgctggaaacagtgtgtgccataatcatcataatcacaattcaatagggaagcaggttcccacttctaccaatgccaacttgaacaacgccaatatgtcaaaagctgcacacggaaagcgtccatctataggtaatctcgaacatgtgagcgagaacggccaccatagtagccataagcatgacagagagccccagcgcaggtcatccgttaaacggacccggtactatgaaacttacattcgcagcgatagtggcgacgagcagctcccaacaatatgtcgcgaggatcctgagattcatgggtactttagggacccccactgcctcggtgagcaggaatacttctccagtgaggagtgctacgaggacgattccagtccaacttggtctaggcagaattatggctactattccaggtaccctggtaggaatatcgactccgagcgcccccggggctatcatcacccccagggatttcttgaagatgacgactcgccagtctgctatgatagcaggcgctccccacgacggaggttgctgcccccaacgcctgcctctcacaggaggtcctccttcaacttcgaatgtctgcgccgacagtcaagccaggaggaggtgccgagctcgccgatattccctcacaggaccgctctgccattgcacttaatgcagcagcagattatggcggtagcggggcttgactcttccaaagcccagaaatatagcccgagccattcaacgcgttcatgggctacacccccagctaccccaccctacagagattggactccgtgttacactcccctaatccaagtggagcagtccgaggctcttgatcaggtaaatggaagtctgccctccctccacagatcatcatggtatacggatgaaccggacatcagctacaggacgtttactcctgcaagtctcacagtcccctccagcttccgcaataagaactccgataaacagcgatcggcagactctctcgttgaggccgtgctcatctccgaagggctagggcggtatgcacgggaccctaaattcgtgtccgccacaaaacacgagatcgctgatgcttgtgatttgacaatcgacgaaatggaatcagccgcgtccaccctgctgaatggaaacgttaggccccgagcaaacggcgacgtggggccactcagtcaccgccaggactacgagttacaagattttggccctgggtatagtgacgaagagcccgatcctgggagagacgaggaggacctcgccgatgagatgatttgcattaccacactgtag

SEQ ID NO: 181236 - DNA, 1620 bp, Artificial Sequence
  Description of Artificial Sequence: Synthetic coding sequence
atgggcgagacctggctgtgccccgccgccctgggcctgctgtacaaggcaatcgattcgaatggagagaacattgggcccatttacaatcaccgcgtcgagatttcaatattcttcattatttatatcattattgttgcattcttcatgatgaatatatttgtgggctttgtcatagtgacttttcaggagcagggagagaaggagtataaaaactgcgagttggataagaaccagcgtcagtgtgttgagtatgcactcaaggccaggccactcagaaggtacattccaaagaacccttatcagtacaagttctggtacgtggtcaattcctcccccttcgagtatatgatgttcgtgctgataatgcttaatacactgtgccttgctatgcagcactacgagcagtcaaagatgttcaatgacgctatggacattctaaatatggttttcacgggagtgttcacagtggaaatggtgttgaaggtaattgccttcaagcccaaaggctacttttccgatgcctggaacacctttgacagcctgatcgtgatcgggagcattatcgatgtggcactgagcgaagcggacaattccgaagaatccaatagaatatcaattacattctttcgcctgttccgtgtgatgcggttggtgaaactgttgagtcgcggagagggaataaggaccttgctttggaccttcatcaagtccttccaagctttgccttacgtggccctgctgatagcgatgttgttctttatctacgccgtcattggcatgcagatgttcggaaaggtcgccatgcgagacaataaccaaatcaatcgcaacaacaacttccagactttccctcaagccgtcctcttgctattccgctgcgccactggagaggcgtggcaagagatcatgctagcctgcctccccgggaagctgtgcgaccctgagagcgattataacccgggtgaggaatatacttgcggatccaactttgccatcgtttactttatctcattctatatgctttgtgcattcctgataatcaatctcttcgtggcggtcattatggacaatttcgattacctaactcgggactggtccattctgggaccccaccatcttgatgaattcaaaagaatctggagtgagtatgacccagaagccaagggcaggatcaagcacttagacgtggtgacacttctgcggaggattcaaccgcccctgggcttcggaaaactttgtccgcatagggttgcctgcaaacgccttgtggccatgaatatgcctctaaattctgacgggaccgttatgttcaacgctaccctgttcgcccttgtgcgaactgctttaaaaatcaagaccgagggtaacctggaacaagccaatgaagaactgcgagcggtcatcaagaagatatggaagaagactagtatgaagctgctagaccaagtggtgcccccagccggtgacgacgaggtgacggttgggaaattctacgcaacatttctcatccaggactatttcagaaagttcaagaagagaaaggaacagggccttgtcggtaagtatccagccaagaacaccacaatagcattgcagatgctagaacgtatgttatag

SEQ ID NO: 181237 - DNA, 1056 bp, Artificial Sequence
  Description of Artificial Sequence: Synthetic coding sequence
atgaacggcctggcccagagccggctggagacctgcatcagctacctccactgttatagcgctggacttaggaccctacacgacattggtccagagattcggcgggcgatatcctgtgatctgcaggatgacgagcctgaagaaactaagcgcgaagaggaagatgatgtgtttaagcgaaacggggccctcctggggaatcatgttaaccacgtgaactccgacagacgcgatagtctgcagcagactaatactacgcacagacccttgcatgtccagcgcccatccattccccccgcatcggatactgaaaagcctctgttccctccggcgggcaattccgtgtgccataatcaccacaatcacaactccatcggcaagcaggtgcctacgtccacaaacgctaacctcaacaacgccaatatgtccaaggccgctcacggaaagcgaccaagtatcggcaacctcgagcacgtttccgagaacggccaccattcatcccataaacatgatagagagcctcagcgaaggtccagtgtgaaaaggacacggtattatgaaacctatatccggtcggattccggcgacgagcagctgccaaccatttgcagagaggacccggagatccacgggtatttccgggatcctcactgtctgggcgagcaggagtacttcagcagcgaagagtgttatgaggatgattctagccccacctggtcacgccagaattacggttattactcacggtaccccggaagaaatatcgattccgaaaggcctcgcgggtaccatcaccctcagggctttctcgaggatgatgactccccggtctgctacgactcccggaggtcaccacgtcgacggttactcccacccacacccgcgtcccaccggaggagtagtttcaactttgagtgcctacgcagacaaagttcccaggaagaagtaccaagtagccccatatttccacacagaaccgctctgcccctgcacttaatgcaacagcagtcccccctgtcaagtgaccatggaagttgcagaccccgctttaaatag

SEQ ID NO: 181238 - DNA, 5901 bp, Artificial Sequence
  Description of Artificial Sequence: Synthetic coding sequence
atgagcgagagcgagggcggcaaggacaccacccccgagcccagcccggctaatggtgctggacccggtcctgaatggggtctgtgcccggggccccccgcggtcgagggcgaaagctccggagcatctggcctggggactccaaaacgccggaaccagcattctaaacacaagacagttgcggtcgcttccgcccaacggagcccaagggcgcttttttgtttaacccttgcaaatcctcttcgacgatcctgcatcagcattgtcgaatggaaaccatttgacatcctcattctacttacgatctttgcaaattgtgtggctctcggcgtgtacatcccattcccggaagacgattcaaatacagcaaaccacaatctcgaacaggtggaatacgttttcttggtgatttttactgttgagacagtgctcaagattgtggcgtacgggttggtgctgcatccaagcgcctacatccggaacggatggaatctgctagatttcatcatagtggtagtaggactcttttccgtgctgctggaacaaggaccaggtcggcccggagacgccccacacacaggcggtaaaccaggtggctttgatgtaaaggcactgcgagccttccgggtgctcaggccccttcgattggtgtcaggggtgcctagcctgcacattgtcctgaatagtataatgaaagccttggtccctttattacacattgcccttctggtcctgtttgtaatcattatctacgctattatcggtttggaactgtttttgggacggatgcacaaaacctgctattttctggggagcgatatggaggcggaagaagacccctccccatgcgcgtcctctggctcaggaagagcttgcacactgaatcaaacagaatgccggggaagatggccagggccaaacggcggaataaccaatttcgacaatttcttctttgctatgcttacagtattccagtgcgtgaccatggaagggtggacagacgtcttatactggatgcaggacgccatgggatatgagttgccctgggtttactttgtgtctctcgtgatcttcggttctttcttcgtgttgaacctggttctgggggttctgtctggggagtttagtaaagaacgtgaaaaggcgaaggccaggggggatttccagaagcagcgggagaagcagcagatggaggaagacttaagagggtaccttgactggatcactcaggctgaagagttggatatggaggaccctagtgcagacgataacttgggcccacagttagccgaattgacgaacagaaggaggggcagacttcgatggttcagccacagtacccggtccacccattctacatcctcgcatgcaagcctgccagcaagcgacacagggtccatgaccgaaacacagggcgacgaagatgaggaggaaggcgccctggccagttgtactaggtgtctaaataagatcatgaagaccagggtgtgccggcgactcaggcgggccaatcgagtgctcagggccagatgccggagagcagtaaagagcaacgcctgctattgggctgtgttgctgctcgtgttcctgaacacacttacgatagcatccgagcaccacggccagcctgtgtggctcactcagatccaggagtacgcaaataaggtcctgctgtgtcttttcaccgtggagatgctgttaaaactgtatgggctcggcccgtccgcctatgtgagtagcttttttaatcgcttcgactgtttcgtggtatgtggcggaatcctagagacaacactggtcgaagtgggagccatgcagcccctggggatatcagtgctgaggtgcgttagactgctcagaatttttaaggttaccagacattgggcgagtctgtcgaacctggttgcaagtctcctgaacagcatgaagtccattgcatccctgctgttgctcctgttcttatttataattatcttctcgctgctcggaatgcagctgttcgggggcaagttcaacttcgaccagacacacaccaaacgctccacattcgatacattcccccaggcccttttgaccgttttccagatcttaaccggcgaagactggaacgtggttatgtatgacgggattatggcctacggggggccattttttccaggcatgctggtgtgtatatatttcatcattttgttcatctgcggaaactatatactgttgaacgtctttttagcgatcgcggtcgataacctcgcgtctggcgacgccgggaccgcaaaggacaaggggggagaaaaaagtaacgaaaaggatctgccccaggaaaacgaggggttagtccctggagtggagaaggaagaggaggagggagcccggcgtgaaggggctgacatggaagaggaggaggaagaggaagaggaagaagaagaagaggaggaggaagagggagccggaggcgtggagctcctccaggaggtggttcccaaggaaaaagtggtaccaatccctgagggttcagccttcttctgcttgtctcagactaaccctctgcgcaagggatgtcacacattgattcaccaccatgttttcaccaatctgatcctggtattcattattctctcgtcagtttccctggccgcagaggatccaatccgggctcattccttcagaaatcacatcctcgggtattttgactacgcttttacctccatatttacagtggagattctgctcaagatgacggtatttggtgcctttctgcaccgcggcagtttctgtcgctcatggttcaacatgctggacctccttgtggttagtgtctccttgatcagctttggcatacactctagtgcaatctctgtagtcaagatcctgagagtgttacgggtcctcaggccactgagagccatcaatagggccaaaggattaaaacacgtcgtgcagtgtgtttttgtggcaataagaacgatcggcaacatcatgatagtgactactcttctccagttcatgtttgcctgtatcggagtgcagcttttcaaaggcaagttctacacatgtaccgatgaagctaaacatacaccacaagaatgcaagggcagctttctcgtgtacccagacggcgacgtgagtaggcccctagtgcgcgaaaggttatgggtcaacagcgacttcaattttgataatgtcttaagcgctatgatggcactgtttacggtatcgactttcgaggggtggccagccctcttgtataaagcaattgacgcgtatgccgaagaccatggccctatctacaactaccgggtggaaattagcgttttctttatagtctatattatcattattgccttttttatgatgaacattttcgttgggttcgtaatcattaccttcagagctcagggtgagcaagagtatcagaactgcgaactggacaagaatcagcgacaatgtgtcgaatacgcattgaaagcccagcctctgaggcgttacattcctaagaatccccatcagtaccgggtctgggccacggtgaattcagcagccttcgagtatctgatgtttttgttgattttgttaaacacagtggcccttgctatgcagcactatgaacaaaccgcaccttttaactatgcaatggacatcctgaatatggtgttcactgggctctttactattgagatggtcctcaagatcattgcttttaagcctaaacactacttcaccgatgcgtggaatacttttgacgcactcattgtggtggggtctatcgtcgatatcgccgtgacagaggtaaataatggcggccatctgggtgagtcctcagaagattcatcaaggatttcaattactttctttcgtctgtttagagtgatgcgtctggtgaagctcttgagcaagggagaaggcattagaactctactctggactttcattaagagtttccaggcacttccttacgttgcgctgctcatcgcgatgattttcttcatttacgctgtgattggcatgcaaatgtttggcaaggtcgccctgcaggacggaactcagatcaatagaaacaataacttccaaacctttccacaagcagtcctgctcttatttcgctgcgccacaggagaggcctggcaagagataatgctagcatctctcccaggcaacagatgtgaccccgaatctgacttcggtccaggtgaggaattcacatgcggatcaaactttgccatcgcttattttatctcattcttcatgctgtgtgctttcctgatcatcaatcttttcgtcgcagtgataatggacaattttgattacctcactcgcgattggtctatactgggcccacatcatctggacgagttcaagcgcatctggtccgagtatgaccctggtgccaagggcagaatcaagcacctggatgtggtggcactgctaagaaggatccagccacccctcggcttcggaaagctgtgtccccatcgggtcgcatgtaagaggcttgtcgcaatgaatatgccgttaaacagcgatggaacagttactttcaacgctaccctgtttgctctagtgaggacttctttaaagatcaaaacagaaggcaatttagagcaggccaatcaggagctccggatcgtgatcaagaagatatggaagagaatgaaacagaaactgctggacgaggtaattccacccccagatgaggaggaggttacagttggcaaattctatgcaacatttctaattcaggattactttcgtaaatttcggaggagaaaggaaaagggccttctgggaaacgacgccgctcccagtacctcctcagctctgcaggccgggctccgatctcttcaagacctgggcccagaaatgaggcaggcactcacatgtgataccgaggaagaagaggaggagggccaggagggcgtggaagaagaggatgagaaggacctcgagacgaacaaggctacgatggtgtctcagccctcagctcgacgcggatccggcataagcgtctccctgccagtcggagaccgcctccctgactcgctatcgtttggtccctctgacgacgatagagggacccccacctcatctcagccgtctgtgcctcaggccggctcaaacacacacagacgaggcagtggggccctgatcttcaccattcccgaagagggcaactcccagccgaaggggactaagggccagaataaacaggatgaagacgaggaagtcccggatcgactctcttatctagacgaacaggccgggacccctccatgttccgtcctcctcccgcctcatagggcccagcgctatatggacggtcacctggttcctcggcgccgcttattgccacctacccccgcagggcgaaagccatcattcaccatccagtgcctccaacgccaaggctcctgtgaagacctgccaataccaggtacctaccatcgcggccggaactctggccccaaccgggctcagggtagctgggccaccccaccccaacgggggagactactttacgcgcccttactcctggttgaggaaggcgccgcaggcgagggatacctaggacgctcatcggggcccctgcgaacatttacctgtcttcacgtacccggtacccatagcgacccgagccacggaaagcggggaagcgccgacagtttagtggaggccgtcttaatatccgaagggctgggtttgtttgctcgggacccccgcttcgtggctttagccaagcaggagattgctgacgcatgccgcctgaccttggacgaaatggataacgcagcatccgacctgctcgcacagggcaccagttccctttactccgatgaagaatctatactctcccgctttgacgaagaagaccttggcgacgaaatggcctgcgtccacgccctgtag

SEQ ID NO: 181239 - DNA, 5739 bp, Artificial Sequence
  Description of Artificial Sequence: Synthetic coding sequence
atgagcgagagcgagggcggcaagggcgagcggatcctgcccagcctgcagacgctcggagcctctatcgtagagtggaagcctttcgatatccttatattgctcaccattttcgccaactgcgtcgcgctaggggtctatatcccctttcctgaggatgacagtaatactgctaaccataatctggagcaggtagagtatgtttttctggttatatttactgtcgaaacagtcctgaagattgtcgcgtatggtctggtgctgcatccctcggcatacatcaggaacggctggaaccttcttgacttcatcatcgtggttgtgggcctgttttcagtgctgctggaacagggaccagggcggccaggggacgcgccacacactggagggaaacccgggggattcgacgtcaaggctctgcgggctttccgcgtgctgcgcccgttgcgccttgtgagcggagtaccctctctccatatcgtactgaactcaattatgaaagctcttgtcccactgttacatattgcactgctcgtcctgtttgtgataatcatatacgcaattatagggttggaactctttcttggtcggatgcacaagacgtgttatttcttaggctctgatatggaggcggaggaggacccatctccttgtgctagctctggcagcggtcgcgcttgcactcttaaccagaccgagtgccggggtaggtggcccggcccaaacgggggaatcactaacttcgataacttcttctttgcaatgctgacggtgttccagtgtgtaacaatggagggttggaccgatgtgctatactggatgcaagacgctatgggatatgagcttccttgggtgtacttcgtgtccctagtgatttttggctccttttttgtactgaatttagtgctgggtgtactgagcggcgagttctctaaagagcgagaaaaagccaaggcaagaggggattttcagaaacagcgcgagaagcagcagatggaggaagacctaagggggtatttggactggattacacaggcagaagagttggatatggaggacccaagcgcagacgataatttaggctccatggctgaggaggggcgggccgggcaccgtccccagctggccgaattaacgaaccgccggaggggtcggctcagatggttcagtcactccacgcgtagcacacactcgacttcatctcatgccagccttcccgccagtgacacaggaagcatgaccgagactcagggggatgaagatgaggaggagggcgctttggccagttgcactcgttgtctcaacaagattatgaagactcgggtgtgccgccgcctacgtagggccaaccgcgttctcagagctcgctgccgccgagcagttaagtcaaatgcctgctactgggctgtcctgctcttggtgttcctcaacactctgaccatcgcttctgaacaccacggacagcccgtttggcttactcagatccaggagtatgcaaacaaagtactcctgtgtctctttacagtcgaaatgctccttaagctgtatggcctgggaccatctgcttacgtctcaagcttctttaatcgttttgactgttttgtagtatgcggtggaattttagagaccaccctcgttgaggtcggggccatgcagccactgggtatttcagtgctgcgctgtgttaggttgctccggattttcaaggtgacccgccattgggccagcctttctaatttggtcgcatccctgcttaatagtatgaaaagcatagcgtccctgctgctgctgttgttcctcttcataatcatcttcagcctacttggcatgcagctgtttgggggcaaatttaacttcgaccaaacgcacactaagagatccacattcgacacattcccacaggcgctgctgacagtgtttcagattctgactggcgaggactggaacgttgtgatgtacgatgggataatggcttatggaggccccttctttcccgggatgctagtctgcatttactttatcattcttttcatatgtgggaactatatactcctgaacgtttttctcgcaatcgcggtcgacaatctcgcgagcggggacgccggaacagctaaagacaaaggaggggaaaagtccaatgagaaagacttaccacaggagaatgagggactcgtccctggtgttgaaaaggaggaagaggagggcgctcgacgcgaaggtgccgatatggaggaggaggaagaggaggaagaagaggaagaggaggaggaagaagaggaaggagccgggggtgtcgagctattgcaggaagtggtccccaaggaaaaggtggttcctattcccgagggttccgctttcttctgcttatctcagaccaatccgcttcggaaagggtgtcacacactgattcatcatcatgtgtttaccaacttgatcttggtatttatcatcctctccagtgtctccctcgccgccgaagatcctattagagcacacagcttcaggaatcacatactcggatacttcgactacgcatttacgagtatctttaccgtcgagatcttgttaaaaatgacagtgtttggtgccttcctgcacaggggcagtttctgtagatcttggttcaatatgctcgatctacttgtggtcagcgtcagcttgataagcttcggcatacatagttctgctatctcagttgttaaaatcctccgggtgcttagggtactccgccccctgagggccatcaaccgggccaaggggctcaagcatgttgtccagtgtgtgttcgtggcaatccggaccatcggcaatatcatgattgtgaccaccttgctacagttcatgttcgcatgtattggtgtgcagctgtttaaaggcaaattttatacctgcacagacgaggcaaaacatacaccccaggagtgtaaaggaagctttctcgtttatccagatggcgatgtgtcacggcctctggttagggaaaggctgtgggtaaatagcgacttcaatttcgataatgtactaagcgcaatgatggccctctttaccgtcagcacgtttgaaggctggccagctctgttatataaggcgatcgatgcctacgccgaggaccacggccctatctacaattacagagtcgagattagtgtattcttcatcgtgtatatcatcatcatcgctttcttcatgatgaatatcttcgtcggtttcgtgattatcacattccgggcccagggcgagcaggagtaccagaattgcgagctggacaagaaccagagacagtgcgtcgaatacgccttaaaagcccagcccctcaggcgctacattcctaaaaacccacaccaatatcgagtatgggccactgttaatagtgctgctttcgaatatttaatgtttctgttaatccttttaaacactgttgccttggccatgcagcactacgaacaaaccgcgccattcaactatgcaatggacattctgaatatggtcttcacaggactttttacaatagaaatggtgcttaaaattatagcgtttaagccgaagcattacttcaccgacgcctggaacactttcgatgcccttatcgttgtaggcagcatcgtagacattgcagtcacagaggtgaacaacggaggtcatctcggcgagtcctcagaggactccagcagaatctctatcacattcttcaggctattccgggtgatgcgcctggtgaaattgctctcaaaaggggaagggatacggaccctcttatggacgttcatcaaatcttttcaggcactcccatacgttgctctactcatcgccatgatctttttcatttacgccgttattgggatgcaaatgtttgggaaagtggctctgcaggatgggacgcagattaacaggaacaataactttcagacatttccccaggctgtgttacttctcttcagatgcgccaccggggaagcctggcaggagataatgttggcctcactgcctgggaataggtgcgatcctgaatccgactttgggcccggtgaagaattcacctgtgggtcaaacttcgccattgcctactttatttcattcttcatgctgtgcgcattcttaatcataaatctttttgtcgccgtgatcatggacaactttgattatctcacacgggattggagtattttaggtccccaccacttggatgaattcaagcgaatttggtctgaatacgatcccggggcaaagggacgcatcaagcacctagacgtcgtggctctgctacgaaggatccagcctcccctcggtttcggtaagctgtgtccccatcgggtggcatgtaaaaggctggtcgccatgaacatgccactaaactccgacggaactgtcacatttaatgcaactctgttcgccctggttagaacgtcgctaaagattaaaaccgaaggaaatctcgagcaggccaatcaggagcttagaattgttataaagaaaatttggaagagaatgaaacaaaagctgctcgacgaggtgatcccaccccctgatgaggaagaggtgactgtaggcaagttttatgctactttcctaatccaggactatttcaggaagtttcgacggaggaaagagaaggggcttctaggaaatgatgccgctcctagcacgtcaagcgctctgcaggctggtctgaggagcctgcaagacttgggtcctgaaatgcgtcaggctctcacctgtgataccgaagaagaagaagaggaaggtcaagaaggcgttgaagaagaggatgaaaaagatttggaaacaaataaggctaccatggttagccagccttccgctagaagaggctccgggatttctgtatccctacctgttggcgacaggctgcccgactccttgtcctttggtccgagcgatgacgatcggggcacgccgaccagcagtcagccctccgttccacaggccgggtccaacacgcaccgacgggggagtggtgctctgattttcaccatcccggaagagggaaactcccagccaaagggcaccaaagggcagaataagcaggacgaggatgaggaggtacctgaccgcctttcgtacctggatgagcaagcggggactcctccctgtagcgtattgctgcctcctcaccgggcacagagatatatggatggacacctggtgccccggcgaaggctactgcctcctacccccgctgggcggaagccctccttcacaattcaatgtcttcaaagacaaggcagctgcgaagacctgcctattcctggcacataccaccggggtcgaaattcaggtccgaatagagcccaagggagctgggctacccctccccaaaggggtcggttgctctacgcacctctgctgttagtcgaggagggcgctgccggggaagggtatctggggcggtcctcaggccctctgcggacatttacctgcctccatgtgcccggaacgcacagtgatcccagtcacggcaaaagaggatctgctgacagccttgtagaggcagtcctgatcagcgaaggtctgggtctctttgcccgcgatccacgcttcgtggccctcgcgaaacaggagattgccgacgcctgccggctgacattggatgaaatggacaatgcagcatcagacctcctggcccaaggaacatcctctttgtactctgacgaagagagtatcctgtcccggtttgacgaggaggatctgggcgatgaaatggcttgtgttcacgccctgtag

SEQ ID NO: 181240 - DNA, 5934 bp, Artificial Sequence
  Description of Artificial Sequence: Synthetic coding sequence
atgagcgagagcgagggcggcaaggacaccacccccgagcccagccctgccaacggcgcaggccccggccccgagtggggactgtgccccgggccccccgcagtggaaggagagagctctggtgcgagtggcctaggcactcctaaacgccgtaaccagcactcaaagcacaaaacagtcgctgtggcctcagcgcagcggtcaccgcgagccctgttttgcctgacactcgccaatcccttgagaagatcctgcatctccattgtcgagtggaaaccttttgatattctgatactcctgaccatctttgctaactgcgtcgccctgggggtctacattccattcccagaggacgattctaataccgcaaaccataacctggagcaggtcgagtatgttttcctggtaatttttaccgttgagactgtgttaaaaatcgtggcctatgggctcgtgctacatcctagtgcttacattaggaatgggtggaatctcctggacttcatcatcgtggtcgtggggctgttctccgtactccttgagcaagggcccggaagacccggcgatgccccacacaccggcggcaagcctggagggtttgacgtaaaggccttgagggcattcagggtgctcaggcccctgaggctggtctccggtgtgcctagcctgcacattgtcctcaatagcatcatgaaggctttggtccccctgctgcacattgccctgttggttttgttcgttataattatctacgccattataggacttgagcttttcctgggtcgaatgcacaagacgtgctactttctgggaagtgacatggaggcagaggaggacccgagtccgtgtgcctcaagcggcagcgggagagcctgtactctgaatcagacagaatgtcgggggcggtggcccggccctaatggtggaattacgaattttgacaattttttctttgctatgctcactgtttttcagtgcgtgacaatggaaggatggaccgacgtactgtattggatgcaggacgctatgggctacgaactgccgtgggtctatttcgtatctttagtgatcttcggatccttctttgtgctcaacctggtcctgggcgtcctgtctggcgaattcagtaaagaaagagaaaaagccaaggcaaggggtgactttcagaagcagagggagaagcagcaaatggaagaagacctccggggctatctggactggattacccaggctgaggaactggacatggaggatccatctgcggatgacaacctcgggtctatggccgaggagggccgcgctggacaccgtcctcagctggccgaactcactaatcggagacgcggccgtcttagatggttctcccattctacccgctctacacatagcactagttcacacgcctccttgcccgcatccgacacaggatctatgaccgagacccagggtgacgaggacgaagaggaaggcgcacttgcctcgtgcactcgctgtctcaacaaaatcatgaaaacacgggtctgtcgccgactgagacgtgctaacagggtgctccgggcacgctgccgaagggctgtgaagtccaacgcgtgctattgggcggtgctgctactggtttttctaaacaccctaactattgcttctgagcatcatggccaacctgtatggctcacacagatccaagagtatgcaaataaagtgctgctctgtttgttcacagtcgaaatgctgcttaaactttatggtttgggtccttcggcttatgtgtcctccttcttcaacaggttcgactgtttcgtggtgtgtggggggatcctggaaaccacgctcgtagaagtgggtgcaatgcagccccttggcatttccgtactgagatgcgtcaggctcctgcgcatattcaaagtaacgcgtcactgggccagcctctccaatctcgttgcatctctcctgaactctatgaaaagcatcgcctcactgctgttacttctctttctgttcataatcatcttttccttgctgggcatgcagctgtttggcggcaaatttaatttcgatcaaacacataccaagcgatccaccttcgatactttccctcaggctctgctaacagtctttcagatcctgaccggggaggactggaacgtggtaatgtatgatggtatcatggcgtatggagggccattttttccaggaatgctggtatgcatttacttcatcatcctgttcatttgtggaaattatatcctgctgaatgtgttcctcgccatcgccgtggacaacttggccagcggagatgccggcactgccaaagataaggggggtgaaaagtccaacgagaaagacctgccacaagaaaacgagggattggtgccaggtgtcgagaaagaagaagaggagggagctagaagggagggcgctgacatggaagaagaagaggaagaggaggaggaggaggaggaggaggaagaagaggagggcgctggaggggtggaattgctgcaggaggtcgtgccaaaagagaaggtggtgcctatccctgaaggcagcgcctttttctgtctcagtcagacaaatccccttcgcaaagggtgtcatacactgatccaccaccatgtgttcaccaacttaatactcgtattcattattctgtctagtgtgtctctcgcggctgaagaccctatcagggcacactcttttcggaaccacattctcggatactttgactatgcctttactagcatatttacggtggagatactgttgaagatgaccgtcttcggggctttcctgcataggggtagtttttgtagaagctggttcaatatgctggaccttctggttgtctcagtgagtctgatttcttttgggatacatagtagcgcaatcagtgtggtgaagattctgagggtgctgcgcgtgctccggccgctccgggccatcaatagagccaaggggcttaaacatgtagtgcagtgcgtgttcgtggctattagaactattgggaacataatgatcgtgacgacactgctgcagtttatgttcgcctgcataggggtgcagctgttcaagggtaagttttacacatgcaccgacgaggccaaacatactccacaggaatgtaagggtagctttttggtgtaccccgacggggatgtgagcagaccactggttcgtgaacggttgtgggtcaactctgatttcaacttcgacaacgtccttagcgcgatgatggctctgtttactgtaagcaccttcgaggggtggcccgcgctgctgtacaaggccatagatgcttacgctgaagaccacggtccaatttacaattatcgggtggaaattagcgtgttctttatcgtttacattattattatcgcgtttttcatgatgaatatctttgtcggatttgtaattataacctttcgggcccaaggtgagcaggagtaccaaaactgtgagcttgataagaaccagagacagtgcgtggagtacgcactgaaagcccagccactccgtcggtatattcccaaaaaccctcaccagtaccgcgtgtgggccactgttaactcagcagcattcgaatacttaatgtttctcttgatactgctgaatacagtagctctggcaatgcagcactatgagcaaaccgccccctttaactatgctatggatatcctcaatatggttttcactggtctgtttacgatagaaatggtgctgaagatcattgcctttaagcctaagcactattttaccgacgcatggaacacttttgacgctttgattgttgtggggagtatcgttgatattgctgtcactgaggtgaacaacgggggacatttaggagaatctagcgaggattcctcccggatttctatcacatttttccgcttgtttcgagtcatgagattggttaagctgttatcaaagggggaagggatacggacactgctgtggacatttatcaagtcatttcaggcccttccttacgtggcgttgctaattgccatgatattctttatctatgccgtgatcggtatgcagatgttcggtaaagtcgccctccaggacggcacccagatcaaccggaacaacaactttcaaacatttcctcaggccgtcttgctgctctttcggtgcgccaccggggaggcctggcaggagatcatgctggcctctttgcccggcaaccgttgcgaccctgagtccgactttggtccaggagaggagtttacgtgcggatccaatttcgccatagcctacttcataagcttcttcatgctgtgcgcttttttgatcataaatctctttgtcgccgtgatcatggataattttgattatctgactagggattggtctatattaggaccgcatcacctcgacgagttcaagcgcatttggagtgagtacgatccaggggcaaaggggcgtatcaagcatttggacgtggtggcgttattgcggagaatccagccccccctgggcttcggcaaactgtgcccgcaccgggtagcgtgtaagcgcctagtggccatgaatatgcctttaaactcagacggaacggtgacatttaatgctaccctgttcgccttggtgaggacctctttaaagatcaagacagaaggtaaccttgaacaagcaaaccaagagctgagaatcgtgataaaaaagatttggaagcgcatgaagcagaaactgctcgatgaagtcatcccacctccggacgaggaagaggttactgtggggaagttttatgcgactttcttaatccaagactactttcgtaaattccgtcgtagaaaagaaaaaggactgttagggaatgacgccgcgccaagtaccagttcagcactgcaggcagggcttcgatctctccaggacctcggaccggagatgaggcaggcgctcacctgtgacacggaggaggaggaggaggaaggtcaggaaggtgttgaggaagaagacgaaaaggacctcgaaaccaataaggccaccatggtgtcccagccttcagctcggcgaggctccggaattagcgtgagcctcccagtgggggatcgcttgcccgactccctcagctttggtccctccgacgatgacagaggcacaccaacatcatctcagccttctgtgccacaggctggatcaaacacccatcggaggggaagtggggctttgatattcaccattcctgaagaagggaatagccagcctaagggaacaaaaggccagaacaagcaggatgaagatgaggaggttcccgaccggctgagttatttagatgagcaagcgggcactcctccgtgctctgtcctgctccccccacatcgggcccagaggtacatggatggacacttggtgccgcggaggaggctcctacctcccactcctgctggtagaaaacccagtttcacaattcagtgtctgcagcgccagggctcttgtgaagacctgcccatcccagggacctaccaccgcggcaggaactccggtcccaatcgtgcacaaggatcctgggcaacaccgcctcagagagggcggctgttgtacgccccactcctgctggtggaagagggagctgccggggagggttacctgggtagatcttccgggccactaaggacatttacctgtctccacgtgccgggtactcactccgatccatcccatggcaagagaggctccgctgacagtctagtcgaagcggtcttaataagtgagggacttggattgtttgctagagacccgcgattcgtcgccctggctaaacaggagatagccgatgcatgccggctgacactggacgaaatggataacgccgccagtgacctactggctcagggcacaagcagcctctattcagacgaggaatcaatattaagtcgattcgatgaggaggacctgggagatgaaatggcctgtgtccatgctttgtag

SEQ ID NO: 181241 - DNA, 5622 bp, Artificial Sequence
  Description of Artificial Sequence: Synthetic coding sequence
atggagcccagcagcccccaggacgagggcctgcggaagaagcagccaaagaaacctgtaccagagatcctgccccgaccacccagggctctcttctgtctcaccttggaaaaccctcttcgcaaagcctgcatcagcatagtggagtggaagcccttcgaaacaatcatcctgttaaccattttcgccaactgtgtcgcactggccgtgtacctgccgatgccagaagacgataacaattcactgaacctaggactagagaaactggaatattttttccttatcgtgttctccatcgaggccgcgatgaagattattgcatatgggtttctcttccaccaagacgcctatcttcggtcagggtggaacgttctggatttcactatcgtgttcctgggagttttcactgttatcctcgagcaagtcaacgtgattcagtcacatactgctccgatgtccagtaagggggccgggcttgacgtaaaggctctgcgcgcctttcgagtgctgagacctctgcgattggtcagtggtgtgcctagtttgcaagtggttttaaacagtatcttcaaggctatgctgccattgtttcacattgctctgctggttctttttatggtgattatatacgccattattgggctggaactctttaaaggaaaaatgcacaaaacctgctacttcatcggcaccgatatcgtggctacagtcgagaatgaagagccctcaccatgcgcccgtacgggcagcggccggcggtgcactatcaacggctcagagtgccgcggcggatggcctgggcccaatcatgggattactcacttcgataatttcggttttagcatgttaacggtgtaccagtgtatcaccatggaaggctggaccgacgtcctgtactgggtgaacgatgcaatcgggaatgagtggccatggatttactttgtgacattaatactactgggctcgttcttcattctgaacctggttctgggcgtgctgtcaggggaatttaccaaagaaagagaaaaggctaagagtagaggtactttccaaaagctgagagagaaacagcagctggacgaagacttaagaggctatatgtcctggatcacacagggcgaggtgatggacgtggaggactttcgagagggcaaactgagtctcgacgaggggggcagtgataccgagtctctgtacgaaattgccgggctgaacaaaattattcagtttataagacactggcgccagtggaaccgaattttccgatggaagtgccatgacatagtgaagagcaaagtgttttattggctagtcattctgatcgtggcccttaacacactgtcaatcgcgagcgagcaccataaccaacccctttggctgaccagactgcaggatattgcgaaccgggtgctgctctctctcttcacaacagagatgctgatgaagatgtacgggctcggcctgaggcaatatttcatgtccatttttaacagatttgactgcttcgttgtgtgtagcggcatcctcgagatactcctggtcgaaagtggtgccatgacccccctgggcatctctgtcctgagatgtatcaggctcctgcggatttttaagatcacaaagtactggacatcgctgtccaacctagtggctagcctgttgaattctatccgcagcattgcatcccttttgctgctactgtttttgtttatagtcatttttgcactcctggggatgcaactattcggcggtcggtacgacttcgaggacacagaagtgaggagaagcaactttgacaactttcctcaagcactaatttctgtctttcaagtcctgaccggcgaggattggacaagtatgatgtacaatgggatcatggcttatggggggcccagctaccctggcatgctggtgtgcatctacttcatcattctcttcgtgtgtgggaattacatcctgctaaatgtgtttcttgcgatagcagtcgacaacctcgccgaagctgagagcctaacttctgcgcagaaagccaaggccgaggagaaaaagcgcaggaaaatgtctaagggactccctgacaaatctgaagaagagaagagcacgatggccaagaagctggagcaaaagcccaagggagaggggatccccacaaccgctaaattgaaaatcgacgaattcgaatcaaacgtaaacgaggtgaaagatccctacccttctgccgattttcctggggatgacgaagaggacgagccagaaatcccactgtcaccacgcccacggcccctggctgaactacagctgaaagaaaaggctgttccaatacctgaggcttcttccttctttatctttagcccgaccaacaagatacgggtgctgtgtcatcgaatcgtcaatgcaacgtggttcaccaattttatactcctgtttatcctgttatctagcgccgccctcgccgccgaagatcccatcagagcagactctatgaggaatcagatcttgaagcacttcgatattggattcacatcagtatttacggtagaaattgtgctaaagatgactacttacggcgccttcctccataaaggatcattctgtcgaaattactttaacatgctcgaccttctggtagtggctgttagtctgatttctatgggcctggaatcctctgccatctcggttgtgaagattctgcgtgttttgagagtgttgaggccactccgggctatcaatcgggccaagggactgaaacatgtggtacagtgcatgttcgtggcaatcagcaccatcgggaacatcgtcctcgttacgacattactgcagtttatgtttgcctgtataggcgttcagttatttaagggaaagtttttccgatgcaccgatctctccaagatgactgaggaggaatgcaggggttattactacgtctacaaggacggggatcccatgcagatcgaactgcgacaccgtgagtgggtccatagtgattttcacttcgataatgtgttaagcgcaatgatgagccttttcacggtgtcaacctttgagggctggccacaacttttgtataaagcaattgattccaacgccgaggatgtagggcctatttacaataaccgcgtggaaatggcaatatttttcatcatttacatcattttgattgccttttttatgatgaatatttttgtgggatttgtcattgtcacctttcaggagcagggggagacagagtataaaaactgtgagctggataaaaaccagcgccagtgcgtccagtatgcgcttaaagctcgaccactgagatgctatattcctaagaacccttatcagtatcaggtttggtacatcgtgacaagctcatactttgaatacctgatgttcgctctgatcatgctgaatacaatttgtctaggaatgcagcactacaatcaatcagaacaaatgaatcacatctccgacattctgaatgtggccttcacgattattttcacgctggagatgatactaaaactcatggctttcaaagctaggggctacttcggggacccttggaatgtgttcgactttcttattgtgattgggagcattattgatgtaatcttgagcgaaatcgatacattcctagcttctagcgggggcctgtactgtcttggaggtgggtgcgggaatgttgatcccgatgagtccgccagaatcagttctgccttctttaggctctttcgcgttatgagacttatcaaactcctgagccgcgcggaaggcgtaaggacactcctgtggaccttcataaagagctttcaagccctgccctatgttgcgctgttgatagtcatgctctttttcatttacgctgtaattggaatgcagatgtttggaaaaatagcattagtggacgggacacagatcaacagaaataataatttccagactttccctcaagcagttttattgttattcagatgcgccactggagaggcctggcaggaaattcttctcgcctgttcttacgggaaactctgtgatcccgagtccgactatgcacctggagaggagtatacttgtgggacaaattttgcttattactactttatcagcttctacatgttatgcgcctttctggtcattaatctctttgtcgccgtgatcatggacaatttcgattatcttacgagagactggtccatactcggacctcatcacttagatgagttcaaagcgatctgggctgaatacgatccagaagccaaggggaggattaaacacctcgacgtcgtgacattactaaggcgcatccagccccccctgggctttggcaagttttgtccccatcgtgtagcatgtaagaggttagtgggaatgaacatgcccctgaacagtgacggcacagtgacgttcaacgccacactgttcgcgctggtgcggaccgctctgaaaattaagactgagggcaacttcgagcaggctaatgaggaactgagagctattataaagaagatctggaaacggacatcaatgaagttgctcgaccaggtgattccccctattggtgatgacgaggtgacggtgggcaagttttatgctacttttttgattcaggaacacttccggaaattcatgaaacgccaggaagaatattacggatacaggcctaagaaggatatagtgcagattcaggccggtttacgaaccattgaggaagaagcagctcccgaaatttgtcgcaccgtgagcggggatctggctgctgaggaagagctcgaaagagccatggtggaggcagctatggaagagggcatcttccggcgcacgggcgggcttttcggacaggttgacaacttcttggaaaggacgaattcgctgcccccagttatggctaaccagaggccactccaattcgcagagatcgagatggaagagatggagtcaccagttttcttagaggacttcccacaagatcctcggaccaaccccctcgcccgggccaacaccaataatgccaatgccaatgtagcttacgggaatagtaatcacagtaatagtcatgtgttctcttccgttcactatgagagggagtttcctgaagagaccgaaacaccggccacacgaggccgtgccctggggcagccatgtcgcgttcttggaccacactctaagccctgcgtggagatgttgaaaggactcctgacacagagagccatgcctcgtgggcaggctccaccagccccctgccagtgcccccgagttgagagttctatgccagaggatcgaaagtcctccactcctggctctctccatgaagagaccccccactccaggtcaactcgcgagaacacttcccggtgctccgcccctgccacagcactcttgattcagaaagcgctcgtgaggggcgggctagggactctggcagcagacgccaattttatcatggctaccgggcaggctttggccgatgcctgccagatggagccggaggaggtcgaaattatggccaccgagctcttaaagggacgggaggcgcccgagggaatggccagttcccttggctgcctgaacctcggttcctctctggggtcgctggaccagcaccaaggtagccaagaaacactcattccacccaggctgtag

SEQ ID NO: 181242 - DNA, 5565 bp, Artificial Sequence
  Description of Artificial Sequence: Synthetic coding sequence
atggagcccagcagcccccaggacgagggcctgcggaagaagcagcctaaaaagccagtgcctgaaatccttcctcggccaccaagagcccttttctgtctcactctcgagaaccctctgcggaaagcgtgcatatcaattgtagagtggaaaccattcgagactataatccttctgactatttttgccaactgtgtggccctggctgtctatctgccaatgccggaagatgacaacaactctctgaatttaggactcgagaagttggaatatttctttctgattgtatttagtattgaggctgccatgaaaattattgcttatggctttctgttccatcaagatgcttatctcagatctggatggaatgtattagacttcaccattgtgttcctgggagtgttcactgtgattctcgagcaggtcaacgttatccagtctcataccgcacctatgagcagtaaaggcgccgggctcgacgtaaaggctctcagggccttccgggtgctaaggcctctgaggctggtgtctggtgtcccgagtcttcaggtggtcctgaattcaatatttaaggcaatgctccctctgttccatatcgctcttctggtgctgttcatggtcataatctacgctattatcggattagagctgtttaaagggaagatgcacaagacttgctatttcatcggaaccgacatcgtggccactgtagagaatgaagagccaagcccgtgcgcacgcacaggaagtggtagacggtgcacaataaacggttctgaatgccggggtggctggccaggccccaatcatggcattactcactttgacaacttcggcttctcaatgctgacagtctaccagtgtattaccatggaagggtggaccgacgtgctctactgggtgaacgatgcaattggaaacgagtggccttggatttattttgtgacactcatcctgctggggagctttttcatactgaacctcgtccttggagtcctaagtggcgagtttacaaaggagagggaaaaggcgaaatcccggggtacattccagaaactgcgtgaaaagcagcaactcgacgaggacctgagagggtacatgtcatggattacccagggggaggtgatggatgtggaggacttccgcgaggggaaactgtccctcgatgagggaggctccgacacggaatcactgtacgagatcgcaggtctcaacaaaattatccagttcatccggcattggagacagtggaatcgcattttcaggtggaagtgtcacgacatcgtcaagagtaaggttttttactggctggtcattctcatcgtcgctctgaacaccctgtccatagcatctgagcaccacaatcagcctctgtggctgactcggcttcaggatatcgcgaaccgggttctgctctcccttttcaccactgagatgctgatgaaaatgtatgggctagggctacggcaatatttcatgagtatcttcaacaggtttgattgttttgttgtatgctccggcatcctcgaaattctgcttgtggagagtggagccatgactccgctcggcattagcgtgctaaggtgtattcggctgctgcgcatctttaaaatcacgaaatattggacgtccctcagcaatctggtggcctcacttctgaacagtattagaagtatcgccagcctgctgctcctgctgtttctatttatcgtgatcttcgcccttctagggatgcaactctttggcggaagatatgatttcgaggacacggaagtgcgcaggtccaattttgacaattttccccaggcccttatttccgtgtttcaggttctcacgggagaggactggaccagtatgatgtacaacggcatcatggcgtacgggggacccagctacccgggtatgctggtttgtatttacttcattattttgttcgtatgcggaaactacattttgctgaatgtgtttctggcaatcgcggtggataatctcgcggaggcagagtccctcacatctgcccagaaggccaaagccgaagagaagaaaagacggaaaatgtctaaaggtctccctgataagtcggaagaggagaaatctacaatggccaagaaattagagcagaaacctaaaggggaaggcatcccaaccacagccaaacttaagatcgatgaattcgaatcgaacgtgaatgaggtaaaggacccttatccatcagccgactttccaggcgacgacgaggaggatgagcccgagatcccgttgtcccccaggccccggcctttagccgaattgcagctcaaggaaaaagccgtgccaattcccgaggcctcatctttcttcattttttcaccaactaacaaaatcagagtactgtgccatagaatcgttaatgctacttggtttaccaatttcatacttctctttatcctgttaagctcagcagcactcgccgctgaggatcctattagagccgatagcatgcggaatcagattttgaaacacttcgatatcggattcacatccgtctttactgttgaaatcgtgctgaagatgacaacatatggcgcctttctgcacaagggttccttctgcagaaattacttcaatatgctggatctgctggtggtggctgtaagcttaatttctatgggattggaatcgtccgccatcagcgttgtgaagattctgcgcgttctgcgggttctcaggccactgcgagctatcaacagagccaaggggctgaagcacgtagtccagtgtatgttcgtcgccatttctaccattgggaatatcgtcctcgtcaccacactgttacaatttatgttcgcttgtatcggtgtccagctgttcaaaggtaaattttttagatgtaccgatctctcaaagatgacagaggaagaatgtaggggttattactatgtgtataaagatggcgaccctatgcagatcgagttaaggcatagggagtgggttcacagtgattttcattttgataatgtgctttctgctatgatgagcctgttcaccgtctccacatttgaggggtggcctcagcttctgtataaagccatcgacagtaatgccgaagatgtgggcccaatttataacaacagagttgaaatggccatattctttatcatatacatcatcctgattgccttttttatgatgaatatcttcgtgggcttcgttatcgtaacattccaggagcagggcgaaaccgaatataagaattgtgagcttgacaagaatcagagacagtgcgtccagtatgctctgaaagccaggccacttcgctgctatattcccaagaacccttaccagtaccaggtgtggtatattgtcacaagtagctatttcgagtacctcatgttcgccctaataatgctaaacacaatctgcctcggaatgcaacactacaaccagagcgaacagatgaaccacattagtgatatccttaatgtggctttcaccatcatctttaccctggagatgatcctgaaactcatggcattcaaggcccgtggctacttcggtgatccttggaatgttttcgacttcttgatcgtaataggctcgatcatcgatgtcatactctcagagattgatgaccctgacgaaagcgctcggatctcgtcagcgttctttaggctctttcgagtgatgcgcctgatcaaactcttaagtcgcgcagagggggtgaggactctcttgtggacattcattaagagtttccaagccctgccttatgtggcgctgcttatcgtgatgttgtttttcatttacgccgttattggtatgcaaatgtttgggaagatcgccctggtggacggaacgcagatcaatcggaataataacttccagaccttcccacaggcagtgttgcttctgtttcgctgtgccactggcgaggcctggcaggaaatcctcctggcttgctcttatgggaaactatgcgatcccgaatccgactacgcacccggcgaagaatatacctgcggcacaaactttgcctattactactttatttctttttacatgctgtgtgcttttctcgtgatcaacttgtttgtcgctgtaatcatggataactttgactacctgactagagattggtcaatcttaggcccccatcacctggatgaatttaaggcgatctgggctgagtacgatcctgaggcaaagggccggatcaagcacctggacgtggtgaccctcctccgcaggatccagccacctctcggttttggcaaattctgtccacatagggtggcatgcaaacgcctggtcggtatgaacatgccactcaactccgatggcaccgtaaccttcaacgcgaccctctttgctctggtacgaaccgcccttaagatcaagacagaggggaacttcgaacaggctaacgaggaactgcgagcaattataaaaaagatttggaagcggacatctatgaagcttctagaccaggtaattcctccaattggtgacgatgaagtgacagtaggtaagttctatgccacatttttgatacaggaacacttcagaaagttcatgaagagacaggaggagtactacgggtaccgaccaaaaaaggacattgtccaaatccaggctggacttagaacgatcgaagaggaagccgcaccagagatctgccgaactgtctctggcgacctggccgccgaggaggagttagaaagagctatggtcgaggccgctatggaagaggggatttttaggaggaccggtggactttttggtcaggtcgataactttctagagagaaccaattccctgcctccggtgatggctaatcagaggccactgcagttcgctgaaatagagatggaagagatggagtcgccagtctttctggaagatttcccacaagacccccgaaccaatcctctggcccgggccaacacgaataacgcgaacgccaacgtagcctatggcaatagcaaccactctaactctcatgttttcagtagcgtgcactacgagagggagtttcctgaagagaccgagacgccggccacacgtgggagggctctaggacagccctgccgcgtactgggtcctcacagtaagccttgtgttgagatgctcaaagggctccttacccagagagcaatgccaagaggacaggcaccccccgccccctgtcagtgtcctcgggtggaatcttctatgccagaagaccgcaaatcctccactccgggctccctgcatgaagagacccctcattccaggagcacacgggaaaacacttctcgatgttccgcccctgccactgccctactgatccagaaagctctcgtccgcggcgggctgggtacccttgccgccgacgcaaatttcattatggcgacagggcaggccctggccgacgcttgtcagatggagcctgaggaagtggagatcatggctacggaacttctgaaggggcgcgaagcacctgagggcatggctagctccctcggctgcttaaatctggggagtagcctgggaagtctagaccaacaccaggggagccaggagaccctgattccacctcgcctgtag

SEQ ID NO: 181243 - DNA, 4602 bp, Artificial Sequence
  Description of Artificial Sequence: Synthetic coding sequence
atgaagacccacctggaccggcccctggtggtggagctgggccgggacggagctaggggaccagtgggaggtaaagcgcggcctgaagctgccgaagctcctgagggtgtcgatcctccccgacggcaccatcgacaccgtgataaagataaaactcccgccgccggcgaccaggaccgtgcagaagctcctaaagccgagagcggggagccaggcgccagggaagaacgccctaggccacacagaagtcacagcaaggaggcagctggccccccggaggcacgcagcgaacgcggcagaggccccgggccagagggtggccgccggcaccatagaaggggctctcccgaggaggccgccgagcgggaaccgaggagacaccgcgcccaccgtcatcaggatccttctaaggaatgcgcaggtgccaagggtgaaagacgagctcggcatcggggcggccctagggccggccctcgcgaggccgagagtggggaggagcctgcccggcgccacagggcgcgacacaaagcccaacccgcacatgaggccgttgagaaagaaaccaccgaaaaagaagctactgaaaaggaggccgagatagtagaggcagacaaagagaaggagttgcggaaccaccagccccgggaacctcactgtgacctcgaaacaagtggtacagttaccgttgggcctatgcacacactgccctccacgtgcctgcagaaggtggaagagcagccagaggatgcggacaaccagcgcaatgttactcggatgggcagccagccaccggatccgaataccatagtgcatattccggtgatgctgactgggcccctgggcgaagccacggtcgtcccttctggaaatgtggatcttgaaagccaggcagaagggaaaaaggaggtggaagctgacgacgtgatgaggtcaggacccagaccaattgttccttactcttccatgttttgcctttcacccactaacctgctgcggcgcttttgccactacattgttactatgcggtactttgaggtcgtcattctcgtagtaatcgcattgtcaagcatcgcgttggctgccgaagatcccgtgaggacggacagcccccggaataacgccctaaagtatttagactatatcttcacaggtgtcttcacgttcgagatggttatcaagatgatcgacttgggactcttgttacatcccggagcttatttccgggacctgtggaacattctggattttatcgtggtgagtggtgcgcttgtggcgtttgcatttagctcctttgtgggcggctctaaagggaaagacatcaataccattaaatcactgcgggttctgcgcgtccttcggcctctcaaaactatcaagcgactgccaaaactgaaggccgtattcgattgcgtggttaacagtcttaaaaacgtgctaaacatcctcattgtctatatgctctttatgtttatttttgcagtcatcgccgtgcagctgttcaaaggaaagtttttctattgcacagacgagtccaaagagctcgaaagggactgtagagggcaatacctagattacgaaaaagaagaagtggaagctcaacctcgacagtggaaaaagtatgacttccactatgataacgtgctatgggctttgctgaccctctttacagtgtcaaccggtgaggggtggcctatggtactcaaacactcagtcgatgctacatacgaggagcaaggacctagcccagggtacaggatggaactctcaatattttacgtcgtctactttgtggtgttccctttttttttcgtcaacattttcgtggccttgatcatcattacatttcaggagcaaggcgacaaagtaatgagcgagtgttctttggagaagaacgaacgagcatgtatcgatttcgccatttcagctaagcccctcacgcggtacatgcctcaaaatcgacagagtttccaatacaagacctggactttcgtggtgtccccccccttcgaatattttattatggccatgatcgctctcaacaccgtggtgttgatgatgaagttctatgatgccccatacgagtacgagctgatgctgaagtgcctcaacatcgtgtttactagcatgttctctatggagtgtgtcctcaaaatcattgcattcggcgttttgaattatttccgtgacgcttggaacgtattcgatttcgtcactgtgctgggcagtattaccgacatcttggtgaccgaaattgctaacaatttcatcaacttgtcattcctgaggctgtttcgcgccgcgagacttattaagctgcttcgacagggatatacaattcgcatcctgctctggaccttcgtgcaaagctttaaagctctcccttacgtttgtctcctgattgcgatgctgttcttcatctatgcaattatcggcatgcaagtttttgggaacatagctctggacgacgatacatccatcaatcggcacaacaactttaggacatttttgcaggcattgatgcttctgtttcgttcagcgacaggggaggcatggcacgaaatcatgctaagttgtctgtctaatcaggcctgtgacgagcaggctaacgcaacggaatgtgggtcagacttcgcgtatttttacttcgtgtcattcattttcctgtgcagcttcctcatgttgaatctgttcgtagccgtgattatggataattttgagtacctgacccgagacagttcaatcctcggaccccaccatctggacgaattcatcagagtctgggccgaatacgatcctgcagcatgcggacggatctcttacaatgatatgttcgagatgctcaaacacatgagccccccgctgggcctggggaagaaatgccccgcccgtgtggcctacaaacgattggtaagaatgaatatgccaatctcgaacgaggacatgacagttcactttaccagcacccttatggccctgatcaggacagcccttgagatcaaactggcacccgccgggacgaaacagcaccagtgtgatgccgagctccgaaaggagattagtgtggtctgggctaaccttccacagaaaaccctggatttgctggtgcctccacacaagcctgatgagatgaccgtagggaaagtctacgctgcgcttatgattttcgacttctacaaacaaaacaagaccacgagagaccagatgcagcaggccccaggcggtctgagccagatgggtcctgtgtccctctttcatccgctgaaagctacccttgaacaaacacagcctgctgtgttacggggtgccagggtgtttctgcgacagaaaagctctacttccctaagcaacggtggtgcaatccagaaccaggaatctggcattaaagagagcgtgagttgggggactcagcgcacccaggacgctcctcacgaggcccggcctccattggagcggggacatagtacagaaattcctgttggccggtccggagctctcgccgttgacgtgcagatgcagtcgatcacaagacgggggccagacggagaaccgcagcctgggctggagagtcaagggcgcgcggctagcatgcccaggttggctgcagagactcagccagtgacagatgcctcaccaatgaagcgaagcatttccacattggcccagcgacctcgagggactcacctgtgttccaccacccctgaccgcccacccccgtcacaggcgtcatcacaccaccaccaccatagatgccacaggcggcgcgacagaaagcagagatccctggagaagggcccgtctctgtccgctgatatggacggggctccttccagtgctgtgggaccagggctacctccgggtgaaggccccacaggatgtcgacgagagagggagcgccggcaagagaggggccgatcacaggagaggcgccaaccttccagttccagcagtgagaaacagcgattttatagttgtgatcggttcggtggaagggaacctcccaagccaaagcctagcctgtcgtcacaccctacatccccaactgctggacaggaaccagggccacatccgcagggctccggtagcgtcaatggctcaccgcttctctctactagcggagccagcactcccgggcggggcggccggcgccagttgccacagactccgctgactccccgaccatccatcacatataaaacagccaatagtagccctatccactttgcaggagctcaaacatccctgccagccttttctcccggccgactgtccaggggcctgtctgaacacaacgctcttctccaacgggatccactgtcacagcctctggcccccggtagtaggatcggatcagacccatatcttggccagcggttagatagtgaggcctccgtacatgctctcccagaagacaccttgactttcgaggaagccgttgcgactaactccggtcgctcctcaaggacatcatacgtcagtagcctgacaagtcagtcccacccccttcggagagtacctaatggataccattgcaccctgggcttgtcgagtggaggtcgggccaggcactcgtatcaccatcccgatcaggaccactggtgttag

SEQ ID NO: 181244 - DNA, 306 bp, Artificial Sequence
  Description of Artificial Sequence: Synthetic coding sequence
gacaacctggccaacgcccaggagctgaccaaggacgaggaggagatggaagaggccgcgaatcagaaactggccctgcaaaaggcgaaggaggttgcggaagtaagcccaatgagtgccgctaatatcagcatcgctgccttcgtgaagcaggcacggggaacagtgagccggtcaagttctgtgtcctctgtcaacagtccgcgccaacaaaatagtgcaaaggcgagatccgtgtgggaacagcgcgctagtcaactcagactgcagaacctgagggcctcctgtgaggcactgtactcgtag

SEQ ID NO: 181245 - DNA, 6714 bp, Artificial Sequence
  Description of Artificial Sequence: Synthetic coding sequence
atggtgcggttcggcgacgagctgggcggccggtacggcggccccggaggcggagagagagctaggggcggtggcgctgggggagcagggggccccggaccaggtgggctgcagcccggacaacgtgtgctctacaagcaatctatcgcccagagggcccgaaccatggctctgtacaatcccattccagtgaagcaaaactgtttcactgttaataggtcccttttcgtgtttagtgaggacaatgtggtacgcaaatatgctaaaaggatcactgagtggccaccgtttgaatatatgatcttggccactatcattgccaactgcatcgtgttagcactggagcagcacctccctgacggagacaaaacaccgatgtctgagcggttggatgacaccgagccgtatttcatcggaatcttctgctttgaggccgggatcaagattatcgcacttggcttcgtatttcataaagggtcatacctccgaaacggatggaatgtcatggactttgtcgtcgtgttgacaggcattctggcaaccgctggcacagatttcgatttgcgcacactgcgcgccgtccgcgtgctgcgcccacttaaattggtgagcggaatcccctcacttcaggtggtcttgaagtctatcatgaaagcgatggtgccgctgctgcagatcggcctgctcttgttttttgcaatcctgatgttcgcgattatcgggttggagttttatatggggaagttccacaaggcctgctttcctaacagtaccgacgccgagccggtgggtgattttccatgtggtaaggaggcacccgcgcgactgtgtgagggagataccgagtgccgagaatattggcctggtcctaactttgggataacaaacttcgataatattctgttcgcaattcttacagtcttccaatgtatcactatggaaggctggactgacatactatataataccaatgatgctgccgggaacacctggaattggttgtattttataccgctgatcataataggctctttctttatgctgaacttggtcctcggagtcctaagcggagaatttgccaaagaacgggaaagagtggaaaatcgccgggcatttttaaaactgagacgacaacagcagatcgagcgcgagctgaatggttacctggaatggattttcaaggctgaagaagtaatgttagctgaagaggatcgaaatgccgaggaaaagtcaccactggacgttctgaagagagccgcaacgaaaaaatcgcgaaatgatctgattcatgctgaggagggcgaggataggttcgccgacctctgcgccgtgggctcgccctttgcacgtgccagcctgaaaagtggcaagactgaaagttctagttattttcgcaggaaggaaaaaatgttccgctttttcatccgtcgaatggtcaaagctcaaagtttttattgggtggtgctctgcgttgtagctttaaataccttgtgtgtggctatggtacactataaccagcccagacgactcacaaccacgttatacttcgcagaatttgtgtttttaggcctcttcctcacggagatgagtcttaagatgtatgggctgggacccagatcctattttagaagttctttcaattgcttcgattttggcgtgatagtgggctccgtgtttgaggtagtgtgggccgccattaagccaggcagttcgtttggtatctctgttctccgcgccctccgtttactgcgaatattcaaagtgactaagtactggagcagtctacgaaatctggtagtgagcctcttaaattctatgaagtctattatttctttacttttcctgctgttcttgtttatcgtggtgttcgcgctgctcggcatgcagctgttcggcggacagtttaacttccaagacgaaacaccaacaactaatttcgacacattcccagctgctatcctgactgttttccaaattctgactggggaagattggaacgcagtcatgtaccatggtattgagtcccagggtggggtctctaaagggatgttttccagcttttatttcatcgtcttgacattgtttggtaattataccctgctgaacgtgttcctcgccatcgctgtggacaatctcgctaacgcccaagagctgacaaaggatgaggaggagatggaagaagcggccaatcaaaagctggcactccagaaagccaaggaagtcgcagaagtatcaccaatgagtgctgctaacatctcgatcgctgctcgacagcaaaactcggctaaggccaggagcgtgtgggagcagagagctagccaactgcggttacaaaacctaagagctagctgcgaggcgctctacagtgaaatggaccccgaggaacggcttcgcttcgccacaacaagacaccttcgccccgacatgaaaacacacttagatcggcccttggtggttgagcttggtagagacggagctcgtgggcccgtcggcggaaaagctcggcccgaggcagccgaagctcctgagggagtagaccctcccagaaggcatcaccgccatcgggacaaagacaaaactccagcagccggcgaccaagaccgcgcggaggcaccaaaggctgaaagtggcgagcctggggctagagaagaacgaccccggccccaccgctcacattccaaagaggctgccggccctcccgaggctagatccgagcgcggcaggggacccggccctgaggggggacgcaggcatcaccgaagagggtccccggaagaagctgcagagcgggagccacggcgccacagggcccaccggcatcaggatccttccaaagaatgtgccggtgctaagggtgaacgacgggcacggcacagggggggccctcgagcagggccaagagaggctgagagtggcgaggaacctgccaggcggcacagagcccgacataaagctcagcccgctcatgaagctgtggaaaaagagacaactgaaaaggaggcaaccgagaaggaggctgaaattgtcgaagccgataaagaaaaggagttgaggaatcaccagcctcgcgaacctcattgtgacctcgaaacttcaggaaccgttactgtggggcccatgcacaccctgcccagtacatgtctgcagaaggtggaggaacagcccgaagatgcagataatcaaaggaatgtgactaggatggggtcacaaccacctgacccgaacaccatagtgcatatcccagtcatgctgactgggccacttggggaggccacagtggttcctagtggtaatgttgatctagaatcacaggccgaaggaaaaaaagaagtagaagccgacgatgtgatgaggagtggaccgcgacccatcgttccttactccagtatgttttgcctatcccccaccaacttgctgcggcgattctgccactacattgtgactatgcggtattttgaggtggttatcttggttgtgatcgcactgtccagcatcgctcttgctgctgaggaccccgtgcgcacggattctccaagaaacaacgccttgaagtatctggactacatcttcactggggttttcacatttgagatggtgattaaaatgatcgacctgggcctccttctccacccaggcgcatacttccgtgatctctggaatatcctggactttatcgtcgtgtctggcgcactcgtggccttcgctttcagcgggagcaagggtaaggatatcaacaccataaaatctttgcgtgttctacgcgtgctccggcctcttaaaacgattaaacgtctaccgaaactgaaagcggtgttcgattgtgtggtcaattccctcaagaacgtgctgaatatcctaattgtctatatgctattcatgtttatattcgcagtgatcgccgttcaacttttcaaagggaaattcttttattgcacagacgagtccaaagagctggaaagggattgcagaggccagtacttggattatgagaaagaggaggtcgaagcccagccacggcagtggaaaaagtatgactttcactacgacaatgtcctgtgggcactgcttaccctgtttaccgtgtctaccggcgagggctggcccatggtgctgaagcacagtgtagatgcgacctatgaagaacagggccccagtccagggtatcgcatggaactttctattttctacgttgtctatttcgtcgtgttcccgtttttttttgtgaacattttcgttgccttaatcatcattacctttcaggaacaaggggacaaggtcatgtctgaatgcagtctagaaaagaacgaaagagcgtgtattgacttcgccatcagcgcaaaacccctgacaaggtatatgcctcaaaatcggcagagctttcaatataagacctggacctttgtcgtctctcccccttttgaatacttcattatggctatgattgcattgaacactgttgtcctgatgatgaagttctatgatgccccctatgagtatgaactaatgctcaagtgcctaaatattgtgttcacctcaatgtttagcatggagtgcgttctgaagattattgccttcggagttctgaactacttcagggacgcctggaatgttttcgacttcgttacagtactcgggtcgattacggacatcctggttacagaaatcgcagagaccaataatttcatcaacttgagcttcttgcgtctcttccgggcggcccggctgataaagttacttaggcagggctacactatacggatacttctgtggaccttcgtgcagtcattcaaagcattgccatacgtgtgtcttctgattgcaatgctgttctttatctatgccattatcggcatgcaggtcttcggtaatattgctctggacgacgacacctctatcaaccgccataataacttcagaaccttcctccaggccctgatgctgctgtttcgtagtgccacaggagaggcgtggcacgaaatcatgctgtcatgcctaagcaaccaggcctgtgacgagcaggccaacgctacagagtgcggttctgatttcgcctatttctacttcgtgagcttcattttcctttgttcttttctgatgttaaatttgttcgttgctgtgatcatggataattttgaatacttaacacgtgatagcagcatcctgggaccacaccacttggacgagtttattagagtctgggctgaatacgaccccgctgcctgcggcagaatctcctacaacgacatgtttgaaatgcttaagcacatgtcaccacctctcggcctgggtaagaaatgtcccgcacgggtagcttacaagagactggtgcgcatgaatatgccgatctctaacgaggacatgaccgtgcattttacatccaccctcatggccctcatcagaactgcactggagatcaagctggccccagctggaaccaaacagcatcagtgcgatgccgaacttcgtaaagaaatttcagtggtgtgggcgaatctcccccagaaaactttggatctcctggtgcctcctcacaaaccagatgagatgacggtgggaaaggtgtacgctgctctgatgatattcgatttctacaaacagaataaaacaactagggatcagatgcagcaggcacccggaggcctgtcccagatggggcctgtgtctctgttccatccactgaaggctacccttgagcagacacagcccgccgtcttgcgtggtgcaagagtatttctgaggcaaaaaagctctacatcgctgtctaatgggggggcaatccaaaatcaggagagtggcatcaaagaaagcgtaagctgggggactcagcggacccaggatgccccacatgaagcaagaccgccattggaacgaggacattcaactgagataccggtcggacggtcaggtgccctagccgttgatgtccagatgcagtcaataactaggcgcgggcctgatggcgagccacagccaggtttagaaagccagggaagggccgctagcatgccaaggctggccgccgaaacccagccagttacagacgcctcacctatgaaacgaagcatcagcaccctggcacagcgacctcgaggcacgcacctgtgttctactacacctgatcggccacctcccagccaggccagctctcaccatcatcaccaccggtgtcataggagaagagatcggaagcagcggtccctagagaaaggaccttccctaagcgccgacatggatggggcccccagttcggccgtcggacccggtctccctcctggcgagggccctacaggctgccgcagggagagggagcggagacaggaaaggggaaggagtcaggaaaggaggcagccttcttcatcttcctcggagaaacagcgtttttatagctgcgaccgatttggtgggcgggaaccaccgaaacccaagccatctctgagcagtcatcctacctcacctaccgctggtcaggaacccgggccccacccccaagccgggtctgcggtggggtttccaaacaccaccccgtgctgtagggaaacccccagcgcatctccatggcctctcgccctcgaactcgcactaacacttacatggggttccgtgtggactgtccggcctctgagtaccccctgtttgcggacactgtcactcagtaggagactgtggcctccaacgagagccgccccgcctggcctcccgacttgcccgccatag

SEQ ID NO: 181246 - DNA, 7023 bp, Artificial Sequence
  Description of Artificial Sequence: Synthetic coding sequence
atggtgcggttcggcgacgagctgggcggccggtacggcggccccggtggcggcgagagggctcggggcggaggcgccggcggtgctggtggtcccggtcctggcggactacagccagggcagagagtcctgtacaaacagagtattgcgcaaagagctagaaccatggccttgtataacccaatccctgtgaagcagaactgcttcacagtcaaccgcagcctctttgtttttagtgaagacaatgtggtaaggaaatacgcaaagaggattaccgagtggccccccttcgagtacatgatcctagcaacaataatcgctaactgtattgttctggcccttgagcagcaccttcctgacggagataaaacccctatgtccgagcggttagacgatacggagccttactttatcggcattttctgtttcgaggccggcattaaaatcatcgcgctgggatttgtatttcacaagggtagctatctccgcaacggttggaatgtcatggactttgtcgtcgtgttgaccggaattttggctacagcgggaaccgacttcgatctgaggacactgcgtgcagtacgcgtgctgcggccactgaagttagttagcggtatcccaagtctccaagtggtgctcaaatctatcatgaaggcaatggtgcctctgttacagatcgggctgctcttgttctttgcaatcctgatgttcgctattataggcctcgaattctatatggggaaatttcataaggcctgtttcccaaactcgacagacgccgagcccgtcggcgatttcccctgcggaaaggaggctccagctcggctttgcgagggcgacacagaatgcagggagtattggccaggtccaaattttggcatcacaaatttcgataacatcctctttgcaatcctgacagtgttccagtgcattaccatggaaggctggacagacattctctacaataccaacgacgcagcaggcaacacctggaactggttatacttcattcccttaattataattggcagtttttttatgctgaacttggtgttgggggttttatcgggcgaatttgcgaaggagagagaaagggttgaaaaccggcgtgcctttctaaagttgaggcgccaacaacaaatcgagcgggagctgaacgggtacctcgagtggatcttcaaggcagaagaagtcatgctcgctgaggaggaccggaacgccgaagagaagtcccccctggacgcagttctcaagagggctgcgaccaagaagtccaggaacgacttgatacacgctgaggagggtgaagatcggtttgccgacctctgtgcagtgggctccccgtttgcaagagccagcttaaagtccgggaagaccgagtctagctcttacttcaggcggaaggagaaaatgtttagatttttcattcgccggatggttaaggcgcagagcttctattgggttgtattgtgcgtggttgctctaaatactctgtgtgtggcaatggtgcattataaccagccgcgaaggctgaccaccactttgtatttcgcagaattcgtcttcctgggactctttttaactgagatgtctctgaaaatgtacggtcttgggccccggagctacttccgcagcagcttcaattgtttcgacttcggcgtgatcgtggggtccgtcttcgaagtggtatgggctgctattaaacccggaagctcttttggaatttcagtcctgagggccttacggctgctgcgcatcttcaaggtgaccaaatactggtcctccctcaggaatctggtcgtctccctcctgaatagcatgaagagcatcatttctctgcttttcctgctgtttttgttcatcgttgtattcgctctgctggggatgcagctgtttggtggccagttcaacttccaagatgaaacgcccaccacaaactttgatactttccctgctgctatcctgacagttttccagattctgacgggagaagattggaacgctgtcatgtatcacggcatagaatcccaaggaggggtttcaaaggggatgttcagtagtttctattttattgtgttaaccctgtttggaaactacactcttctgaatgttttcctagccattgcagtagacaatctggccaacgcccaggaactgacaaaggacgaggaggaaatggaggaggctgcaaaccagaagctggccttacaaaaggcaaaagaggttgccgaggtgagtcctatgtccgccgccaacatctcgatcgcagccagacaacagaacagcgccaaggcccgctctgtatgggagcagcgcgcctctcagctccgcctgcagaaccttagagcgtcctgtgaggctctttactctgaaatggatcctgaagaacgcctgagatttgcaaccactcgacacctccggccagacatgaagacgcatctggatcggccactggttgttgaacttggacgcgacggagctcgagggcctgtgggagggaaagctcggccagaggcagccgaagccccagaaggagtggacccaccccggcggcatcatcgccacagagataaagacaaaaccccagccgcaggggatcaggaccgggccgaagcacctaaagccgagagcggcgaacccggcgctagagaagagcgtccacgtccacaccggtcccattcaaaagaagccgcaggacctcccgaagccaggtcagaacgaggccgcggacccggccccgaaggcggaaggcggcaccaccgaagaggatcccccgaggaagcagctgaacgcgaaccccggaggcatagagcacaccgccatcaagacccatccaaagaatgcgccggtgccaaaggagagaggagggcgagacatagaggcggacccagagcaggcccacgtgaggcggagtctggcgaagaacctgcacggcggcatcgggcacggcacaaagcacagccagcccatgaggctgtcgagaaggaaactacagagaaggaggcaaccgaaaaagaagcagagattgttgaggcggacaaagagaaggaacttcggaaccaccagccgagggagccacattgtgacttggaaacctctggcaccgtcactgtggggcccatgcacacactcccatctacatgcctccagaaggttgaggaacagcctgaggacgccgacaaccagcgaaacgtgacacggatgggaagtcagcccccagatcctaatacaatagtccacatcccagttatgttgacaggcccactgggtgaggctaccgtcgtcccctccgggaacgttgatctcgaatcccaggccgaaggcaagaaggaagttgaggcggatgacgttatgaggagcgggcctcggccaatcgtcccttactccagcatgttctgcctatctccgaccaatctcctcagaaggttttgccattacatcgtgacaatgcgatatttcgaggtcgtaatactggtagtgattgccctatcatctattgcactcgcggccgaggacccggtacgtaccgactctccccgcaacaacgcgctgaaatatctggactacatcttcacgggcgtgtttacgttcgagatggtaatcaagatgatcgatttagggctgctcctgcaccctggcgcctacttcagagatttgtggaacattctcgatttcatcgttgtaagtggagccttggttgctttcgctttcagtggctccaagggaaaagacatcaacacaattaagagtctcagagttttaagagtgttgcggcccctgaaaacaataaagagattgcccaagctgaaggctgtctttgattgcgtcgttaattccttaaagaacgtactgaacatcttaatcgtttacatgctatttatgtttatcttcgccgtcattgcggtgcaactgtttaagggcaagttcttttactgtacagacgaatcgaaagaactggagcgcgactgcagggggcagtatctggattacgaaaaagaggaagtggaagcccagcctagacaatggaagaagtacgatttccactacgataatgttctttgggcccttctgaccctctttactgtaagtaccggggagggatggcccatggtgctgaagcacagcgtggatgccacttacgaggagcagggcccctcccctggctaccgcatggaattgtccatcttctacgtagtgtacttcgtggtgtttcctttcttctttgttaacatttttgtagctctgattattatcactttccaggagcagggcgataaagtgatgtccgagtgttccttggaaaagaacgagcgcgcatgtattgacttcgccataagcgcaaaaccgctcacaagatatatgcctcagaatcgtcagagctttcagtataaaacatggacctttgtcgtttctcctccttttgagtactttattatggctatgatcgctctaaatactgtggtgctgatgatgaaattttacgacgccccatacgaatatgagctgatgctcaagtgccttaacatcgtgttcacttccatgttcagcatggagtgcgtcttgaaaattatagcgtttggagtgttgaattatttccgggatgcctggaacgtgttcgatttcgttaccgttctcgggtctattactgatatcctcgttacggagattgccgaaactaataacttcatcaacctttcttttctgcgtttgttccgggccgcacgtctcattaagttgctacggcagggatataccatccgcatactattgtggactttcgttcaatcgtttaaggccctgccttacgtgtgcctccttatagccatgctatttttcatttacgcgattatcgggatgcaggtgtttggcaatattgcccttgatgatgatacatccatcaatcggcataacaattttcgtacatttctccaagcgttgatgctactctttaggtccgccacaggcgaggcttggcatgagataatgctgtcctgcctgtctaaccaggcttgtgatgaacaagctaatgcgactgaatgtggaagcgacttcgcttacttttactttgtcagttttatcttcctctgttcatttcttatgttgaatttgttcgtggcagttattatggataatttcgagtatcttacccgggacagctccatccttggacctcatcacctagacgagttcattagagtgtgggcagaatacgatccagccgcatgtggtagaattagctacaatgacatgttcgaaatgctcaagcatatgtcgcctccattaggactgggcaaaaaatgccccgcaagggtggcctataaaagactggtccgaatgaatatgccaatttctaacgaagacatgactgtccattttacgtcaaccttgatggctctgatacgtaccgcacttgagatcaagctggcccccgccgggaccaagcagcaccagtgcgacgccgagcttagaaaagagatctccgtggtgtgggccaacctccctcaaaagaccctggacttactcgtccccccacacaagcccgatgagatgaccgtgggcaaggtctatgccgcgcttatgatttttgacttttataaacagaacaaaacaactagagatcagatgcaacaagctcctggtggcctttcccagatgggccctgtttctttgtttcatccactgaaggctacccttgaacagactcagccggccgtcctccggggcgcccgcgtgtttctgcgccagaagtctagtacctccctgtccaacggaggagccattcagaatcaggagagtgggattaaggaatccgtgagttgggggacccaaagaacccaggacgccccccacgaggctaggcctcctcttgagcgaggacactctacagaaatccccgtgggccggtcgggggccctcgcagtcgatgtccagatgcagtcgattacgagacgaggcccagacggggagccgcagccaggcttagagtcccagggccgcgccgcgagcatgcctcggttggccgccgagacacagccagtgacagacgcctcccccatgaagaggtccattagcacactcgctcagcgccccaggggcacccacctttgcagcaccactcccgatagacctccaccttctcaggcatcatcccaccaccatcaccacagatgccaccggagaagggatagaaaacagcgcagtctcgaaaaaggccctagtctctctgccgacatggacggggccccaagcagcgccgttggaccaggcttgccacccggggagggccctaccgggtgccggcgagagagggagcgtcgtcaggaacgtggtcggtctcaggagcgaaggcagccctctagtagcagcagcgagaaacagagattttattcctgcgataggttcggaggtcgcgaacctcctaaaccgaaaccttcgctctcctcccatccgaccagccccactgcagggcaggagcctggcccccacccccaggggtctggctcggtcaacggaagccctctgctctctaccagcggcgctagcaccccagggcggggaggcaggcgacaactgccacaaacccccctcacccccaggccttccattacttataagacagccaattcgtcaccaatccacttcgcaggagcccagaccagcctccctgcattctcacccggccgactgagcaggggcctctctgaacacaatgccctgcttcagagagacccgttgtcccagccacttgcccccggatccaggatcgggtcagacccctatttgggtcagcggctggactccgaggcgagcgttcacgccctccccgaagacaccctcacattcgaagaagcagtggctactaatagcggcaggtcctccagaacctcctacgtgtccagcttgactagtcagagccacccgttacgcagagtccccaatggttatcactgcacgttgggcctctcttcaggcgggcgggccaggcactcataccaccatccagaccaggaccattggtgttag

SEQ ID NO: 181247 - DNA, 7017 bp, Artificial Sequence
  Description of Artificial Sequence: Synthetic coding sequence
atggtgcggttcggcgacgagctgggcggccggtacggcggccccggcggaggcgagcgcgctagagggggaggggcagggggtgctggtggtccaggtccaggcggtctccaacctggacagagagttctctataagcaatccatagctcagcgggccagaaccatggccctgtataatcctatcccagtgaagcagaactgtttcacagtgaaccgatccttgttcgtcttctccgaggataacgtagtcagaaagtacgctaagcggattactgagtggccccccttcgaatatatgattctcgccactattatcgcaaactgtattgtactggcactggagcagcacctccctgacggagacaaaacacctatgtctgaaagattggacgacaccgagccatacttcatcgggattttctgctttgaagccgggatcaagatcatagccctgggcttcgtgttccataaggggtcgtacctgcgtaatggttggaatgtgatggactttgttgttgtcctgactggaatactggcaacagctggcacagactttgatcttcggacactgagggctgtccgtgtcctgagaccactcaagctggtctcgggcattccatccctgcaggttgtcctgaaaagtatcatgaaggccatggtgcctctccttcaaataggtctcctactgttttttgccattcttatgtttgccatcattggcttggagttctatatgggtaagttccataaagcgtgctttcctaattccaccgatgctgaaccggtgggagattttccttgtggcaaagaggcaccagcccgactttgcgagggcgacacggagtgtagagagtattggccggggccaaatttcggaatcaccaatttcgacaatatcctgtttgctatactcaccgtttttcagtgtatcaccatggaaggttggaccgatattctctacaacacaaacgatgctgccggtaatacttggaactggctttacttcattccacttattattattggcagcttctttatgcttaatttggtcctaggggtgctttctggagaatttgctaaggaacgggagagggtagagaatagaagagcgtttcttaaactgcgccgacagcaacagatcgaaagggagctgaatggctacctcgagtggatcttcaaagccgaggaggtgatgttggccgaggaagataggaacgcggaggagaagagccccttagacgccgtgctaaagcgtgccgctacaaagaagagtcgcaatgatcttatccacgccgaagaaggggaagatcggttcgctgatttatgtgctgtcggatcgccatttgcccgtgcgtctttgaagagcgggaagactgagagcagctcatacttccgacgcaaggagaaaatgttccggttctttattaggcgcatggtgaaagcacagagcttttattgggtagtactttgcgtggtcgccctcaacactttgtgcgtggcaatggtgcactataaccagcccagacggctgaccacaaccctgtatttcgctgaattcgtgtttctggggctgttcctgacagagatgtcccttaaaatgtacggtctgggccctcggtcttatttcaggagctccttcaattgtttcgactttggcgtgatcgtggggagtgtctttgaggtggtgtgggcagctatcaaacccgggtcctcttttgggattagtgtcctgagagccctccgcctgttgcgcatttttaaggtgactaagtactggagcagcctcagaaacctggtggtgagccttctcaattcgatgaagagcattatttcccttctgttcttactttttctctttatagttgtgtttgcccttttaggaatgcagctctttggcggccagttcaattttcaagacgagacacctactaccaactttgatacttttcccgcagccatcctcaccgtgtttcagatcctcaccggggaggactggaatgcggtgatgtaccacgggattgagagccagggcggcgtaagcaaagggatgttcagcagtttctacttcatagtgctcacgctctttggtaattacactctccttaacgtgtttcttgcaatcgcagtggacaacctggcgaacgctcaagaactgactaaggacgaagaagaaatggaggaagccgcaaatcagaagctggccttgcagaaggcgaaagaggtggctgaggtatcacctatgtccgctgcaaacatttccattgctgcgcgccaacagaattcagctaaagcccgctctgtgtgggagcaacgcgcgagccagctccgactgcagaacctgagggcctcgtgcgaggcactgtactctgagatggatccagaggagaggctaaggtttgcaactaccaggcacctccgacctgacatgaaaacccacctggacagaccgctagttgtggaacttggaagagatggggctaggggcccggtggggggcaaggcccgcccagaggcagccgaagctccagagggagttgaccccccccggcggcatcatcgtcatagggacaaggacaagactcccgccgctggggaccaggaccgcgccgaggcccccaaggcggagagtggggagcctggagctcgggaagagcggccaaggccccatcgtagccactctaaggaggccgctggtcctcctgaggccaggtcggaacgcggccgcggacccggccctgaagggggtcgccgccatcaccgtcggggctccccggaagaggccgcagaacgagaaccaaggcgccaccgggcccatcgtcaccaggatccgagtaaagagtgtgccggcgcgaaaggggaacgccgtgctcgtcacagaggtgggccgcgcgccggaccccgtgaggccgaaagcggggaggagcctgccaggaggcacagggcacggcacaaagctcagcctgcacatgaagctgtggagaaggagactactgaaaaggaggccacggagaaagaggcagaaattgtggaagctgataaagaaaaagagctgcgcaaccaccagccccgcgagccgcactgtgatctggagacatccggcaccgtgacagtggggccaatgcacactctcccttccacatgtctgcagaaggtggaggagcagcccgaagatgctgataaccagcgcaacgtgactagaatgggcagtcagcctccagaccctaatacgattgttcatatccccgtgatgctgactggacccctgggtgaggcgaccgtggtgccctccggaaacgttgatctggagtcccaggctgagggaaaaaaagaggtggaagcagacgacgtgatgagaagtggcccaagacccatcgtcccttactctagcatgttttgtctgagtccaactaacctgctcagacgtttctgccattatattgtaactatgcggtatttcgaggtcgtcatattagtggttatagctctgtcctcaattgctctggccgcggaggatcctgtccggacagatagtccgaggaataacgccctcaagtacttagactatattttcaccggcgtcttcacttttgaaatggtgatcaagatgatagatttgggtctgcttctgcacccaggcgcttacttcagagatctctggaatattcttgatttcatagtggtttccggcgcactggtggccttcgccttctcaggcagcaagggcaaagacatcaacactatcaaatccctgcgagtgctgcgtgtccttcggcccttgaaaacaatcaagaggctacccaagttaaaggccgtatttgattgtgtggttaatagtctcaagaatgtcctaaatatcctgatagtttacatgctcttcatgtttatctttgcagtaatagccgtacagttgttcaaaggaaagttcttttactgcacagacgagagcaaagagctagagcgggattgtcgcggccaatacctggactacgagaaagaagaggttgaagctcagcctaggcagtggaagaagtacgatttccactacgataatgttctttgggctctattaaccctcttcacagttagtaccggcgagggctggcccatggtgcttaagcatagcgttgacgctacctatgaggagcagggtccctcaccggggtataggatggaattgagtattttctacgtcgtgtattttgtggtgtttccctttttttttgtcaacatattcgtcgcgctgataatcattacattccaggaacagggggacaaggtcatgtcggagtgtagccttgaaaagaatgaaagggcttgcatcgacttcgctatctcagcgaagcctctgacaaggtacatgccacaaaaccgtcagtctttccaatataaaacttggaccttcgtcgttagtccgccctttgaatacttcatcatggccatgatcgcactgaatactgtcgtactaatgatgaagttctacgatgctccttacgagtatgaactgatgctcaagtgcctgaacatcgtctttacctcaatgttttccatggagtgtgtgcttaagatcattgcgtttggggtcctcaactactttagagacgcctggaatgtgttcgacttcgtgacagtgcttgggtccattacggacatcctggttactgagatcgctaataacttcattaatttgagcttccttaggctttttagagccgctaggctgatcaaattgctgcggcaaggatatactattcggatcctactttggactttcgttcagtcatttaaggcattaccgtacgtgtgcctccttatagcaatgttgtttttcatttacgctatcattgggatgcaggtttttgggaatatcgcccttgacgatgacacatccataaacaggcataacaactttagaacgtttctccaggccctgatgctcctcttccggtccgctacaggggaggcgtggcatgaaattatgctgagctgcctgagtaatcaagcttgtgacgagcaagccaatgccaccgagtgtgggtccgactttgcttacttctactttgtatctttcatcttcctctgcagctttctcatgctcaacttgttcgtcgctgtgatcatggataacttcgagtacctcaccagggactcctcgatactagggccccaccatctagatgaattcatccgggtttgggctgaatatgatcctgctgcatgtggaagaatctcttacaatgatatgttcgaaatgctgaagcacatgtctccaccgcttggcctgggcaaaaaatgtcccgcaagagtcgcctataaacgactggtccgcatgaacatgcctatatccaatgaagatatgacagtacattttaccagtaccctcatggctctcattcgtactgctttggagatcaaattggcacccgctggtacgaagcagcaccaatgcgacgccgagctgcggaaggagatatccgttgtatgggcaaatctgccacagaaaaccttagacctcttggtgcccccgcataagccagacgaaatgacagtcggaaaggtgtatgctgccctcatgattttcgacttctacaagcagaacaaaacaacaagagatcagatgcagcaggctccgggaggtctttcgcagatgggtccagtgagcctgttccacccattgaaagcaacccttgagcagactcagccagccgttcttcgaggggcccgggtttttctgagacaaaagtcttctactagcttgtcaaatgggggcgctatccagaatcaggagtccggaatcaaagaaagcgtcagctggggcacacaaaggacccaagatgcccctcacgaggctagacctcccctggaacgaggtcactctacggaaatccccgttggcagatctggggcccttgcagtggacgtgcaaatgcaatcaattaccagaagaggtcccgacggcgagccccagcccgggctggaatcccaggggcgggcggcctctatgccaagactggcggctgaaacccagcccgtcacagacgcatcacctatgaaaaggagcatttccaccctcgcacagcggcctagggggacccacctgtgctctaccactcctgaccgtccacctccttctcaggctagtagtcaccatcaccatcaccgatgtcatcgacgacgcgataggaagcagaggtctttagagaagggaccctccctctccgcagacatggatggcgcccccagtagcgccgtcggaccgggcttgccgcccggggaaggaccaaccgggtgccggagagaacgggagaggaggcaagagagaggccggtcacaggagcgccgacagccctcttcttctagctccgagaagcagcgcttttacagttgcgatcgctttggcggcagggagccacctaaacctaaacccagtctctctagccacccaactagccccaccgccgggcaggaacctggcccacatccacagggcagcggctcggtgaatggctctcctcttctcagcacctccggtgctagcaccccggggagaggcggacgccgccagcttccacagacccctctgacgcctagacctagcataacgtacaaaaccgccaattcatcccccattcactttgctggggctcagaccagcctccccgcctttagtcccggacggttatcacggggtctgtcagagcacaatgctttgctgcagagagatcccctttctcagcctctggcccctggatctcggattggtagtgatccatatctgggccagcgcttagactccgaagcctctgtgcacgccttacccgaggatactctgacctttgaagaggccgtagccactaattccgggcgatccagccggacatcatacgtgtcctccctaacaagtcagagccacccccttcggagggttcctaacggataccactgtaccctcgggctgagtagtggcggcagagcgcgccactcctatcaccatcctgatcaggatcactggtgttag

SEQ ID NO: 181248 - DNA, 7014 bp, Artificial Sequence
  Description of Artificial Sequence: Synthetic coding sequence
atggtgcggttcggcgacgagctgggcggccggtacggcggccccggcggaggagagagagccagaggcggtggtgccgggggagccggagggccgggcccaggggggttgcaacctgggcagagagttttgtataagcagtccattgcccagagagcacgaacaatggccctttacaaccccattcccgtgaaacagaactgctttaccgttaatcggtcactctttgtcttctcagaggataacgtggttcgcaagtatgcaaagcgaatcaccgaatggccacctttcgaatatatgatcctggctactatcatagcaaattgtatagtcctggcccttgagcagcatctccctgatggggataagacgcctatgtccgaaaggctggatgataccgaaccctattttatcgggatcttttgcttcgaggcagggatcaaaatcatagcattgggtttcgtcttccacaaaggctcctatctgcgcaatgggtggaacgtgatggatttcgtggtcgttctcacaggtattctcgccactgctggcacagatttcgacctgcggacacttcgtgccgtcagagtcttgcgtccgttaaaattagtgtctgggatcccttcgctgcaggtggtcttaaagagtatcatgaaagcaatggtgcctctcctgcagataggtctgctactgttctttgcaatcctgatgttcgctataatcggcctggaattttacatgggaaagttccacaaagcctgcttcccaaactcaaccgacgcagagcccgtcggagactttccctgtggaaaggaggcgcctgctcggctctgtgagggagacacggagtgccgggagtattggccagggcccaatttcgggatcactaacttcgataacattctgtttgcaatactgaccgtatttcagtgcattaccatggagggatggacagatatcctgtacaacacgaacgacgccgctggtaacacatggaactggttgtatttcataccacttattattataggatcttttttcatgttgaatcttgtgctgggagtactgtctggggaatttgccaaggagagagagagagtggagaatcgccgcgccttcctcaagctccgcagacagcaacagatcgagagagagctgaacggctatcttgaatggatcttcaaagctgaggaagtcatgctcgccgaggaagacagaaatgcagaagagaagagccccctcgacgtcttgaaacgtgcagccacgaaaaaaagcagaaatgatcttattcacgccgaagagggcgaagatcgtttcgccgatctgtgtgctgtcggctcccccttcgcacgcgctagccttaagagcggtaagaccgaatctagctcatacttccgacgcaaggaaaagatgtttcgcttcttcatccggcggatggtgaaagcacagagcttctattgggtggtcctgtgcgtggtagccttgaacacactgtgcgtcgccatggtgcattataaccagccccgccgtctgaccaccacactttactttgcggaattcgtgttcttggggctgtttttaaccgagatgagcctgaagatgtacggcctgggcccaaggagctacttcaggagttccttcaactgcttcgactttggtgttatagtcggctccgtgtttgaagtggtatgggcagcaataaagccaggaagctcgttcggcatttccgtcctgcgtgccttgcggctcctgcgcattttcaaggtgaccaagtactggtcctccctacgaaatttagtggtgtctctcctgaatagtatgaagtctatcatctccctcctgtttctgttgttcctcttcattgtagtttttgcactcctgggtatgcagctgtttggcggacagttcaacttccaagacgagacacctaccactaactttgacacttttcctgcggccatcctgactgtgttccagatcttaacaggcgaagactggaacgccgtgatgtatcatggcatcgaaagccagggaggcgtatcgaagggcatgttctcgtcattttactttatcgtgctgactcttttcggcaactatactttgcttaacgtgtttcttgccatagcagtggacaacttggctaatgctcaagagttgactaaggacgaggaagaaatggaggaagcggctaaccagaaactggctctgcagaaagccaaggaggtggccgaagtatctcccatgagcgccgctaatatatcgatcgccgcccggcagcagaacagtgcaaaggccagaagcgtttgggaacagagagcctctcagctgcggctgcagaatctgcgggccagttgtgaagccctgtactctgaaatggaccctgaggagcggttgcggttcgcaacaacacgtcacctcaggcctgatatgaagactcatttagatcgtccactcgtggtggagcttggaagagatggcgcgcgtggtcctgtggggggaaaggccaggcctgaagcagcagaagcacctgaaggggtcgatccgccccggaggcatcatagacacagggacaaggataagaccccggccgcaggtgaccaagatcgggcagaggcacccaaggcagaatctggtgaacccggcgcgagagaggaacgcccccggccgcatcgcagtcactcaaaagaggctgcagggcctccggaggccaggtccgagagaggtagaggaccagggcctgaaggaggtcgacggcatcaccggaggggctccccggaggaggctgccgagcgggagccacgcagacaccgagcccacagacaccaggacccctcgaaagagtgcgcaggagccaagggggaaaggcgagctagacaccgcggcggtcccagagccggacctcgcgaggccgaatctggagaggaacctgctcgtagacacagagccagacataaggcacaaccagcccatgaggctgtggaaaaggaaacgacagagaaagaagctacagagaaagaggccgagatcgtcgaggctgacaaggagaaagagctcagaaaccaccagccccgagagccacattgcgatctcgaaacctccggtactgtgactgtgggccccatgcacaccttaccatccacctgcttacaaaaggttgaggaacaacccgaggatgctgataaccagcgcaatgtgacaagaatgggctcccagccccccgatcctaacaccatcgtgcacataccagtcatgctcactggcccgctgggcgaagcaacagtagtgccctcggggaatgtcgatttggagtctcaggccgagggaaagaaagaagttgaagccgacgatgtgatgagatctggcccaaggccgattgtcccttactcaagcatgttttgcctgtcgcccactaacctactaaggagattctgtcactacatagtgactatgagatactttgaagtggtaatcttagtagtcatcgccctgtcttctatcgcccttgccgccgaggatccggtccgcaccgactccccgagaaataatgccctcaagtacttggactatatcttcaccggggtcttcacatttgagatggttattaaaatgatagacctaggactgcttctgcatcctggggcatatttccgggacctgtggaacatcctggattttatagtggtgtccggggcactagtagccttcgcatttagtggctctaagggcaaggatatcaacaccataaagtctctgagagttctacgagtcttgagaccactgaagaccattaagcgtctgcccaaactcaaagcagtgtttgattgtgtggtgaacagcctaaaaaatgttctcaacatacttattgtctatatgctgttcatgtttatatttgccgtgatagccgttcagctatttaagggaaagttcttctattgtaccgatgaaagtaaagaactggagagagactgtagaggtcagtacctagattatgaaaaagaagaggtggaagcccagccgcgacagtggaagaaatacgactttcactacgacaacgtgctgtgggcgctgctgactttgtttaccgtttctactggggaaggctggcctatggtgttgaaacatagcgtggatgcgacgtatgaggaacagggccccagccccggctatcgaatggaactctcaatcttctacgttgtatactttgtggtgttcccatttttcttcgtgaatatttttgtggccctgatcatcatcactttccaagaacagggcgacaaggtgatgtctgagtgcagtcttgagaaaaatgaacgggcttgcattgatttcgcaatctctgctaagccactcactcgctacatgccacagaaccgccagtctttccagtacaaaacctggacctttgtggtgagccctcccttcgaatacttcatcatggccatgatcgcgttaaatacagttgtgctgatgatgaagttctacgatgcgccatatgaatatgaactaatgctgaagtgcttgaacatagtcttcacatccatgttttccatggagtgtgttttaaagatcatcgcctttggagtcctgaactatttccgagacgcctggaatgtgttcgactttgtgactgtgctgggctccataacagacatcctcgttaccgagattgccaataattttatcaatttgagctttttacggctctttagggctgctaggttaattaagttgttacgccaaggatatacaatccggatcctgttgtggaccttcgtccagtctttcaaggccctgccctacgtgtgcctcctgatcgctatgctcttttttatatatgccattatcgggatgcaggtgttcggaaacatagctctggatgacgacacgtccatcaataggcacaacaactttaggacatttttgcaggcactgatgctcctcttcaggagcgcaacgggcgaagcctggcatgaaataatgttatcatgcctgtccaatcaggcatgcgacgaacaagcaaacgctacagaatgcggttccgactttgcttacttctattttgttagctttatttttctgtgctccttcttaatgttaaacttgtttgtggccgtgattatggacaactttgagtatttaaccagagacagctcgattctggggccacatcatttagatgaattcatccgcgtctgggcagagtatgatccagccgcttgtggacggatcagttacaacgacatgttcgaaatgcttaaacacatgagccctcccttgggccttggaaagaagtgccctgccagagtggcctataagcgcctggtgagaatgaacatgccgatctccaatgaggacatgacagtgcacttcacctccacactgatggcgttgattaggactgctctggagataaaactagctccggccggcactaaacagcatcagtgtgacgccgaactgcgtaaagagatctctgtggtgtgggctaacctgccacagaagacacttgatctgctcgtcccaccacacaagcccgacgagatgaccgtgggtaaggtgtacgctgctttaatgattttcgacttctataaacagaataaaacaaccagagaccaaatgcaacaggcacccgggggcttgagccagatgggtcccgtgagcctcttccaccccctcaaggcgacacttgagcagacccagcccgccgttttgaggggcgctcgggtgttcttaaggcagaaaagtagcacctctctttcgaatggcggagccatccagaatcaggagtctggcatcaaagaaagcgtgagctgggggacccagaggacacaggacgcaccacatgaggcacggccaccactcgagcgaggccactccaccgagattcccgttggccggagcggtgccctcgctgtggatgtccaaatgcagtcgattaccagacgcggaccggatggggaaccccagcccgggcttgagagtcaggggcgggcagccagcatgcctcgcctcgcggctgaaactcaacccgtgacagatgcttcacctatgaagagaagcatatctactctcgctcagcgtccacgaggaactcatttgtgctcaacaacgcctgaccggcctccgccttcccaggcctcttcccaccatcaccatcatcggtgccacaggagaagagacaggaagcaaaggagcctggagaagggccccagtctctccgccgatatggacggtgcaccatcgagcgccgtcggcccaggactgccacccggtgagggaccgacaggctgcaggagggagcgggagaggcgacaagaacgtggacgctcccaggagcgtcgccaacccagctcatcaagctccgagaaacagcggttttatagctgtgatcgtttcggtgggcgggagcctccgaagcccaagccatcactgtcttcccaccccactagtccaaccgcgggtcaggagccagggccacacccacagggttctggtagtgtgaatgggtcccctttgctctctacaagtggcgcatcaactcccggtaggggagggagacgacaactgccgcagactccccttacacctcggccaagcatcacttacaagactgctaatagctcacccatccactttgccggagctcagaccagtttgccagccttctcccctgggcgcctctccagaggcctctcggagcataacgcgttgttacagagggatcccctgagccagccgctcgcacctggtagcagaatcggaagcgacccctatttaggccaaagactagactccgaagctagcgtacatgccctgcctgaggacacattgaccttcgaagaggccgtggccaccaatagtgggcggtcatcgagaaccagctacgtgtccagcctgaccagtcagtcacacccactgaggagagtccctaatggatatcattgtaccctaggcctttcctctgggggacgtgccagacactcataccatcatccagaccaggatcattggtgctag

SEQ ID NO: 181249 - DNA, 495 bp, Artificial Sequence
  Description of Artificial Sequence: Synthetic coding sequence
aacttccggaccttcctgcaggccctgatgctgctgttccggagcgccacaggcgaagcttggcacgaaatcatgctgtcctgcttaagtaatcaggcctgcgatgagcaggccaacgccacagagtgcggctcggactttgcttacttttatttcgtctcttttatctttctctgttctttcctgatgctgaacctgtttgtggccgtgataatggacaactttgaatatttgacccgcgactcaagcatcttggggccacatcatctggatgagtttatcagagtatgggccgaatatgacccagcggcatgttgccgcatccactacaaggatatgtacagtctattacgctgtatagcacctccagtcgggttgggcaaaaattgccccagacgattggcctacaagcggctggtccgtatgaacatgccaatctccaacgaagacatgacagtgcacttcacttctactctgatggctcttatcagatag

SEQ ID NO: 181250 - DNA, 327 bp, Artificial Sequence
  Description of Artificial Sequence: Synthetic coding sequence
ctgcggaaccaccagccccgggagccccactgcgacctggagaccagcggcaccgtgactgtgggcccaatgcacactctgccttcaacctgtttgcagaaagtggaggagcaacctgaggatgctgataatcagcggaacgtgacaaggatggggtctcaacctcctgatcccaacactatcgtgcatatccctgtgatgctaacggggcctctcggtgaggcgacggtggtcccaaccctggaaaagaacgtatgtttgttcctgctgacatctatggtgagtgacgagaagagcactgttattcgaatcgtgttctttctgtag

SEQ ID NO: 181251 - DNA, 7020 bp, Artificial Sequence
  Description of Artificial Sequence: Synthetic coding sequence
atggtgcggttcggcgacgagctgggcggccggtacggcggccccggaggcggcgagagagcccgtgggggcggggctggcggagctgggggccccggtccaggagggttgcagcctggtcagcgggtgttgtacaaacaaagcatcgctcagcgcgcacggacaatggccctctacaatccgattccagtgaaacagaattgtttcacagtgaatcgctccctgtttgtctttagcgaagataatgttgtccggaaatacgctaaaaggataacggagtggccaccctttgagtatatgatcctggctaccataattgctaactgcatagtgctggcgttggagcagcatctccctgacggcgacaagactccaatgagtgagcgccttgatgacacagagccatacttcatcggaatcttttgtttcgaggccggcattaaaattatcgcactggggttcgtgtttcacaagggttcatatctgaggaatgggtggaatgtgatggacttcgtcgttgtcttgaccgggatcttggccaccgccggcaccgactttgacctaaggacacttcgcgccgtccgggttcttcggcctctgaagcttgtctcgggcatcccgtcgctgcaggtggtcctgaaaagtatcatgaaagccatggtccccctgcttcagatcggtcttctgttattcttcgctatactcatgttcgccattattgggctggagttttatatgggcaagttccacaaggcatgcttccccaatagcacggatgcagagccagtgggtgactttccatgcggcaaggaggcaccagccaggctctgcgaaggcgatactgagtgccgtgaatattggcccggcccaaatttcggcataacaaattttgacaacattctctttgcaattctcactgtgttccagtgcataacaatggagggctggaccgatattctctacaacaccaatgacgctgccgggaacacatggaactggttatactttatccctctaataatcattggcagcttctttatgttgaatctggtactgggggtcctgtccggggaatttgccaaagagcgggagcgagtagagaatagaagggcttttttaaaactccggcgtcaacagcagatcgaaagagaactgaacgggtacctggagtggatcttcaaggccgaagaggtcatgctggccgaggaggatcgcaacgctgaagagaaaagccctctggatgtcctgaagcgcgcagctaccaaaaaaagcagaaatgatttgatccacgctgaggaaggtgaagataggttcgctgacctttgtgctgtcggcagtcccttcgctagggcctccctgaaaagtggcaagactgagtcctcttcctatttccggcgaaaggagaaaatgtttcgcttttttatcaggaggatggtaaaagcccagtccttctattgggtggtgctgtgtgtggtcgccctcaacacgctgtgcgttgcaatggtccattacaatcagccaaggcggttaaccaccactttgtatttcgccgaattcgtctttttgggcctgttcttgaccgaaatgtccttgaaaatgtatgggctgggcccacggtcgtatttcaggtcgagctttaactgctttgatttcggcgtcattgtcgggtcagtctttgaagtagtgtgggccgcaattaagccaggctcttcattcggtattagcgtactacgtgccttgcggttgcttcgaattttcaaagtaacaaaatattggtcgtcgctccggaaccttgtggtatccctgctgaattctatgaagtccatcatctccttgttattcctcttatttctgtttatcgtggtgttcgctctgcttggcatgcagttatttgggggacagttcaatttccaagacgaaactcctaccaccaatttcgatactttccctgccgctattctgaccgtttttcagatactgactggagaagactggaatgcggtcatgtaccatggcatagagtcccagggcggggtgagcaaagggatgtttagttcattctatttcatcgtactgaccctgtttggcaactacacccttctgaacgtctttctggccatcgccgtcgataacctcgccaatgcccaggagctgacgaaggatgaggaagagatggaagaagccgctaatcagaagctcgcattgcagaaagccaaagaagtggctgaagtatctccaatgtccgccgccaatatatctatcgccgctcgtcagcagaactcagccaaggcacgctcggtgtgggaacagagagcctctcagctccgcctgcagaacctgagggcctcttgtgaggccctgtacagcgagatggatccagaggagaggctgcgcttcgcgaccacccgccacctgcgacctgatatgaagacccacttagacagacccctggtggtcgagctcggtagagacggcgccagaggacctgtggggggaaaggccaggcccgaagccgcagaagccccagaaggggtggatccccctcggagacatcatagacatcgggataaggacaagacaccagcagccggagaccaggaccgggctgaggcacctaaagcagagtccggcgagcctggtgcccgcgaagagcgacctcgtccccacagaagtcattccaaggaggcagccggccccccagaagctagaagtgagcgcggacgcggaccgggtcctgagggcggccgccgacaccatagaaggggatccccggaggaagcagctgaaagagaaccgaggcgacaccgcgcgcacaggcaccaggacccttctaaagagtgtgccggcgcaaagggcgagcgaagggcaagacaccgtggaggccccagggctggccctcgagaagcagagtcgggcgaggaacctgcccgcagacatagagccaggcacaaagcacagccagcccacgaagccgtggagaaggagactactgaaaaggaagccacggaaaaggaggccgaaatagtggaagctgataaggagaaggaattgcgtaatcaccagccccgggagccccattgcgacctcgaaacatctggcacagtgaccgtgggccctatgcacaccttaccgtctacatgcctccagaaagtcgaggagcaacccgaagatgcggataaccaacgtaatgttactcgaatggggtcacagccacccgatcctaataccattgtgcacatcccagtgatgttaacaggccctttaggagaggccaccgttgtccccagcggcaacgtcgacctggagtcacaagcagagggcaagaaagaggtggaagccgacgacgtgatgcggtcaggccctcggcctattgtgccatattcgtcaatgttttgtctctcccccaccaatcttctgagacgattttgtcattatatcgtgaccatgcggtacttcgaagtggtgatcctggtggtgattgcgctgtcctctattgctcttgccgcggaggatccggtgcgcactgattcccctaggaacaacgcccttaagtacctggattatatcttcaccggtgtgtttaccttcgagatggtgataaagatgattgacctcggactgctgctacatccgggggcctacttccgagatttgtggaatattctggactttatcgtcgtttccggagcactggttgcctttgccttctcgggctccaaggggaaagacattaataccatcaagtcacttcgggttctcagagtgctgcgcccactcaaaactatcaagaggctgccaaagttaaaggccgtattcgattgtgtagtgaattcactgaaaaacgtgctgaatatcctgattgtctatatgctcttcatgtttatctttgcagtaattgctgtacagctcttcaagggcaaattcttttattgcaccgatgaaagcaaggaactggagagggactgcaggggccaatacctggattacgaaaaagaggaggtcgaagcccagccccgacaatggaaaaagtatgacttccactatgataacgtgctatgggccttactgacactgtttactgtaagtacaggagaaggttggccgatggtactgaagcattctgtggacgccacctatgaggagcagggcccatctcctgggtataggatggagctcagtattttctacgtggtatattttgttgtattccccttttttttcgttaacatcttcgtggctctcataatcattacctttcaggagcagggtgacaaggtgatgtccgagtgctctctggagaaaaatgagcgtgcttgtatagactttgcaatcagcgctaagcctctgacaagatacatgcctcaaaatcgccagtcctttcaatataagacctggaccttcgtggtgtcccctccattcgaatactttatcatggccatgatcgccctcaatactgttgtgctgatgatgaagttttacgatgcaccttacgagtacgagctcatgcttaaatgcctcaatatcgttttcacatccatgttcagcatggagtgtgtgctgaagatcattgcatttggcgtgctgaattatttccgggacgcctggaatgtgttcgatttcgtcacagtgctaggcagcattaccgatattttggttacagaaatcgcagagacaaataacttcatcaatcttagcttcctgaggctattcagggctgcccgcctgattaagctattgagacaaggctacacgattagaatcctgctttggacgtttgtccaatcgtttaaagccctgccatacgtgtgcttgctcattgcgatgttatttttcatttacgccattatcggaatgcaggtcttcggtaacatcgctcttgacgacgataccagtataaaccgccataataatttcaggacctttctacaggcactgatgttgctcttcagaagcgcaaccggtgaagcatggcatgaaatcatgctcagctgccttagtaatcaggcctgcgatgaacaagcgaacgcgaccgaatgtggaagtgatttcgcttacttctattttgtgagctttatttttctctgcagctttctgatgctcaatctctttgtcgccgtcatcatggataattttgaatacctgacaagagactcttctattctggggcctcaccacttggatgagttcattcgagtgtgggctgagtatgaccccgctgcctgcggccgcatttcatacaacgatatgttcgagatgctgaagcatatgtcaccacccctcggactcggaaaaaagtgcccagcccgtgtagcatataaacgcctagtgaggatgaacatgcccatctcaaatgaagacatgacggtccactttacctcaaccttgatggcgctgatccgtacagcactcgagattaaattagccccggccggtaccaagcagcaccaatgtgacgctgagctgcgcaaggagatatcggtggtgtgggctaacctgccccagaagacgcttgacctgttggttccaccacacaaacccgatgaaatgaccgtcgggaaggtgtacgccgcccttatgatcttcgacttctataaacagaacaaaaccacacgcgaccagatgcagcaggccccaggcggcctgtcccagatgggacctgtgagcctgttccatccgttgaaggcaacgttggagcagacacagcccgccgttttgagaggagctagggtcttcctgcgccagaagagcagcaccagcttatctaacggcggtgcaatccaaaaccaggagtcagggattaaagagagtgtcagctgggggacccagcgtactcaggacgcgcctcatgaggcgcgcccacctctggagagaggacactccactgaaattccagttggacgttcaggtgccctcgctgttgatgtgcagatgcagtcaatcacacgcagaggtcccgatggtgagccacaacctggccttgagtctcagggcagagcggcttcaatgccacgcctggctgccgaaactcagcctgtgacagatgcttccccaatgaagcgcagcattagcacgttggctcagaggccaaggggtacacacctgtgctccacgactcccgacagaccgcccccgagccaagcctcttcacaccaccatcaccacagatgtcataggcgccgcgaccgcaagcagaggtcccttgaaaagggccccagcctgtctgcagatatggatggtgccccctcctctgcagttgggcctgggcttcctcccggcgaggggccaaccggctgcagaagagagagggagagaagacaggaacgcggaaggtcccaggaacgacggcaaccctctagctcctctagcgagaagcagcggttttactcttgcgatcgcttcggaggtagagaacctcctaagccaaagcccagcctcagtagccatcccacttctccaacagctgggcaggaacctgggccccaccctcagggtagcggatcagttaacggtagcccattgttgagcacatccggcgcctccacacccggccgaggcggacgccgccagctgccacagacaccgctgacgccccgcccgtccattacgtataaaaccgcaaattcgagtcctatacacttcgctggggctcagacctcattgcccgctttcagcccaggcaggctgtcgagagggctgtctgaacataacgcactactccagagggatcccctctcccagccactcgcccctgggtccaggatcggaagtgatccctacctgggccagagactggactctgaagcctccgtgcatgccttgccagaggacacccttaccttcgaggaagcggttgccactaatagcggcagatcaagccgcacgagctatgtctcctccctaacttcgcaatcccaccccttaagaagagtacctaatggataccattgcaccctcggactgagtagcggcgggagagccagacactcttaccaccaccctgaccaggaccactggtgttag

SEQ ID NO: 181252 - DNA, 498 bp, Artificial Sequence
  Description of Artificial Sequence: Synthetic coding sequence
tgaaacttccggaccttcctgcaggccctgatgctgctgttccggagcgccactggagaggcttggcatgaaatcatgttgtcatgtctcagtaatcaagcatgtgacgagcaggcaaatgctaccgagtgcggcagcgacttcgcctatttctactttgtgtctttcatcttcctttgttccttcctgatgttgaatcttttcgtggccgtgattatggataacttcgagtatctgactcgcgatagtagcatccttgggccgcaccatctggacgagttcatacgggtatgggccgaatacgacccagctgcttgttgccgtatccattataaagatatgtactctctgctgaggtgtatcgccccacccgttggcctaggaaaaaactgcccccggagactggcctacaagcgccttgtgagaatgaatatgccaatctctaatgaagacatgacagtgcattttacaagcacattgatggcccttatcagatag

SEQ ID NO: 181253 - DNA, 564 bp, Artificial Sequence
  Description of Artificial Sequence: Synthetic coding sequence
ctgcggaaccaccagccccgggagccccactgcgacctggagacctcagggaccgtgacggttggccctatgcatactctgcccagtacctgtttgcagaaagttgaggaacaaccagaggacgccgataaccagcgaaacgtgactcgaatgggatcccagcccccagatcctaatacgatcgtgcacataccagtgatgctgactgggcccttgggcgaggccaccgtcgtgccaagccctacaatcgggcggctgcaggcagaggaacaaggggagcccgctagggtgagtaaactgaacttggagtctgacgtccgaggtcaagaggcctcatccactggggaacggtataggttgggaggtggcaacgttgatctcgaaagtcaggccgagggcaagaaggaggttgaggcagatgacgtgatgcggagcgggccaaggccgatcgtgccttatagttccatgttctgcctgtcacccactaacctgttacggaggttttgccattacattgtgacgatgcgttactttgaggtcgtaatcctggtggtgattgcatag

SEQ ID NO: 181254 - DNA, 6786 bp, Artificial Sequence
  Description of Artificial Sequence: Synthetic coding sequence
atggcccggttcggcgacgagatgcccgcccggtacggcggcggcggctctggtgctgctgccggcgtggtcgtgggctctggaggcggaaggggcgccggcgggtctagacagggtggtcagccaggagcccagcgaatgtataagcagagcatggcccagcgggctcgcacaatggcgctttacaatccaatcccagtgaggcaaaattgcctcaccgtcaacagaagcctgttcttgttttccgaggataacgtggtcaggaaatacgccaaaaagattaccgaatggccaccttttgagtatatgatactagctactataattgcgaattgtattgtgttagcgctcgagcagcacctcccagacgatgataaaactcctatgtctgagcgcttggacgataccgagccctattttatagggatcttctgtttcgaagctggcattaagattattgctctcggattcgcatttcataaggggtcttatctgcgcaatggatggaatgtcatggatttcgtggtggtgttgacagggatattggccaccgtgggaactgagtttgacctgcgcactctgcgagccgtgagagtccttcgccctctaaaactggtctctggtataccgagtctacaggtggtcctcaagtcaatcatgaaggcgatgattccccttttacagatcggtctcctgctgttcttcgctatactgatattcgcaataatcggcctggaattttatatgggcaagttccacaccacctgttttgaggaagggacagatgatatccagggggaaagtcccgctccatgcggcacagaggaaccggcgcgaacctgccccaacgggacaaaatgccaaccttattgggagggacccaataatggcattacccagtttgataatattcttttcgctgttctgacagtgtttcaatgtattactatggagggctggacagatttgttgtacaattccaatgacgcctccggaaatacgtggaattggttatactttattcccctgattatcatcggaagcttttttatgttgaacttagtcctgggagtgttgtctggtgagtttgccaaagagcgtgagcgggtcgagaatcgtcgggcgtttctcaagttgagacggcagcaacaaattgaacgggaattgaatggctacatggagtggatctctaaagccgaagaagtgattctcgccgaggatgaaactgatggagaacagagacatcccttcgacggtgcccttcgtcgtaccacaataaaaaaatcgaaaaccgatctgttgaatcctgaggaggcagaggaccagcttgctgatatcgcgagcgttggatcgccctttgcgcgggcctcaatcaaatctgccaagttggagaacagcacattcttccataaaaaggagaggcgcatgcggttctacattaggcggatggtgaaaactcaggccttctattggacggtgctctcgcttgttgcactaaatacactgtgcgtggctattgtgcattacaaccagcccgagtggctgagcgattttttatattatgccgagtttatttttctgggcctattcatgtccgagatgttcattaagatgtatggtctggggacaagaccatacttccatagctcatttaattgctttgactgtggagtaatcatcggctccatttttgaggtgatctgggcggtaatcaaaccaggtacctcctttggcatcagcgttctgcgcgctcttcggctgctgcgcatattcaaggtcaccaaatactgggcgagtctgaggaatctggtggtgagcctgttgaattccatgaagagcattattagccttcttttcttgctgttcttatttatcgtggtctttgcactgctaggaatgcagctctttggaggacagttcaatttcgacgagggaactcctccgaccaatttcgacactttccctgcagccataatgaccgtatttcagatactcacgggagaggattggaatgaggtgatgtacgatggaatcaagagtcagggaggcgtgcaaggtggcatggttttctcgatctattttatagtgctgaccctgttcggcaattacaccctcttgaatgttttcttggctatcgctgttgacaacctggccaacgcgcaggagttaactaaagacgagcaggaggaggaggaggcagccaatcagaagctggcactccagaaagctaaggaggtagctgaagtgagcccactttccgctgctaatatgagcatcgcagtcaaggagcagcaaaaaaatcagaagcccgccaaatcagtgtgggaacaacgtacgtcagagatgcgtaagcagaacctactggcctcaagagaagcactgtacaatgaaatggatccagacgagcggtggaaagccgcctatactcgtcacctgcgccccgacatgaagacacacctggacagaccgctggtggtcgatcctcaggaaaaccgaaataataacacgaataagtctagggccgcagagccaaccgttgaccagcgattgggccagcagagggccgaggacttcctccggaagcaagctaggtatcatgatagagctcgtgatccttccgggagcgcagggctggatgcccggcggccttgggccgggagtcaggaggcggagctgtccagagaagggccctatggaagagagagcgaccaccatgcacgcgagggaagcctcgagcagcctggcttttgggagggagaagccgagaggggcaaggctggcgacccccatagacgtcatgtacaccggcaggggggatccagggaaagcaggtctggatctccccgcaccggtgctgacggtgagcaccggcggcatcgtgctcataggcgccccggtgaggagggccccgaagataaagcggaacgcagagctcggcatagagaaggctctagaccagccaggggaggcgaaggcgaaggggaggggccagacggcggcgaaaggcgacgaagacatcgacacggagcgccagccacgtacgagggcgacgcccgaagggaggataaggaacgtaggcaccgtagaaggaaggaaaaccaggggtccggtgtccccgtctctggcccgaacttatctaccaccagaccaatccagcaagacttgggccgccaagacccccctctagcagaggatatcgacaacatgaaaaataacaaattggcaaccgccgagtctgcggccccacacggcagcctcggccacgcaggcctccctcagtctccagcaaaaatgggaaattccaccgatcctgggcccatgctggctattccggctatggccaccaacccgcagaacgcagcttcacggcgcaccccgaacaatcccggcaatccttccaaccccggcccccccaagactccagaaaacagtctgattgtaacgaacccttcaggcacacagactaacagcgctaagactgccagaaaaccagatcatactactgtcgatatccctccagcttgccctccgccattgaaccacaccgtagtacaggtaaacaagaacgccaaccccgaccccttgcccaaaaaagaagaggagaagaaagaggaggaggaggacgataggggagaggatggtcctaaacctatgccgccttactcatccatgttcatactgagcaccacgaacccgttaaggcgtctgtgccactatatcctgaatctgcggtatttcgagatgtgtatactgatggtaattgccatgagttcaattgcgttggcagcggaggaccctgtacagcccaacgccccacggaacaatgtcttgcgctacttcgattacgtgtttacaggtgttttcacttttgagatggtcataaagatgattgatctgggcctggtactgcatcagggagcatactttcgagacctgtggaacattctggactttatcgtggtttcaggagctcttgtggcattcgccttcactggaaacagcaaagggaaggatattaacacgatcaagtcactgagggtcctgagagtgctgcgacctttgaagaccattaagcggttacctaaactcaaagctgttttcgactgcgtcgtgaattcactcaaaaatgtgtttaacatattgattgtatacatgctattcatgtttattttcgcagtggtggcagtgcagcttttcaagggaaagttttttcactgtacagatgaatcgaaagagttcgaaaaagattgtcgcgggaaatatctgctgtatgagaagaatgaagtgaaggcaagagacagggagtggaaaaaatacgagtttcattacgacaatgtgctttgggccctgctcaccctctttacggtgagcaccggtgagggttggccccaggtactcaaacactctgtcgatgccacttttgaaaatcagggtccgagccctggatatagaatggagatgagcatcttttacgttgtctatttcgtcgttttccctttcttcttcgtgaacattttcgttgcgctgataattatcacattccaagagcagggggataagatgatggaagagtactcgttggagaagaacgagcgcgcctgtatcgattttgcgattagtgccaagccgctcacccggcacatgccacaaaacaaacagtcttttcagtatcggatgtggcagtttgtagtgagtcctcctttcgagtatacaatcatggccatgatcgctctgaatacaattgtgttaatgatgaagttttatggggccagcgtggcctacgaaaacgctcttcgagtctttaatattgtgttcacatccttatttagcctggagtgtgtgctcaaagtgatggcgtttggtatcctcaactattttcgcgatgcttggaacatatttgacttcgtgactgtcctgggctcgattaccgatatcttagttactgagttcggaaacaacttcatcaacctgtccttcctccggctgtttcgagcagctcgcctgattaaactgctaagacagggctacactatccgtatcttgttatggacctttgtgcagtcctttaaggccttgccctacgtatgcctcctgattgctatgctcttcttcatctacgcgattatcggaatgcaggttttcggcaacattgggattgatgtggaggatgaggatagtgacgaagacgaatttcagatcacggagcacaataactttcggacttttttccaggcccttatgctgctgtttaggagcgctaccggtgaggcatggcacaatataatgctttcctgcctatcggggaagccatgcgacaaaaactccggtatcctgaccagagagtgcggtaatgagtttgcctatttttactttgtttcttttatttttctgtgcagcttcctaatgctgaacctcttcgtggccgttatcatggataacttcgaatacctgacccgggattcatccatcctgggaccccatcacttggacgagtacgtgcgggtatgggctgaatatgatcccgctgcctgtggtcggattcattataaagatatgtattctctgcttagagtgattagtcctcctctcggccttggcaagaagtgcccacaccgggtggcctgtaaaaggttgctgcggatggacctacccgttgcagatgacaacacagttcattttaactctacactgatggcccttatccgcaccgccctggacataaagattgcaaaggggggagccgataagcagcagatggacgcggagctaaggaaagagatgatggcgatatggcctaatctttcacagaaaacattggatctgttagttactccccacaaaagcactgatctaactgtcggtaaaatctacgctgccatgatgatcatggagtactaccgccagtcaaaggcgaagaaattacaggctatgcgggaggaacaggacagaaccccattgatgtttcagcgcatggagcctcctagcccaacccaggagggcggccccggccagaatgcactgccttcgactcagttggatccggggggggccctgatggctcatgagagtggtttgaaggaatctccatcttgggtaactcaaagggcgcaggagatgtttcagaaaaccggtacatggagtcccgaacaaggcccacccactgatatgcctaactctcagcccaattcccagagtgtcgaaatgagggaaatgggtagggacgggtatagcgacagcgagcattacctgcctatggagggacagggtagggccgcctctatgccgcgattaccagcagagaaccaacgcagacgtggacggcctaggggaaacaatctgagtaccattagcgacacctcaccaatgaaaagatcagccagtgtcctgggccccaaggcccggagactggatgattacagtttggagcgggttccacctgaggaaaatcagcggcaccaccagcgccgaagggatagatcgcacagggcctccgagcggtcactgggcaggtatacagacgttgataccggtctggggaccgacctttctatgaccacccagagcggcgatttgccatcgaaggagagagaccaagagcgtgggcggccaaaagataggaagcataggcaacaccaccatcaccaccaccatcaccaccacccccccccaccagacaaggaccggtatgcccaggaaagacccgaccatggccgggcccgcgctcgcgaccagcggtggtctagatctccttcagagggacgcgagcacatggcccaccggcaatag

SEQ ID NO: 181255 - DNA, 7488 bp, Artificial Sequence
  Description of Artificial Sequence: Synthetic coding sequence
atggcccggttcggcgacgagatgcccgcccggtacggcggcggcggctcaggagccgcagcgggagtggtggtcgggtctggcggcggccggggcgctggaggaagccggcagggcggacaaccgggagcgcaacgaatgtataaacagagtatggcccagcgcgcccgaaccatggctttgtataatccaatacctgtgcgccagaattgcctgactgtcaaccgctcactattcctgttttccgaggataacgtcgttcggaagtatgctaaaaaaatcacagaatggccccccttcgaatacatgatcctagctaccattattgccaactgtattgtactggcactcgagcagcacctgccagacgatgataagaccccaatgtctgaaaggctggatgataccgaaccttatttcatcggcatattttgctttgaagccggaatcaagataatcgctcttggattcgccttccacaaagggagttacttaagaaacggatggaatgtgatggacttcgtggtggtgctcacgggcatcctcgccacagtgggaaccgaattcgaccttcgcactctgcgagccgtccgagtgctaagacctttgaagctcgtgtcaggaattccaagtctgcaggttgtgctaaagtcgattatgaaggctatgatccctttgctccagatcggcttgcttctgtttttcgcgatcctgattttcgccattattggcctagaattctacatgggaaaattccacacaacctgttttgaggaggggactgacgacatccagggagaatcccctgcaccatgtggcaccgaagagccagcccgaacatgtcccaacggaacgaaatgccagccatattgggaaggcccgaacaatggcatcacccagttcgacaatatcttgttcgctgtgctgacagtgttccaatgcatcaccatggagggctggacagatctgctctataactctaacgacgcttctgggaatacctggaactggctgtacttcatcccacttataataatcgggtccttttttatgcttaacttagttcttggtgtgctgtccggagagtttgccaaagaacgggagcgggtggaaaaccgtcgcgcctttcttaaactccggaggcaacagcagatcgagagggaattgaacggatatatggagtggatcagtaaagccgaagaagtcattctagcagaagatgaaaccgatggcgaacagcgacatcctttcgatggtgcacttaggagaactaccatcaagaagagtaaaactgatcttcttaaccccgaggaggctgaggatcagcttgccgacatcgcatcagtcggaagtccattcgcccgggcctcaattaaaagcgccaaactggaaaacagcaccttctttcataagaaagagagacggatgcgcttctatatccgaagaatggtaaagacacaggccttctactggaccgtgcttagccttgtcgcattgaatactttgtgcgtggccatcgtccactataatcagcctgaatggttgtccgacttcctgtattacgccgaattcatctttcttggcttatttatgtccgagatgtttatcaaaatgtatggtctggggaccaggccttatttccactccagctttaactgctttgattgcggggtgattattggatctattttcgaggtgatctgggcagtgataaaaccaggaacgagcttcggaatttccgtgctgcgggcactgcgcctcctgcgcattttcaaggtaacaaaatactgggcttctctgagaaacctggttgtaagtctcttaaacagcatgaaatcgatcatttccctgctgtttttactgtttcttttcattgtggtatttgcactgctgggaatgcagctgtttggaggtcagttcaactttgacgaaggtactccccctacaaatttcgatacattcccggctgctattatgaccgttttccaaatcctgaccggcgaggactggaacgaagtgatgtatgacggcataaaatcccagggtggcgtacagggcggtatggtatttagtatatatttcattgttttgacactattcggtaactacacactgctgaacgttttcctagcaatcgcagtggataatctcgccaatgcgcaggaattaactaaggacgaacaggaggaggaggaagctgccaatcagaaactggcactgcagaaggcaaaggaggttgcagaggtcagccctctgtccgccgccaatatgtctattgctgttaaggagcagcagaaaaatcagaagcccgcaaaaagtgtgtgggagcagagaacttctgaaatgcgcaagcaaaatctcctggcctctcgggaggccctgtacaacgagatggacccagatgagcggtggaaggctgcctacacaaggcacctgcgccctgatatgaaaacacacctcgacagacctcttgtggtcgatcctcaggaaaaccgtaataacaacaccaataagtcacgggcagccgagcctactgtcgatcaacgcttgggacagcaaagggccgaagatttcttgcggaaacaggccagataccacgatagggccagagacccaagtggaagtgccgggttggacgctcgccggccttgggcagggagccaagaggcagagctgtctagggagggcccttacgggcgtgaatccgaccatcacgcccgggaaggatccctggaacagcccgggttttgggaaggcgaggccgagcgggggaaagccggtgacccccaccggcgtcatgtgcacagacagggcggctccagggagagtagaagtggctcgcccaggacaggggcggacggggagcacaggcggcatagggcgcaccgtagaccaggggaggaaggccccgaagataaggcagagcgcagggcccggcaccgagaggggtccagacctgctcgcgggggtgagggagaaggcgagggtccagacgggggcgaacggcggcgccgccaccgtcatggagctcctgcaacatacgagggtgacgcccggagagaagacaaagaacggaggcatcgccgcagaaaggaaaaccagggatccggcgtcccagtatctggccctaatctcagcacgaccaggcctatccagcaagatctgggaagacaagatccaccactggcagaggatatcgataatatgaaaaacaacaaactggctacagctgaaagtgccgcaccccacggatcattgggacatgctggcctgcctcagagtccagccaaaatgggcaacagcacagatccagggcctatgctggctatcccagccatggctactaacccgcaaaatgctgcgtctcggagaacacccaataacccagggaatccctccaaccctggccctccaaagacccctgagaacagcctgatcgtgaccaatccctccggcacccagaccaattccgctaaaaccgcccggaagcccgaccatacaacagtggacattcctccagcgtgcccgcctccgctcaaccatacagtggttcaggtaaataaaaacgctaatcctgaccccctgccaaaaaaagaggaggagaagaaggaggaggaagaagacgatcgcggagaagacgggccaaagcctatgccaccctactcatcgatgtttatcctgtctaccactaacccgctgagaaggctctgccactatatcctcaatctacggtacttcgaaatgtgcattctgatggttattgcaatgagttctatcgccctcgccgccgaggatccagtgcagcctaatgctcccagaaacaacgtcctccgttatttcgattatgtgttcacaggcgtgttcacatttgagatggtcatcaagatgatcgatctgggcttagtgctgcatcagggagcatattttcgggacctgtggaatattcttgattttatcgtggtgagcggcgctttggttgctttcgcttttaccgggaatagcaaaggcaaagatattaatactattaaatccctgcgtgtcctgcgagtgctgagacccttaaagacaattaagagacttccgaaactgaaggccgtgttcgattgtgtggtgaactcactgaagaacgtgtttaacattctaatcgtatacatgctctttatgtttatctttgctgtcgtggccgtacaactcttcaagggtaagttttttcactgcactgacgaatccaaggagttcgagaaggactgtagggggaaatacctgctgtatgaaaagaacgaggtaaaggccagagatagagagtggaaaaagtacgagttccactacgataatgtactgtgggctctgctcacactcttcacagtgtcaactggcgaaggatggccccaggtgttgaaacactcagttgatgcgactttcgaaaatcagggccctagcccaggctaccgtatggagatgagcatattctacgtggtgtacttcgttgtatttccttttttctttgttaacatcttcgtggctctgatcattattaccttccaagaacagggtgataagatgatggaagagtatagtctggaaaagaatgaaagggcatgcatcgatttcgccatcagcgccaagccacttacaagacacatgcctcaaaataaacagagctttcagtacagaatgtggcagtttgtggtcagtccgcccttcgagtacactattatggctatgatcgccctcaatacaatcgtgttaatgatgaagttctacggggccagcgtggcctacgagaatgcattgcgggtttttaatattgtctttacaagcctgttctctctggagtgtgtgctgaaagtgatggcattcggaatcttgaattactttagagacgcatggaacatctttgattttgttaccgtactcggctccatcaccgatatcctggtcacagagtttggaaacaactttatcaatctctctttcctccggctttttcgggcagccagactgattaagcttttgagacagggttacaccataaggatcttgctgtggacctttgtccagtctttcaaagctttgccatacgtgtgcctgttgatcgcaatgcttttttttatatacgctatcatcggtatgcaggttttcggaaatatcggcatcgatgtggaagatgaagactccgacgaggatgaattccagatcactgaacacaataactttcggaccttttttcaggctctcatgctactttttagatcagcaacaggtgaagcatggcataatataatgctgtcatgcctgtctggtaaaccatgtgataaaaacagtggcattctcacacgtgagtgtggcaacgagttcgcttacttttattttgtgtccttcatatttctgtgctcattcctcatgctgaacctgtttgtggccgtgattatggacaacttcgagtacctcactcgtgactcaagcatcctggggccacaccacttggatgagtatgtacgtgtgtgggccgaatacgaccccgcggcgtggggaagaatgccgtacctagacatgtaccagatgctacgccacatgtcacctcccctcggactaggtaagaagtgccccgcaagggtggcatataagagactgctgaggatggatctacccgtagcagatgataacacagtgcatttcaacagcactttaatggctcttattcggacagcactggatattaagattgccaaagggggcgccgacaagcaacagatggatgcagagctgagaaaagagatgatggctatctggccaaacctgtctcagaaaacactagaccttctggtgacccctcacaagagtaccgatttgactgtgggtaagatctacgccgcaatgatgattatggagtactataggcaatcgaaggctaagaaactgcaggcgatgagagaggagcaggataggacccccctcatgttccagaggatggagcctcccagtcccactcaggagggtgggcccggccagaatgccctgccgtctacgcagctggaccctggaggcgccctgatggcacatgaaagcggcctgaaagaatccccaagttgggtaacccaaagggcccaggagatgtttcaaaagaccggaacctggagtccagaacagggtcctcctacggatatgcccaattcgcagccaaattcacagagcgtggaaatgcgggagatgggacgcgatggctactcagactcagaacactacttgcctatggaaggtcagggcagagcagctagcatgccccggcttcccgcagagaaccagacaattagcgacaccagtcccatgaagaggagcgcctccgtgttgggccccaaggcgagaagattggacgactattccctggagagggtgccccccgaagaaaaccagaggcaccatcagcggcgcagagaccgtagccatcgtgcttcagagaggagtttgggccgatatacagacgtggataccggtctcggcacggacctcagtatgacgacgcagtccggtgacctccctagtaaggagcgggaccaggagcgcggtaggcccaaggacagaaaacatagacaacaccatcatcaccatcaccatcaccatcacccaccgcctcctgataaggaccgatacgctcaagaacgcccagatcacgggagggcgcgggcaagagaccagaggtggtcccggagcccatccgagggcagagaacacatggctcaccgtcagggatcgtcgagtgtgtcaggcagcccagctcccagtacatcaggaacgagcacccctcgaagagggagacgccagctgccacagacacccagtacaccaagacctcacgtgtcgtatagtcccgtgatcaggaaggccggtggcagtggtccgccacaacagcagcaacagcagcagcaacagcagcaacaacaggccgtggcaagacctgggagggctgccacaagcggtcctcggcggtacccggggcctacagccgaaccactagctggtgatcgccccccaactgggggccactctagtggccggagtcctcgtatggagcggagagttcctggacctgcacggagcgagagtccccgcgcctgtcgtcatggcggtgcaaggtggcctgcctcaggtcctcacgtctccgaaggcccacccgggccaaggcaccatgggtattaccgaggaagcgattacgatgaggcagacggtcccggttcaggtggtggggaagaggccatggctggtgcttacgacgcccccccacccgtacgccacgcctctagtggtgctacagggcgatccccacgaaccccccgtgcatctggccctgcatgtgcttccccttctcgccatggacgcagattgcccaatggctattaccccgctcatggcctcgccaggccccggggtcctggaagtcggaaaggcttgcacgaaccatacagcgagtctgacgatgactggtgttag

SEQ ID NO: 181256 - DNA, 7521 bp, Artificial Sequence
  Description of Artificial Sequence: Synthetic coding sequence
atggcccggttcggcgacgagatgcccgcccggtacggcggcggcggaagcggcgctgccgctggcgtcgttgttgggtccgggggaggacgaggcgcagggggctcacgccaggggggtcagccaggcgcccaaagaatgtacaagcagagtatggcccagagggcgcgcaccatggccctgtataaccctattcctgtgcggcagaactgcctgactgtcaatcggagccttttcctgttcagtgaagacaatgttgtgcgaaaatacgcgaagaagattactgagtggccccccttcgagtacatgatccttgctacaattatcgccaattgcatcgtgttagcacttgaacagcatcttcctgacgacgacaagacacctatgagcgaacggctggatgatacagagccctatttcataggcattttttgtttcgaagcgggaattaaaattatcgctcttggtttcgctttccacaagggaagttacctgcggaatggttggaacgttatggacttcgtcgtggtgctgaccgggatcctggccacagtaggtaccgagtttgatctgcggacacttcgagcagttagggtcctgaggcctttgaaattggtctctggtattccttccctccaggtggttctcaaatctatcatgaaggccatgatccctctgctccagattggtttgctcctcttctttgcgatattaattttcgctattatcggactcgaattttacatggggaaatttcataccacatgcttcgaagaaggcacagatgacattcagggggagtctccggcgccttgtggcacagaggagcctgcccgtacatgcccaaatggcacaaagtgccagccgtactgggaggggcctaacaacggcatcacccaattcgataatattctgtttgcagttctgaccgtgtttcaatgtataaccatggaagggtggaccgatctgttgtataatagcaatgatgccagcggcaatacctggaattggctctactttattccgctgattattatcgggagcttttttatgctgaacctggtgctgggggtgctatccggcgagtttgcaaaggaaagagaaagggtcgaaaatcgtagagcattcctgaagcttcggagacagcagcagatcgagcgcgaattgaatgggtatatggagtggatcagcaaggcggaggaggtcattcttgccgaagacgagactgatggagaacaaaggcaccccttcgacgcacttaggagaaccaccattaagaagtcaaagactgatctgctgaatccagaggaagcagaagatcagctggctgatattgctagcgtgggttcgccattcgccagagcctcaattaaatcagccaagctggaaaacagcacgttctttcataagaaagagcgccggatgcgtttttacatccggcggatggtcaagactcaggctttttactggactgtgttgtccctcgtcgcattaaacaccctgtgcgttgctatcgtccattacaatcaaccagaatggctgtctgactttctctattacgctgaattcattttcctagggctcttcatgagcgagatgtttattaaaatgtacggcttgggaacaaggccatattttcactccagctttaactgctttgactgcggcgtgatcattggaagtattttcgaagtcatttgggctgtcataaagccaggcacgtctttcgggattagcgtgctgagggctttgcggctgctgagaatctttaaggtcacgaagtactgggctagtctgcgaaaccttgtcgtgtctctccttaactctatgaaatcaattatatcgctgctattcctgttgttcctttttattgtcgtgttcgcccttttgggaatgcagctcttcggcggccaatttaacttcgatgaaggcaccccaccaacaaatttcgatacattccccgctgccattatgacggtttttcaaatcctcaccggtgaagattggaacgaggtgatgtacgacggcataaaatcccagggcggggtgcagggcggtatggtcttctccatctatttcattgttctcaccctgtttggcaattataccctacttaacgtattcctcgccattgccgttgataacttggcgaatgctcaggaattgacaaaagacgagcaggaggaagaagaggccgccaatcagaaactcgctctgcaaaaggctaaggaggtggcagaggtatctcccttgagtgccgctaatatgagtattgcagttaaagagcagcagaagaatcagaaacccgctaaaagtgtttgggagcagcgtacttctgagatgcggaaacagaatctactggcatctcgcgaggcgctgtataacgaaatggaccccgacgaaagatggaaggctgcctacacccggcacctacgaccggacatgaagacccacttggaccggcctcttgtggtggacccacaggagaatcgtaataataacacgaacaagtctagagccgcagaacccacggtcgatcagaggctcgggcagcagcgagctgaggacttcctcaggaaacaggccaggtaccacgacagagctagggatcctagcggatccgctggcctggatgcgagacgtccgtgggccggctctcaggaggccgaactgagtagggaaggcccttatggacgggaaagcgatcaccatgctagagaaggttcactggaacaacctggattttgggagggagaggccgagcgtggaaaggctggtgacccgcacaggcgacatgtccacagacagggtgggtcaagggagtcaaggagcggcagtcccagaactggtgccgacggagaacaccggcggcaccgcgcacatcgaaggcctggcgaggagggaccggaggacaaggctgagcggcgcgctaggcatcgtgaaggtagtcgtccagcccggggcggagagggcgagggggagggacccgacgggggtgaacggaggagacgccaccggcatggagcccctgccacttatgaaggcgatgcccgcagagaagataaagagcggagacatagaagaagaaaagaaaatcagggatcgggtgtccctgtcagtgggccaaatctgtctacaactagacccatccagcaggacctaggaagacaggacccacccctcgctgaggatatcgataacatgaaaaataataagttggctaccgctgagtcagccgccccccatggaagtctgggacacgcaggtttgccccaatcacctgcaaagatgggcaattcaaccgatcctgggccaatgctcgcaatccctgcaatggcgaccaacccccaaaacgccgcttcccgtaggacacctaacaacccagggaacccaagcaaccctggcccccccaagacccctgaaaacagcctcatcgttactaatccttccgggacgcagaccaattccgccaagaccgccagaaaacctgatcacactacagtggacattcccccggcttgtccacccccgttgaaccacaccgtagtccaggtaaacaaaaacgccaaccccgatccattacccaaaaaggaggaggagaaaaaagaggaggaggaggacgacaggggagaggacggacctaaacctatgcccccctattccagcatgtttattctctcaaccactaatccacttcgcagactgtgccactacatcctaaatctaaggtattttgagatgtgcattcttatggtgatcgcaatgagcagtatagctttggcggctgaggatccagtacaacctaatgcccccagaaataacgtgttgaggtactttgactacgtgttcactggggtcttcacatttgaaatggtgattaagatgatcgacttgggtctcgtgctacaccagggagcttatttcagggacctgtggaatattctggactttattgtggtgtccggggcgctggtggcattcgcatttaccggaaattctaagggcaaagatataaacaccattaagagcctgcgggtcctccgagtcctgcggcccctgaaaacaatcaagagacttcctaaactgaaagctgttttcgattgtgtcgttaactctctcaaaaacgtgttcaatatcctcattgtgtatatgctatttatgttcatctttgctgtggttgccgtacagctttttaaaggaaagttcttccactgcacagacgagagtaaggagttcgagaaggactgccgcggaaagtacctcctctacgagaagaatgaagttaaagccagggatcgcgagtggaagaaatatgaatttcattatgataatgtcctgtgggctttgctgacattgttcactgtatccacaggagaggggtggcctcaggttctcaagcactccgtggacgctaccttcgagaatcagggcccttcgcctggctatagaatggagatgagtatcttttacgtcgtgtatttcgtggtgttcccattcttttttgtgaacattttcgtcgcgctgattattatcactttccaagagcagggggacaaaatgatggaggaatacagcctggaaaagaacgagcgcgcatgtatcgattttgccatctcagcaaagccactgacacggcatatgccccaaaacaagcaaagctttcagtacaggatgtggcagtttgttgtatctcctccattcgagtacacgatcatggccatgatcgcccttaacactattgttctgatgatgaagttctatggggccagtgtcgcttacgaaaatgcactgcgcgtgtttaatattgtctttacgtctctgttttctctggagtgcgtcctcaaggttatggcctttggaatcctaaactatttccgagatgcctggaacatcttcgatttcgtgactgtgctgggctccattacagacattctcgtgaccgagttcgggaataatttcatcaacctttcttttctgagactgtttagggcagcaaggctgattaagcttttgcggcagggatacacaatcagaatcctcctctggactttcgttcagagctttaaggcacttccatatgtttgtctactaatcgccatgttatttttcatttacgcaattatcgggatgcaggtgtttggtaatattggtatcgacgtggaggacgaagattctgatgaagatgagttccaaatcacggagcacaacaacttccgcacattctttcaggcgctgatgttgctgtttcgctccgccaccggagaggcctggcacaatatcatgctctcctgcttgagcgggaagccatgtgacaaaaactctggaatcctcacaagagagtgcggcaatgaatttgcgtatttttacttcgtaagtttcatctttctgtgttcatttttgatgctaaacctgtttgtggcagtcatcatggataacttcgagtatcttacgagggactcaagcattctgggcccacatcatctggacgaatatgtgagagtatgggctgaatacgaccccgcagcctgggggagaatgccatatctagacatgtaccagatgctacgccacatgagccccccactgggtcttggaaagaagtgcccggcccgcgttgcatacaaaaggctcctgcgcatggacctgcctgtggctgacgacaacactgtgcacttcaattcgactctaatggcactcatccgaactgctctagatatcaagattgctaagggcggggcagacaaacaacagatggacgccgagctgaggaaggagatgatggctatctggcccaatttatcccagaagacactggacctgctagtgacacctcacaaatcaacagatctaactgttgggaagatctacgcagccatgatgataatggagtattatcgtcagtccaaggccaaaaagttgcaagctatgagagaagagcaggataggacccctctgatgttccagcgcatggagccccctagtccaactcaggaaggcgggcctgggcaaaacgccctgcccagcactcaactggaccccggaggggctctcatggcccacgaatccggccttaaggagtccccatcctgggttactcagcgcgctcaggagatgttccaaaagactggcacctggtctccagaacaaggccctccaactgacatgcctaactcacaacctaattcgcagagcgttgaaatgagagagatggggcgcgatggttactccgattcagaacactacttacctatggaggggcaaggccgggctgcgtccatgcctaggctccctgctgagaatcagcgcaggagggggcggccaaggggtaataatttgagcaccattagcgacacttcccccatgaagaggagtgctagcgttctcgggcccaaggcgagaaggctggatgattacagcctcgagcgggtgccgcccgaagagaatcagcgtcatcaccagaggcgccgcgacagatctcacagagcttccgagagaagtctgggcagatacaccgacgtagataccgggctagggacagaccttagcatgaccacccagagcggggatctgcctagcaaggagcgcgatcaggagcgggggcgtcccaaggaccgtaaacaccggcagcatcatcaccaccaccatcatcatcatcatccacctcctcctgataaagaccgctacgctcaggagcggccggatcacggacgtgcccgggccagagaccagcgctggagccgcagtcctagcgagggaagagagcatatggcacaccgccaaggatcctcatccgtgagcggctcccctgcaccatcaacgtccggcacctccacacctcgaagaggacgccggcagctccctcagacccctagcacgcctaggccccatgtctcttatagcccggtcataaggaaggccgggggaagcgggccaccacagcagcagcaacagcagcagcaacagcagcagcagcaggccgttgcacgtcccggcagagctgcgacctccggcccgaggagatatccgggccccaccgccgagcccttggccggcgatcgccccccaaccggcggacatagtagtgggcggagtccacggatggagcgacgcgtccccgggccggcacggagcgaatcacctcgcgcctgtcgccacggcggggcgcgctggccggctagcggcccacatgtgtcagaaggaccgccgggaccaagacaccacgggtactaccgcggctctgattacgatgaagccgatgggcccgggtccggaggaggcgaagaggctatggctggtgcctatgatgccccgcctcccgtgagacacgcgagttccggagcgactggacgctctcccagaactcccagagcctccggccccgcatgcgcctccccgtcaaggcacggccgcaggctgccaaatggctactatcccgcccacgggttagccagaccaagaggtcccggaagtagaaaaggcctacatgagccatattccgaaagcgacgatgattggtgttag

SEQ ID NO: 181257 - DNA, 7539 bp, Artificial Sequence
  Description of Artificial Sequence: Synthetic coding sequence
atggcccggttcggcgacgagatgcccgcccggtacggcggcggcggtagcggtgccgccgccggagtggtagtggggtctggcgggggacggggagccgggggatcgcgccagggcggccaaccaggagcccagcggatgtataagcagtctatggcgcagcgcgctcgtaccatggccctgtacaatcccatccccgtgcggcagaactgtcttaccgtgaatcggtccctcttcttattcagtgaggataacgtggttcgcaagtacgccaagaaaattactgaatggccacccttcgagtacatgatcctggccaccataatcgctaactgcattgtgttggcactggagcagcatctccccgatgacgataaaactcccatgtctgagcgccttgacgatactgagccttactttatcggcattttctgcttcgaggcagggattaaaataatcgccctaggcttcgcgtttcataaggggtcttacctgcggaacgggtggaacgtgatggatttcgtagtggtcttaacaggtattctggccactgtgggcaccgagttcgatctgcgaacactgcgggcagtgagagtgctgcgcccacttaagttagtgtccggcatcccctcactgcaggtagttctaaagtcaatcatgaaagccatgattcccctccttcaaatcgggttgctgctgttctttgccatcctcatctttgctattataggactagagttctacatgggcaagttccacactacttgcttcgaggaaggcactgatgatatacagggcgaatcacccgctccttgtggtacagaggagcccgcccgaacatgtcccaacggcaccaagtgccagccgtactgggagggtcccaacaacgggattacccaatttgacaacatactttttgcagtcttgaccgtttttcagtgcattacgatggagggctggacggacttattgtataattcaaacgatgcatctggcaatacttggaactggctctactttattcctctcatcatcattggtagcttctttatgctgaatcttgttcttggagttctgagtggggaattcgctaaggagcgagagcgtgttgaaaacagaagggctttcctgaagctgcggcggcagcagcagattgagcgtgagctcaatggctacatggagtggatctccaaggcagaagaagttattctggccgaggatgagacagacggcgaacagagacaccccttcgacggagcattgagacgcacaacaatcaagaagagtaagacggacctgttgaaccccgaggaagctgaggaccagttagcggacatcgcttcagtcggcagtcccttcgccagagctagcatcaagagcgctaaacttgagaattcgacattctttcataagaaggaacgacgcatgcggttttacattagacgtatggtcaagacgcaggccttctactggacagttctgagcctggtggccctcaatacgttgtgcgttgctatcgtgcactacaaccagcccgagtggctgtccgatttcctgtactacgctgagttcatcttcctgggcctgttcatgtccgaaatgttcatcaagatgtatggcctgggtacccgcccttacttccactccagctttaattgcttcgattgcggtgtaattattggaagtatttttgaagtcatctgggccgtcatcaagcctggtacatctttcgggatcagcgttttgcgtgctcttagactcctgaggatctttaaagtgacaaaatactgggccagtctacgaaacctagtcgtctcacttctgaacagcatgaagtcaatcatctcattgttatttctcttgttcctgtttatagtagtgttcgctctgctaggtatgcagctctttggagggcagtttaatttcgatgagggtacaccccccactaactttgacactttccctgcagcaatcatgaccgtcttccagatcttgactggcgaggactggaacgaggttatgtatgacgggatcaaatcccagggaggcgtgcagggcggaatggtattcagtatttacttcattgtgctgactctgtttggcaattacacattattaaatgtcttccttgccatcgccgtggacaatctggccaacgcccaggaacttaccaaagttgaggctgacgagcaggaggaggaggaggctgccaatcagaaacttgcactgcaaaaagcaaaagaagtagctgaggtatctcctttatctgcagctaacatgtctattgccgtgaaggaacaacagaagaaccagaagccagccaaatccgtctgggaacagcgcacctccgaaatgagaaagcagaatctgctggcttctcgtgaagctttgtataacgagatggaccctgacgaacgctggaaagcagcgtatacacggcacctcagacccgatatgaagactcatttggacagaccactggtggtagaccctcaggagaaccggaacaacaacacaaacaaaagccgcgctgctgagcccaccgtagaccagaggctcgggcagcagcgagctgaggacttcctgaggaaacaagcaaggtaccacgatcgagccagggatcccagtgggtctgctggacttgatgcccgcaggccttgggccgggtcccaggaggcagagctgtccagagaggggccttacggccgagagtcagatcatcacgctagggaaggaagtctcgagcaaccgggtttctgggaaggggaagccgaaagaggaaaggctggtgatccacatcgcaggcacgtccatcggcagggtggctccagagagtcacggagcgggagccccagaaccggagcggatggggaacaccgccggcaccgtgcccaccgacggcccggagaagagggacccgaggacaaggccgagcggcgggctagacatcgggaaggttccaggccggcgcgggggggggagggggagggcgagggaccagacggcggcgaacgacgccgacggcatagacacggtgcccctgcgacatacgaaggagatgcgcggcgggaggataaagagaggcggcataggaggcgcaaggaaaaccagggttccggggtgcccgtgagtgggccgaatctgtctaccaccaggcccattcagcaagatctgggtcggcaggacccgcccttggccgaagatatcgataacatgaaaaacaacaagcttgcgactgctgagagtgcggcccctcacggctccctcggccacgcaggtctcccacagtccccagctaaaatgggcaattccacagacccaggccctatgttagccatacctgcaatggccaccaatccccaaaacgccgcatcacgaagaacacccaataatcctgggaatccaagcaacccgggccctccaaagacacctgaaaattctctgattgttaccaacccgagcggcacacaaacaaatagtgcaaaaacagccagaaagccagaccacacaacagtggatattccccctgcttgcccaccacccctaaaccatactgtggtgcaggtaaacaagaacgccaacccagatcctcttccgaaaaaggaagaagagaagaaggaggaggaagaagatgaccgcggtgaggatgggccaaaacccatgcctccctacagctccatgttcattctcagcacgacaaacccactccgacgactgtgccattacattttaaacctgcgatattttgaaatgtgtatacttatggtaatcgcaatgagcagtatcgcgctggccgccgaggaccctgttcaacccaacgcaccccggaataacgtgctgcggtatttcgattacgtgttcaccggtgtgtttacgtttgagatggttatcaagatgattgacttaggattggtcttacatcagggagcctatttcagggacctgtggaatatcctggatttcattgtggtgtctggcgccctggttgccttcgcattcaccggaaattccaagggaaaagatataaatactattaagtcactccgcgtcctgcgagtgctaagacctcttaaaactatcaagagattaccaaagctcaaggctgtttttgactgtgtggtgaactccctgaaaaatgtgttcaacatcctgattgtctatatgctgttcatgtttatttttgccgttgtcgccgtgcaactgtttaaggggaagttctttcactgtacggatgaatccaaagagttcgagaaggactgccgtggaaagtacctactgtacgaaaaaaacgaggtgaaagcacgggaccgcgaatggaagaagtacgaatttcattatgataacgtgctctgggccctcctaacactgtttactgtgtccacgggcgagggttggccccaggttctgaagcattctgtggatgctacgttcgagaatcagggaccttcgcccggctatcgaatggaaatgtccatcttctacgtggtgtacttcgtggtgttcccctttttttttgttaacatcttcgtggctcttattatcattacctttcaggaacagggggacaagatgatggaggagtacagcctggagaagaacgagagagcttgtattgacttcgcaatttccgctaaaccgctgacacgccatatgccacagaacaagcagtcgtttcaatacaggatgtggcagtttgttgtgtctcccccttttgagtacacaatcatggccatgattgcattaaataccattgtgttgatgatgaagttctacggggctagtgtcgcgtacgagaacgcattaagagtcttcaacatcgtcttcacatccttgtttagcctggagtgtgttcttaaagtgatggcctttggaattttaaactacttccgagatgcctggaatatcttcgatttcgtcacagttctcggtagtatcaccgacatcttggtcaccgagttcgggaaccctaacaactttatcaacctcagcttcctgagactgtttagagcggcgcggctgatcaaactgctgaggcaaggatatacgatccgaatactgctttggacctttgtccaaagctttaaggctctcccctacgtctgcctcttaatcgcgatgctgttttttatctacgcgattatcggcatgcaggtgtttgggaacatagggatcgacgtggaggacgaagatagcgacgaggacgagttccagatcaccgagcacaacaactttagaacattctttcaggccctgatgctgttattccgctccgccacaggcgaggcctggcataacatcatgctgtcatgtctatctggaaagccctgtgataaaaatagcgggattttaacgagagagtgtggaaacgaattcgcctacttttattttgtctcctttatctttttatgctctttcctcatgctcaacctcttcgtggctgttataatggacaactttgaatacctgactagggactcatcaatcctcgggccacaccatctcgatgagtacgtgcgggtatgggccgagtatgaccctgctgcctggggaagaatgccttatcttgacatgtatcagatgctgcgccatatgtctccccctctgggcctgggcaaaaagtgccccgccagagtagcctacaaacgactccttagaatggacttgcccgttgccgatgacaacaccgtccactttaactccaccctgatggccctgattaggaccgctctggatatcaagatcgcaaaagggggggcagataaacagcagatggacgcggaactccggaaagagatgatggcaatttggccgaatttgtcccagaaaacattggatctgttagtgacaccccacaaatctacagacctcacagttggcaagatctacgcagccatgatgattatggagtattacaggcagtccaaagcgaagaagctacaggcaatgagagaagaacaagatcggacgcccctcatgttccagcgcatggagccaccttctccaacgcaggagggcgggcctgggcagaacgccttgccatccacccagctcgaccctggaggcgcactgatggcacacgaatcaggattaaaggaatccccttcttgggtgacccagagggcccaagaaatgtttcagaagactgggacatggtcccctgagcaggggcccccaactgacatgcccaattcacagcccaattctcagtcagtcgagatgcgcgagatgggcagggatgggtacagcgattccgagcactatcttccaatggaaggacaaggcagagccgcttccatgccaagattgcctgctgagaatcagaggcgcagggggcgtccccgaggaaataatctctccacaatttctgatacaagcccgatgaaacgttccgccagcgttctcgggcctaaagccagaagacttgacgattattccttagagcgggtgcccccagaagaaaaccaacgtcatcaccagaggcgaagagataggtcccatagagcttctgaacggagtctcggaagatacaccgacgtggacactggccttgggaccgacctgagtatgaccactcagagcggtgatctcccatccaaggagcgcgatcaagaacggggcagaccaaaggaccgaaaacataggcagcaccatcaccaccatcaccaccaccaccacccacctcccccagataaagacagatacgcccaggagaggcctgaccacggccgggcgcgagccagggaccaacggtggtctcggagcccctctgagggacgggagcatatggcccacagacagggatcatcaagtgtgtcaggaagcccagctccttcaactagtggcaccagtacaccccggcgcggtcgcaggcagctgcctcagaccccttctacacccaggccccatgtcagctactctccagttatccggaaagcggggggttcaggccccccacagcagcagcagcaacagcagcaacagcagcagcaacaggcagtcgcgcgacccggtagagccgctacttcaggacctagaagataccccggcccaacagcagaacccttagccggagatcggccaccaactggggggcacagcagcggacggtctccgcgtatggagcgacgggtgcctggccctgcaagaagcgaaagccccagagcctgtcggcatggaggggctcgttggcccgctagcggcccacatgtctccgagggaccccctggccctaggcatcacggttactatcggggatcagattatgacgaagcagatggcccgggctctggagggggcgaggaggctatggcaggtgcttatgacgctcccccaccggtacgacatgcctcttctggagctacaggaagaagtcctcggacccccagagcatcaggtcccgcgtgtgcctccccaagtcgacatgggcgtaggctgccaaacggctattatcccgctcacggcctggcacgaccccggggaccagggtcgaggaagggattacacgaaccttatagtgaatcagatgatgattggtgttag

SEQ ID NO: 181258 - DNA, 804 bp, Artificial Sequence
  Description of Artificial Sequence: Synthetic coding sequence
atgctgttcatgttcatcttcgccgtggtggccgtgcagctgttcaaaggtaaattcttccattgtacggacgaatcaaaagaattcgagaaggactgtagaggcaaatacctcttgtacgagaagaacgaggtcaaggcaagagatcgggagtggaagaagtatgagttccattacgataatgtcctgtgggcactgctcacactctttaccgtgagcacaggtgaaggatggccacaggtgctcaagcactccgtggacgcaacctttgaaaaccagggaccctccccaggctacagaatggaaatgtcaatattttatgtggtgtactttgttgtgtttcctttcttcttcgtgaacatcttcgtcgccttgatcatcatcacttttcaggagcagggggacaaaatgatggaagaatacagtctggaaaaaaatgagagagcatgtattgactttgccattagcgcaaagcctctgacccggcatatgccgcaaaacaaacagagctttcaatacaggatgtggcagttcgtggtgtccccccccttcgagtataccattatggccatgatagctctcaacacaatagtgttaatgatgaagttttacggagcatcagtggcttacgaaaatgcgttacgggtattcaacatcgtgttcacatcactctttagcctggaatgtgtcttgaaggtcatggcatttggaatcctgaactacttccgagacgcctggaatatctttgatttcgtgacagtgctgggctcaattactgacatcctcgtgacggagtttggctag

SEQ ID NO: 181259 - DNA, 6795 bp, Artificial Sequence
  Description of Artificial Sequence: Synthetic coding sequence
atggccctgtacaaccccatccccgtgcggcagaactgcttcaccgtcaaccggtcactgttcatctttggagaagataatatagtccgtaagtacgcaaagaaactaatcgactggccacccttcgaatacatgattctggcaacgatcattgcaaattgtatcgtcctggccctggaacagcatcttcctgaggatgacaaaacacccatgtcgaggaggcttgagaagaccgagccctacttcattggtatcttttgcttcgaggcaggcatcaagattgtcgccctcgggtttatctttcacaaggggtcatatctgcgcaatgggtggaacgtgatggatttcattgtcgtgttatctggaatcctggccacggccggaactcatttcaacacccacgtggatctccgcacacttcgggccgtgagggtcctgcgacccctgaagttggtgagtggtataccaagcctccaaatcgtattgaagtctattatgaaagccatggtgccgctgttgcagattggcttgctgctcttctttgctattcttatgttcgccattatagggctagaattttactcaggcaagctgcatagggcctgttttatgaacaacagcgggattctcgaggggttcgatccccctcatccctgcggggtccagggttgtcctgcaggttacgagtgcaaggattggatcggccccaatgatgggatcacacagtttgataacatcctgtttgccgtcttaacagtgtttcagtgtatcaccatggaaggctggacaaccgtgctctacaacacaaatgatgctctgggggcaacgtggaactggctgtactttatacccttaataatcatcgggagtttctttgttctgaatctggttttgggcgtactctccggagagttcgccaaggaacgggagcgcgtggaaaataggcgcgcttttatgaaattgagaagacagcagcagatcgagcgggagctcaatggataccgagcgtggatagataaggcggaagaagtcatgttagcggaagaaaataaaaacgccggcacttcagccctagaggttttgaggcgggcgaccatcaagcgatctaggacggaggctatgacacgtgatagcagcgacgaacactgcgtagacatttccagcgttggaacgccactggcccgggctagtatcaagtctgcaaaggtggacggggttagctacttcagacacaaggaacgcctgctgcgcatttcaatccgccatatggtgaagagccaggtattttactggatagtgctgagcctagttgcccttaatactgcttgcgtagcaattgttcaccataatcagccacagtggctcactcacctgctctattatgctgagttcttgttcctgggattgttcctgcttgagatgtccctgaaaatgtatggtatggggcctaggctctactttcacagctcatttaactgctttgacttcggagtgacagtgggctccatctttgaagtagtgtgggctatttttcgacctggcacatccttcgggatcagtgttctgagagccctgagactcctccgcattttcaaaatcactaaatattgggcctctctaaggaatctggttgtgtctctaatgtctagcatgaagtctattataagtctcctgttcctgctgttcttgttcatcgtggtatttgcattgctggggatgcagttgtttggcggccgattcaatttcaatgatggaacacccagcgcaaatttcgacacattccccgccgccataatgacggtctttcagattttaacaggggaagactggaatgaagtgatgtataacggaatcaggagccagggtggagtgtcctcgggcatgtggagtgctatttactttattgtgctcaccctgttcggcaattatacccttttgaatgtgtttttggcaatcgctgtggacaacctagccaacgcgcaagaactgactaaggacgagcaggaggaggaggaggcattcaaccaaaagcacgccttacagaaagctaaggaagttagccctatgagcgctcctaatatgccgtccatagaaagagaccggaggcgtcgacatcatatgtccatgtgggagccacgatctagtcacctaagagaacgcaggcgccggcaccacatgtccgtctgggaacagagaacctcccaactcaggaagcacatgcagatgagtagccaggaagccctgaaccgggaagaggctccaaccatgaaccctctcaacccgctgaaccccctgtcatcgctgaacccactgaacgcccaccccagtctgtataggcgccccagggccatcgaagggttggctctcgggctcgcactagagaagttcgaggaggagcgcatctcccgagggggatcactaaaaggggacggcggagaccggtcatccgcactagacaatcagagaacaccactctctttaggccagcgggagcccccttggctggctcgcccatgccatgggaactgcgaccccacacagcaggaagccggcggaggcgaagctgtcgtcacctttgaggatagagctagacacagacagtcccaacgacggtcccgccatcggcgagtgagaacagaagggaaggagagcagtagcgcttcccggtcaaggtcagcaagccaggaaagaagccttgatgaggcaatgcccactgaaggggagaaggatcacgaattacgggggaaccatggggcaaaagagcctaccattcaggaagagagagctcaagacctccgaaggactaactccctcatggtttcacgcggcagtggcctggctggcgggttggatgaagccgatactcccctagtgctgcctcatccagagctagaggttggaaagcatgttgttctgacagagcaggagcctgaggggtcgtcggaacaagctctgctaggaaacgtacaactggatatgggtcgggtgatctcacagtcggagccagacctgtcgtgcattacggcaaataccgacaaggcgacaactgagtccacaagtgtgacagtcgcaatccctgatgtggacccactggtggacagcactgtggttcacatttctaacaagaccgacggagaggcttctcccctgaaggaggctgagattagggaagatgaggaagaggtagagaaaaagaaacagaaaaaggaaaaaagggagaccggcaaagcaatggtcccacatagcagtatgtttatcttctcgaccaccaaccctatacgccgcgcctgtcactacatagtaaacctgcgctactttgagatgtgtatcctccttgttattgcagcttcatcaatcgcccttgccgctgaagacccggtgctgacgaactcagaaaggaacaaggtccttagatactttgactatgtgttcacaggagtgttcaccttcgaaatggtaattaaaatgatcgaccagggcctgatacttcaagacggttcttacttccgggacctctggaatattttagactttgtggtggtagtcggagctctggtcgccttcgccctggccaattctatgaaaacaaataaagggcgcgatataaagaccattaagagcctgagagtactgcgagtgctcagacctctcaaaacaatcaaacggctcccaaaactcaaggctgtgttcgactgtgtagtgacctccctgaagaatgtgttcaacattctgattgtctacaagcttttcatgttcattttcgccgttatcgcggtacagctttttaaaggcaagtttttttattgcacggatagcagtaaggacacggaaaaggagtgtattggaaattatgtcgaccacgagaagaacaaaatggaggtcaaagggcgggagtggaagagacatgagtttcattatgacaacattatatgggccctgctcaccctcttcactgtctccaccggggaagggtggcctcaggtgttacagcattcagtcgatgtgaccgaggaagacaggggaccaagtagatctaacagaatggaaatgtcaattttctacgtagtatactttgttgttttccctttctttttcgtcaacatttttgttgctctgattattataactttccaggaacagggagacaaaatgatggaggaatgcagtcttgaaaaaaacgagcgagcttgcatagacttcgctatatctgcaaagccactcacacggtatatgcctcagaatcgacacacctttcagtatcgtgtctggcactttgttgtgtcaccatcattcgagtatacgatcatggcaatgatagccttgaatacggtcgtgctgatgatgaaatattacagcgcaccatgcacctacgagcttgctcttaagtatttaaacattgcctttacgatggtttttagtctggagtgtgtactcaaggtgatcgcttttggttttctaaactacttccgggacacctggaacatcttcgattttattacagtgattggaagtatcaccgaaatcatcttgactgacagcaaactggttaacactagcggctttaatatgagtttccttaaactatttcgggccgcacgcctcattaagcttctccgccaggggtataccattagaatcctgctgtggacattcgtacagtcatttaaagctctaccctacgtgtgcttgttaattgctatgctgtttttcatttatgctatcattggcatgcaggtttttggaaatatcaagttagacgaagagagccacataaatagacataataactttcgttcctttttcgggtctttgatgctactcttccgaagcgcaaccggcgaggcctggcaggagatcatgttgtcctgcctaggggagaaggggtgcgaaccggacacaacggccccttcaggccagaatgagaacgagaggtgtgggacagacctcgcctatgtctatttcgtcagctttatctttttttgcagctttctaatgctcaacctgtttgtggccgtaattatggataacttcgagtatctgaccagagattcctctattttaggaccccatcatctagatgagtttgtgcgggtgtgggcggagtacgacagagcagcatgcggcaggatacactacactgagatgtacgaaatgctgacactgatgtccccccctttgggtctcggaaaacgttgtccctctaaagtggcttataagcggcttgtgctcatgaacatgcccgtcgctgaggatatgaccgtccacttcacctccacacttatggctttgattaggacagccctggacatcaagattgccaaggggggagctgaccgacaacagctggacagtgaattacagaaagaaacgctggcaatctggccgcatctctcccaaaaaatgctagatctgctggtgcctatgcccaaggcgtcagatctgaccgtaggtaagatatatgcagcaatgatgataatggattactacaagcagtcaaaagtgaagaagcaacgccaacagctggaggaacagaagaacgcccctatgtttcagagaatggagcctagtagtcttcctcaggagatcattgctaacgctaaggcactaccttaccttcaacaagaccctgtgagtggcctcagcggaagaagcggttatccctctatgtcacccctctcccctcaggacatattccaactggcctgcatggacccggccgatgatggtcagttccaggaacggcagagtctagaacccgaggtgagtgaactaaagagcgtccaacccagcaaccacggcatctacctcccttccgacactcaggaacacgcaggcagcggtcgcgcttccagcatgccgcggttgacagtcgatccgcaggtggtgaccgatccttcgtccatgcgtagaagcttctccacaattcgcgataagcggtccaattcatcctggctggaggagttcagcatggaaaggtcgagcgaaaacacctacaagtctcgaagacgcagctatcactcctctctgagactctctgcgcataggctgaacagcgattccgggcataagagcgatacacacaggagtggtggccgtgagagaggccgatctaaggagcggaagcatctgctgagcccagacgtttcacgctgcaattctgaggagaggggaacgcaggctgactgggagtcccccgagcgtcggcagagccgatccccatccgagggtcgatcccaaacccctaatagacagggtactggcagtttgtcagagagcagtatcccttcggtatcggatacctctacacctagaaggagtaggaggcagctccctcccgtgccacccaagccaaggccattgctctcttattctagcttaattcgacatgctggctccatttctcctccagccgacggctcagaggagggctcgcccctgactagccaggccttggaaagcaacaacgcatgtctcaccgaatcaagcaattccccacacccacagcaatcacagcacgcgagtcctcagaggtacatcagcgaaccctacctggccctgcacgaggattcccacgcctcagattgcggcgaggaggaaaccctcaccttcgaggcagcagtggctacatcccttgggcgcagcaatacaatcgggtctgctccacctctccgccattcttggcagatgcctaatgggcattaccgacggagaagacgaggtggccccggtcctggcatgatgtgtggtgctgtgaacaacctcctcagcgacacggaagaagacgacaaatgctag

SEQ ID NO: 181260 - DNA, 6609 bp, Artificial Sequence
  Description of Artificial Sequence: Synthetic coding sequence
atggccctgtacaaccccatccccgtgcggcagaactgcttcaccgtcaacagaagcctattcatcttcggggaagacaacatcgtcaggaagtacgctaaaaagctgattgattggcctcccttcgagtatatgatcctggccaccatcatcgcaaactgcattgttctggctctggaacagcacctgccagaggatgataagacccccatgagtcggcgtcttgagaaaacagagccgtattttattggcatattttgcttcgaagccggtattaagattgtggccctcggcttcatcttccataaaggatcctatcttaggaacgggtggaatgtgatggacttcatcgtcgttttatcggggatcttggcaaccgcaggaacacactttaacactcacgttgacctgcggaccctccgggcagtaagggtcctgagaccccttaagctggtgtctggtatcccaagtctacagattgtgctcaaatccatcatgaaggctatggtgccgctcctccagattggtctgctcttgttctttgccatcttgatgttcgcaattatcggcctggagttctactcaggcaagctacatagggcgtgttttatgaacaacagcggaatactcgagggtttcgatcccccccatccatgtggggtacaagggtgccccgcagggtatgagtgcaaagattggattggccctaacgacggcatcacacaatttgacaacattctgtttgcagtgctcacagtttttcagtgcatcaccatggaagggtggactacagtattgtacaatactaacgacgccctgggcgccacatggaattggttgtactttatcccactgataataatcggttcattctttgtactcaacttggtgctgggagttctgagcggagaattcgcaaaggaacgggaacgggttgaaaaccggcgagcattcatgaaactgcggagacagcagcagattgaacgggagctcaacggttatcgggcgtggattgacaaagccgaagaagtaatgctagcagaggagaacaagaacgccggtacaagcgctttagaggtccttcggagagccactatcaagcggtctcgcacagaggccatgactcgggacagttctgacgaacactgtgtggatatttctagtgtgggcactcctttggcacgcgcttctattaagtccgctaaggtggatggagtcagctatttcaggcataaagagcgactcttgaggatttccatacggcacatggtgaagagccaagtgttctactggattgtactgagcctcgtcgcattgaataccgcatgcgtcgccatcgtccaccacaatcagccccagtggttaacccatctcttgtactatgctgagttcctgttcctcggactatttttgctggaaatgagcctcaagatgtatggaatggggccgcgcctttacttccactcctcttttaattgctttgattttggagtgaccgtaggatcgatctttgaggtcgtatgggctatttttcgcccaggtacatcctttgggattagcgtgttgcgggcgctgcgcttactcagaatatttaagattaccaagtactgggcctccctgagaaatcttgtggtctccttaatgtcttccatgaaatcaatcatctctttgctgttcttgctgttcttatttatagtcgtctttgccctcttggggatgcagctgtttggcggacgcttcaactttaacgatggaaccccatcagcgaacttcgatacctttcccgctgcaatcatgacggtgtttcagattctaactggcgaagattggaacgaggtgatgtacaatggaatccgatcccaggggggcgtgagttctggcatgtggtcagccatctattttatcgtgcttacactgttcggcaactatacactgcttaatgtattcctggccatagccgttgacaacttggctaacgcgcaggagttgacaaaagacgagcaggaggaagaagaagctttcaatcagaaacacgctctccagaaagcaaaggaagtgtccccaatgtccgctcccaacatgccttccattgaacgggaacgcaggaggcgtcatcatatgtcagtttgggagcagaggacatcccagctgcgcaaacatatgcagatgagctctcaggaggctctgaatcgtgaggaagccccaaccatgaatcctcttaacccactcaaccctctgtcgtcgctgaacccactaaatgcccacccttccctgtaccgaagacctcgggccatagagggccttgccctgggattagccctggagaagtttgaggaggagcggatctctagaggaggtagcctgaagggcgacggcggggatagatccagcgccctggataatcagaggacccctctgagcctagggcagagggaacctccgtggctagctcggccttgtcacggcaattgcgatcccacacagcaggaagccggcggaggtgaggccgttgtgacctttgaagatcgcgcccggcacaggcagtctcaacgacgtagccggcaccgtcgagtgagaacagagggcaaggaatcatctagcgcctctcgatcaaggagcgcatcccaggaaaggtcactggatgaggcgatgccaacagaaggagaaaaggatcatgagttaagagggaaccacggtgccaaggagccaaccatccaggaagaaagagcacaagacttgcgcaggactaattccctgatggtctccagaggatctggcctagccggaggactcgacgaggcagatacccccttggtgctgcctcacccggaactcgaggttgggaagcatgtggtcctcacagagcaggagcccgagggctcttccgagcaggcactgctaggaaatgtgcagctggatatggggagagtgatttcccagtctgagccagacctgtcttgtattaccgccaatacggataaggctaccacagaaagcacgagtgtgacagtggccattccagacgtcgatccactggttgacagcacggtggttcacatctccaataagaccgatggggaagcatcaccactgaaagaggccgagatccgggaggacgaggaagaagtcgagaaaaaaaagcaaaaaaaggagaaaagggagaccgggaaagctatggtgccccactcctctatgttcatcttttccactacaaatcctataaggcgggcctgtcattatattgttaacctgcgatacttcgagatgtgtatactactggtgattgccgcctccagcattgccctggccgcagaggaccccgtccttaccaatagcgagagaaacaaagtgttaagatacttcgattatgtgttcactggtgtgttcaccttcgagatggtgatcaagatgatcgatcagggcttgatcctgcaggacgggtcatattttagagacttatggaatatcctcgacttcgttgtggtggtgggtgctctggtggcattcgcattagcaaacagtatgaagactaacaaaggtcgtgatattaaaactatcaaaagcctgagagttctccgcgttctgaggcccctgaaaacaattaagagactacctaagttgaaggccgtttttgattgcgtcgtcacctccctcaaaaatgtgttcaacatactgatagtttacaaattgtttatgtttatatttgcagtcattgccgtccagctctttaaaggaaagtttttttattgcactgacagctccaaagacacggagaaggagtgtattgggaactatgtagaccacgaaaagaataagatggaagttaagggaagggagtggaagcggcacgaattccattacgataatattatctgggcgctgttaactctgttcaccgtctccaccggggagggttggcctcaagtgctgcagcacagcgttgatgttacagaggaggacagagggccgtcccgcagcaatcggatggaaatgtccattttttacgtcgtgtacttcgtggtgttcccattcttcttcgtgaacattttcgtggccctcattatcattacttttcaggaacagggagataagatgatggaggagtgcagcctggagaaaaatgaaagggcatgcattgatttcgccatcagcgccaaacccctgacacgatatatgccccagaaccggcacacttttcaataccgtgtgtggcactttgtggtttccccatcctttgaatacacaatcatggccatgatagctcttaatacagtggtcctcatgatgaaatactactcagcaccctgcacttacgaattggcccttaaatatctgaatatcgcgtttaccatggtgtttagtttggaatgcgttctcaaagtcattgcctttggatttttgaactatttccgagacacctggaacatctttgactttatcactgtgattggatctataacggagatcatcctgaccgacagtaaactggtcaacactagcggattcaatatgtcgttccttaaactgtttcgcgccgcgagattgatcaagttgctgcggcaaggttatacaattcgcattttactgtggacctttgtccagagcttcaaagctctgccctacgtatgcctgcttattgccatgctcttctttatatatgcaattattggaatgcaggtctttgggaacatcaagctggacgaggagagtcatatcaatagacacaataacttccgctctttttttggcagcctcatgctgctgttcagatccgcgaccggcgaagcttggcaggaaattatgctttcatgtctcggtgagaagggatgcgaacccgacaccacggcccccagcgggcagaacgaaaatgagagatgcgggacagatctggcatatgtgtatttcgtctcatttattttcttctgctcattcctgatgcttaatttatttgtcgccgttatcatggataatttcgagtatctgactcgggactcatccattctggggccccaccatttagatgagtttgtacgggtgtgggctgagtatgatcgcgcagcttgtgggcggattccctataaggacatgtacaagctagtcagggtgatatcccctccactgggcctgggtgaaaattgtccttaccgggtcgcatgcaagcgccttgtgctgatgaatatgccagtggccgaggacatgacagttcattttacctcaaccctgatggccctcatcagaacggctttagacatcaagatagcgaagggaggcgctgatcgtcagcagcttgacagcgaattacagaaggagaccctcgctatttggcctcacctgagccagaagatgctggatctattggtgcctatgccaaaggcctccgatctgacagtggggaaaatctatgcagcgatgatgatcatggattattataagcaatccaaagtgaaaaaacagcggcagcaattagaggagcagaagaatgctccaatgttccagcgcatggagccatcttccctgccccaggagattattgctaacgccaaagctttaccctatctgcagcaagacccagtgtcagggctatcagggcggtcggggtacccatccatgagtcccctctcgccgcaagatatctttcaactggcttgcatggatcccgccgacgacggccagttccaggagcgacagtccctagtggtgactgatccgtcgtccatgcgtcgctcattcagcacaattcgtgataaacgttctaacagtagctggttagaggaattctctatggagcgctcgtcagaaaacacatacaaatctcgaaggaggagttatcattcctcactgcgcctctcagcccaccgtcttaactccgactccggtcacaagagtgatacccatcggtccggaggccgcgagcggggtcgaagtaaggagagaaaacatctgttgagccctgacgtctccaggtgcaacagcgaagaaagaggcactcaggccgattgggaaagccccgagaggcgccagagcagaagtcccagtgaggggaggagccagactccaaacagacaagggaccggaagcttgagtgaatcctctatcccgtctgtcagcgatacctctacgccgcgccggagccgaaggcagcttccgcctgtcccccccaagccaaggccccttttgagctactcttctttgattagacatgctggtagcatctccccgcccgctgatggctccgaagaaggcagccccctgacctctcaggcacttgaatcgaacaatgcgtgtcttacggagagcagcaactctccccatccgcagcagagtcagcatgcgtctccgcaaaggtacatctccgaaccatacctggctttacatgaagactcccatgcttcagattgcggagaggaggagactctgacttttgaggcagccgtggccacctctctgggcaggtccaacacaatcggatctgcacctcctttaagacattcgtggcaaatgcctaacggtcactaccgccgcaggaggcggggtggtccagggcctggaatgatgtgcggagccgtgaacaacctcttaagcgacaccgaggaggatgacaaatgctag

SEQ ID NO: 181261 - DNA, 6885 bp, Artificial Sequence
  Description of Artificial Sequence: Synthetic coding sequence
atggcccggttcggcgaggccgtggtggcccggcccggcagcggcgatggcgactccgaccagagccgcaatcgacaggggactccagtgcccgcctcaggccaggctgctgcctataagcagacgaaggctcagcgggcccgcacaatggctctctataatccaattcctgtgagacagaattgtttcactgtcaacaggagcctgttcatcttcggagaagacaacatagtcaggaaatatgccaaaaagctgatcgactggcccccatttgaatatatgatcctggccacgatcatcgccaattgtatcgttttggctttggagcagcatcttccagaggatgataaaactccaatgtcacgccgactcgaaaaaaccgagccgtactttatcggaatcttctgcttcgaggcaggaattaagattgtggctctgggttttatatttcataagggctcctacctgcgcaatggttggaatgtaatggactttatcgtcgtcctgtccggcatcttggccacagccggaactcatttcaatacccacgtggacttacgtactcttcgagccgtgcgggttctcagaccactaaaactggtttcgggaatcccttccctgcagattgtccttaaaagtatcatgaaggcgatggtgccgctgctgcagatcggactcctcctctttttcgccattctgatgttcgccattattggcctggaattctactccggtaaactacatagggcttgttttatgaacaactctggcatcctggagggattcgacccgccccacccatgcggtgtccaggggtgtccagcagggtatgagtgtaaagattggattggcccgaatgacggaattacacagtttgataatatcctctttgctgtgctgaccgtcttccagtgtataaccatggaaggatggaccaccgtgctgtataataccaatgatgctctgggtgcaacgtggaattggctttacttcatacctttaattatcattggtagttttttcgtgcttaacctagtgctgggggttctctccggcgaattcgctaaggagagggaacgcgtagagaaccgtcgggcatttatgaaactgcggcggcagcagcagatagaaagggagttgaatggttacagagcctggatagacaaagccgaggaagtgatgctggctgaggaaaataaaaatgcaggcacctcagctctggaagttctgcgtagagccactatcaagcgcagccgcactgaagcaatgactcgggacagttccgacgaacactgtgtcgatatatcctctgtcggaacacctctcgctcgggccagtattaaatccgcaaaggtcgacggcgtttcttacttccgccacaaagagcggctgctgcggatctctatcaggcatatggtcaaaagtcaagtcttttactggatagtcctttctttggtggccttgaataccgcgtgtgtcgccatcgtccaccataaccaacctcagtggttgactcacctgctgtactacgcagaatttctttttctaggactgttcctgcttgaaatgagcttgaaaatgtacggtatgggtcccagactgtatttccactcgagttttaattgcttcgactttggagtcaccgtaggttccatctttgaagtcgtatgggccatctttagacctgggacgtcattcggcatctcggttctaagagctctgcgcttgctgagaattttcaagattaccaaatattgggcctcccttaggaacctggtagtgagcctgatgagcagcatgaagagtattatttccctgctcttcctgctgttcctcttcatcgtcgtgttcgcgctcctcggaatgcaactgttcggggggaggttcaacttcaatgatggtaccccaagtgctaactttgacacattccccgcagctataatgaccgtattccagatcttaaccggcgaggactggaatgaagtcatgtataacgggattaggagccagggtggagtatcatcgggcatgtggtcagcaatctactttatcgtattaactctgttcggcaattacacactgctgaatgtgtttctggccattgccgtggacaaccttgctaacgcccaggagctcacgaaggatgagcaggaagaggaggaggcattcaaccagaaacacgctctccagaaggctaaggaggtttccccaatgtccgcgcccaacatgcctagcatagaacgagagcgccgccgtcgccaccatatgtccgtgtgggaacagcgcacatctcaactgcggaaacacatgcaaatgtcgtcacaggaagccttaaatagagaggaagcccccacaatgaatccccttaatcctctgaaccccctttcgagcctaaacccattgaatgcacacccttcattataccgccgcccaagagccattgagggcttggctctcgggcttgcgctggaaaaatttgaagaagagcgaatcagccgcggcggctccctgaagggcgatggtggagacaggagcagcgcactggataaccagcgcacacccctgtcacttggccagagggagccaccatggctggcgagaccttgtcacgggaattgcgacccaacacaacaagaagcagggggcggcgaagctgtggtcacattcgaggatcgtgcccggcaccgccaaagccaacggcgctccaggcacagacgagtccggactgaagggaaggagagtagctctgccagcaggtctaggtcagcaagtcaggagcgatccctggatgaggcaatgccaaccgaaggtgaaaaggaccatgagctgagaggaaatcatggtgccaaggaaccaaccatccaagaagagagggctcaggatttgcgacgaactaatagtctgatggtgtctcgaggctcaggactcgcggggggactggacgaggccgatactccactcgtgttgccgcaccctgagttggaggtcggaaaacacgtggttctgacagagcaggagccagaaggcagcagtgagcaggcccttctgggcaatgtccagttagatatgggtcgcgtcattagtcagtccgagccagatttatcctgtattacagctaataccgacaaggccacgaccgagtctacttctgttactgtggccatccctgacgtagatccattggtggattcgacagtggtccacattagcaacaagacggacggcgaagcctcacccctgaaggaggcggagatacgggaggacgaggaggaggtggagaagaagaagcagaaaaaagaaaagagagaaaccggtaaggccatggtgccacactcttctatgttcatttttagcacaacaaatcccatccgcagggcatgccactacatcgtgaacctccggtacttcgagatgtgcatcttacttgtgatcgccgccagttccattgcattggcggcagaggaccctgtgttgactaactccgagcgcaacaaagtgttacgatatttcgattacgtattcacaggggtgttcaccttcgaaatggttatcaagatgattgaccagggtctgattctccaggatggttcttattttagggatctgtggaatatacttgactttgtagtagtggtgggtgccctggtggcattcgccctcgctaacgccttgggtactaacaaggggagggacattaaaactattaagagtctccgggtgctgagagtacttaggccattaaaaacaataaagagactgcccaaattgaaggccgtgtttgactgtgtagtcactagcttgaagaacgtgttcaatatactaattgtatataagctgtttatgtttatttttgcagttatcgctgttcagctgttcaagggcaagttcttttactgcacagattcgtctaaagacaccgaaaaagagtgtataggtaattatgtggatcacgagaagaacaagatggaggtgaaaggtagagagtggaaaaggcacgaatttcattacgacaatatcatttgggctttgttgaccctgttcactgtgtctacgggggaaggctggcctcaggtcctgcagcatagtgttgatgtaacagaggaagacaggggaccctctaggagcaacaggatggaaatgtcaatcttttatgtggtctatttcgttgtcttcccgtttttcttcgtgaacatctttgtggccctcattatcataacgttccaggagcagggggataagatgatggaagaatgctctttagagaagaacgagcgcgcatgtatcgactttgcaatttccgccaagcccctgacccgatacatgccacagaaccggcatacattccaatacagggtgtggcactttgtggtgtccccatcatttgagtatactatcatggctatgatcgccctcaataccgtcgtgctcatgatgaagtactactcggccccctgtacctatgagctggctctgaagtatttgaacattgcattcaccatggtgttcagcctggaatgcgtcctcaaagtaattgcctttggctttttgaactactttagggacacctggaatatctttgacttcatcaccgtgatcgggtccatcacagaaataatcctgaccgattccaaactcgtcaacacatcgggcttcaatatgtcatttctcaagctgttcagagctgctcgtctgattaaattgctgaggcagggctacacaattaggatccttttatggaccttcgtgcaaagctttaaggcgctgccctacgtctgtttgcttattgcaatgctgttctttatatacgccatcatcggtatgcaggtgttcggaaatattaaacttgatgaagagagccatatcaacagacataacaacttccggagcttcttcgggagcctgatgctactatttcgcagtgcaaccggggaggcgtggcaggaaatcatgctgtcttgcttaggcgagaaaggctgcgagcccgacaccaccgcaccgtccggtcaaaatgagaatgaaagatgtggaacagacctggcatatgtttattttgtcagtttcatatttttttgcagtttcttgatgctcaatctgttcgtggccgtgataatggacaacttcgagtacttgacaagagatagttctatcctgggaccccatcacctggacgagttcgtcagggtgtgggccgagtatgaccgggccgcctgcggaagaatccactacacagagatgtacgaaatgctgactctgatgtcacctcccctcggactgggcaagaggtgcccatccaaagtggcatacaagagactggtgctgatgaacatgccggtcgcagaagacatgacggtacatttcacctccactttgatggcacttattagaaccgccctggatattaagatcgccaagggtggcgcagaccgacagcagctcgacagcgaactccaaaaagaaactctggcaatctggccacacctgtctcagaagatgctcgatttgttggtccccatgcctaaggctagcgatctcaccgttggcaagatctacgcggctatgatgattatggactactataagcagagcaaggttaaaaagcagcggcaacagttggaggaacagaagaacgcacctatgttccagcgcatggagccatcatctctcccccaggagatcatcgccaatgccaaggctctcccatatcttcagcaagaccccgttagcggactctctggccgatcaggttatccgtcgatgagtccactgtctccacaggacatttttcagctcgcctgcatggatcctgcggacgatggtcagtttcaggaaagacagtcacttgagcccgaggtcagtgagctgaaatcagttcaaccgagcaaccatggaatatatttgccaagcgatacacaagaacatgctggttcagggagagcaagctcaatgccaaggcttactgtcgatccacaggtagttaccgatccctcttccatgcggcggagtttcagcactatccgggataagagaagcaactcttcatggcttgaagagttctccatggagaggagctctgagaacacctacaaatctagaagaagatcctaccactcctctctgcgcctctcagcacaccggcttaattcggactcaggacacaaatccgatacccaccgttcaggaggtagggagagaggaaggagcaaagagagaaaacatctgctgagccccgacgtaagcagatgcaattcggaagaacgcgggacccaggccgactgggagtctcctgagcgccgacagtctaggtctccctctgaaggcaggtcccagaccccaaaccgccaggggacaggatctctatctgagtctagtatcccatcagtgtctgacacctccacacctcgtagaagccgcaggcaacttcccccagtacctcctaagccacgtcctctgcttagctacagctctctgatccgccatgctgggagcatttcaccccctgccgatggatcagaggagggctcaccattaacaagccaggcgctggaatccaataacgcttgcctcacggaatcgagtaactctccgcacccccaacagtctcagcacgcctctccgcaaagatacatatccgagccttacctagccttacacgaggattcacacgcaagcgattgcggtgaagaagaaaccctgacttttgaagccgctgtagcgacctccctgggccgcagcaacacgattggatcagcacctcccctgaggcactcatggcagatgccaaatgggcattaccgtagaaggaggcggggaggccctgggcctggaatgatgtgcggggcagtgaacaacctcctgagcgacacagaggaagatgataaatgttag

SEQ ID NO: 181262 - DNA, 5634 bp, Artificial Sequence
  Description of Artificial Sequence: Synthetic coding sequence
atgctggccgaggagaacaagaacgccggcaccagcgccctggaggtgctgcgaagagctacgataaagaggtcccgcacagaagcaatgacgcgtgactcatcggacgaacattgcgtcgacataagttctgtcggaactccgctggccagggcctctatcaaatctgcaaaagttgatggggtaagctattttcgacataaggagcggctgttacgaatctctatccgtcatatggtgaaaagccaggtgttctattggatagtcctctctttggttgccttgaataccgcttgcgttgctattgtgcatcataaccagccccaatggctcactcacctgctgtactatgccgaattcctatttctcggcctgttcctgctcgaaatgtcactcaagatgtacgggatgggtcctaggttatattttcattcttccttcaattgtttcgacttcggtgttactgttggttccatattcgaggtggtctgggccatctttcggccaggtacctcctttggcatctctgtgcttagagctctgcgtctgctgcggatttttaagatcactaagtactgggcttccctcaggaacttggtggtgtcattgatgtcctccatgaagtcaatcataagtctactgttcctcctctttttgtttatcgtggtgttcgccttactaggcatgcaactctttggggggcgttttaattttaatgacgggaccccttccgcgaacttcgacacattcccagccgcaatcatgacggtatttcaaatccttactggggaagattggaacgaagtgatgtacaatggcatcaggtcccagggaggagtttccagcggcatgtggagcgctatctacttcattgtgcttacactcttcggtaactacacactgctcaacgtttttctggcaattgccgtggataacctggctaatgcccaggagctgacaaaggacgaacaggaagaggaagaggccttcaaccagaaacatgctcttcagaaagctaaagaggtcagccccatgtcagccccaaatatgccctctattgagagagatagacgccggcgccaccatatgtccatgtgggaaccacgctcatcacatcttagagaaaggcgccgcagacatcacatgagtgtgtgggagcagagaacttcacagctccgcaaacacatgcaaatgtcaagccaagaagctcttaaccgcgaggaagctccgaccatgaatccgctgaatccccttaaccccctttcctctcttaatccgctgaacgctcacccttcactgtatcgcaggccaagggccatcgagggcctggccctgggtttggccctcgagaagtttgaggaggaacgaattagtagaggaggaagcctcaagggtgatggaggagacagatcgtctgctttagacaatcaaaggacgccactgtccctggggcaacgagaacccccctggctagcacgcccctgtcacggaaactgcgatcctacacagcaggaggcggggggaggcgaagcagtggtgacgttcgaggatcgtgcaagacaccggcaaagtcagcggcgatctagacaccggagggtgaggaccgaggggaaggaatccagcagtgcttcacggtcccggtctgccagccaggagcgaagtctggatgaggctatgccaacggaaggcgaaaaagaccacgagctaaggggaaatcacggtgctaaggagcctacaatccaagaggaacgggctcaggacctcagaagaaccaatagtcttatggtttcgagagggagcggcctcgccggcggactcgatgaggcagatacgcctcttgtactgccacatcccgagctcgaggtgggtaaacatgttgtgctcaccgagcaggagcctgaggggagctctgaacaagccctactcggaaatgtgcagctagacatgggccgcgtgatcagccagtcagagcccgatctgagctgtatcactgccaataccgataaagcaaccacagaatctacctctgtaactgtcgcgatccctgacgtcgacccactggtggattccactgtggttcatattagtaataagaccgatggagaggcctcccccctgaaggaagctgaaatacgtgaggatgaagaagaagtggagaagaaaaagcagaaaaaagagaagcgcgagaccggcaaagctatggtgcctcatagctcaatgtttattttctccacaaccaatcctatcaggagggcatgtcattatattgttaatctcaggtatttcgagatgtgtatcctgctggtgatagcagccagctctatagccctggccgcagaggacccagtgctgacgaactccgaaagaaacaaagtactccgttactttgactacgtgtttacgggtgttttcactttcgagatggtcatcaaaatgattgaccagggccttattctccaggacggttcttactttcgggatctttggaatatcctggacttcgttgtcgtcgtgggcgctctggtggcattcgctctagccatgagcctggagacaaataagggcagggatataaagacaattaagtctctgcgggtgctccgtgttctgcgccctctcaaaacaattaaacggctgccaaaactcaaagcggtcttcgactgcgtggtgacgagccttaagaacgttttcaatatactgattgtctataagctgttcatgttcatctttgctgtcatcgcggtccagctcttcaagggcaagtttttctattgtaccgactcctctaaagataccgagaaggagtgcataggtaattacgtggatcacgagaagaacaagatggaggttaaagggcgagagtggaaacggcatgaattccactacgataacattatttgggccctgctcactttatttacagtgtctaccggagaagggtggcctcaggtattgcagcacagcgtcgatgtgactgaagaggataggggaccgtcccggtccaaccgcatggaaatgagcatcttttatgtcgtctactttgtcgtattcccatttttctttgtcaacatctttgtggccttgattattatcacttttcaggagcagggcgacaagatgatggaggaatgctcgttggagaaaaacgagcgtgcatgcattgacttcgccatctcagccaagcccctgacacgttacatgccccagaatcggcataccttccaatatagagtatggcatttcgtggtcagcccgtcatttgaatacaccatcatggccatgatcgctctgaacaccgtcgtgctaatgatgaagtactattctgccccatgtacttacgagctggctctgaagtatctaaacatcgccttcactatggtgttctccctggaatgcgtactgaaagttatcgcttttgggtttcttaattactttcgtgatacttggaacatcttcgacttcatcacggtgattgggagtattacagagattattcttacagattccaagctggtgaatacatctggattcaatatgtcttttcttaagctttttcgcgctgcaagactcatcaagctcctgagacagggttacaccatccgcatcctgctttggacctttgtgcagtcttttaaagccttgccctacgtgtgcctgcttattgccatgttattttttatttacgcgatcatcggcatgcaggtcttcggcaatatcaagctggacgaggaatcacatattaaccggcacaataatttcaggagcttcttcgggtcactgatgctgctcttcaggtccgcaaccggcgaggcatggcaggagatcatgctgtcgtgtctcggcgagaaaggctgcgaaccggataccacagctccttccggccagaatgaaaacgagcgatgcggtaccgatctggcatacgtgtactttgtctccttcatttttttctgttccttcctcatgctaaacctgttcgtggcggtcattatggataatttcgagtacttaaccagggattccagcatcctgggcccgcaccatctggatgagtttgtgcgagtctgggccgaatatgacagagcagcttgtggtaggatacattatactgaaatgtatgagatgctgactttaatgtcacctccactgggcctaggcaaaaggtgccctagtaaggtggcatacaaacggctcgtgctaatgaacatgcctgtggccgaggacatgaccgtgcactttactagcaccctgatggcactgatacgtaccgccctcgacatcaagatcgctaagggaggcgccgataggcagcaattggattccgagctgcagaaggagactcttgccatctggccccatctaagtcaaaagatgttggatctgctggtccctatgccaaaggcatcagacttaaccgtgggaaagatttacgccgcaatgatgattatggattattacaaacaatcaaaagtgaagaagcagagacagcaactcgaggaacagaaaaacgcccctatgttccaaagaatggaacccagcagcctgccccaggaaatcatagcgaatgccaaagccttgccctatctacagcaggatcctgtgagcggcctgtcgggaaggtccggatatccatctatgagccccctctccccccaggacatctttcaactggcgtgtatggatccagccgacgatggtcagttccaggagagacagtccctggtcgttactgacccttcctctatgaggaggagtttcagcaccatcagagataagcgcagcaacagttcctggcttgaagaattctccatggagcgatcgtcagaaaacacttataaatcgagaagacgtagctaccattcgagcttgcgactgtcggcgcacagactgaattccgattctggacacaagtccgacactcatagaagtggcggccgtgagagaggccggtcaaaagagaggaagcacctactctctccagacgtcagtaggtgtaattccgaggagcggggcacacaggccgactgggagtccccggaacgacggcagagtcgatccccaagtgagggccgctctcagacacctaacagacaaggcaccggctctctctccgagagtagcatacccagcgtgtcggatacctcaaccccccgtagaagtcggcgccagctaccccctgtgccaccaaagccccgccctctcctcagctattccagcttgattaggcatgcaggttctattagtccccccgccgatgggtcagaagaagggagccctctgactagccaagcactggaaagtaacaacgcgtgcttaactgagtcttccaactccccgcaccctcagcagtctcagcacgcctcaccacagcgatacatttctgaaccgtatttggctttgcacgaagacagccacgcatctgattgcggggaagaagagacactgacctttgaggccgccgttgcgacatcactcggtcggtcgaacactatcggtagtgcccctcccttacggcattcttggcagatgcctaatggtcattataggagaaggaggcgtgggggccctggtccaggcatgatgtgcggagcagtaaataatctgttatcggacactgaagaagacgacaaatgctag

SEQ ID NO: 181263 - DNA, 6813 bp, Artificial Sequence
  Description of Artificial Sequence: Synthetic coding sequence
atggcccggttcggcgaggccgtggtggcccggcccggcagcggcgacggggattcggatcagagccgcaacaggcaaggaacgcccgtcccagcaagcggacaggccgctgcatataagcaaaccaaggcacagcgcgcccgaactatggcactctataacccaatccccgtgaggcagaactgtttcaccgtgaacaggtccctgtttattttcggtgaggacaacatcgtcagaaaatatgccaagaaactgattgactggcctccatttgagtacatgatcttggccactataattgccaattgcatcgtccttgccctcgagcagcatctccctgaagatgataagaccccaatgtccaggcgcctggaaaagacagaaccgtacttcattgggattttctgttttgaggcagggatcaagatcgtggcactcgggtttatctttcacaaaggttcataccttcgtaacgggtggaacgtaatggactttattgtggtcctctcaggcattttagctaccgccgggacacactttaacactcatgttgatctcaggacactcagggccgtaagagtgctgaggccgctcaagctcgtttccggtatcccgagtcttcagatcgtgcttaagtccatcatgaaagccatggtgcccctcctgcagatcgggttactgctcttcttcgccattttgatgtttgcaataattggtctggagttctatagcggcaaacttcaccgggcttgtttcatgaataattccggcatcctcgagggttttgatcctccccacccctgcggtgtgcagggctgccccgccggctatgagtgcaaagactggatcggcccaaacgatggaatcacccagtttgacaatatcttgttcgccgtcctaaccgtgtttcaatgtattactatggagggctggaccactgtgctgtataacactaatgacgccctgggtgctacatggaattggctgtacttcatccccctgataatcatcggtagcttctttgtgttaaatctcgtcttgggcgtcctgtccggagaattcgccaaggagcgcgagcgtgtggagaatcgacgcgcttttatgaagcttcgccggcagcagcagattgagagggaactgaacgggtatcgagcttggatcgataaggccgaggaagtcatgttagccgaagagaataagaatgccgggacctctgcactggaggttctccgcagggctacgattaaacgaagtcggactgaggcgatgacgagggactcatctgatgagcattgcgtggatataagctctgtcgggaccccactggctcgggcgtccattaagtcggcaaaggtcgacggcgtgagctatttcaggcataaggagcggctgctccgaatttcaatcaggcatatggtcaagagccaagtattctattggatagtcctgagtttagtcgccttaaatacagcttgtgtggccatcgtccaccataaccagccgcagtggcttacccacctgctatattacgcagagttcctgtttctgggtttgtttctgctggaaatgtctctaaagatgtacgggatgggccctcggctgtatttccacagctcgtttaactgctttgacttcggagtgaccgtaggcagcatctttgaagtggtctgggccatttttcgccctgggacgtctttcggcattagcgtcctgcgggctctgcgtttgttgaggatcttcaaaatcaccaagtattgggcctcattgcggaacctggtagtctctctgatgtctagcatgaagagcataatctccctactgttcctcctgttcctgttcatcgttgtgttcgcgttgctcgggatgcagctatttggcggcagatttaactttaacgatgggacgcctagtgccaatttcgacacatttcccgcagccatcatgaccgtgttccaaatcctgacaggcgaggattggaacgaagtgatgtataacggcataagaagccagggtggtgtatcttccggcatgtggagtgccatatatttcatcgtgctcaccctgttcggcaactatacactgttgaacgtgttcttggccatcgcagttgataaccttgctaatgctcaggagctgacaaaagacgagcaggaggaggaggaggcctttaatcagaaacatgcactgcagaaagccaaggaggtgtcacccatgagtgcacctaatatgccgtccatcgagcgcgaccggaggcgacgccaccatatgagcatgtgggaacctcgcagcagccatctccgagaaagaagaaggcgacaccatatgtcagtgtgggaacaacgcacttcacagctccgaaaacatatgcagatgagtagccaagaagcgcttaatagggaagaggccccgacaatgaacccgctgaatcccctgaatccactcagctcccttaatcccctgaacgcacatccatcattatatagacgacccagagccatcgagggtctggccctcggcctggcgctggaaaaattcgaagaagagaggatttccagggggggatccttgaagggagatggcggagacaggagttccgcactggacaatcaacgtacccctctgtctttaggtcagcgcgaaccaccatggttagctcgtccgtgccatggaaattgcgatcccacccagcaagaagcaggcgggggtgaggccgttgtcacattcgaggacagggcccgtcataggcagagccaacggcgatccagacaccggagggtgaggaccgagggcaaggagagctcctccgccagtcgatctcggtccgcaagccaggagagaagcctcgacgaggccatgcctactgaaggcgaaaaagatcatgagttgaggggcaatcatggcgcaaaagagcctactattcaggaagagagagcccaagatctgcgcaggacaaattccctgatggtgagtcggggatcaggactggcaggtggtctggatgaagccgacacacctttagtgcttccgcaccctgagctcgaggtgggaaaacacgtagtgctgaccgagcaagaacccgagggaagctccgagcaggccctgcttgggaatgttcagcttgatatgggccgagtaatctcccagagcgagcctgacctgagctgtattacagccaatacagacaaggccacaactgaaagcacatccgtcacggtcgctatacctgacgttgatccactcgtggattctaccgtcgtgcatatttctaacaagacagacggggaggccagccctctaaaggaggccgaaattcgcgaagacgaggaggaagtggagaagaagaagcaaaaaaaagaaaagcgcgaaaccggtaaagctatggtcccacacagttctatgttcatcttttccacaacaaatccgattcggcgcgcttgccattatatcgttaacctgagatatttcgagatgtgcattttgctggtgatcgctgcctcttccatcgctctggcggcggaggacccggtgctcactaattccgagcggaacaaggtcttacgctattttgattacgttttcacaggcgtgttcacatttgaaatggtaattaaaatgatcgatcaggggctcatactgcaggacggcagctatttcagagacttgtggaatatcctcgatttcgtggtggtggtgggcgccttggtggcgttcgcactggccaatgctctgggcacaaataagggcagagatatcaagacgataaaaagcctccgagtgctcagagtattgagacctcttaagactatcaagcgtttgccgaagctgaaagccgtgtttgattgcgtggtgacatccctgaaaaacgtgtttaacatcctcatcgtgtacaagctcttcatgtttatatttgccgtgatcgccgttcagctgttcaaggggaaattcttctattgcactgattcttcaaaggataccgagaaagaatgcataggcaactacgtggatcatgagaaaaataagatggaagttaagggcagggaatggaagcgccacgaattccactacgataacatcatatgggctttactcacccttttcactgtctctacaggcgagggctggccacaggtgttgcaacatagcgtagacgtgactgaagaggaccggggcccatctaggagcaaccggatggagatgtccatattctatgtggtgtatttcgtggtgttcccattctttttcgtgaatatattcgtggcactgataataatcactttccaggagcaaggggacaagatgatggaagagtgttctttagagaagaatgaaagagcctgcatcgactttgctattagtgctaaaccccttacccggtatatgcctcagaaccgacatacctttcagtaccgggtctggcattttgtcgtgtctcctagttttgagtatacaataatggcgatgattgcgctcaacaccgtcgtcttaatgatgaagtactactcagccccctgcacatacgaacttgctctgaaatacctgaatatcgccttcacaatggtcttctccctggagtgtgtgctcaaagttattgccttcggatttctgaattacttccgggacacctggaatattttcgacttcatcaccgtgattggttccataaccgaaatcattctaaccgatagtaagcttgttaatacctcaggtttcaatatgagctttcttaagctcttcagagctgcaagactgatcaaactcctaagacaggggtataccattcgaatccttctgtggacattcgttcagtcattcaaggctttgccgtacgtgtgtcttttgatcgcgatgctcttttttatctacgctatcattggcatgcaagtatttggcaacatcaaactagatgaggaaagccatatcaacagacacaataactttcgcagctttttcggaagtttaatgttacttttccggtctgctactggagaggcatggcaggagatcatgctgagttgtctcggtgaaaaaggatgtgagcccgacaccactgctccctccggccaaaacgaaaacgaacggtgcggcactgatttggcatacgtatactttgtctcatttatcttcttctgttcctttctcatgctcaacttgttcgtggccgtaatcatggataacttcgagtacctcactcgtgattcttcaattctcggacctcaccacctggatgagtttgtgagggtgtgggctgagtatgacagggctgcctgcggccgaatccactatactgagatgtacgagatgttaaccctgatgtctcccccacttggacttgggaagagatgtcccagcaaggttgcatataagaggctggtcctgatgaacatgcctgtggctgaggatatgaccgtccactttaccagcacactgatggccttgattcggacagcacttgatataaagattgccaaaggcggcgccgaccgccaacagctagattccgagttgcaaaaggaaacattggcgatttggcctcatttgtctcagaagatgctggatttgctagtgccgatgccaaaggcctctgacctgaccgtcggcaaaatctatgccgcgatgatgatcatggactattacaaacagtccaaagtgaaaaaacaacggcagcagctggaagaacagaagaatgcgccgatgttccagcgaatggagccctccagtctgccccaggagattattgccaatgctaaggcacttccctatctgcaacaagatccagtgtcaggattgagcggccgctctggatatccctccatgtcacctctgagtcctcaggatatttttcagctggcctgcatggatccagctgatgatgggcagttccaggaacgacagtctctggtggtgacagatccatcctcaatgaggaggagcttctcaacaatccgggataaacgtagcaactcctcttggttagaggagtttagtatggagcggtctagcgagaacacctacaaatctcgtcgacgcagctatcattcttctctccgcctctcagcccatagactaaactccgacagtgggcataagtccgatacacaccggtcaggcgggcgggagcgcggtcgcagcaaagaacgcaaacatctgctaagccccgacgtcagcaggtgcaattctgaggaacgtggcactcaggccgattgggagagtccggagcgaagacaatctaggtccccaagtgagggccgatcccaaacccccaataggcagggcactggcagcctgtccgagagctcaatcccttctgtgtccgatacatcaacgccacgcagaagtcgaaggcagctgcctcccgtgcctcctaaacctcgacctctgctctcttattcttcacttatccgccacgcaggctctatttcccctcctgccgatgggtccgaggaaggatcacctcttacctcacaggctctcgaaagtaacaatgcatgcctcaccgagagttccaattcaccacaccctcaacagtctcagcatgcctcaccacagaggtacattagcgaaccttacctcgccttacacgaagatagtcacgccagtgattgtggcgaggaagagacactgacgttcgaggccgccgtcgctacatctctgggccgcagcaacacaatcggatctgctcctccactgcgtcatagttggcagatgccaaatggacattaccggagaaggagaagggggggacccggccccggaatgatgtgcggcgccgtgaataatttgcttagcgacactgaggaggatgacaaatgctag

SEQ ID NO: 181264 - DNA, 6942 bp, Artificial Sequence
  Description of Artificial Sequence: Synthetic coding sequence
atggcccggttcggcgaggccgtggtggcccggcccggcagcggcgacggcgattccgaccagagcagaaaccgacaggggactcccgtgccggcaagtggccaggcagctgcctataagcagacgaaagctcagagagcacgcacaatggcgctgtacaaccctatacccgtaaggcagaattgttttacagtaaaccgcagcctgtttattttcggggaggacaacattgtgcgcaagtatgccaagaagctcatcgattggcctcccttcgagtacatgattctggctactataatcgcaaactgcatcgtgttggcccttgagcagcacctgcctgaagacgacaagacgcccatgtccaggcgcctcgagaagacagaaccgtatttcattggcattttttgctttgaggctggcatcaagattgttgccctgggcttcatattccataaaggttcttacctccgaaacggctggaacgttatggactttatagtcgtgctttccggaatcttggccaccgccggaacccacttcaacacccacgtggatctccgtactctgagggccgtccgcgtgttacggccactgaagctggtctctggcattccttccttgcagattgtgcttaagtctatcatgaaagcgatggttcctctgttgcagatcggcttgctgctgtttttcgccatcctgatgttcgccataatcgggctagaattctactccgggaagcttcatagagcctgtttcatgaacaactccggcatattggagggcttcgatcctccccacccgtgtggcgtccagggctgtcctgctggctacgaatgtaaggactggataggtcccaacgatggcatcacccagttcgataacattctttttgccgttctgaccgtcttccagtgtatcaccatggagggctggaccaccgtgctgtacaatactaacgacgccctgggcgccacctggaattggctttattttattcccttgatcatcatcggttctttcttcgtcctgaacttggtgctgggcgtgctgagcggagaatttgccaaggagagagagcgtgtggaaaatagacgggcgttcatgaagctgcgcaggcagcagcagatcgaaagagagcttaacggttaccgggcctggattgacaaggcagaagaggtgatgctggcagaagaaaacaagaacgctgggacatccgccctggaggtgctcagaagagcgaccatcaaaagaagccgaaccgaggcaatgacccgtgatagctccgacgagcactgtgtggacatcagtagtgttggcaccccactcgcccgcgcttcaatcaagagtgctaaagtggatggcgtgagctattttcggcacaaagaacgtttactgcgtatcagcattaggcatatggtgaaaagtcaggtattctattggattgtgctatccctggttgcactgaacactgcctgcgtggcgatagtccaccacaatcaacctcagtggcttacacaccttttgtactatgccgagtttctgtttctggggctttttttattagagatgtccttgaagatgtatggaatgggacccagactgtacttccacagctcttttaattgctttgattttggagtcactgtcggctcgatcttcgaggtggtttgggcaatctttagaccgggaacctcttttggaatctcagtgctccgcgcccttcgattactgcgcatttttaagatcactaaatattgggcttcacttcgcaatttagttgtatccctgatgagcagcatgaaatccatcatctccttgcttttcctactttttctgttcatagtggtgtttgccctgttgggcatgcagctttttggcggcagattcaattttaacgacggcacaccatccgcaaatttcgacacattccctgcggcgattatgactgtgtttcaaatcctgaccggtgaagactggaacgaggtgatgtacaacggcattagatcccagggaggcgtctccagtggaatgtggtccgctatctacttcattgtattgactctatttgggaactatacgctcctaaacgtttttttggcaatcgccgtggacaacctcgcgaacgctcaggagcttactaaggatgagcaagaggaagaggaagcattcaaccaaaagcacgctctgcagaaggctaaggaggtgagcccaatgagtgccccgaatatgccatccattgaacgcgaccggcgacgaaggcatcatatgagtatgtgggaacctaggtcatcacacctgcgggaacgacgaagaaggcatcacatgtccgtgtgggaacagaggacatctcagctaagaaaacacatgcagatgtcaagccaggaggcactcaacagggaggaggcgcctaccatgaatccactcaatccactaaaccccttatccagtttaaatcctctaaatgcacatcctagcctttacaggaggcctcgagcgatcgagggactggccctcggcctggccctggagaagtttgaggaggagcggataagccggggcggaagcctaaagggggacggcggggaccggagttcagctctcgataaccagagaaccccattaagtctgggtcagagggagcccccttggctggctagaccatgccacggaaactgtgatcccacccagcaggaggccggaggcggcgaagctgtggtaacctttgaagatcgcgcaaggcatcgacagtctcaacgccgatctaggcacagaagagttagaaccgagggtaaggaaagctcctccgcctcaagaagccggagtgcctcacaggagcgctcactcgacgaagcaatgcctacagagggcgagaaggaccatgagctgagaggtaaccatggggccaaagagccaacgatccaagaggaacgagcccaggatctgcgccggactaatagcctgatggttagtcgggggtctggtctggctggagggctggatgaagcggacacacccctggttctgcctcatcccgaactggaggtcgggaagcatgttgtgctcaccgagcaggaacccgaaggtagcagcgaacaggctctattgggtaacgtccagcttgatatgggtagggtgatcagtcagtcagagccagatctcagctgtattacagctaatacagataaggcaacgacagaatctacttcagtcacagtggccatccccgacgttgacccccttgtggatagcacagttgttcatatttcaaacaagaccgatggggaggcctccccattgaaggaggctgaaatacgggaggatgaggaggaggtggaaaagaagaagcagaaaaaagagaaaagagagaccggcaaggccatggtcccgcactcttcaatgttcatattctctacaaccaatcctataaggcgggcttgccactacattgtgaatctaaggtattttgagatgtgcatcctgctcgtgatcgccgctagcagcatagccctcgcggcagaggatcctgttctcactaattcggagcggaacaaagtgctccgctatttcgattatgtcttcacaggcgtgtttacctttgagatggttattaagatgatcgaccaggggcttatactgcaggacgggtcttatttccgcgatctgtggaacatcctggactttgtggtcgtggtaggcgccctggtcgcgtttgcattagcaaatgccctggggactaacaagggaagggacattaagacaatcaaatcgctgagggtgctcagggtcttaaggcccttgaagaccatcaaacggctgccaaagctgaaagcagtcttcgactgtgtcgtgacgagtcttaaaaatgttttcaacattctgatcgtgtacaaactcttcatgttcatctttgcagtgatcgccgtccaactatttaagggcaagttcttttattgcacagacagctctaaggatacagaaaaggagtgcattggcaattacgtcgaccacgagaaaaataagatggaagttaagggccgagagtggaaacggcatgagtttcattatgacaacataatctgggccctccttaccctcttcaccgtttccaccggggaagggtggccacaggttctgcaacattcagtggacgtaacagaggaagacagaggcccaagccgctcgaatcgcatggagatgtcgattttttatgtcgtgtacttcgtagtcttccctttcttctttgttaacatcttcgtggcgctgattataatcacctttcaagagcagggagacaaaatgatggaagagtgttctcttgaaaagaatgaacgcgcttgcattgacttcgctatttcagcaaagccactgaccagatatatgcctcagaatcggcacaccttccagtaccgtgtctggcactttgtggtaagtccatccttcgaatataccataatggcgatgatcgctttaaatacggtcgtgcttatgatgaagtactactcagccccctgcacctatgaattagctctgaaatacctcaacattgcatttaccatggtcttctcactcgagtgtgttctgaaggtaattgctttcggtttcctaaactactttcgagatacctggaatatctttgactttatcacagtcatcggctctatcacagaaataatcctgacagattccaagctggtcaataccagcggcttcaatatgtctttcctgaaactgtttagggcggctcgtcttattaagctattgcggcagggttacacaataaggattctcctgtggacgttcgtgcagagtttcaaagctctcccatatgtgtgtttactgatagcaatgttattttttatttacgctattatagggatgcaggtctttggcaacataaaactggacgaggaaagccacatcaatcgacacaacaactttagaagtttcttcggcagcctgatgttactgttccggtccgctactggcgaggcctggcaggaaatcatgctgtcctgtcttggcgagaaaggctgcgagcccgacacaacggctccctcaggacagaacgaaaacgaacgatgcggtactgacctcgcttatgtgtacttcgtatcctttatcttcttttgctctttccttatgctgaatttatttgtcgctgtcattatggataattttgagtatctgactagggattcatcgatcctgggcccacatcacctcgatgaattcgtccgtgtatgggccgagtacgaccgcgcggcatgtggccgtatccactataccgagatgtatgagatgctgacactgatgtccccacctctcggcctggggaagagatgcccaagtaaggtcgcgtacaagaggttggtactgatgaacatgcctgtggccgaagatatgaccgtacactttaccagcactctgatggcattaatcaggacggctcttgatatcaagatcgccaagggtggtgcggaccggcagcagcttgattccgaactccagaaggagaccttggccatatggcctcatctgtcacagaagatgcttgatctgcttgtgcctatgcccaaagcgtccgatcttacggttggaaagatatacgccgcaatgatgattatggactattacaagcagtccaaagtgaagaagcaaaggcaacaactggaggaacagaagaatgccccaatgtttcaacgcatggagccaagctcactcccccaggagattattgcgaatgccaaggccctgccatacctccaacaagatcctgtatcgggattatcagggcggagcggctatccctccatgtcacccctcagcccccaggatatcttccagctcgcctgcatggatccagcggacgacggccagttccaggagcgtcaaagcctcgaacctgaagtgagcgagcttaaaagtgtacagccctctaatcacggcatatacctgccgtcggatacacaagaacatgccggcagtggtcgcgctagctcaatgcccaggctgacagtcgatccccaagtggtcaccgatccttcttcaatgcgaaggagcttctcaaccatcagagacaagaggtctaatagcagctggttagaggagttctcaatggagcgttcttccgagaatacttataaatctagacgccgctcctatcatagttcactccgcctgtctgctcaccggctgaacagcgactcaggtcacaagtccgatacacatcgttccggcggacgggagaggggcaggtccaaggagcggaagcatctgctctccccggacgtgtctcgctgtaatagtgaggagagaggcacgcaagctgactgggaatcacccgaacgccgccagtctcggtctccttccgaaggacggagtcagaccccgaataggcagggtacggggagcttatcagagtcttccatccccagtgtttcagatacctctacccccagacgcagtcgacggcagctgccccccgtcccccctaagcctcgccccctcctctcatattcctctctaattcgacatgctggcagcatttcaccgccggccgacgggagcgaggaaggcagccccctgacgtcacaggcccttgaatctaacaatgcctgtctgaccgagagctcaaattctcctcacccccaacagtcccagcacgcctcaccacagcgctatatctctgagccctacctggccctccatgaggatagccacgcgagcgattgcggtgaggaagaaacgctgaccttcgaggccgccgtggctacatcccttggaagatctaacacaatcggctcggctcctcctctgagacacagttggcagatgcctaacggccactatcggcgccgacggcgaggtggaccgggaccagggatgatgtgtggagccgttaataacctcctgtctgacacagaggaagatgacaagtgttag

SEQ ID NO: 181265 - DNA, 1317 bp, Artificial Sequence
  Description of Artificial Sequence: Synthetic coding sequence
atggcccggttcggcgaggccgtggtggcccggcccggcagcggcgatggcgactctgaccaatcccgaaatagacagggaactccagtgcccgcttctggacaagctgcagcctacaagcaaactaaagcacaaagagctcgtacgatggccctgtataatccaattcccgttcgtcaaaattgctttaccgttaaccgctcattattcatttttggggaagacaatatagtgcgcaagtacgctaagaaacttattgattggccgccctttgaatacatgatcctggccacaataatcgccaattgtattgtgctcgctttggaacagcacttacctgaggatgataaaactcctatgagtcgacggcttgagaaaactgagccttactttattggaattttctgtttcgaagccggaatcaagatagtcgcactgggatttatattccacaaaggcagttacctccggaatggctggaatgtaatggatttcattgtggtcctgagcggtatactggcaaccgccggcactcactttaatacacacgtggatctaagaaccctaagagcagttagagtgttacgccctctgaagttagtttcagggataccttccctgcagattgttctgaaatcaatcatgaaggccatggtccctttactgcaaatcggactgcttctctttttcgccatcctcatgttcgccatcattggactcgaattctacagcggtaagctgcacagagcttgcttcatgaataactccggcatcctggaaggctttgatccaccacacccttgtggcgtgcaaggatgtcctgcagggtacgagtgcaaggactggatcgggcccaacgacggcatcacgcagttcgataacatcctgtttgcggtactgaccgtctttcaatgtatcaccatggaggggtggaccaccgtgctgtataacacgaacgatgccctgggcgccacttggaactggctttatttcattcctctgatcatcattggttcttttttcgtgctcaatctggtcttaggggtcctgagcggcgagttcgctaaagagcgggaaagggtcgagaatagacgtgcctttatgaaacttagacgccagcagcaaattgagcgcgaactgaatggataccgggcctggatagacaaagcagaagaagtcatgttggccgaggaaaacaaaaacgctggaactagcgcattggaagttctgagacgggcaaccatcaaaagatcccggaccgaggccatgactcgcgactccagtgatgaacattgtgtcgacatctctagcgtatag

SEQ ID NO: 181266 - DNA, 6756 bp, Artificial Sequence
  Description of Artificial Sequence: Synthetic coding sequence
atggcccggttcggcgaggccgtggtggcccggcccggcagcggcgatggcgatagtgaccagtctagaaatcgacaggggacacctgttccggcctcaggtcaagccgccgcctataaacagaccaaagcccagcgggcccggaccatggccctctacaatcccataccggttagacaaaactgcttcaccgtgaatcgatccctgtttattttcggcgaagataacattgtgaggaagtatgccaaaaaattgattgactggcccccctttgagtacatgatccttgccacaataatcgcaaactgtattgtcctagcccttgagcagcacctaccagaagacgacaagacacccatgagccggaggctggagaaaaccgagccctacttcattggaatcttctgctttgaggcaggcatcaaaatcgtggcactgggcttcatattccacaaagggagctacctacggaatggatggaacgttatggacttcatcgtcgtcttgtccgggatccttgccacggctggcacccattttaacactcacgtggatctgaggactctgcgagccgtcagagtgcttagacctcttaaactggttagcggcataccatctttacagatcgtgcttaaatccatcatgaaggccatggttcctctgctgcagattggcctgctcctgttttttgcgattctaatgtttgccattatcggacttgagttctactcaggaaagctgcatcgcgcgtgttttatgaacaactccggaattctggagggcttcgacccaccacacccctgtggagtacaagggtgccctgccggatatgagtgcaaagattggatcggtccaaatgacggaatcacgcagtttgataatatcctctttgcagtacttactgtcttccaatgtattaccatggagggctggaccactgttttgtataacaccaatgacgccctgggcgcaacctggaactggctgtactttatccccctcatcatcatcggttctttctttgtactgaacctggtcttaggggtactctctggcgagttcgccaaggagcgggagagagtggagaaccggcgtgctttcatgaagctccgaaggcaacagcagatcgagcgggagctgaatggatatcgcgcctggatcgacaaggccgaagaggttatgctggcagaagagaacaagaatgcaggcacttcagcgctggaagtactgcgccgggcaactattaaaaggtcgagaactgaagccatgactcgtgatagttccgacgaacactgtgtggacatctccagcgtcggcactcccctggcaagagctagcatcaagtcagccaaggtggacggcgttagttacttccgccataaggaacgcctcttgaggatttccatccgccacatggtgaagtcccaagtgttctactggatcgtattatcactggtggcacttaatacagcttgcgtggccatcgtgcaccacaaccagccccagtggctgacccatttgttgtactatgccgagttcctttttctgggcctgtttctgctagaaatgagcctgaagatgtatggaatgggaccacggctgtattttcacagctcctttaactgcttcgatttcggagtgactgtgggttcaattttcgaggtggtgtgggcgatctttaggcctgggacctctttcggaatatccgtactccgggcattgcgattactcagaatctttaagatcaccaaatattgggccagcctgcggaatctcgtggtgtcgctaatgtcttcaatgaaatcaatcataagccttctttttcttttgtttctctttatagtggtcttcgctctgctgggaatgcagctttttgggggtcggttcaattttaacgatgggacaccttcagcaaacttcgacacatttcctgcagcgattatgaccgtgttccaaatactgaccggcgaggattggaacgaggtcatgtacaacggaatcaggagtcaaggaggagtttccagcggcatgtggtcagcaatttacttcatcgtgctcacattattcgggaattacacattattaaatgtgtttctggcaatcgcagtcgataatttggctaacgcgcaggagctcactaaggatgagcaagaagaagaggaggcctttaatcagaaacatgcactgcagaaagccaaggaagtgagccctatgtcagctcccaatatgccttctatcgaaagagaacgcagacgaagacaccatatgtcagtgtgggagcagcgcaccagtcagttaagaaaacacatgcaaatgagttcacaggaagcactgaacagggaggaggcacctactatgaatcccttgaacccacttaatccgctgagctccctgaatcccttaaatgcccacccaagcctgtacagacggccgagagcgattgaaggactggctcttggcttggcacttgagaagttcgaagaagaacgcatctctagaggggggtctcttaaaggagacggaggcgaccggagtagcgcactcgacaaccagcggacgccactatccctggggcagcgagagccaccctggctagctcggccatgccacggtaactgtgaccctacccagcaggaggctgggggcggggaggctgttgttacatttgaagatcgcgcgagacatcgtcagtcacagcgccgaagtaggcataggcgggtgcgcaccgagggcaaagaatcttccagcgcatcaagatcaagaagcgcttcacaggagagatcacttgacgaagcgatgcctactgaaggcgagaaggatcacgagctacggggaaatcacggtgcaaaggagcctacaatacaggaagagagagcccaggacttgaggcggaccaacagtcttatggtatctaggggctctgggttggcaggggggctagatgaagcagacacacccttagttttgcctcaccctgaactggaggtgggaaaacacgttgtattgaccgaacaagaaccagaagggtccagtgaacaggctctcctagggaatgtgcaactcgatatgggccgcgttatctctcagtcggaacctgacttgtcttgcattacagctaacacggataaggctaccacagagtccactagtgtgacagtggctattcctgatgtcgatccgctagtggacagcacagttgttcacatttcaaataaaacggacggcgaggcctccccactgaaggaggccgagatccgggaagacgaggaagaggtggagaaaaaaaaacagaagaaggaaaagagggagacaggcaaagcgatggtgccccactcttccatgtttattttttcaacaacgaatccgataagaagggcttgtcattacattgtgaacctgaggtacttcgagatgtgcattcttctcgttattgcagccagtagcatcgcccttgcagctgaggatcccgtgcttacaaatagtgaacgaaataaagtgctcagatacttcgactatgtgttcacaggggtgttcacatttgagatggtgattaaaatgatcgaccagggactcatattgcaagacggaagctatttcagggatctatggaacattttggactttgtggttgtagttggggcactcgttgctttcgccctggcaaatgctctgggaaccaataagggaagagatatcaagactatcaaatctcttcgcgtcctaagagttctaaggccattgaaaactattaagagattgccaaaactcaaggccgtgttcgattgtgtagtaacctctttgaaaaacgtgttcaatattcttatagtgtataagctctttatgtttattttcgcagtaatcgccgtccaactcttcaaaggaaagttcttttattgcacggacagcagcaaggacacagaaaaagaatgcatcggcaattatgtggatcatgagaaaaacaaaatggaggttaaaggtagggagtggaagcggcatgagttccattatgataacattatctgggcgctgctcaccctgttcaccgtcagtaccggtgaaggctggccccaggtactgcagcatagcgttgatgtcaccgaggaagatcgcggacctagccgcagcaaccgaatggagatgtccatattttatgtggtgtatttcgttgtgttccctttcttcttcgtgaatatattcgtcgctctaattataatcacgttccaggagcaaggcgacaaaatgatggaagagtgttcattggagaaaaatgagcgagcttgcattgatttcgcaatttccgccaagcccctcacacgttatatgccccaaaaccggcacacctttcagtacagggtgtggcacttcgtagtgtcaccttccttcgagtataccattatggcgatgatcgcattaaacacagttgtgctgatgatgaagtattattcagctccttgtacgtacgagctggcactcaagtaccttaatatagctttcacgatggttttttcccttgagtgcgtgctgaaagtgattgcgttcgggttcctgaactatttccgggatacatggaacatttttgacttcattaccgtgatagggtccattacagaaattattctgacagactctaaactggtcaatacgtcaggattcaatatgagcttcctcaagctttttagggctgcccgcctgattaaactgcttaggcagggctacaccatccgcatcctgttgtggaccttcgtacagagttttaaggccctgccttatgtatgcttgctgattgcaatgctcttctttatctacgccatcattggcatgcaggttttcggcaacattaaattggatgaagaatcacatatcaaccggcacaacaatttccggtcattttttggctctctgatgctcctctttagatccgcaaccggcgaagcctggcaggagatcatgctgtcatgtctcggcgagaaagggtgcgagcccgacacgacggcaccaagcggacaaaatgagaacgagaggtgtggtaccgatctcgcatatgtgtactttgtctcctttatattcttctgcagctttctcatgctgaatctgttcgtggcagtaataatggacaattttgaatacttgacccgggattccagcattctcgggccacatcacctggacgagttcgtaagagtttgggctgagtatgacagagctgcctgtggtcggatccattacaccgaaatgtacgaaatgcttactctcatgtctccgcctctaggcctcggaaagagatgtcctagcaaggtggcgtacaagaggctcgtgctgatgaacatgccagtggccgaagatatgacagtgcattttacctccactctcatggccctgattcgaaccgccctggacattaagatcgccaaggggggcgctgaccgtcaacaattggacagcgaattacaaaaggagactttggcaatctggccccatctatcccagaaaatgcttgatttgcttgtcccgatgcctaaggcatccgatctgaccgtcggtaagatctatgccgctatgatgatcatggactattacaagcagtccaaagtgaagaagcagcgacaacagctggaagaacagaagaatgcaccaatgttccagcgaatggagcccagctctctgccacaggagattatagcgaacgccaaagctctgccttacctccagcaggatccagtctccggcctctccggtaggtccggctacccctctatgagtcctctgagtccccaggacatcttccagctggcatgcatggaccctgcggacgacggtcagtttcaggaacgacagtccctcgtggtgaccgaccctagctcgatgaggagatccttttctaccatccgggacaagcggtcgaactcctcctggctcgaagagtttagcatggaacgtagctcagaaaatacctacaagtctagacgacgatcgtaccacagcagcctcaggctgtctgcccataggctcaattctgattctgggcataagtcagatacacaccgatccggggggagggaacgaggaagatctaaggaacggaagcacctgctctcaccagacgtatcccgctgcaactcagaagagcgcgggacccaggctgattgggagtctccagaaagacgccagtccagatccccctctgaaggacgctcacaaaccccaaataggcaaggtacgggatcccttagtgagagcagtatccctagcgtgagcgacacttcaacacctagacgatcacgccggcagctccctcccgtgccccccaagccgagacccctcctttcttactcatctctcatacggcacgcaggttcaatttctcctcccgctgacgggagtgaggagggttctccgctgacctcccaagctctggagagtaataacgcctgcctgaccgagtcctctaattctccccacccccagcagtcccaacacgcaagccctcagcggtatatcagcgagccataccttgcgctgcatgaggatagccacgctagtgactgcggtgaagaagaaaccttaaccttcgaggcagccgtggccacatccctgggaagaagcaatacaatcggatcagcccccccattgagacactcttggcagatgcctaacgggcattatcgtcgaaggagacgtggcgggccgggcccagggatgatgtgtggggccgtgaataacttactttccgataccgaggaggacgacaagtgctag

SEQ ID NO: 181267 - DNA, 7062 bp, Artificial Sequence
  Description of Artificial Sequence: Synthetic coding sequence
atgaccgagggcgcccgggccgccgacgaggtgcgggtgcccctgggagccccccccccaggtccagccgccctggtgggggcttctccagaatccccgggcgcacccgggcgtgaggcggagcgtggcagtgagctgggggtgtctcctagcgagagtcccgcagccgaacgcggtgcagaactgggcgcagacgaggaacagagagttccgtatcccgctttagctgcaacggtctttttttgcctgggccagaccacaagaccaaggagctggtgcttacggcttgtgtgtaacccctggttcgagcacgtaagtatgctcgtcatcatgttgaactgtgtaactctgggaatgtttaggccttgtgaggacgtggagtgcggctcggaacgatgcaacatcttggaggcattcgatgcctttatcttcgccttttttgcagttgagatggtcataaaaatggttgctctgggcctgtttggacaaaaatgctacctgggcgacacctggaacagactagactttttcattgttgtggctggcatgatggagtactctctcgatgggcacaacgtcagtctcagcgcgattaggactgtgcgagtcctgcggcccctgcgggccattaatcgagtcccttctatgcggatcctggtgaccttgttactggacaccctgcctatgcttggtaacgttcttctgctatgtttttttgtgtttttcatctttggcattgtaggggtgcagctctgggcaggcctgctgcggaatcggtgcttcttggattctgccttcgtccgcaataataaccttacatttcttcggccctactatcagactgaagagggagaagaaaacccctttatctgctcttctcggagggacaacggaatgcaaaagtgtagccacattcctggaagaagggagctacggatgccgtgcacattaggatgggaagcctacacccagccacaggcagaaggggtgggggccgcacgcaacgcgtgcattaactggaaccagtattacaacgtgtgtagaagtggcgactccaacccccacaacggagctataaacttcgacaatataggatacgcgtggatcgcgatctttcaggtgatcacactcgagggttgggtcgatatcatgtactatgtcatggatgcccattctttttacaattttatctacttcatcctgctaattatagttggatctttcttcatgatcaacctctgtctcgtagtcattgcgacacaattcagcgaaacaaaacagcgggagtcgcaactgatgcgggagcaacgggcgcgccacctgtcaaatgactctacgctggcaagcttcagtgaacccggctcctgctacgaagaacttctgaagtacgtgggtcatatatttaggaaggtgaaaagacggtcattaagattgtacgcccggtggcagtccagatggcggaagaaggtggatccttccgccgtccaggggcaaggacctggacacagacaacgccgggctggtagacacacggccagcgttcaccaccttgtataccaccatcaccatcatcaccatcatcattaccacttttcacacggctcacctaggagacctgggcccgagccaggtgcctgtgatacccgactcgtgagagccggagccccaccaagcccccccagtcctggacgcgggccaccagatgccgagagcgtgcactctatttaccatgctgattgtcatattgaggggccacaagagcgcgcccgagtggctcatgcagctgccacggctgctgcgtccctcagattggccactggcttagggacaatgaactaccctacgatcttgccaagtggggtggggtcgggaaaaggtagcacatccccaggtccaaaggggaagtgggctgggggtcctcctggcacaggcggccacggaccgttgagcctgaattcgccagacccatatgaaaagatcccgcatgtagttggcgaacacgggcttgggcaggcgcctgggcacctatcaggactttcagtcccatgcccactgcccagtccacctgccgggactctcacatgcgaattgaagagttgtccatattgcacacgagccctcgaggaccccgagggcgagctgagcggaagtgagagcggggactcagacggccggggcgtttacgagtttacgcaggatgttagacatggagaccggtgggatcccacacgccctccccgcgccactgataccccaggacctggtcctggttcccctcaacgtcgtgcccaacagcgcgccgcaccaggagaacccggctggatggggagattatgggtgacgttttccggcaagttgagacggattgtggattccaaatattttagccgagggatcatgatggccatacttgttaataccctatccatgggcgtcgaataccacgaacagcctgaggaactgactaatgctcttgaaatctccaacattgtctttacttcgatgtttgctctggaaatgttgctcaagctcctggcctgcggcccattaggctatataaggaatccgtacaatatttttgatgggattattgtcgttattagtgtgtgggagattgtgggccaggctgacgggggcctctccgtccttcgcaccttcaggctccttagagtgctcaaactggtgaggttcctgcccgcccttaggaggcaactcgtggttctggtcaagaccatggataacgtcgcgaccttttgcaccctactcatgttattcatcttcatcttttcaatccttggcatgcatctgtttggctgtaaattttctctgaagaccgacacaggagataccgtgccagatagaaaaaattttgattccctgctttgggccatcgtcaccgtttttcagatcctgactcaggaggactggaacgtcgttctgtacaatggaatggcctctacatccagttgggctgctctgtatttcgttgccctgatgaccttcggcaattatgtgctctttaacctgttggtcgccatcctggtggagggttttcaagcagaaggagatgcaaatcggtcagataccgacgaggacaagacttctgtccacttcgaagaggattttcataagctgagggaactgcagaccacagaactcaaaatgtgttctctcgctgttactcctaacggtcacctggaaggaaggggaagccttagccccccgttgatcatgtgtaccgcagctactcccatgcccacgcccaagagctcgccattcctggacgctgcaccgagccttcccgactccagaagaggtagctcctcctcgggtgacccacccctgggtgaccagaagcccccagcaagcctccgatcctccccgtgtgcaccgtggggtcccagcggggcatggagcagcagacggtcctcctggtcctccctgggaagagcgccatctctgaagagaagaggccagtgtggggagagggaatcactcctgtcaggggagggcaagggctcaactgacgacgaagccgaggatggtcgcgcagcccctggaccccgggccactcctctgagacgagccgagtctctagatccgcgaccccttagaccagccgccctgccacctacgaagtgcagagatcgggacggccaggtggtcgcgctgccctccgatttttttctcaggattgattctcaccgtgaggacgctgctgaactggacgacgatagcgaagactcctgctgtctccggctacacaaggtactggaaccatataaaccgcagtggtgccgttctcgcgaggcgtgggccctgtatctcttctccccccaaaatagatttagagtttcttgccagaaggtgattacccataagatgtttgatcacgtggtcctggtgtttatcttccttaactgcgtcaccattgcacttgagcgacccgatatcgacccgggaagtactgaaagagtttttctctctgtcagcaattatatattcactgccattttcgttgcagaaatgatggtgaaagtggtagccctgggacttttatcaggagagcatgcctatctccagtcctcatggaacctgctggacggcctgctggtcctggtgtctttggtggatattgtcgtcgcaatggcttccgcaggaggagccaaaatacttggcgtgctgagagttttgcgattattgcgtactctcaggcctctgcgagtaatctctagggcgcctggcctgaagctggtggtggagacacttattagctctttgaggcccatcggcaacattgtgctcatatgctgtgccttctttatcatttttgggattctgggtgtgcagttgttcaaaggtaagttttactactgcgaggggccagatacacggaacatctcaacgaaggcccagtgcagagcggcccattaccggtgggtccggaggaagtataacttcgataatttaggacaagcccttatgtccttgtttgtgttgtcctcgaaagacggttgggtgaatatcatgtatgatggcctggacgcagtgggcgtggaccagcagcccgttcagaaccacaacccgtggatgcttctctactttatcagcttcctgctgattgtgtccttcttcgtccttaatatgttcgtgggggtggttgtggaaaatttccacaaatgtaggcagcatcaggaggccgaggaagcacgccgacgagaggagaaacgactgcggcgactcgagagacgaagaagatctacattcccctcgccagaggcacagcgccgcccctattacgcagattattctccaacaaggaggtcaatccattccctgtgcacctcgcactacctggacctgtttataacttttatcatctgcgtgaacgttattactatgtctatggagcactacaaccagcctaagagcttagatgaagccctaaaatattgcaactacgtctttacgatagtttttgtgttcgaggccgcacttaaactggtggccttcgggttcagacggttttttaaggaccgctggaatcagctagacctggcgatagtgttgttgagccttatgggcatcacattagaggagatcgagatgtccgccgccttaccgattaatcccactattatccgaattatgcgagtgctgcggatcgctcgtgtcctgaagctactcaagatggccacaggcatgcgcgcattgctggacaccgttgtgcaggcacttccgcaggtgggcaacctcggcctgttgtttatgctcctgttttttatatatgccgccctgggggtggagttgttcggaaggctagaatgctcggaagacaacccctgtgagggtcttagccgccacgccacgtttagtaacttcggaatggcctttttaactctgttccgcgtgtctacgggggataactggaacggaatcatgaaagacactttacgagaatgtagcagggaagacaagcactgtctctcctacctgccagcactttcccccgtctatttcgtgaccttcgtgctggtggctcagtttgttctggttaacgtggtggtagcggttctcatgaaacatctagaagagtcaaacaaagaagcccgggaagatgctgaactagacgccgagattgaactggaaatggcacaggggcccggctccgcacggcgtgtggacgcagataggccaccactgcctcaggagtctccaggtgccagggatgcccccaacttagtggccagaaaggtgagtgtgtcacgaatgctgtctcttcctaacgacagctatatgtttcggcccgttgtgcccgcatctgcaccgcatccacgccctctccaggaagtggagatggaaacatacggtgcaggcacacctctcggctccgttgcctcagtgcattcccctcccgctgagtcttgtgcctccctgcaaattcccttggccgtttcatcacccgcaagatctggggaacctctccacgctctctccccgagagggactgctcgaagcccctccctctctcgcctgctgtgcagacaggaagccgtccacaccgactctctcgaaggaaagatcgattcacctcgcgataccctggatcctgccgagccaggggagaaaacccctgtgcgccccgtgacacaaggtggatctctccagagccccccaagaagcccacgtcctgcctctgtccggacaaggaagcacacatttggacagaggtgcgtgagttcccggccagcagccccggggggcgaggaagccgaggcgtccgacccggccgacgaggaggtaagtcacatcaccagctctgcctgtccctggcagcccacagccgaaccacatgggcctgaggcttcacctgttgctgggggagaaagagacttacggaggctttacagcgtggacgcacaaggtttccttgacaagcctgggagggcagacgaacagtggagaccatccgcagagctgggatcgggcgagcccggcgaagcgaaggcttgggggcctgaagccgaacccgcccttggagcacgacggaagaaaaagatgtcccctccctgcatttccgtagagccccccgccgaggatgagggctccgctaggccttccgccgctgagggaggatcaaccactctaagacgccggaccccatcatgcgaggctactccacatcgcgatagtctagagcccacagagggttctggggcaggcggcgatcctgctgcaaaaggagagcggtggggccaagcttcttgtcgagccgaacacttgacggtcccctcttttgcgtttgaacctttggacctgggcgtcccatctggggaccctttcctagatggcagtcacagtgtcaccccagaatccagggccagctcttctggcgccatcgtcccattagagccccccgaaagcgagcctccaatgcccgttggagatccccccgagaaaagacggggcttgtacctgactgtaccacaatgtccactggagaaacccggctctccttcagctaccccagctcccggaggaggggccgacgaccctgtctag

SEQ ID NO: 181268 - DNA, 7044 bp, Artificial Sequence
  Description of Artificial Sequence: Synthetic coding sequence
atgaccgagggcgcccgggccgccgacgaggtgcgggtgcccctgggtgcaccaccgcccggccctgctgcactcgtgggcgcctctcccgaatcgcctggggcacctggacgcgaggccgaacggggcagcgaactaggagtgtctccttctgagagccccgcagcagaaagaggcgcggagctcggagccgacgaagagcagagggtcccatatccggcactggcggccacagtctttttctgcctcggacagacgacacgtccacgctcatggtgcctgaggttggtatgcaatccttggtttgagcatgtgtctatgctcgtgataatgcttaactgtgtcacccttggcatgtttcggccatgcgaggacgtcgagtgtgggtccgaaagatgcaatatcctggaggcctttgacgcttttatatttgcgttttttgccgtggaaatggtcattaaaatggtggcattaggcctgttcggtcaaaagtgttacctcggagatacttggaataggctggacttctttatcgttgtggccggtatgatggaatactccctggacggtcacaatgtaagtctgagcgctatcagaacagtgcgggtcctgcgccccctgcgagctatcaatcgggtgccaagtatgcgaattttggtgacacttctgctggacactctgcccatgctcggaaatgtcctgttactttgtttttttgtgttcttcatctttggtatagtaggggtgcagctgtgggctgggttactgcggaatagatgcttcttggacagcgcctttgtgcgcaataacaatctgacttttttgcgcccatactatcaaactgaggagggagaggaaaatccttttatctgcagtagccggagggacaatgggatgcagaagtgctcccatatcccaggcagaagagaattacgtatgccctgcaccctgggctgggaagcctacactcagccacaggcagagggcgtgggagccgccagaaatgcttgtatcaattggaaccagtactataacgtctgtaggagtggggattcgaatccccataacggcgcaatcaattttgataacatcggctacgcctggatagccattttccaggttataactctggagggatgggtggacattatgtactacgtgatggacgcacacagtttctacaactttatttactttatcttgctgatcattgtaggaagtttttttatgattaatttgtgcctggtggtgatcgcaactcagtttagtgagacaaagcagcgggagtctcagctcatgcgtgagcaaagagcacgacatctttcaaatgactccacacttgcctctttctcagagcccggctcttgttacgaagagcttcttaaatacgtcggccatatcttcagaaaggtcaaacgacgtagcctccgattatacgctcgctggcagagtagatggcggaagaaggtggacccatccgcagtccagggccagggacccgggcataggcaaaggagagccggccgccataccgccagtgtacaccatctggtttaccatcatcatcaccatcaccaccaccattatcatttttctcatggcagcccccgacggccaggacctgagccaggcgcttgcgataccaggctggtgagagcgggagccccccccagcccaccaagcccgggccgggggcctccagacgctgagtctgtccactcaatctatcatgcggattgccatatagaaggccctcaggaaagagctcgcgtggcgcatgccgcggctaccgctgccgcctcacttaggctggcgactggactgggaacaatgaactatccaacaattctacctagcggggtggggtctgggaaggggtctacatctcctgggccgaaaggtaaatgggctggcggcccacccgggaccggtggacatggtcctctgagccttaactccccagatccctacgagaagatcccccacgtagtcggagaacacgggttggggcaggcacccgggcacctgtcaggcctgagtgtgccatgcccccttccgagtccaccagccgggacacttacgtgcgaattaaaaagttgcccgtactgcacacgggccctggaagatccggagggcgagctgagcgggtccgagtcgggagactctgatggccgcggcgtgtatgagtttacacaggatgtgagacatggggaccggtgggatcccacacgccccccacgggcaaccgatacgccaggaccaggccccggcagcccacagagaagggcacaacaacgtgctgcccctggcgagcccgggtggatgggcagactttgggtgaccttttccggaaagttgcgtcggatcgtagactccaaatatttttcacgcggaattatgatggccatcctagtcaatactctctcaatgggagtagagtatcatgaacagccggaagaattaacaaacgcgctcgaaatctccaacatcgtgtttacttcaatgttcgctctcgagatgctgctgaaactcctggcctgcgggccgctgggctacatcagaaacccatacaacatttttgatggcataatcgttgtgatatccgtgtgggaaatcgtcgggcaagccgacggtggtttgtcagtgctacggactttccgccttctccgggtgctgaaactggtccgattccttcccgcccttcggaggcagctggtggtgctggtaaaaactatggataacgtagctactttctgcacactcctgatgttgttcatcttcatcttcagcatcctgggcatgcatctttttggctgcaaattttcattaaagacagacacaggggataccgtacctgaccgaaaaaatttcgactcattgctctgggcaatcgtgaccgtctttcaaattctgactcaggaagattggaatgtggtgttgtacaacggaatggcaagcactagtagttgggccgctctgtattttgtcgcccttatgaccttcggcaattacgtgctgttcaacctactggtggcaatcctagtagagggtttccaggcagagggcgacgccaatcgttccgataccgacgaggacaaaacatccgttcacttcgaagaagatttccataagctgcgtgaactccagaccacagaactcaaaatgtgcagcctggcagtgacgcccaatggccatctggagggacgggggtctctgtcaccccctttaataatgtgtacagctgccacgcctatgccgaccccaaagtcctcgccattcctggatgccgcaccctcgctcccagattctcgacgtgggtcatcctcctctggggacccccctctgggagatcagaagcctcccgcgtctctacggtcctcaccatgcgcaccctgggggcccagcggggcgtggtcttcgcgccgcagttcttggtccagcctgggaagggcacctagccttaaacgcagaggccagtgtggcgagcgcgaaagcctcctgagtggagaaggtaagggatcaacagatgacgaggctgaagacggcagagctgcccccggtcctagagcgactccactgaggagagctgaatctctcgatccccggcccctgaggcctgccgctctgccacccacaaaatgtcgtgatcgtgacggacaggtcgtggctctgccatctgactttttcctaaggattgacagtcaccgggaggatgctgcggagctcgacgacgactccgaagactcctgttgcctcaggctgcataaggtactcgagccatacaagcctcagtggtgcagatcccgcgaggcctgggccctgtatctcttttcacctcagaatagatttagagtatcatgtcaaaaggtgatcactcacaaaatgtttgaccacgtagtattagtctttatttttctgaattgcgtcacaatcgctttggagaggccggacattgatcccggtagcaccgagcgtgtttttctaagtgtctccaactatatctttactgccatattcgtggcagaaatgatggtgaaagtcgtggctttggggttgctttctggtgagcatgcttacctccaaagctcctggaacctgttggatggtcttctggttttggtgagcctggtcgacatcgtagtcgcaatggctagcgctggtggtgctaaaattctgggtgttctcagagtgctgagattgttgcggactctgcggcctctacgtgtgatatctcgcgcgcctggcttaaagctggtggtggagactctcatcagttccctgcggcccatcggcaatatagtcctgatatgctgcgccttcttcatcatcttcggcatcctgggtgtacagctgttcaaggggaagttctattactgtgagggtccggatacccggaacataagtaccaaggctcagtgccgcgccgcccactatcgttgggtgcggagaaaatacaatttcgataatctggggcaggccctgatgtccctgtttgtgctttcatccaaagacggctgggtgaacattatgtacgatggactggatgccgttggcgtagaccaacaacccgttcagaatcacaatccctggatgctgttatactttatttcgtttctcctaattgtgtccttttttgtgctgaacatgttcgtgggagtagtggttgagaactttcataaatgtcgacaacaccaggaggccgaagaggctaggcggcgggaggagaagagacttaggcgtcttgaaagaagacgacgcaaggcccaaaggagaccatactatgctgactattctcctacaaggagaagcatccactcactatgtactagtcactacttggacctgttcatcacctttattatttgtgtaaacgtcattactatgagtatggaacactacaatcagccaaagtctctcgacgaagctctcaagtactgcaactacgtgtttactatcgtcttcgtctttgaggcggccctcaaactggttgccttcggttttcgaagatttttcaaggataggtggaaccaacttgacttggcgatcgtgctactaagtctaatgggaattaccctggaggaaatcgagatgtccgcagcacttcctattaaccctaccattattcggatcatgcgggtcttgcgcatcgcaagggtgttgaagctgctgaagatggccactgggatgcgcgcactgctggataccgtggtgcaggccctgccacaggtaggtaatcttggactgttattcatgctgttatttttcatctatgccgccctcggcgtggagctcttcggcagactggaatgcagcgaagacaatccttgcgagggccttagtaggcatgccactttttctaatttcggcatggcatttctgactctcttccgggtgagcactggcgacaactggaacggcattatgaaggataccttgcgggagtgctctcgcgaggataagcactgcctcagttacctcccagcccttagcccagtgtacttcgtgacctttgtgctggtggctcaatttgtcctggtgaacgtggtcgtcgctgtgctgatgaagcacttagaggagtcgaacaaggaagcacgtgaagacgcggaactggacgctgaaatcgaattggaaatggcccagggtccaggaagtgccagaagggtagacgctgatcggcccccactcccccaagaaagccctggcgcccgggacgcccccaacctggtggccagaaaggtcagtgtgagccgaatgctgtccctcccaaatgacagttatatgtttcgccccgtggtacccgcctccgccccgcaccctagaccccttcaggaagtggagatggagacgtatggcgcaggcacccctctgggctctgtagccagcgtgcattcacccccggcagagtcgtgcgcctcactgcagatcccactcgccgttagcagcccagctcggagcggggagccgctccacgcgctgtccccacgtggaactgccaggtctcccagtctcagtagactgctttgtcggcaggaggccgtgcacacagattctctcgaggggaaaattgactcaccaagagacactttggaccccgccgagccaggggaaaagacgccagttcgacctgtgacccaggggggcagtctgcagagcccaccacgatctcctaggcctgcttccgtccgcacccgcaagcatacattcggacagcgctgcgtgtcatcacgcccagccgctcctggaggtgaggaggctgaagcaagtgatccggcggacgaggaggttagccacattacaagcagtgcatgcccctggcagcccacggccgagccgcatggcccggaggctagtcctgtggcaggaggcgagcgcgacctgcggagactgtattctgttgacgcccagggattccttgacaagcctggcagagctgacgagcagtggaggccaagtgcagaactagggtccggagagccaggtgaagctaaagcatggggcccagaagccgagcccgccctcggggcacgcaggaagaagaagatgagtcctccgtgcatttcagttgagcccccagccgaggacgagggcagtgcacgtccttccgccgcagaaggcggaagcactaccctgagacgaagaactccctcctgtgaggctaccccacatcgagactccctagaacccaccgagggcagcggggcaggaggagacccggccgctaagggggaacggtggggacaggcctcttgtcgtgccgagcatctgactgttccaagctttgcatttgagccactcgatttgggcgtgcccagtggagatcctttcctggatgggtcacattctgttacacccgagagtcgcgcttcttcatcaggcgcaattgttccgctagagcctcccgaatcagaaccacctatgccggttggggatccaccggagaaacggcgaggactttacctcaccgtcccacagtgtcccctggagaagccaggaagtccttctgccacaccagctcctggaggaggtgcagacgacccagtgtag

SEQ ID NO: 181269 - DNA, 6690 bp, Artificial Sequence
  Description of Artificial Sequence: Synthetic coding sequence
atggccgagagcgccagcccccccagcagcagcgccgccgcccccgccgccgaacccggcgtgacaaccgaacagcctggtccccgttctcctccttcatcgccacctggcttggaggagccactcgatggtgcagatccacatgtgcctcatccggatcttgcacccatcgcatttttttgtctaaggcagacaacctcccccaggaattggtgtatcaaaatggcaacaggcccctggtggtggtgcctttgcatgcttgtgattctgctgaattgtgtcactttaggcatgtaccaaccttgtgatgatatggattgcctgagcgatcgctgcaaaatcctccaggtgtttgacgattttatttttattttctttgctatggagatggtgttaaaaatggtggccttgggcatctttggcaaaaaatgctacctgggcgacacctggaacaggctcgactttttcattgtgatggctggcatggtagaatactcgctggacctgcaaaatatcaacctgagcgccatacggactgtcagggtgctgcgccctttaaaggctataaatcgcgtcccctccatgcgcatccttgttaatcttttgctcgataccctcccgatgttgggtaatgtgctcctactgtgtttcttcgtgttttttatcttcggtattatcggcgtccagctctgggccggactgctgaggaaccggtgttttctcgaggagaattttacaatccagggcgatgtagccctccccccctactaccagccagaagaggatgatgaaatgccattcatctgcagtctgagtggagacaatggtatcatggggtgccacgagataccccccctcaaggagcaaggccgagaatgctgtctctccaaagacgatgtctacgacttcggcgctgggaggcaggacctgaacgcttcagggctgtgcgtcaactggaatcgatactacaacgtgtgccgtaccggtagtgcaaatccccacaagggcgctatcaacttcgataacatcggctacgcttggatcgtgatttttcaggtcattacactcgagggatgggtcgagatcatgtactacgtgatggatgcgcattccttttataactttatatactttattttgttgatcatcgtgggctctttcttcatgatcaatctctgtcttgtggttatagccactcagttcagtgaaaccaaacaacgggagcacaggctgatgctggagcagagacagcgttatctctccagctctacagtggcctcatatgctgaacccggggactgctatgaagagatctttcaatacgtgtgccacatattacgcaaagctaaacgccgggcactgggactgtaccaagcactgcagtccaggaggcaggccctggggccagaagcgccagccccagccaagcctggcccacatgccaaagagccacggcactaccatggcaaaaccaaagggcagggagatgagggacgccatctcgggagtcgacactgtcagacactgcacggtccagcatcgcccgggaatgatcacagtggccgcggaaagcccggtcctagagaactgtgcccccagcactccccattggacgctacaccacacactcttgtgcagcccatacccgctaccctggcaagtgacccagcgagctgcccttgctgtcagcacgaggatggccgtcggccaagcgggctgggttctaccgactccggacaagaaggtagcgggtcgggcagttctgccggcggagaggatgaggcagatggcgacggtgctagatcatctgaggacggggctagctccgagctgggtaaagaggaagaggaggaggaacaggcagacggagccgtgtggctgtgtggcgacgtgtggcgcgagacaagagctaaattgcgcggtatcgtggactctaagtacttcaaccgtggcataatgatggcaattcttgttaacacagtgagtatgggaattgagcaccacgagcaggctaacgaactgactaacatcctggaaatttgcaatgtcgtattcacttccatgtttgccctcgaaatgattctgaaactggccgcgttcggcctgttcgactacctacggaatccctacaatatctttgatagtattattgtgatcattagtatttgggagatcgtcgggcaagcagacggtgggctgagcgtcctcagaacctttcggctgctgagagtgctcaaactggtcaggtttatgccggcgctgagaagacagctggttgtcttaatgaagactatggacaatgtggccaccttctgcatgctactcatgctttttatctttatattcagcatccttggcatgcacatatttgggtgtaaattcagtctacggaccgatacaggtgacaccgtcccagatcgaaagaactttgattcactgttgtgggctattgtaaccgtgttccaaattcttacccaggaggactggaacgttgtcctctataacgggatggctagtacaagcccttgggcctccttgtatttcgtggcactgatgaccttcggtaattatgtgttattcaatctgcttgtggccatcctggtcgagggttttcaggctgaaggagatgcaaataggtcttactcagacgaagaccagagctcctcgaacatagaagagttcgataagcttcaggagggactcgatagcagcggcgatccgaagctgtgccccatccctatgacccctaacgggcaccttgacccttctctacctctgggtggacacctggggccagctggcgctgcggggccagccccgaggctctcattgcagcccgacccaatgttggtggctctcggttcgcgaaagtcctccgtgatgtctttgggcagaatgtcgtacgatcaaagatcgttgagtagttcacggagttcttactatgggccttgggggagatccgccgcatgggctagtcgtcggtcatcttggaattccctcaagcacaaacctccctcagccgagcatgagtcactcctgtctgcggagagggggggaggagcgagagtgtgtgaggtcgctgccgatgagggtccccctagggctgctccactgcatacgccccacgctcatcacatccatcatggcccgcatcttgctcacagacatagacatcatagacgtactctctccctggataacagggactctgtggatctggccgagttggtccccgcagttggtgcccatccaagggcagcatggcgggccgccggccccgctcccggccatgaagactgcaacggcaggatgcccagcattgcaaaagacgtttttaccaagatgggggaccgaggcgaccgcggagaggatgaagaagagatcgactataccctttgctttagagtgagaaagatgattgatgtatacaaaccagactggtgcgaggttcgggaagattggagcgtgtacttattcagccctgagaacagatttagggtgctgtgccagaccattatagctcacaagctgttcgattacgtggtcctcgcttttatttttctgaattgcattacaatcgcactcgagcgtccacagatcgaggctgggagcactgaaagaatctttctgactgtgtccaactatatctttacagctatctttgtgggtgagatgacactgaaagtcgtctccttgggtctctatttcggagagcaggcatatcttcggagctcatggaatgtgctcgacggctttctcgtgttcgtctcaatcatcgatattgtggtgtcccttgcatcggcaggcggcgccaagatcctgggagtgctccgagtactccggcttttacggactcttcgcccgcttagggtaatttccagggcacccgggttgaagcttgtagtagagacgttaatctctagtctgaagcctataggaaacatcgtgttaatatgctgtgctttcttcattattttcgggatactcggagtgcagttgtttaagggcaagttttatcactgcctcggcgttgataccaggaatatcaccaacaggtcagattgcatggctgccaactatcgctgggtgcatcataaatataacttcgacaacctgggccaggccctgatgtcactgtttgtactcgcttctaaagatggatgggttaacatcatgtacaacggtctagatgccgtggccgtggatcagcagcctgtgacaaaccacaacccttggatgctcctttatttcatctcattcctgctgatcgtgagctttttcgtcctgaatatgttcgtgggcgttgtggttgaaaatttccataaatgtcggcagcaccaagaggccgaggaagcacgtcgccgcgaagagaagcgcctgagacgtctcgagaagaagagacgcaaggctcagcgcctcccctactatgccacttattgtcacactagacttcttattcactccatgtgcacctcccactacctggacatcttcataacgttcataatttgcttaaacgtggttaccatgtccctggagcactacaatcagcctacaagcttggaaaccgctctgaaatattgtaattatatgttcaccacagttttcgttctcgaagcggtgttgaaactcgtggccttcggactgagacggtttttcaaggaccggtggaaccagttggacttggcaatcgtgttgctgagtgttatgggcataaccctcgaggagatcgagataaatgctgcactcccaatcaacccgaccatcatccggatcatgcgcgtcttacggatcgccagagtcctcaagttactcaaaatggccacgggtatgcgtgcattactggacacggttgtgcaagctctgcctcaagtgggaaatctggggctcttatttatgctgctttttttcatctacgctgccctcggcgtggagttattcggcaagctggtctgcaatgatgagaacccctgtgaaggcatgtcccgtcacgctacattcgaaaactttggcatggcgttcctgactctgtttcaggtgagcaccggggacaattggaatgggatcatgaaggataccttgcgcgactgtactcatgatgagcgctcctgcctctctagcctgcagttcgtcagtccactctattttgtatccttcgtgttaacggctcagtttgttctaatcaatgtagtcgtggcggttttaatgaagcatctcgatgattccaataaagaagcacaggaagacgccgaaatggatgccgagcttgaactggagatggctcacggtctggggccagggccccgcctgcctaccggcagccctggcgctccaggtagggggcccggcggtgccgggggggggggagatactgagggagggctgtgcaggagatgttattcccccgcacaggaaaacctctggcttgactccgtgagtctgataattaaggatagcctggaaggggaactgaccatcattgacaatctgtccggctcaattttccatcactactcatctcctgctggatgcaaaaaatgccatcacgacaagcaagaagtgcagctggcagagactgaggcattttcactcaacagcgaccgatctagctccatactgctgggcgatgacctctccctcgaagacccgacagcctgtcctcccgggaggaaagatagcaagggagagctggaccccccagagcctatgcgagtgggcgacctcggggaatgttttttcccccttagcagtactgccgtaagccctgaccctgagaactttctttgtgagatggaggagattcccttcaaccctgtgagaagttggctcaaacatgacagttcccaggcgcccccttcaccattttcaccagacgcctccagccctcttctcccgatgcctgctgagttttttcacccagcagtttccgcctcgcagaaggggcctgaaaaaggcaccggcactggaacgcttcctaaaattgctttgcaggggagctgggcttccctccggagccctcgggtcaattgcactttgctgcggcaggctaccggctcagacacatccctggatgcttcacctagttcttctgctggctcattgcagactaccttagaagactctctcaccctgtccgattcccccaggagagccctcggcccacccgcaccagctcctgggccaagagccgggctgtccccagctgcaagacgccgactctcacttagaggccgtggccttttttccctcagggggttgagagcccatcagagatcccacagtagcggaggaagtacctcgcccgggtgcacccatcacgattctatggacccttctgatgaagaaggcagagggggggcggggggtggcggggcgggctccgagcacagtgaaacactttctagtctgtctcttacctcgttattttgcccacccccgccgccacccgctcccgggttaactcccgctcggaaattttcaagcacttcaagcctcgctgctccaggccggccccatgccgctgccctggcccacggcctcgcgcgctctccttcctgggcagcagataggtcaaaggacccgcctggcagggctccacttcccatgggcctcggccctctggcaccccctccccagccactgccaggtgaattggaaccaggagatgcggcatcaaaacgcaagagatag

SEQ ID NO: 181270 - DNA, 6567 bp, Artificial Sequence
  Description of Artificial Sequence: Synthetic coding sequence
atggccgagagcgccagcccccccagcagcagcgccgccgcccccgccgcggagcccggggtcaccacagagcagccaggtcccaggtccccaccctcctccccaccaggtctggaagagccacttgacggtgcagacccccatgtgccccaccctgatctggctcccatcgctttcttctgcttaaggcagaccacttctccccgaaactggtgcatcaaaatggcaacaggcccttggtggtggtgcttatgtatgcttgttattcttttaaattgcgttactctcggaatgtatcagccctgcgacgacatggattgcctcagtgatcgatgtaagattctccaagtcttcgacgactttattttcatcttttttgctatggaaatggtgctgaagatggtggccctgggcatatttgggaaaaaatgttacctgggcgacacctggaaccgcctggattttttcatcgtcatggccgggatggtagagtactcccttgacctccaaaatattaatctttctgccatacgcaccgtgcgcgtcctcagaccactcaaagctatcaaccgagtcccttcaatgaggatcttagttaacctcctgctggatacacttcccatgttggggaacgttctgctgttatgtttttttgtgttctttatcttcggcattatcggtgtgcagttgtgggctggcctattacgtaacaggtgtttcctggaggagaactttacaatccagggagatgtcgccctgccgccctattaccagcccgaagaggacgatgagatgccctttatctgctccctgtctggagacaatggcataatggggtgtcacgagattccacccttgaaagagcagggtcgggaatgctgcctaagcaaagacgatgtgtatgacttcggggcaggccggcaggatctgaacgcctcagggttatgtgttaattggaatcgatactataatgtctgcaggaccggctcggccaacccgcacaagggcgctatcaacttcgataatataggttacgcttggattgttatttttcaagtcattacccttgaaggatgggtggagatcatgtattatgtgatggatgcccacagcttctataactttatatacttcatcttgctgatcatcgtgggttctttcttcatgatcaatctgtgcttggtggtcatcgcaactcagttctctgagactaaacagagggaacatagattaatgttggagcagcgtcaacgatacctgtcttcttcgactgtggcctcctacgcggaacctggtgattgctatgaggagatctttcaatatgtgtgtcatatactccgtaaagctaagcggcgcgctctcggcctttaccaggctctacagtcccgacgtcaggctcttggaccggaagcaccggcccccgcaaagcccggaccccatgcaaaggagccaaggcactatcaattatgcccacagcattcaccgctggacgctacgccacacacattagttcagcccattccagcgactcttgcttccgatccggcctcttgcccctgctgccaacatgaggacggcagaagaccatccggactcggttcaactgactcagggcaggaggggtcaggctctgggagttcagcaggcggggaagacgaagccgatggtgatggcgcccggtccagtgaggacggtgcttccagtgaactcggtaaggaggaagaggaggaggaacaagcagatggagcagtgtggctgtgtggtgacgtgtggagagagacaagggcgaagttgcgaggcattgtcgatagtaagtactttaacaggggtattatgatggcaattcttgtgaatactgttagtatggggatcgaacaccatgagcaagccacggagctgacaaatattttagagatatgcaatgtcgtatttactagtatgttcgccttagagatgattctgaagctggccgcttttgggctctttgactacctccgcaatccttacaacattttcgacagcatcattgtaataatttccatctgggaaattgttggacaggctgacgggggtctgagcgtgctgaggacgttcagactcctcagagtcctaaaactggtgcgcttcatgcctgcattaagaagacagttggtggtcctcatgaaaactatggataatgttgccaccttttgtatgctcttgatgctcttcatttttatcttctctatccttggaatgcacatcttcggatgcaaatttagtttgaggaccgatactggggatacagtgcctgacagaaaaaattttgacagtcttctgtgggctatcgtaaccgtgtttcaaattctgacacaggaagactggaacgtcgtcttgtataacggtatggcttccacttcaccatgggcttcactctactttgtcgccttaatgacctttggcaattacgtactatttaatctcctcgtcgctatcctggtagaggggttccaggccgagggcgatgctaaccgaagctacagcgatgaagaccagtccagttcgaacattgaagaattcgacaagctgcaagaggggctagactcctctggtgatccaaagctgtgcccaatccccatgacaccaaatggccacctcgacccctcactaccccttggcggtcacctgggcccagccggagccgccggcccggccccacgactttccctgcagcctgaccctatgctcgtcgcactggggagccgcaaaagctctgtgatgagcttggggcggatgagctatgatcagaggtcactctcttcgagcaggagcagctattatggcccgtggggtcgtagtgcagcttgggcttcaaggaggtctagttggaattccctgaagcacaagccaccttccgcggagcacgagagcctcttatcagccgaacgaggtggcggagcacgcgtctgcgaagtcgccgcggacgagggaccccctcgggcagcccctttacacacgccccatgctcatcacattcatcacggaccccacttagctcaccgtcataggcaccatcggcgcaccctgagcctcgacaatagggatagtgtggacttggccgagctcgttccagcagttggcgcccaccccagagccgcctggagagctgcaggtcctgcaccgggtcacgaggactgtaacggccgcatgccctcaattgccaaggacgttttcaccaagatgggtgacaggggtgaccggggagaggatgaagaagagatcgattacactctctgcttcagagtccgtaagatgatcgacgtgtataaacccgattggtgcgaggtgcgtgaagactggtccgtgtacctcttttccccagaaaaccgctttagggtgctgtgtcagaccatcattgcgcataagctgtttgattacgtggtgctggccttcattttcctcaactgcatcacaatcgcccttgaaaggccccaaatagaggccgggagcacagagcgcatattcctgaccgtgtcaaattatatctttacagctatatttgtgggggaaatgacgctaaaagttgtctcattgggactctattttggagagcaggcctacttacggtcctcatggaatgtgttggacggatttcttgtgttcgtgtccatcatcgatatcgtcgttagccttgcgagcgccgggggcgcgaaaatactgggggtgctgcgggtactaaggttactgcgcacgttaagacccctgagggtgatctcgcgagccccaggcttaaagctggtggttgaaacactgataagttctctgaagcctatcggcaatattgtgcttatctgctgcgcgttctttattattttcgggatactgggtgtgcaactgttcaaaggaaagttttaccactgtctgggcgttgacacacgaaatataaccaaccggagcgactgcatggctgccaattacaggtgggttcaccacaaatacaacttcgacaatctggggcaggcactaatgagtctgttcgtcttagcttctaaagatgggtgggttaacattatgtacaatggcttggacgcagtcgctgtggaccagcaacccgtcacaaaccataacccttggatgttgctgtacttcatatccttcttacttatagttagtttcttcgttctgaatatgttcgttggcgtggtggtggagaactttcataaatgcaggcaacatcaggaagcagaagaagctaggcgtagggaagaaaaacgcttaaggcgacttgagaagaagagaagaaaggcacagagactgccatattacgccacgtactgccacactcggctactgattcattctatgtgcacgagccattacctggatatctttattacctttatcatctgtctgaatgtggtgaccatgtcactggagcattacaatcaaccgactagcttagaaaccgcccttaaatactgcaactacatgttcacaacagtttttgtgttggaagcagtcttgaagcttgtagcattcggtctgagaaggtttttcaaggatagatggaatcaactggatctcgccatcgttctgctttcggttatgggcatcacccttgaggagatcgagatcaacgccgccttgcctatcaatcccacaataatcaggattatgcgggttctgagaatcgctcgcgtacttaagctactgaagatggctacaggcatgagagctctgttggacacagtagtgcaggcacttccccaggtaggcaatctggggctgctttttatgttactgttctttatatatgctgccctgggagttgaactattcggcaaactggtctgcaatgatgagaatccttgcgaggggatgtctaggcatgctacttttgaaaattttggaatggccttcctgaccctctttcaagtgtctacaggggacaattggaacggcattatgaaagatactctccgagattgcacccacgatgagcgctcatgcctgtcttccctacagttcgttagccccctttacttcgtgtcgtttgtgctgaccgctcagtttgtgctaatcaatgtggtggtcgctgtcctcatgaaacatctggacgattcaaacaaggaggcccaagaggacgccgagatggacgcggaactggaactagagatggctcatggacttgggccaggcccccggctgcctaccggatctcccggtgctcccggccggggcccaggaggtgctggcggcgggggggacaccgaaggcggcttgtgtcggagatgttattctccagctcaggaaaacctgtggctggacagtgtttccctgataatcaaagacagcctcgagggggaactgactattatcgacaacctttctggtagcattttccatcactattcaagcccggccggctgcaaaaaatgccaccacgacaagcaggaggtacaactggccgaaactgaagccttctccctcaacagcgatcgctcctctagcatcctgcttggcgacgatctgtcgctggaggaccctactgcctgccctccaggcaggaaggattctaaaggggagctggatcccccggagcctatgcgggtgggagacctgggcgaatgcttctttcctctgagctccacagccgtttctccagatcccgagaattttctctgtgaaatggaggaaattccgtttaacccagtccgtagctggttgaagcacgacagtagtcaggcgcctcctagtcccttctctcctgacgcatcaagtcctttgctcccgatgcctgcagagtttttccaccccgcagtctcggcaagtcagaaaggcccggagaaaggcacagggacggggaccctgcccaaaatagcgctgcagggaagttgggcatccctcagatcccccagggtgaattgcacactccttaggcaggctacaggaagcgacacgtctctggatgcttctcccagttcttccgccggctcactgcaaactaccctggaggattccttaactttatccgacagtcccaggcgggccctcggcccccctgccccagctccaggacctcgagccggtctgtccccggctgcacgacgccggttaagtctcagggggagaggcctcttttccttgcgtggactgcgcgctcaccagcgctcccactcatcgggaggctccacgtccccgggctgtacgcaccacgactccatggatccatccgatgaagagggtaggggaggagctggaggaggtggcgctggatcggaacactccgaaactctctcttctctatcactgacgtccctgttttgccctccccccccaccccccgctcccggcctgactcctgcccgaaaattttcctctaccagcagtctcgctgccccaggccggcctcacgcagctgctcttgctcacgggttggcccgaagcccatcttgggctgctgaccggagcaaagatccaccagggcgtgcacctttaccgatgggcctcggtcccctcgcccctccaccccaacccttacctggcgagctggaaccaggagatgctgcttctaagcggaaacgatag

SEQ ID NO: 181271 - DNA, 6051 bp, Artificial Sequence
  Description of Artificial Sequence: Synthetic coding sequence
atggccgagagcgccagcccccccagcagcagcgccgccgcccccgccgccgagcctggggttacaacagaacagcccggcccgcgctccccaccaagctcccccccaggccttgaagagccactggatggggctgatcctcacgttccacaccccgacctcgcccctatcgctttcttctgcctgaggcagacaacttctccaagaaattggtgcatcaagatggtgtgtaacccttggtttgagtgcgtctcaatgctcgtgatcctgctcaactgcgttactctcgggatgtaccaaccttgtgacgacatggattgtctatccgacaggtgtaaaattcttcaagtgtttgacgactttatcttcatcttctttgccatggagatggttctcaaaatggttgcactgggaatctttgggaagaagtgttatctcggtgatacctggaacaggctggacttcttcattgtgatggccggcatggtggagtatagcctggacctgcagaatatcaatctgagtgctatacgaacggtaagggttctgcggcctcttaaggcaattaaccgtgttcctagtatgagaattctggtgaatctcttactggacactctgccaatgcttggaaacgtgctgctgttgtgctttttcgtgtttttcattttcggcatcataggggtccagttatgggccgggctcctccgtaacaggtgcttcttggaagagaacttcacaatccagggggacgtcgcactgccaccctactatcaacctgaggaggatgatgagatgcccttcatctgcagtctgtctggagataacgggattatgggctgccatgaaatcccacccttgaaggagcaaggacgggagtgctgtctgagcaaggatgatgtttacgactttggcgctggacggcaggacctgaatgcaagtggcctctgtgtgaactggaaccggtactataacgtatgtcgtaccggcagtgctaacccacataaaggagcaatcaactttgataacatcggttacgcctggatagtgatctttcaggtgatcaccctcgagggttgggtcgagataatgtactacgtcatggatgcgcacagtttctacaattttatctacttcatcctgctgatcatagtgggatccttctttatgatcaacttatgcctggttgtgatcgcgactcaattctccgaaactaagcagagggaacacagactcatgctcgaacaacgtcagaggtacctgtcatcaagtactgtggcttcctacgccgagccgggagactgctacgaggaaattttccagtatgtgtgccacatcctgagaaaggccaagagaagagcccttggattgtatcaggcattgcagagcagacggcaggccctcgggccggaggccccagccccagccaaacccgggccacacgccaaggagccgagacactatcacggcaagacaaagggccaaggcgatgagggaaggcacctcggaagcagacactgccaaaccttgcatggacccgcatctcccggtaatgatcattctgggcgtgaattatgcccacagcactctccattggacgctactcctcacactctcgttcagcctattcctgcgacactggcttccgatcccgcatcttgcccatgctgccagcatgaggatggtcggcggccctcagggctcggttcgactgactctggtcaggagggtagcggctccggatcgagtgccggtggtgaggatgaggccgatggggatggggcaaggtccagcgaagatggagcgagcagcgagctgggcaaggaggaagaggaggaagaacaggccgatggggcggtttggttatgtggggatgtgtggcgcgagaccagagccaaattgcggggcatagtggattctaaatactttaatcgagggatcatgatggcaatcctcgtgaacacagtgtcgatgggaatcgaacatcacgagcagccagaggaactaactaatatcttggagatttgtaatgtggtgttcactagcatgttcgcgctggaaatgatcttgaagctggctgccttcgggctgtttgactacttgaggaatccttataatattttcgactcaattattgtgattatctctatatgggagatcgtgggccaagcagatggtgggctgtccgtattgaggacttttcgcttactgagggtgctcaaacttgtgcggttcatgcctgcactgagacgccagttggtggtgctcatgaagacaatggataacgtggcgaccttttgtatgctgcttatgctttttatctttatattttcaatcctggggatgcacatcttcggatgcaagttctccctgaggacggacactggggatacagttcccgaccgcaaaaatttcgatagcctcctgtgggcaatagtgaccgttttccagattctcacccaagaggattggaacgtggtactttataatggtatggcctcaacttccccttgggcctcactctacttcgttgccctaatgacatttgggaactatgtgctgtttaacttgcttgtggccatactcgttgaaggttttcaggcggaaggcgacgcaaacagaagctatagtgacgaagatcaatcgagtagcaatatcgaggagttcgacaagctgcaggagggcctcgacagcagtggagacccgaagctgtgtccaatccctatgactccaaacggccacctcgacccgtccctgccattaggaggacatctggggccagcaggagcagcgggtccggcaccaaggctgtcactgcaacctgaccccatgcttgtggcacttggatcgaggaaaagctccgtcatgtctctgggcagaatgtcctacgaccagcgaagcctaagctcgtccaggagcagttattacggcccttggggacgttcagcagcctgggcttcccgtcggtccagttggaacagcctaaagcacaagcccccctctgctgaacacgagagcctcctgagtgccgaaaggggtgggggtgcacgggtttgcgaagtcgctgcggacgaggggcctccacgagctgccccactacacactccccacgcccaccacatacaccatggtccacacttggcccacagacatcggcaccatagacgcactctgagtcttgataatagggactccgtggacttggccgagttggtgccggccgttggcgcccacccaagggccgcttggcgcgccgccgggcccgcacccggacatgaggattgcaatgggaggatgccaagcatcgctaaagacgtgtttactaaaatgggagacagaggggacaggggcgaagacgaggaggagatcgattacaccctgtgtttcagggtccgaaaaatgatcgatgtgtacaaacccgactggtgcgaagttcgcgaggactggtccgtctacctcttttccccagagaatagattcagagtcttgtgccaaaccataatagctcataaactgttcgattacgtggtgctggcctttattttccttaattgcattaccatcgctctggaacgcccccagatagaagcgggctccacagaacgcatctttctgacggtgtcaaactacatttttacagccatcttcgtaggagaaatgaccttgaaggtagtgtcattggggctttatttcggagagcaggcatatctgcgctcgagttggaatgtcttggacggcttcctggtcttcgtgtccatcatcgatatcgttgtcagcttggcatctgcaggtggcgccaagatcctcggcgttttaagagtgctcaggctgctgcgcactctgagacctcttagagtgataagcagggccccaggcttaaaattggtggttgaaacgttgatttcaagcctgaagcctatcgggaatattgttctaatctgctgcgcattttttattatttttggcattctgggtgttcagctcttcaagggcaagttctaccattgcctcggcgtggatacgcgaaacataaccaaccgcagtgattgcatggccgccaactaccgctgggtccaccacaagtacaattttgacaacctggggcaggcgcttatgtctcttttcgtccttgcatctaaggatggctgggtcaatatcatgtacaatggcctggacgctgtagccgttgatcaacagcctgtaactaaccataacccatggatgctactgtacttcataagtttcctgctgatcgtgtcttttttcgtgctaaacatgttcgtgggggtggtcgtagagaactttcacaaatgcagacaacaccaagaggctgaagaggctagaaggagggaagaaaagaggctccgcaggcttgaaaagaagcggcggaaagcgcagcgacttccatactatgcgacttactgccatacgaggctgcttatccactccatgtgtacaagccattacttggatatcttcattacttttatcatctgcctgaatgtggtcacaatgagtttggagcattataaccagcctactagcctcgagaccgcattgaagtactgcaattatatgttcactacagttttcgtcctggaagcagtgctgaagcttgtggcttttggtctgcgccggttttttaaggacagatggaaccagctggacctcgcaattgtgttactctccgtgatgggaatcactcttgaggagattgagataaacgccgctctccccatcaacccaacaataatccgaatcatgcgcgtgcttagaatagctagagtcttgaaactcttaaagatggctaccggaatgcgcgctctgttagatacagtagtacaggcacttccacaggtggggaacttaggcctcttgtttatgctgttgttcttcatttatgccgcactcggggtggaactttttgggaagctggtctgcaatgatgaaaacccatgcgaaggtatgtctcgtcatgcaacatttgagaacttcggaatggcctttctgacgctgtttcaggtaagtaccggggacaattggaatggcatcatgaaggacactctccgagactgcacacacgacgaaaggtcctgcttgtcatcactgcaattcgtatccccactctactttgtgtcttttgttttgacagcgcagtttgtacttattaatgtggtggtggctgtgctgatgaagcatctggatgattcaaacaaggaggcccaagaggatgctgagatggatgccgaactggagctcgaaatggcccacgggctggggcccggaccaagactcccaacaggctctccaggtgccccaggccggggcccgggcggtgccggcggcggcggagataccgagggaggtttgtgccggaggtgttacagccctgcgcaggaaaatctgtggttagattctgtctccctgatcattaaagattccttagagggagagctgacaatcatcgataacctatctggctccatattccatcactacagctcacccgcgggctgtaagaagtgccatcatgacaagcaagaagtccaactggccgagactgaagccttcagcctcaattctgatcgcagctccagtattttgctgggagacgacttgtcgcttgaggatcctaccgcgtgtcccccaggcagaaaagactctaagggggaactggaccccccagagccgatgcgagtgggcgacctgggtgaatgcttcttcccactgagttcgacggccgtgtcccctgaccccgagaatttcctctgcgagatggaggagatcccattcaaccccgtgcgatcatggttgaaacacgactcttcccaggccccaccttcccccttttcacccgacgcttcttctcctttgctgcctatgccggctgaattcttccacccagccgtctctgcctctcagaagggccctgagaaggggacagggacaggaaccctccccaagatcgcgcttcaggggtcttgggcttccctgcgctctcctagagtcaattgtacgttgctgaggcaggtacccacccccccacgaccatag

SEQ ID NO: 181272 - DNA, 6672 bp, Artificial Sequence
  Description of Artificial Sequence: Synthetic coding sequence
atggccgagagcgccagcccccccagcagcagcgccgccgcccccgctgctgagcctggagttaccaccgagcaacccggcccccggtcgccacccagctctcctccaggcctcgaggagccactggacggcgcagaccctcatgttcctcaccccgatctggcccctattgcctttttttgtctgagacagaccaccagtcctcggaactggtgcataaagatggtatgcaatccatggttcgaatgcgtcagtatgctcgttattttgctgaactgcgtgactctgggaatgtaccagccttgtgatgatatggattgtctttctgaccgttgcaagatcttgcaggtcttcgatgactttatattcattttcttcgccatggaaatggtcctcaagatggtggcgctcggaatctttggaaaaaagtgttatctgggcgacacctggaaccgactggacttctttatcgtgatggcagggatggtggaatattcgctggacctgcaaaacattaacctcagcgccattaggacggtgagagtgcttaggcccttaaaagcaatcaaccgtgtaccctcaatgcggattttggtaaatcttctcctggacacgctgcctatgttaggtaacgtcctgctcctgtgcttcttcgtcttctttatcttcggcattatcggagtgcaactttgggccggattacttagaaatcggtgttttttagaggagaactttacaatccagggcgacgttgctttgcccccatattaccagcctgaagaagacgacgagatgccctttatttgttccctttctggcgataacggaatcatgggatgtcatgagattccccccttgaaagaacagggacgggagtgctgtctgagtaaagacgacgtttatgattttggtgccggtcgtcaggacttgaacgcttctggcttgtgtgtaaattggaatcgttattacaacgtgtgtcgcaccggcagcgccaatccacacaaaggggctatcaatttcgacaatatcggatacgcgtggatagtgatattccaggtcatcacactagagggatgggtggagattatgtattacgtgatggacgcgcactctttttacaactttatctactttattctgctgatcattgtgggcagcttcttcatgataaacctttgcctggtcgtgatcgcaacccaattctctgagactaagcagcgggagcatagactcatgcttgagcaaagacagagatatctctcctctagtactgtagcctcttatgcggagcctggagattgttatgaggagattttccagtacgtttgccacattcttcgcaaggctaagagacgggcccttgggctatatcaggccttacaatccagacgccaagctcttggacccgaggccccagccccagcaaagccagggccgcacgctaaagaaccgcggcactaccacggaaaaacgaaaggccagggtgacgaaggcaggcacctggggtctaggcactgccaaaccttgcacggtccagctagtccaggcaacgaccactccggaagggaactgtgccctcagcacagcccgttggatgccaccccccacacccttgtgcagccaattcccgctacactagcctcagaccctgcctcctgtccttgctgccagcatgaagatggcagacgaccttccggccttgggtccaccgacagtggacaggagggcagtggttctgggagtagtgccggcggtgaggacgaggcagatggggatggtgctcggagtagtgaggatggtgctagttccgaactgggtaaagaagaggaggaagaggagcaggctgatggagcagtgtggctttgtggggacgtgtggcgcgaaacacgagccaagctgaggggaatcgttgactccaagtacttcaatcgggggatcatgatggctatcctggtgaacaccgttagtatgggcattgaacatcacgagcagcccgaggagctgacgaacatcctcgagatctgtaatgttgttttcacttccatgtttgcattagaaatgatcctgaagctggcggcatttggactcttcgactacctgcgaaatccatataacattttcgattccatcatcgttatcatctcaatttgggagattgtcgggcaggcagatgggggattgtcggttctgaggacgttccgtcttcttcgggtgctgaaattagtcaggttcatgcccgccctccggcgccagctcgtcgtcctgatgaaaaccatggacaatgttgcaaccttttgcatgctactcatgctgttcatttttattttttctattctgggtatgcacatttttggctgtaagttctcccttagaactgacactggcgatacggtccctgatagaaagaatttcgacagccttctgtgggccattgtcactgttttccagatactcacacaagaagactggaacgtggttctgtataacggcatggcatccaccagcccttgggcttctctctacttcgtcgccctgatgacatttggaaattacgtgctgttcaacctgctagtcgcaattttagtagagggttttcaggcggagggagacgcaaatcggtcttattccgatgaggatcagagttcgagtaatatcgaggagttcgacaagctccaggagggactggactcaagcggggatcccaagctgtgccccatcccaatgacacccaatgggcacttagaccccagccttcctctgggagggcatctggggcccgctggagcggcagggcccgcccctaggctatcacttcagcctgatcctatgttagtggctctggggagccgaaaatccagcgttatgtctcttggcaggatgtcttatgatcagcgcagtctcagctcaagcagatctagttattatggcccctggggtaggagtgctgcctgggcgagtcgcaggtcgagttggaattcgctgaagcacaaacccccatccgcagaacatgagtccctgctgagtgcagagcgaggaggaggtgcacgtgtgtgtgaagtcgccgccgacgaggggcccccaagggccgcgcccctacacacaccccacgcccaccacatccaccacggcccgcatctggcccataggcacaggcaccatcggagaacgctgtctttggataacagagacagtgttgacctggccgaactggttcctgcagtgggcgcacatcctcgggccgcctggcgggctgctggccccgcccctgggcacgaggactgcaatggccgcatgccatcgattgcgaaggacgttttcactaagatgggcgatagaggagacaggggcgaggatgaggaggaaattgactacacgctatgcttcagggttagaaagatgattgatgtgtacaagccagactggtgtgaagtccgcgaggactggagcgtgtacttgttttcaccagagaaccgctttcgggtgctgtgtcagaccatcattgcgcataagctgtttgactacgtggttctcgcatttattttcctgaattgcatcactatcgccctggagagaccccagatcgaagctggtagcaccgagcgtatttttcttaccgtaagtaactatatcttcacagcaatctttgtcggtgagatgacactgaaggttgtgtccctggggctgtactttggcgagcaagcataccttcgatcaagttggaacgtcttggacggcttcctggtgtttgtctctatcattgacatagtggttagcctggcatccgctggcggcgccaagattcttggcgtgttgcgggtcctgcgattgctgagaactctaagacccttgcgcgttatctccagggctcccggcttgaaattagtagtagaaacacttatcagctcgttgaagccaattggcaatatagtgcttatctgttgtgctttcttcattatctttgggattctcggcgttcagctgtttaaaggaaagttctaccactgcctgggagtggatacccggaatattacaaataggtccgattgcatggctgccaactatcgctgggtccatcacaagtacaatttcgacaatctggggcaagcccttatgagcctcttcgtgttggcttcaaaggacggatgggttaacattatgtataatggtctggatgccgtggcagtggatcagcaaccagtgacaaatcacaacccatggatgcttctgtactttataagttttttgctaatagtttcctttttcgtactgaatatgtttgttggagttgttgtggaaaatttccacaagtgtaggcagcaccaggaagctgaagaagcaagaagaagagaagaaaaacgactgcgccggcttgaaaagaaacggagaaaggcccaacgtctgccctactacgcgacctactgtcacacacgactgcttattcactcaatgtgcacatcacattatttggatatctttatcactttcattatctgtctgaatgtggttacaatgagcctggagcactataatcagcccacatccctagagacggctctgaaatactgtaattatatgtttaccacggtgttcgtgctcgaggccgtactcaagctggtcgcttttggtctgagaaggtttttcaaagatagatggaatcagctcgatttagctatcgtccttctgtcggttatgggtattacactagaagagatcgagataaacgcagccctgccaattaaccccaccattattaggattatgcgggtcctgcggattgcccgggtgctgaagttactcaagatggcaacaggtatgcgtgccctgctcgacactgtagtgcaagcgctcccccaggttggaaacttagggctgttgttcatgctgctctttttcatatacgccgcgcttggggttgaactcttcgggaaactagtgtgcaacgacgaaaacccatgtgaggggatgagtcggcatgcaacctttgagaatttcggcatggcatttcttactctctttcaagtgtcaacaggagataactggaacggaataatgaaggacaccctgagagattgcacacatgatgagcgctcttgtttatccagcctacagttcgtctctcccctgtatttcgtgagcttcgtgttgaccgcacagttcgtcctcatcaacgtggttgtagcagtcctcatgaaacacctggatgacagcaacaaggaagcccaagaggacgccgagatggacgctgaactggagttagaaatggcccatggactcgggccggggcctcgactccccacaggcagtcccggtgctcccggacggggccctgggggggctgggggcggtggtgacaccgagggcggactctgccgccggtgctacagtcctgcgcaggagaacctgtggttggactctgtgtccctgattataaaggactcactggagggcgagcttactattatcgacaacctgtccggtagcatatttcatcattacagctcaccagctggttgtaagaagtgtcatcatgataagcaggaagtccagctcgcagagaccgaggccttttctctcaactcagacaggtccagttcaatcttactgggtgacgacctaagcctagaagatcccactgcctgcccacccggacgtaaagattccaaaggcgaactcgaccctccagagcctatgcgggtgggcgacctcggtgagtgctttttcccactcagtagtaccgccgttagcccggatccagagaattttctgtgcgagatggaagagatcccatttaacccagtgaggagctggctgaagcatgactcaagccaggccccaccttcgccattcagtccagatgctagttcccccctcttgcccatgcctgccgagttcttccatcccgccgttagtgccagccagaaaggtcccgagaagggaacagggacaggcactctgcccaaaatagccctgcaagggtcatgggcatccctgcgttcacctcgtgtcaattgcactctgttaagacaggccaccggctcagatacaagtctggatgcctctcccagtagttcagccgggtctctgcaaaccacccttgaggactccctgactctcagcgattcccctcgtcgcgccttgggtccccccgcacccgctccgggcccgagggctggcctgtcacccgctgctagacggcgcctgagtcttagaggtaggggacttttcagccttcgcggactaagggcgcatcagaggagccatagttccgggggctctacatccccaggttgtacccaccatgactccatggacccatctgacgaagagggccggggaggcgctggaggtggaggcgcaggtagcgaacattctgagaccctctcttccctgtccctgacttcactgttctgtcccccgcctcctcccccggcccctggactgacacccgcgaggaaattctcaagcacgtcctctcttgcagccccaggaagaccacatgcggccgccctggctcatggactcgcaagaagcccatcgtgggctgccgaccggtcaaaggacccccccggccgcgcccccctgcctatggggctgggacctttagcccctccaccacaacctctgccgggagagctggaaccgggagatgccgcttcaaaaaggaaaaggtag

SEQ ID NO: 181273 - DNA, 6567 bp, Artificial Sequence
  Description of Artificial Sequence: Synthetic coding sequence
atggccgagagcgccagcccccccagcagcagcgccgccgcccccgcggctgagcctggcgtgactaccgagcagccaggccctcgatcacccccttcctctccccccggtcttgaagaacccctggacggggccgaccctcacgtgccacaccccgatctggctccaatcgcctttttctgcctgcggcaaacaactagccctaggaattggtgtattaagatggtctgcaatccttggtttgagtgcgtctcgatgttagtaatcctgctgaactgcgtgactctggggatgtaccagccatgtgacgacatggattgtcttagtgacagatgtaagatcctgcaggtgttcgacgattttattttcatctttttcgccatggaaatggtgctgaaaatggtggccctagggatatttgggaagaagtgctatctcggcgatacttggaatcgcctggacttcttcatcgtgatggccgggatggttgagtatagcctggatctccagaatattaacttgagcgccatccggacagtccgagtcctcaggccacttaaagccatcaaccgagtgccgtcaatgcggatcctggtgaacctgctcctcgacaccttgcctatgctagggaacgtgctgctgctgtgctttttcgtattctttatattcgggatcattggggtacagctctgggctggattgttgaggaataggtgttttttagaagaaaattttacaatccaaggtgacgtggccctgcccccctactatcagccagaggaggatgatgaaatgccatttatttgctccctctccggagacaacggaattatgggatgtcacgagatcccacccctcaaggagcagggccgggagtgttgcctcagcaaagacgatgtatacgacttcggtgctggtaggcaggatctgaatgcatcagggctctgtgtgaattggaatcgctactataacgtgtgccgaacaggctccgctaatcctcacaaaggagcaatcaatttcgacaatatcggctatgcctggatagtgatattccaggtgatcacactagaaggctgggtcgagatcatgtactatgttatggatgctcacagtttctacaattttatttattttatcctactcatcattgtcggctctttctttatgattaacctgtgcctcgtggttatcgctacgcagttttcagagacaaagcaaagggaacatagactaatgctggagcagcgacagcggtacctgtcctctagcaccgtggccagctatgccgagcctggtgactgctacgaggagattttccagtacgtgtgccatattttgagaaaggccaagaggagggcacttggcctctaccaggctctgcagagcaggagacaggccctaggacctgaggcacctgcaccagccaagcctggtccccacgcgaaagagccacgacattaccagctgtgcccgcagcactctccattggatgcaaccccacacactctggttcagcccattcctgcaactctggcaagcgaccccgctagctgcccttgttgtcaacatgaagatggtaggcgaccgtcagggctcggatccacagactctggccaggagggttcgggcagtggctcctccgctggtggagaggatgaagctgacggcgacggtgcacggtctagcgaggacggcgccagctctgagctcggaaaagaagaggaagaagaagaacaggctgacggcgccgtctggctctgcggagatgtgtggagagagacacgggctaaattaagagggattgtagacagcaagtacttcaatcgagggataatgatggccattctggtgaatacagtctcgatgggcatagagcatcatgagcagcctgaagagctcacaaatatattagagatctgtaacgtagtattcacctcaatgttcgctctagaaatgattctcaaactggctgctttcgggctttttgattatcttagaaacccctataatattttcgattccattattgtgatcataagcatctgggagatcgtgggtcaagcagatggaggcctatctgtgctgcgaacgttcagactgcttagagtgctgaagctggtgcgtttcatgccagccctccgaagacagctcgttgtcctaatgaagaccatggataacgttgccaccttctgtatgctcctgatgctgttcatattcattttctccatcctagggatgcatatctttgggtgcaaattcagtctgcgaacagacaccggcgacaccgtgccagaccggaagaattttgacagcctcctttgggccattgtgaccgttttccagatcctgacccaagaggactggaacgtggtcttatataacggcatggcatctaccagtccctgggcatctctctattttgtcgccctgatgacgtttgggaactacgtcctgtttaatctgcttgtcgctatccttgttgaggggtttcaggccgaaggtgatgcaaatcggtcatattccgatgaggatcagagttctagcaatatcgaggaatttgataaacttcaagagggcctggattcctctggggatcctaaattgtgcccaatccctatgacaccgaacggccacttggacccatccctgcctctgggcggacacttaggcccagccggtgcagcaggcccagcgccgcgactgtccctgcagccggaccctatgctggtggccctaggctcgcgtaagagcagtgtaatgtccctcgggcggatgagctatgatcagagatctctcagcagcagtcggagtagctactacggtccctgggggaggagcgctgcctgggcaagtcgtcgctcttcttggaactctctgaaacataaaccaccatccgcagagcatgaaagcttgctttcagccgagaggggcggtggtgcccgcgtgtgtgaagtcgccgcagacgaaggaccccctagggcagctccccttcatacccctcacgcacatcatatccatcacggtcctcacctggcacacagacatcgtcaccacaggaggactcttagcttagacaatcgcgacagcgtggacttagcagaacttgtccccgccgtgggcgcccacccaagggctgcttggcgggctgccgggcctgccccagggcatgaggactgcaatggacggatgccttccatcgcaaaagatgtgtttactaagatgggagataggggcgataggggcgaagatgaagaagagatcgattatacgctctgtttccgggtccgaaagatgattgacgtgtataagccagactggtgcgaagtgcgggaagactggtccgtgtatctcttttcccccgaaaaccgttttcgggtgctctgtcagacaataattgcgcacaaactctttgattatgtggtgttggccttcatcttccttaattgcataactattgccctggagaggccacagattgaggctgggtcgacagaacggatttttctaacggtaagcaattacattttcactgccatatttgtgggcgagatgactctcaaggtcgtgtccctggggctctacttcggggagcaagcatacctccggtcctcttggaacgtgctagacgggttcctcgtcttcgtaagtatcattgatattgtagtcagcttggcctccgcaggaggggctaagatactgggcgtacttcgagtgttgcggttgctccgcacgctgagaccactccgggtgatttcccgggctccaggactgaaattggtggtcgagacactgatctccagcctgaagccaatcggaaatattgtacttatttgctgtgcattctttattatattcggcatcctcggcgtgcagttattcaaaggcaagttttaccattgtttgggagtggatacccgcaacataaccaaccgatcggactgcatggccgctaactatagatgggtccatcataagtacaatttcgataatctcggccaggcactgatgtccctgttcgtgctcgcatctaaggatggatgggtcaacatcatgtacaatggcctggatgccgttgccgtggaccaacagccagtgaccaaccacaatccatggatgctcttgtacttcatcagttttttattgattgtttccttcttcgtattgaatatgttcgtcggtgtggtcgtggaaaattttcacaagtgccggcaacatcaggaagccgaagaggcacgtaggcgggaggagaagcggctgagacgcctggagaagaagcgccggaaggcacagcgactgccgtactatgctacctactgtcacaccaggttgttaattcattccatgtgtacaagccattaccttgacatctttatcacgtttattatttgcctgaatgtagtgactatgtcgctcgaacattacaaccagcctactagcctggagacggcgcttaaatattgcaactacatgttcaccacagtattcgtgctggaggcagtactaaagctggtggcatttggcctgaggaggttttttaaggatcggtggaaccagttagatctcgcaattgtgctcctatccgtaatggggatcaccttagaggagatcgaaatcaacgctgcactgccgatcaatccaactatcattagaattatgagggtcctaagaattgcccgtgtgctgaagttgctgaagatggcaaccgggatgcgcgccctgctggacaccgtcgttcaggccctcccacaggtcggcaaccttgggctcttgtttatgctgctgttcttcatttacgccgcccttggcgtggagctgtttgggaaactggtgtgcaacgacgaaaacccatgtgagggcatgtcccggcatgctactttcgaaaatttcggcatggcatttctaactttatttcaagtgtccaccggtgataactggaacggtataatgaaggatacactgagagattgcacccacgacgagcgctcttgcctgtcatcccttcagttcgtttcccccctttacttcgtgagcttcgtgctaaccgcccagtttgtactaatcaacgttgtagtggccgtactgatgaagcacctagacgactcaaataaggaggcgcaggaggacgcagaaatggacgccgagctcgagttggagatggcacacggcctcgggcctggccctcgcctccccacaggaagtcccggcgccccagggagaggcccaggtggtgccgggggcggcggggacacggaaggaggcctatgccgcaggtgctatagccccgctcaggaaaacttatggctagattcagtgtctctgatcattaaggactcactggaaggggagctgaccattatcgacaatctttcaggcagtattttccatcactatagctcccccgcgggttgtaaaaagtgccaccatgataagcaggaagtccagctggcggagaccgaggctttctctttgaattctgatcgctcctcatcaattttactcggagacgacctgtcgctcgaggatccaaccgcttgccctcccggaagaaaagattccaagggcgaacttgacccacccgaacctatgcgcgtaggggatttaggcgaatgttttttccctctttctagtactgctgtgtcacccgaccctgagaactttctatgtgagatggaggagattccatttaatcctgttcgctcatggctgaagcacgatagctctcaggccccaccctcacctttttcgccggatgcgagttcccctttactcccaatgcctgcggagttcttccaccctgctgtcagcgcttcccagaaaggccccgaaaaaggcaccggcaccggcactttgccgaaaatcgcactccagggctcctgggcgtccttaaggtcaccgagagtcaactgtaccctcctaagacaggcaacgggaagcgacaccagcctcgatgcctctccttcttcttcagcgggatctctgcagaccaccttggaggattctctaactctttctgactctccacggcgcgctctcggcccacccgctcctgctcctggcccgcgggcaggactgtctcccgcagcgaggagacgtctatccttgcgtggacggggactgttctctctccggggcttgcgggcgcatcagcgttctcactcttccgggggatccacctcccctggctgcacccatcatgactcaatggacccttccgacgaagaggggagaggcggggcggggggtggaggtgctgggagcgaacattctgagaccttgagctcacttagcctgacctccttgttttgtccaccaccgcctccccccgctcctggactgacccccgcaagaaagtttagctcaacgtccagcctggcagcccctgggcgaccacacgcagcagcgctggctcatggcctggctaggtcacccagctgggcagcagatcgctcgaaagacccaccaggccgggcaccgttaccgatgggcctaggacccctggcccccccaccacagcctctcccaggggagttggaacccggcgatgcggccagtaaaaggaagcgctag

SEQ ID NO: 181274 - DNA, 5946 bp, Artificial Sequence
  Description of Artificial Sequence: Synthetic coding sequence
atggccgagagcgccagcccccccagcagcagcgccgccgcccccgcagccgaacccggcgtgactactgaacagccgggaccgcgtagcccccctagtagtccccctggtttagaagagcctctggacggtgccgacccccatgtaccccacccggatctcgctcccatagccttcttttgcctgaggcagaccactagtccccgtaactggtgtataaaaatggtctgtaacccatggttcgagtgtgtctcgatgctcgtaatccttttgaattgcgtcaccctgggaatgtatcagccctgtgatgacatggattgtttatctgatagatgcaaaattctgcaggtgtttgatgatttcatcttcattttttttgccatggaaatggtactaaagatggtggctctaggaatcttcggaaaaaaatgctacctcggagatacctggaatcgcctcgacttctttatagttatggcgggtatggtggagtactccttggaccttcagaacatcaacttgtcagccataagaaccgtcagagtgctgcgcccattaaaggcgattaaccgggtcccttccatgcgcattctcgtgaacctgttgttggatactctccctatgctgggaaatgtattactgctttgcttcttcgtgtttttcatattcggtatcatcggagtgcagctgtgggccggcctcctcagaaatagatgctttctggaggaaaatttcacgattcagggtgatgtggccttgcccccatattaccagcccgaggaggatgatgagatgcccttcatctgctcgctttccggcgataatggaatcatgggatgccacgagatcccaccactgaaggagcaagggagagaatgctgcctgtcgaaagatgatgtgtacgactttggtgccgggcgtcaggatttgaatgcctctggtctctgcgtcaattggaatcgttattacaatgtgtgtagaactggaagcgccaaccctcacaagggagccatcaattttgataacatcggttacgcctggattgtaatttttcaggtgatcaccttggaaggctgggttgagatcatgtactatgtgatggacgcacatagcttctacaattttatttactttattctgctcatcatcgtcggaagcttctttatgatcaacctctgtctggtcgttatagcgacgcaattctccgaaaccaagcagcgggagcacagattgatgctggaacaacgccagcgctatttatcatcttctaccgtggcatcctacgccgagcccggcgactgctatgaggaaatctttcagtatgtatgccatattctgcgcaaagccaaaagacgcgcactcggcctttatcaggccctgcagagtagaagacaggctctgggtcccgaagccccggcgccggccaagcccggtccccatgcaaaagagccaaggcactatcagctctgccctcagcactcgcccctggacgccactccccacaccttggtccagcctatccccgccacgttggcctcagatccagcctcctgtccttgctgccagcatgaggacggcagaagaccctccgggttgggcagtaccgattctggacaagaaggaagcggatctggaagttcagccggaggcgaagacgaggccgacggagacggggctaggagctcggaggacggagcctcttccgagttagggaaggaggaggaagaggaggagcaggcagatggcgcagtatggctgtgtggcgatgtgtggagggagacgcgcgccaaactgaggggaatcgtggactcaaagtacttcaatcgagggataatgatggcaattctggtgaataccgtctccatgggcattgagcaccacgagcagccagaagaactgactaatattctagaaatttgtaacgtggtgttcacatccatgttcgcgcttgagatgatacttaagctggccgcctttgggctgtttgactacctcaggaacccctacaacatttttgactccatcatagtaatcataagtatatgggagattgtcggtcaagcggacggcgggctgagtgtgctccgtacattcagacttcttcgggtactgaaacttgtacgctttatgcctgcactccgacgccagctggtggtgctgatgaagaccatggacaatgtggctaccttttgtatgcttttaatgctctttatctttatcttctctatcctcggaatgcacattttcggctgcaaattcagccttaggacggacactggagacaccgtaccagataggaagaacttcgattccctcctgtgggcgatcgtgaccgtcttccagatcctgacacaggaggactggaacgtggtgctgtacaacggcatggcttcaacttctccttgggctagcctttactttgtcgccttaatgacctttgggaactacgtgctgttcaatctcctagtggcgattctggtggagggttttcaggcagaaggcgacgcaaatcggtcatacagcgatgaggaccaaagctcttccaacatcgaggagtttgacaaattacaggaaggccttgactcctcgggcgatcctaaactatgcccgatccctatgaccccgaatggacacttagaccccagtctacctttaggcggacatctcgggccagctggcgccgccggaccagcaccccgattgagcttgcagcccgatcctatgctggtagccctgggaagcagaaaatcctccgtgatgtcactggggcgtatgagttatgaccagcggagtttaagcagcagccgaagtagctactacggcccttggggccgatcagccgcatgggcatcgaggcgctccagctggaactcgctgaagcataagcccccttccgctgaacatgagtccttactatctgcagaacgaggcggcggtgctcgcgtgtgcgaggttgccgccgacgaagggccacctcgcgccgctccgctccacactccacatgcccatcacatccatcatggacctcatctcgctcatcgccacaggcaccatcggagaacgctctctttggacaacagggacagtgtcgatctggcggagttggtccctgctgtgggggcccatccgagagcagcttggagggctgccggccccgcgcccggccatgaggactgtaacggacggatgccaagtatcgctaaagacgtgttcacgaaaatgggcgaccgcggggataggggggaagatgaagaggagatagattacaccttgtgcttccgggtacggaagatgattgatgtctataagccagactggtgcgaggtccgcgaggattggtccgtgtacttgttcagccctgagaatcgatttcgcgtcctctgtcagacaatcatcgctcataaactgttcgattacgtcgttctagccttcatttttttgaactgtatcactatcgcccttgaacgccctcagatcgaggccggaagcacagaacgtattttccttaccgtatccaattacatttttacagctatattcgtgggggagatgactctgaaggtggtgagccttggactatattttggcgagcaggcgtatttgcgatcctcctggaatgtactcgacggtttcctcgtgttcgtctccatcattgatatcgtagtgtctctggctagcgccgggggagcaaagattctcggggttctgagggtccttagacttcttcgcaccctgagaccactgcgcgtcattagccgagccccaggccttaagctggtcgtggagaccctgatctcttctcttaaaccaattggtaatatcgttctgatctgctgcgctttttttattatcttcggaatactgggagtgcagctgtttaaagggaaattttaccattgcctgggtgtagatacacgcaatatcactaatcggtccgattgcatggctgcgaactatcgctgggtgcatcacaaatataatttcgataacctgggccaagctctgatgtctctgtttgtactggcttccaaggatggatgggtgaatatcatgtataacggactggacgccgtcgctgttgatcagcagccggtgaccaaccacaatccatggatgctgttgtatttcataagcttcctcctcattgtgtctttttttgttttaaacatgttcgtgggcgtggtggtcgagaacttccacaagtgccgacagcaccaagaggccgaggaagctcgcaggagagaggagaagaggcttcggcgtttggaaaagaagagacgaaaagctcaacggttaccttactacgcaacatactgtcacacacgcctgctgattcattccatgtgcacttcccactatctggacatattcatcacattcatcatttgcctgaacgttgtaaccatgagcctggagcattacaaccagcccacatctctggagaccgctctcaagtactgcaactacatgtttacaaccgtgttcgtactcgaggcagtcctaaagttggtggcattcggcctgagaagattcttcaaagatcgctggaatcagttagatctagcaatcgttttgctgtctgtgatgggaattactctcgaagaaatagagataaacgcggccttgccaattaaccccaccataatcaggatcatgagggtcctcaggattgcccgagtgctcaagctactgaagatggctacagggatgcgggctctcctggatactgttgtccaagctcttccgcaggtggggaatttggggcttctgttcatgctgcttttttttatctacgctgccctgggtgtggaattgttcggcaagctggtctgtaacgacgagaacccatgtgaggggatgagcagacatgcaaccttcgagaacttcggaatggccttcctaacgctgtttcaggtgtctaccggagacaattggaacggcatcatgaaagataccttaagggattgcacacacgatgagcggagctgcctgtcatcacttcagttcgtttcacccttatactttgtttcctttgttctcactgcccagtttgtcttaatcaatgtagttgtggcggtcctaatgaaacacttagacgatagtaataaagaagctcaggaggacgccgaaatggatgcagagttggagttggaaatggcccatgggctaggacctggaccgaggttaccaactggcagtccaggagctccaggtcgcggtcctggtggcgccggcggcgggggagatacagaaggaggcctctgtcggcggtgctattctcctgcccaagagaacctttggctggacagtgtctccctgatcattaaggacagcctggagggggaactaacaattattgacaacttaagtgggagtattttccaccattatagctctcccgctggatgtaaaaagtgtcaccacgataagcaagaggtgcagctggcagaaacggaagccttctcgctgaattccgacaggtcttcctccatcttattaggcgacgatctctcactggaagatccgacagcatgcccacccggccgaaaagacagcaagggggagttggacccaccggagccgatgagagtgggggatctgggcgaatgttttttccccctttcgtcaactgcagtgtctccagaccccgagaatttcctgtgtgagatggaagagattccgttcaacccggttagatcatggctcaagcacgattcatcacaagccccgccatctcccttctcaccagacgcctcatcaccattgctgccaatgcccgccgaattctttcacccagccgtgtcagccagccagaagggacccgaaaaggggaccggtaccggcacattacccaagatagcccttcagggaagttgggcatccctcagatccccgcgtgtgaactgtaccctattgagacaggtgcccacaccaccacgtccatag

SEQ ID NO: 181275 - DNA, 1041 bp, Artificial Sequence
  Description of Artificial Sequence: Synthetic coding sequence
atgatggacaagttccggatgatcttccagttcctgcagagcaaccaagaatccttcatgaacggtatatgtggcatcatggccctcgccagcgcccagatgtattcggcttttgattttaactgcccatgcctgcccggatataatgccgcttattccgccggcatcttgcttgctcccccattggtcctcttcctgttagggctggtgatgaataataatgtgtctatgctggccgaggagtggaaaaggcctctggggcgacgcgccaaggatcctgcagtgctgaggtatatgttttgcagtatggctcagcgggcattaatcgctcctgtagtctgggttgctgtgacactgctggatggcaagtgttttctgtgcgccttctgcacagccgtgcccgtgtccgccctgggcaacggttctcttgctccaggactccccgcccctgaattggcccgccttctcgcccgcgtcccgtgcccagagatatacgatggtgactggctactggcccgggaggtggctgtaaggtacctgagatgcattagccaagcattgggatggagttttgtattgctaacaaccctcctcgcattcgtggtccggtcagtacggccttgcttcacacaggccgccttcctgaaatcgaagtattggtcccactatatcgatatcgagcgcaaattattcgacgaaacatgtacagaacatgcaaaggctttcgccaaagtgtgcatccagcagttttttgaggccatgaaccacgacctggagctggggcatacccacggaacgctggccactgcacctgcctctgctgccgcgccaactacacccgatggggctgaagaggagcgggagaagcttcgggggattactgatcagggaactatgaacagactgctgactagctggcacaaatgcaagccgcccctgagactggggcaggaggagcctcctctaatggggaacgggtgggccggcggcggcccgagacctccccgaaaggaggtggcaacatatttcagtaaagtttag

SEQ ID NO: 181276 - DNA, 972 bp, Artificial Sequence
  Description of Artificial Sequence: Synthetic coding sequence
atggccgccctgatcgccgagaacttccggttcctgagcctgttcttcaagtccaaggacgtcatgatcttcaatggactggtcgctttaggaacagtaggatctcaagagcttttctcagtggtggcctttcactgtccatgttcccctgcaaggaactacctctacggcctggcagccatcggagtgccggcccttgtactatttataattggcatcatcctgaataaccacacctggaacctcgtagccgaatgccagcatcgacgtacgaaaaactgtagcgccgctcccaccttcctgctgctcagttccattctgggacgagccgcggtggctcctgttacttggagcgtcatctctctgctgagaggtgaggcgtacgtgtgcgccctgtccgaattcgtggacccctcgtcattgactgcacgcgaggagcacttcccaagcgcgcacgccaccgaaattctcgcacgctttccttgcaaagaaaatcctgacaatctctcggatttccgtgaagaagtatctcggcggcttcgttatgagtctcagctcttcggttggctattgatcggcgtcgttgccatccttgtttttctgacaaagtgtctgaagcactactgtagcccactcagctatcgtcaagaagcctattgggcccaatatcgcgctaatgaggaccaactgttccaacggacagcggaggtccactctagggtattggctgctaacaacgtgcggagatttttcggcttcgtggccctgaacaaggacgacgaggaactgatcgcaaattttccagtcgaaggcacccagccacgaccccagtggaacgccatcacgggggtgtacttgtatcgggaaaatcagggactgccactgtacagccgactgcataagtgggcacagggcttggccgggaacggcgctgctccagataatgtggaaatggctctcctcccatcttag

SEQ ID NO: 181277 - DNA, 972 bp, Artificial Sequence
  Description of Artificial Sequence: Synthetic coding sequence
atggccgccctgatcgccgagaacttccggttcctgagcctgttctttaagagcaaggatgttatgatctttaatggccttgtcgcgctgggcacagtgggatcgcaggagctgttctctgtggtcgcctttcactgtccctgttccccagcaagaaactatctttacgggttggctgccattggagtacccgcactagttctgttcattatcgggatcattctcaacaatcatacctggaacctggtagctgagtgtcagcatcggcggacaaagaactgctctgcagctccaacctttctcctgctctcttccatccttggaagggccgcagtagctcccgtgacatggtcagtgatttccctcctgagaggggaggcttacgtttgcgccttgtctgagttcgttgaccccagctctctcaccgccagggaagagcactttccatccgcacacgctaccgagatccttgcaaggttcccatgcaaagagaaccctgacaacttgagcgatttccgggaggaggtgtctagacgactccggtacgaatcgcagctgttcggatggctcctcatcggagttgtggccatcctcgtattcctcacgaagtgtttgaagcactattgctctcctctgagctatcggcaggaggcctactgggctcaatatcgggccaatgaagaccagctatttcagagaacggctgaggtgcactccagagtgctggccgcaaacaatgtgaggaggttctttggctttgtagcgttgaataaggatgacgaggagctgattgctaatttccccgtcgaaggcacccagccccgtccgcaatggaatgcgattactggtgtatacttatatcgggaaaatcaaggcctgccactgtacagccgtctccataaatgggcacaggggctcgccggcaacggcgccgccccagacaacgtagagatggcattactgccctcctag

SEQ ID NO: 181278 - DNA, 657 bp, Artificial Sequence
  Description of Artificial Sequence: Synthetic coding sequence
atggccgccctgatcgccgagaacttccggttcctgagcctgttcttcaagagcaaggacgtgatgatcttcaacgggttagtggccttaggcaccgtgggctcccaggagctgttttctgtagtagcctttcactgcccctgcagtcctgcacgaaactacttatacggcctggccgcgattggcgtccccgccctagtgctctttatcattggcatcatccttaataaccacacctggaacttggttgcagagtgtcagcaccgtagaaccaaaaactgttctgctgctcccactttcctacttctttcatccatcctcggcagagcagcagtggcacctgtgacttggagtgtaatcagtctcctccgaggggaggcttatgtgtgtgctctatccgagtttgttgacccgagttcactcactgccagagaggaacatttcccatcagctcatgccacagagatcttagcccgtttcccctgtaaggagaatcctgataatctgagcgacttcagggaggaggtctctcggcggttaagatatgagagccaagtgcggagctgtgctaaaggatcctcctctagtttggtggtggccggagagcgaagcggagacggcctggtgttaaaactgggactggttctgaggggttag

SEQ ID NO: 181279 - DNA, 891 bp, Artificial Sequence
  Description of Artificial Sequence: Synthetic coding sequence
atggagagcatggccgtggccaccgacggcggcgagcggcccggcgtgcctgccgggagcggactgagtgcctctcagcggcgcgcggagttaagaagaaggaagcttctgatgaattcggaacagcgaataaacaggatcatgggattccacagacccggttctggggccgaagaagagagtcagacaaaatcaaaacagcaagacagcgacaaattgaattcattatctgtgccatcagtgagcaagcgagtggtgctgggggattcagtttcaacgggcactacagatcagcaggggggtgtcgctgaggtgaagggcacacagctgggagataagctggattcattcattaagcctcccgaatgtagtagtgatgtgaatctggagctacgccagcgtaataggggcgatctgacagcggatagtgtacaaaggggttccaggcatgggctggaacagtatctcagtcgcttcgaggaagcgatgaagctgcgaaaacagctgatttccgagaagccaagccaggaggacggcaacacgaccgaggagtttgattccttcaggatctttcgtctggtagggtgtgccctgctggcccttggagttagagcctttgtgtgcaagtacctctccattttcgcccctttccttacgttgcagctggcgtacatggggctgtacaagtatttcccaaaatccgagaagaagattaagacgacagtccttaccgcagccctcttgctgagtggcatccctgccgaggtgatcaatcgaagcatggacacttattccaaaatgggcgaggtgttcaccgatctgtgcgtgtacttttttacatttattttctgccatgagcttcttgactactgggggagcgaggtcccttag

SEQ ID NO: 181280 - DNA, 1113 bp, Artificial Sequence
  Description of Artificial Sequence: Synthetic coding sequence
atgctgggcgccgtggagggcccccggtggaagcaggccgaggacattcgggacatttacgactttagagacgtgctcgggacgggcgcattctcggaggtgattctagctgaagataagcgaacacagaaactggtggccatcaagtgcattgctaaggaggcattagaaggaaaggagggttcaatggaaaacgaaattgccgttctgcacaagattaagcatccaaacatcgttgccttggatgacatctatgaaagcggaggtcacctgtacctcattatgcagctggtgtccggtggtgagcttttcgaccggattgtggagaaggggttttacacagagcgtgatgcatcacggctaatttttcaggttcttgacgcagttaaatatctgcacgacctggggattgtgcacagagacttaaagcccgaaaatttgttgtactattccctcgatgaagattctaagatcatgatctccgatttcggactcagtaagatggaagatcctgggtccgtcctcagcacggcctgtggaacccccggctacgtagcccccgaggtgctggctcagaagccatactctaaggctgtggactgctggtccatcggtgttattgcatacatccttctatgcgggtatccccccttctacgacgagaacgatgcgaagctttttgaacagatattgaaggcagaatatgagttcgatagtccttattgggatgacataagcgactcagcgaaagattttatcagacacctgatggagaaggatcccgagaagcgctttacttgcgaacaagcgttgcagcatccatggattgcaggagatactgcactagataaaaacatccaccagtctgtgagcgagcaaattaaaaagaactttgccaagtctaagtggaagcaagcttttaacgcaactgccgtagttcggcatatgcggaagcttcaattagggaccagtcaagaaggacagggccagacagcaagccatggtgagctactcactccggtagcgggggggccagcggccgggtgttgctgtagagactgctgtgtggaacctggaaccgagctgagtcctacgctaccacaccagctgtag

SEQ ID NO: 181281 - DNA, 1437 bp, Artificial Sequence
  Description of Artificial Sequence: Synthetic coding sequence
atggccaccatcacctgcacccggttcaccgaggagtaccagctgtttgaggaattagggaagggcgcattcagcgttgtacgaaggtgtgtgaaagtgctagcaggacaggagtatgccgccaagatcattaataccaagaaactttccgccagagatcaccaaaaattggaaagggaggcccgcatttgccgcctgctaaagcatcctaacatcgtgcgactccatgacagcatatctgaagaaggccatcactatctgatttttgatttggtgaccggcggcgagcttttcgaagacattgtcgctcgcgagtattattcagaggccgatgcaagtcattgcatccagcaaattctggaagccgtgctgcactgtcaccagatgggcgtggtccaccgggatctcaagcctgaaaatttgctcttggcttcgaagctaaagggagcggccgtgaagttggctgattttgggcttgccatcgaggtggaaggggagcagcaggcctggttcggtttcgctggaaccccaggctatctgtcacccgaagttctgcgtaaagatccatatgggaagccagtcgacctctgggcttgcggagttattctctacatcctcctggtgggctacccaccattctgggacgaggaccaacatcgtctgtatcaacagattaaagcaggtgcgtacgactttccgtcacctgaatgggacacagtcactcctgaagcaaaagacctgatcaataagatgctcaccattaacccttcaaaacggattactgctgcagaagccctcaagcacccctggattagtcatagatcgaccgtggcctcctgcatgcatagacaggagacagtggattgcctcaaaaagttcaacgctagacggaagctgaagggcgcaatcctcacaaccatgctggccactcgtaacttttccggcggcaaaagcggcggaaacaagaagtcagacggtgtgaaagagtcatctgagagtaccaacactacaatcgaagatgaagacactaaagtccggaaacaagaaatcattaaagttacagaacagctcattgaggccatttccaatggggatttcgaaagctataccaaaatgtgtgaccccgggatgacagccttcgagcctgaagcactggggaacttggtcgagggcctggacttccacagattctacttcgagaacttgtggtctaggaactctaagcccgtgcataccactatcctaaatcctcatattcatctgatgggggacgaatcagcctgtatcgcttatattagaattacccagtacctagatgccggtgggatcccaaggacagcccaaagcgaagagacacgggtgtggcacagaagggatggaaaatggcagattgtacacttccatcggagtggagcccccagtgtactgccccactag

SEQ ID NO: 181282 - DNA, 1470 bp, Artificial Sequence
  Description of Artificial Sequence: Synthetic coding sequence
atggccaccatcacctgcacccggttcaccgaggagtaccagctgttcgaggagctcgggaaaggggctttttccgttgtcaggaggtgtgtgaaggtgctcgccgggcaggagtacgcagcgaagatcatcaacacgaaaaaactttcggcccgggatcaccagaaattggaaagggaggccagaatttgtagactgttaaaacatccaaatatcgtccgattgcacgatagcatctcggaggaaggacaccattacctgatcttcgatctggtgaccgggggggagctttttgaggatatcgtggccagggagtactactcagaggcggacgcttcccactgtatccagcagattctggaagcggtgttgcattgccaccagatgggtgtggtccacagagacctgaagcctgagaaccttctcctcgccagcaaactcaagggagctgctgttaagctggctgacttcgggcttgcaattgaagttgagggggagcagcaggcatggttcggttttgccggaactcctgggtacctgagcccggaggttctgcgtaaggacccttatggcaagccggtggatctctgggcctgtggagtgattttatacatcttgctggtgggataccccccattctgggatgaagatcagcataggctgtaccagcagattaaggcaggagcttacgacttcccatctccagaatgggatactgttactccagaggcaaaagaccttatcaataagatgttgacgattaatcctagcaaacgcatcacagcagcagaggccctcaaacatccttggatttcacaccgctccacagtagccagctgtatgcatcgccaggagaccgtggattgcttaaagaagtttaatgcccgccggaaactgaagggggcgattctgaccactatgctcgcaaccaggaatttctccggcggaaaatccgggggcaacaagaaatcggacggggttaaaaaaaggaagagctcctcatctgttcagctgatggagtccagcgagtcaaccaataccaccatagaggatgaggatactaaggtgcgtaagcaggaaataatcaaggtcaccgaacagcttattgaggctataagcaatggtgattttgaatcctacacaaagatgtgtgatcccggtatgactgcatttgaacctgaagcgctgggcaaccttgtcgagggtttggatttccatcggttctactttgagaatctgtggagcaggaattctaagcccgtccataccaccatcctgaaccctcacattcacctcatgggtgacgagtctgcctgtatcgcttacatccggatcacacaataccttgacgcgggggggatccctcggactgcccagtccgaagaaactagggtttggcatcgcagagacggaaagtggcagatcgtgcattttcacaggagcggcgccccatccgtcctccctcactag

SEQ ID NO: 181283 - DNA, 276 bp, Artificial Sequence
  Description of Artificial Sequence: Synthetic coding sequence
atggccaccatcacctgcacccggttcaccgaggagtaccagctgtttgaggaactggggaaaggggcattctctgtagtcaggcgatgcgtaaaggtgctcgcgggccaggaatacgccgccaaaatcatcaacaccaaaaagcttagcgccagggaccatcagaagcttgagcgtgaagccaggatttgcaggttactaaaacaccctaatatcgtgcggttacatgattccattagcgaagaggggcatcattatttaatcttcgacctttag

SEQ ID NO: 181284 - DNA, 1554 bp, Artificial Sequence
  Description of Artificial Sequence: Synthetic coding sequence
atggccaccaccgtgacctgcacccggttcaccgacgagtaccagctctacgaagatatcggtaaaggggccttcagtgtcgtcaggcggtgtgtcaaactgtgtactggccacgaatacgcggcaaagatcataaataccaagaaactttccgccagagatcaccagaagttggagcgagaagcgcgtatttgtcggctcctcaaacatagtaacatcgttaggttgcacgactcaatttccgaggaagggtttcactacctcgtgttcgatctggtgacaggtggcgaacttttcgaggacattgtggctcgtgaatattacagtgaagcggatgctagccactgcatccagcagattctggaagctgtgctgcattgtcatcagatgggcgtagttcatcgggatttgaaaccggagaacttactgttggcttctaagtgtaagggagctgctgtaaaactggccgatttcggcctggccatcgaggtccagggagatcaacaggcatggtttggcttcgccgggacacccgggtacctgagccccgaggtgctgagaaaggaggcctacggcaaacctgtggacatttgggcctgtggggttattctgtatatcctgctggtggggtacccacccttctgggatgaggatcaacataagctctaccagcagatcaaagccggggcatatgattttcccagccctgagtgggacacagtgactcctgaagcgaaaaacctcatcaatcagatgctgacaatcaaccccgccaagcgcattaccgcccatgaggccctcaagcacccttgggtgtgtcagaggagcaccgtggcttctatgatgcaccgccaagaaactgtggaatgcctaaaaaaattcaatgcccggcgcaagttaaagggagcaattctcacaaccatgcttgccacgagaaatttctctgccaagagtcttctgaataaaaaggcagatggcgttaagcctcagacaaattctacaaagaacagcgccgctgccacaagtcctaagggtacacttccccctgccgctctggaacctcagacgaccgtaatccataatcctgtcgatggaattaaggagtcttccgacagtgcgaatacaacaatagaggacgaggacgccaaagcacggaagcaagagattattaaaactacagaacagctaatcgaggccgtgaataatggcgatttcgaagcatatgcaaagatttgcgatcccggcttaacttccttcgagccagaggcactaggcaacctggtggaagggatggactttcatcgattttatttcgaaaacctgctggcgaagaactccaaacctatccacactactatattgaacccccacgtgcacgtaatcggtgaagacgccgcatgcattgcctatatccggctgactcagtatatagacggtcagggcagacctcgtaccagtcagtcagaggaaacaagagtgtggcacagaagagatggcaaatggcaaaatgtgcactttcactgttcaggggccccagtggcgcctttacagtag

SEQ ID NO: 181285 - DNA, 1350 bp, Artificial Sequence
  Description of Artificial Sequence: Synthetic coding sequence
atggccaccaccgtgacctgcacccggttcaccgacgagtaccagctctatgaggatataggaaaaggagcctttagcgtcgtgagacgctgcgtcaaactttgcaccggtcacgagtacgccgcaaaaataatcaatactaaaaagttgtctgcaagggatcatcagaaattggagcgggaagctcggatttgcaggctgctgaagcacagtaacattgtaaggctccatgacagcatctcggaagaagggttccattatctcgtgtttgacctggttactggcggcgagctctttgaagacattgtcgcccgcgaatattactccgaagccgacgcttcccattgtattcaacagattctcgaggctgtgctgcactgccaccagatgggagtcgtccaccgggatttaaagccggagaatctcctactggcttcaaaatgtaagggcgctgcagtgaagctagcggattttggactcgccattgaggtgcaaggtgaccagcaggcctggttcgggtttgctgggactccgggttatcttagcccagaagttttaaggaaggaggcctacggcaagcccgttgacatctgggcctgtggcgtgatactatacatcctgctggtcggttatccacctttttgggacgaagatcaacacaagttgtatcagcagattaaagctggagcctacgactttccgagccccgagtgggacactgtgactcctgaggcaaagaatctcattaaccagatgctaaccatcaatccagccaagcgaatcaccgcacacgaggccctgaaacacccttgggtgtgccagaggtctacagtggcaagtatgatgcatcgccaggagaccgtcgagtgccttaagaagtttaatgctagaaggaagctcaaaggcgcgattttgaccacgatgctggctacaagaaacttcagtgctagaaagcaggagataattaaaacgaccgagcaattgatagaagccgtcaacaatggagattttgaggcatacgcaaagatttgtgatccaggattgacatcgtttgagcctgaagcgctgggaaatttggtagaaggcatggattttcatcgcttttatttcgaaaacttactggctaagaattccaagcctatccatacgactatcctgaaccctcatgtccatgtcatcggcgaggatgctgcgtgtatcgcctacattcgcctgacccagtacatcgatggccaggggcgtcctcgcacaagccagtccgaagagacacgggtgtggcatagaagagatggaaaatggcagaatgttcacttccattgctctggggcccccgtggcaccactgcagtag

SEQ ID NO: 181286 - DNA, 1479 bp, Artificial Sequence
  Description of Artificial Sequence: Synthetic coding sequence
atggccaccaccgtgacctgcacccggttcaccgacgagtaccagttgtatgaggatattgggaagggggctttctctgtggtccgcagatgtgttaagctatgtactggccacgagtatgccgcaaagataattaacactaaaaagctgtccgctcgggaccatcagaagttggaaagagaggctaggatttgccggctgcttaagcatagcaatatcgtgcgcctgcatgatagcatttccgaggaaggctttcattacctggtgttcgacttagtgactggcggtgagctgttcgaagacattgtcgctcgcgaatactatagcgaggctgacgcctcccattgcatacagcagattctggaggcagttctgcactgccatcagatgggggtggtgcacagggacctaaagcctgaaaatctgctactggcaagcaagtgtaagggcgcggcggtgaagctagcagatttcgggttagccatcgaggttcagggcgaccagcaagcgtggtttgggtttgcggggactcctggctatctcagccccgaagttctgcgcaaggaggcctacggcaagcccgtcgatatttgggcctgtggggtgattttgtacatcctgctcgtgggataccccccattttgggacgaagatcaacacaaactctaccagcagatcaaggcaggcgcttacgattttccctctcctgaatgggatacagtaaccccagaagctaagaatctgattaaccagatgttgaccatcaatcccgcgaagcgcattaccgcacatgaggctctgaaacacccgtgggtctgtcagcgctcaaccgtagcctccatgatgcacaggcaggagacagtggagtgcctgaagaaattcaacgcccggagaaaattgaaaggcgctatcctcacgacaatgttggccacccgtaatttctcagtcggccggcaaaccactgcgccagcgactatgagcaccgcagcttcaggaacaacgatgggactagtggagcaggcaaagtccttattgaacaagaaggctgatggcgtgaaagaaccacagaccactgtgattcacaacccggttgacgggataaaggagtccagtgatagtgccaacaccacaatcgaagatgaggatgcaaaagccaggaagcaggaaattataaagacgactgagcaacttattgaggcagtgaacaacggggacttcgaagcctacgcattttatttcgagaacctccttgcgaaaaatagtaagcccatccatacgacaatcctgaaccctcacgtccatgtaataggggaagacgctgcatgtatcgcctatatacggcttacccagtatatcgatgggcagggacgaccccggacatctcagtctgaggaaacgagagtgtggcatagacgtgacgggaaatggcagaacgtacactttcactgctcaggcgcccccgtcgcccctcttcaatag

SEQ ID NO: 181287 - DNA, 1629 bp, Artificial Sequence
  Description of Artificial Sequence: Synthetic coding sequence
atggccaccaccgtgacctgcacccggttcaccgacgagtaccagctatacgaggatatcggcaaaggagcctttagcgtggtccggcgttgcgttaagctctgcacaggccacgaatatgccgccaagatcatcaacactaaaaagctgagtgcaagggaccatcagaagctggagagggaagcgagaatatgtcgacttttgaaacacagtaatatcgttcgcttacacgatagcatcagcgaagaaggcttccattatcttgtgtttgacctcgtgacgggcggtgaactgttcgaggacatcgtcgcccgagagtactactccgaggcggacgcatcacactgcattcagcagatcttagaggccgtccttcactgtcaccagatgggtgtcgtccacagagacttgaaacccgaaaacctgcttttagctagtaaatgtaaaggggccgcagtgaagttggccgacttcggcctggccattgaggtccagggcgatcaacaagcatggttcggcttcgccggcacccctggctacctcagtcccgaggttctccggaaagaagcctacggcaaaccagtggatatttgggcctgcggcgtgattctttacattctactcgtcggctatccccccttttgggacgaggatcaacataagctctatcaacaaataaaggccggtgcttacgattttccctcccccgaatgggacaccgtgaccccagaggccaagaatttgataaaccagatgctaaccatcaatcctgcaaagagaataactgctcacgaagcactgaagcatccatgggtgtgccagcgatctactgtggcttccatgatgcacaggcaggagacagtagagtgcctgaagaaatttaatgctcgccgaaagctaaagggtgcgatcctcacaaccatgttagctacccgaaatttctctgtgggcagacagacaacagctcctgccaccatgagcacagcagcgtcagggaccaccatgggcctcgtagaacaagctaagagcctattgaataagaaagccgacggggtcaaaccacagacgaactccacgaagaactccgccgccgcgacgtcccctaaaggaaccctcccccctgccgccctggagccacaaacaactgtgatccataatccagtggatgggatcaaggagtcctctgacagcgcaaacactacgatagaagacgaggacgctaaagctaggaagcaggagattatcaaaaccaccgagcaattaatagaggccgttaacaatggtgattttgaggcctatgctaaaatctgcgatcctggactgacttcgtttgagcctgaagcacttggaaaccttgtggaagggatggacttccaccgattctacttcgagaaccttcttgccaagaatagtaagcctatccataccacaattctcaatccacacgtacacgtgatcggggaggacgccgcatgcatcgcttacattcggctgactcagtacatcgacggccaaggaagaccgcgcacctctcagtctgaggagacacgggtgtggcaccgcagggacggcaagtggcagaacgtacacttccattgttccggggctccagtggcgcctctgcagtag

SEQ ID NO: 181288 - DNA, 1440 bp, Artificial Sequence
  Description of Artificial Sequence: Synthetic coding sequence
atggccaccaccgtgacctgcacccggttcaccgacgagtaccagctctatgaggatatcggaaaaggagccttctcagttgtgcggagatgtgttaaattgtgcacaggacacgagtacgccgcaaaaattatcaatacgaagaaattgtccgcccgcgatcaccaaaagctggagagggaggccagaatctgccgtctgctgaaacattcaaatattgtgaggctgcatgactccatctccgaagagggattccattacctggtgttcgacctcgtcaccggaggcgaactatttgaggacatagtggctcgagaatattatagcgaagccgacgctagtcattgcatccaacagattctggaagctgtcctgcattgtcaccagatgggcgtggtccatagggacctgaaaccagagaacctcctgttggcaagcaaatgcaagggtgctgccgtgaagttagctgattttgggcttgctatcgaggtccaaggcgaccagcaggcctggttcgggttcgcaggtacccccggatacttgtcgccagaagtgttgcggaaggaggcttatgggaagcctgtggacatctgggcctgtggggtgatattgtacatcctgctcgtggggtatccacccttttgggacgaagaccagcacaaactgtaccagcagattaaagcgggtgcttacgactttccatcaccagagtgggacacggttacgccagaagcaaagaacctcattaatcaaatgttaaccatcaatcctgctaagcggattaccgctcatgaagctctgaagcacccgtgggtctgtcaacggagcacagttgcttccatgatgcaccgtcaggagaccgtggaatgcctgaaaaagtttaatgccaggcggaagttaaagggcgctattcttacgacaatgctggctactcgcaacttcagcgccgccaagtcccttctcaataagaaggcggacggagtcaaggagagttctgatagtgctaacactacaatagaggatgaagatgccaaggctcgaaaacaggaaattatcaaaacaacagagcaactgatcgaagctgtgaacaacggtgactttgaggcttatgcaaagatctgtgacccaggcctgactagttttgagcccgaagcccttgggaacctcgtggagggtatggattttcaccgtttctacttcgaaaacctgctggccaagaactctaaacccatacataccaccattcttaatccgcatgtgcatgtgataggcgaggatgctgcttgtattgcgtatattagacttacacagtatatcgatggacaggggcgcccccgcacatctcaatctgaggaaactagagtgtggcatcgcagggatgggaagtggcaaaatgttcattttcactgttccggcgcacctgttgcaccccttcagtag

SEQ ID NO: 181289 - DNA, 1512 bp, Artificial Sequence
  Description of Artificial Sequence: Synthetic coding sequence
atggccaccaccgtgacctgcacccggttcaccgacgagtaccagctctacgaggatatcggcaagggtgcgttcagtgttgtcaggcgttgcgtgaagctttgtaccggccatgaatacgctgctaagatcattaacacgaagaagctgtctgctagggatcatcaaaagctcgaacgggaagccaggatttgccgtttactcaagcactcgaatattgtgcgattgcacgacagcatttctgaagaagggttccattacctggtgtttgatttggtgaccggtggggaactattcgaggatatcgtcgcgcgcgaatactattccgaagccgacgcctcccactgcatccaacagatactggaagcagttctacattgtcaccagatgggggtggtgcacagggatctcaagcccgaaaatctattactggcctctaagtgtaagggagcagctgtgaagctggcagacttcggtctggccatcgaggtccagggggatcagcaagcctggttcggattcgccggaaccccagggtacctctcgcctgaagtcctgagaaaagaggcttatggtaaacccgtggacatctgggcatgcggcgtaatcctatatatactactggtaggctatcctccattctgggacgaagatcaacacaaactgtaccagcagattaaagccggagcctatgatttcccgagccctgagtgggatacagttacaccagaggccaagaatctgattaatcagatgttaaccataaatccagcgaaaaggataaccgcccacgaggccctgaagcatccatgggtgtgccagcgatctaccgtggcttctatgatgcaccggcaggaaacggtggaatgtctgaagaaattcaacgctcggcgaaagctcaaaggcgctatcctgaccactatgttggccacgcgcaacttctctgccgccaagtccctcctgaataaaaaagctgacggagtgaagccacagacaaatagtactaagaattctgcggccgccaccagccctaagggcaccctgccacccgcagcattagagagttcagattctgccaacaccactatcgaggacgaggacgccaaggcccgcaagcaagaaattataaagaccacagagcagttgattgaagccgtaaacaatggcgattttgaggcatacgccaaaatctgcgaccctggactgacaagctttgagccagaggccctgggcaacttagtggagggcatggatttccatcggttttatttcgaaaatctattggcgaaaaactccaagcccatccatacaaccattctgaatccacacgtccacgtgattggtgaggacgctgcctgcatcgcttacatccgcctaacccagtacatagatggccaaggtcggccaagaacctctcaatctgaagagacaagggtgtggcatcgtcgagacggtaagtggcaaaatgtccattttcactgttccggcgcacccgtggcccccctgcaatag

SEQ ID NO: 181290 - DNA, 1557 bp, Artificial Sequence
  Description of Artificial Sequence: Synthetic coding sequence
atggccaccaccgtgacctgcacccggttcaccgacgagtaccagctctatgaagacatcggaaagggggccttttctgtagtgcgtcggtgtgtgaagctgtgcacagggcatgagtacgcagccaagatcattaacaccaagaagctcagcgcccgcgaccaccagaaactggagagagaggcccgcatatgtcgcttgttaaagcactccaatatcgtgcgactccacgatagtatctcagaggagggattccactacctcgttttcgacttggtaactggtggagagctgttcgaggacatcgttgctcgggaatactatagcgaggcagatgcttcacactgtatccagcagatcttagaggccgtcttacactgccatcagatgggcgtcgtacatcgagatttgaagcctgaaaacttgctgctggccagtaagtgcaagggcgccgccgttaagttggcagactttggattagcgatagaagtgcaaggggatcaacaagcatggttcggattcgctggcacacctggatacctgtcccctgaagtgcttcgaaaagaagcatatggcaaaccggtggatatttgggcttgcggcgtgatcctatatatccttctggtgggatacccacctttctgggatgaggatcagcataagctgtaccagcaaattaaggcgggggcatacgacttcccatctccagaatgggacaccgtgactcccgaggccaagaatctgattaaccagatgctgactatcaacccagctaagaggatcactgcgcacgaagccctcaagcacccctgggtgtgccaacgtagcaccgtagccagcatgatgcatcgccaagagactgtggaatgcttaaagaagttcaacgctaggagaaagctgaagggcgccatcctgacgacaatgctcgccacaaggaatttttccgctgcaaaatcactcctcaataagaaagccgacggtgttaagccacagacaaacagcaccaagaatagcgcggcagccaccagtcccaagggtacactcccacctgcagccctcgaaccccaaaccacagtgattcataatcctgttgatggtattaaggagtcttcagacagcgccaatactacaatcgaggacgaagatgctaaggctaggaaacaagaaatcattaaaacgaccgagcaacttattgaagccgtcaataacggcgactttgaagcctatgccaagatttgtgatccagggctcacaagtttcgagccagaggccttagggaacctggtggaggggatggattttcataggttctacttcgaaaatctgcttgcaaagaacagtaaacccattcatactacaattcttaatcctcacgtccacgtgatcggggaagatgctgcttgtatagcctacattcgcctgacccaatacatcgacggccagggcagaccgcggactagtcagtcggaggagacaagggtatggcacagacgggacgggaagtggcaaaacgtgcatttccactgttctggcgctcccgtcgctcccctacagtag

SEQ ID NO: 181291 - DNA, 2001 bp, Artificial Sequence
  Description of Artificial Sequence: Synthetic coding sequence
atggccaccaccgtgacctgcacccggttcaccgacgagtaccagctatacgaagatatcggtaagggggccttcagcgtggttcgccggtgcgttaagctctgcactggacacgaatatgccgctaagataattaatactaaaaagctatcagcacgtgatcaccagaagctcgagcgagaagcacgaatctgtcgtctgcttaagcactcaaacatcgtccgtctgcatgatagtatatctgaggagggttttcattacctcgtgtttgatctggtcacaggaggtgagctgtttgaggacatagtcgcccgagaatattactcagaggcagacgcttctcactgcatccagcaaatactggaggccgtgctacactgtcatcagatgggagtggtgcatcgtgatctgaagcccgagaacttgttgttggcctcgaaatgtaaaggcgcagcagtcaagctggcagactttggtctcgcaatcgaggtgcagggcgatcagcaggcatggtttgggtttgccgggactccaggatatctgtcccctgaagttctgagaaaggaggcctacgggaaaccggttgacatttgggcatgcggtgtgatactgtacatcctgctcgttggctatccgccgttttgggatgaggaccagcataagctctatcagcagataaaagctggagcctacgactttccctctcccgagtgggacacagtgactccagaggcgaaaaatctcataaatcaaatgttaactatcaatcccgcgaaacgtatcactgcccatgaggctctgaagcatccctgggtttgtcagcggtccacagtggcatcaatgatgcaccgccaggaaactgtagaatgcctgaagaagtttaacgctcgaagaaagctgaagggcgccatcctgacgaccatgcttgcaacccgcaatttcagcgtcggccgacaaaccactgcccccgccacaatgtccaccgccgcatccggcaccaccatgggcttggtggaacaggcaaaaagcctcctcaataagaaagctgacggcgtgaagccacaaactaactctaccaaaaacagcgctgcagcaacctcacctaaaggtactctgccacctgccgctctggaaccacaaacaactgttatacacaaccccgtggatgggataaaagagagcagtgactcagcgaacacgacaattgaggacgaagatgccaaggcgcctagagtgcccgacatcctgtcatccgtccgccgggggagtggtgctccagaggctgagggcccactcccatgtccctcccctgcgcccttctccccactgcccgccccttcaccgcgaattagtgacatactgaactccgtgagacgtggatctggcacacctgaagccgagggacctcttagcgctggtcctccaccctgcttgagccctgcactcctggggcctctgagcagccctagtccacggatctccgacattctgaattcagttcggagaggaagtgggactcccgaggctgaaggcccatcccccgttggaccaccaccctgtccttccccaaccattcccggccctctgcccacaccttccaggaaacaggaaatcatcaagacgactgagcaactgatcgaagcagtgaataatggtgacttcgaagcctacgccaaaatttgcgatccaggactgactagttttgaacctgaagcccttgggaacctggtcgaggggatggacttccataggttttactttgagaacctgctggccaaaaatagcaagccaatccatactaccattcttaatccgcatgtgcacgtgattggcgaagatgcagcatgcattgcctacattaggttgacacaatacatcgacggtcagggtcgacccagaacttcgcagtccgaggaaacgcgagtgtggcaccgtcgggacggcaagtggcagaatgtccatttccactgttctggcgcccccgttgcccccctgcagtag

SEQ ID NO: 181292 - DNA, 1629 bp, Artificial Sequence
  Description of Artificial Sequence: Synthetic coding sequence
atggccaccaccgtgacctgcacccggttcaccgacgagtaccagctgtacgaggacatcggcaagggagccttctccgtcgtccgccggtgtgtgaagttatgtacagggcacgaatatgctgccaagattatcaatacaaagaaactgagcgcaagagatcaccagaaacttgaaagagaagctcggatttgtcggctccttaagcactccaatatagtgcggctacacgatagcatctccgaggagggttttcattacttggtttttgacctcgtcactgggggcgaattgttcgaggatatagtggctcgcgaatactactcggaggcagacgcgtctcactgcatccaacagattttggaagctgtgttgcactgtcaccagatgggggtggtccatagagatctcaaaccagaaaacctcctgttagccagcaaatgcaagggagccgctgtcaagttagctgactttggactggctattgaggtgcagggagaccagcaagcctggtttggtttcgcgggtacaccaggatacctgtcccccgaggttctccgaaaagaggcctacggtaaacctgtggacatttgggcatgcggcgtaatcttgtacattctcttggttgggtatcctccgttttgggacgaggatcagcataaactctatcaacaaatcaaggcaggtgcttacgattttcccagccctgagtgggacaccgtgactcccgaggccaagaacctcatcaaccagatgctcactattaacccagccaagagaataactgcgcacgaggcactgaagcacccctgggtgtgtcagagatccacagttgccagtatgatgcaccgccaagagaccgtggagtgcttgaaaaaatttaacgcccgccggaaactgaagggggccattctcacgaccatgctagctactaggaatttttccgtcgggaggcagactaccgcaccagctaccatgtccacagcagcttccgggaccaccatgggtctggtcgagcaggcaaagagtctattaaacaagaaagccgacggcgtcaaaccccaaactaatagtacaaaaaattctgcggccgctaccagtcccaagggaactctccctccagccgcacttgagccccagacgacggttatacataaccctgtggacggaatcaaggagtcaagtgatagcgccaacacaactattgaggatgaggatgccaaggctaggaagcaggagatcattaagacaactgagcagctgatcgaagccgtgaacaatggagacttcgaagcatacgccaaaatctgtgatcccgggttgacctctttcgagcccgaggccctcggaaatttggtggaagggatggatttccacaggttttacttcgaaaacctgctggctaagaactcaaaaccaatccacaccacaatacttaaccctcacgtccatgtgattggcgaagacgcggcatgcatagcatacatccggctcacccaatacattgatggtcagggtaggccccgcactagtcagtccgaggaaactcgagtgtggcaccggagggacggcaagtggcagaatgttcattttcattgcagcggtgctcctgttgcccccctgcagtag

SEQ ID NO: 181293 - DNA, 1557 bp, Artificial Sequence
  Description of Artificial Sequence: Synthetic coding sequence
atggccaccaccgtgacctgcacccggttcaccgacgagtaccagctttacgaggacattgggaaaggggcattctcagtggtccgcagatgcgtgaagctctgcaccggacacgaatacgccgctaagatcataaacacaaagaaactatccgcacgggaccatcagaagctcgaaagagaggctagaatctgccgtctcctgaagcactctaacattgttagactccatgacagtatcagtgaggagggattccattatctggtgtttgacctagtcacaggcggggaactattcgaggacattgttgccagagagtactatagcgaggcggatgctagtcactgtattcagcaaatacttgaagccgtgctccattgccatcagatgggagtcgtccacagggacctgaaaccggaaaacctccttctggccagcaagtgtaaaggggctgcagtcaaattagccgacttcggcctcgctatagaggtccagggggaccagcaggcctggttcggctttgcaggaactccgggttatttaagcccagaagttctgagaaaggaggcttacggcaagcctgtggatatatgggcatgcggggtgatcctctacatcctcttggttggatatccccctttctgggacgaggaccagcataaactttaccagcagattaaagcaggcgcatacgactttccctctcctgaatgggacaccgtgactcccgaggcaaaaaatctgattaaccagatgctcacgattaatcctgccaagcgtattactgcacatgaggctctgaagcatccgtgggtgtgccagagatcgactgtggcctcaatgatgcaccgtcaggagactgttgagtgtctgaagaaatttaacgcacgtcggaagttgaagggcgcaatactaaccactatgttggcaacccgtaacttcagcgcagcaaagtccctgctcaacaagaaggcggacggtgtaaaaccccagacgaattcaaccaagaattcagccgcagctacaagcccaaaaggaaccttaccaccggctgccctggaaccccagacgacggtaattcataaccccgtggacggcatcaaggaatctagtgactccgccaataccaccatcgaggatgaagacgcaaaagccaggaaacaggaaattattaagactacagagcagttgattgaggccgtgaataatggcgatttcgaggcatatgcgaaaatttgcgaccctggactgacgtcatttgagcctgaagctctcgggaatctcgtggagggaatggattttcaccgtttctacttcgagaacttgctcgcaaagaactcaaagcctatccacaccacaattttgaacccacacgtgcacgtgataggagaggatgcagcctgtattgcttacattcggctgacacaatacattgatggccagggccgtccacgaacctcccaaagtgaagaaaccagagtatggcaccggagggatggtaaatggcagaatgtacattttcactgttctggagcacccgtggccccacttcagtag

SEQ ID NO: 181294 - DNA, 918 bp, Artificial Sequence
  Description of Artificial Sequence: Synthetic coding sequence
atgggcgtggtgcaccgggacctgaagcccgagaacctgctgctggcgtccaagtgtaagggtgccgctgtgaaacttgcagacttcggactggccatcgaagtgcagggggatcaacaggcctggttcggctttgctggtactccaggataccttagcccggaggttctccgtaaggaagcatacggtaagcctgtggatatctgggcctgcggagtgattctgtatattctgctcgtagggtacccaccattttgggatgaagatcagcacaagctgtatcagcagatcaaagctggcgcatacgattttccttctcctgagtgggacacagtgacacctgaggccaagaacctcattaaccagatgctcacaattaatccagctaaaaggatcacggcacatgaggctctgaaacatccttgggtgtgtcagaggtctactgtggcatccatgatgcacaggcaggagacggtggagtgccttaagaagtttaacgctcgcaggaagcttaaaggagctatcttgaccaccatgctggctactcgtaacttctcagttggacggcagacaacagcgccggccaccatgagcacagctgcctctgggactactatgggcctggtggagcaggcaaaatccctgctaaacaagaaagcggatggagtgaagccacagaccaattccacgaagaatagcgcagcggcaacctcccccaaaggcacgcttccacctgcagctctggaaccccagacgactgttattcacaacccagtagatggaatcaaggaaagcagcgatagcgctaatactacgattgaagacgaggatgccaaggctcggaaacaggagattatcaagaccacagaacagctgatcgaagctgttaacaatggtgacttcgaggcatatgcatag

SEQ ID NO: 181295 - DNA, 1437 bp, Artificial Sequence
  Description of Artificial Sequence: Synthetic coding sequence
atggccagcaccaccacctgcacccggttcaccgacgagtaccagctgttcgaagagctcggaaagggagcattctcggtggtgcgccgctgcatgaagattccgaccgggcaggaatatgccgccaaaataattaacacaaaaaagttatcggctcgggatcatcaaaaactcgagcgtgaggccaggatctgtcgcctgctaaagcatcctaacattgtgcgcctacatgactccattagcgaggaggggttccattacttagtcttcgatctagtcaccggcggagaattatttgaggatatcgtggcaagagaatactactctgaggccgacgctagtcattgcattcagcaaattctcgaatcggtgaaccactgtcatctgaacgggatcgtgcatagagacctgaagcctgagaacctgttgctggccagtaaaagcaaaggtgctgccgtaaagttagccgattttgggcttgcaatcgaggtgcagggagatcagcaggcctggtttggattcgccggcacacctgggtacctgtcgcccgaggttctgcggaaagacccatacggaaaacccgttgatatgtgggcttgtggcgtcatcttgtatatcctactcgtaggttatcctcctttctgggacgaggaccagcatagactgtatcaacagatcaaggcgggcgcctacgatttccccagccccgaatgggatactgtgacccccgaggccaaggatctcataaataaaatgctcacaatcaaccccgccaagcgcatcactgcctctgaggccttgaagcacccatggatttgtcagaggtctacagttgccagcatgatgcacagacaagagaccgttgattgtctgaaaaagttcaacgcgcgtcgtaagctaaaaggcgctatcttaaccactatgttggccactaggaacttctcagctgctaagagcctcctgaaaaagcctgacggcgtaaaggaatccactgagagctccaatacaaccattgaggacgaagacgtaaaggccagaaagcaggaaatcatcaaggtgactgaacagctgatcgaagctatcaataatggcgacttcgaggcatatactaaaatctgtgacccagggctgacagcctttgaacccgaagcactgggaaacctcgtggagggaatggatttccacaggttttatttcgagaacgccctgagtaagtctaataagcctattcataccatcatcctaaatcctcacgtccacctagtcggagatgacgcagcctgcatcgcctacataagactcacgcagtacatggacgggtcaggaatgcctaagacaatgcagagcgaggagactagggtttggcaccggcgcgacggcaagtggcagaatgttcattttcatcgtagtggttcacctactgtcccaatcaaatag

SEQ ID NO: 181296 - DNA, 1500 bp, Artificial Sequence
  Description of Artificial Sequence: Synthetic coding sequence
atggccagcaccaccacctgcacccggttcaccgacgagtaccagttgttcgaagaactcggcaagggggctttctcggtagtcagacggtgtatgaaaatacctactggacaggagtacgctgcaaaaatcataaataccaagaagttgtctgctagggaccatcagaagttggaacgggaagccagaatatgccgcctgctcaaacatccaaacattgtgcgcttgcacgacagcatctcagaggaaggatttcactatctggtgttcgatttagtcaccggcggtgagttgttcgaggacattgtcgctagggagtactactctgaggccgacgcgtcacactgtatccagcagattttagagtctgtgaaccattgccatctgaacggcatagtccaccgcgatctcaagcctgagaatctcctgcttgcatcaaagtcaaaaggagcggctgtcaaacttgccgatttcggcctggctattgaggttcagggggaccaacaggcctggttcggctttgccggcacacccggttatttgtctccggaagtactgaggaaggacccatatgggaagccagttgatatgtgggcctgtggcgtcattctgtacattctattggttggatacccaccattctgggacgaagatcagcacagactttaccaacaaatcaaagccggtgcttacgactttcccagccccgagtgggacaccgtgactccagaggcgaaagatttaatcaataaaatgctcaccattaacccagccaaaaggattaccgcctccgaggcccttaagcacccgtggatctgccagagatcgactgtcgcatctatgatgcataggcaggaaacggtggactgccttaaaaagtttaatgcccgccgaaagctcaaaggcgccatactgaccaccatgttggcaactagaaattttagtgccgcaaaatctctgctcaaaaaacctgacggcgtgaaggagtctaccgagtcaagcaacaccaccatcgaagacgaggacgtcaaggctaggaaacaggaaatcatcaaggtgaccgaacagctgatcgaagccattaacaacggagatttcgaggcctatacgaagatctgcgaccctgggctcacagcctttgagccggaagcacttggcaacctcgtcgagggcatggattttcatagattctattttgaaaacgcactctctaagtctaacaagcccatccacacaatcatattgaatccacacgtgcatcttgtcggtgacgatgccgcatgcattgcctatataagattaacacagtatatggacggatccggaatgcctaagacaatgcagagtgaggaaaccagggtctggcacaggagggacggtaaatggcagaacgtccattttcaccggtctggctcgcctaccgttccgattaagcctccttgcatacccaatgggaaggaaaacttctccggaggaacctccctctggcaaaacatatag

SEQ ID NO: 181297 - DNA, 1437 bp, Artificial Sequence
  Description of Artificial Sequence: Synthetic coding sequence
atggccagcaccaccacctgcacccggttcaccgacgagtaccagctctttgaggagcttggtaagggggccttttccgtagttcgccgttgtatgaaaattccaactggacaggagtatgccgctaaaattatcaatacaaaaaaactttctgcacgggaccatcagaagctagaacgcgaagcccgtatctgtaggctgctgaaacaccccaatatagtgaggctgcacgattcaatcagcgaggagggattccattacctggtgtttgatctcgttactggaggggaactgttcgaggacattgtcgcaagggagtattatagcgaagcagacgccagccactgcatccaacaaatcttggagagtgttaatcattgccacttgaacggcattgtgcacagggatttgaagcccgagaatctgctgctcgcttctaaatccaagggcgctgccgtgaaactggctgattttggcctggctatagaggtgcagggcgaccagcaagcgtggttcggattcgccggaacccctggctatctgagcccagaagtgctcagaaaagacccctacggaaagccggtggatatgtgggcttgtggagtgatcctttatatactgttagtgggatacccccctttctgggacgaagatcagcaccgtctgtaccagcaaatcaaagcaggagcttacgatttcccctcccccgaatgggacacggtaacccctgaggctaaggacttgatcaataaaatgctaaccatcaatcccgctaagagaattactgcatccgaagcccttaaacacccctggatttgccagcgctccacagttgcgagtatgatgcatcgacaggaaaccgtcgattgtctgaaaaagttcaatgctcggagaaagctaaagggcgcaattctgacaacaatgttggcgacacggaattttagcgccgctaagagcttgctgaagaagcccgacggggtaaaggaatctaccgagtccagcaatactaccatcgaggatgaggatgttaaagcccggaaacaggagatcatcaaggtgacggagcaacttatagaagccattaacaacggcgacttcgaagcctatacaaaaatatgcgatcctggcttgacagctttcgagcccgaggccctcggcaatctcgtggagggaatggacttccatagattttacttcgagaatgcgctgtcaaaaagtaacaagccgatacacactattattctgaatccccacgtgcatctcgtgggggatgacgctgcctgtatcgcctatattcggctgacgcagtacatggatggaagtgggatgccgaagaccatgcagagcgaggaaactagggtgtggcatagaagagatggcaaatggcaaaatgtgcattttcaccgctcaggatcccctactgtccctatcaaatag

SEQ ID NO: 181298 - DNA, 1479 bp, Artificial Sequence
  Description of Artificial Sequence: Synthetic coding sequence
atggccagcaccaccacctgcacccggttcaccgacgagtaccagctctttgaagagctgggtaagggcgctttttcagtggtgcgtcggtgcatgaagatccccaccggccaagagtacgctgcaaagattatcaacaccaagaaactgtccgcaagggatcaccagaaactggaacgcgaagcaaggatctgccgactgttgaagcatccaaacatcgttaggctacatgactcaatcagcgaggaaggctttcattatctggtctttgacttagtcaccggcggcgaactctttgaggacattgtggcgcgggagtattactcggaggcagatgcaagccactgcatccagcagattctcgagagtgtgaaccactgccaccttaatggcatcgtccatcgggatctgaaaccagagaacttactgctcgccagtaagtctaaaggagccgctgttaagttggcagactttgggctggcaatcgaggtgcagggggaccaacaggcatggttcggattcgcagggacaccagggtatctgtcaccagaagtcttacgcaaagacccttacggcaaacctgtggatatgtgggcatgcggcgtaatcctttatatcttgctggtaggctatccaccgttttgggacgaggaccagcaccgcctgtaccaacagattaaggccggagcgtatgattttccctcaccagagtgggacactgtaactcctgaggctaaagatcttatcaataaaatgctgaccattaatcccgccaaacgcatcaccgcgtctgaggccttgaaacacccatggatctgccagcgctccacagtcgcttctatgatgcatagacaggaaactgttgactgtctgaagaaattcaatgccaggcggaagctgaagggagcaatcctgactactatgttagcaacgcggaatttcagtgccgccaagtccctcctcaagaaaccggacggcgtgaaggaaccccagaccactgtgatccataaccccgatggcaacaaggaatccactgaatcttctaatactacgatcgaagacgaggacgtgaaagctcgtaaacaggaaatcatcaaagtgacagagcagctcatcgaggccattaataatggagacttcgaggcttacaccaagatctgtgaccctggactgacagcgtttgagcccgaggccttaggaaatctcgtggaggggatggactttcaccgattctactttgagaatgcactttcaaaatcaaataaacccatccatacaatcatcctgaatccacatgtacacctggttggggatgatgccgcttgtattgcctacataaggctaacccaatatatggacggtagtggcatgcctaagactatgcagtccgaggagacacgggtttggcaccgtagagacggcaaatggcaaaatgtgcacttccatagaagcggcagccccactgtgcccatcaagtag

SEQ ID NO: 181299 - DNA, 1533 bp, Artificial Sequence
  Description of Artificial Sequence: Synthetic coding sequence
atggccagcaccaccacctgcacccggttcaccgacgagtaccagttgttcgaggaactcggaaaaggagcttttagtgtggttcgccgttgcatgaagatcccgacaggccaggagtatgctgctaaaatcattaatactaagaagttgtccgctagagaccatcagaaactagagcgggaagctagaatttgcagattgctgaagcatccaaacatcgtccgcctgcatgatagcatttcagaggagggcttccactacctggtgttcgatctcgttaccgggggcgagctgtttgaagatattgtggctcgcgaatactactctgaggctgacgcctcccactgcatacagcagatcctggagagcgtgaatcactgccaccttaatggaatcgtgcatagggaccttaaaccggagaatttgctgcttgcaagtaaatccaagggggcggctgtgaagctggccgatttcgggttggccatcgaagtccaaggtgatcaacaggcttggtttgggtttgctggcactcctgggtacttaagccccgaggtcctgcgcaaggacccatacggcaagcctgtggacatgtgggcctgcggcgtgatcctgtacatccttttagtgggttatccgccattttgggacgaagaccagcatagactctatcaacagattaaggccggagcgtatgatttcccgtcaccagaatgggacacggtgacgccggaggccaaagacctgataaacaagatgctgaccatcaatccagcgaaaagaataacagcaagcgaggccctaaaacacccttggatctgtcagcgaagcacggtggctagtatgatgcacaggcaggagaccgttgactgtctcaaaaaatttaatgctcgtcgtaaactgaagggcgcaatactgaccaccatgcttgcaaccagaaacttttctgcagctaaaagtcttttgaagaagcctgatggagtgaaaaaaagaaagagtagcagttctgtgcaaatgatggagtcaacggagtccagtaacaccacaatcgaagatgaggatgtcaaggcacggaagcaggaaatcatcaaggtcaccgaacagcttatcgaggctattaataacggggacttcgaagcatacactaagatttgtgaccctggccttacagcttttgaacccgaggccctgggcaatcttgtagagggcatggactttcaccgattttacttcgagaacgctctgagtaagtcaaataaacctatccatacgattattcttaatcctcacgttcacctggtgggggacgacgcagcctgtattgcatatattcgcctcacgcagtacatggatggcagtgggatgccgaagacaatgcaaagcgaagagacacgcgtatggcataggagggacggaaaatggcaaaacgtgcattttcaccgttccgggagtccaacggtaccaatcaagcctccatgcatccctaacggaaaggaaaactttagcggcggaacttcactatggcagaacatatag

SEQ ID NO: 181300 - DNA, 1542 bp, Artificial Sequence
  Description of Artificial Sequence: Synthetic coding sequence
atggccagcaccaccacctgcacccggttcaccgacgagtaccagctgtttgaggaacttggaaagggggctttcagcgtggtcagaaggtgcatgaaaattccaaccgggcaggagtacgccgcaaaaatcattaacacaaagaagctgagcgcaagggaccaccagaagcttgagagggaagcccgtatttgccgattgctgaaacaccccaacattgtgagactgcacgactctatcagcgaagaagggtttcattacttggtgttcgacctcgtgacaggcggcgagctctttgaggatatcgttgccagggagtattactcagaagctgatgcgagtcattgcatccagcaaatactggaaagtgtgaatcattgccaccttaatggcatagtacacagggacttaaagccagaaaacctgcttctggccagtaagagcaaaggagccgcagtcaagttggcagattttgggcttgcaatagaggtgcaaggggatcagcaggcctggttcgggttcgcggggacgccaggctacttgagccccgaggttctgaggaaggacccctacggaaaacccgtcgacatgtgggcttgtggtgtcatactgtacatcctgctggttggctatcctcccttttgggacgaagaccagcataggctctatcagcaaataaaggccggcgcttacgacttcccaagtcctgagtgggacactgtgactcctgaagctaaggacttgatcaacaaaatgttaacgattaacccagctaagaggatcactgccagtgaggcgctgaagcacccctggatatgtcagcgatctaccgtggcctccatgatgcacagacaagaaactgtggactgtctcaagaagtttaatgctcgccggaagctgaaaggtgctattttgacgacgatgctggccacacgtaatttctcagctgctaaatctttgctcaaaaagccggacggagtcaaagagccacagaccaccgttatccacaatccggatggaaataaggaatccacagaaagttcaaacacaactatcgaagacgaggacgtcaaggcacgtaagcaggaaataatcaaagtgaccgaacagctgattgaagccatcaacaacggtgactttgaggcatatactaagatttgtgatcctggcctgacggcctttgagccggaggcgctcggcaacctggtcgagggaatggatttccacaggttctatttcgagaacgcactctccaaatcgaataagccaattcatacaatcatactcaatccccacgttcacctcgtgggcgacgatgctgcatgcatagcttatatccggctgactcagtacatggacgggagtggcatgcctaagaccatgcaaagtgaggagactcgggtgtggcaccgaagggacggaaagtggcagaatgtgcactttcatcggtctggctcccccacagtgccaataaaacccccttgtataccaaacggcaaagaaaactttagcggtgggacttctctatggcaaaacatttag

SEQ ID NO: 181301 - DNA, 1560 bp, Artificial Sequence
  Description of Artificial Sequence: Synthetic coding sequence
atggccagcaccaccacctgcacccggttcaccgacgagtaccagctttttgaggaactcggaaaaggggccttttctgtggtgcggcggtgtatgaagatacctaccggacaggagtatgctgctaagattattaacactaagaagctcagcgccagagaccaccagaaactcgaacgggaggccagaatatgtagactcttgaaacaccctaatattgtgcgtcttcacgactccatttctgaggaaggtttccattacctcgtctttgatctggttacaggcggggagctctttgaagatatagtggctcgggaatattacagcgaggccgatgcctcacactgtatacagcagatcctcgagtctgtgaaccactgtcacctgaacggaatcgttcatagggatctgaaacccgagaatctcctgttggcatctaagagtaaaggcgctgccgtgaaactagctgactttggattggcaattgaggtgcagggagatcagcaggcatggtttggattcgccggtaccccgggttacctcagccccgaggttctgaggaaggacccttatggcaaacctgtggacatgtgggcctgcggagtgatcctatacatcttgctcgtgggctacccccctttctgggatgaagatcagcatcggctttatcagcagatcaaagcaggggcatacgactttcctagccccgagtgggacacggtgacaccagaagcgaaggatttaattaataaaatgttgaccatcaaccccgcaaaacggataactgcatctgaggccctgaaacacccttggatctgtcagcgctcaaccgtggcgtctatgatgcatcgacaggagacagtggattgtctgaagaagtttaatgcccggaggaagttgaaaggtgctatcctaacaaccatgctagccactcggaacttttccgccgccaagagcctgttaaagaaaccagatggagtcaaaatcaataataaggccaacgtcgtgaccagcccaaaagagaatatccccactcctgcccttgagagtaccgagagtagcaacactaccattgaggatgaagacgtaaaggcacgaaagcaagagattattaaagtcacagagcaacttatcgaggcaataaataatggcgactttgaagcttataccaagatttgcgacccaggtctaactgcctttgagcctgaggccctgggcaacctcgtcgaaggtatggacttccatagattttattttgagaatgccctgtctaagtcaaacaaacccattcacaccattatccttaatccccacgtgcatttagtaggtgacgatgctgcctgcattgcatatatacggctgacccagtacatggatgggtccggtatgcccaaaacaatgcaatccgaggagacccgggtgtggcacaggcgcgacggcaaatggcaaaatgtacacttccataggtctgggtcacccactgttcctatcaaacctccatgtataccgaatgggaaggaaaattttagcggcggaacgtctctgtggcagaacatttag

SEQ ID NO: 181302 - DNA, 1575 bp, Artificial Sequence
  Description of Artificial Sequence: Synthetic coding sequence
atggccagcaccaccacctgcacccggttcaccgacgagtaccagctattcgaggagctcggcaagggcgctttctccgtggtgcgaaggtgtatgaagatccccacagggcaagaatacgccgcaaaaataataaatactaagaagctatcagcgcgagaccaccagaaacttgaaagggaagccagaatctgtaggttgttgaagcacccaaacattgtgcggctgcatgacagcatttctgaggaaggatttcactaccttgtattcgacctggtgactggaggtgagctgtttgaagacattgtggcacgcgagtattattctgaggcggacgcaagccactgcatacaacagatcctggagagtgtgaatcactgccatctgaacggcatcgtgcatcgggatctcaagcccgagaacctgctcctggcctcaaaatctaaaggggcagctgtcaaactggctgactttgggctcgccattgaggttcagggcgaccagcaggcttggtttggctttgcaggaaccccaggatatctgtctccagaagtcctgaggaaagatccttatggtaagcccgtggacatgtgggcgtgcggcgtcatcctgtacattttactggtgggctatccccctttttgggatgaggaccagcatcgcttgtatcagcagattaaagcgggggcctatgacttccctagccctgagtgggatacggtaaccccggaagccaaagaccttattaacaaaatgctgactatcaatccggcgaagagaattaccgctagcgaggccctcaaacatccgtggatctgccaacggtcaaccgttgcctccatgatgcaccggcaagaaaccgttgactgcttgaagaagttcaacgcccgcagaaagttaaaaggagcaatcctcactactatgctggccacacgcaatttctctgctgccaaatccctcctaaagaaacccgatggtgtgaagaagcggaaaagctccagctccgtgcaaatgatggaacctcagaccactgtaatacataaccccgatgggaataaggagagcacagagagcagcaataccactatcgaagatgaggacgtgaaagctaggaaacaggagatcatcaaagtcacagagcagttgatcgaagcgatcaataacggagattttgaggcatacaccaaaatctgtgaccccgggctaaccgccttcgagccagaggcactcgggaacctggttgagggaatggattttcaccgattttatttcgagaacgcactttctaaaagcaacaagccgatccacacaattattctcaaccctcacgtccacttggttggcgatgatgccgcatgtatagcctacataagactcacccagtacatggatggatccggtatgcccaaaacgatgcagagcgaggaaacccgggtttggcatcggagagatggtaagtggcaaaacgtgcattttcatagaagtggcagtccgaccgttcccatcaagcctccttgcatccccaatggtaaggaaaactttagcggcggaacaagcctgtggcaaaatatctag

SEQ ID NO: 181303 - DNA, 1470 bp, Artificial Sequence
  Description of Artificial Sequence: Synthetic coding sequence
atggccagcaccaccacctgcacccggttcaccgacgagtaccagctcttcgaagagttagggaagggcgccttttctgtggtgcggagatgtatgaagatacctaccggccaggaatatgccgcgaaaattattaacacgaagaaactctcagcacgggatcatcagaaactggagagggaggctagaatttgccgcctgctgaaacatccgaatatcgtacggctgcacgactccatatcagaagagggattccactatcttgtgtttgatcttgttaccggaggcgagctttttgaggacattgtggctcgggagtactactcagaagcagatgctagccactgcatccagcagatcttagagagcgtgaaccactgtcaccttaatggcattgtccaccgggatctgaagcccgagaatctgctgctagcgagcaaatctaagggagccgccgtgaaacttgccgacttcggtttggcaatagaagtgcagggcgatcagcaggcctggtttggcttcgccggcaccccaggctacctatcaccagaggtgctgagaaaggatccttacggcaagcctgtagacatgtgggcctgcggagtcatcctgtatattctgctggtcggttaccctcctttctgggacgaggatcagcaccgcctatatcagcagataaaggccggggcatacgattttccaagccctgagtgggacacagtcacacctgaggcgaaagatctgattaataagatgctgactatcaatcctgccaagagaattacggctagcgaggcgttgaagcacccctggatctgccagcgctctactgtggcttcaatgatgcataggcaggagaccgtggactgcctgaagaaattcaatgcaaggcgaaagctgaaaggcgcaatactgaccactatgttagccacaagaaatttctcagcagccaaatccctgctcaaaaagcctgacggcgtgaagaaacgtaaatcctctagttcagttcagatgatggaatcaacagagtccagcaacacgacaatcgaggatgaggacgtgaaagctagaaaacaggaaattatcaaagtcactgagcagctaatcgaggccattaataacggcgactttgaggcctatacaaagatctgtgatccaggcctgacagccttcgagcccgaggcactcggaaatctagtagaaggcatggactttcataggttctacttcgaaaacgccctctctaagtcaaataagccaattcacacgatcatactgaacccccacgttcacttggtgggcgatgacgctgcctgtatagcttacatcaggctgacccaatacatggatgggtccggcatgccaaaaaccatgcagtcagaggaaacacgcgtctggcacagacgcgacggcaaatggcagaacgtgcacttccatcgttctggcagcccaaccgtcccaatcaagtag

SEQ ID NO: 181304 - DNA, 549 bp, Artificial Sequence
  Description of Artificial Sequence: Synthetic coding sequence
tgacggaagctgaagggcgccatcctgaccaccatgctggccacccggaacttctcagctgctaagtcacttctgaagaaacctgacggggtgaaggaaagcactgagtcttcaaatactacgatcgaggacgaggatgtgaaggcccggaaacaagagatcattaaggtgacagagcaattgatcgaggccattaacaacggcgacttcgaggcctacactaaaatctgcgaccccgggctgaccgccttcgaacctgaagcgttgggcaaccttgtggagggaatggacttccacagattttactttgagaatgctttatccaagtctaataaacctattcacaccataattcttaatccacacgtgcatctggttggagacgacgccgcttgtattgcctatatcagactcacacaatacatggatggatcgggcatgcctaaaactatgcaatcggaagagacgcgcgtatggcataggcgtgacggaaagtggcaaaatgtgcacttccatcgttctggatcccccacagtcccaatcaagtag

SEQ ID NO: 181305 - DNA, 1437 bp, Artificial Sequence
  Description of Artificial Sequence: Synthetic coding sequence
atggccagcaccaccacctgcacccggttcaccgacgagtaccagttgttcgaggagctgggaaaaggtgcattttccgttgttaggagatgcatgaaaattccaacgggacaagaatacgcagctaagataattaacaccaagaagcttagcgctagggaccatcagaaattggagagagaagcgcgtatctgcagacttcttaaacatcccaatattgtgcggctccatgattcaatctccgaagaaggcttccactacctggtgtttgacctcgtaacaggaggagagctctttgaagatatcgtggcccgggaatattactctgaggccgatgcctcccattgtattcagcagatccttgagtccgtgaaccactgccacttaaatggcatagtccaccgcgacctgaagcctgagaacctgctgttggcctccaagtcgaaaggtgcggccgtcaaattagctgacttcggcctggctattgaggtgcagggggaccaacaggcttggttcggatttgctggaactccgggttatctcagtcccgaggtcctccgcaaggacccttatggaaaacctgtcgacatgtgggcctgcggtgtgatattatacattctgctggtgggttatcctcccttttgggacgaggaccagcaccgattgtaccagcaaatcaaggcaggagcatacgacttcccttcacccgagtgggacaccgtgaccccagaggcaaaagatctaatcaataagatgcttacaattaatcctgccaagaggatcacagcatcagaggccctgaagcacccatggatatgccagcgcagtactgtcgcctccatgatgcacaggcaggagactgtggattgtctgaaaaaatttaatgctcggagaaaattgaaaggggcgatcctgaccaccatgttggccacccgcaacttctccgcagctaaatctcttctaaagaaaccagacggagtgaaagaatcaaccgagtcatccaatactacaatcgaagatgaagacgtgaaggcccgaaaacaagaaattattaaggtgacagaacaacttatcgaggccataaataacggagacttcgaggcctataccaagatttgcgatcctgggctgacagcctttgagcccgaagctctagggaatctggttgaggggatggattttcataggttctatttcgagaatgcactgagcaagtctaataagcccattcataccatcatcttgaatccccatgtacacttggtaggtgacgatgccgcctgtatcgcctatattaggctgacccagtatatggacggaagcggcatgccaaaaacaatgcagtcagaggagaccagggtgtggcatagacgcgacggcaaatggcagaatgttcattttcaccgcagcgggagccctacggtgcccatcaactag

SEQ ID NO: 181306 - DNA, 1590 bp, Artificial Sequence
  Description of Artificial Sequence: Synthetic coding sequence
atggccaccaccgccacctgcacccggttcaccgacgactaccagctgtttgaggagctgggaaagggagcttttagcgtagtgcgacgctgtgtgaaaaagaccagtacccaagagtatgctgcaaaaataattaatacaaagaaactgtccgctcgcgaccatcagaagctggagcgcgaagctcgcatttgccgtctcctcaaacaccccaacatcgtgcgtctgcacgactctatcagcgaggagggattccattacctggtgttcgacctggtaaccggaggcgaactcttcgaagacatcgtggctagggagtactatagtgaagcggacgccagtcactgtattcatcagatcctcgaatcggtcaatcacatacatcagcacgatattgttcatcgggatctcaaacccgagaatctgcttctggcttccaaatgcaaaggcgcagcggttaagctggcagatttcggcctcgcaatcgaagttcagggtgagcagcaggcctggtttgggttcgctggaactccaggatacctctcgcctgaagttctgcgaaaggacccgtatggaaaacctgtagacatctgggcctgtggtgtgattctgtatatacttctggtagggtaccccccattttgggatgaggaccaacacaagctgtaccagcagatcaaagctggagcctacgactttccatcaccagagtgggacacagtgacccccgaggccaaaaacctaatcaaccagatgctcaccattaaccctgccaagagaataactgcagaccaagcgttaaagcacccttgggtgtgccaacgcagtacagtggcctccatgatgcacagacaggaaactgtggagtgcttgaggaagttcaatgccagacggaagctgaaaggggccatcctcacaacaatgcttgtgtccagaaacttttccgctgccaagagtttattgaataaaaagtcagacggaggagtcaaaaaacgtaagtcctcttcatccgtgcatttgatgcctcagagcaacaacaaaaattcgctcgtatcacctgctcaggagcccgccccactccagacggccatggaaccacagacaacagtagtccataatgccacagatgggattaagggatccaccgagtcatgtaacacgactactgaggatgaagacctgaaagttagaaagcaggaaatcattaaaattactgaacagttaattgaggccattaacaatggggattttgaggcctacaccaaaatttgcgatcctgggctaacatcatttgagcccgaggcgttaggtaatctggttgaaggcatggactttcacaagttttatttcgagaacttgttatcaaagaacagtaagcctatccacacaaccatattgaatcctcatgttcacgtgattggggaggacgctgcatgcatcgcctatatccgtctcactcagtatattgacgggcagggaaggcctaggacatcgcagtcagaggaaacccgcgtgtggcatagacgggacggcaaatggctcaacgttcactatcactgttccggcgcacccgccgccccgttacagtag

SEQ ID NO: 181307 - DNA, 1584 bp, Artificial Sequence
  Description of Artificial Sequence: Synthetic coding sequence
atggccaccaccgccacctgcacccggttcaccgacgactaccagttgtttgaggagttgggtaaaggggcgtttagtgtggtccgtaggtgcgttaaaaagactagtacccaagagtatgctgccaagatcatcaacacgaagaagttaagtgccagagatcatcaaaagctggaacgggaggccagaatttgcaggctgctgaaacatcccaacatcgtccgcctgcacgacagcataagcgaggagggattccattaccttgtctttgaccttgtcaccggaggggagctgttcgaggacattgtagctcgcgagtattacagtgaagccgatgcatctcattgcatacatcaaatccttgagtcagttaatcatatccaccagcacgacatcgtccaccgtgacctgaagcccgaaaatttgctcctcgcttctaaatgtaaaggggcagcggttaagctcgcggatttcgggctggcgatagaagtccagggagagcagcaggcatggtttggcttcgccggtacgccaggctacctctctccagaggtgctgcgtaaggacccctacggtaaaccagtggacatctgggcttgcggggtcattctgtacatcttattagtcggatacccacctttttgggatgaagaccagcacaaactttaccagcagattaaggcaggtgcatatgatttcccctcacctgagtgggataccgtgacccccgaggccaaaaaccttatcaatcagatgttgactataaatcccgcaaaaagaataactgccgatcaggctctcaaacatccctgggtctgtcaacggagcaccgtcgcttccatgatgcatcggcaggaaaccgtggagtgtctaagaaagttcaacgccaggcgcaaactaaagggtgccatccttactacaatgctggtttcccgcaatttctccgtaggacgacagtcttctgcccccgcaagccctgctgcctcagccgccggtcttgccggacaggcagcaaagtccctgctcaataagaagagtgacgggggcgtgaagaagagaaaatccagctcctctgtgcatctcatggagccgcagactactgttgtccacaacgctaccgacggaatcaaagggagtaccgagagctgcaatactaccactgaggatgaggacctaaaggtgcgaaaacaagagattataaaaatcaccgaacagcttattgaagctatcaacaacggagactttgaagcgtataccaaaatctgtgatcccgggctcacctcctttgagccagaagcactcggcaatctggtcgagggcatggatttccacaagttttacttcgaaaacctgcttagtaaaaactccaagccaatccacaccaccattctgaacccccacgtacacgtgattggtgaggacgcagcctgcattgcatatatccgattaacccagtacatcgacgggcagggacggcctcggacgtctcaaagcgaggaaacgcgagtctggcataggcgggacggcaagtggttaaatgttcattaccactgctctggtgcccccgctgccccactgcaatag

SEQ ID NO: 181308 - DNA, 1671 bp, Artificial Sequence
  Description of Artificial Sequence: Synthetic coding sequence
atggccaccaccgccacctgcacccggttcaccgacgactaccagctttttgaagagctggggaagggagccttctcagttgtgagacggtgtgtgaagaaaaccagtacccaggagtacgcagcaaaaattatcaacacaaagaagctttctgcccgtgatcatcaaaaattggagagagaagcgcggatctgtaggctactcaagcatccaaacatagtgcggctccacgactcgatatcagaagagggtttccattacctggtgttcgatttagtcacagggggagaacttttcgaggacatcgtagcccgagaatattactctgaggccgacgcatcgcattgtatacaccagatcctggagagcgtgaatcatatccaccagcacgatatagttcacagagatctgaagcccgagaacctgttactcgccagtaagtgtaaaggcgcagccgtgaaactggctgactttggacttgctattgaggtacagggggagcagcaggcttggtttggcttcgccggtactcctggctacctcagccccgaggtgctgcgcaaagacccatacggcaagcctgtcgatatctgggcctgcggcgttattctctacatcctgcttgttggctacccccccttctgggatgaggatcagcacaaactgtaccaacagattaaggcgggcgcctatgattttccctcacccgagtgggatacagtgacccccgaagctaaaaacctgataaatcagatgctgactattaacccagccaaaagaattaccgccgatcaggccctgaaacacccttgggtttgtcagaggtccaccgtggcttctatgatgcacaggcaggagaccgttgaatgtctccgcaaattcaatgcacgacggaaactcaaaggggcgatattgacgaccatgctcgtgagccggaatttctcagcagcaaaatccctcctcaacaaaaagagcgatggaggagttaagcctcagtctaataacaaaaatagtcttgtgtcccccgcccaggagcccgctccattgcaaacagcgatggaacctcaaacgaccgtcgtccacaatgccaccgacggaataaagggatccactgaatcctgtaacaccactacagaggatgaagatcttaaggcagcaccactgcgcacaggaaacggttcatccgtgccggagggacgttcgtcgcgcgaccgtaccgcaccttccgctggcatgcaaccccagcctagcttgtgttcctcggccatgcgcaaacaggagatcattaaaatcactgaacagctgatcgaggctattaacaacggagattttgaggcttatactaagatttgtgacccaggccttacttccttcgagccagaggccttgggaaacttggtggaaggcatggattttcacaaattctacttcgaaaacctgctaagcaaaaatagcaagcccattcatactaccatcctcaatcctcacgttcatgtgatcggcgaggatgcagcatgcatcgcatatatcagactgacccagtacattgacgggcagggacgcccaaggaccagtcagagcgaggagactagggtctggcaccggagggatggaaagtggctgaacgtgcactatcactgttctggcgcgccagctgctcccttgcagtag

SEQ ID NO: 181309 - DNA, 1488 bp, Artificial Sequence
  Description of Artificial Sequence: Synthetic coding sequence
atggccaccaccgccacctgcacccggttcaccgacgactaccagctgtttgaagagctcggaaaaggagctttcagtgttgtccgacgctgcgtgaagaagacttccactcaagaatacgccgccaagataattaatactaagaaactgtccgcacgggaccaccagaagttagaaagggaagccagaatctgccggcttctcaaacatcctaacatcgtccgcctgcacgattctatctccgaggaaggctttcactacttggtcttcgacttggtgaccggaggagagttatttgaagacatcgttgccagagaatattactcagaggcggatgctagccactgtattcaccagatcctggagtccgtgaaccatatccatcagcacgatatcgttcatagggatctgaagcctgaaaatctgcttttggcgtctaagtgcaagggagccgctgtgaaattggccgattttggtttagcgattgaggtccaaggggaacaacaggcctggttcggctttgccgggacccccggatatttgtctcctgaggtgttacgtaaggatccctatggaaaaccggtggatatttgggcgtgcggcgtcattctttacatactgctggtgggatacccccccttttgggatgaagaccagcacaagctctaccagcagataaaggccggagcctacgacttcccttctcccgaatgggacactgtgactcctgaagcaaagaatctgatcaatcagatgctgacaataaatcctgcaaaaagaatcaccgcggatcaggctttgaagcacccatgggtgtgccaaaggtctaccgtcgcatccatgatgcacagacaggaaactgtggagtgtctgcggaagtttaacgctcggaggaagctgaagggagctatcctgaccaccatgctggtgagtagaaacttttccgctgctaaatctctactgaacaagaaaagtgacggtggcgtgaaggagccccagacaacagtggttcacaacgccactgacgggatcaagggttcgaccgaaagctgcaacaccacaacggaggatgaagatctgaaggtgcggaagcaagaaattattaaaattactgaacaactcatagaggctatcaataacggcgattttgaagcttataccaaaatctgtgatcccggtctgacatccttcgagcctgaggcgctgggcaatctggtagagggcatggatttccacaagttttactttgagaacctgctgagcaaaaattcaaaacccatacacaccacaattctgaaccctcatgttcacgtcataggcgaggacgccgcctgcatcgcctacattcggttgactcagtatatagatggccaagggagacccagaacaagtcagtctgaagaaacgagggtgtggcatcgtcgagacggaaaatggctaaatgttcactaccattgtagcggggcacccgccgcccccctccagtag

SEQ ID NO: 181310 - DNA, 1551 bp, Artificial Sequence
  Description of Artificial Sequence: Synthetic coding sequence
atggccaccaccgccacctgcacccggttcaccgacgactaccagctgttcgaagaactcggtaaaggagctttctccgtcgttcggaggtgtgtcaagaagacttctactcaggagtatgccgcaaaaatcatcaatacgaagaaacttagcgctcgcgaccaccaaaagctcgagagagaagcccggatctgtagactcttgaagcaccctaatatcgtcaggctccatgacagcatttccgaggagggattccactatctggtcttcgatttggtgacgggtggagagctgttcgaggacatcgtcgcacgagagtactattcagaagcggacgcctctcactgcatccatcaaatcctggagagcgttaatcatatccaccaacacgatatcgtgcatagggatcttaaacccgagaacctgctcctggcctctaagtgcaaaggagccgcagtcaagctcgccgatttcgggctcgccatcgaagtgcagggagagcaacaggcatggttcggtttcgctggtacgccgggctatctgtctcccgaggtgctgcgcaaggatccgtacgggaaacccgttgatatctgggcatgtggcgtcatcttgtatatattgctcgtcggttatccacccttttgggatgaggatcagcacaaattgtatcaacagatcaaggcaggagcctacgactttccatcccccgagtgggacaccgtgacccctgaagccaagaatttaattaatcagatgttgactataaacccagccaaacgcataacggctgatcaggcactgaagcacccttgggtttgccagcggtccacagtagcaagtatgatgcaccgccaggaaacggtggaatgccttcgcaaatttaatgcaagacgcaaattaaagggcgccatcctgacgacaatgttggtttcccgaaatttcagtgtgggccgacagagcagcgcccccgcttccccagccgcatctgccgccgggctggcaggacaggcggctaagtcgctcttgaacaaaaagtctgacgggggcgtcaaagagccgcagaccactgtggttcacaatgctacagatgggatcaagggctcgacggaatcttgcaacacaacaactgaggatgaagaccttaaggttcgcaagcaggagatcataaagatcactgaacagctgattgaagcaatcaataatggagattttgaggcctacacaaagatatgcgatcctgggctcaccagctttgagcccgaggccctcggcaatttagtggaggggatggactttcacaagttctacttcgagaacctactgtctaaaaattccaagcccatacatactacaatactgaatcctcacgttcatgtgatcggggaagatgcagcctgcatagcatacattcgtcttacccagtatatcgacggacaaggaaggcctaggacaagccaatcggaggagacccgcgtgtggcaccgacgcgacgggaagtggcttaatgtacattaccactgttcaggcgctccagctgccccactccagtag

SEQ ID NO: 181311 - DNA, 1602 bp, Artificial Sequence
  Description of Artificial Sequence: Synthetic coding sequence
atggccaccaccgccacctgcacccggttcaccgacgactaccagctgtttgaggagctgggcaaaggggcattctccgttgtgaggagatgtgtcaagaaaacgagtactcaggagtatgctgctaagattattaataccaagaaactgtctgcccgggaccatcagaagctggagcgcgaagccagaatctgcagattactcaagcatcctaacatcgtacggttacacgacagcattagcgaagaagggttccactacttagtcttcgatctggtgacagggggggagctctttgaggacatcgtcgcccgggaatactactcagaagcagacgcgtcccactgcattcatcagattttggaatcggtgaaccatattcatcaacacgatattgtgcacagagatttgaagccggaaaacttgcttctggcctctaaatgtaagggggcagcggtgaagctagcagattttggtctcgcaatagaagtacagggggagcagcaggcctggtttggtttcgccggaactcccggatatctctcccctgaggtcctgcgaaaggatccttatgggaagccagtggatatctgggcctgtggcgttattctgtacatcctacttgtgggctatcctcctttttgggatgaagaccagcacaagttgtaccaacagatcaaggccggggcgtatgattttcctagtcctgagtgggacactgtgacgcctgaggcaaagaacttgatcaaccagatgctgactattaatcctgccaagcggatcacagccgatcaagcactcaaacacccgtgggtttgtcagagatctactgttgcctccatgatgcatcgccaggaaaccgtggagtgtctgcgaaaattcaatgctcggaggaaattgaaaggcgccattctcacaaccatgctggtgagtaggaacttttccgccgccaagagtctgcttaataagaaatctgacggcggtgtcaaggagccacagactaccgtcgtgcacaacgcaacagacggtatcaagggatccaccgagtcctgcaataccacaaccgaggacgaagatctcaaggccgcacccctgcgtactggcaacggtagctccgtgcctgaaggccgatcctctagggacagaaccgcaccctccgcagggatgcagccccagccatcactctgtagctctgccatgaggaaacaagagattataaagattactgagcagctcatcgaagccattaataatggcgactttgaggcctacacaaaaatttgtgatccaggcttgacatcctttgaacctgaggctctcggcaacctggtcgagggtatggactttcataagttttacttcgaaaaccttttaagcaagaacagtaagcctatacataccactatactcaacccgcatgtccacgtaatcggcgaggacgcagcgtgcatagcctacattaggctaactcagtatattgacgggcagggaaggcccagaacatcacagtcagaagagaccagagtctggcacaggcgagacgggaaatggttgaacgtacactatcactgctccggcgcaccggctgcgcctctgcaatag

SEQ ID NO: 181312 - DNA, 1677 bp, Artificial Sequence
  Description of Artificial Sequence: Synthetic coding sequence
atggccaccaccgccacctgcacccggttcaccgacgactaccagctgttcgaagaactgggaaagggggcgttctccgttgtccgacggtgcgtcaaaaaaacctcaacgcaagagtatgcggccaagattattaatacaaaaaaattaagtgctagagatcaccagaagctcgagagggaggcccgaatttgtcggctgctgaaacatcccaacatagttagactgcacgattccatctccgaggagggatttcactacctggtgttcgacttagtcactggcggagaactgttcgaagatatcgtggcccgcgagtattactccgaagccgatgcttcccattgtatacatcaaatcctcgagagcgtgaaccacattcaccagcacgacattgtgcacagagacttgaagcctgagaacctgttactggccagcaaatgcaagggtgcagccgtgaaactggcggactttggtttagccatagaagtgcagggcgaacaacaagcgtggtttggcttcgccggaaccccaggatatctttcccctgaggtcctgagaaaagacccatatggtaagccggtggatatctgggcgtgcggtgtgatcctctacatcttgctggtgggctatccccccttctgggacgaggatcaacataaactgtaccagcaaataaaagccggagcctatgattttcccagccctgaatgggacactgtgacccctgaggctaagaatctcatcaaccagatgttgacaataaatccagctaaacgtattaccgctgaccaggctttgaaacacccgtgggtgtgccagcggtcaaccgtcgcctcaatgatgcatcgtcaggagacggtggagtgcctgagaaaatttaatgcacgcagaaaattgaagggggctatcctcactaccatgttggtttctcgaaacttttccgccgctaaatccttgctcaacaagaagagtgatgggggcgttaaaaagcgaaaatccagctcaagcgtccacctgatgcctcaatcaaataataagaattcgcttgtcagtcctgcacaggagcctgcccccctccagactgccatggagccacagaccaccgtggttcacaatgcaaccgatggaatcaagggcagcacagaatcttgtaacacgactactgaagatgaagatcttaagggtagcgtgcccgagggccgaagctcacgggaccgaaccgccccctcagccgggatgcagccccaaccgtctctgtgttcctccgccatgcgtaagcaggaaatcataaaaatcacagagcagcttatcgaagctattaacaatggcgacttcgaggcatacactaaaatctgcgatccggggttaacctctttcgaaccggaagccctgggcaacctagtagagggcatggacttccacaagttttacttcgaaaacctcctgagcaaaaattcgaagccaatacataccactatactcaatcctcacgtccacgttattggggaagacgccgcttgtattgcctacataaggctcacacagtacattgacggacagggtagacctcgtacttcacaatctgaggaaaccagagtctggcaccgacgcgacgggaaatggctgaatgtacactaccactgtagcggtgcccccgccgctccactgcagtag

SEQ ID NO: 181313 - DNA, 1767 bp, Artificial Sequence
  Description of Artificial Sequence: Synthetic coding sequence
atggccaccaccgccacctgcacccggttcaccgacgactaccagctcttcgaagaactcggcaaaggagcgtttagcgtcgtgcgcagatgtgtgaaaaaaaccagcacacaggagtacgctgcgaaaattatcaacacaaaaaagctttcagcgagagaccaccagaagctcgaacgggaggcccggatttgtagacttctaaagcacccgaacattgtccgcctgcatgactctatcagtgaggagggcttccactacctggtttttgacctggtgacaggcggtgaactatttgaagacatcgtggcaagagagtattactccgaagcagatgcctcccactgtattcaccagatcttggagtctgtgaatcatatccatcagcatgacatcgttcaccgcgaccttaagccggaaaatttactcttagcctcgaagtgtaaaggcgctgcggtgaaacttgccgacttcgggctggctatagaagttcaaggcgagcagcaggcttggtttggcttcgccgggacgcctggatatctgagcccagaggtgctgagaaaggacccctacggcaaacccgtggatatctgggcgtgcggtgtgattctctacatactgctggtcggataccccccattttgggacgaggaccagcataaactttaccagcagatcaaagcgggggcatacgatttcccatcccccgagtgggacactgttacacccgaagccaaaaacttaattaaccagatgctgactataaaccctgctaaacgcatcaccgctgatcaagccctcaaacacccctgggtgtgtcaacgtagcaccgtcgcttccatgatgcatcgtcaggaaaccgtcgagtgcttaaggaaattcaatgccaggaggaaacttaagggcgccatcctgacgacaatgttggtgtcacggaacttcagtgtaggacgccagtctagcgcgcctgcctcacccgccgctagcgccgctggcctggctgggcaggcagcaaaaagcctgttgaacaagaaatcggatggaggcgtcaaaaaaagaaagtccagcagcagcgtgcatttgatgccacagtctaacaacaaaaattccctcgtaagcccagcacaggagcccgccccactccagaccgccatggagcctcagactaccgttgtccacaatgcgaccgacgggatcaaaggctcaacagaaagctgcaacactaccaccgaggatgaggacctgaaagccgcacccctgaggactggaaatggttcctcagtgccagaaggaagaagttcccgtgacagaactgctccgtccgccggaatgcagccccagccctctctttgctcttcagcaatgcgtaagcaggagatcattaaaatcacagagcagctgattgaagcaattaataacggcgacttcgaggcctacacaaaaatttgcgatcccggactgacctcttttgagccagaagctttagggaacctggtggaagggatggacttccacaaattctactttgaaaatttgctgagcaagaacagcaagccaattcacaccactattctaaatccgcacgtgcacgtgataggggaagatgcagcttgcatcgcctatatccggctcactcagtatattgacggacaaggccgacctcgtaccagtcagagcgaggagacacgcgtgtggcacagacgagatggcaaatggctaaacgtccactatcattgctccggggcccctgccgcccccctccaatag

SEQ ID NO: 181314 - DNA, 1362 bp, Artificial Sequence
  Description of Artificial Sequence: Synthetic coding sequence
cggctgctgaagcaccccaacatcgtgcggctgcacgacagcatctcagaggaggggtttcattatctcgtcttcgatctcgtaaccggcggcgagctatttgaggatatcgtggcacgggaatattatagcgaagccgacgcaagccattgcatccaccagatcctcgaaagcgttaatcatatccatcagcatgacatcgttcacagggacctcaagccagaaaacctgctgctggcctccaagtgtaagggagccgcggtgaagcttgcggacttcggcttggccatagaggttcaaggagaacagcaggcttggttcggatttgctgggacgcccggctacctgagccccgaggtgctgcgcaaggacccctacggaaaacctgtggacatatgggcttgtggggtgatcctctacatacttctcgtgggatatccacccttctgggacgaagaccaacataagctgtatcagcagattaaggcaggcgcttatgactttcccagtccagagtgggacacggtgacaccagaggccaaaaacctcatcaaccaaatgctgaccatcaatccagcaaaaagaatcaccgccgaccaggctttaaagcacccttgggtgtgccagcgatccaccgttgccagcatgatgcacaggcaagaaaccgtggaatgcctccggaaatttaacgctcgccgtaaactcaagggcgccatcttgaccaccatgttggtttcccggaatttctcagccgctaagagtctgctgaataagaagtcagacggcggagttaagccacagagcaacaacaaaaacagtttggttagtcccgcccaagaaccagctcccctgcagaccgccatggagccccagactactgtagtccacaatgcaacagatggcatcaaaggttcgaccgagtcctgcaatacaactacggaggatgaggatttgaaggttcgtaagcaggagatcattaagataaccgaacagcttattgaggccatcaacaatggcgatttcgaagcttacacaaaaatctgcgacccgggactcacatcgttcgagccggaagccctcggaaacttggtcgagggtatggactttcacaaattttacttcgagaacctgttatcgaagaactctaagccaatccacaccacaatcctgaacccccacgtgcacgtgataggcgaagacgcggcatgcattgcttatatcaggctaacccagtacatcgatggccagggcagacctcgtactagccagagcgaggagacaagagtctggcataggcgggacggaaagtggcttaacgtgcactaccactgctccggcgctcccgcggcacccttacagtag

SEQ ID NO: 181315 - DNA, 1008 bp, Artificial Sequence
  Description of Artificial Sequence: Synthetic coding sequence
tgataccagcagatcaaggccggcgcctacgacttccccagccccgagtgggacacagttacacccgaagccaagaatcttatcaatcaaatgctgaccattaaccctgctaaaagaatcaccgctgaccaggcactgaagcatccatgggtgtgccagcgatcgactgtagccagtatgatgcatcgccaggaaactgtggagtgcctgagaaagttcaacgctcgacgcaaacttaagggtgcaatcttgacaacaatgctggtgtcacggaactttagcgccgccaaaagcttgctgaacaaaaaaagcgatggaggcgtgaaaccacaaagcaacaacaaaaacagcctggtgtcacctgcccaagagcctgctcccctgcaaacagccatggaacctcaaacaacagttgttcacaatgccaccgacgggattaaaggaagtactgaatcttgcaatacaactacggaagatgaggatctcaaggccgcgccgctgcgcacgggcaacggctcatcggtgcctgagggccgctcatcccgagataggactgcgcccagtgccggtatgcagccccagccatccttatgtagttccgctatgagaaagcaggaaatcatcaaaattaccgagcaactgatcgaggccatcaataatggggattttgaagcttacaccaagatatgtgaccccgggcttacctcctttgagcccgaagctttgggtaatctggtggaagggatggattttcacaagttttactttgagaacctgctttctaaaaacagcaagccaatccataccacaattctgaaccctcacgtgcacgttattggggaagatgccgcgtgcatcgcttacatccgactgacgcaatatatcgatgggcagggccgacccaggacttctcaaagtgaagagacccgggtttggcaccggcgcgacggaaagtggcttaatgttcactaccactgttccggagctccggcagcccctctgcaatag

SEQ ID NO: 181316 - DNA, 543 bp, Artificial Sequence
  Description of Artificial Sequence: Synthetic coding sequence
atggccaccaccgccacctgcacccggttcaccgacgactaccagttgtttgaagaactcggtaaaggagcatttagtgtggtcagacggtgtgtaaagaagacctccacccaagagtacgccgccaagattattaacacgaaaaagctcagcgcccgcgatcatcaaaaactggaaagggaggctcgtatttgccggcttttgaaacatcccaatatcgcaactattcacggcggaattcatgacgcctcttctggcgactgtggggtcttcgctcaggttcagtgtcctgaaaagacagaaggctgccacccccacgatcatgcatgcttacaggaactgttgtcctgccagaaacccatcgaacaggaggtcggatggagatgtcaagctacagagcaacagcagaagcagtcaaggaaacctagtccccgtgccagagccctggcggatggacatggggccactaaccactgtggcacgcagcggtacagatgggaccagggtctccatcgggagctgcagcaccaccatcggaggtag

SEQ ID NO: 181317 - DNA, 240 bp, Artificial Sequence
  Description of Artificial Sequence: Synthetic coding sequence
atgagcgagatcctgccctacagcgaggacaagatgggccggttcggcgctgaccctgaaggctcggatctctctttcagctgtcgtctgcaggacaccaactccttcttcgcagggaaccaggcgaaaaggccaccgaagctcggccagatcggtagagctaaacgggtggtgattgaagatgatcggatagatgatgtgcttaaagggatgggggagaaaccccccagcggagtgtag

SEQ ID NO: 181318 - DNA, 1422 bp, Artificial Sequence
  Description of Artificial Sequence: Synthetic coding sequence
atgctgaaggtgaccgtgcccagctgcagcgccagcagctgcagctccgtcaccgcaagtgctgcacccggtaccgcctctctggtcccagactactggatagacgggtccaaccgagacgccttgtcagattttttcgaggtcgagtctgagctcggccgtggcgcaacctcgatcgtctaccgatgcaagcagaaagggacccaaaaaccatacgccttgaaagtcctcaagaaaactgtggataagaagattgtgcgcaccgagataggagtattgctccgcttaagccatcctaacattatcaaactgaaagaaattttcgagacacccaccgagatctcgctggtcctagagctggtaacaggtggggagctgttcgatcgcatcgtggagaagggctattactcagaaagggatgcagccgatgcagtcaagcaaatcttggaggccgtggcatacctgcacgaaaatggcatcgtacatcgagatctgaagccagagaatttgctctatgcaactcccgctcccgacgcccctcttaagatcgccgatttcggcctcagtaaaattgtcgagcatcaggtacttatgaagactgtctgtggtaccccgggctactgcgcccccgagattcttaggggatgtgcctatgggcctgaagtggacatgtggagtgtgggcataatcacctatatcttgctctgtggcttcgaacctttctatgacgagagaggtgatcagttcatgtttcgcagaatccttaattgtgaatattatttcatttctccctggtgggacgaggtatcccttaacgctaaagatttagttcgtaagctgatcgtgctggaccccaaaaagcgactcacaacctttcaagcgctacaacatccatgggtgacaggcaaggcagcgaattttgtacacatggacaccgctcagaaaaagttgcaggagtttaacgccaggagaaagcttaaggctgccgtgaaagcagtggttgcttcctctcgcctcggctcagcttcatcttcccatgggtcaatacaggaatctcataaggcctcacgcgacccgtctccaattcaagacggcaacgaggatatgaaagccattcctgaaggagagaaaattcagggagacggcgctcaggccgctgtaaaaggggcacaggcggaactgatgaaggtccaagcactggaaaaagtgaagggcgcagacataaatgccgaagaggcacccaaaatggttcccaaggccgtggaggacggaattaaggtcgccgatttagagctggaggaagggcttgctgaggagaaactcaaaactgtggaggaagctgcagccccacgcgagggacaaggctcgagtgctgtgggatttgaagttcctcagcaggatgtaatcttgcccgagtactag

SEQ ID NO: 181319 - DNA, 429 bp, Artificial Sequence
  Description of Artificial Sequence: Synthetic coding sequence
atgctgaaggtgaccgtgcccagctgcagcgccagcagctgcagcagcgtaaccgccagcgcagcccccgggacagcgtctctcgtgcctgattactggatcgatggcagcaatcgggacgctctgtccgatttcttcgaagtggagtcagagctcggacggggagctacaagcatagtgtaccgctgtaaacagaaggggacccaaaagccgtacgccctgaaagtgttgaagaaaactgtcgacaaaaaaatcgtgcgaaccgagattggggtcttacttcgtctttctcaccctaacataatcaaacttaaggagatttttgagacacctactgagatttccctcgtgctcgagttggtgacaggtggtgagctatttgaccgcattgtcgagaaaggctattacagtgagagagatgccgcctag

SEQ ID NO: 181320 - DNA, 1422 bp, Artificial Sequence
  Description of Artificial Sequence: Synthetic coding sequence
atgctgaaggtgaccgtgcccagctgcagcgccagcagctgcagctccgtgactgccagcgccgcacccggcaccgcctctctggtacctgattactggatagatggctccaaccgggacgctcttagtgatttcttcgaggtcgagagcgagctgggacgcggtgccacatcaatcgtctatcgttgtaaacagaagggcacgcaaaagccctacgctttaaaagttctgaagaagaccgtggataagaaaatcgttcgtacagaaatcggagtgcttctgcgattgtcacacccaaatattatcaagctgaaggagatctttgaaaccccaaccgagatcagcctggtacttgagcttgtgaccgggggggaactttttgatagaatagttgagaaggggtactactctgagagagacgcagctgacgctgtgaaacagatcctggaagccgttgcgtacctgcatgaaaatggcattgtccaccgtgatttaaagcccgaaaacctgttgtatgccacccccgcccctgatgcgccactaaaaattgcagacttcggtctgtcaaaaatcgtagagcatcaggtccttatgaagaccgtgtgtggtactccaggctactgtgcccccgagatcctcaggggatgcgcatacggtccagaagtcgacatgtggagtgtgggcattatcacgtacattctgctgtgcggttttgaacctttttatgatgagcgtggggaccaattcatgtttaggcgaatacttaactgtgaatattactttatcagtccttggtgggacgaggtttcactcaacgcaaaggacctggtacggaaactgatcgtcctggaccctaagaagcgactgacaacatttcaggccctccaacacccgtgggtcaccgggaaagccgccaatttcgtgcacatggataccgcacagaaaaaactccaagaatttaatgcccggaggaaactgaaggccgcagtaaaagccgttgtcgcctcatctcggctgggctcggcttcttcaagccacggcagcatccaggagtcacacaaagcttcccgggaccctagcccgattcaagacggaaacgaagacatgaaggctatacccgaaggtgaaaaaatccaaggtgacggcgcccaggccgctgtcaagggagcccaggccgagctgatgaaagttcaggcgttagaaaaagtgaagggggcagatatcaacgccgaggaggcaccgaagatggtccctaaagcggtcgaggacgggatcaaggttgctgacctcgagctcgaggaagggctggccgaggagaaactaaaaactgtggaggaagcagcagcgcctcgcgaagggcagggcagctcggccgtcggatttgaagtgccacagcaggacgtgatcctgcctgagtattag

SEQ ID NO: 181321 - DNA, 2766 bp, Artificial Sequence
  Description of Artificial Sequence: Synthetic coding sequence
atggccgacgacgacgtgctgttcgaggacgtgtacgagctgtgcgaggttattgggaagggcccattttctgtggtgaggaggtgcatcaatcgcgagactggacagcagttcgccgtcaagatcgtcgatgtcgccaaatttacttcaagccccggactgagtacagaggacttgaagcgagaggccagcatatgccacatgctgaagcatccccacattgtggagcttctagagacttattccagtgatggaatgctgtatatggtctttgaatttatggacggagccgatttatgttttgaaatagtgaaacgggccgacgctggctttgtctactcagaagccgttgcatcccactacatgagacagattctggaagctctgcggtattgtcacgacaacaatatcattcatcgagacgtcaagccccactgcgtcctgctcgcaagcaaagagaacagtgctcccgttaagttgggaggttttggggtggccattcagttaggcgaatcaggcctcgttgcaggcggcagggttgggacaccccactttatggcaccagaagtcgttaaaagagaaccatatgggaagcccgttgatgtgtgggggtgcggtgttattttgtttatcctcctcagcggctgcttgcccttttatggtacaaaagagcgactcttcgagggaattattaaaggtaaatataaaatgaatccaaggcagtggtctcacatcagcgagtcagcaaaagacctcgtcagaaggatgctgatgcttgacccggcagaacggatcactgtctatgaggccctaaaccacccctggcttaaggagcgagatcgctacgcctataagatacacttgcctgaaacggtcgaacagctcagaaagtttaatgcccgcaggaagttaaaaggggctgtgctagcagctgtgtccagccataagtttaattctttctatggagatccccccgaggagctgcctgatttctctgaggatccaacttcaagcgtactgttgattgtctctcgggctgtgagtcaggtgctagacagcctcgaggaaatccacgctttaaccgactgcagcgagaaagacctggattttctgcacagcgtattccaagatcaacacctgcataccctgctggatctgtacgacaagatcaataccaaatcctcgcctcaaatccggaatccaccaagcgatgccgtgcagcgagcaaaagaggtcctggaggagatctcatgctaccccgaaaataacgacgctaaagagctgaaaagaatcctcacccaaccacacttcatggcactgctccagacccatgatgtggtggcccacgaggtgtactctgatgaggccctacgcgtgacgcctccccccacatccccatatctgaatggagatagtcctgagtcagcaaatggtgacatggatatggaaaatgtgacaagggtgcgacttgtacagttccaaaaaaacacggacgaaccaatggggattaccctaaagatgaatgagctgaatcactgcatagtggctaggatcatgcacggcggtatgatccacagacaggggactttacatgtgggagacgaaatacgcgagattaacggaatttccgtggccaaccagacagtggagcagcttcaaaagatgctgagagaaatgagaggttccattacttttaaaatcgtgccatcatacagaacccaatcttcttcatgtgaacgggactcaccaagtacaagccgtcagtccccagccaacgggcacagcagcacgaataatagcgtgagtgatctcccaagcactactcagcccaaaggtagacagatttacgtcagagcccagtttgagtacgacccagccaaggatgatctaataccatgcaaagaagcaggaatcagattcagggtgggtgatatcattcagatcattagtaaggatgatcataactggtggcaaggaaagttggagaatagcaaaaacggaacagcaggcctgattccttctcccgaactccaggaatggcgcgtggcctgtatagccatggagaaaacaaaacaggagcaacaggccagctgtacatggttcgggaaaaaaaagaaacagtacaaggacaagtacttagccaagcataatgccgatttggttacttacgaagaggtggtgaaactccccgccttcaaacgaaaaaccctggttttgcttggagctcatggcgttggccgtagacatatcaagaacactctcataaccaagcacccagacaggttcgcctacccgatcccccacactactcgccccccaaaaaaagacgaagagaacgggaaaaattactatttcgtgtcccacgatcagatgatgcaggatatttctaataatgagtatctagagtatggctctcacgaagatgccatgtacggtactaaactggagacaatcaggaagatacacgaacaggggcttatagcaatactggacgtggagcctcaagcacttaaagtcctaagaacggccgaatttgctcccttcgtggtgttcattgcggcccccacgataacacctggcctgaacgaagacgagtcactccagagactgcaaaaagaatccgatattctccagcgcacctacgcacactatttcgatttgacaattatcaataacgaaatagatgagaccattagacatctcgaagaagcagtagagttagtgtgtaccgccccacagtgggttcccgtgagttgggtttactag

SEQ ID NO: 181322 - DNA, 2730 bp, Artificial Sequence
  Description of Artificial Sequence: Synthetic coding sequence
atggccgacgacgacgtgctgttcgaggacgtgtacgagctgtgcgaggtgattggaaaaggcccattctccgttgtgagacggtgcatcaatagggagactggccagcaattcgctgtgaagatcgtggacgtggctaaatttacgtcttcacccggactgagcaccgaggacctcaaacgggaagcctctatctgtcatatgcttaagcaccctcacattgttgaactactggagacatactccagcgacggcatgctctatatggtctttgaatttatggacggcgccgacctgtgtttcgagattgtcaagagggcagatgccggtttcgtttactcagaagcagtggccagccattacatgcgccagatcctcgaagctctgagatactgtcatgataataatattatccacagggatgttaagccccattgcgtcctgctagcaagtaaggaaaatagcgcccccgtgaagttaggcgggttcggcgtcgcgattcagttgggggagagtggcctggtggccggaggtagggtgggtaccccccattttatggctcctgaggtggttaaacgcgagccctatggtaagccagtggatgtgtggggctgtggcgtaatcctttttatattgctttctgggtgtctgcccttctacggaaccaaggagcgattgttcgaggggattatcaaaggtaagtacaagatgaatcctcgccagtggagccacattagtgaatcagccaaagatctggtgagaaggatgctcatgcttgacccggcagagcgcattactgtttacgaagcacttaatcacccttggcttaaagaacgcgatcgctatgcctataaaattcatttgccggagacagttgaacagcttagaaaattcaacgcacgcaggaagttgaagggagcggtgcttgcagccgtaagttcacataagttcaattccttctacggtgaccccccagaggagcttcctgacttcagtgaggatcccaccagctccgtactcctgatcgtgtcgagggcggttagtcaagtactagacagcctagaggagatccacgctctgaccgactgcagcgagaaagacctcgattttttacactcagtgtttcaagatcagcacctccacaccctgctcgacctgtatgataagatcaatactaaaagttcaccccagatccgaaacccaccctcagacgcagttcaaagagcgaaggaggtccttgaggagatatcttgctaccccgaaaataatgacgcaaaggagctgaaacggattttgacccaacctcactttatggcactgttgcagacccacgacgtagtcgctcatgaggtgtatagcgacgaggcactccgagttacgcccccgccaactagcccatatctgaacggcgattccccggagtctgcaaacggcgacatggacatggagaatgttactcgcgtcaggttggtccagttccagaaaaacaccgacgagccaatgggcataacactgaagatgaatgagttgaaccactgtatagtcgctcgaataatgcacggaggcatgatccaccggcagggcacactgcatgtgggcgacgaaatcagagagatcaatggaatctccgtggcaaaccagactgtcgagcagcttcagaaaatgttacgagagatgcggggctccattacgtttaaaattgttccctcttaccgcacccaatctagctcctgcgaacgagattccccttccacgtcccgtcagagtcccgctaatggacactccagtaccaacaactctgtgtcgatatatgtccgggcgcagttcgagtacgatcctgccaaagacgaccttataccatgcaaagaagctggaattaggtttcgagtcggggatatcattcagataattagcaaagatgaccacaattggtggcagggcaagctagagaatagtaagaatggaaccgcaggattgatacccagtcccgaactccaagagtggcgggtcgcctgtatagccatggaaaagaccaaacaggagcagcaagcctcctgcacatggtttgggaaaaagaagaaacagtacaaggacaagtacctggcgaagcacaatgccgatctggttacctatgaggaggtggtaaaattgcccgccttcaaaaggaaaacattggtgctcctaggcgcccatggggtcgggcggaggcatatcaaaaacactcttatcacgaaacatcctgataggttcgcctaccccataccacacactacaaggcctcccaagaaagacgaagagaacggtaaaaactattattttgtgtcacacgatcagatgatgcaggacatatccaacaatgaataccttgagtacggatcccatgaggacgctatgtatggaactaagcttgaaacgatccggaaaatccatgagcagggactaattgctatcttagacgtggaaccacaggcactgaaagtcctgcggacagctgaattcgccccttttgtcgtgttcatcgcggcaccaacaattacacctggcttgaatgaagacgagagtctgcagcgtctgcagaaggagtcagatattttacagcgcacatacgcccactattttgatctgactattatcaataatgagattgatgaaactattcgccacctggaggaagccgtagagcttgtgtgcaccgccccccaatgggtgccagtctcgtgggtgtactag

SEQ ID NO: 181323 - DNA, 1773 bp, Artificial Sequence
  Description of Artificial Sequence: Synthetic coding sequence
atggccgacgacgacgtgctgttcgaggacgtgtacgagctgtgcgaggtgatcgggaagggaccgttctctgtcgttcgcagatgtattaaccgcgagaccggtcagcagtttgccgtgaagattgtggatgtggcaaaattcacatctagtcctggactgagtacagaggatctgaaaagggaagctagcatttgccatatgcttaagcaccctcatattgtggaactcctggagacctatagcagcgacggtatgctgtacatggtgttcgagttcatggatggcgccgacttatgcttcgagatagtaaagagggcagacgctggtttcgtgtacagtgaggctgttgcaagccattatatgagacagatactcgaagcactcaggtattgccacgacaataacataattcaccgcgatgtgaaacctcattgcgttctcctagcttcgaaagagaattccgctccggtcaagttaggaggcttcggtgtagcgattcagcttggagaaagcggccttgtggctggcgggcgggtcggtacacctcattttatggcaccggaggtggtcaagcgggagccttatggtaagccagtagatgtgtgggggtgcggcgtcattttgttcattctgctatcaggatgtctgcctttttatggtactaaagagcgacttttcgagggaattattaaaggcaagtacaagatgaatcccagacagtggtctcacatatctgagtccgctaaggacttggtgaggaggatgttgatgctagatccagcggagcgcataactgtctatgaggctttaaaccacccttggctgaaggaacgggaccgttacgcttataaaatacacctgccagagacagtggagcagctaaggaagttcaacgctcgacgcaagctcaaaggagccgtgctggctgccgtcagttcgcataagtttaattcattctatggcgatccgcccgaggaattacccgattttagcgaggatccaacgtcaagcgggctgcttgccgcagagagagccgtgagtcaggtgctcgactccctcgaggagatccatgctctcacagactgctcagagaaggatctcgactttctccactctgtgtttcaggaccagcatctccacacactccttgatctctacgacaaaatcaacacaaaatcgtcgccacagattagaaacccccctagtgacgcagtccagcgagctaaagaggtgcttgaagaaatctcttgctatccagagaacaatgacgcaaaggagctgaaacgcattctgactcagccccatttcatggcgctgctccaaactcacgatgtggtcgctcacgaggtgtacagcgatgaggccttgcgagtcactccaccgcctactagcccgtacctcaacggggacagtcccgaatctgccaacggggacatggatatggagaatgtgacccgggtcaggctggtgcagttccaaaagaatacagatgagcctatgggtatcactctcaaaatgaatgaattaaaccattgtatcgtcgcacggataatgcacggtggaatgatacaccgacagggtaccttgcacgtcggagatgagataagggagatcaatggaatcagtgtagccaaccagacagttgaacaattgcagaagatgctgagggagatgcggggatccattacctttaaaatcgttcccagctaccgtacacagtcctcctcatgcgaggtgatgactctcacaaatcacccccatcttttatag

SEQ ID NO: 181324 - DNA, 2730 bp, Artificial Sequence
  Description of Artificial Sequence: Synthetic coding sequence
atggccgacgacgacgtgctgttcgaggacgtgtacgagctgtgcgaggtcattggtaaaggcccttttagcgtggttcggagatgcattaatcgagagacggggcaacagtttgccgtgaaaattgtggacgttgccaagtttacatcctcaccaggactctcaacggaggacctgaaacgagaggccagcatctgccacatgctaaaacatccgcacatcgttgagctactggagacctattcatccgacggtatgttgtacatggttttcgagtttatggacggagccgatctgtgtttcgagatagtgaagcgcgctgatgcaggcttcgtctactccgaggcagtcgcctcacattacatgcgacagattctagaggccttgcgctattgccatgacaataatatcatccaccgggatgtgaaaccccactgcgtcctgctagcctctaaggaaaattctgcaccggtgaagctgggtgggttcggcgtagccattcaactgggtgaatccggcctggtggctggaggccgggtcggcacaccacattttatggcccctgaggtggtaaaacgagagccatacggtaaacctgtcgatgtgtgggggtgcggcgttatcctgttcatccttctgtcgggatgcttgcccttttacgggaccaaggagagactgtttgaaggtattatcaagggaaaatacaagatgaaccctcggcaatggagccatattagtgaaagtgctaaagatctcgtgcgcaggatgctgatgctagaccctgccgagagaataaccgtctacgaggcactgaatcacccttggctaaaggagagggatagatacgcctacaagattcatctgcccgaaacagtggagcagctgaggaaattcaacgcccggcgtaaactcaaaggcgcagttcttgctgcagtgagttcccataaattcaatagtttttacggcgacccgcccgaagagcttccagacttttctgaagatcctacatcctccggcctcctcgctgcagaacgtgcagtcagccaggtactggactcactggaggagatccacgctctaactgattgcagcgaaaaggaccttgactttttacattcagtatttcaggaccagcacctgcacactctcctggacctgtacgacaagattaatactaagagctcacctcagattagaaacccaccatccgatgccgtgcaacgtgcgaaagaagtcttagaggaaatatcctgttatccagagaacaacgatgctaaggaactgaagcgaatcctgacacaaccgcacttcatggccctgcttcagactcacgacgttgtagcccacgaagtgtactccgatgaggccctccgggtgacgcctcctccaacgtctccctatctgaatggagactcacctgaaagtgccaatggtgatatggacatggaaaatgtgactcgcgtacggctcgtgcagtttcaaaaaaacaccgatgagcccatgggaattacactgaagatgaatgaactcaatcactgtatagtggcccgaatcatgcatggagggatgatacaccgccagggcaccctgcacgtgggtgatgagattcgtgagatcaatgggatttccgtcgccaaccaaaccgtggaacagctgcagaaaatgctgcgggagatgagaggcagcattaccttcaaaatcgtaccatcctacaggacacagagcagttcctgcgaaagagacagcccgagcacttctcggcagtcgccagctaatggccacagctctaccaacaattcggtttcaatctatgtgcgggctcagttcgaatatgatccagctaaggacgacctgatcccctgcaaggaggctggaatccggtttcgggttggggacatcattcagattattagtaaggacgatcacaattggtggcagggcaaactggagaactctaagaatgggaccgctggactgattccgtccccggaactgcaggaatggcgggtcgcatgtatagcgatggagaagactaagcaggaacagcaagcatcttgcacttggttcgggaaaaaaaagaaacagtacaaggataaatacctcgccaaacataacgccgatcttgtgacctatgaagaagtcgtgaagctgcctgccttcaagcgaaaaaccctggtgttactcggagcccacggggttgggaggcgccacattaaaaacacgctaataactaagcacccggatcgcttcgcctacccaatacctcacacgactcggccccctaaaaaggacgaggagaacggcaaaaattattacttcgtgtcgcatgatcagatgatgcaggatatctctaacaatgagtatttagaatatggcagccacgaggacgcaatgtacggcacaaagctggagaccatcagaaaaatacacgaacaaggcctgatcgccatcctcgatgtcgaaccacaagccttaaaggttctgcgcacagcggaatttgcacccttcgtagtattcattgcagctcccaccatcaccccagggctgaacgaagatgaaagtctgcagagactccagaaggagtccgacattctacagcgtacatacgcccactatttcgacttgacaatcatcaacaacgaaattgacgagactattaggcacctggaggaggccgtggagttggtctgtaccgctccccagtgggttccagtgtcctgggtttactag

SEQ ID NO: 181325 - DNA, 2781 bp, Artificial Sequence
  Description of Artificial Sequence: Synthetic coding sequence
atggccgacgacgacgtgctgttcgaggacgtgtacgagctgtgcgaggtgatcggcaagggtccgttttcggtggtcaggagatgtatcaatcgcgaaacgggccagcaatttgccgtcaagattgtggatgtggccaagttcacatcgtcccctggtctgagcactgaggacctcaagagggaggcctcaatttgccacatgctgaaacaccctcatattgttgaattgcttgaaacctactcgtctgatgggatgttatacatggtgtttgaattcatggatggcgccgacctgtgcttcgaaatcgtgaaacgcgcagatgctgggtttgtctatagcgaagccgttgcctcccactatatgagacagatcctcgaagccctgcgctactgccacgacaacaacatcatccacagagatgtaaaaccacattgcgtgctcctagccagcaaagagaattccgcccccgtaaagctcggagggtttggcgttgctatccagttgggagagagtgggttggttgcgggcggcagagtcggcacgccacactttatggctcctgaggtggttaagcgcgagccctacggcaagccggtcgacgtctggggctgcggagtcatcttatttatccttctctccggttgccttcccttttacggcaccaaggagcgtttattcgagggaatcatcaaaggaaagtacaagatgaacccccggcagtggtcccacatctccgagtccgcaaaagatctagtcaggaggatgttaatgcttgatcccgccgaaaggataaccgtatacgaagcactcaatcacccatggctcaaagagcgagaccgatacgcttacaaaatccacctgcccgagaccgtagagcagctgagaaagtttaacgcaagacgcaaactgaagggcgctgtcttagccgcagtaagctctcataagttcaacagtttctacggggacccgccagaagaactccctgatttttcagaagaccctacttcgagcggtctcttggccgccgagagagctgtgagccaggtgctggatagcctcgaagagattcacgctctgacagattgttctgaaaaagacctggattttctccatagcgtgttccaggaccagcacttgcatacactgctggacctctacgataagatcaatactaagagttcaccccagatccggaaccctccctccgacgctgtacagagagctaaggaggtgctggaggaaatcagttgctaccctgagaataatgatgctaaagaactcaagagaatcctgactcaaccacacttcatggctctgttacagacccatgacgtggttgctcatgaggtgtattctgacgaggctctgagggtgacgcctccacctacatccccttatcttaacggggactctccggagtccgccaatggagacatggacatggaaaacgtgacccgagtgcgcctcgtccaatttcagaagaacaccgatgaacccatgggtataacactgaagatgaacgagctgaatcattgtatcgtagctagaataatgcatggtggtatgattcaccgccagggaacactccatgtaggtgacgaaatcagggagatcaatggcatctctgtggcaaatcagacagtggagcaactgcagaaaatgttacgcgaaatgcggggatctattacattcaaaatcgtgccctcgtacaggacacagagttcctcttgcgaaagagacagtccttccacttcacgccagtccccagccaacggccacagctcaaccaataatagtgtgagtgacctcccctccactacgcagcccaaaggcagacagatttacgttcgagcgcaattcgaatatgacccggcgaaagatgacttgatcccctgtaaagaagccggaatacgcttcagggttggcgatatcatccagatcatctccaaagatgaccacaactggtggcaggggaaactggaaaatagcaaaaatgggaccgcaggccttattccctccccggaactccaggaatggagggtagcctgtatagccatggaaaaaactaagcaggaacaacaggctagctgtacttggttcgggaagaagaaaaaacaatataaagacaagtacctggctaagcacaacgctgtgttcgatcaactcgatctggtgacatacgaagaggtggtgaaactcccagccttcaagcgcaagacattggtgttgcttggggcccatggtgtcggtcgacgacacattaaaaatactctcatcaccaagcacccagaccggttcgcttaccccatccctcacaccacccggccccccaaaaaagatgaagaaaacggcaagaattactattttgtatctcatgaccagatgatgcaagacattagcaataacgagtacctggaatacggcagccacgaagatgcaatgtacggaaccaagcttgaaacgattcgcaagattcacgagcaggggcttattgccatacttgacgttgagccccaagctcttaaggtgcttcgaacagctgagtttgccccgttcgtggtgttcatcgccgctcctacaatcactccgggcctgaacgaggacgagtccctgcagagactccagaaggagagcgatattttacagaggacatatgcacactactttgatctgacaattatcaacaacgagattgatgaaaccattcgacaccttgaggaggccgttgagctcgtctgtactgccccccagtgggtgcctgtttcttgggtttattag

SEQ ID NO: 181326 - DNA, 2766 bp, Artificial Sequence
  Description of Artificial Sequence: Synthetic coding sequence
atggccgacgacgacgtgctgttcgaggacgtgtacgagctgtgcgaggtaatcggtaaaggcccattctccgtggttcgccggtgcatcaatcgcgagaccgggcagcagttcgcggtcaagattgtggatgtcgccaaattcacaagctcccccggcttgtctacagaggacctgaaacgggaggcttctatttgccacatgctgaaacacccacacattgtggaactccttgagacctactcttcagacggaatgctgtatatggtttttgagtttatggatggcgccgatctgtgttttgagattgtgaagcgggcagacgccggattcgtgtactccgaagccgtggcctctcactacatgcgtcaaatccttgaggctctgagatactgtcacgacaataacatcatccatcgggacgtcaagcctcactgtgtgttgttagctagcaaagaaaatagcgcccctgtgaaactggggggatttggggtggctatccaactaggcgaatccgggctggtagccggagggagagttggtacacctcatttcatggcgcccgaagtggtaaaacgcgagccttacggaaaacccgtcgatgtgtggggctgtggagttattctgttcatcttgctgtccggttgcctgccattctatggtaccaaagaacgcctctttgaggggatcatcaagggcaaatacaagatgaacccgcgacagtggtctcatataagcgaaagtgccaaagatcttgtgaggagaatgctcatgctagatcctgcagagagaatcacggtctacgaggcattaaatcacccatggcttaaagaaagggataggtatgcttacaagatccatctaccagagaccgttgaacagctaaggaagtttaacgcacggcgaaaactaaaaggcgccgtgctggccgctgtaagttctcacaagttcaattctttctacggggatcctcctgaagagctgccagatttctctgaggatcctacaagctccggtctgttagccgcagagcgggccgtgtcacaagtgctcgattctctcgaggagatccacgcactcacagattgttccgagaaggacctggacttcctgcactccgtcttccaagatcagcacttacatactctgttagatctctacgataagatcaacactaagtcttctccccaaattaggaacccgcccagtgatgccgtgcagcgggccaaggaagtcctggaagagatctcctgctatcccgaaaacaacgatgccaaagaactgaaaaggattctcactcaaccccatttcatggccctgctgcaaactcatgacgtggtcgctcatgaggtatactccgatgaagctctgagggttactccgcccccaacatctccgtaccttaatggagatagccccgagtctgcaaacggggatatggatatggaaaacgtgacccgggtcaggctagtacaattccagaagaacacggatgagcctatgggtattacccttaaaatgaatgagctaaatcattgtatagttgcacgaatcatgcacggcgggatgattcaccgccagggaacactacatgttggggatgagatccgagaaattaatggcatttcagtggccaatcagactgtcgaacagttgcagaagatgctgagggaaatgcgcggctcaattaccttcaagattgtcccttcgtatcgcactcagtctagctcctgtgaaagagattcgccctctacctctaggcaatctccggccaatggccattcttctaccaacaattcagtctcggatctcccgagcaccactcagcctaagggacgacagatatacgttcgagcccagtttgagtacgacccagcaaaggatgatctgattccgtgcaaggaggctgggatccggtttagagtgggggacatcattcagattatttcaaaagacgatcataactggtggcaaggcaagctcgagaattctaaaaatggaacggcaggcctcatccctagccccgagcttcaggagtggcgtgtggcatgtatcgcgatggagaagaccaaacaggaacaacaggcatcttgcacgtggtttggaaaaaagaagaagcagtacaaagacaagtacctggccaagcacaacgccgacctggtgacttatgaagaggtcgtcaaactccccgcatttaaacggaaaaccctcgtactcctgggggcccatggcgtgggcagacggcatattaagaataccctgataaccaaacatcctgataggtttgcctaccctattccccataccacccgcccacctaaaaaggacgaagaaaacggcaagaattactattttgtgagccatgatcagatgatgcaggatattagcaataacgaatatctggaatatgggagccatgaagatgctatgtatggaaccaagctggagacgataaggaagatccatgagcagggtctcatagccatcctggatgtcgaacctcaggccctcaaggttctgcggacggctgaatttgctccttttgtggttttcatagctgccccaactattacacctggcctcaacgaggacgaatccctgcagcgactgcagaaagaatccgacattttacagaggacctacgcacactacttcgatctgacaatcatcaacaacgaaattgacgagaccattagacacctggaagaagccgtggagcttgtttgtactgcaccacagtgggtgccagtttcctgggtgtactag

SEQ ID NO: 181327 - DNA, 1146 bp, Artificial Sequence
  Description of Artificial Sequence: Synthetic coding sequence
gacgagatccgggagatcaacggcatcagcgtggccaaccagaccgttgagcagttgcaaaaaatgttgcgggagatgcggggttccatcacatttaaaattgtgccctcatatcgtactcaaagttctagctgtgagagggattctccgagcacgtccagacagtctccagcgaatggccactcttccacaaataacagtgtgtccatctacgtgcgggcccagttcgagtatgatcccgccaaagatgacctgataccttgtaaagaagctggcattcgctttcgagtgggcgacatcatccagattatttccaaggatgaccataactggtggcagggaaagttggaaaacagcaaaaatggcaccgcaggcctgattccttccccggagctgcaggagtggagggtcgcctgcattgctatggagaaaacaaaacaggagcagcaggcttcttgtacttggtttggaaagaagaaaaaacagtacaaggacaagtatttggcgaagcataatgccgtctttgatcagcttgacttagtcacatatgaagaggtcgttaaactacctgcctttaaaaggaagacactcgtgctgctcggtgcccatggcgtgggacgccgtcacatcaagaacacactcataacgaagcacccagacagatttgcttaccctatcccacacacaacaagacctcccaagaaagatgaagaaaatggaaaaaattattatttcgtgagccatgatcagatgatgcaagatatttccaataacgaatatctagagtatggttcccatgaggatgccatgtatggaacgaaattggaaacaattcgaaaaatccacgagcaaggactgatcgccatcctagacgtggaaccccaagcactgaaggtgctgcggactgcggagtttgcccctttcgtggtatttattgctgcccccaccatcacacctggcctgaacgaagatgaatcacttcaaaggctccaaaaggagagcgatatccttcagcggacttatgcccactatttcgatctcacaatcataaacaacgagatcgacgagacgatccggcacttagaggaagccgtcgagctggtgtgcaccgcaccacaatgggtgccggtgtcgtgggtgtactag

SEQ ID NO: 181328 - DNA, 1557 bp, Artificial Sequence
  Description of Artificial Sequence: Synthetic coding sequence
ctgtacgacaagatcaacaccaagagcagcccccagatccggaacccaccatcagacgcagtccagagagccaaagaggtcttggaggagatctcgtgttatcctgagaataatgatgccaaggaactcaagagaatcttaactcagcctcattttatggcactgctgcaaacacacgacgtggtggcacacgaggtttactctgacgaagctctgcgcgtgacaccacctcccacctctccctacctcaacggcgatagtcccgagagtgcaaatggggatatggacatggaaaacgtgacaagggtgcgcctcgttcagtttcagaaaaacaccgacgagcccatgggcatcactctgaagatgaacgagttaaatcattgtattgtcgctcggatcatgcacggggggatgattcacaggcagggcacgctgcacgtgggagatgagatcagggagattaacggcatcagcgtggccaaccagacagttgaacagctgcagaaaatgctccgcgagatgagaggctccatcaccttcaagatagtgcctagttatagaactcagtcttcctcatgtgaagacctcccgtcaactacccagcctaaaggaagacagatctacgtgcgagcccaatttgagtacgatcctgctaaggatgacctgattccctgtaaagaggcaggcatccggttccgagtcggtgacatcatccagattatatccaaagatgaccacaactggtggcaggggaaactcgagaacagcaaaaacgggaccgccggcctcatccccagcccggaattgcaggaatggcgtgtcgcctgcatagccatggagaagacaaaacaggaacagcaggcctcgtgcacatggttcggaaagaagaaaaagcagtacaaagataaatatcttgctaagcacaatgccgtgttcgatcagttggatctggtgacctacgaggaggtcgtaaaacttcctgcctttaagcggaagacactcgtcctgctgggagcccacggcgtgggaaggcgtcacatcaaaaacaccctgataaccaaacaccctgaccgctttgcttatcctataccacatacaacccggcctcctaagaaggacgaggagaacggcaaaaattattattttgtcagccacgatcagatgatgcaggacatctctaataatgagtacttagaatacggcagtcatgaggacgcaatgtacggcactaagttagagacaatcaggaagattcacgagcaaggccttatagctatcctggatgttgaaccacaggcactgaaagtactgcggaccgctgaattcgccccttttgtcgttttcattgcagccccgactatcacccccggcttgaacgaggatgaaagcttgcagagactgcaaaaggagagtgatatcctgcagcgtacctacgcacactactttgatttaaccatcattaacaatgaaattgacgagaccatccgccacctggaggaggctgttgagctggtgtgtaccgcaccacagtgggtgcctgtaagctgggtttattag

SEQ ID NO: 181329 - DNA, 2694 bp, Artificial Sequence
  Description of Artificial Sequence: Synthetic coding sequence
atggccgacgacgacgtgctgttcgaggacgtgtacgagctgtgcgaagttatcggaaaggggcctttttcagtcgtgaggcgttgtatcaatagagaaactggacagcaatttgccgtgaaaattgtagatgtggccaaatttactagcagtcctggcctctctactgaggatctcaaaagagaagcctctatttgtcacatgttgaaacaccctcacattgtcgagcttttggaaacatattcatctgatggtatgctgtacatggtctttgagtttatggatggagccgacttgtgtttcgaaattgttaagcgagctgacgctgggttcgtttattccgaggctgtggcctcacactatatgagacaaatacttgaggcgctccgatactgtcacgacaataatattattcatcgagatgtgaagcctcactgtgtccttctagccagcaaagagaactcggcacctgttaaactcggtggcttcggagtggccattcagttaggcgaatcgggcctggtggccggtggccgagtgggtaccccgcattttatggccccagaggttgtgaaaagggagccctacgggaaacctgtggatgtatgggggtgcggagtgattctcttcatcttactttcaggctgcctgcctttttacgggaccaaggagcgcctctttgagggaattatcaaagggaagtacaaaatgaatcctcgccaatggagtcacatcagtgagtctgccaaagatctggtgcgtcgcatgctgatgttggaccccgcagaacggatcaccgtatatgaagcactgaaccatccttggctgaaggaaagagaccgctacgcatataagattcatctgccagagaccgtggagcagcttaggaaattcaacgctcgccggaaattgaagggagctgtgctggccgcagtgtcatcacataaattcaactctttttacggcgacccaccggaggagctacccgactttagcgaggatcccacctccagtggcgccgtgtctcaggtattggactccctggaagaaatacatgccttaaccgattgttccgagaaggatctggattttctgcattctgtcttccaagaccagcatctgcacactcttctggacctgtacgacaaaataaatactaagtccagtcctcagattcgtaatcctccatctgacgctgttcagcgcgccaaagaagtcttggaggaaattagttgttaccccgaaaacaacgacgccaaagagcttaagcggatcctcacacaaccccacttcatggctctgctccagactcacgatgtggtggcccatgaggtgtattcagacgaggcgcttcgggtaacccctcccccaacttccccttatcttaatggggacagccctgagtctgctaacggagatatggatatggagaatgtgactcgggtgcggctcgtacagttccaaaagaatacagatgagcccatggggatcacattaaaaatgaatgagctgaatcattgcatcgtggcacgcattatgcacggaggcatgatccaccgccagggaacacttcacgtgggagatgaaattcgtgagattaacggaatcagtgttgctaatcaaaccgtggaacaactgcaaaagatgcttcgggaaatgcggggatccatcacctttaaaatagttccatcttatagaacccagtcaagctcctgtgaagaccttccgagtaccacgcagcccaagggccgccagatctacgtgcgtgcccaatttgagtacgacccagccaaggacgatctgattccatgcaaagaggcaggaattcgatttcgagtcggggatattatccagatcatcagtaaggatgaccacaactggtggcaagggaagctggagaatagcaaaaacggtacagccggcctgatcccttctcccgaactgcaggagtggcgagtcgcttgcatcgcaatggagaaaacaaaacaggaacagcaggcttcatgcacctggttcggaaagaaaaaaaaacagtataaggataagtatctggccaagcacaacgccgtgttcgaccaactcgatctagtgacatatgaagaggttgtgaagctccccgcctttaaaagaaagaccctggttttgctgggggcgcacggtgtgggccgacgacacataaagaatacactgatcactaaacatccggaccgattcgcctaccctatcccccacacaaccagaccccctaaaaaggacgaggaaaatggcaagaattactacttcgtcagccacgaccagatgatgcaggacatcagcaacaatgaatatttggaatatggctctcacgaagacgctatgtacggcactaagttagagaccatccgcaagatccacgagcagggactgatcgcgatattagatgtcgaaccgcaggctctaaaagtgctgcgaaccgccgaatttgctccattcgttgtcttcatcgcggcgccaaccatcaccccgggcttaaatgaagacgagtctctgcagcgccttcagaaggaatccgacatacttcagaggacttacgcacactattttgacttgactattattaacaacgagattgacgagactattcgccacctggaggaggctgtagagcttgtatgcacagccccccaatgggtccctgtgagctgggtatactag

SEQ ID NO: 181330 - DNA, 2697 bp, Artificial Sequence
  Description of Artificial Sequence: Synthetic coding sequence
atggccgacgacgacgtgctgttcgaggacgtgtacgagctgtgcgaggttatcggaaaggggcctttcagtgtggtccgcagatgtataaatcgcgagacagggcaacagttcgctgtgaagatcgtggacgtggccaagttcaccagtagccccgggctttcaactgaagatttaaagagagaggcgtccatctgccatatgctaaagcacccccacatcgtcgaactcctcgagacctactcgagcgacggtatgctgtatatggtgttcgaatttatggatggagccgatctgtgcttcgagatcgtgaagagggcagatgctggatttgtttatagtgaggccgtggcgtcacactatatgcgtcagatcctggaagccctgaggtattgccacgacaataatataatacatagggacgtaaagcctcactgcgtccttttggcatctaaagagaattctgcgccagtgaagctgggcggcttcggcgtcgcgattcaactgggagagtccggtctggtggccggcggacgagttggaactccacactttatggcccctgaggttgttaaacgagagccctatgggaaaccagtggacgtctggggatgtggggtgattctttttattcttctgtccggatgcctccccttttatgggaccaaggaacggttgttcgaaggcatcatcaaaggcaagtacaaaatgaatccgcgtcagtggtctcacatatctgagagcgcaaaagacctggttagacgaatgctgatgctcgatcccgcagagaggattactgtctatgaggccttaaatcatccctggctgaaggagagagacagatatgcctataaaattcatctccctgaaacggtggagcagcttcggaagtttaacgcccggcgtaaattaaagggggcagtacttgcagccgtatcttcacataaatttaacagtttttatggcgacccccctgaagagctgccagacttttcagaggaccccacctctagtgggctgcttgccgcggagagggccgtgagccaggtactggatagtttagaggaaattcatgccctgaccgattgtagcgaaaaggacctcgacttcctccatagcgtgttccaggatcaacacctgcatacacttctagacctgtacgacaagattaatacgaagtcctctccccagatccgcaatcccccaagtgatgccgtacagcgggctaaggaggtgctggaagaaatctcatgctatccggaaaacaatgatgctaaggagctgaaaaggattttaacccagcctcactttatggctcttctccagactcatgacgtcgtcgcacacgaggtgtactcagacgaggcgttacgtgtgacacctccgcccacctccccctatctgaatggggatagtccagagtccgccaatggggacatggacatggagaatgttactagggtgcgtctagtacagttccagaaaaacaccgacgagcctatgggcatcacactgaaaatgaacgaactgaatcactgcattgtcgcccggattatgcatggcgggatgattcaccgccagggcacattgcacgttggtgacgaaattcgggaaatcaatgggatttctgtagctaaccagacggttgaacagttacaaaaaatgttgagggaaatgcgtgggtctatcacttttaagattgtgcctagctataggactcaatcatcatcctgcgaagaccttcccagtactacacagccgaaaggtcgtcagatctacgtgcgagcgcagttcgagtacgatccagccaaagacgatttaattccttgtaaagaagccggaatcagattcagagtgggtgatatcatccagatcatctctaaagacgatcataattggtggcagggcaaattagagaacagtaagaatgggacagctggtctcataccgtcgcccgagctgcaggagtggcgcgtcgcctgtattgccatggagaagacgaagcaagaacagcaagcttcctgcacttggttcggtaaaaaaaagaagcaatataaggacaagtacctggcaaagcacaacgccgacttagtgacctatgaagaggtcgttaaattaccagcctttaagcgcaaaacgttggtgttgttgggagcacacggggtgggtcgacgacatatcaagaacactctgatcaccaaacaccccgatcgctttgcgtaccctattccgcatactacacgacccccgaagaaagacgaagaaaatggaaaaaattattatttcgtgtctcacgaccagatgatgcaggatatctctaataatgagtacctggagtatggaagccatgaggacgccatgtatggtacaaagctcgaaaccatcagaaagatacatgagcaagggctgatcgctatcctggacgtcgagcctcaggccctcaaggtcctccgcactgctgaatttgcgccttttgtcgtcttcatcgccgcccccacgataaccccggggctgaatgaggatgaatctttacagcgcctgcagaaggaatctgatatcctgcagcgcacatacgctcattactttgacctaacgatcatcaataatgagatcgacgagacaataagacatctggaggaggccgttgagctggtatgcacggctcctcagtgggtaccagtgtcttgggtgtattag

SEQ ID NO: 181331 - DNA, 3237 bp, Artificial Sequence
  Description of Artificial Sequence: Synthetic coding sequence
atggccttctacagctgctgctgggtgctgctggccctgacctggcacacctctgcttacggccctgaccagcgcgctcagaaaaaaggcgatattattttgggaggactttttccaatacactttggggtggccgcaaaggaccaggatctgaaaagccgacccgagagtgtggaatgcattcggtacaatttcagaggattcagatggctacaggcaatgatttttgccatcgaagaaatcaactcctcaccagctctgcttcctaatcttacattggggtataggatcttcgacacctgtaacactgtgtctaaagctcttgaggcaactctctcattcgtggcccagaacaaaatcgattctctgaatcttgacgaattctgtaactgctcagaacatatcccatccacaatagccgttgtgggggctacaggctccggcgtgtctaccgccgtcgcaaacctgctcggactgttttacataccccaggtgagctacgcgtcctcttcccgacttctgtccaacaaaaatcagttcaaaagttttcttcgaactataccaaacgacgaacaccaggccaccgccatggctgatatcatcgaatacttccgctggaattgggtggggacaatcgccgccgacgatgactatgggagaccaggcattgagaaatttagggaggaggcagaggaaagagatatctgcattgacttcagtgaactcatatcccagtacagcgacgaggaggaaatccaacatgtcgtggaggttatccagaactctacagccaaagttatcgtggtcttcagctccgggccggacctcgaacctctgatcaaggagatagtaaggagaaatattacaggcaagatctggcttgcctcagaagcctgggcctccagcagtctcatcgctatgccgcagtacttccacgtagtgggcgggacaatcggattcgcccttaaagctggacagattccgggctttcgcgaattcctgaagaaagttcacccacggaagagcgtccacaacggtttcgcgaaagagttttgggaggaaacattcaactgccatcttcaggagggagccaaggggcctctgccagtggacacgttcctcaggggacacgaagaatctggcgacaggtttagtaacagctctaccgcatttcgccctctgtgcaccggcgatgaaaacatatcatctgtggagacaccttacattgattatacacacttaaggattagttataatgtgtatctcgcagtatattcaatcgcccatgcacttcaggacatttacacctgtctacccggaaggggcttatttacgaatggatcatgcgccgatattaagaaagtggaggcctggcaggttctcaagcatctcaggcacttaaacttcacaaacaacatgggagagcaggtcactttcgacgagtgcggagatttagtggggaactacagcattattaactggcatcttagccccgaagacgggagcatcgtgtttaaggaggtgggctattataatgtgtatgccaagaagggcgaacgattgttcattaacgaggaaaagatactgtggtctggattctctcgcgaggttccgttctcaaactgctctcgtgattgccttgcggggaccaggaaagggatcatagagggggagccaacctgttgtttcgagtgcgtagaatgcccagacggagaatattccgacgagacggatgcctccgcttgcaataaatgtcccgacgatttttggagcaacgagaatcatacgtcctgcatcgccaaagaaatcgagtttttgtcttggacagagccattcggcatcgctctcaccctttttgcagtattggggatcttcctcaccgcctttgttctgggggtctttattaagtttcgaaacacacccatagtcaaagccactaacagggaattgagttacctgcttctcttctccctcctctgctgcttcagtagctcactgttttttataggtgagccacaggactggacttgccgattgcggcagcctgcttttgggatttcatttgtgctgtgcatcagctgtatcctggttaagacaaatagggtgcttcttgttttcgaggccaagataccgaccagctttcatcggaaatggtggggcctcaatctgcaatttctgctggttttcctctgcacttttatgcaaatagtaatctgtgtcatctggctgtacactgcccctccgtcttcctaccgcaatcaggagcttgaggacgagatcatcttcattacgtgtcatgaggggagcctcatggccctgggcttcctgataggctacacgtgcctgctggccgccatttgcttttttttcgcttttaagagtcggaaactccctgagaatttcaatgaggccaagttcatcactttctccatgttgatttttttcatcgtctggatctccttcatccctgcatacgcaagtacctacggtaagttcgtctccgcagtcgaagtgatcgccattctggcagcctctttcggcctgctcgcctgcatcttcttcaacaaaatttacatcattttgttcaagcccagcaggaacactatcgaggaagttcgctgcagtacagccgctcacgcattcaaggtggcagctcgcgccacactgcgcagaagtaacgtgagcaggaagcggtcatcttcactgggcggctccacgggcagtacaccaagttctagtatctcctccaagtctaactcggaggacccctttccccagcctgaacggcaaaagcaacagcaacctctcgccctaacacagcaggaacagcagcaacagccccttacgctcccccagcagcagagaagccagcagcagccacgttgcaagcaaaaagtgatctttggaagcgggacggtgacattctccctttcctttgatgaaccacaaaagaacgctatggcacatagaaacagtacccaccaaaattcactagaggcccagaaaagttctgacacactgactagacacgaaccattgctgccattgcagtgtggagaaacagatctggatctgactgttcaggaaaccggtttacaggggccagtgggaggcgaccagcggcccgaggtggaagatcctgaggagttgtctcctgctttggtagtctcctcaagtcaaagcttcgttatttctggaggtggtagcaccgtcacagaaaacgtggtgaactcctag

SEQ ID NO: 181332 - DNA, 3237 bp, Artificial Sequence
  Description of Artificial Sequence: Synthetic coding sequence
atggccttctacagctgctgctgggtgctgctggccctgacctggcacacgtctgcgtatggtcctgatcagcgcgcccagaagaaaggggatataattttaggcggcttatttccaatacactttggggtcgcagccaaggatcaggatctcaaatctaggccggagagtgtggagtgtataaggtacaactttagaggattccgctggctgcaagcaatgatttttgcaattgaggaaataaatagctctcctgccttgctccccaatctcaccttgggttatcgcatctttgacacctgcaatacagtgtcaaaggctcttgaagccacactcagttttgttgctcagaacaaaatagactccctgaacctggacgaattctgcaactgtagtgagcatatcccctccacgatcgcagtggtcggcgcgactggttcaggggttagcaccgctgtggctaatctgttaggcctattttacattccgcaggtgtcatacgctagcagctccaggctgctgtccaacaaaaatcagtttaaatcttttctgcgaactattcctaatgatgagcaccaggcgaccgcgatggccgacatcatcgagtatttccgatggaattgggtgggaacaatcgccgcagacgatgattacggccggcccggaatcgaaaagtttagagaggaggctgaggagcgcgatatctgcatagatttctccgagcttatcagccagtactccgatgaggaagagattcagcacgtcgtggaagtgatccagaattccaccgcgaaggtgatcgtggtgttttctagcggccccgacctggagccgctcatcaaggaaatagtccggcggaacattactgggaaaatatggctggcaagtgaggcctgggcatcctcaagtctgatcgcaatgccacaatatttccacgtggttggtggcacaattggctttgcactcaaggccgggcagatcccaggcttcagagagttcttgaagaaagttcaccctcgcaaaagcgtgcataatggattcgccaaagagttctgggaggaaactttcaactgtcacctacaggaaggcgccaagggccctctccccgtcgataccttcttgcgcggccacgaagagtcgggtgatagattttctaacagttcaaccgcctttaggcctctttgtaccggggatgagaacattagcagcgtggaaacaccctatattgactacacccacctgcggataagctacaatgtgtatctggctgtatattcaattgctcacgccttacaagacatatatacttgtctccctggcagggggttgtttactaatgggagttgcgccgatatcaagaaggtggaagcttggcaggtcttaaagcacctgaggcatttgaatttcacaaataacatgggcgagcaggtgacgttcgacgagtgtggcgacctagtcgggaattacagtattattaattggcacctaagccctgaagatggctcgatcgtcttcaaagaggtggggtattataacgtgtacgcaaagaagggggaacggctcttcataaatgaagaaaaaatcctgtggtcaggatttagtagggaggtgcctttctcaaattgttctcgtgactgtctcgcggggacacgaaagggtattatagaaggcgaaccaacctgctgtttcgaatgtgtcgagtgccccgatggggaatattcagatgagactgacgcctccgcgtgcaacaagtgtcccgacgacttttggagcaatgaaaaccacactagctgtattgccaaagagatcgaattcctgagttggaccgagcccttcgggattgccctcacactgtttgccgttcttggtatctttctgaccgccttcgtcctgggagtgttcattaagtttcggaacacccctattgtcaaggctactaatagagagctgagttacctcctgctgttcagtctgctgtgttgcttctcgagttcattgttttttatcggagagccacaggactggacatgtcgccttcgccagcccgcgtttggtatatctttcgttctgtgcatctcatgtattttggttaaaactaacagagtgttgctggtgtttgaggctaaaataccaacctcgttccatcggaagtggtggggtctcaacctccagtttctgctggtcttcctgtgtactttcatgcagatcgtgatctgcgtgatttggctttataccgcaccaccaagctcatatcgcaaccaggagttagaagacgagatcatcttcatcacgtgtcatgaaggctctctgatggccctgggctttctcataggatacacttgcctcctggcagcaatctgctttttctttgcctttaaaagccgaaaactaccagagaacttcaatgaagccaagttcatcaccttttcaatgctcatcttcttcatcgtgtggataagttttatccccgcctacgccagcacttacgggaaattcgtcagtgcagtggaagttatcgccatcttggctgcttcctttggcctgctagcttgcattttttttaacaaaatttacattatattgttcaagccttcccggaacactattgaagaagtgagatgcagtacggctgcacacgccttcaaagtggccgcgcgggcaactctgcgcaggtcaaatgtctctagaaaacgatccagcagcctgggcggaagcacagggtctaccccaagctcaagtatatccagcaagtcaaactcggaagatccctttccccaaccagaacggcagaagcagcagcagcctttggccctgacacaacaggaacagcagcagcagcctctcaccctgccacagcagcaacgatcacagcagcagccgagatgcaaacaaaaagttatttttggctctgggaccgtcacctttagtttgagtttcgatgaacctcagaaaaacgccatggctcacaggaactctacacaccagaacagcttggaggctcagaagagcagtgatacactgaccagacacgaacctcttctccccttgcaatgtggggaaacggaccttgacttaaccgttcaagagacaggactgcagggacccgtgggtggcgatcagagacccgaagtggaagaccccgaggaactatcccctgccttggtcgtgagttcctcacaatcattcgtcatctcgggaggcggaagtaccgttacagaaaatgtggtgaattcttag

SEQ ID NO: 181333 - DNA, 3267 bp, Artificial Sequence
  Description of Artificial Sequence: Synthetic coding sequence
atggccttctacagctgctgctgggtgctgctggccctgacctggcacacgagcgcctatggcccagaccagcgcgcacaaaagaagggcgatattatactgggagggctctttccgatccactttggcgtcgctgccaaggatcaggatctgaagtctaggccagagtctgttgagtgtatccggtataactttcggggctttcgttggttgcaagctatgatctttgctattgaggagatcaactcctctcccgctctattgcccaatcttaccctggggtatcgcatctttgacacatgcaacacagtatccaaagccctggaggctactctcagctttgttgcgcaaaataaaatcgactctctgaacctggacgagttctgcaattgttcagagcacatcccatctaccatcgccgtggttggagcgactggctctggcgtctctactgccgttgctaatctacttgggttgttttacatcccccaagtcagttatgcctcttcctcgcggctgctgtctaacaaaaaccagttcaagagttttctccgcacgatcccgaatgacgaacaccaggccactgcaatggctgacattatagagtactttcgttggaattgggtcggcacgatcgccgcagacgatgactacggccgacctggaatcgagaaattccgcgaggaagcagaggagagagatatatgcatcgacttctccgaactgatatcccagtacagcgacgaggaggagatacagcacgtggtggaagtgattcagaacagcacagccaaagtaattgtggtattctcctccggcccggatctggagccactaatcaaggaaattgttcggaggaacataacgggtaaaatctggctggcatccgaagcgtgggcgagttcttctctcatcgcaatgcctcagtatttccatgttgtggggggcacaatcgggtttgcccttaaggctggacaaattccaggtttcagggagttcctaaaaaaagtgcacccgagaaagagcgttcataatggattcgctaaggaattttgggaggaaacttttaactgccaccttcaagagggcgctaagggcccactccccgttgatacctttcttcgcggccatgaggagtccggcgaccgctttagcaattcttctactgctttcaggcccctctgtactggcgatgagaatatatcaagtgtcgaaaccccctatattgactacacccaccttcggatttcatataatgtgtacctggcagtctattcaatcgcgcatgccctgcaggacatctatacttgccttccaggccgcggactgtttaccaatggctcttgtgccgacattaaaaaagtggaggcctggcaggtgcttaaacatctaagacaccttaatttcacaaacaatatgggtgagcaggtgaccttcgacgagtgcggggaccttgtcggaaactactccattataaactggcacctgtcacccgaggacggaagcattgtgttcaaggaggtcgggtactataatgtttatgctaagaagggagaacggttattcattaacgaggagaaaattctctggtccggattttcccgtgaacctctaacgttcgtattatctgtgttgcaagtgccctttagcaactgcagtcgagactgtcttgcgggtactcggaagggtatcatagaaggagagccaacttgctgcttcgagtgtgtggagtgtcctgatggcgaatacagcgacgagactgacgctagtgcttgcaataaatgtcctgatgacttctggagcaatgaaaatcatacttcatgtatcgcaaaggagattgagtttctgagttggacagagcccttcgggatcgccttaacactgttcgccgtactggggatctttttgactgcctttgtgcttggagtgttcatcaaattccgtaatactccaattgtgaaagcaacaaacagggagctttcttatttgttattattttctctgctctgctgcttttccagcagccttttcttcataggcgaacctcaagattggacttgtagactcaggcagcccgcctttgggatatctttcgttctgtgtatctcctgtatcctagttaaaacaaatcgggtcctactggtttttgaggctaagatccctacatccttccaccgtaagtggtgggggctaaacttacaattccttctggttttcctgtgcacatttatgcagattgtcatttgcgtgatctggctgtataccgcacctcccagcagctacaggaaccaggagctcgaggatgagatcatcttcataacatgccacgaagggtccctaatggcattagggttcctgatcgggtatacctgcttgttggccgctatttgtttttttttcgcctttaaatcccggaagctgcctgagaatttcaatgaggcgaaatttatcaccttttcaatgctcatcttttttatcgtgtggataagcttcatccccgcttacgcttccacgtacggaaaattcgtctcagctgttgaggttattgctatattggctgcctctttcggactcttggcatgcatattctttaataagatatacattatcctctttaagcctagccgcaatacaatagaggaagtgagatgttcaaccgcagcgcacgccttcaaggtggcagcaagggcaactctcaggcgttccaacgtaagccggaaacggagctctagccttgggggttcaacaggctctacaccgtcttcctccatctctagcaaaagcaatagcgaagatccattcccacagcctgagcgccaaaagcagcagcagccgttagctctgacccaacaagagcaacagcagcaaccactgactttgccccagcaacagcgaagccagcagcagccgaggtgcaagcaaaaagtgatttttgggtccggtactgtcactttctctctaagctttgatgagcctcagaagaacgccatggcccatcgcaacagcacccaccaaaacagtctggaagcacagaaatccagcgacaccttaacccgccacgagccattgctccccctgcagtgtggcgaaacagatcttgatctgacggtgcaggaaaccggactgcagggccctgtgggaggcgaccaaagaccagaagtcgaggaccctgaggaattatcccctgctctagtggtgagcagctcccagtcgttcgtgatttcaggcgggggcagtactgtaacggaaaacgtggtgaatagctag

SEQ ID NO: 181334 - DNA, 978 bp, Artificial Sequence
  Description of Artificial Sequence: Synthetic coding sequence
atggcccggcccgtgagcgaccggacccccgcccccctgctgctggggggacctgcaggcactccacccgggggaggcgcactccttggactgcgctctctgctgcagggtacctctaagccaaaagagcctgccagctgtctccttaaagagaaggagcgcaaagccgcgcttcctgctgcgaccactccaggcccggggctcgaaactgctggaccggccgacgcacctgcaggagcagttgtaggcggcgggtctcccaggggtagaccaggtccggtgcccgctccaggactcttggctccgctactgtgggaacgaaccctcccattcggtgatgtagaatatgttgacctcgacgctttcctgctggaacatggactgccgccaagccctccccctcctggagggccctcacctgagccgagcccagcaaggacacccgcgcccagccctggacctggctcctgcggctctgcatcacctcggtcctcccccggacacgcccccgcccgggccgctttgggcacagcaagtggccaccgagctggtttaacgtctagggatacacctagccctgtcgacccagatactgttgaggtcctgatgacattcgaaccagatcctgcggacctggcattgtcctctatccccggccatgaaactttcgaccctagaagacatcggttcagcgaggaggagttgaaaccacagcccattatgaaaaaggcccgtaagatacaggtccccgaagagcagaaggatgagaagtattggagtcgccgttacaagaacaacgaggctgccaaaagatcaagagacgctaggcgcctcaaggaaaatcagatcagcgtgcgagccgcatttttggagaaagagaatgccctcctgagacaggaagtcgtagcagtgcgccaggaactgagtcattatcgagctgtgctgtcccgttatcaggctcagcacggcgctctatag

SEQ ID NO: 181335 - DNA, 969 bp, Artificial Sequence
  Description of Artificial Sequence: Synthetic coding sequence
agccagcggggcaagggcacctgccccggcagccaccggaaccacgcctcctcattgccttcacatggcttggttagcatccaggggatctccgcccctgccggacagtggccggccccgcctccctggtcccaggaaggaatgcagtgccatcgggacctcgctctcagtcaggccctctgggggtggcaactgtccaagcagtccggatgggcacatccctctctgccacactccccactgcccagcacagtgcactcttgtagctgggcccccccccatctgcagaggcatcttcctctggcaaccgtttctcccggcactacacagctaacccagggacccgctggtaggaccctcggccagacccaggcctcctgtcctgaacctagaccgtccatggatgctgtggatgccacaatggagaaactgagggcccagtgtctgtctcgcggagcgagcggcattcagggattggcccggttcttcaggcagttggatcgcgatgggtcgaggagtctagacgctgatgaatttaggcagggcctggccaagctcgggttggttctggatcaggcggaagccgagggtgtgtgtcggaagtgggaccgcaatggatctggcactctggacttagaagagtttctgcgggctctgaggcctccaatgagccaggcacgtgaggcagtgattgccgctgcatttgcaaagctggacaggtccggggatggagtggtgacagtagacgacctgcggggagtgtactcaggtcgggcacatcccaaggttcgaagtggcgaatggacagaggatgaggtgttgagaagattcttggacaacttcgattctagcgagaaagatggacaggtcaccctggcggagttccaggactattactccggagtgtctgctagcatgaacaccgatgaggaatttgtggctatgatgacatcagcttggcaactgtag

SEQ ID NO: 181336 - DNA, 489 bp, Artificial Sequence
  Description of Artificial Sequence: Synthetic coding sequence
atggacgccgtggacgccaccatggagaagctgcgggcccagtgcctgagtcggggtgcaagcgggatccaaggcctggcccgtttttttcgccagctggatcgggatggttctaggtctttagatgcggatgagttccgtcagggcctggccaaattaggcctggtgctcgatcaagccgaggcagaaggggtctgtcgaaaatgggacaggaacgggtcagggacactggatctggaggagttcctacgagctctgagacccccaatgtcccaggccagggaagccgtgatcgcggccgcttttgctaaactggataggtctggagatggtgtggtgaccgtagatgacctgcgcggggtatattccggcagggcccaccctaaggtgaccctagccgaatttcaagactattattctggtgtgagtgcaagtatgaacacagacgaggagtttgtggccatgatgacctccgcgtggcagctgtag

SEQ ID NO: 181337 - DNA, 882 bp, Artificial Sequence
  Description of Artificial Sequence: Synthetic coding sequence
ctgatcaacatcctgtaccgggccgtgatcagcgaccccgagcagaatctggcaatagagcaaaaggaatccgaccatatcctgccggattcaaagatgacaccgctccggttcaggaagagaacgttgcatgagacaaagatacgcacccactcaactttaacagagaacgtcttgagccacaaactacagttcgacgggcgcattgtcagccgcacaaatgtcctacctttcatccagaagtccatttattctcatcagtgcgggcgccgcaaaggtaaacagtataggctcggggatttttatgtcggagctactcttaccttcttaagctcggaccaccttagcctgcccgaatcaatcaaagaaaacacacttttaaaattgagaattaccaacatcgatcagatcgcacttgatagcttgaagacagcttcaatggaacaggaggacgacatcattatccaagaaaccaatgacagattggtcttcaaggccattcaggatgtacttaaggagaagttacataaaagaggcgtgcgaatactgaccggcttgggaaaatatttccaacaattggataaagaggggaatgggcttctcgacaaggctgacttcaagcaagccttaaaggtcttccatctcgaggtgagcgagaaggacttcgagagtgcttggcttatcctcaatgacaacggtaatggcaaggttgactacggcgagttcaagcgtggaattattggcgagatgaatgaatatcgaaagtcatacgtgcgcaaggcgttcatgaagctagactttaacaagtctggcagcgttcctattatcaacattaggaagtgctactgcgctaaaaagcatagtcaggttatcagcgggtag

SEQ ID NO: 181338 - DNA, 1149 bp, Artificial Sequence
  Description of Artificial Sequence: Synthetic coding sequence
atgatcgaccacctgagccgggccgtgatcagcgaccccgagcagaatctagccattgaacagaaggagagcgaccacattcttcccgactcgaaaatgaccccactcagattccggaagcgtaccctgcatgaaaccaaaattagaacacatagcaccctgacagagaacgttttgagccataagctgcagtttgatgggcgaatcgtttcaaggaatggcagggacgcctgcagggaactgatcggatttttcttcacccacgaccagagcctgactatctacgagtacaggcagttcggcaaaaatcgtaccaatgtcctgccctttatacaaaagagcatttattcccaccagtgcggccgccgaaagggcaaacagtatcggctaggggatttttacgttggcgcaactttgacctttctgagcagcgaccatctgagcctcccagagagtattaaagaaaatactctactaaaattacggataaccaatattgatcagatcgccctggacagtctgaaaacagccagcatggaacaagaggatgacattatcatccaggaaactaacgatcggctagtcttcaaggcgatacaagatgtcctcaaagagaaattgcataagcgaggcgtccggatccttacgggactcgggaaatacttccagcagttggataaagaaggcaacggcctgctcgataaagctgatttcaaacaggcattgaaagttttccatctggaagtatccgagaaagacttcgaaagcgcttggctgattctcaatgataatgggaacggcaaggtcgattacggcgaatttaaacgtggtataattggcgagatgaatgagtataggaagtcttacgtgaggaaagcctttatgaagctcgacttcaacaaatccggaagtgtgcctataattaatattcgtaaatgttactgcgcaaaaaagcacagccaggtaattagcggtcactccaccgaggaggagattaagtcctcattcctggaaacactgaaagtggcctgcagtaaaagtgatgaggtgtcgtatggcgaatttgaggactactacgaggggctcagtatcggcattgtggacgacgaggatttcgtgaatatacttcggacaccttggggaatctag

SEQ ID NO: 181339 - DNA, 1674 bp, Artificial Sequence
  Description of Artificial Sequence: Synthetic coding sequence
atgggcaacagcttctgctacaccgccgtgtactgcatgatcaacaccggaacccagatggatctggaggttaagggggtcgcggccaccagtcggtctcagatacagcctttctttggtcgcaaaaagcctctccaacaaagatggacctccgagtcctggacgaatcagaatagttgtcctcccgtggtgccgaggctagacctcggatctttagtggattccgacgacgaagacaatttttcctacattcctctgtctacagccaatctgccgaactctagttctaccctgggttgggttaccccctgccaaactccttacacgcagtaccacctaaacaagctggatcagaacatcatcccagagaatttacccgcccccaccgataagtgcaagctgaagtaccagcagtgtaagactgaaatcaaggaagggtataaacagtatagccaaagaaacgccgagaatacaaaatccaatgttacccataaacagtctcctcgcaataagatcgatgagaagtgcgtgcaggatgaggaagccaatactgacgacctcacgacgttagatcggaaggccatcctgcagcaggggtatgccgacaactcatgcgacaagcagcagcgtgcacggaaattggatgccgaaatcgtcgccgcagagaagaagaaacagatcgtggccgaacaggtcatgattgaccatctgagtcgggcagtgatatctgacccggagcaaaacctcgccatcgagcagaaagaatccgatcatatccttccagacagtaagatgacaccgctgcgatttcgtaagcgaactctgcatgagaccaagatcagaacacatagcacactcaccgagaacgttctgtcacataagttacagtttgacggtcgcatagtgagccggaacggtcgcgatgcatgtagggaactgatagggtttttcttcacccacgaccaaagcctgaccatttatgagtacaggcagtttggaaagaatcgaaccaacgtgcttccttttatccagaaatctatctattcccaccagtgtggccgccgcaagggaaagcagtacaggctgggcgatttctacgttggggcaaccttaacctttttatcttcagatcacctaagccttcccgaatctattaaagaaaacacgttgctgaagctccgcatcacaaacatcgaccaaattgccctggattcactaaagactgcctccatggagcaggaagatgatattatcattcaggagactaacgatcgactggttttcaaagcaattcaggatgtgctgaaggaaaagctacataagcgtggcgtccgaatccttacaggactgggtaagtactttcagcagctagacaaggagggcaacgggcttctggataaggcagactttaagcaggcattgaaggtgttccacctggaagtgtccgagaaagatttcgagtctgcgtggcttattctcaatgataatggcaatggaaaggtggattatggcgaattcaagaggggcatcattggggagatgaacgagtacagaaagtcttatgtgcgaaaagccttcatgaaattagacttcaacaagagtgggtcggtccccatcattaatatccgcaaatgctattgcgcgaagaagcattctcaggtaatcagtgggtag

SEQ ID NO: 181340 - DNA, 615 bp, Artificial Sequence
  Description of Artificial Sequence: Synthetic coding sequence
atggagcaggaggacgacatcatcatccaggagaccaacgaccggctggtcttcaaagccatccaggacgttctgaaagaaaagctgcataagagaggcgtccgcatcctgacaggcctcggaaagtacttccagcaacttgataaggaaggtaatgggctgctggacaaggctgactttaaacaagccctgaaagtttttcatttagaggttagcgagaaggatttcgagtctgcctggcttattctaaacgataatggaaatgggaaagtggactacggggaatttaaacggggcataattggcgaaatgaacgagtataggaaatcgtatgtgaggaaagcgttcatgaaacttgactttaacaaatctgggtcggtccccataataaacatcagaaaatgctactgcgccaagaagcatagccaggtgatttcgggccactccacagaggaagagattaaaagctcattcctcgaaacactgaaggtagcttgttcaaagtccgatgaggtgtcctatggtgaattcgaagactattatgaggggctgtctattggcatagtcgatgacgaagactttgtgaatatccttcgaactccctgggggatatag

SEQ ID NO: 181341 - DNA, 3009 bp, Artificial Sequence
  Description of Artificial Sequence: Synthetic coding sequence
atggccgcccacgagtgggactggttccagcgggaggagctgatcggacaaatatctgacatcagggtacaaaacttgcaggtggaaagagagaatgtccagaaacggacattcaccagatggattaacctgcacttggagaaatgtaacccacccctcgaggtgaaggacctgtttgtggacattcaggacggcaagattctgatggcactcttggaggtccttagtggacgcaaccttttacacgagtataagagttcttcccacagaatcttcagactgaataatatagcaaaggccttaaagtttttagaggattctaatgttaaattagtctccattgatgcggcagagatcgcagacggaaaccccagcctggtgttgggtctcatctggaacatcattctttttttccaaattaaggaactgacaggaaacctgtcccgcaacagtcctagctcttcactatcacctggaagtggtggtaccgactccgattcatccttcccgccaactcccacggccgagcgttctgtggcaatttctgtcaaggaccagcgcaaggcaataaaggctcttttggcatgggttcaaagaaaaacaagaaaatatggcgtggccgtgcaggatttcgccgggtcctggcgctccggacttgcattcctcgctgtgatcaaagcaatcgatccgagtttggtggacatgaagcaggccctagagaacagcacaagagagaacctggagaaagcatttagcatcgcccaagatgcactgcacatacctaggctgctggagcccgaggatatcatggtggacacacctgacgagcagtctatcatgacgtacgtggcccagttcctcgaaagatttccggaactggaggctgaggacatcttcgattctgataaagaagtgcctatcgaaagcacctttgtcagaataaaggagactcctagtgagcaggagtccaaggtcttcgtcctcaccgagaacggagaacgaacgtacacagttaaccatgagacctcacaccccccacccagtaaagtgttcgtttgtgacaagcccgaaagtatgaaggaattcagactcgatggagttagctctcacgcactgtccgatagctccacagagtttatgcatcaaattatcgaccaggtgttgcagggcggcccagggaagacttcagatatcagtgagcctagtcccgaaagctctatcctcagtagtagaaaagaaaacggaaggagcaattccctccccatcaagaaaacggtgcacttcgaagctgacacctataaagacccattctgttcaaagaatctgtctctgtgcttcgagggttcacctagggtcgctaaggaaagtctgcggcaagatggtcatgtgctcgcggttgaagtggccgaagagaaagaacagaagcaggaaagctccaagatccctgaatcctcatccgataaagtagcaggcgacatctttttagtggaaggaactaacaataactctcagtcaagctcctgcaacggcgccttagagagtactgctcgccatgacgaggagagtcactcgctgtcaccaccaggggaaaacaccgtgatggccgatagcttccagatcaaggttaacttaatgactgtggaggctcttgaagagggagattatttcgaggcgatccccttgaaagccagcaaatttaattctgaccttatcgactttgcatcaacctcccaggctttcaacaaagtccctagcccacacgaaaccaagccagatgaagacgccgaggcatttgagaaccatgcggagaagctgggaaaacgcagtattaaatctgctcacaaaaagaaagatagcccagagcctcaggtgaagatggacaaacatgaaccgcaccaggattctggcgaagaggctgaaggctgcccctccgccccagaagaaacccccgtagataagaagcccgaggtgcacgagaaggccaagcggaagtccacgaggcctcactatgaggaagaaggagaggatgacgatctacaaggggttggcgaagaactgagtagcagccctcccagcagctgcgtttccttggagactctgggaagtcatagcgaggaaggattggacttcaagccatctccccctctgtcaaaagtgtcggtgattcctcacgaccttttctatttcccacactatgaagtgcccctggcagcggtgttggaagcttatgtcgaagacccggaagacctgaagaacgaggaaatggacctggaggagccagagggctatatgccggatctcgactcccgtgaagaagaagctgatggctcccaaagcagtagttctagcagcgtccctggagaatcacttcccagtgccagtgatcaggtactctacctttctaggggcggggtgggaactacgcccgcttcagaaccagcgcccttagcaccccacgaagatcatcagcagcgagagacgaaagaaaacgaccccatggatagccaccagtcgcaggagtcacccaatttagagaacatagccaaccccctagaggaaaacgtgactaaggagagcatctcttccaagaagaaagagaaacgaaagcacgtggatcacgtagaatcctccctttttgtcgctccgggctctgtgcagagttccgacgacctggaggaagactcatccgattacagtatcccctcacggacgagccattcagatagtagcatctatctacgccggcatacccacaggtctagtgaatcggatcacttttcctatgtccagctcaggaatgcagccgatctggatgaccgtcgtaaccggattctcactaggaaagcgaattcgtccggcgaggccatgtcgctcggaagccactctccccagtccgactcactgacccaactcgtacagcagcctgacatgatgtatttcatcctgtttctgtggctccttgtgtactgtctcttgctcttcccccagctggatgtgtcaaggctatag

SEQ ID NO: 181342 - DNA, 450 bp, Artificial Sequence
  Description of Artificial Sequence: Synthetic coding sequence
atggccgaccagctgaccgaggagcagatcgccgagttcaaggaggctttcagcctgtttgataaagacggcgatggtactataactaccaaagaattggggacggtaatgaggtctctgggacaaaatccaacggaagctgaacttcaggacatgattaacgaagtggacgcagacggcaacggcacaattgattttccagaattccttacaatgatggcccgaaagatgaaggacaccgacagcgaggaagaaatccgagaagctttcagggtgttcgataaggatggcaacggctatattagtgcggccgaactcagacacgtgatgactaatctgggcgaaaagctgacggacgaggaggtggatgagatgatcagggaagctgacatcgacggagacggacaagtaaactacgaagaattcgtgcagatgatgaccgcaaagtag

SEQ ID NO: 181343 - DNA, 450 bp, Artificial Sequence
  Description of Artificial Sequence: Synthetic coding sequence
atggccgaccagctgaccgaggagcagatcgccgagttcaaggaggccttcagtctttttgataaggacggtgacggaactatcaccactaaggagttgggcacagtcatgagaagcctgggacagaacccgactgaagccgaactgcaggacatgataaatgaggtggacgcagatggaaacggaacaattgacttccccgaatttctgacaatgatggctcgcaagatgaaggacaccgattccgaagaagaaattagggaggctttccgagtatttgacaaagacggaaatggctatatctcggcagccgagcttcgacacgtgatgactaacctcggcgagaaactcaccgacgaggaggtggatgagatgatccgtgaggctgacattgacggcgacggccaggtgaactacgaggagttcgtacagatgatgactgccaagtag

SEQ ID NO: 181344 - DNA, 450 bp, Artificial Sequence
  Description of Artificial Sequence: Synthetic coding sequence
atggccgaccagctgaccgaggagcagatcgccgagttcaaggaggcattttccctgttcgataaagacggtgatgggacaatcactacgaaagagctgggtaccgtcatgcgatcgctgggccagaatcctacagaggcagaactccaggacatgattaatgaggtagacgccgatggcaacgggacaatcgatttccccgagtttctgacgatgatggccaggaaaatgaaagatacggatagcgaggaggagatccgggaagcgttccgggttttcgacaaggacgggaatggatatattagcgctgccgagctgaggcacgttatgactaacctgggggaaaagctcactgatgaagaggtggacgagatgatcagggaagccgacatcgatggagatggccaggtgaactatgaagagtttgtccagatgatgactgctaagtag

SEQ ID NO: 181345 - DNA, 450 bp, Artificial Sequence
  Description of Artificial Sequence: Synthetic coding sequence
atggccgaccagctgaccgaggagcagatcgccgagttcaaggaggcatttagcctcttcgacaaagacggagacgggacaatcacaaccaaagaactgggaacagtcatgcgttcacttgggcagaatccgacagaggccgagcttcaggacatgatcaacgaggtagatgccgatggcaatggcaccatagacttcccagagttcctgaccatgatggctcgcaagatgaaggacaccgattcagaagaggagataagagaggctttccgagtgttcgataaggatggcaatggctatattagcgctgccgaactgcgccacgtgatgaccaatctgggagagaaacttaccgacgaggaagttgacgaaatgatacgcgaggccgacatcgacggagatggccaagttaattacgaagaatttgtgcagatgatgacagcaaagtag

SEQ ID NO: 181346 - DNA, 5022 bp, Artificial Sequence
  Description of Artificial Sequence: Synthetic coding sequence
atgtggcgggccgagggcaagtggctgcccaagaccagccggaagtctgtgagccaaagcgtcttctgcggaactagcacatattgtgtcctcaacaccgtgccacctatcgaggatgaccacggtaattctaacagctctcacgtcaagatcttcctgcctaagaaactgttggaatgtctgcctaaatgttctagtctgccgaaagaacgccaccgatggaacacaaatgaagagatcgctgcttacttgatcactttcgaaaaacacgaggagtggctgactacttctcctaaaacaagaccgcagaatggttccatgatactgtataacaggaagaaggttaagtatcgaaaggacggttattgctggaagaagcggaaggatggcaagacaacacgggaggaccatatgaagctgaaggttcaaggcgtggagtgtctgtacgggtgctacgtgcattcttcgatcattccaacatttcaccggcggtgctactggctactgcagaacccagacatcgtgctcgtccattaccttaacgtgcctgccattgaagactgtggaaaaccatgcggccccattctgtgtagtattaatacggataagaaggaatgggctaagtggaccaaggaggagctaatcggacaactcaagccgatgttccacggcatcaagtggacctgcagtaacggcaacagtagtagtggctttagtgtcgagcaactcgtgcagcagatcctcgactctcaccaaaccaagccacagcctaggactcacaactgcctttgtaccggctcacttggagccgggggatccgtccaccacaagtgtaatagcgcaaagcaccgcatcatctcgccaaaagtagaaccacgcaccggagggtatggctcacattctgaagtacagcataacgatgtcagcgaagggaagcacgagcacagccattcgaaggggtcatcacgggaaaaaaggaatgggaaagtggccaaaccagtactgctgcaccagtcctccacagaagtgagctccaccaatcaggtcgaggtgccagatacaactcagtccagccccgtttctatttcatcagggttgaacagcgacccagacatggtggacagccccgtggtcactggggtttctggtatggctgttgccagcgtcatggggtctcttagtcagtctgcaaccgtgttcatgagcgaggtgacaaacgaggccgtttatacaatgagccccacagcaggccctaaccatcacctgttatcccccgatgccagccagggactggttctggctgtgtcttctgatggccataagttcgctttccctaccacaggcagcagcgaatcactgtccatgctgcccactaatgtgtccgaggagctggtgcttagtaccacactggacggcggccgtaagatccctgagacgactatgaactttgatcccgactgcttcctgaataatcccaagcaaggccagacttatggcggaggtgggttgaaggctgagatggtgagcagcaacatcagacactcacctcctggagagaggtcgttctctttcactacagtcttaactaaggaaattaaaaccgaggacactagctttgagcagcagatggccaaagaagcatactccagtagtgctgccgcagtagcagccagctcactaacccttacagccggctcatctcttttaccttccggcggcggcctaagtccatctacgaccctggagcagatggacttctccgcaatcgattctaataaggattatacttcaagctttagccagactggacacagtccacacatacatcagacccccagccccagttttttcttacaggacgcgtcgaagcccctgcccgtggagcagaatacccacagctctctgagcgacagcggagggacctttgttatgccaacagtcaaaacagaggccagctcccagacgagttcctgctcaggtcacgttgagacccgtatagaaagcacttcttctctacatctgatgcaattccaggccaacttccaggctatgaccgcagaaggtgaggtaaccatggaaacctcccaagccgccgagggaagtgaagtgttattgaagtcgggtgagttgcaggcgtgctcctctgagcattacttgcagcccgaaacaaacggagttataaggtctgccggcggcgtgccgatattgcctggtaatgtggtgcaggggttatatcctgtggcacagccatcactcggcaatgcctctaacatggaactgtcccttgatcactttgacatttcattctctaaccaattttctgatctcatcaacgacttcatttcagttgagggtggatctagtaccatctatggtcatcagctcgtgtcaggggactctactgccctcagccagagcgaggatggtgcacgcgctccatttactcaggccgagatgtgtctcccatgctgctctccacagcagggctctctgcagttaagcagtagcgaaggcggcgcatccactatggcatatatgcatgtggccgaagtagttagtgcagctagcgcgcaaggtaccctgggaatgcttcagcaatctggccgggttttcatggtcaccgactacagcccagagtggtcttaccctgaggggggcgttaaggtcctgataaccgggccctggcaagaagcctccaacaattacagttgtctattcgatcagatatcagtccctgcttcattgattcaacccggcgtacttaggtgttattgccctgcccacgacaccggcctcgtcacgcttcaggtggcctttaacaaccaaatcataagcaactccgtggtctttgagtataaagctagggcactgccaaccctgccatctagtcagcatgactggttgagtctggatgataaccaatttcgaatgtccatccttgagcgccttgagcagatggagcgtaggatggccgaaatgactggcagtcaacagcataaacaggcctcaggcggtggcagctctggcggagggagcgggagcggcaacggcgggagccaagcgcagtgcgcgagtggaaccggcgcactcggctcatgcttcgaaagtcgtgttgtcgttgtgtgcgaaaaaatgatgtccagggcctgctgggcaaagtccaagcatctcatacatagtaaaacatttagagggatgacgctcctgcacctggctgcagcacaggggtatgcgactttaatacaaacccttataaagtggcgcaccaaacacgctgattctattgatctagagctggaggtggatccactgaacgtcgatcacttctcctgcacccctctgatgtgggcatgtgccttagggcacctagaggcagccgtggtgctctacaagtgggaccgccgggctatttcaatccccgattccctggggcgcctgccactgggcatcgcacgttcacgcggtcacgtgaaactcgcagagtgccttgaacatcttcaacgcgatgagcaggcccaactcggacagaacccgaggatacattgtcctgctagcgaggagccaagtaccgagtcttggatggcccaatggcacagcgaggcaatctctagtccggagattcctaagggcgtgacagtgatcgctagcacaaatcctgagctgcgtcgccccaggagcgagccctcaaattactattctagcgagagccacaaggattaccccgcccctaagaaacacaagcttaaccccgaatactttcagaccagacaggagaaacttctgcccaccgcccttagtctggaggaaccgaacattcgaaagcagagcccgagcagcaagcagtctgtcccagaaacacttagcccatccgagggcgtccgggacttcagccgggagctctcgccgcccacccccgaaactgctgcttttcaggctagcgggagccagccagtcggaaagtggaatagtaaggacctgtatattggggtctccacggtgcaagtgacggggaatcctaagggaacctccgttgggaaagaggctgctcctagccaggtgcggcctcgggagcccatgtccgtgctgatgatggccaatcgagaagtggtcaacacagagttgggctcctacagggattcagcggagaacgaggagtgtggtcagcccatggacgacatccaagtgaatatgatgacattggcagagcacatcattgaagccacccctgaccgcatcaaacaggaaaacttcgtgcccatggagagctccggactggagcggacagatccagccaccattagtagcacgatgagctggcttgcctcttatttggcggacgcagactgtctgccttctgcggcacagattcggtcagcctacaatgaacccttaacaccctctagtaacacaagcctctctcccgtagggtcccccgtctcagaaatagcgttcgaaaagcctaatctgcctagcgctgcggactggtctgaatttctgagcgctagtacctcagaaaaggtggaaaacgagttcgcccagctgacgctttctgaccacgagcagcgtgagctgtacgaagcggcccggttggtacagacagcctttaggaaatacaagggacggccgctgcgcgaacagcaggaggtcgccgccgctgttattcagagatgttatcgcaaatataagcagtatgcactgtacaagaaaatgacacaggcggcgattctgatccaatccaagttcagatcctattacgagcagaagaagtttcagcagtcacggcgggccgccgtgcttatccagaagtattacaggagttataaaaagtgcggcaagcgacggcaggctagacggactgccgttatcgttcagcagaagctccggagcagtctcctaactaagaagcaagaccaagccgccaggaagattatgagatttctgaggagatgccggcactcgcctctggtcgatcataggctctataagcgaagtgagagaatcgaaaaaggccagggaacatag

SEQ ID NO: 181347 - DNA, 1911 bp, Artificial Sequence
  Description of Artificial Sequence: Synthetic coding sequence
atgatgagccgggcctgctgggccaagagcaagcacctgatccactccaagacttttcgcggtatgacccttctccatcttgccgcagctcaaggctatgccacactaatacagacactcatcaaatggcgtaccaaacacgcagactcgatcgacttagagttagaggtagatcctctgaacgtggaccatttttcttgcactccactgatgtgggcctgcgccctaggacacctcgaggctgcggttgtactgtacaagtgggaccggagggctataagtatcccagattccctggggaggctgccattgggcatagccaggtcccgtggacatgtcaagctagccgagtgcttggagcacctccagagggacgagcaggcccagctcgggcagaatccccgaatccattgccccgcgtccgaagagccctccaccgaatcttggatggcgcaatggcattccgaagccattagcagtcctgaaatcccaaagggtgtaaccgtgattgcttccactaaccccgagcttcgtaggccccggagcgagccttcaaattattacagcagtgagtcacacaaggattatcctgccccaaagaaacacaaactgaaccctgagtactttcaaactcggcaggaaaagctactccctactgcattgagtctcgaggaacctaatattcgcaagcaaagtccatccagtaaacagtcggtccctgaaactctctccccttctgagggcgttcgggattttagtcgtgagctcagtccccctacccccgaaaccgctgcgttccaagcctcaggcagtcagcctgtgggaaaatggaactccaaagacctctatataggcgtttcaactgtccaggttacaggcaacccgaaggggaccagcgtcggcaaggaagccgccccctcacaggttcgacctagagagcccatgagcgtcctgatgatggcaaatcgggaggtggtaaacactgaactgggttcctatagggacagtgccgagaacgaagaatgcggacaaccgatggacgacattcaggtgaacatgatgactctcgccgaacatatcatcgaagccactcccgatcggatcaagcaggagaacttcgtcccaatggaaagcagcggactcgagagaaccgatccagccaccatcagtagtaccatgtcttggcttgcttcctacctcgcggacgcagactgtctccccagcgccgctcagataaggagtgcttacaacgaacctctgacaccgtcctcaaatacttcactgtcgccagtcgggagcccagtctcagagatcgcatttgagaaacctaatctgccgtcagccgctgactggtctgagtttctaagtgcaagcacctccgaaaaagtcgagaatgaattcgctcaactaacgctctctgatcatgaacagcgtgaattgtacgaggccgcccggctggttcagaccgcattccgcaagtacaaagggagacccctgagagaacaacaggaggtagccgcagcagtgattcaacgatgttaccgtaagtataaacaagggaaaaacatttgtctgaagtacgccttgtacaagaagatgacacaggctgccatactcatccaatctaaattcagatcttactatgagcagaagaaattccagcaaagtcgccgtgctgcggtactgattcaaaagtactataggtcctataagaagtgcggaaaaagacgacaggcacgacggaccgctgtgatcgtgcagcagaagctccgaagtagcctcctgaccaagaagcaggaccaagccgccagaaaaataatgaggtttctaaggaggtgcaggcacagagtgaaggaactaaagaaggctaaggagctggaggacatccagcagcaccccctcgccatgtag

SEQ ID NO: 181348 - DNA, 2151 bp, Artificial Sequence
  Description of Artificial Sequence: Synthetic coding sequence
atggcctgccccgtgagccccgaccacaagcaggagggcgcccacgacaccggtcttgtgacactgcaggttgctttcaacaatcagataatttccaactcagtggttttcgaatacaaagcgagggcgctccctacactcccatcgtctcagcacgattggctgagtttggatgataatcagtttcgcatgagtatcctggagaggttggaacagatggagcgacgaatggccgagatgactggctctcagcagcacaaacaggccagtgggggggggtccagcggcggtgggagtggcagcgggaatggaggaagccaggcccaatgcgcaagtggcaccggagcattagggtcctgctttgaaagtcgggttgtcgtggtgtgtgagaaaatgatgagccgcgcttgttgggccaagtctaagcatctcatacattccaagaccttccggggcatgaccctacttcatctggccgccgctcagggatacgcaactcttattcagaccctgataaaatggcggacaaagcacgccgacagcatcgacctcgagctggaggttgaccccctgaacgttgatcatttttcttgtactcctcttatgtgggcctgtgccctgggacacctcgaagccgcagtggtgctgtacaagtgggaccgaagggctatttctatccccgactccttaggaagactgccacttggcattgccagaagcagagggcacgtgaagttagccgagtgccttgagcacttacagcgcgatgagcaggcccagttaggccaaaatcctcggatccattgcccggcctcagaggagccatccactgaatcctggatggcccagtggcattcagaggccatttccagtccagagattcctaaaggcgtaacggtaatcgcctccacgaaccccgaactgcgccgtccccggagcgaaccgtcaaactactacagctccgagagtcataaagattacccagccccgaaaaagcacaaattgaacccagaatactttcagacccggcaggaaaagctcctgcccacagcgctgtctctggaagagcctaatatccgaaaacagtctccttcctccaagcaaagcgtacctgaaaccctctcacccagtgaaggggtacgcgatttctccagagagctatcaccacctacgcctgagacagccgcttttcaggcatctggctcccaaccagtgggcaagtggaatagtaaggatctctacatcggcgtcagcacagtgcaagttacgggcaacccgaagggaactagcgtcgggaaagaagccgccccctcccaggtgaggccgcgggagcccatgtctgttctgatgatggccaaccgggaggtggtgaatacagagctcggttcctatcgggacagcgcggaaaacgaagagtgcgggcagcccatggacgacattcaggtaaacatgatgacactcgccgagcatatcatcgaagcaacgctttcaagcactatgtcctggctggctagctacctcgctgatgctgactgcctgccatctgccgcccagatcaggagcgcatataacgagccacttaccccatcttccaacacaagcctcagccctgttggaagcccagtgtctgaaatcgcctttgaaaaggttgaaaatgagtttgcccaactgaccttgtctgaccatgagcaacgggagctgtacgaggccgctcgcctagtgcagaccgccttcagaaagtacaagggcaggcccctgcgcgagcaacaggaagtagcagccgccgtgattcagcgttgctaccgaaagtacaagcagtacgcattgtataaaaagatgactcaggctgcaatcctgatccagagcaaattccgctcatactatgaacagaagaagttccagcaatctcgcagggctgccgtgttgatccagaagtactacaggtcctacaaaaaatgcggtaagcggcgacaggccaggcgtactgccgtcattgtgcagcagaagttacgttccagcctactgactaagaagcaggatcaggcggcgcgcaagattatgcgctttctcaggcgttgcagacaccgggtaaaggaactcaagaaagccaaagaattggaggatatccagcagcatcccctggccatgtag

SEQ ID NO: 181349 - DNA, 4980 bp, Artificial Sequence
  Description of Artificial Sequence: Synthetic coding sequence
atgtggcgggccgagggcaagtggctgcccaagaccagccggaagtctgtgtcccagagcgtgttttgcggtacatcaacatactgtgtcctgaacactgtcccaccgatagaggacgatcatggcaactcgaactcttcacacgtgaaaatctttctgccgaagaagctcctggaatgcttgcccaaatgcagcagcctacctaaggaacgccatcgctggaacaccaacgaggagatcgctgcatacctcatcaccttcgaaaagcacgaagagtggcttactacttccccgaagaccagacctcaaaatggctcaatgatcctttacaacaggaaaaaggttaaatatcgcaaggatggctactgttggaagaagagaaaagatggcaaaacaacacgggaggaccatatgaagctgaaggtgcaaggggtcgaatgcctctatggatgttatgtacactcatcaattattccaacttttcaccgtagatgttactggctacttcagaaccccgacatcgttctggtccattatctgaatgtgcccgccattgaggattgcggaaagccgtgcggcccaatcctttgtagtattaatacagataagaaggaatgggcaaagtggacaaaagaagaattaatcggccaactaaaacctatgttccacggaatcaagtggacttgctctaacggaaatagctcttccgggtttagtgtggagcagctggtccagcagattctggactcccatcagaccaaacctcagcccaggactcacaattgtctgtgcaccgggagcctcggagcaggaggttcagtacatcataagtgcaactccgccaagcacaggattatcagcccaaaggttgaacctcggaccggtggatacggttcccactcagaggtgcagcacaacgatgttagtgaaggcaaacacgagcattcccattctaaagggagtagtagggagaagagaaacgggaaggtggcaaagccagtgctactgcatcagtcgtctacggaagtgtcctccaccaatcaagtcgaggtacctgatactacacagagctctcctgtctcaattagtagcggcttgaactctgacccagatatggtagactcacccgtagtgacaggcgtttctggaatggctgtggctagcgtcatgggatccctgagccagtcagcaacagtattcatgtctgaggtgaccaacgaggcagtatatacaatgtcccccactgccggacccaaccatcatctgttgagcccagatgcctctcagggtcttgtccttgcagtgagcagcgacggccacaaatttgctttccctactacagggtccagtgagtctctgtcaatgctgccaacaaatgtgtctgaagagctggtactttccacaaccttggatggaggtcgtaaaatccctgaaactaccatgaacttcgaccctgactgttttctgaacaacccgaaacagggccaaacctatggcggcggcgggcttaaagccgagatggtctctagcaatattagacattcacctcctggcgaaaggtccttcagctttaccaccgtcctgaccaaagaaatcaaaacggaggatacgagtttcgaacagcaaatggccaaagaagcttattccagtagtgccgcggcagtggcggcatcttcattgacactgacagccggctcctccctgttaccgagcggcggcgggctcagtccctcaactaccctggaacagatggacttctccgctatagactccaacaaagattacacctccagcttttctcagacaggtcattcacctcatattcatcaaactcctagtccctcgttttttctccaggatgcctctaagcctctgccagtggagcaaaatactcactcctcccttagcgattcagggggcaccttcgtgatgcccacagttaagaccgaagcgtcaagtcagacctcctcatgctctggccatgtggagactcgaattgagagcaccagctccctgcacctcatgcagtttcaagctaacttccaagccatgactgcagaaggggaggtcaccatggagacaagtcaggccgccgaggggtccgaggtgctgcttaagagcggcgagctgcaggcttgctccagtgaacactacctgcagccagaaaccaatggagtgataaggtcagctggaggcgtaccaatcctgccaggaaacgttgtccagggcctgtaccccgtggctcagccatccctgggtaacgcctccaacatggagctgtctctggaccattttgatatttcattctccaatcagttctccgacctgatcaatgattttatcagtgttgaaggcgggtcttcaacaatctacggacatcagcttgtgtctggtgattccaccgcactgagtcagtcagaagatggtgctagagcccctttcactcaagcggagatgtgcctcccatgctgctccccacaacagggcagtcttcagctgtctagcagtgaggggggtgcctctactatggcctacatgcacgtcgcggaggttgtcagtgccgctagtgcgcaaggtactctgggaatgctgcagcagtccggccgggtgttcatggtcaccgactattcccccgagtggtcataccccgagggtggcgtgaaggtactaatcaccggaccctggcaggaagcctccaacaattatagctgtctgtttgaccaaatctctgtgcccgcgagcctgattcaacccggggtgctccgctgttattgtcccgcacacgacacaggcctggtgactctacaggttgcattcaataatcagattattagtaatagcgtcgtgtttgagtacaaggcccgagcactccccactctgccatcatcccagcatgattggctgtcactggacgacaatcagttccgcatgagtatcttggagagactggagcagatggaaaggagaatggccgaaatgacaggctcacaacagcacaagcaggcctccggcgggggtagttctggtggcggctctggttccggaaacggagggtcacaggcccagtgcgcatcgggcacaggagcactcgggtcctgctttgagtctagggtcgttgtggtgtgcgagaaaatgatgagtcgggcgtgttgggctaagagtaagcatctgattcactctaagacattcaggggtatgactttgctccacctggccgcagcacaggggtacgccacactgatccaaactcttattaaatggcgcactaagcacgctgactccatcgatctcgagctagaggtggaccccctgaatgtggaccactttagttgtactcctctgatgtgggcctgcgccctgggacacctggaagctgcagtagtgctgtataaatgggatcggagagccatatcaataccggactccttgggacgcttgcctttaggaattgcccgtagtcgtggacacgtgaaactcgccgagtgcctagaacatttacaaagagatgagcaggctcaactcggacagaacccacgcattcactgtccagcctctgaagagccttccaccgagagttggatggcccagtggcatagcgaggccattagcagtccagaaataccgaagggtgttacagtcatcgcctcaactaatcctgagctgaggagacctagatccgaaccctccaactattatagcagcgagagccataaggactaccccgccccaaaaaaacacaaactcaaccctgaatactttcagacacgacaggaaaagctcctgcctacagcccttagcctggaggagcccaatatcaggaagcaaagcccatccagcaaacaatcagtgcctgaaaccctgtcccctagcgagggagtgcgtgacttcagtagagaactcagcccgcccactcctgaaacggctgccttccaggccagtgggtcccaaccggtgggcaagtggaacagcaaagacctttacattggagtttccactgttcaagtgacaggcaaccctaagggaacatccgttggtaaagaagctgcccccagccaggtgagacctagagaaccaatgtctgtgctgatgatggctaaccgcgaggtggtgaacaccgagctcggctcatatcgggatagcgcggagaatgaagagtgtggccagcctatggacgacatccaggtgaacatgatgacactggccgagcacatcatcgaggccacacccgaccgcatcaagcaggaaaattttgtccccatggaatctagcggcttggagcgcacagaccccgcaactatctcttccacaatgagctggctcgcctcctacttagcagatgccgactgcctcccgtcagcggcacaaattagactgtcgccggtgggcagtccagtctcagagatagcttttgagaaacctaacctgcctagcgctgctgattggtccgaatttctgagtgcatccacctccgagaaggtggagaatgagttcgcacagctgactctgtcggaccacgagcaaagagagctctatgaagctgcccggctggtgcagactgcatttcgtaaatataagggtcgtcctcttcgcgagcaacaggaggtggccgctgccgttatccagcggtgctatcggaagtataagcaatatgcgctgtacaaaaaaatgacccaggctgcaattctcatacagtcaaaatttcggagctattacgaacagaagaagtttcagcagtcaagacgggcagcagtactaatccagaaatattacagatcctacaaaaaatgtgggaaaaggcggcaggctagacgaaccgcagtgattgtccagcagaagctccggagctccctgttaacgaagaagcaggaccaggcagcgaggaagatcatgcgcttcttgaggcgctgccgacatcgagtgaaagaactgaaaaaggcgaaagaactggaggacatccagcagcaccctctggcaatgtag

SEQ ID NO: 181350 - DNA, 243 bp, Artificial Sequence
  Description of Artificial Sequence: Synthetic coding sequence
atgtggcgggccgagggcaagtggctgcccaagaccagccggaagagtgtgtctcagtctgtgttttgcggcacatctacttactgtgtcctgaatacagtgccaccaatagaggatgatcacggtaatagtaacagtagtcacgtcaagatcttcctgccaaagaagctcctggaatgtctgcctaaatgcagtagcctgcccaaggagcgacaccgatggaatacaaacgagcggtcttag

SEQ ID NO: 181351 - DNA, 306 bp, Artificial Sequence
  Description of Artificial Sequence: Synthetic coding sequence
atgtggcgggccgagggcaagtggctgcccaagaccagccggaagtccgtgtcacaatccgtcttctgtggcacttctacatattgtgtgctgaacacagttccccctatcgaggatgatcatggcaattctaactccagccatgtcaaaattttcctcccaaagaaactgctggagtgtttgccaaagtgttcctctctgcctaaagagcggcaccgctggaatacaaacgaagcacttactactcacctctttatgggagccgctaaaaagcgcgaccctcagagctggagtcatgagggttag

SEQ ID NO: 181352 - DNA, 3609 bp, Artificial Sequence
  Description of Artificial Sequence: Synthetic coding sequence
atgaacaccaaggacaccaccgaggtggccgagaacagccaccacctcaagatcttcctcccaaagaagctgctcgaatgtttgcctcgatgtccgctattgcctcctgaacgactgcgctggaacaccaacgaggaaatcgcgagctacctcatcacgtttgaaaagcacgacgagtggctgagctgtgcccctaagactagacctcagaatggcagcataattctgtacaaccgcaaaaaagtgaagtatcgcaaggatgggtacctatggaagaagcggaaggatggcaaaacaaccagggaagaccatatgaaattaaaggtccagggcatggagtgcctgtacggatgttacgtccattctagtatagtccctacatttcaccgtcggtgctactggctgctgcagaaccccgatatagtcctggtgcactacctgaatgtcccggcattggaggattgtggtaaaggctgcagtcctatcttctgttcgatatcatctgaccgtcgcgagtggctgaagtggagcagagaggaattgctgggacagctcaaacctatgtttcacggtataaagtggtcatgcgggaacggcacggaagaatttagcgtcgaacaccttgtgcagcagattctggacacacaccctactaaaccagccccgcggactcatgcttgtctgtgttccggagggcttggctctgggtcccttacccacaaatgttcaagcactaagcataggattatcagcccaaaggtagaaccccgcgcgctgacactcacctccatcccgcatgcccacccacctgaacctcccccgctcattgccccacttcctccagaattgcctaaggcgcacacttcaccctcttcatctagcagttccagcagcagcggattcgccgaaccattggagatccgaccatcccctccaacttctagaggagggagctcccgaggggggacggcaatactgcttctcacgggattagagcagagagccggcgggttaacaccgacacgacacctagccccgcaggccgatccacggccatccatgtctcttgccgtagtggttgggacggagccgtctgcccctcctgcacctccttcaccagctttcgacccagatagatttctgaactctccacagcgagggcagacttacggcgggggacagggagtgtccccagacttccctgaggcggaggccgcccacacaccgtgctctgctctagaacctgccgcagctctggagcctcaggccgccgcacgaggcccccccccccagtccgtggccggcggtcgcaggggtaactgcttctttatacaagacgatgactcaggggaagagctaaagggccacggcgctgctcctcccattccttctccacccccctcccctcccccatcgccagcgcctctggagccttctagcagagtaggccgaggcgaggcactttttggggggccagtgggagcgtccgagctggagccattttctttaagtagctttccagatctgatgggagagctcatctccgacgaggccccctccatcccagcaccgacaccccaactatcaccagccctctctacgattactgacttttcccccgagtggtcttatccggaggggggggtgaaggtgctcataacaggcccttggactgaggccgcagaacattacagctgcgtgttcgatcacatcgcagtccccgcctctttggttcagcccggagtcctgcggtgttactgcccagcccacgaggtggggctcgtgtccctgcaggtagccggacgggagggcccgctcagcgcctcggtcttgtttgaataccgggcccggcggtttctttcactgccttctacacagttggactggctgtcattggatgacaatcaatttcgaatgagtatattagagaggctggaacagatggagaaaagaatggccgaaatcgctgccgccggacaagtgccttgccaggggcccgacgcacccccagtacaggacgagggtcagggccccggattcgaagctcgggtagtggtcttggtcgaaagtatgattccacgctccacatggaaaggacccgagcggctggctcatgggtctcccttccgaggaatgagcttgctacacctcgctgctgcccagggctatgcccgtctgattgagacgctgtctcaatggagaagcgtggaaaccggtagcctggacctggaacaggaggtcgacccattaaacgttgaccattttagctgcacaccgttgatgtgggcgtgtgccctcggccatctcgaagccgccgtcttgctctttcgctggaaccgacaggcccttagcatcccggatagcctgggccgattgcccttatccgtcgctcattcccgaggccacgtcaggcttgcacggtgcctggaagagctgcagagacaggaaccttcagtggagccacctttcgcgctgtctcccccttcctcatcacctgatacaggcctaagctcggtgtcatcccccagcgagcttagtgatggtactttctccgtgacctccgcctattcctctgccccagacggctcccctcctcctgccccactgccggcttcagagatgactatggaagatatggcacctgggcaactcagcagcggggtgccggaggcacctttgctgttaatggattacgaggccactaactccaagggaccactttctagtctgccagctctgcctccagcctcagacgatggggctgcacctgaggatgccgatagtccccaggctgtggacgttatcccggtcgacatgatcagcctagcaaagcagattattgaggccactcctgaaagaatcaagagggaggacttcgtgggtctacccgaagcaggggctagcatgagagaacgcaccggtgccgttgggttatcagagaccatgtcgtggttggcttcatacctggagaatgtggatcactttcccagcagtacacctccttcggaactcccattcgaacgcggtagactggctgtgccctccgccccctcctgggccgagttcctgagcgcaagcacttcaggcaagatggagagtgactttgctctgcttacattatccgatcacgagcagcgagagctctacgaagccgcgcgcgtgatacaaactgcttttcgtaagtataaaggtaggagattaaaggagcaacaggaagtggccgcggctgtaatccagaggtgctacagaaagtacaagcagctaacatggatagctctcaagtttgctctgtataaaaaaatgacccaagccgcaattcttatacagtctaagttccggagttattatgaacagaaaaggtttcaacagtctcgtcgcgctgctgtactgatacagcaacactatcgatcctaccgccgcagaccgggaccacctcaccggacttcggcaacacttccagcgagaaataagggctccttcctgactaaaaagcaggatcaggctgctcggaagattatgcggttcctgcggcgctgtcgccaccgcatgcgcgaactaaagcagaatcaggaactcgaggggctaccacaaccaggtctggccacgtag

SEQ ID NO: 181353 - DNA, 3588 bp, Artificial Sequence
  Description of Artificial Sequence: Synthetic coding sequence
atgaacaccaaggacaccaccgaggtggccgagaacagccaccacctgaagatttttcttcccaagaagctcctggaatgtctgcctagatgccccctgctgccaccagagaggctgcgctggaatactaacgaggaaatagcttcttaccttattacattcgagaaacatgacgagtggctgtcttgcgctccaaagacccgaccccagaacggatcaataatcctgtacaaccgaaaaaaggtcaagtaccgaaaggacggctatctgtggaaaaagcggaaggacggcaaaactactcgggaagaccacatgaagctcaaagtgcagggaatggaatgcctgtatgggtgttatgttcacagcagcattgttccaacattccatcgacgatgttattggttattgcaaaaccctgatatcgtgctggttcactacctgaatgtgcctgctctcgaagattgtggcaaagggtgctcacctattttctgttctatcagtagcgatcgcagagaatggctgaaatggagccgggaagagctgttgggccagctcaagcctatgttccacggtataaagtggagttgcggcaatggcactgaagagttcagcgtggagcacctcgtgcagcagatcttggacacgcaccccacaaaaccagcaccacgaacgcacgcctgtctctgcagcggggggcttggctctggcagcctaacccataaatgttcctcaaccaagcacaggataatctcgcccaaggtggagccccgcgcgttaactctgacaagcataccccacgctcacccacctgaaccaccccccctcatcgccccactccctcccgagttaccaaaagcacacacctcgccgagctcttccagctcgagcagttcatctggctttgctgaaccactggaaatacgaccatcccccccaacatcgcgtggggggtctagccggggggggactgccatactgctgcttacggggttagaacagcgagcaggggggttgacaccaacacggcaccttgcaccgcaagctgatccacgcccttccatgtcacttgccgtggtggtgggaacagagccctcggcgccacctgctccgccatcccctgcttttgatcctgaccgctttctcaattcaccccagagggggcagacatatggcggaggacaaggagtgagtccggactttccagaggccgaggctgcccacactccatgcagcgccctggagcctgctgcagctctagaaccccaggcagccgcacgcgggccccctccccagtccgtagctggcggacggcggggcaattgcttcttcatccaagatgatgactctggggaggagctgaaggggcatggggcggctccccctatcccctcaccccccccctcgccacctcccagccctgcccctctcgagccaagctcaagagtaggccgtggagaggccttgtttggcggaccagtaggagccagtgaactggagcccttctccctctcgagtttcccggacctgatgggcgagctgatttctgacgaggccccctctattccagccccgacccctcagttgtcccctgccttgagtacgatcaccgacttttctccagaatggagttacccagaaggcggggttaaagttctaatcaccgggccttggacggaagccgccgagcactactcctgcgtttttgatcacatcgccgtgcctgcatccctcgttcagcctggcgtcctgcgctgctactgtccagcacacgaggtgggtttggtgtccctacaggtcgccggtcgggaaggacccctgtctgcatccgtgttgtttgagtaccgggcccgtcgttttctctctctaccttctacccagctggattggctgagccttgatgataaccaattccgcatgtccattctagagaggctcgagcagatggagaaacggatggccgagatcgccgcagcaggacaagtgccatgccagggcccagacgctcccccagtccaggacgaaggccaaggccccggattcgaagcacgcgtggtcgttcttgttgagtccatgattccgagaagcacatggaaaggccccgagcggcttgctcacggcagcccgttccgaggaatgtcactgctccacctcgcagctgctcaaggctacgccagacttattgagacactctcccagtggcgttccgtcgagacaggctcactggacctggagcaggaggtcgaccctctgaacgtcgaccatttctcctgtaccccactcatgtgggcctgtgctctaggtcatctggaagcggcagtcctgctgtttcgctggaaccgccaggccctctcaattcctgattccctgggacgacttccccttagtgtggctcactcgagaggacacgtgcgcctcgctaggtgcctcgaggagctgcagcgacaagagccatccgtggaaccgcctttcgccttgagccctccaagcagctcaccagacacaggcttgtcttcagtttccagcccatcagaacttagtgatgggaccttctcggtgaccagtgcctactcgtccgctcctgatggtagtcctccacctgcgcctctccctgcttcggaaatgaccatggaggatatggcaccagggcaactctcctccggcgtccccgaggctcccctccttctgatggactatgaggctactaacagtaaagggcccttgagctcattgccagcccttcctcctgcatcggatgacggtgcggctccagaggatgctgatagcccccaggcagtggatgttatccccgtggacatgatctctctggccaaacagattatagaggctacccctgagagaattaaaagagaggactttgttgggctgccagaggcaggtgcctctatgagggagcgaacaggcgccgtgggattgtctgagacaatgagctggctggcaagttacctcgagaacgtagaccattttccttccagcactcctccgtccgaattgccgttcgagcggggccgacttgccgttccgagtgctccctcctgggcagagttcctgtctgcctcaacctctggaaaaatggagagcgacttcgccctgttgacactgtctgaccacgaacaaagggaactgtatgaagctgctcgtgtcatccagaccgcttttcggaagtacaaaggtcgaaggttgaaagagcaacaggaagtggctgcggctgtgatacagcgctgttatcggaagtacaagcagttcgctctgtacaagaaaatgacgcaggccgccattcttatccaatccaagttccgctcttactatgagcagaaaaggttccagcagtctcgaagggcggccgtcttgatccagcagcattatagatcttacaggagaagacccggacctcctcaccggacctctgctacgctgcccgcccggaacaaaggttcctttcttaccaaaaagcaggaccaggcagcgagaaagatcatgcggttcttgcgcagatgtaggcaccgaatgcgtgagctgaagcagaaccaggaacttgaaggattgccgcagcctgggttagctacttag

SEQ ID NO: 181354 - DNA, 3606 bp, Artificial Sequence
  Description of Artificial Sequence: Synthetic coding sequence
atgggcaccgacagccccagcccccggcccctgcggcccggcgtgaccctgcctcccggggcattgacgatgaataccaaggatactacggaagttgcagagaattcacaccacctgaagattttcctgcctaaaaagctcctggaatgcctgccgcggtgtcccttgctccctcctgagagacttcgctggaatacaaatgaggaaattgctagctacctgatcactttcgagaagcatgacgagtggctgtcctgtgcccctaaaactagaccccagaacggtagtatcatcctttataacagaaaaaaagttaagtatcggaaggatggctatctgtggaaaaaacgcaaggatggaaaaaccacacgtgaagatcatatgaagctgaaagtacaggggatggagaaccctgatattgtgttagtgcattacctcaatgtgccagcactggaggattgtggcaaagggtgctccccaatattttgttccatcagcagcgacaggcgggagtggctcaagtggtctagggaggaacttcttggacaactcaagcccatgtttcatggcatcaagtggtcatgtgggaacgggacagaggagttttcagttgaacatcttgtccagcagatcttagatacacaccccactaagcccgctccccggactcacgcgtgcctgtgctccggcggtctgggctccgggtccttaacccacaaatgcagttcaaccaaacaccgcattatcagcccaaaggtggaacctcgtgccctgactctcacgtccatcccccacgcccatccccccgagccacccccgctgattgcccctctgccccccgagttacctaaggcccatacatctccctcttcaagcagttccagttcttcttcgggtttcgcagagcccctggagattagaccaagcccaccaacatccagaggcggctccagcaggggcggcacggctattctcctcctgaccggccttgagcagcgtgccggtggtctaacgcccacgcgtcatctggctccacaggccgatccccggccaagtatgtccctcgccgtggtggttggtactgagccaagtgctccgccggcccccccaagtccagcctttgatcccgaccggtttctgaatagtccccagcgcggccagacctacggcggaggccagggagtgagccccgactttccggaggctgaagccgcacatacaccctgctccgccctggaaccagcagccgctctggaacctcaggccgcagcaagaggtccaccgcctcaaagcgtcgctggagggcgtcgtggcaattgctttttcatccaggacgacgacagcggggaggaactgaaaggtcacggcgcagcacctcccattcctagtccccccccatcaccccctccgtcgccggccccactagaacctagctcccgcgtgggcaggggcgaggctcttttcgggggacctgtcggggcttccgagctggagccctttagtctgtcgagctttcccgacctgatgggtgagttgatctccgatgaggcaccatcaatccccgcccccactcctcagctgtctccagctctgtcaaccattacagacttctcgccagagtggtcataccctgaaggcggagtgaaggtgctcataaccggaccatggactgaggccgcagaacattattcgtgtgtgttcgaccacattgctgtacccgccagtctggttcagccgggggtgttgcgctgctactgcccagctcatgaggtcgggcttgttagcctgcaggtggcggggcgggaagggccattaagtgcttcagtccttttcgaatacagggcacggcgcttcttgagtctaccctccacgcaactcgactggctttccctggacgacaaccaattccgaatgtcaatcctggaacggctggaacagatggaaaagcgcatggccgagatcgctgccgccggtcaggtgccatgccagggccccgacgcacctccggtacaagatgagggtcaaggccctggatttgaagcccgggtggtcgttctggtagagagcatgattcccaggtctacatggaaaggcccagagagattggcgcacgggagtccattccgcgggatgtcccttcttcaccttgccgcagcccaaggctatgctagactgatcgaaacgctgagccaatggaggtctgtcgagactggaagcctagatctcgagcaggaggttgacccattgaatgtggatcacttctcatgtacccctctgatgtgggcttgtgccctcggacatctggaggctgccgtccttctttttaggtggaacaggcaggctctgagcattccagactccctcgggcgtctgcctctgagtgtcgctcattccagaggacacgtgagactggcacgatgcctagaggaactgcagcggcaggagccctctgtcgagcctcctttcgctctcagccctccatcgtcatcccctgacacaggccttagttctgtgtcaagcccgagcgagctctcagacggcaccttctccgtgacctccgcctactctagcgcgccggacggttcaccaccccctgctccgctgccagcttcagaaatgacgatggaagacatggccccagggcagctgtcgtctggcgtcccagaagctcctcttctgctgatggattatgaggccactaacagtaaggggcctctctcttcattacctgccctcccccctgcctcagacgatggcgcggcccccgaggatgctgactctcctcaggcagttgacgtgattcccgtggatatgatttccctggccaagcaaataatcgaggccacacctgaacgcatcaagagagaggattttgtaggcctgccggaggctggtgcatccatgagagaacgtactggagcagtgggactgtcagaaacaatgagttggttggcaagttacctcgagaatgtggaccatttcccctcttccacgccccctagtgagctccccttcgagcgtggccggctcgccgttcccagcgcaccgtcctgggcagagtttctgagcgccagcacctccgggaaaatggaatcagattttgcgctgctgactctgtctgatcacgagcagcgcgagctgtacgaagccgcacgggtgattcagacagcgtttcgcaagtacaaagggagacgcctgaaggagcagcaggaagtagcagccgctgtcatacagaggtgctacaggaagtataaacagctgacttggatcgctctcaagttcgcactgtacaaaaaaatgacgcaggctgcgatactgatccagagtaaatttcgaagttactacgagcagaaacgtttccagcagagtcgtagggcagctgtgcttatccagcagcactacaggtcttacagacgccgcccgggtcctccgcaccggacatcggccacactgcccgctagaaataaggggagcttcctgacaaagaagcaggatcaggcggcccgtaagattatgcggttcctgcgtaggtgtcgccaccgaatgcgggagctcaagcagaatcaggaactggaggggctgccccagccaggcctggctacgtag

SEQ ID NO: 181355 - DNA, 3594 bp, Artificial Sequence
  Description of Artificial Sequence: Synthetic coding sequence
atggccgccgccgccgtgacccggggcacccccggcgagaacagccaccacctgaaaatattcctgccaaaaaagctccttgagtgccttccccgatgccccctgctcccacccgagcgccttcgttggaacacgaatgaggaaatcgcgagctatctaattaccttcgaaaagcacgacgaatggctcagctgtgctcccaaaacgcgtccccagaacgggagcatcatattatataacagaaagaaggtcaaatatagaaaggatgggtacctctggaaaaagcggaaggatggaaagacaacccgcgaggaccacatgaaactcaaggtgcaaggtatggagtgtctgtacggctgctacgtacactcttctattgtgccaacattccatcgcagatgctattggctgctgcaaaacccggatatagtgcttgtgcactatctgaatgtgcccgctctcgaagattgcggcaaggggtgctctcctatcttctgtagtatttcatcagatcgaagggaatggctcaaatggtcacgggaagaactgctgggacagctcaagcccatgtttcacggcatcaaatggtcctgcgggaatggcactgaagagttcagtgtggagcacctggtgcagcagatactggacactcacccaactaagccagcaccacgcactcatgcatgtctgtgcagcggcggactgggtagcggcagcttaacccacaaatgctcgtccacaaagcacaggattatctctccaaaagtcgagcctagagcactgacgttgacctctattccccacgcacatcctccagaacctccaccactgattgccccactgccaccggagctgcccaaagcacatactagcccatcttccagtagctcatcctcctctagcggattcgcagagcctctggaaatacggccatcaccgcccacttcaagaggaggttcgagccgaggaggcacagctattctgctcctaactggcttagagcagcgggctgggggattaacccccactaggcacctggcaccacaggcagatccacggccttccatgagcttggctgtggtggtaggcacagaaccaagcgcacctcccgcccccccttcacccgctttcgacccagacaggtttttgaattcccctcagagaggtcaaacctacggcggtggccagggcgtaagccccgactttcccgaagcagaggctgcccacaccccatgcagtgccctggagccggccgctgctctcgagccacaggcagccgctcgtgggccccccccccagtctgtcgcgggcggccggaggggtaattgcttttttatccaagatgacgactcaggagaagaactgaagggccacggcgccgcccctcctattccttcccctcccccgagccccccgccctctccggcgccactagagccatctagtagagtcggaagaggagaagcgctgtttgggggaccagtaggcgcatccgaattggagcctttctcactatctagcttccctgatctgatgggggaactgatttctgacgaagctccttctattcccgcacctactccccaattgagcccagccttgagtaccatcactgatttcagccctgagtggagctatcccgaaggaggcgtaaaagtgcttatcaccggaccctggactgaggcggccgagcactatagctgcgtcttcgaccatatcgcagtcccagctagtcttgtgcagccaggtgtgcttcggtgttattgtcccgcccacgaagtcggattagtctcactgcaagttgccggaagggaaggccccctcagtgctagcgtcctgttcgagtatagagctcgccgatttctgtctctccctagcacccaactcgactggctctcgctggatgataaccagttcagaatgtccattcttgagcggcttgagcagatggagaagcggatggcggagattgcggcggccgggcaggtgccatgtcaaggtcctgacgcccctcccgtccaggacgaaggacaggggccaggatttgaggcaagagtcgtggtcctcgtcgagtccatgataccgcgtagcacgtggaaggggcctgagaggctcgcacacggatctccgtttcggggcatgtccctcctccacttggctgccgcccagggttacgccagactgatcgaaaccctgagtcagtggcgctcagtggaaactgggtcccttgacctggaacaagaagtcgatccgctcaacgtcgatcatttctcgtgtactccgctgatgtgggcttgtgccctgggacacctcgaggctgccgtcctgctcttccggtggaatcgtcaagccctttctatcccagattctttaggtaggttgccgctctctgtcgcccattctagggggcatgtgcgcctcgctaggtgcttggaggagctgcagaggcaagaaccatccgtcgaaccacccttcgctctgagccctccgtctagctcccctgatactggtctgtcaagcgtctccagcccttcggagctgtccgatggtacttttagtgtgacttctgcctactcctccgctccagacgggtctcccccaccggcccccctgcctgcatctgagatgacaatggaagacatggcccccggccaactgtcaagtggcgtccccgaggcacccctgttgctcatggactacgaggccaccaacagcaaggggccgctgagtagcctgcctgcactcccacctgcatctgacgacggcgcagcacctgaggacgcagatagcccccaggccgtggatgtgatacctgtagatatgataagtttagctaaacagattatcgaggcaactcctgaacgcattaaaagagaagacttcgtcggcctacctgaagccggagcatccatgcgggaacgtaccggggccgtgggtctaagcgaaactatgagctggctcgcctcctacctagagaatgtggaccactttccgagcagcacgcctccttctgaactccctttcgagagaggccgcctggctgtgccctcagcgccatcatgggcggagtttctgtctgcaagcaccagtgggaagatggaatctgattttgctctgttgactctatccgaccatgaacaacgagagctttatgaagctgcgcgggtgatccaaacagcattcagaaagtacaaggggaggcgcttgaaggagcaacaggaggtcgccgcagccgtcatccaacgctgttatcgcaaatataagcagtttgcattgtataaaaaaatgactcaggctgctattttaatacagtcaaaatttcggagctattatgagcaaaagaggttccagcagtccaggcgcgctgcagtactgatccagcagcactaccgctcttacagacgccgacccggacctccacatcggacctccgcgactctgccagccaggaataagggctcattcctgacaaagaaacaggatcaagctgctcggaaaattatgcgcttcctgaggaggtgccggcacagaatgcgcgagcttaagcagaaccaggagctggagggcctgccgcaacccggactggcaacctag

SEQ ID NO: 181356 - DNA, 3726 bp, Artificial Sequence
  Description of Artificial Sequence: Synthetic coding sequence
atgggcaccgacagccccagcccccggcccctgcggcccggcgtgacgctacccccaggcgccttgacaatgaacacaaaagataccactgaggttgctgaaaactcacatcatctgaaaattttcctgcccaaaaagctgctggagtgtctgccgcgttgtcccctgctcccccctgagcggctccgctggaacacaaacgaagagatagcttcgtacttaatcacatttgaaaaacatgacgaatggctctcttgtgctcccaagaccaggccacaaaatgggtcaatcatcctctataaccggaaaaaggtgaaatacagaaaagacggctacctgtggaaaaagagaaaagacggcaagactacccgggaagatcatatgaaactgaaggtacagggaatggagtgtctgtacggctgttatgtgcattccagcattgtgcctacctttcatagacggtgttactggcttctgcagaaccccgacatagttttagtacattatctgaacgttcctgccttggaggactgcggcaaagggtgttctcctatcttctgcagtatctccagcgacagacgtgagtggctcaagtggtcacgggaagagcttctgggacagctcaagccaatgttccacggcatcaagtggtcctgcggaaatggtacagaggagtttagtgtggagcatttggtccagcagattctggatacgcatcctactaagcccgctcctaggactcatgcctgcttatgctcaggcggactgggaagtggtagtttgactcataagtgcagctccaccaagcacagaatcatatcccccaaggtggagcctagggctctgacacttactagtataccccacgcgcacccaccagagcctccacctctgatcgcccctttgcctcccgaattaccaaaggctcatacatccccatcttcttcttcctcctcctcttctagcggttttgccgaacccctggagattagaccctcccctcccacaagcagaggaggctcttctcgggggggaaccgcaatccttctactgaccggcctcgaacaacgggcaggaggattgacaccgactagacatctggctccccaggccgatccgagaccaagcatgtcgctagctgtggtcgtcggcactgagccatctgcgccccccgctccaccaagtccagctttcgaccctgatcgattcctgaactcaccgcagagaggacagacttatggtggaggtcagggcgtatcgcctgacttcccagaggctgaagccgcgcatacaccttgtagtgcactggagcccgctgcagctctggaaccgcaagcggccgctagaggcccgcccccccaatccgtggctggaggtcgccggggcaactgcttctttatccaagacgacgattctggcgaagagctgaagggccatggtgccgcaccgccaatacccagtccgccaccaagcccccccccgtctcccgcccccctggagcccagcagccgggtgggccgcggtgaagcactgtttggtggtcccgtgggagcctcggagctcgagccattttctttatcatcattccccgatctgatgggggaactaatttctgacgaggcccccagtatccctgcacccacacctcagttgtctccagccctctctaccatcacagacttttcacccgagtggagttatcccgaagggggggtgaaggtattaattacaggtccttggacagaagccgccgaacactattcttgcgtgtttgatcatatcgccgtgcctgcaagtctcgtgcagcctggggtgttgcggtgctactgccccgctcacgaggttggtctggtgagcttacaggtggccggccgcgaaggccctctgtcggccagtgtgttgtttgaatacagggctcggcgcttcctctcactgcccagtactcaattggactggttgagtctggatgataaccagttcaggatgtcgatccttgagcgtctcgagcagatggagaagaggatggcggagatcgcagccgcaggccaagtaccctgtcaaggccccgacgcaccccctgtgcaggacgaaggacaggggcctggattcgaggctcgagtggtcgttcttgtcgaatcaatgattcctcgcagtacgtggaagggcccagaacgcttggcacacggctctccatttcgaggaatgtcactgctccacctggctgcggcgcagggctacgcccgactcattgagacactgtcacagtggaggagtgttgaaactggaagcctcgatctggaacaagaagtggatcccctcaacgtcgatcacttctcatgtacacctttaatgtgggcctgcgcccttgggcatctggaggctgcggtactgctcttccggtggaaccggcaggctcttagcattccagattccctgggtcgcctgcccttgagtgtggcgcactcgaggggtcacgtccggctcgcgcgctgcctggaggagttgcagaggcaggagccttcagttgagccaccttttgccctgtcgccccctagttcctcacccgataccggactctcttcggtgtcgtccccatcagagctgagcgacggaacgttttccgtaacctctgcctacagcagtgcccccgacggttcacctccccccgcgccacttcctgcgtcggagatgaccatggaggatatggcccctgggcaacttagctctggagtgcctgaggctccccttttactcatggactatgaggccaccaattccaaaggacctctgtcctcgctgcccgctctgccccccgcttcagatgatggggcggcccctgaagatgccgactctccacaggcagtagacgtgataccggtggatatgatttctctggccaagcagatcatcgaggccaccccagagcgcataaagcgtgaagactttgtgggcctgcccgaagccggagcctctatgcgtgagcggacaggagcagtcgggctgtcggaaactatgtcctggctcgcgtcttatctcgaaaatgtggaccatttcccgagctctactcctccttctgagttacccttcgagcgtggtcgcctcgcagtcccatctgctccctcttgggctgaattcttgtcagcttccacctctggcaagatggagtctgactttgcgctgttgaccctctccgatcatgagcagcgggagctgtacgaagctgctagagtaattcaaactgccttccgcaagtacaagggcaggaggctaaaggagcagcaggaggtggccgctgcagtgattcagcgctgctaccgcaagtacaaacagttgacctggatagccctcaagtttgcgttgtacaagaagatgacacaggcggcaatcctgattcagtccaagtttaggagttactacgaacaaaagcgctttcagcaatcccggagggcagcggtgctgattcaacaacactatcggagctaccgcagacgaccaggcccaccccacaggacctcagcgacactgcctgcccggaataaactgctaagccaccaggaggctggacccggtagcccagaagatcacgaaattcccgcggccctgccaactcaggacgaggggaccgaggcagagcctggagctgggcgggctagtccagcaggcaccgggcatatgacgtggcccccccccttttctccgccgtgggggcgcttagtgcagtcctag

SEQ ID NO: 181357 - DNA, 4470 bp, Artificial Sequence
  Description of Artificial Sequence: Synthetic coding sequence
atgggcgacgccgccgacccccgggagatgcggaagaccttcatcgtgccggccataaaacctttcgaccattatgatttttcccgggctaagattgcctgtaaccttgcctggctcgtggcaaaagcatttggtacggagaatgtaccagaggagttacaggagccattttatacagatcagtatgaccaagagcacatcaagccaccagtggtaaatctgctgctctccgcggagctgtactgccgagcaggctcccttattctcaagtctgatgcagctaaacctcttcttggtcatgatgcggtgatccaggctttagcacagaaagggttgtacgttactgaccaggagaagcttgtgaccgagcgagatcttcataagaagcccatccagatgtctgcacacctggctatgattgacaccctaatgatggcctacacagtcgaaatggtgtccattgaaaaagtcatagcatgtgcacaacagtatagcgccttctttcaagccaccgacctgccctatgacatagaagatgccgtgatgtattggatcaacaaggtcaatgaacatctgaaggacattatggaacaggagcagaaactgaaagagcaccacaccgtggaggccccgggaggccagaaaagcccttccaaatggttctggaagctcgtgccagcccgatacagaaaggagcagacacttctcaaacagctaccctgtataccactggttgaaaatttgttgaaagacggtactgacgggtgtgcgctggccgcgctgatacatttttattgtccagatgtggtccggctggaagatatctgtctgaaagagactatgagtctcgctgactcgctttataaccttcagctgatccaggaattctgtcaagagtaccttaaccagtgttgccatttcacactggaggatatgctgtacgccgcatcctctatcaaaagcaattatctggtctttatggccgagctgttctggtggttcgaagtcgtgaagccatcttttgtgcagccaagggtcgtccggccacagggagcggagcctgttaaagacatgccaagtattcctgtactgaacgccgccaagcggaacgtgctggatagttcttcagatttcccgagctcgggagaaggagccacctttactcaatcccatcaccacctgccctcccggtacagcagacctcaagcccactccagtgcatccggagggattagacgtagtagttcaatgtcatatgtcgatggctttatcggcacatggcctaaggaaaaacgttcttcagtccacggcgtgtcgtttgacatcagctttgataaagaagacagtgtgcagcgatccacacctaatagaggcattaccaggagtatctcaaacgaggggctgactcttaataatagccacgtcagcaagcatattagaaaaaacctgtcgttcaagccaataaatggggaggaggaagccgagtctatcgaggaagagctcaacatcgacagtcactccgaccttaaatcgtgtgttcccctgaatacgaacgagctaaacagtaatgagaatattcactacaagctccctaatggggccctgcagaataggatcctcttggacgagtttgggaaccaaatagaaacccccagtattgaggaggcgctgcaaattattcacgataccgaaaaaagccctcacactcctcagcccgatcagatcgctaacgggtttttcctgcatagtcaggagatgagcattctcaattcgaatatcaagctgaaccaaagttcccctgacaacgttacagataccaagggtgcactttctccaatcaccgacaacactgaagtcgacaccggaattcatgtcccctccgaggatattcctgagactatggatgaggattcctcactgagggactatacagtaagtctggattctgacatggatgatgctagtaagtttctgcaagactacgacatcaggaccggcaacaccagagaagccctgagcccctgtccaagtactgttagcacgaagtcacagccagggtcgagcgcatcctcctcttctggggtgaaaatgaccagcttcgcagagcagaagttcagaaaacttaaccatacagacggaaagagtagcggctcttctagccagaagacaacccctgaggggtcagagctcaacatccctcacgtagtagcatgggcccagatcccagaagagactggacttcctcaaggcagggatactacccaattactcgccagcgaaatggttcatctcagaatgaaacttgaggaaaagcggcgagccatcgaggcccagaagaaaaagatggaggcagccttcacaaagcaacggcagaaaatgggtaggaccgcatttctgactgtggtaaagaagaaaggtgacgggattagcccactccgggaagaggccgcaggcgctgaggacgagaaggtctataccgatcgggccaaggaaaaagaaagccagaagactgacggacagcgtagcaagtcccttgcagacatcaaggagtcaatggaaaacccacaggctaaatggctgaaatctcctaccaccccgatcgacccggagaagcaatggaatctggcaagccccagcgaggaaacgctgaatgaaggagagatcctggaatataccaagtcaattgagaagctaaactcctccctgcactttctgcaacaggaaatgcagcgcctgagcctccagcaggagatgttgatgcagatgagagagcagcaatcttgggtgatctcccccccgcaaccgtcgccccagaagcagatcagggatttcaagcccagtaagcaggccgggttgtctagcgcaatagcccccttttccagcgatagccccaggcctacacatcccagtccgcaaagcagtaacagaaaatcagcctccttcagtgtgaaaagccagcgtactcctagaccgaacgagttgaagatcaccccactaaaccggacgctgaccccaccgagatctgttgatagtctcccacgcctgcgacgtttttcgccatcacaggttcctattcagacccgttctttcgtctgcttcggagatgacggtgagccccaactcaaggaatctaagcctaaggaagaagtcaagaaggaagagctagaaagcaagggaactcttgaacagcggggccacaatcccgaggagaaagagattaagccttttgaatcaacggtgtcagaggtactgtctcttcccgtcacagaaactgtgtgcttgactcctaacgaggaccaactcaaccagcccacagagccccctccgaagccggtgtttccccctaccgcaccaaaaaacgtcaatctgattgaggtctcactcagcgaccttaaacctccggagaaggcagacgtgccggtggaaaaatacgacggggaatctgacaaggaacagttcgacgacgaccaaaaagtttgttgtgggttcttctttaaagacgatcagaaggccgaaaatgacatggcgatgaagcgggcggcactgctggagaaacgcttgagacgggagaaggagacgcagctgcgcaaacagcagctggaagcagagatggaacataaaaaggaggaaaccagaaggaaaactgaggaagagagacagaaaaaagaagacgaacgcgcacgtcgggagtttataaggcaggagtacatgcggcgtaagcagctcaaattgatggaggatatggataccgtcatcaagcctcgcccacaggtagtgaagcaaaagaagcagagaccaaagagcatccatagggaccatatcgagtcacctaagacacctattaagggaccacctgttagcagcctgtccctcgcctctctgaacaccggtgataacgagtcagttcatagcgggaagaggaccccccgttccgaaagtgtggagggcttcttaagcccctcacggtgtggatctcgtaacggtgaaaaagattgggagaacgcgagcactacaagtagtgttgcttccgggactgagtacaccggaccaaaactgtataaggagccgtctgccaagtctaacaagcatattattcagaatgctctggcgcactgttgcctggctgggaaggtgaacgaaggacaaaaaaagaaaattctcgaggaaatggagaagtctgatgcaaataactttctgattctttttcgcgatagtggatgtcagtttaggagcttgtacacgtactgtccagaaaccgaagagataaataagttgaccggcataggccccaagagcataacgaaaaagatgatcgagggtttatataagtataacagtgaccggaagcagttttcgcatatacctgccaagacactgtctgcctccgttgatgcaataactatccactcacacttgtggcagaccaagaggcccgtaacgcctaagaagttattacccaccaaggcgtag

SEQ ID NO: 181358 - DNA, 4437 bp, Artificial Sequence
  Description of Artificial Sequence: Synthetic coding sequence
atgggcgacgccgccgacccccgggagatgcggaagaccttcatcgtcccggctataaagcccttcgaccactatgacttcagtagggccaaaatagcttgtaatcttgcatggctagtggcgaaggcctttggaaccgagaatgttcctgaagagctgcaagaaccattttacacagaccagtacgatcaagaacacatcaaaccgccggtggtgaacctgctgctctctgcggaactgtactgtcgagcaggctctctgattctgaaatccgatgcggccaagcccctgctgggacacgacgccgtgatccaggccttagcgcaaaaaggtctatacgtaactgatcaggaaaaactcgtcactgagagggacctccacaaaaaaccaatacagatgtctgcccaccttgctatgattgacacactaatgatggcttatacagttgaaatggtcagcatagagaaggtgattgcttgcgcacagcagtactctgccttcttccaggcaactgacctcccctacgatattgaggatgccgtcatgtattggataaacaaagttaacgaacacctcaaggacatcatggagcaggagcagaagctcaaggagcaccatactgtcgaagcacctgggggtcagaaagccagatatcggaaggaacaaacattgctgaagcagctgccctgcattcccctcgtggagaacctgctcaaagacggtaccgacggttgcgcacttgctgcattgatccacttctattgcccagatgtcgtgcggcttgaagacatctgcctcaaagagactatgagcctggctgattccctgtacaacctccagctgatacaggagttctgtcaggagtatctcaatcagtgctgtcactttactctggaggatatgctttatgcagcctcctcgatcaaaagcaattacctcgtgttcatggcagaactcttctggtggtttgaggtggtgaagccgtccttcgtgcagccacgagtcgttagaccgcagggggctgaaccggttaaggatatgcccagtatccccgttttgaatgcagcaaagagaaatgtgcttgactccagctccgattttccatcatctggtgagggcgctacatttacccagtctcaccaccacttaccgagtcgttactcacgcccccaagcccattcttctgcatccggtgggataagaagatcgtcgtccatgtcatatgttgacggctttatcggtacttggcctaaggaaaagagaagctcggtccacggcgtcagtttcgacatcagcttcgacaaggaggacagtgtgcagcgctccacaccaaatagaggtattactcgttctatcagcaatgagggcctcaccttgaacaatagccacgtgtcaaaacacatacgaaagaacttaagtttcaaacccatcaatggggaggaggaggctgagtctatagaggaagaactgaacatcgattcccatagcgacctgaagtcctgcgtgccactcaacactaatgaactgaattccaacgagaatatccactataagctgccaaacggtgcactgcaaaacaggatcttgttggatgagtttggcaaccagattgaaaccccgagtatagaagaagcactgcagataatccacgatactgaaaagtcacctcacacacctcaaccggaccaaatcgccaacggcttttttctgcactcacaagagatgtctatcctcaattctaatattaaactaaatcaatcttccccagacaacgtcactgatacaaagggagccctcagccccatcacagataacaccgaagtggacaccggcatacacgttccttccgaggatatccctgagacgatggacgaagactcctctctccgcgattacaccgtgtcacttgattccgatatggacgatgctagcaaattcctgcaggattacgacatcagaacaggaaacacacgcgaagcgctatctccgtgcccgagcacagtgtccactaaatcgcagcccggctccagcgcctcgagctcttctggggttaagatgacctcttttgcagaacagaaatttagaaaactcaaccacacggatggaaaatcctcagggagtagttcccagaaaactactccagaaggttcagaactcaacatcccacacgtggtcgcatgggcccagatccctgaggagaccggcctgccacaggggagagatactactcagctgctggcctcagaaatggtccatctcagaatgaaactggaagagaagcgaagagcaatagaagcccagaaaaagaaaatggaagccgctttcaccaagcagcgtcaaaagatgggtaggaccgctttcttgacagtcgtgaagaaaaaaggcgacgggataagcccactccgggaggaggcggcaggggccgaagacgagaaggtttacaccgacagggccaaggagaaagagtcacaaaagactgacggtcagcggagtaagagcctggccgatattaaagaatcaatggagaacccccaagccaagtggttgaaatccccaaccacccctatagaccctgaaaagcagtggaatcttgcctctccttctgaagagaccctcaacgaaggtgagattctcgaatacaccaagtccatcgaaaaactgaattccagcctgcatttcttacagcaggaaatgcaacggctatccctacagcaagaaatgctaatgcagatgcgtgagcagcaatcctgggtaatcagtccccctcaaccatcacctcagaagcagattagagatttcaagccctcaaaacaggcaggcttgtcgagcgcgatagccccattttccagcgactctccgcggcctactcatccaagtcctcagtctagcaacagaaaaagcgcaagttttagcgtgaagtcgcagaggaccccaagacccaacgaactgaaaataacacccctgaacagaacactcactcccccacgttctgttgattctctccctcgccttaggaggttctctccgtcccaagtgccaattcagacacgaagttttgtgtgttttggagatgatggagaaccccagttgaaggaatctaagcccaaggaggaggttaagaaggaagaacttgagagtaaaggaaccctagagcaacgcggtcataacccagaagagaaggagataaaacctttcgaatccactgtgtctgaggtgctctctctgccagttactgagactgtctgtctcacgccgaatgaggatcagctgaaccagcctacagagcctcccccaaagccagtcttccctcctaccgccccaaaaaacgtgaatctgatagaggtatctctaagtgacctcaagccaccagagaaggccgacgtgcccgtggagaaatacgacggcgaatctgataaagaacagtttgatgacgaccagaaggtgtgctgtggcttcttctttaaagatgaccagaaggctgaaaacgacatggctatgaagcgggcagcgttgttagaaaaaaggctacggcgagaaaaggaaactcagctgcggaagcagcagctcgaggccgagatggaacacaaaaaggaggagacccgtagaaagactgaggaggagcgccaaaagaaagaagatgagcgtgcccgaagagagttcatcagacaggagtacatgcgacggaaacaattgaagctgatggaggacatggacaccgtaattaaaccgaggccgcaagtggtaaagcagaaaaaacaacgacctaaatctatccacagagaccacatcgaaagtcctaagacgccaatcaagggcccgcccgtgtcttcactgtccttggccagcctcaatactggggataacgagtcagttcattccggtaaaagaactcccaggagcgagtcggttgaggggttcctcagcccatcccggtgcggcagccgaaatggagagaaagattgggaaaacgcatctaccacttcctctgttgcttccggaactgagtacaccggacccaagctttataaagagcccagcgccaagtctaataaacatataatacaaaacgcgctggctcattgctgccttgccggaaaggtcaatgaggggcagaagaagaagatcctggaggagatggagaaaagcgatgcaaataacttcctcatcttatttcgggactctggctgtcagtttaggtccctttacacctactgcccggaaaccgaggagatcaacaaactgaccgggattggccctaagtctatcaccaagaagatgattgaggggctgtacaagtataatagcgatcgcaagcaattctctcacatccccgccaagacactcagcgctagcgttgatgctatcaccattcattcacacctgtggcagacaaagaggccagtcaccccaaagaaactgctgcccaccaaggcctag

SEQ ID NO: 181359 - DNA, 4389 bp, Artificial Sequence
  Description of Artificial Sequence: Synthetic coding sequence
atgggcgacgccgccgacccccgggagatgcggaagaccttcatcgtgcccgccataaagccctttgaccactacgatttctctcgagctaagatcgcctgcaacctcgcctggctcgtggctaaggccttcggcacagagaacgtaccagaggaactgcaggagcctttctacacggaccagtacgaccaagagcacattaagccaccagtggtgaatctcttgttgtcggccgaactctattgtagggccggctcgctgattcttaaatctgacgctgctaagccccttttggggcacgacgcagttatccaggcactagcccagaagggtctttacgtcaccgaccaagagaagttagtgaccgagcgggatctgcataagaagcctatccagatgtcagctcacctcgcaatgatcgacactcttatgatggcgtatacagtagaaatggtgagcatcgagaaggtgatcgcatgtgcccagcagtactctgcattctttcaagccactgatctgccatatgatatcgaagacgctgtaatgtactggattaacaaagtgaacgagcacctgaaggacatcatggagcaggaacagaaactgaaagaacatcatacagtcgaggccccaggaggtcagaaggcacggtatcggaaagagcagactctgcttaagcagctgccatgcataccacttgttgagaatttactgaaagacgggaccgatggctgcgccttggccgctctgattcatttttactgtccagacgtggtccggctggaggacatctgcctcaaggagaccatgagccttgccgattcactgtacaatctccagctgattcaagagttttgccaggaatacctgaatcagtgctgtcatttcactcttgaagatatgctgtacgcggcctcctctattaaaagtaattacctagtcttcatggcagaacttttttggtggttcgaggtcgtaaaacccagctttgtgcaaccaagggtggttcggccccagggggccgaacccgtgaaggatatgccatctatcccagtcttgaatgcggccaagaggaacgttctagacagctccagtgactttccctcacggtatagccggcctcaggctcactctagcgcttccggcgggatcagaagatcctcaagcatgtcctacgttgatggtttcatcggtacctggcccaaggagaagcgtagttccgtgcacggcgtgagtttcgacatctcgtttgacaaagaggacagcgtgcagcgcagcacgccaaatagaggcatcacacggagtatctccaatgaaggcttgaccctgaataactcccatgtgtccaaacatatcagaaaaaatttgtcatttaaaccaattaatggtgaggaagaagccgagagcattgaggaagagctgaacatcgatagccattccgatcttaagagctgcgttccacttaataccaacgaactgaacagcaatgagaatatccactacaagttaccgaatggagccctgcagaaccggatcctacttgacgaatttggcaatcagatcgaaacaccttcaattgaagaggccctgcagataatccacgatactgagaaatccccccacacaccccagccagatcaaattgccaacggcttttttctgcactcgcaagagatgtctatcctgaacagcaatatcaaacttaatcagagctcacccgacaatgtgactgatacgaaaggtgccctttcacctattactgacaatactgaagtggacactgggattcatgtgccctccgaagacattccagagaccatggatgaggattcctccctgcgcgactataccgtaagtctggattcggacatggatgatgcttccaaatttctccaggactacgatatcagaaccgggaatacccgggaggccctatctccctgtccttcgaccgtgtctaccaaatcgcagcccggctcttccgcatcatcctccagcggagtgaaaatgacctcatttgctgaacagaagtttagaaagttaaatcataccgacggtaaaagtagtgggtctagcagtcagaaaaccactcctgaaggaagcgagctcaacatccctcacgtggttgcgtgggcacaaattccggaagagactggtcttcctcagggacgggacacaacgcagctgttggcgtccgaaatggtgcacctgcgtatgaaactggaggaaaagagacgggccattgaggctcagaaaaagaagatggaagccgccttcaccaaacagcgccaaaaaatggggaggactgcatttctgaccgtggtcaagaaaaaaggggacggtatctctcccctccgcgaggaggccgcaggcgccgaggatgaaaaggtgtacaccgatagagcaaaagaaaaggagagccagaaaacggacggtcagcgcagcaagtcactggccgacataaaggaatccatggagaatccacaggctaagtggcttaaatccccaactactcccattgatcctgagaaacaatggaacctggcaagcccatcagaggaaaccctaaacgagggggagatcctggaatacaccaaatccattgaaaagctcaattcttctttacacttccttcagcaagaaatgcaacgcctttctttgcaacaggagatgttaatgcagatgagggaacaacagtcctgggtgattagcccccctcagccatctcctcagaagcagatccgcgacttcaagccatctaaacaagccgggttgtcttcggccatcgccccgttttcttcagactcaccaaggcccacccacccctccccccagagttccaatcggaaaagtgctagcttctctgtgaaatctcagcgaacacctaggcccaatgagctgaaaattacccctctgaatcgcactctcacacccccccggagcgtggactccctaccgcgtctaaggagattcagccccagtcaggtgccgatccagacacgttcctttgtgtgtttcggggacgatggggaacctcagttaaaggagagcaagccaaaggaggaagtgaaaaaggaggaactggagagcaagggaacacttgaacagaggggtcataaccctgaagaaaaggagatcaagcctttcgagagtactgtgtctgaagtactctccctgccagtgacggagaccgtatgcctgacccccaacgaggatcagcttaaccagccaaccgaaccaccaccaaaacccgtgttcccccccactgcacccaagaatgtgaatttgatcgaggtgtccctctccgatctcaagccacccgagaaggctgacgtgcctgtcgagaagtacgatggcgagagcgataaagagcagttcgacgatgaccaaaaggtctgctgcgggtttttttttaaagacgaccagaaggcggaaaacgatatggctatgaaacgggccgcactcctcgaaaaacggctacgacgcgagaaggagacccagctgagaaagcaacagttggaggcagagatggaacacaaaaaagaggagaccaggcgtaagacggaagaggagaggcagaaaaaggaggacgagcgcgctagaagagagtttatccggcaggaatatatgaggcgaaaacagctcaaactgatggaagacatggacactgtgattaagccacggccacaagtagttaagcagaagaagcagaggcctaagtctatccaccgtgaccacattgaatctccaaaaacgcccatcaaagggcccccagtgagttccctgtccctggctagccttaatacaggagacaacgaatccgtgcattccggcaaacgtaccccaaggagcgagagcgtggaggggttcctcagtcccagtaggtgcgggtccaggaatggagaaaaagattgggaaaatgccagcaccacatcaagcgtagcgagcggcacggagtataccggcccaaaactgtataaggagcctagtgccaaatctaataagcacattattcagaatgctctggcgcattgttgcttggccggcaaagtgaacgaaggtcagaaaaaaaaaattctcgaagagatggaaaagagtgacgccaataacttcctcatattgttcagggatagcgggtgccagtttaggtctctgtatacatactgccctgagacagaggagattaataagctgactggcataggccccaagtcaattactaagaagatgattgagggtctgtataaatacaactccgaccgcaagcagttttcacacattcctgctaagactctctccgctagcgtcgacgccatcactatccatagtcacttgtggcagactaaacggccagttactccgaaaaaacttctgcccactaaggcatag

SEQ ID NO: 181360 - DNA, 450 bp, Artificial Sequence
  Description of Artificial Sequence: Synthetic coding sequence
atggccgaccagctgaccgaggagcaggtgaccgagttcaaggaggctttttccctttttgacaaagatggagatggctgcattaccactcgggaactgggaaccgtaatgcggagcctaggacagaaccccacagaggccgagctgcgggatatgatgagtgaaatcgaccgtgatggaaatggtaccgtggattttccggagtttttaggcatgatggccagaaagatgaaggacactgataacgaggaagagatccgggaggccttccgtgtgttcgacaaggatggaaacggattcgtatcagccgcggagctgcggcatgttatgacacggcttggtgagaaattaagtgacgaagaagtcgacgagatgattagggctgctgataccgacggcgacggacaggttaactacgaggaatttgtgcgggttctggtgagtaaatag

SEQ ID NO: 181361 - DNA, 546 bp, Artificial Sequence
  Description of Artificial Sequence: Synthetic coding sequence
atgggcctgcagcaggagatcagcctgcagccctggtgccaccaccccgctgagtcctgccagaccacaaccgatatgactgagcgactttctgcggaacaaatcaaagagtacaaaggtgtattcgagatgttcgacgaggagggcaatggagaggtaaaaacgggggaacttgagtggctgatgtcactcctaggaatcaaccctactaagagcgaattggcctctatggcgaaggacgtggaccgcgataacaagggtttttttaactgcgatggttttctggcattgatgggcgtttatcatgagaaggctcagaatcaggaatccgagctgagggcagccttccgcgtttttgataaagagggcaagggttacatcgactggaatacgttaaaatacgtccttatgaacgcgggtgagccattgaatgaggtggaggccgaacagatgatgaaggaggccgacaaagatggtgacagaacgattgattatgaggagtttgttgcaatgatgaccggggagtcgtttaaacttatccagtag

SEQ ID NO: 181362 - DNA, 495 bp, Artificial Sequence
  Description of Artificial Sequence: Synthetic coding sequence
atgggcctgcagcaggagatcagcctgaccgagcggctgagcgccgagcaaattaaggagtataaaggcgtgttcgaaatgttcgacgaagaaggcaacggagaggtgaagacaggcgaactggaatggctcatgtcgctgctcggcatcaatccgaccaaatctgagttggctagtatggctaaagacgtggacagagacaacaagggtttctttaattgcgatggtttccttgcccttatgggggtttaccacgagaaagcccagaatcaggaatctgaacttagagctgccttccgagtgtttgacaaagagggcaaaggctacatcgattggaataccctcaagtacgtccttatgaacgccggggagcctttaaatgaggtggaagccgaacagatgatgaaggaggcagacaaagacggcgaccgcacgatcgattacgaggaatttgtcgctatgatgactggagagtcttttaaactcatccaatag

SEQ ID NO: 181363 - DNA, 1779 bp, Artificial Sequence
  Description of Artificial Sequence: Synthetic coding sequence
atggagggcaagtggctgctgtgcatgctgctggtgctgggcaccgccatagtggaggctcatgacggccacgacgacgacgtaatcgatatcgaggacgatcttgatgacgtgatagaagaagttgaggatagtaagccggatactaccgcccctccatccagccctaaagtcacttataaggctcctgtccccactggagaagtctactttgctgacagctttgaccggggaaccctttcgggatggatcctctccaaggcaaaaaaagacgatacagatgacgaaatcgcaaagtatgatggcaaatgggaggttgaggagatgaaagaatccaagctcccaggggacaaagggctggtcctgatgtctcgcgccaagcatcacgccatcagcgctaaactgaacaagccattcctcttcgacaccaagccactgatcgtccagtacgaggtgaattttcagaatggtattgaatgtggtggagcatatgttaaactgctgtcaaaaactccggaactgaaccttgatcagttccatgacaagactccctacaccattatgttcgggcccgataaatgcggagaggattataagctgcacttcatttttcggcataaaaacccaaagacgggcatctacgaggagaagcatgctaagcgtcccgacgccgatctcaaaacatactttaccgacaagaaaacacatctctataccctgatactcaatcctgataatagcttcgaaattctcgtagaccaatcagttgtcaactctggaaatctgcttaatgacatgaccccccctgtaaacccttcacgtgagattgaggacccagaagacagaaagcctgaagactgggacgagcgtccaaagatcccggaccctgaggccgtcaaacctgacgattgggatgaagatgcacccgctaaaatacccgacgaagaggcaacaaaacccgaaggatggctagacgatgagcccgagtatgtgccagacccagacgctgagaagccagaagattgggacgaggacatggacggagaatgggaggctccacagatagccaacccaagatgcgaatccgcacccggatgtggcgtgtggcagcggccggtgatagataatccaaactataaggggaagtggaaaccaccaatgatcgacaacccgtcttatcaggggatctggaaacccagaaaaatcccaaatcctgacttttttgaagacttggaacctttccggatgaccccatttagcgctataggcctcgagctctggtctatgacaagcgacatctttttcgacaacttcatcatttgcgccgaccggagaatcgtggacgactgggcaaacgatggatggggcctcaagaaggccgccgatggggcagctgaacccggagttgtgggtcaaatgatagaggccgccgaagaaagaccgtggttgtgggtagtgtacatattaactgttgccctgccagtattcttggtgattcttttttgttgctctgggaaaaaacaaacatcaggaatggaatacaagaaaactgatgcacctcagcccgatgtaaaagaggaggaagaggagaaagaggaggagaaagacaaaggggacgaggaagaagagggagaagagaaacttgaggagaagcagaaaagtgacgcggaggaggatggcggcaccgtctcccaggaagaggaggaccgcaagcccaaggcggaggaagatgaaatcctaaacaggtcaccccgcaataggaaacctcgccgtgagtag

SEQ ID NO: 181364 - DNA, 852 bp, Artificial Sequence
  Description of Artificial Sequence: Synthetic coding sequence
atgctgctggtgctgggcaccgccatcgtggaggcccacgacggccacgacgatgatgtgatcgacatcgaagatgatttggatgacgtgatcgaagaggtcgaggattccaaacccgataccaccgcgccccccagttctccaaaagtcacctataaggccccggtgcctacgggcgaagtgtacttcgcagactcctttgatcgtggcacactgagtgggtggattctgagtaaagcaaagaaggatgatacagacgatgagatcgcaaaatacgacggcaaatgggaagtcgaagagatgaaggagtccaaactccccggggataaaggcctcgtcctgatgtctagggctaagcaccatgcaatatccgctaaactgaacaaacctttcctgtttgacacaaagcccttgatcgtgcagtacgaggtcaatttccagaacggaattgaatgtggcggcgcttacaactgctttctcaagcaccagaacagcacctgggatcagttccacgacaagacaccctacaccatcatgttcggtcccgataaatgtggggaagattataagttgcattttattttcaggcataagaacccaaagaccggaatctacgaggagaaacacgcaaagcgtcccgacgccgacttgaaaacatactttaccgataaaaaaacacacctctatactcttattcttaacccagacaattctttcgagattcttgtggaccagtccgttccacctgtgaacccatcacgcgagatcgaggatcccgaggataggaaacccgaggattgggacgagagacccaaaatcccggatcccgaggctgtgaaacctgacgactag

SEQ ID NO: 181365 - DNA, 984 bp, Artificial Sequence
  Description of Artificial Sequence: Synthetic coding sequence
atggagggcaagtggctgctgtgcatgctgctggtgctgggcaccgcaatagtggaggctcacgacggccacgacgacgatgtcatcgacatcgaagatgaccttgatgatgtgatcgaggaagtcgaggagatgaaggagagtaagctaccaggtgacaaggggctggtcctgatgtcacgggccaagcatcatgcgatcagtgctaagctgaataagcccttcctctttgacacaaaaccactgatcgtgcagtacgaggtaaatttccagaatgggatcgaatgtggcggggcctacgtcaaattgctgtctaaaacgccggagctgaatctggatcagttccacgataaaactccctatactattatgtttggaccagataagtgcggtgaggattataaactgcacttcattttccggcataaaaatcccaagactggaatctatgaagagaaacatgccaaacgccccgatgctgacctcaaaacttactttacggataaaaagacacatctatacaccctcatcttgaatcctgacaattctttcgaaattctagttgatcaatcagtggtgaattcgggtaatcttctcaacgacatgactccaccagtgaacccgtctcgtgagatcgaagacccagaagatagaaaacctgaggactgggacgaacggcccaaaattccagatcccgaagcagtgaaaccagacgactgggatgaggacgcacccgccaaaatacccgacgaggaagcaacaaaacctgaaggctggctggatgacgaacccgaatatgtacccgatccagatgccgagaaacctgaggactgggatgaagatatggatggagagtgggaagctccacaaatcgccaaccccagatgtgaaagcgcccctgggtgtggcgtgtggcagagacctgtggtcgatatccagaagactagcaggcatcaccaccagcaggctcctgtggagcactag

SEQ ID NO: 181366 - DNA, 1884 bp, Artificial Sequence
  Description of Artificial Sequence: Synthetic coding sequence
atggccgaccggcggacccccacccccttcgccggctgccggctgcccagacaaagacgggcgcgcgacgctagccaagtaagcgcccccggcaccagaagaattatggaggggaaatggctgttgtgtatgcttctagtgctcgggaccgccatcgtggaggcgcacgatggccacgacgatgacgttatcgacatcgaagacgatttggacgatgtgattgaagaggtcgaagattcaaagcccgacaccacagcaccgccttctagcccaaaagtgacatacaaggccccagtgcccaccggcgaagtctatttcgccgattccttcgaccgtggcacactctcgggctggatcctgagcaaggcgaagaaagatgataccgacgatgagatagctaagtatgacggtaagtgggaggtggaggagatgaaagagtcaaaactgcctggtgataagggtctagtgctaatgagcagagcaaaacatcatgccatttctgcgaaactcaacaaaccatttctatttgatacaaagccactcatagttcaatacgaggtcaacttccagaacgggatcgaatgcggaggtgcctatgtcaagctgttatctaaaacacccgaactgaatctcgaccaatttcatgataagaccccatatacgattatgttcggccccgacaaatgcggcgaagactacaagctgcactttatattccgacacaaaaacccaaagactggcatttacgaggaaaagcatgcaaagcgcccagatgccgatctaaaaacttactttacagataaaaagactcacttatacactctgatacttaacccagataactccttcgaaatcctagtggatcagtcggtggtgaactcaggaaatctgctgaacgacatgaccccgccagtaaacccaagcagagaaatagaggatcccgaagaccggaagccagaagattgggacgagaggcccaaaattccagaccctgaggctgtgaagccggacgattgggacgaagatgcccccgcgaagataccagacgaagaggccactaagcccgagggatggctggatgacgaaccagaatatgtgccagacccagacgctgagaagcccgaggattgggatgaggatatggacggcgagtgggaagccccgcaaatcgccaacccacggtgcgagagtgctcctggctgcggagtgtggcagagacctgtaatcgacaatcccaattacaaagggaagtggaagcctccgatgattgacaacccctcatatcagggaatctggaaaccacgcaagattcccaaccccgacttctttgaagatctcgaaccgtttcgtatgaccccattcagtgcaatcggtcttgagctatggtcaatgacatctgatattttcttcgataatttcataatttgcgctgaccggcgaatcgtggacgattgggcgaacgacggttggggactgaagaaggcagcggatggcgccgccgagccaggtgtggttggtcaaatgattgaagccgcggaagaacggccatggctttgggtggtgtatatactgaccgtggccctgcccgtcttcttagtaatcttgttctgctgtagtggtaaaaagcagaccagcgggatggagtataagaagacagacgcaccgcaacccgacgtaaaggaggaggaggaagagaaggaggaagaaaaagacaagggagatgaagaagaggagggtgaagaaaaactcgaggaaaaacagaagtctgatgcggaggaggatggggggaccgtgtcacaggaagaggaagaccgcaagccaaaagccgaggaagatgaaatattgaaccgttccccacggaaccgaaagcctagacgggagtag

SEQ ID NO: 181367 - DNA, 1779 bp, Artificial Sequence
  Description of Artificial Sequence: Synthetic coding sequence
atggagggcaagtggctgctgtgcatgctgctggtgctgggcaccgccattgttgaggctcatgacgggcatgacgatgatgtgatcgacatcgaggatgacttggacgacgtgatagaagaggtggaggacagtaaacccgacactacagccccaccgtcctccccaaaggtgacttacaaagcccccgtgccaactggcgaggtgtactttgcggactcgttcgaccgaggaaccctgtccggctggatcctgtccaaggcaaagaaagacgacacagatgacgaaatcgctaaatatgatgggaagtgggaggtggaggagatgaaagagagcaaacttcccggcgataaaggtttagtcttgatgagccgggcaaaacatcatgctattagtgccaaactgaacaagcccttcctctttgatacgaaacccctcattgtgcaatatgaagtcaactttcagaatgggatcgagtgtggcggtgcttatgttaagcttctgtccaaaactcctgagctcaatcttgatcagttccacgacaagaccccctatactataatgtttggccccgacaagtgcggtgaggattacaaactgcattttatttttaggcacaagaacccaaaaaccggtatatatgaggagaagcatgccaaaagacctgacgctgacctcaagacatacttcacagacaagaaaacccatctgtataccctgattctcaatcctgataatagctttgaaatcttagtggatcagagcgtcgtaaattccggtaacctgttaaatgatatgaccccccccgtgaatccaagccgcgaaatagaggacccagaagatcgtaaacctgaggattgggatgagaggccgaagattcccgatcctgaggcagtcaaacctgatgactgggacgaagacgctcctgcgaaaattccggacgaagaagctaccaagcctgaagggtggctcgacgacgagcctgagtacgttcccgaccctgacgctgagaaaccagaagactgggacgaggacatggatggagagtgggaagctccccagatagccaatccgcgatgtgaatctgcacccgggtgcggggtttggcagaggcctgtaattgacaatcccaattacaaaggaaagtggaagcctcccatgatcgataatccctcatatcagggcatctggaaaccaagaaaaatacccaatcctgatttttttgaggacctggagcccttcaggatgacacccttttctgccatcggattggaactctggtcgatgacctcagacatcttcttcgacaactttatcatttgcgcggaccgacgaattgtggacgactgggccaatgatggctggggtctgaaaaaggccgctgatggagccgccgaacctggtgtggtgggtcagatgatcgaggcggcggaggagaggccatggttatgggtggtgtatatcctcacggttgccctccctgtttttctcgtgatcttgttctgctgctcaggcaagaagcagacgtctggtatggagtataagaagacagatgcaccccagccagatgtgaaggaggaggaggaggaaaaagaagaggaaaaagataaaggagacgaggaggaggaaggggaagagaagttagaagaaaagcagaaaagcgatgctgaggaggacggtggaactgttagccaggaggaagaagaccgcaagccaaaggccgaagaagatgagattttaaatcggtcccccagaaatcgcaagcctcggcgggaatag

SEQ ID NO: 181368 - DNA, 405 bp, Artificial Sequence
  Description of Artificial Sequence: Synthetic coding sequence
atggagggcaagtggctgctgtgcatgctgctggtgctgggcaccgctatagtcgaagcccacgatggccacgatgacgatgtgatagacatcgaggatgatctggacgacgtgatagaagaggtggaagactccaagcccgatacaaccgcccctccctccagtccgaaggtgacctataaagctcccgttcccacgggggaagtatacttcgccgactctttcgatagggggacgctgtccggatggattttgagcaaggccaaaaaagatgacacagatgacgaaattgccaagtacgatgggaagtgggaggtggaggaaatgaaggaatcaaagttgccaggggacaaaggcctcgtcctgatgagccgggccaaacatcacgccatcagtgctaaatag

SEQ ID NO: 181369 - DNA, 507 bp, Artificial Sequence
  Description of Artificial Sequence: Synthetic coding sequence
atggagggcaagtggctgctgtgcatgctgctggtgctgggcaccgcaattgtagaggcacacgacgggcacgacgatgacgtgattgatattgaggatgaccttgacgatgttatcgaggaggttgaggactctaagccagacactactgcccctccctccagtccaaaggtgacttacaaggcgcctgtacctacaggagaagtatatttcgcggactcatttgaccgcgggactctgtccggttggatcctgagtaaggcgaagaaagacgatacagacgatgagatcgccaaatacgatgggaaatgggaagtcgaggagatgaaggaaagtaaactgccaggggacaagggactagttctgatgtcgagggccaaacaccatgcaatttcagctaagctgaacaagccctttctctttgacacaaagccccttatagtgcagtacgaagtgaacttccagaacggtattgagtgcggcggtgcttatgtgaagttgctgtag

SEQ ID NO: 181370 - DNA, 1779 bp, Artificial Sequence
  Description of Artificial Sequence: Synthetic coding sequence
atggagggcaagtggctgctgtgcatgctgctggtgctgggcaccgcaatcgtggaagctcatgatgggcatgatgacgacgtcatcgacatcgaggatgatctcgatgacgtaatcgaggaggtggaagactcgaagcccgatacaacggctccacccagttccccgaaagtgacttacaaggcaccagtgcccacaggcgaggtctacttcgccgacagttttgatcgagggacgttgtcaggatggattctgtctaaagcaaagaaagacgacactgatgatgagatcgctaaatacgacggcaagtgggaagtagaagaaatgaaagagtctaagttgcccggagataaggggctggtccttatgagccgcgccaagcaccacgccatctctgctaagctgaataagccctttctgttcgacaccaaaccactgattgtgcaatacgaagtcaacttccagaacggcatcgagtgcgggggggcatacgtgaagctactgtcaaagacccctgaactcaacctggatcaattccatgacaaaaccccgtatacaatcatgttcggcccggacaagtgtggggaagactacaagctgcacttcatttttcgccacaagaaccctaagacaggaatttacgaagagaagcacgcaaagaggcccgatgccgacctgaagacctactttacagacaagaagacccacctgtacaccctcatcctgaacccagataactcttttgaaatcctggtagatcaaagcgtggttaactctggcaatctcttaaacgacatgaccccccccgttaatccatcccgggagattgaagacccagaagacaggaagcccgaggactgggacgaacggccaaagattccagatccagaagccgtgaagcctgacgactgggatgaggatgcccccgcaaagataccggacgaagaggccacaaagcctgaaggttggctcgacgacgagcctgaatacgtgccagatccagacgccgaaaagcccgaggactgggatgaagatatggatggagagtgggaggcgccgcaaatcgccaatcctagatgcgaatctgcccccgggtgcggcgtgtggcaacggcccgtcattgataatcccaactacaagggtaaatggaagccccccatgatcgataatcctagttatcagggaatctggaaaccaagaaagattcctaaccctgactttttcgaagatctggagcccttccgcatgacacccttctccgcaattggactggaactctggagcatgacgagcgacatattcttcgacaatttcataatctgcgccgaccgccggatagtagatgactgggccaatgatggctggggattgaagaaggcggctgacggggcagccgaaccaggggtggtcgggcaaatgattgaggccgccgaagagaggccatggctctgggtggtatatatcttgaccgtcgcgttacctgtattcctggtcattctcttttgttgttctggaaaaaagcagacatctgggatggagtacaaaaaaactgacgctccacagccggatgtaaaggaggaggaggaggaaaaggaggaggaaaaagataagggcgacgaagaggaggagggagaggagaagcttgaagagaagcagaaatccgacgctgaagaagatggggggaccgtgagccaagaagaggaggaccggaaaccaaaagctgaagaggacgagatcttgaaccggtccccgcggaaccggaagccccgccgggagtag

SEQ ID NO: 181371 - DNA, 240 bp, Artificial Sequence
  Description of Artificial Sequence: Synthetic coding sequence
atggagggcaagtggctgctgtgcatgctgctggtgctgggcaccgctattgtcgaggcccacgatggccatgacgatgatgtgattgacatcgaggacgacttggatgacgtgatcgaggaggttgaagatagcaagcctgatactaccgcccctccaagtagcccaaaggtgacgtataaggcccctgttcctactggtgaggtatacttcgcagacagttttgatagggggacttag

SEQ ID NO: 181372 - DNA, 99 bp, Artificial Sequence
  Description of Artificial Sequence: Synthetic coding sequence
atggagggcaagtggctgctgtgcatgctgctggtgctgggcaccgcaatcgtcgaagcacacgacggtcatgacgatgatgtcatagatattgaatag

SEQ ID NO: 181373 - DNA, 1455 bp, Artificial Sequence
  Description of Artificial Sequence: Synthetic coding sequence
atgaaggagagcaagctgcccggcgacaagggcctggtgctgatgtcacgagccaagcatcacgcgatcagcgccaaattgaacaaaccattcctgtttgacaccaagcctctgatcgtgcaatacgaagtaaatttccaaaatggcattgaatgcggaggcgcatatgtgaaactgttgtccaaaaccccagagctaaacttggatcagtttcatgataaaactccatacaccatcatgtttggacccgacaagtgcggcgaagattacaagttgcatttcatctttcgacataaaaaccctaaaactgggatatacgaagaaaaacacgcgaaaagaccggatgccgacctcaaaacctatttcacagataaaaagacacatctgtataccctaatcctaaacccggacaactcgtttgaaatcttggttgaccagagtgtagttaattctggaaacctgttgaatgacatgactccgccagtgaatccatctagagaaattgaggaccccgaagataggaaacctgaggattgggacgaacgaccgaaaattcctgatccagaagcagtcaagcctgacgactgggacgaagacgccccagccaaaatccctgacgaagaggctactaaacctgagggctggctggatgatgagccagagtacgtaccggatcctgatgctgaaaaacccgaagactgggatgaagatatggatggggagtgggaggccccccagatagccaacccgagatgcgagtctgcgccggggtgtggagtgtggcaacgtccggtcatagacaaccccaactacaaaggcaagtggaagccacccatgatcgacaacccctcctaccagggaatctggaagccgaggaagatccccaatcccgattttttcgaagatctcgagccttttcgcatgactcctttcagcgccatcggtctagagctttggagcatgacatcagacatctttttcgataacttcattatctgcgccgaccgccgcatcgtagacgactgggccaatgatggttggggactaaaaaaagccgcggatggagcggccgagccgggagtggtcgggcagatgattgaggctgctgaggagagaccttggttatgggtggtgtatatactgactgtggcccttcctgtgtttctggtaattctcttttgctgctccggcaaaaagcagacttccgggatggagtataagaaaacagatgccccccagcccgacgttaaagaagaagaagaagaaaaagaagaggagaaagacaaaggggatgaggaggaagagggggaagagaagttggaagagaaacagaagtctgacgccgaggaagacggaggcactgtatcccaagaagaagaagacaggaagcccaaggctgaagaggatgagatcctcaaccggagtcctcgcaacagaaagccacgcagggagtag

SEQ ID NO: 181374 - DNA, 324 bp, Artificial Sequence
  Description of Artificial Sequence: Synthetic coding sequence
atggagggcaagtggctgctgtgcatgctgctggtgctgggcaccgctatcgttgaagcgcatgatgggcacgatgatgacgtgatcgacatcgaagacgacctcgacgatgttatcgaagaggtagaagacagcaaaccagacactacggctccgcctagcagccctaaagtcacatataaagcccccgtcccaacgggcgaggtttatttcgctgacagcttcgatcgcgggaccttgtcgggctggattttgtccaaagccaagaaagacgacacagacgacgagattgcaaagtatgatggcaagtgggaggttgaatag

SEQ ID NO: 181375 - DNA, 435 bp, Artificial Sequence
  Description of Artificial Sequence: Synthetic coding sequence
atggagggcaagtggctgctgtgcatgctgctggtgctgggcaccgccattgttgaggcacacgatggccacgatgatgatgtgatcgacattgaagatgaccttgatgatgttatagaagaggtcgaggactctaagcctgacactacagcgccaccctcctcacctaaggttacatacaaggcccccgttcctactggagaggtctacttcgctgactcctttgacagaggcacattgagcgggtggatactttccaaggcgaagaaggacgacactgatgacgagatcgcaaagtatgacggaaaatgggaagtcgaagagatgaaggagtctaagcttcccggagataagggattagtgctcatgagtcgtgcaaagcaccacgctatatccgcaaagcttaataaacccttcctgttcgacacgaagtag

SEQ ID NO: 181376 - DNA, 420 bp, Artificial Sequence
  Description of Artificial Sequence: Synthetic coding sequence
atgcgggccggccggggcgccacccccgcccgggagctgttccgggatgctgccttccccgctgccgactccagcttattctgcgacctgagtacacctctggcgcagtttcgcgaggacatcacctggcggaggccacaggagatttgcgctaccccccggctgtttccggacgatcccagggaaggccaggtgaagcagggacttctgggtgactgttggttcctctgtgcttgcgcagccctacaaaagtcacggcaccttctcgatcaggtctcctgtccagtgcagctgcctgcagactggacttgcaaggttcagcctgtctggcttgaatttccttgcttacccattagctgcaggcttcgcgtgtctagtgacacctcgccggattctgctacttgggggtcctggaagtag

SEQ ID NO: 181377 - DNA, 417 bp, Artificial Sequence
  Description of Artificial Sequence: Synthetic coding sequence
atgcgggccggccggggcgccacccccgcccgggagctgttccgggacgccgcttttccagccgccgacagcagcctgttttgtgacctgtcaacccctctggcccagttccgcgaggacattacatggcgacggcctcaagtcccggaaggcgggcgctcccaggatgcgcctccccttctgcttcaggaacccctgctgtcatgcgtgccacatcgttacgcccaagaggtcagcagattgtgcctgctgccagctggcacctacaaagttgttccgagcacttatctccctgatactgagggggcctttactgtcacaatcgccactcggatagacagaccctcgatacactcccaggaaatgctcggacagttcctgcaggaggtctccattatggctgtgatgaagacctag

SEQ ID NO: 181378 - DNA, 1554 bp, Artificial Sequence
  Description of Artificial Sequence: Synthetic coding sequence
atgcgggccggccggggcgccacccccgcccgggagctgttccgggatgccgcctttcccgctgccgattcttctctgttttgcgacctgtctacccccctagcacaattccgtgaagatatcacctggcgcaggccgcaagaaatttgtgccacgccgcggctgttcccagacgaccctcgagagggccaggtgaagcagggtctacttggagactgctggttcctgtgtgcctgtgccgccctacagaaatctcggcacctcttagatcaagtcattccacccggacaacctagctgggccgaccaggaatatcgaggctcctttacctgtcgcatctggcagttcggacgctgggtggaggttactacagatgaccggctgccatgtttggcaggacggctctgcttttcaaggtgccagagggaagacgtgttctggctcccgttgctggagaaggtgtacgccaaagtgcacggaagctacgagcacctttgggccgggcaggtagcagacgcactggtcgacctgacgggcgggctggccgaaaggtggaatctgaagggagtcgcgggctcaggaggacagcaggacagaccagggagatgggaacacagaacatgcaggcagctgcttcatctgaaagaccaatgtcttatctcctgttgtgtcttaagtccgagggcgggtgcccgcgagcttggcgagtttcacgcattcatcgtatccgatcttagggagttgcaggggcaagccgggcagtgtatacttttgttgagaatccaaaatccctgggggaggcggtgctggcaaggactttggagggaaggcggcgaagggtggtcacaggtggatgcagccgtggcatccgagctgctgtcgcagttacaggaaggagagttctgggttgaggaagaggagttcctgcgcgagtttgacgaactgacagtggggtaccctgtcaccgaagcaggacatctgcagtccctttacacagagcgactgctgtgccatacccgagctcttccaggcgcctgggtgaagggacaatcggcgggcggttgccgcaacaactctgggttcccttcaaatcctaaattctggttgcgggtgtcggagcccagcgaggtttacatcgcagtgctacagagatcccggctgcacgctgctgattgggcaggtagggcgcgggctttagtcggtgactcccatacctcctggtctccagctagtataccgggaaaacattaccaggccgtgggcctccatctctggaaggtgcctgagggagggagatcacaagatgctcctcccctgttacttcaggagcccctgttaagctgtgtgcctcaccgttacgctcaagaagtgtcaagactctgcctgctacctgctgggacatataaggtggtcccatctacttacctgccagacactgagggggcgtttacagtaactattgcaacaagaattgataggccatctatacattctcaggagatgctgggacagtttttgcaggaagtgtcaatcatggccgtgatgaaaacctag

SEQ ID NO: 181379 - DNA, 1335 bp, Artificial Sequence
  Description of Artificial Sequence: Synthetic coding sequence
atgcgggccggccggggcgccacccccgcccgggagctgttccgggacgccgcttttccggcagctgactcatctctattttgtgatctgagcacccccctggcccaatttagggaggatattacctggcggcggccacaggagatctgcgcaacgccacggttattccctgatgatcctagagaaggccaggtgaagcagggcttacttggcgactgttggtttttgtgcgcatgtgcagctctccagaagagccgacatctgcttgatcaggtgattccgcctggacagcctagttgggctgatcaggagtatcgaggttccttcacgtgtaggatctggcagttcgggcgctgggtcgaagtcactactgatgatcgccttccctgcttggccggccgactgtgctttagccgatgccagagagaggacgtgttttggctgcctcttctcgaaaaagtgtatgcgaaggtccacggctcttacgaacacctctgggccggacaggtggctgacgctttggtcgatttgacaggtgggctggccgagaggtggaacctgaagggagtggccggcagcggtgggcagcaagatcgacctggcagatgggagcaccgcacatgtcgccagctgctgcacctgaaagatcagtgcctaattagctgctgcgtactgagccctcgggccggagctcgcgaactgggggagttccatgctttcattgtgtctgacttaagggaacttcagggacaggcaggtcagtgcatcctactgctccgtatccagaacccctggggccgccgttgttggcagggcctgtggcgggagggcggggaggggtggagccaggttgatgctgccgtcgcctctgagttgttgtcccagctccaggaaggagaattctgggttgaggaggaagagtttcttagggagtttgatgaactgactgtaggctaccccgttaccgaagccggacaccttcagtccctttacaccgagagattgttgtgccatactcgtgcgcttccaggtgcatgggtgaagggccagagtgccggcggttgtaggaacaattccggatttccatccaaccccaagttttggctcagggtttcagagccaagcgaggtgtacattgcagtactgcaacggagtagactacatgctgctgattgggcaggtagggccagagccctggtaggagacagtcatacaagctggtcacccgcctctatccctgggaaacattaccaggcagtgggcctgcacctctggaagggcgttaccctaggcacaaccctgttccccgtcccatcttggatgtggcctacctag

SEQ ID NO: 181380 - DNA, 2019 bp, Artificial Sequence
  Description of Artificial Sequence: Synthetic coding sequence
atgcgggccggccggggcgccacccccgcccgggagctgttccgggacgcagcatttcctgccgcagattcatccctgttttgtgatctctccacacctttagctcagtttagagaagacattacttggcgccgcccgcaggagatctgcgcaacacctcgcctttttccagatgacccccgagaggggcaggtgaagcagggactgctcggcgactgctggttcctgtgtgcttgtgctgccctccagaaaagtcgccacctccttgaccaagtgattcctcccggccagccctcatgggccgaccaggaatacagggggtcttttacttgccgcatttggcagtttgggcgctgggtggaagtgactacagacgacagactcccctgccttgcggggcggctgtgcttctcccggtgtcagagagaagatgtcttttggttaccactgctggagaaagtgtacgctaaggtccacggaagttacgagcatctgtgggctggccaggtcgccgacgccctggtcgacttgaccggcggacttgccgaacggtggaatctgaagggagtggccggctctggaggccagcaggataggcccgggaggtgggagcacagaacttgtaggcagctcctccatctcaaggaccagtgtttgattagctgttgtgtgctttccccacgagctggggctagggagctgggggagttccacgcttttattgtttctgacctgagagaactccagggacaggctgggcagtgcatcctattactccgcattcagaacccctggggtagaagatgctggcaggggctctggcgggagggcggggaaggttggtctcaagtcgatgccgccgttgcttccgaattgctgagccagctgcaagagggtgaattctgggtcgaggaagaagagtttctcagagagttcgatgagctgaccgtaggatatcccgtgaccgaggccggccacttgcaatctctatatacagagaggcttctctgccataccagagccctgccgggggcttgggttaaaggccagtcagcgggtggctgcaggaacaactctgggtttccatcaaaccccaagttctggctgcgtgtttccgagccgtctgaggtctatatagcggttctgcaacgttcccggctacatgcagccgactgggccggccgggcacgggctctcgtgggcgattcccatacatcctggtctcccgcatccattccaggaaagcattaccaggccgttggtctgcatctttggaaagtcgagaaacgcagggtgaacctaccacgcgtgctgtcaatgcctccagttgctggtacagcctgtcacgcttacgatagggaggttcacctacgctgcgaactgtcacctggatattatctcgcagtgcctagcaccttcttaaaagacgcacctggagaatttttgctcagggttttctccacaggacgggtctctctgtctgcaattcgcgcagttgcgaagaacactacccccggtgctgcattgcctgccggcgagtggggcaccgtgcagctgcgaggctcatggagagtgggacaaacagctgggggcagccgcaacttcgcgtcttaccctacgaacccatgctttccattcagcgtgccggagggaccgggaccgagatgcgtgaggattaccctacaccagcattgccggccctctgacaccgaatttcacccgataggcttccacatcttccaggtgcctgagggtggcagaagccaggatgcccccccactgctgttgcaggagccactgctctcttgcgtcccacatcgctacgcccaagaggtgtccaggctctgtctgttgccagcaggaacatataaggtcgtaccttctacttacttgcccgatactgagggagcgtttacagtgacaatagcaacacgaatagataggccttccattcactctcaggaaatgctcgggcagttcctgcaagaggtctctatcatggcagtgatgaaaacctag

SEQ ID NO: 181381 - DNA, 2220 bp, Artificial Sequence
  Description of Artificial Sequence: Synthetic coding sequence
atgctgtacagccccggccccagcctgcccgagagcgccgagagcctcgatggttcacaggaagataaaccacgcggctcctgtgcagagcctaccttcaccgacacaggaatggtcgcccacatcaacaactcaagactgaaagccaagggggttggccagcatgacaatgcccagaactttgggaatcaaagctttgaagagctgagggcagcctgtctgaggaagggggagctgttcgaagaccctctatttccagccgagccctcatcccttgggtttaaggatctcggtccgaactccaagaacgtgcagaacatttcctggcaacgcccaaaagacatcattaacaatccacttttcatcatggacgggatcagccctactgatatttgtcagggaatcctgggggattgttggttattggccgcgatcgggagcctcaccacctgcccgaaactcctgtatcgggtggtgccacgaggacagtcctttaagaagaattacgctgggatttttcattttcaaatctggcagttcggtcagtgggtgaacgttgtagtggacgatcggctgccaacgaagaacgataaactggtctttgtgcactccactgagaggtccgagttttggagcgcacttctggagaaagcttatgccaagctgtctggaagttatgaggccctatcagggggctctacgatggaagggctggaggatttcacaggaggcgtggctcagtcatttcaattacaacgcccgccccagaacctgcttaggcttcttaggaaggccgttgagaggtcatcactaatgggctgcagtatcgaagttaccagtgactccgaacttgagtctatgaccgacaaaatgcttgtacgcgggcacgcctatagtgtcacagggctgcaggacgtgcactacagaggcaaaatggagacccttatccgggtcaggaatccgtggggacgcattgagtggaacggcgcctggtccgattcagcccgggaatgggaggaagtggccagtgacatccaaatgcagctcctgcacaagaccgaggatggggagttctggatgtcgtaccaggattttcttaataactttaccctgctggaaatctgcaacctcactcccgacacacttagtggggattacaaatcctactggcatactacattttacgaagggtcctggaggcggggatcctcagcgggcggctgccggaaccatcctggtacattctggaccaatcctcaattcaaaatctcgctgcccgagggagacgatcctgaggatgatgctgaaggtaacgtggtcgtctgtacctgcctggtggcccttatgcagaagaactggcggcatgctcgacaacaaggagctcagctccagaccatcgggtttgtgctctacgcggttccaaaagagttccaaaacatccaggacgtccatcttaagaaagagttcttcaccaagtaccaggaccacggattttccgaaatttttaccaacagtagggaggtgtccagccagctccggctaccgcctggagaatatattataatcccaagtactttcgagccccatagggacgctgattttctgttaagggtctttacagaaaagcacagcgagagttgggagctcgacgaagtgaactacgctgagcagttgcaggaggagaaggtcagtgaagatgatatggaccaggatttcctgcaccttttcaagatcgttgcaggtgaggggaaagaaatcggggtctatgaattacagcgcttactaaatcgcatggccatcaagttcaaatcctttaagacaaaaggctttgggttggatgcttgccgttgcatgattaacctaatggataaggatggctccggcaagttagggctactggagtttaaaatcctatggaaaaagctaaaaaagtggatggacatcttccgggagtgcgaccaagatcactcggggacccttaacagctacgagatgcggttagtaatagagaaggcagggatcaaacttaataataaagtaatgcaggtgctggtggcccgctatgctgacgatgatctcatcatcgactttgacagcttcatcagctgctttctgagactgaagacaatgttcacatttttcctgaccatggaccccaaaaatactgggcacatctgtttatcactggaacagtggctgcagatgacaatgtgggggtag

SEQ ID NO: 181382 - DNA, 2220 bp, Artificial Sequence
  Description of Artificial Sequence: Synthetic coding sequence
atgctgtacagccccggccccagcctgcccgagagcgccgagagcttggacggcagccaggaagacaagcctcgcggctcctgtgctgagcccacgtttaccgataccggcatggtagcacacatcaacaattcgagactcaaggcgaaaggcgtaggacagcatgacaatgctcagaattttggtaatcagagcttcgaggagctgcgggccgcctgcctcagaaaaggcgagcttttcgaggatcctttgttcccggctgagcccagtagtctcggttttaaggaccttggccccaattcgaagaacgtccagaatatcagctggcagagaccaaaagatatcataaataaccctcttttcatcatggatggaatttctcccacagacatttgtcaggggatcttaggggactgctggctactggccgcgattggatcgttaaccacctgtcctaaattactgtatcgtgtggttccaagggggcagagttttaaaaaaaactacgctggcatatttcactttcagatttggcagtttggacagtgggtgaatgtggtggtggacgatagactccccactaaaaacgataagttagtctttgtccactcaacagagagatctgaattctggagcgcactacttgaaaaggcttacgctaagctctccggaagctacgaagccttgtccggcggcagtactatggaaggcctggaggacttcacaggaggagttgcacagtcttttcagctgcaacgcccaccgcagaatctgctgaggcttctgagaaaagctgtcgagaggtcgtccctcatgggctgttcaatagaagtcacctctgactctgagctggaatcaatgacagacaaaatgttggtgcgtggacatgcttatagcgttacagggttgcaggacgtgcactaccgcggcaagatggagaccctgatccgtgtgcgcaacccatggggtagaattgaatggaacggagcctggtctgatagtgcacgggagtgggaggaggtggccagtgatatccagatgcagctgcttcacaagacggaggacggagagttctggatgagttaccaggactttctaaacaattttactctgctggaaatctgcaacctcacaccagacacactaagcggagactataagtcttactggcacacaactttctatgaaggctcctggaggcgaggtagctctgctggcggttgtcgcaatcaccctggcaccttttggaccaaccctcagtttaagatttccctgccagagggggacgatcctgaggacgatgccgagggaaatgtcgtagtttgtacctgcctggtcgcccttatgcagaaaaactggagacacgctcgacagcagggtgcgcagctccaaaccatcggatttgtcctgtacgcagtcgcttcacccttccagaacattcaagacgtacatttgaaaaaggaatttttcaccaagtaccaagatcatggcttttcggagatttttacaaactccagagaagtgtcatcacagctgagactcccacctggcgagtacataataataccgtctacctttgagccccatcgcgacgccgattttttactgcgtgtgttcaccgaaaagcacagcgaaagctgggagctcgatgaagtgaactacgccgaacaactgcaggaggaaaaagtatctgaagatgatatggatcaagactttctacatctgttcaaaattgttgccggagaaggtaaagagataggtgtgtatgagctccagaggctcctgaatcgaatggccataaaattcaaaagcttcaaaacaaaaggttttggattggacgcttgtaggtgcatgattaatctcatggacaaggacggaagtggaaagctgggactgctggaattcaagattttgtggaagaaacttaagaagtggatggatatcttcagagagtgcgatcaggatcattccggaacgctgaattcctacgaaatgcgcctggttatcgaaaaagcaggcatcaagttgaacaacaaagtgatgcaggtactggtggcccgctatgcagacgatgacttaataattgatttcgactcttttatctcctgctttcttcgactcaaaacaatgtttactttttttctgacaatggatcccaagaacacaggccacatctgcttgtcgttagagcagtggctacagatgacaatgtggggttag

SEQ ID NO: 181383 - DNA, 2160 bp, Artificial Sequence
  Description of Artificial Sequence: Synthetic coding sequence
atggccagcagcagcggccgggtgaccatccagctggtggacgaggaggctggcgtcggggcggggcggctgcagctgttcaggggccagagctatgaagcaatccgtgcagcatgtctagattcaggaatactgttcagggatccttattttccggccggaccagatgcccttggttacgaccagctcggcccagactctgaaaaggccaaaggagtgaaatggatgcgaccacacgagttctgtgcggagcctaagtttatctgtgaggacatgagcaggacagacgtgtgccaggggagtttgggtaattgctggtttctcgctgctgctgcttcactcactctgtacccacgacttttacgccgcgtggttcctcctggtcaagatttccagcatggatatgcgggcgtttttcactttcaattatggcaatttgggcgctggatggatgtggtcgtcgacgataggttacccgtgcgagagggtaagctgatgttcgttagatccgagcagcggaacgaattttgggctccacttttagaaaaggcatacgccaaactgcacggatcttatgaagtgatgagaggtggccatatgaatgaggccttcgtcgatttcactggtggtgtgggcgaagtcctttatcttagacagaactcaatgggcctcttctccgccctgcggcatgccctggcaaaagaatccttggtgggagccacagccctgtctgatagaggggagtatcggacagaggaaggtctagtaaagggacatgcgtactccattactggtactcacaaagtctttctcggctttactaaggtgcggctgctgaggctgagaaacccatggggttgtgtcgagtggaccggcgcctggagtgacagctgccctcgctgggatacgctgccaaccgagtgcagggatgcccttttggttaaaaaagaagatggagagttttggatggagctgcgggatttcttactccatttcgatactgttcagatctgtagcctgagcccagaagttctcggaccatcccctgaaggcgggggatggcatgtgcatacatttcagggcaggtgggtccgaggcttcaattctgggggatctcagccgaatgccgagacattttggacaaatccccagttccgactgaccttgcttgagcccgatgaggaagacgatgaggatgaggagggcccttggggggggtggggggcagctggggcccgggggcctgccagaggcggcaggaccccgaagtgcaccgtactactcagtctgatacaacggaaccgcagaaggcttagagccaagggattgacgtatctgacagttggcttccacgtgttccaaattcctgaggagctgcttggcctttgggattctccccgctcacatgcattactcccacggcttctgcgtgccgatagaagccccctctcggcccgccgtgacgtgacacgtaggtgctgcttacggcccgggcattacctggtggtgccatctacagctcacgctggagatgaggccgatttcaccttgcgcgtcttttctgagcgcaggcacaccgccgtggaaattgatgacgtgattagtgcagaccttcagtcactccagggaccctacctgccattagagctagggttagaacagttattccaagaattagcgggtgaggaagaggaacttaatgcgagtcagctgcaagccctacttagcatcgcattggagccagctagggcccatacaagcacgccgcgagaaatcggattacgcacttgcgagcagctactccagtgcttcgggcacggacaatctctcgcattacatcatttccaacagctgtgggggtacctattggagtggcaggccattttcaataagtttgacgaagatacatcgggcaccatgaactcctatgagcttcgccttgctctgaatgctgccgggttccacctcaacaatcagctgacccaaacgttaacttccagatatcgagattctcgcctgagagtcgactttgagcgttttgttagctgtgtggctcatctgacgtgcattttttgccactgttcacagcacctggatggaggggaaggggtgatttgtctgactcatcgccagtggatggaagtcgccacttttagctag

SEQ ID NO: 181384 - DNA, 2448 bp, Artificial Sequence
  Description of Artificial Sequence: Synthetic coding sequence
atgcccaccgtgatcagcgccagcgtggccccccggaccgccgccgaaccgcgttcccccggaccagtgccgcatcctgcccagtcaaaagctacagaagccgggggcggaaacccgagcggcatctacagcgcaatcatctctcgaaattttcctatcatcggagtgaaggagaaaacgtttgagcagcttcataaaaagtgtctggagaaaaaagtactttacgttgatcccgagttcccacccgatgaaacttcattgttttactctcaaaagtttccaattcaatttgtgtggaagcggcccccagagatctgtgaaaatccccggtttattatagacggtgccaatcgcactgacatatgtcaaggggagctaggcgattgttggtttctggctgctattgcctgtttgactctcaatcaacacctgctcttcagggtcatcccacacgaccagtccttcattgagaattatgccgggatttttcacttccagttttggcggtatggggagtgggtggatgtggtgattgatgactgcctcccaacctataataaccagctagtgttcaccaaatccaatcaccgcaacgagttttggagtgctttacttgaaaaagcttatgctaagctccacggcagctatgaggccctgaagggaggcaacacaactgaggccatggaggactttaccggtggtgttgcagaattcttcgaaatcagggacgccccttccgacatgtacaaaataatgaaaaaggccattgagcggggttccctgatgggatgtagcatcgacgatggtacgaatatgacttatggaacgtctccaagtgggctgaatatgggtgagctcatcgccagaatggtgcgcaacatggataattctcttctacaagactcagacctggatccgcgggggtctgacgagcgccctacccggactattatcccagtccaatatgaaacgcggatggcctgcggtctcgtgcgaggccatgcctactctgtcaccggactggacgaagttccctttaagggagagaaagtcaagctcgtgcgcctgagaaatccatgggggcaggtggaatggaacgggtcctggtccgatcgatggaaggattggtctttcgtcgacaaggacgaaaaggcacgactgcaacaccaggtgaccgaggacggggaattctggatgtcctatgaagactttatctaccactttactaagctggagatctgcaatttaaccgccgatgctctgcaaagcgacaaactgcaaacgtggacagtcagcgttaacgaggggagatgggtcaggggttgttccgccggcggatgtcgaaacttccccgacacattttggaccaatccccagtaccgccttaaactgctggaggaggacgacgatccagacgattcagaagtgatatgttctttccttgttgcactgatgcaaaagaataggagaaaggatcggaaactgggcgccagcctcttcacaatcggattcgccatctacgaagtgccccaccaaatgcacggcaacaagcagcacctgcaaaaagatttctttctgtacaatgcctctaaggcccgttcaaagacctacatcaatatgcgggaggtgagccagcggttccggctgcccccgtcagagtacgtgatcgtaccctccacgtatgaaccgcaccaagagggtgagtttatactgcgagtgttctccgagaagaggaatctttctgaagaggtagaaaacaccatctctgttgaccgcccagttccaatcatcttcgtctcggatagggcgaatagtaataaggagctaggggtggaccaggagtcagaagagggaaagggtaaaacgagtccggataaacagaagcaatcccctcagccacagccaggctcaagcgaccaggaatcggaagaacaacaacaatttcgcaacatctttaagcagatcgctggggacgacatggagatttgtgctgatgagctcaaaaaggtgctgaatacagtggtgaataaacacaaagacctgaagacccacgggtttactttggaatcctgccggagcatgattgcattaatggacaccgacgggtctggaaagctcaatctccaagagtttcaccatctttggaataaaatcaaagcttggcagaagatctttaaacattatgatactgaccagagcggaaccatcaattcctacgaaatgcgcaatgctgttaacgacgccggattccatctcaacaaccaactttacgatatcataactatgcggtatgcagacaaacatatgaatatagatttcgactctttcatatgctgcttcgtgagactcgagggcatgttccgggcattccacgccttcgacaaggacggcgatggaatcattaagctgaatgtgcttgagtggttgcaactgaccatgtacgcctag

SEQ ID NO: 181385 - DNA, 930 bp, Artificial Sequence
  Description of Artificial Sequence: Synthetic coding sequence
atgcacggcaacaagcagcacctgcagaaggacttcttcctgtacaatgcaagtaaagccagatctaagacgtatattaatatgagagaggtgtcacagcgcttcagactgcccccatctgaatacgtaatcgtgcctagtacgtatgagccccatcaggagggggaatttatactgagagtgttttcagaaaaacggaacctgagtgaagaggtggaaaataccatcagcgttgatagaccagtgcgaaaggagacctacaagcctatcatcttcgtgtccgaccgggccaactcaaacaaagaactcggagtcgatcaagagtccgaggaggggaaaggcaagacatcaccagataaacaaaagcagagcccccaaccacagccaggctcatccgatcaggaaagcgaagaacagcagcagtttaggaacattttcaagcaaattgcaggagatgacatggaaatctgcgccgatgagcttaagaaggtgcttaatactgtggtgaataagcataaagacctgaagacccatggatttactctggagtcctgccgatcaatgatagcgctgatggacacggacggctctgggaagctcaacctgcaggaatttcaccacctgtggaataaaattaaggcctggcagaagatctttaaacactacgacaccgaccaatccggcactataaatagttacgaaatgagaaatgcggttaacgacgccggattccatcttaacaatcagctgtacgacattatcaccatgcgatatgctgacaagcacatgaacattgatttcgactccttcatttgttgcttcgtccggttggagggaatgtttagagcctttcatgcctttgacaaggacggggacggcattattaagctgaacgtgttggagtggctccagcttacaatgtacgcttag

SEQ ID NO: 181386 - DNA, 471 bp, Artificial Sequence
  Description of Artificial Sequence: Synthetic coding sequence
atggagatctgcgccgacgagctgaagaaggtgctgaacaccgtggtgaataagcacaaggatctgaagactcatggctttacgctggagagctgtcggagcatgattgccctcatggacactgacggcagcggaaagctgaatctgcaggaattccatcacctatggaataaaatcaaagcgtggcagaaaattttcaagcactatgatacggaccaaagcggtacaatcaactcctacgagatgaggaacgccgtgaacgatgcaggattccacctgaataaccagctttatgatattatcacgatgcggtatgctgacaaacacatgaacatcgactttgattcattcatatgctgttttgtgcgccttgaaggaatgtttagagcattccatgcttttgacaaggatggggatggcattatcaagctgaatgtgctggaatggttgcagctgaccatgtatgcctag

SEQ ID NO: 181387 - DNA, 2190 bp, Artificial Sequence
  Description of Artificial Sequence: Synthetic coding sequence
atgcccaccgtgatcagcgccagcgtggccccccggaccgccgccgagccacgttccccagggccagttcctcatcctgcccagagcaaggctacggaggcaggcggcgggaatccttccggcatatattcagcaataatcagtagaaacttccccattattggcgtcaaagaaaaaacctttgagcagctccacaaaaaatgtctcgaaaaaaaagtgctctatgtcgatccagaattccctccagacgagacctcacttttttacagccagaaatttcccattcagtttgtatggaagcgcccgccagagatttgtgagaatcccaggtttataattgacggagccaatcgcactgacatatgtcagggggagttgggtgattgctggtttcttgcagctattgcctgcctgacactgaatcagcatctgctttttcgggtcatcccgcacgaccagtcatttatagaaaattacgctgggatctttcattttcagttttggcgctatggagagtgggtagacgtcgtcatcgacgactgcctccctacctacaataaccagttagtctttaccaaaagcaaccacaggaatgaattttggtccgctctcttagaaaaggcatatgccaagctgcatggatcctacgaggcactgaagggcggaaacacaaccgaagctatggaggattttactggaggagttgccgaattttttgaaattagagatgcgccctcagacatgtataaaatcatgaagaaagcaattgagcgcggatctcttatgggctgcagtatcgatacaatcattccggtacagtacgagacaaggatggcatgcggcctcgtgagggggcacgcttactccgttactggcctggacgaggttcccttcaagggagagaaagtaaagctggttcgacttcgtaatccctggggacaagtggagtggaatggaagttggagcgatagatggaaggattggtcctttgtggataaagacgaaaaagcccgattgcaacatcaggtcactgaggatggcgaattctggatgtcatatgaggattttatataccacttcactaagctcgagatctgtaatttgactgctgatgcgttacaatctgataaactacagacttggacggtgagcgttaacgagggacggtgggtccgggggtgtagtgccggggggtgtcgaaattttcccgacaccttctggactaacccccaataccgcctcaaactgctggaagaagatgatgacccagacgatagtgaggtgatctgttcattcctagtcgccctaatgcagaagaatcgccgaaaggatcgcaagctgggggcatccttgttcaccattggctttgctatctacgaagtgccaaaggaaatgcacggaaacaaacagcacctgcaaaaggatttttttttgtacaacgcctcaaaagctaggagcaagacctacatcaacatgcgtgaagtttcccagaggttcagactcccccctagcgaatacgtgattgttccatccacttacgagccacatcaggaaggagaattcatcctgagggtcttctctgaaaaaagaaacctttcagaagaggtggagaatacgatcagcgtcgacagacctgttcctcaaccaggctccagcgaccaggaaagcgaggagcagcagcagttccgaaacatctttaagcagatagcaggagacgatatggagatctgtgcggatgagctgaaaaaggtactaaacactgtcgtaaataagcacaaagatctcaagacccatgggtttactctggagagttgcagaagcatgattgccctcatggatactgacggatccgggaagttgaacctccaggagttccaccacctgtggaacaagattaaggcttggcaaaagatttttaagcattacgatacagatcagtctgggactattaactcttacgagatgcgcaatgcagtaaatgatgctggcttccatttaaacaatcagctgtacgatattattaccatgcgctacgctgacaaacacatgaatatcgatttcgacagctttatctgctgcttcgtcaggctcgaaggcatgttcagggccttccacgcgtttgacaaggatggggacggcatcatcaaactgaatgtactcgagtggctgcagctgacaatgtacgcttag

SEQ ID NO: 181388 - DNA, 2187 bp, Artificial Sequence
  Description of Artificial Sequence: Synthetic coding sequence
atgagctggcagatcagcctgaagacccagaccacccagcagaagaacgaaatctgcgagaatccgcgatttataatcgacggagccaatcgcaccgacatttgccagggggaactgggagactgttggttccttgccgctatcgcctgcctgactctgaatcagcacctcctcttccgggtgatcccgcacgaccagtcattcatcgagaactacgccggcatcttccacttccagttttggagatacggcgagtgggtcgatgtggttattgacgactgcttaccaacctacaacaaccagctggttttcacgaagagcaaccacagaaatgagttttggtcggccctgctcgagaaagcctacgccaagctgcacggcagctatgaggccctcaaaggggggaatacaaccgaggcaatggaggattttactgggggggtggcagaattctttgagattcgcgacgcaccatccgacatgtacaagattatgaaaaaagccattgaacgaggatctctgatgggatgcagcatcgacgacggaaccaatatgacctatgggactagccccagcggcctgaacatgggcgaactcattgcacgtatggtgcgcaacatggataactccctcctgcaggatagcgatctcgatcctcgcgggtccgatgaaagacctacgagaacaatcatacctgtgcaatacgaaacccgaatggcatgtggtctggtcagaggacacgcttactcagttaccgggctcgatgaagtgcccttcaaaggtgaaaaagtcaagctcgtgcggctgagaaacccctggggccaggtagaatggaacggcagctggtccgatcggtggaaggattggtcatttgtagataaggacgagaaagctaggctccagcaccaggtgaccgaggacggcgaattttggatgagttatgaagatttcatctaccatttcaccaagctcgaaatctgtaatctgactgcagacgcactgcaatcggataagctgcagacttggacggtatccgttaatgaggggagatgggttagaggctgcagcgcagggggctgtagaaacttcccagacaccttctggacaaaccctcaatacaggttaaagcttcttgaggaggacgatgaccccgatgatagcgaagtgatctgtagtttcctggtcgctctcatgcagaaaaaccggcgcaaggatagaaaactgggagcgagcctgtttactattgggtttgccatttacgaggtccctaaggagatgcacggaaacaaacagcacctgcagaaggatttctttctgtacaatgcctctaaggcccgatccaagacatatattaatatgcgagaggtgagccagcgctttcgtctaccaccttcagaatacgtgatcgttccatccacttacgagccccaccaagagggggaatttatcttaagggtatttagcgagaagcgtaacctttcggaggaagtggagaataccatcagcgtcgacagacccgtgccaataattttcgtcagtgatcgggcaaacagcaacaaggagctgggcgtagatcaggagtctgaggaaggtaaaggcaaaacctctcccgacaagcagaaacagagcccccagccccagcccggaagtagtgatcaggagtcagaggagcaacagcaattccggaacattttcaagcaaatcgctggggatgatatggagatctgtgccgacgagctgaagaaagtcctgaatactgtggtcaataagcataaggacctcaagactcatggctttaccctcgagtcttgccgttctatgattgcactcatggatactgatgggtcagggaagctcaacctgcaagaattccatcatctgtggaacaaaatcaaggcttggcaaaaaatcttcaagcattacgacactgaccagtccgggactattaacagctacgaaatgaggaacgcagttaacgacgccggcttccatcttaacaatcagctgtacgatattatcacgatgagatatgctgacaagcacatgaacattgattttgactcattcatttgctgttttgtgagactcgagggcatgttcagggcgtttcacgcctttgacaaggacggtgacggaattatcaaacttaatgttctcgaatggttgcagctgaccatgtacgcatag

SEQ ID NO: 181389 - DNA, 2448 bp, Artificial Sequence
  Description of Artificial Sequence: Synthetic coding sequence
atgcccaccgtgatcagcgccagcgtggccccccggaccgccgccgaaccaagaagccccggccccgtaccccacccggcccagagtaaggctacagaggctgggggggggaacccatccggcatctattccgcgatcataagtcgaaacttccctattatcggagtgaaggagaaaacgtttgagcaactacataagaaatgtttggagaagaaagtgctctatgtcgaccctgaatttccccctgacgaaacctctctcttttattctcagaaattccccatccagttcgtttggaagagaccccctgaaatttgtgaaaatccacgcttcatcatcgatggggccaatagaactgatatatgccagggagaactgggggattgctggtttcttgctgccatcgcttgcctgacactgaatcaacatctgctgtttagggtaatcccccatgaccagtcctttattgagaattacgccggaatattccattttcagttttggcggtatggtgaatgggtagatgtggtgattgatgattgtctccctacatataataatcagctcgtattcaccaaaagtaaccaccgcaatgagttctggagcgccctgctggaaaaggcgtatgccaagctccacggcagttatgaggccctgaagggcggaaacacaaccgaggccatggaagattttactggtggggttgccgagttttttgagattcgggatgctccttccgatatgtataaaatcatgaagaaggccatagagcgcgggagcctaatgggatgtagcatagacgatggcaccaatatgacatacgggacatcaccaagcggtctgaacatgggtgaactaatcgctagaatggtgcggaacatggacaactcactcctgcaggactcagacctcgacccaagaggctccgacgagaggcccactagaactatcatccccgtacaatacgagaccaggatggcctgcgggctcgtcaggggtcacgcatattccgttacaggattagacgaggttccatttaaaggcgaaaaggtaaaactggtgagattgcgaaacccttggggtcaggtagagtggaatggcagctggagcgatcggtggaaggattggagtttcgtggataaggacgagaaagcccgcttgcaacaccaggttacagaggacggggagttctggatgagctatgaggatttcatctatcacttcaccaagctggaaatttgtaacctcaccgctgacgccctgcagtctgataagctccagacctggaccgttagcgttaacgaaggtcgctgggtgcggggttgtagtgccggtggctgtagaaatttcccagacacattctggactaacccacaatatcgcctcaaattgcttgaagaggatgatgatcccgacgactcagaagttatttgcagctttctggtcgcactgatgcaaaaaaaccgcagaaaggatagaaaactgggggctagcctgtttactataggattcgctatttacgaggttcccaaagagatgcatggcaataaacagcaccttcagaaagatttctttctgtacaacgccagcaaagctcgctcaaagacttacataaacatgcgcgaagtgtcacagagatttagattgccaccatctgagtacgtgattgtgccatctacctacgagccacaccaggaaggcgaatttatccttcgtgtatttagcgaaaaacggaatcttagcgaggaggtcgagaatacaatctccgtcgatagacctgtgccgatcattttcgtgagtgaccgcgcaaacagcaacaaggaactcggcgtggatcaagagtccgaggaaggcaagggcaagactagccccgacaagcagaagcagtccccacagccacagcccggaagcagcgatcaggaaagcgaagagcaacaacagtttcgcaacatattcaagcagatagcgggcgacgatatggaaatatgcgcggacgagctgaaaaaagttttaaatactgtggtcaataaacataaggacctgaaaacccacgggttcacactcgagtcatgccgctcaatgattgccttaatggatacggatggctccggcaagttgaatctgcaagaattccaccacctgtggaataaaattaaggcttggcaaaagatatttaaacactacgacacagaccagtcgggcacaattaattcctatgagatgcgcaacgctgttaacgacgctgggtttcacctgaataatcagctgtacgatatcataaccatgcgctacgctgacaaacatatgaacattgattttgatagcttcatttgttgcttcgttcgcctagaaggcatgttccgagctttccatgcgttcgacaaggacggcgacgggatcattaaactcaacgtcttggagtggctgcaattaaccatgtacgcatag

SEQ ID NO: 181390 - DNA, 2466 bp, Artificial Sequence
  Description of Artificial Sequence: Synthetic coding sequence
atgcccaccgtgatcagcgccagcgtggccccccggaccgccgccgaacccaggtcgcctggccccgtgcctcaccccgcccagagtaaagcgaccgaggcaggcggcggcaaccccagtggaatttatagcgccataattagcagaaattttcctataattggggttaaggaaaagacatttgagcagctgcataaaaagtgcctagagaaaaaagtgctatatgttgaccctgagtttcctccagatgaaacctcactgttttattcccagaaattccccatacagttcgtatggaaacgaccacccgagatctgcgagaatcccagattcattatcgacggggccaatcggaccgatatttgccaaggagaactaggagattgttggtttcttgccgctattgcctgcctgacgcttaaccaacacctattatttcgggtgattcctcatgaccaatcttttattgagaattacgctgggatctttcactttcagttttggcggtacggtgaatgggtcgacgtggtgatcgacgactgccttccaacttataacaatcagctggtcttcaccaagtccaatcaccggaatgaattttggagcgcgctcctcgaaaaggcctatgccaagctccatggctcttatgaggccctcaaggggggcaacaccactgaggctatggaagatttcacaggaggggttgccgagttttttgagatccgcgacgctccctctgatatgtacaagatcatgaagaaagccattgagcgaggttccctgatgggttgttcaattgatgacgggaccaatatgacctacggaacctcacccagcggcttgaacatgggagaacttattgcgagaatggtccggaacatggacaatagcttgctgcaggattccgatcttgaccctagggggtcagacgaaaggccaacaagaaccattatccctgtccagtatgaaacgagaatggcatgtggtttggtgaggggtcacgcttattctgtgacgggcctagacgaagtgcccttcaaaggcgagaaggtgaagctggttaggcttaggaatccttggggacaggtggagtggaatggctcatggtccgacagatggaaggactggtctttcgttgataaggacgaaaaagccagactgcagcaccaagtcaccgaagacggagagttttggatgtcctacgaagacttcatctaccactttacaaagctcgaaatctgcaacctgaccgccgatgctctgcagtctgataagcttcagacgtggaccgtaagcgtgaatgaaggccgctgggtccgtggctgctcggccggcgggtgccggaactttcccgacaccttctggaccaatcctcagtacaggctgaaattgctggaagaagatgacgatcccgacgattcagaggttatttgtagttttctggtggccctgatgcaaaagaacagacggaaagatagaaagctgggcgcttctctctttacaatcgggtttgccatctatgaggtccctaaggagatgcatggtaataagcagcacctgcagaaggattttttcctatataatgcttctaaagccagatcaaagacatacatcaatatgcgagaggtgtcgcaacgtttccggctaccccccagtgagtacgtgattgtcccttcaacatacgagcctcatcaagagggagagtttatcctgcgagtgtttagtgagaaacggaacctctctgaggaggtggaaaacaccatcagcgtggaccgccctgtgaagaagaagaagacaaagcctataatctttgtgagtgacagggcaaattcaaacaaggaactgggagtcgatcaggagtctgaggagggcaaaggtaaaacctcgcctgacaagcagaagcagtcaccacaaccacagcctggctcttccgaccaggagagcgaggagcagcagcagttccgtaatatctttaaacaaatcgctggcgacgatatggagatttgtgctgacgagctaaagaaggtgctgaataccgtggtgaacaagcacaaggacctgaaaacccacgggtttactctcgagtcttgtaggagcatgatcgcgctcatggacacggatggatctggcaaactgaacctccaggagttccaccatttgtggaacaagataaaagcctggcagaagatttttaaacactacgacactgaccaatctggcacaatcaactcctacgaaatgcgcaacgctgtcaatgatgcaggctttcacctgaacaaccagttgtacgacatcatcaccatgcgatatgccgacaagcacatgaacatagacttcgactcctttatttgttgttttgtaagactcgagggcatgtttcgcgcttttcatgcattcgataaggacggggacggcattatcaaattaaacgtcctcgaatggctacagctgaccatgtatgcttag

SEQ ID NO: 181391 - DNA, 930 bp, Artificial Sequence
  Description of Artificial Sequence: Synthetic coding sequence
atgcacggcaacaagcagcacctgcagaaggacttcttcctgtacaatgcaagcaaggcaaggtctaaaacatacatcaacatgcgcgaggtatcccaacggttccgattgccccccagtgaatatgtcattgtgccctccacatacgaaccacaccaggaaggtgagttcattttgagggtgttttctgagaagaggaacctctcggaagaagtggaaaacaccatctccgtagataggccagtgaagaaaaagaagaccaagccgataattttcgtgagcgaccgtgcgaacagcaacaaggagctgggggttgatcaggagagcgaggagggcaagggcaaaacgagccccgataagcagaagcagagcccacagccgcagcctggttcatcagatcaggaatcagaggagcagcagcagttccggaacatttttaagcagattgcaggtgatgacatggaaatttgcgcagacgaactgaagaaggttctcaatacagtggtgaataagcataaggacctcaaaacccacgggtttacgttagaatcgtgccgttcaatgatagctctgatggataccgatggcagtggaaagttgaatctgcaagaattccatcatttgtggaataaaatcaaggcctggcagaaaatttttaagcactacgataccgatcagtccggcaccatcaatagctatgagatgaggaatgctgttaacgatgcaggattccacttgaacaaccaactgtacgatattatcaccatgcgatatgctgataagcatatgaatattgacttcgactcattcatttgttgttttgttcgcctggagggcatgtttagagcatttcacgcctttgataaagatggcgatggaatcataaagttgaacgtgttagagtggctgcaactgacgatgtatgcttag

SEQ ID NO: 181392 - DNA, 471 bp, Artificial Sequence
  Description of Artificial Sequence: Synthetic coding sequence
atggagatctgcgccgacgagctgaagaaggtgctgaacaccgtggtgaacaagcacaaagacctgaagactcatggcttcacactggagtcatgccggagcatgattgctttaatggacacagacggttctgggaaactgaatctgcaggaattccatcacctttggaacaagatcaaggcttggcaaaaaattttcaaacactacgacactgatcagagcggcacaatcaattcttacgaaatgcggaacgccgtgaatgacgctggattccacctcaacaaccaattgtacgacatcattacaatgaggtatgctgacaaacacatgaacatagatttcgatagctttatctgctgctttgtaaggctggaaggcatgtttagagccttccacgcctttgacaaagatggcgacggtatcatcaaactaaatgtcctcgagtggctacagctcaccatgtacgcatag

SEQ ID NO: 181393 - DNA, 1923 bp, Artificial Sequence
  Description of Artificial Sequence: Synthetic coding sequence
atgttcagctgcgtgaagccctacgaggaccagaactacagcgccctgaggagagattgtcggagacgcaaggttttgttcgaggatcccctctttccagccactgatgactcactctattacaagggcacccctggccctgcagtcaggtggaagaggcctaaaggcatctgcgaggacccacgcctgtttgtggacgggatctcctcccacgacttgcatcagggccaggtcgggaattgttggttcgtcgccgcttgttcgagcctggcaagccgggagtctctgtggcagaaagtgatacctgattggaaggagcaggagtgggatcccgaaaagcctaacgcctacgctggcatctttcattttcacttttggcgctttggcgagtgggtggatgtcgtgattgacgatcgactccctacagtgaataatcaactcatctattgtcatagtaattcaaggaatgagttctggtgcgcactcgtggaaaaagcgtacgctaaattggcagggtgctaccaggcactggacgggggcaatacggccgatgccctggtcgatttcacaggcggagtatcagaacccatagacctaaccgagggagactttgccaatgatgagacaaaaaggaaccagctatttgagaggatgttgaaagtgcacagcagagggggactgatctccgcttccataaaagctgtgaccgccgccgacatggaggcacgtctggcctgcggactcgttaagggacacgcctacgcagtgaccgatgtacggaaagtgaggctgggccatgggctccttgctttcttcaaaagcgagaagttggatatgatacggctccgaaatccgtggggcgaacgcgaatggaatgggccatggtcagacacgtccgaggagtggcaaaaggtgtctaaatccgagcgggagaagatgggagtcacggttcaggatgacggagagttctggatgacgttcgaagatgtgtgtagatacttcactgacattatcaagtgcagggtgattaacacgtctcatctgagcatccacaagacttgggaagaggccagactacacggtgcctggactctacacgaggaccctagacagaacagaggcgggggctgcatcaatcataaggacactttttttcagaatccgcaatacatcttcgaggtgaagaagcccgaggacgaggttttaatttgcattcagcagaggccaaagagaagtacacgccgggagggcaagggtgaaaatctggccatcggcttcgatatttacaaagttgaggagaatagacagtacaggatgcattccttgcagcacaaggcagcctcttccatttatatcaactcccgtagcgtgtttctgagaactgaccaacccgagggccggtacgttatcatacccacgacgtttgagccagggcacacaggagaattcctgctgagagtgttcactgacgtgccctctaactgtcgggagctccggctagatgagcctccacacacgtgctggtcctcactttgtggatacccccagctggttacccaagttcacgtcttaggcgctgctggattgaaagattctcctaccggagctaactcctatgtcataatcaagtgtgaaggagataaagtgcgatcagcagtgcaaaagggcacaagcacgcctgagtataacgtaaaggggatcttctacagaaagaagctaagccaacccatcaccgtacaggtgtggaaccatcgtgtccttaaagacgaatttctgggacaggtacacctaaaggccgatcccgacaacttgcaggcgctgcatactttgcatctgagggacagaaattcaaggcagccctcaaatctccctgggacagtggccgttcatatactcagttccacctccctgatggccgtgtag

SEQ ID NO: 181394 - DNA, 2043 bp, Artificial Sequence
  Description of Artificial Sequence: Synthetic coding sequence
atgagctgcaccggcacccccagctgcatctacctgctgagcgccttatccctccaggaccttgtgctggattgggaaccaaggggtgtcccacctcctctcccgggagctgcagccaccatgttttcatgcgtcaagccatatgaggatcagaattacagcgcactgcggagagattgccggagaagaaaggtgttgttcgaggacccgctgttccctgccaccgacgactccttatactacaagggaacaccggggccagctgtgagatggaagcgaccaaagggaatatgcgaggaccctcgactgttcgtggacggtatctcctctcacgatctgcatcaaggacaggtgggcaactgctggttcgtggcggcatgcagttcactggcttctcgagagtccctatggcagaaggtgatacctgattggaaggagcaggaatgggacccagagaagcctaacgcctacgcaggtatcttccatttccacttctggcgattcggggaatgggtcgatgttgtcatcgacgatcggcttccaactgttaataatcagctgatatactgccactctaattcacggaatgagttctggtgtgccctggtcgaaaaagcatacgcaaaattggccgggtgctatcaggcactagacgggggaaatactgccgatgcccttgtcgattttaccggtggtgtgtcagagccgattgatcttactgaaggtgactttgcgaacgacgagaccaagcgtaatcagctgttcgaaagaatgctcaaggtgcatagcagaggcggactgatatcagcttcgattaaggccgtgaccgccgccgatatggaagcgagactggcttgtggcctcgtgaaaggtcacgcatacgccgtgacagatgtcaggaaagttcggcttggccacggcctgctggcattcttcaaatccgagaaattggacatgattagactgcgtaatccatggggagaaagagaatggaacggcccatggagtgatacaagcgaagaatggcagaaagtgagcaagtcggaaagggagaagatgggcgttaccgtgcaggatgatggagagttctggatgacatttgaggacgtctgtcgctactttaccgacataatcaagtgtcgcgttataaatacatcgcatcttagcatccataaaacatgggaagaggcacggctgcacggtgcttggaccctgcacgaggatcctcggcagaaccggggcggaggatgcatcaaccacaaagataccttctttcagaatccacagtacatcttcgaagtgaaaaagccggaggatgaagtgctcatctgtatccagcagcgtccaaagcggtcaacccgcagggaaggaaaaggggaaaacctcgccattggcttcgatatctataaagtggaagagaacaggcaataccggatgcacagcttgcagcataaggcagcaagcagtatatacatcaactctaggtccgtatttctgagaaccgaccaaccagagggaagatatgtaattatcccaacaactttcgagcctggccatactggtgagttcctgttgcgggtcttcacggacgtcccgagcaactgtagggagctgcgactggatgaaccacctcacacatgctggtcttctctgtgtggctatcctcaattggtcacacaagttcacgtcctgggggctgccgggttaaaagacagccctacgggcgctaatagctacgtcatcattaaatgtgagggcgataaagtgaggtctgctgtccagaagggaacctctacccctgagtataacgtcaagggtatcttctatagaaaaaaattgagtcagcccatcaccgtacaggtgtggaaccacagagtgcttaaggacgagtttttgggccaggttcacctcaaagctgatccggacaacctgcaggctctgcacacattgcatctgcgagaccgcaacagcaggcagccatctaacttgccaggcaccgtcgccgtacatattctgagttccactagtctgatggctgtctag

SEQ ID NO: 181395 - DNA, 294 bp, Artificial Sequence
  Description of Artificial Sequence: Synthetic coding sequence
atgttcagctgcgtgaagccctacgaggaccagaactacagcgccctgcggcgcgattgtaggcgacgaaaagttctattcgaagacccactcttccctgctacagacgactcattgtactacaaaggtacgccgggacctgctgtacggtggaagagacctaagggcatctgtgaagaccccagactgttcgttgatgggatctccagccatgacctccaccagggacaggtgggcaattgctggttcgttgccgcttgttcctcgctggctagcagagaatcactttggtag

SEQ ID NO: 181396 - DNA, 1923 bp, Artificial Sequence
  Description of Artificial Sequence: Synthetic coding sequence
atgttcagctgcgtgaagccctacgaggaccagaactacagcgccttacggcgggactgtcgcagacgtaaggtgctcttcgaggatccactgtttcccgcaacagatgactccttgtactataagggaacgcccggtcccgcagtgaggtggaagcgcccgaaggggatctgtgaggatccaaggcttttcgtcgacggaattagctcacacgatttgcatcaaggtcaagtggggaattgctggttcgtagccgcatgctcatctcttgctagcagggaatcactgtggcaaaaggttatccccgactggaaggaacaggagtgggaccccgagaaacccaatgcctacgcaggtatctttcactttcatttttggcgcttcggcgagtgggtcgacgttgtgatagatgataggctgccgaccgtcaataatcaactaatctactgccatagcaactctagaaacgagttctggtgcgcactcgtcgagaaggcttatgcaaagctcgccggttgttaccaagccctggacggtggtaatacagcagacgctctggtagatttcacagggggagtcagcgagccgatcgaccttacagaaggggatttcgctaatgacgaaaccaaacgtaatcagctattcgagagaatgcttaaggttcactcacgcggtggcctgatatctgcatcaatcaaggcagtcacagcagcggatatggaagccagattggcctgtggtctcgtcaaaggccacgcctacgccgtgaccgatgttcggaaggtccgcctggggcatggactcttggccttttttaagagcgaaaagctcgatatgattcggctccgaaacccctggggagagagagagtggaacggcccttggtctgacacctccgaggagtggcagaaggtgtccaaatcggaacgcgagaagatgggagttacggtgcaggacgacggagaattttggatgacctttgaagatgtttgtcggtatttcacagacatcatcaagtgccgggtcattaatacttcacatctgagtattcacaaaacatgggaggaggcccgcctgcatggggcttggaccctgcatgaagacccacggcagaatagagggggggggtgtatcaaccacaaggacactttttttcagaacccacagtacatctttgaggttaaaaaaccggaagatgaggtcctcatctgtattcaacagcgacccaagaggtcgacccgcagggaaggcaaaggcgagaatctggctattggattcgatatttacaaagtcgaggagaacagacagtataggatgcactccttgcagcacaaggccgccagttcgatttacatcaatagccgatcagtgttcctgcgtaccgaccagcctgaggggcggtacgtgattatccctaccacgttcgaacccgggcacaccggtgagttcctacttcgcgtgtttaccgatgtgcccagcaactgtcgcgagctcagactggatgagcctcctcacacatgttggagctctctctgtggctacccacaactagtcacgcaggtgcatgtcctcggcgctgccggactgaaggacagtcctaccggggcaaattcatacgttattattaagtgtgagggcgacaaggtgcgaagcgcagtgcaaaaggggacctccaccccggagtacaacgtgaagggtatcttctaccggaagaaactttcgcagcccattacagttcaagtgtggaaccatcgcgtgcttaaggatgaatttctgggccaggtccatctgaaggccgaccccgataacctgcaagccctccataccctgcacctccgagatcgtaactcgcggcagccctcgaaccttccgggaaccgtagccgtgcacattttatcctctacatcgctgatggccgtatag

SEQ ID NO: 181397 - DNA, 1674 bp, Artificial Sequence
  Description of Artificial Sequence: Synthetic coding sequence
atgttcagctgcgtgaagccctacgaggaccagaactacagcgccttgcgcagggattgccgccggaggaaggttctcttcgaggacccgctgtttcccgccacagatgactccctttattacaagggcaccccggggccagcagtccggtggaagcggcctaaatatagtggccacagcctggccccacatcggccggggtggggggacgcgagaaggatggagaacgttccccgaccagggtcttcaggttgcccctcatccagcctgcgcgcacgcgatctcgggatctgtgaagaccctcgcctgttcgtcgacggcatctcctcgcacgacttgcaccaggggcaggtcggcaactgttggttcgtagcggcttgctccagcttggcttcccgcgagtctctgtggcagaaagtgattccagattggaaagaacaagaatgggatcctgaaaagcctaacgcttatgcaggaatatttcacttccatttctggcgtttcggagagtgggtcgatgtcgtgattgacgatcgcctgcccacagtcaacaaccaattgatttactgccacagtaactcgcgtaacgagttctggtgtgcgctcgtagagaaggcctatgcaaaattggccggctgttaccaggccctggacggaggtaacactgctgatgctttggtcgattttacgggcggtgtctctgagcccatcgatctgaccgagggagatttcgccaacgacgagaccaaacgaaaccagctatttgaacgtatgcttaaagtacactcacggggcggcctcatatcagcttctatcaaggcggtgaccgcagctgacatggaagccagactggcttgcgggctggttaagggacacgcgtatgcagttaccgatgtccgaaaggtgagattgggacacgggctcttagcatttttcaaatctgagaagctggacatgatccgacttaggaatccatggggagagagggaatggaacgggccgtggagcgacacctctgaggagtggcagaaggtttctaagagcgaacgcgagaagatgggggtaacggtgcaggacgatggtgagttctggatgacctttgaggacgtgtgtcgctactttaccgacattattaagtgccgggtcatcaatacaagtcatttgtcgatccataagacatgggaggaggcccgtttgcatggtgcctggacgctgcatgaggatcccaggcagaatcggggcgggggctgtattaaccacaaggatacttttttccagaacccgcagtacatattcgaggtgaagaagccagaagacgaggtgctgatctgtatacaacagagacccaagcgttcaactcgcagggagggtaaaggggagaatctagctattgggtttgatatatacaaggtggaagaaaatagacaatacagaatgcattcattgcagcacaaagcagctagttccatatatattaattcacgcagtgtgtttctcaggacagaccagcccgaaggccggtatgtgataatcccaacaaccttcgaaccaggacatacaggagaatttctgctgcgcgtttttaccgacgttccaagcaattgccgcgagctccgtcttgacgagcccccccatacctgttggtcctcactctgcgggtacccccagtggtag

SEQ ID NO: 181398 - DNA, 2442 bp, Artificial Sequence
  Description of Artificial Sequence: Synthetic coding sequence
atggacgccaccgccctggagcgggacgccgtgcagttcgcccggctggctgtgcagcgagaccacgagggtcgttatagtgaagctgtattttattacaaagaggcggcacaggccttaatttacgccgaaatggccggcagctccctggaaaatatccaggagaagattactgaatatctggaacgagtccaagcactgcactcagcagtgcaaagcaaaagcgctgatcctctgaaaagcaaacatcagctcgacctggagagagcgcacttcttagtaacccaggcattcgacgaggacgagaaggagaacgtcgaggatgcaatcgagctgtatacagaggccgttgacttgtgtttgaagacaagttatgagacagcagacaaggtactgcagaacaagttgaagcagctggctcgccaagcccttgaccgtgccgaagccctgtcagagcccctcacgaaacctgtgggcaagatttcatccacgagtgtgaagcccaagcccccccccgtcagagcccacttccccttgggggcgaacccttttctcgaacgaccccagagtttcatctcgccacaatcgtgtgacgcgcaaggtcagcgctataccgccgaggagatagaggtcttgagaacaacctctaagatcaatggcattgaatacgttcctttcatgaatgtggatctcagggagagattcgcctaccctatgccattctgtgatcggtgggggaaattaccgttaagtcccaaacagaagacgaccttcagcaagtgggtaagacccgaggaccttacaaacaatcctacaatgatctatacagtgtcatccttttctattaaacagacgattgtctccgactgcagcttcgtggctagccttgctatttcagccgcttacgaacggaggttcaacaaaaaattaatcaccggcattatttatccacagaataaagacggcgaaccagagtacaacccttgtggcaagtatatggtcaaactgcacctaaatggagtccctcgaaaagttatcatcgacgatcagttgccagtggaccacaagggcgagttgctttgttcgtactctaataacaagtctgagctttgggtgagcttaatcgaaaaggcctacatgaaagttatgggtgggtacgactttcccggttcaaattccaacatcgacctgcacgcactcacgggatggatccccgaacgtatagctatgcactcagacagtcaaactttttctaaggacaattctttcagaatgctgtatcaacggtttcacaagggggatgtgttaattaccgcatctacaggcatgatgactgaagcagagggggagaaatggggactcgtcccgactcatgcatacgccgtgctggacattagagagtttaaaggcctcagatttatccagctgaagaacccttggtctcacctgaggtggaaggggcgatactcagagaatgatgttaaaaactggactcctgagctgcaaaagtacctgaacttcgaccctagaactgcacagaagattgacaacggaatcttttggatatcgtgggacgacctctgccagtactatgacgtgatatacttaagttggaaccctggactgttcaaggaatcaacctgtatacactctacctgggatgccaaacagggacccgtcaaagacgcgtacagtctagctaacaacccacagtataagctggaggttcagtgcccacagggaggcgccgcagtctgggtcttgttgtcacggcacatcaccgacaaagacgactttgcaaacaatagggaatttattacgatggtggtctataaaaccgacgggaagaaggtgtattaccctgctgatccacccccttacatagacggcatacgcatcaactcaccacattatctgaccaagattaagctaaccacccccgggacacacaccttcactctcgtcgtttcacaatacgagaagcagaacacaatccattacactgtaagagtctattctgcctgctctttcacgttctctaaaattccatcaccttatacgttgagtaagcgcattaacggaaaatggtccggccagagcgctggcggatgtggaaactttcaggaaactcataagaataaccccatatatcagttccacatagaaaaaacagggcccctgctgatcgagttgcgaggcccccggcagtacagtgtcgggttcgaagtcgtgacagtttccaccctcggagacccgggtcctcacggatttctacgcaagtcttctggggattatagatgcggcttttgttatctggagctggagaacatcccatcagggatttttaatattattccgtcaacctttctcccaaagcaggaagggccattcttcctcgactttaatagcattatccccatcaagatcacccagcttcaatag

SEQ ID NO: 181399 - DNA, 2073 bp, Artificial Sequence
  Description of Artificial Sequence: Synthetic coding sequence
atgccctacctgtaccgggcccccggcccccaggcccaccccgtgccgaaagatgctagaattactcacagcagtggacaaagcttcgagcagatgcgtcaggagtgtcttcagcgaggtactctgtttgaggacgcagattttcccgccagcaacagtagtctgttctactcagaaaggccacagattccctttgtttggaagagaccgggtgaaattgttaaaaacccagagttcatcctgggtggagctacccggaccgatatctgtcagggtgaactgggggattgctggctccttgctgcaatcgcctctctaacattgaatcagaaagcactcgcccgcgtgattccacaggaccaaagctttggacctggatacgccggtatcttccattttcagttttggcagcatagtgaatggctggatgtggttattgacgaccggcttcccacattccgggatagactggtcttcctccattcagctgaccataacgaattttggtctgcccttctggagaaagcttacgccaagctgaacggcagctacgaagcgttgaagggtgggagtgccattgaggcaatggaagattttactggtggagtggctgagactttccagactaaagaagcacccgaaaatttttatgaaattcttgagaaggccttaaagcgaggaagtttactgggctgctttattgacactagatcagctgccgagtcggaggccagaactccattcggccttattaaaggccacgcatatagcgtaacaggcatcgaccaggtgtccttcagggggcagaggattgaattgatcagaatcaggaacccgtggggccaagtggagtggaatggatcctggagcgacagctccccggagtggaggagcgttggcccagctgagcagaagcgcctttgccacaccgccctggacgatggcgaattctggatggcattcaaggacttcaaggcgcacttcgataaggtggagatctgtaatctcactccagacgctctcgaggaggatgccattcacaaatgggaagtaacagtccaccagggctcttgggtgaggggatccaccgctggtggttgtcgcaacttcctcgacactttttggaccaacccacagattaagctgtctctgaccgaaaaggatgaaggacaggaagaatgctcttttctggtcgctcttatgcaaaaagacagaagaaagctgaagagatttggcgctaacgtgttaactataggatacgccatctacgaatgcccggataaagatgagcatctgaacaaagatttcttccggtatcacgcgagcagggcgcgttctaagactttcataaacctccgggaagtgtctgataggttcaaactgcctcccggcgaatatattctaatcccaagtaccttcgagcctcaccaggaggcagacttctgtctccggatcttcagcgagaagaaggctatcaccagggacatggacggcaacgtggacatagacctgcctgaacctcctaaaccgacgccccccgaccaggaaaccgaagaggagcagagattccgggcgttgttcgaacaggtggccggagaggacatggaagtaacagcagaggaactagaatacgtcctgaacgcagttctgcagaagaagaaggacattaaatttaaaaagttgagcctgatatcatgcaaaaatatcattagccttatggacacttccggcaacgggaaacttgagttcgatgaatttaaggtgttctgggacaagctgaagcagtggataaatctgtttttacggttcgacgctgataagagcggcactatgtctacgtacgagctgcggacagctctgaaggctgcagggttccaactgagctcgcacttacttcagctaattgtgctgagatatgccgacgaggagctgcagctcgatttcgatgatttccttaactgcttggtaagacttgagaatgcgagtcgggtttttcaggccctgagcacaaaaaataaggagtttattcacctgaacatcaacgaatttatccacctcactatgaacatctag

SEQ ID NO: 181400 - DNA, 1995 bp, Artificial Sequence
  Description of Artificial Sequence: Synthetic coding sequence
atgccctacctgtaccgggcccccggcccccaggcccaccccgtgccaaaggacgctagaattacccattcctcgggccaatcatttgagcaaatgagacaggagtgcctccagcgcggtactcttttcgaggacgctgacttccctgcctccaatagttccttattctacagcgagcgcccccagatcccttttgtatggaagcgacctggcgagatcgtcaaaaacccagagttcatattgggcggcgctacaagaaccgatatctgccagggtgaacttggcgactgctggctacttgccgccatcgcttccctcacattgaaccaaaaagcacttgcccgcgtgattcctcaagaccagtcctttggccccggatacgcaggcattttccattttcagttctggcagcattcagagtggctcgacgtggtcattgacgaccggttaccaaccttccgggataggcttgttttcttacactctgcagaccataacgagttttggagcgctctacttgagaaagcctacgccaagctaaatgggtcgtacgaggcgctgaaggggggcagtgcaatcgaggctatggaagatttcactggaggagttgcagaaacttttcaaaccaaagaagcaccagagaatttctacgagatactcgagaaggctctaaaaaggggctctttactggggtgtttcattgatactaggagcgcagcggaaagcgaggcaagaacccctttcggcttgatcaaggggcatgcatattccgtcaccggcatcgaccaggttagcttccgtggccaacggatcgagttgatccgaattaggaacccgtggggacaggtagagtggaatgggagctggagcgaccgcatggccttcaaagacttcaaggcccattttgataaagttgaaatctgcaatctcacccctgatgcactggaagaagatgccattcacaagtgggaggtgactgtgcatcaggggtcttgggtgagaggctcaactgctggaggatgcaggaattttttggacacgttttggactaatccccagatcaagctctctttaaccgaaaaggatgaagggcaggaggaatgttctttcctcgtggcccttatgcagaaggacaggcgaaaacttaagaggttcggcgcaaatgtattgactattggctacgctatctacgaatgccccgataaagacgagcatcttaataaagacttctttaggtaccatgcatcgagggcccgaagtaagacgttcatcaacctgcgggaagtatccgatcgttttaagctccctcctggagaatacatcctcattccatccacctttgagcctcatcaggaggctgacttttgcttgaggattttttccgagaagaaggcgatcactagggatatggacggtaacgtggatatagatctgccggagccccctaaaccaactccacccgaccaggagacggaagaagagcaacggtttcgcgccttgttcgaacaggtagctggcgaagacatggaggtgactgccgaggagctggagtatgttctgaacgctgtcctgcagaagaagaaagacattaaattcaagaagctcagtcttatctcctgcaaaaacattatttctctcatggatactagtggtaacgggaaactggaatttgatgagtttaaagtattctgggacaagctgaaacagtggatcaacctattcctccgcttcgatgcggacaaatctggtactatgagcacatacgaactacggacagccctaaaagccgccgggtttcagcttagctctcatctattacaactcattgtgctccgatatgcagacgaggaactgcaactcgatttcgacgactttctgaactgtttggtgcgcctggaaaatgcctccagagtgtttcaggctctaagtactaagaacaaagagttcatacacctgaacatcaacgagtttatccacttgactatgaacatctag

SEQ ID NO: 181401 - DNA, 1884 bp, Artificial Sequence
  Description of Artificial Sequence: Synthetic coding sequence
atgccctacctgtaccgggcccccggcccccaggcccaccccgtgccaaaggacgcgaggatcactcacagctcaggacagtccttcgagcagatgaggcaagaatgccttcaaagaggcacactgtttgaggacgcggacttccccgcctcaaatagctctttattttactccgagcgcccgcagattcccttcgtatggaagcgcccaggcttttggcagcacagcgagtggctggatgtcgtcatcgatgatcggttacccacgttccgggaccggcttgtctttttgcactccgccgaccataacgaattttggagtgctctgctggagaaagcatatgccaaactgaacggcagctacgaggccttgaaaggagggtctgccatcgaagccatggaagacttcactgggggagttgctgaaacattccaaaccaaggaagcccccgagaacttttacgagatactggagaaagctcttaagaggggcagcctgctcggatgctttatcgacactcgcagcgccgccgagagcgaagcccggaccccatttggcctcatcaaggggcatgcttacagcgtaaccggcatcgaccaggtgtccttccgcggacagcgcatcgagcttatcagaatacggaacccgtggggtcaggtggagtggaacggatcatggtcagattcctcaccagagtggagatcagttggccctgctgagcagaaaagactgtgccacaccgcgctagacgatggagagttctggatggccttcaaagattttaaagcgcattttgataaggtggaaatttgcaatctgactcccgacgccctcgaagaagatgcaattcacaagtgggaagtgactgtgcaccagggttcttgggttaggggatcaacagccggagggtgtcgcaattttctagacacattttggaccaaccctcaaatcaagctctccctgacggaaaaggatgaaggacaggaggagtgcagcttcctggtcgctttaatgcagaaagacagacgaaaactgaaacgctttggggcaaacgtactcaccataggttatgcaatctacgaatgtcctgacaaggacgaacatctaaataaggacttcttcagatatcacgcaagccgtgctagaagcaaaaccttcattaacctgagggaggtttctgatcggttcaagctacctccgggcgagtacatactgatcccaagcacattcgaaccacaccaggaagccgacttctgtcttcgtattttctctgaaaagaaggccatcaccagagacatggacggaaacgtcgatatcgacttgccggagccccccaaacctacacctccagaccaggaaacagaagaggaacagcggtttagagccctgttcgagcaggttgctggggaagacatggaggtgactgccgaagagctggaatatgtcctaaacgctgtgcttcagaagaaaaaagatattaagtttaagaaactaagcttaatcagttgcaaaaacatcatttccctgatggatacgtctggaaacggtaagcttgagttcgacgagtttaaggtgttctgggataaactcaaacagtggatcaaccttttcctacgatttgacgccgataaaagcggaactatgtccacatacgagcttcgtacagcactgaaagcagctggtttccaacttagtagtcacctactgcagcttatagttctccgatatgccgacgaagagctgcagcttgactttgacgattttctgaattgcctggttcgcttggagaatgcatcacgcgtattccaggccttatccaccaaaaataaggagttcattcacttaaacattaatgaatttatacacctcaccatgaacatctag

SEQ ID NO: 181402 - DNA, 807 bp, Artificial Sequence
  Description of Artificial Sequence: Synthetic coding sequence
atgttcctggtgaacagcttcctgaagggcggcggcggcggcggcgggggcggaggcggactcggggggggcctggggaatgtgctgggcggtctgattagtggtgccgggggtggcggagggggcggcgggggcggaggcggaggtggcgggggcgggggtggaggcaccgcaatgcgaattcttgggggggtgatcagtgcaattagcgaggccgcagcccaatataatcctgagccacccccccccagaactcactactccaatatcgaggccaatgaaagcgaagaggtgagacaatttcgtcggttatttgcacaactggcgggagacgacatggaggtgtccgcaaccgaactcatgaacattctcaataaggtggtgacgcgacatcctgatctcaaaactgatgggttcggaatcgacacatgtagaagcatggtcgcggtaatggactcagatacaacagggaagctgggatttgaagaatttaaatacctgtggaataatatcaagcgctggcaggccatctacaagcaatttgataccgacagaagcggtacaatctgtagttccgaactccccggggccttcgaagcagccgggttccatctgaacgagcacctgtataatatgataatccgacgatatagcgacgaaagcggcaatatggacttcgacaactttatttcctgcctcgttaggcttgacgccatgtttcgagcttttaaatccctcgataaggatgggaccgggcagatccaggtaaatatccaggagtggctgcagctaacgatgtactcgtag

SEQ ID NO: 181403 - DNA, 2061 bp, Artificial Sequence
  Description of Artificial Sequence: Synthetic coding sequence
atgaaccccaccgagaccaaggccgtgaagaccgagcccgagaagaaaagtcagtctaccaaattgagcgtggtgcacgaaaaaaaatctcaagaaggcaagccaaaagagcacacggagcctaagtctcttcccaaacaggcgagcgatacgggtagtaacgatgcacacaacaagaaagcagtgtcgcgctcagctgagcagcagccctcggagaagtcgaccgaaccaaaaactaagccacaagacatgatctctgccggcggggagagtgtggccggtattactgccatttctggaaagcccggagacaagaagaaagagaagaagagcctgacacccgcagtccctgtagagagcaaacccgataagccgtctgggaagtctggcatggatgcggctttagatgacctgatagatacactcggcggacctgaggaaaccgaggaggagaacactacatatactgggccagaagtatccgatcccatgtccagtacatatatcgaggaactggggaagcgggaggtaaccatcccccctaaatatagggagctcctggcgaaaaaagaggggattaccgggcctccagcagactccagtaaacccattgggcccgatgacgctattgatgctcttagcagcgacttcacatgcgggagccctaccgctgctgggaagaagaccgaaaaggaagagagcaccgaagtgctgaaagcacagagcgccggtactgtccgttcggccgcaccacctcaagagaaaaagcgcaaggtggaaaaggacacaatgagcgaccaagctcttgaagcactctcagcatctttgggcacccggcaggccgagccggaactcgatctgagatccatcaaagaagtggatgaggccaaagcaaaggaggagaagttagagaagtgcggagaggacgacgaaacaatcccttctgagtataggctaaagcctgccactgataaggatggaaaacccctcctccctgaacccgaggagaagccgaagcctagatctgagagcgaattgattgatgaactcagcgaagatttcgacaggagcgaatgcaaggagaaaccttctaaacctaccgaaaagactgaggaatccaaagcagcggcgccagcaccggtgagcgaagccgtgtgcagaacctccatgtgttcgattcaatctgcaccacctgagccagccacccttaaagggacggtgcccgacgacgccgtggaggcactggctgatagcctcggaaagaaggaggccgacccagaagatggaaagcccgtcatggacaaggtaaaggagaaggctaaggaggaagatagggagaaacttggcgaaaaagaggagacaatccccccagattataggctggaggaggtgaaagacaaagatggcaagccgctgctcccgaaagaaagcaaagagcagttgccccctatgtctgaagattttctcctggacgccctgtccgaggatttctcagggccacagaacgcatcttcacttaaattcgaggatgcaaagctcgccgcagcgatttcagaagtagttagtcagacaccagcaagcacgacccaggcaggcgccccgcccagagataccagccagtccgataaggacctggacgatgcactggacaagctaagtgattctttaggtcaacgccagccagatcccgatgagaacaagcccatggaggacaaagtcaaagagaaggcgaaagcagagcatagggataagctgggggaaagggatgacacgatccctcctgagtaccgccacctgctcgatgataacggccaggacaagccagtcaaaccacctactaagaagtcagaggactcgaaaaaaccggcagacgaccaagaccccatcgacgccctctccggcgaccttgactcttgcccctcgaccacagagacctctcagaacaccgctaaagataagtgtaaaaaggcggcctcgagcagtaaggctcccaagaatggaggaaaagcgaaagatagtgcaaaaactaccgaggaaaccagcaagccgaaggacgactag

SEQ ID NO: 181404 - DNA, 2271 bp, Artificial Sequence
  Description of Artificial Sequence: Synthetic coding sequence
atgagccagcccggccagaagcccgccgccagcccccggccccggagggctgcggctgcccggcgaactcacgaacatgtaagcgagaagacgtctgaaagcccctcaaagccaggtgaaaagaaaggttccgacgagaagaaggccgcgtctcttggatccagtcagagctcgcgaacatatgctggcggcaccgcttcagccacgaaagtgtcagccagtagtggtgcaacctctaaatctagttccatgaatcccactgagacaaaagccgtcaagactgagcccgagaagaaatcacagtccaccaagctatcagtcgtgcatgagaaaaaatcccaagaaggaaagcctaaggagcacacagagccgaaaagcctaccaaagcaggcaagtgataccggcagcaatgatgctcacaataagaaagccgtgagtcgttcggcggaacaacagccctctgaaaaaagcacggaacctaagactaaaccccaggacatgatcagcgcaggcggcgaaagtgtggccggcataacggctatttctgggaagcctggggacaaaaagaaagaaaagaagagtctcaccccagccgtgcccgtcgagtccaaacctgataagccctctgggaagtccggaatggatgcggccctcgatgatttgatcgataccctgggcggccctgaagagacagaagaggaaaataccacctacactggacctgaagtgtcagacccaatgtccagcacgtatattgaggagcttgggaaacgcgaagtcaccatcccccccaaatacagagagctgctggccaaaccgatcgggcccgacgacgctattgatgcactctccagtgatttcacatgtggatctcccactgcagcggggaagaaaaccgagaaagaagagtctaccgaagtgctgaaggcccaatcagcaggtacagtccggtcagcagcgcctcctcaggagaaaaaacgtaaagttgaaaaggatacaatgagcgaccaggccttagaggctttgtcggcctctttagggactaggcaagccgagcccgaattggaccttaggtcaatcaaagaggttgacgaggcaaaggccaaagaggaaaaactggaaaaatgcggcgaggatgacgagaccattccttccgagtacagactgaagccagccactgacaaagacgggaaaccactgctgccagagccagaagagaagcccaaaccgaggtctgaatctgaactaatcgacgaactttccgaagactttgatcgttctgaatgtaaggagaagccctcaaaacccacagaaaagacagaagagtctaaagctgcagccccggctccagtgtccgaagccgtttgccggaccagtatgtgcagcatccaaagcgcaccacctgagccagcaaccctaaaaggcacagtacccgatgacgctgtcgaagcactggccgacagtctcggcaaaaaggaagccgaccccgaggacggcaagccggtgatggataaggtgaaagaaaaggccaaggaagaggacagggagaagctgggcgagaaggaggaaacgattccgccagactacaggctcgaagaggtgaaggacaaggacggcaagccgctgttgccgaaagagagcaaagagcaactacctccgatgagtgaagattttttacttgatgctctctctgaagacttttctggaccccagaatgcatcctcattgaagtttgaagacgctaagctggccgccgctattagcgaggtagtgtcacagacacccgcttcaacaacacaggccggtgcaccccctagagacactagccagagcgacaaggatctggacgacgcacttgataagctgagcgacagccttggccagcgccagcccgaccccgatgagaataagcccatggaggacaaggtgaaagaaaaagctaaagcagaacaccgtgataagttgggtgaacgggatgataccatcccccctgagtatagacacttactggacgataacggccaagataaaccagtcaaaccacctaccaagaaatccgaagattccaaaaaacccgccgatgatcaagatcctatcgatgctttatctggcgaccttgactcttgcccatccactaccgaaacaagccagaacactgccaaggataaatgcaaaaaagccgcgtccagtagcaaagctcccaaaaatggaggcaaggccaaggactccgcgaagactaccgaggagacttctaaacccaaggatgactag

SEQ ID NO: 181405 - DNA, 2088 bp, Artificial Sequence
  Description of Artificial Sequence: Synthetic coding sequence
atgaaccccaccgagaccaaggccatccccgtgagccagcagatggaaggaccacacctcccaaataagaagaagcacaagaagcaggccgtgaagactgagccagagaagaagtcccagtccacgaaactcagtgtggtgcacgagaaaaagtcacaggaaggcaaacctaaggaacacacagaaccaaagtccctgcccaaacaagcctccgataccggctccaacgatgctcacaacaaaaaagctgtctccagatccgccgaacagcaacccagcgagaagtctactgaaccaaaaactaaaccacaggatatgatatccgccggtggtgaatccgttgccggcataactgcaatcagtggcaagccaggagacaaaaaaaaggagaagaaatcgttaactcctgccgtacctgtcgagtccaagcccgataaaccatccgggaagtctggaatggatgcggctctggacgatctcatagacacattaggcggcccagaggagactgaagaagagaacacaacctacacgggccccgaggtgtccgatccgatgagctcaacgtacatcgaggagctgggtaagagagaggttacgataccccccaagtaccgcgagcttctcgcaaaacctataggacccgacgacgccattgacgccttgagtagcgacttcacgtgtggcagtcctactgccgctggcaagaaaacagagaaggaggagtccacagaagtccttaaagcacagagcgccggaaccgtccgatctgctgcaccccctcaggaaaagaagagaaaggtcgagaaggacaccatgtccgatcaggctctggaagcgctttctgcctcactgggaacccggcaggcagaacctgagctcgacctccgaagtattaaagaggtggatgaagccaaagctaaggaagagaaactcgaaaaatgcggggaagacgatgagaccatcccatcggagtacaggttgaaaccagcaaccgacaaggacggaaagccactgttgccggagccggaggaaaaacctaaacctagatccgagagtgaactgatcgacgagctgagcgaggatttcgacaggtccgagtgtaaggagaagccttccaagcccaccgagaagacggaagaatccaaagccgcagcaccagccccagtgtcagaagctgtttgcaggacctccatgtgttcgatccagagtgctcccccggaacccgctaccctgaaaggaacagtgccggacgatgcagtcgaagctttggccgattcccttggcaaaaaagaagccgatccagaggatgggaaaccagtaatggataaggtcaaggaaaaggcaaaagaggaggatagggagaagctgggcgaaaaggaggagaccatcccgccggattatcgcctcgaggaagtgaaggataaagatgggaaaccactgctccctaaggagtccaaggaacaactgcctccgatgtccgaggattttctgctggacgccctgagcgaagatttcagcggcccgcagaatgcctccagtcttaagtttgaggacgccaagctggccgctgctatatcagaggtcgtcagccagacacccgccagcactacacaggcaggagcacctccgagggatacctctcaatctgataaggacctggacgatgccctggataagctttccgacagtctcggacagagacagccagacccagacgaaaacaagcccatggaagataaggtgaaggagaaagcaaaggctgaacaccgggacaaactgggggaacgcgatgacaccattcccccagaataccgccacctcttggatgacaatggtcaggataagcctgtgaaacctccgactaaaaaatccgaggatagtaaaaaacccgctgatgaccaagatcctatcgacgccctcagcggcgatctcgactcatgtccttccacaactgagactagccagaatacggctaaagataaatgcaagaaagcagcatcttcgtccaaagcgcccaagaatggtggaaaagcaaaggactccgctaagacaacagaggagacctccaagccaaaggacgactag

SEQ ID NO: 181406 - DNA, 2127 bp, Artificial Sequence
  Description of Artificial Sequence: Synthetic coding sequence
atgaaccccaccgagaccaaggccatccccgtgagccagcagatggagggcccacacctgcctaacaagaaaaagcacaagaaacaggctgtgaaaacggagccagagaagaaatctcaatccacaaagctctcagtagtgcacgaaaagaagtcccaggaagggaaaccaaaggagcacaccgaaccaaaatctcttcctaaacaggcttccgacacaggatctaacgatgctcataataagaaggctgtgagccgcagtgccgaacagcagccaagcgaaaaaagtacggaacctaagaccaaacctcaggatatgatatcagccggaggcgaatccgtggcaggcattacggcaatcagcggcaagcctggcgataaaaagaaggaaaagaaatctctgacccccgctgtgccagtggagagtaaaccggacaaacctagcggcaaaagtggaatggacgcagcgctggatgatcttatagatacactgggtgggccagaagagacagaagaggagaacacaacctataccgggcccgaggtgagtgaccccatgtccagcacgtacatagaggagttagggaagcgggaagtgacgattccccccaaatacagagagttgctggcaaagaaggagggtatcacaggtccacctgctgattcttccaaacctatcggtcccgacgatgcgatagacgccctcagcagcgactttacgtgtggcagtcctacggcggccggaaagaaaactgaaaaggaagaatctactgaagtccttaaggcacagtctgctggcaccgttcggtcagccgcacccccccaggagaagaagagaaaagtggaaaaagacactatgagtgatcaagctttagaagcactgtccgcctccctcggcacccgacaggccgagccagagttggacttgcgatctatcaaagaagtggatgaagctaaggcgaaggaagagaaactggagaagtgtggcgaggatgacgaaactattccgtcggagtatcgcctgaaacctgcaaccgacaaagatggcaagcctctcctgcccgagccggaggagaaaccaaaaccaaggtcagagtcagagctgatcgatgagctgtctgaggatttcgacagatctgagtgtaaagagaagccctcaaagcccaccgaaaagacagaagagagtaaggcggcagcccctgcgcctgtgtcagaagctgtgtgccggacatcaatgtgctctatccagtcagctcccccggagcccgccacactaaaaggcactgtgcctgacgatgccgtcgaagctcttgcagactctctgggcaaaaaggaggcagaccctgaagacgggaaaccagtgatggataaagtcaaggagaaggccaaggaggaagaccgagaaaagctcggggaaaaggaagaaaccattccgccagactacaggctggaggaagttaaagacaaagacggcaagcctttgttgccaaaggagtcaaaggaacagcttccacccatgagcgaggacttccttttggatgccttaagcgaggacttctccgggccacagaacgctagctcgctcaagttcgaggatgcaaaactcgcagctgctatctctgaggtggtctcccagacacccgcgtcaactactcaagctggggctcctcctcgggatacctcacagagcgacaaagatctcgacgacgccttagacaaactaagcgactctcttggccaacgacagcctgatcctgacgaaaacaaacccatggaggacaaggtaaaggaaaaggctaaagctgagcacagggacaagctcggagaacgggatgataccatacctcctgagtatcgtcatttgctagacgacaacggtcaagataaacccgtcaagcctcctacaaagaaatccgaagactcaaaaaagcccgccgatgaccaggaccccatagacgcactgtcgggcgatctggactcttgtccttcaactactgagacctctcagaatacagcaaaagataagtgtaaaaaagctgcttcttcctccaaggcaccaaagaacggcggcaaagccaaggattcggcgaaaaccactgaggaaaccagcaagcccaaagatgattag

SEQ ID NO: 181407 - DNA, 2319 bp, Artificial Sequence
  Description of Artificial Sequence: Synthetic coding sequence
atgagccagcccggccagaagcccgccgccagcccccggccccggcgcgctgctgccgcgcggagaactcacgagcacgtcagcgagaaaacatctgagtcacctagcaaaccgggcgagaaaaagggatccgacgagaagaaggccgcttcgctgggctccagtcagtctagccggacatacgctggcggcaccgcttcggccacaaaggtgtctgcaagtagcggggcaaccagcaagtcatctagtatgaacccaacagagacaaaagcaatcccggtgtcacagcaaatggaaggaccgcatctacctaataagaaaaaacacaaaaagcaggccgtcaagactgaacctgagaagaaatctcagtccacaaagcccaagtctcttcctaagcaggcaagcgacacaggatctaacgatgctcacaataagaaggctgtgagccgatccgcggagcaacagcccagcgagaagtccaccgaacccaagacaaagccacaagatatgatcagcgctggcggggagtcggtggctggcatcaccgccataagcgggaagccaggggacaaaaaaaaggaaaaaaagagtttgactcctgccgtgcccgtcgagtctaaacctgataagccttcagggaagtctggaatggacgcggctctggacgacctcattgacactctgggcggaccagaagagacagaggaagagaacacgacatatactggacccgaagtatctgacccaatgagcagcacgtatatcgaagagttgggcaaaagagaggttacgatcccacctaaataccgcgagctgctggctaaaaaagagggcatcacggggcctccggccgactcgagtaagccaattggccctgatgacgccatcgacgctctcagttccgatttcacttgcgggtcccccactgctgctggaaagaaaacggagaaagaagaatctacagaggttcttaaggcacagagcgctggtaccgtacgctcagctgcgcctccacaggaaaagaagcgaaaggtcgaaaaagatacgatgtctgaccaggccctggaggccctgtcggcctctttaggcacgcggcaggccgagccagagttggacctgcgatccatcaaggaagtggatgaggctaaggcgaaagaggagaaattagaaaagtgcggtgaggatgacgagaccatccccagtgagtatcgactcaaaccagcaacagacaaggatgggaagcctctgttgccggaacccgaagaaaaacccaagcccagaagcgaaagcgagcttattgacgagctgtctgaagatttcgaccggtcagagtgcaaggaaaaacctagcaaaccgacagaaaaaacagaggagagcaaagcagcggcaccagcgcccgtcagtgaggccgtgtgccgaacttccatgtgcagcatccagagcgcgccaccggaacctgctacccttaagggaactgttcctgatgacgcggtcgaagcattagctgattccttggggaaaaaggaagccgatccagaagacgggaagccggtcatggacaaggtgaaggagaaagcaaaagaagaggatagagaaaaactgggcgagaaggaggagactatcccacccgattacaggctggaagaggtgaaggacaaggatggaaaaccgttactgcctaaggaaagtaaggaacagcttccacctatgagcgaagatttcctgcttgatgcactgtccgaggactttagcggaccgcagaacgcctcaagtctgaagttcgaggacgcgaagctggccgcggctattagcgaggtggttagccaaacccctgcatctacaacacaagcaggcgcaccccctagggatacatctcaatcagataaagacttggacgatgccctggataagctatcggacagcctcgggcaacggcagcccgaccctgatgaaaacaagccaatggaggacaaggtcaaggaaaaagcaaaggccgaacaccgggacaagttgggagagcgggacgacactattccccccgagtatcggcacctgctcgacgataacggccaggacaaaccagttaagccccctaccaagaagtccgaggactctaagaaacccgccgatgatcaggatcctatcgatgcactgtctggtgacctcgattcttgcccgtcgacaacggaaacttcccagaataccgctaaggataaatgtaagaaggccgcttccagctccaaagcccccaaaaatgggggcaaggctaaagactccgctaaaaccaccgaagaaacgtctaaacctaaggacgactag

SEQ ID NO: 181408 - DNA, 2376 bp, Artificial Sequence
  Description of Artificial Sequence: Synthetic coding sequence
atgagccagcccggccagaagcccgccgccagcccccggccccggagggccgctgctgcccgccgaactcacgagcacgtgagcgagaagacatccgagagcccctctaagcccggcgaaaaaaaggggtccgacgagaaaaaagcagctagcttaggaagttcccagtccagccgcacttacgcagggggtacagcatcggcaaccaaagtttccgcttcctctggagccactagtaaaagctcatccatgaatcctactgagactaaggccatcccagtgtcccagcaaatggagggcccacacttgccaaataagaaaaaacacaagaaacaggccgttaagaccgaacccgagaaaaagtcccagagcacaaagctgtccgtggtccacgaaaaaaaatcccaagagggtaagccgaaagagcatacggaacccaaatccttacccaaacaagcttcagataccggttcgaacgacgctcacaacaaaaaggcggtctcaagatccgcagagcagcaaccttcagaaaagagcactgaacctaaaacaaagccacaggacatgatttccgcaggcggagagtccgtagccggtataactgccatcagtggtaagcccggagacaagaagaaggagaaaaagtctttaaccccggccgtccccgttgagagtaaaccggacaagccttccggcaagagcggcatggatgcagctctcgatgacctcattgacactctgggaggcccagaagagacagaggaggagaacactacatacactggcccggaagtgtccgatcccatgtcttctacatacatcgaagagctggggaagagagaggttacaatccctccaaagtaccgcgaacttctggccaagaaggagggcatcactgggcctccagctgactccagcaaaccaatcggccccgatgacgctattgatgccctctcttcagactttacatgtggtagcccaaccgccgcaggtaaaaagacggagaaggaagagtcaaccgaggttctgaaggcacagagtgccggcacagtgcgatccgctgccccccctcaggaaaaaaagagaaaggtggaaaaggatacaatgagtgaccaggccttagaagctctgtctgcgagcctcgggacccgccaggccgagcccgagttggatcttaggtccataaaggaagtcgatgaagccaaggctaaggaggagaaactcgagaaatgcggagaggatgatgagacgattccaagtgagtatagacttaaacctgccactgataaagatggaaagcctctgctgccggaaccagaggagaagcctaagccccggagtgaaagcgaactgatcgacgagttatctgaagattttgatcgctcagagtgcaaagaaaagcccagtaagcccaccgagaagacagaggaaagcaaggctgcggctccagcccccgttagcgaggccgtctgccgcacatccatgtgcagcatccaatcagcccccccagagcctgcgacactaaaagggacagttcccgacgacgccgttgaagctctggctgattcactgggcaagaaagaggctgatccagaggacggcaaacccgttatggacaaggtgaaggagaaggctaaagaagaggatcgggaaaaacttggagaaaaggaggaaactatccctccagattataggcttgaggaggtcaaagacaaagacggaaaaccactgctgccaaaagaatcaaaagagcaactccctcctatgtcagaagattttctgttggacgcactttccgaggactttagcggccctcagaacgcctccagcctgaagtttgaagacgccaaactggctgccgcaatctcagaagtggtgtcccagacgccggcctcaactacacaagcaggcgcacctcctcgggatacaagccagagtgataaagatctcgacgatgcgctcgataaactttcagacagtctgggtcagcggcaacccgaccctgatgaaaataaaccgatggaagataaagttaaggagaaagccaaagccgaacacagagataaattgggggaacgtgatgacaccatccccccagagtacaggcatctcttggacgataatgggcaggataaacccgtcaaaccgcccactaagaaaagcgaggacagcaagaagcctgccgacgaccaggaccccatagatgccctgagcggggacctggactcctgtcctagcaccacagagacaagtcaaaataccgcgaaagataaatgcaagaaagccgcttcatcctcaaaagcaccaaagaacggcgggaaggctaaggattctgccaaaacaacagaggagacttccaagcccaaggacgattag

SEQ ID NO: 181409 - DNA, 2265 bp, Artificial Sequence
  Description of Artificial Sequence: Synthetic coding sequence
atggccttcgccagctggtggtacaagacccacgtgagcgagaagacgagcgaatccccttccaagcccggcgagaagaaaggctcagatgagaagaaggctgcgagcctcggttcctctcaatcaagccgaacttacgccggcggtacggccagcgctacgaaagtttccgcttccagcggagccacatctaaatcctccagtatgaatcccactgagacaaaggccgtcaaaacagagcctgaaaaaaaaagccagtccacaaaactgagcgtagtgcacgaaaaaaagtcccaagaaggcaagcccaaagaacacacagaacccaaatccctacccaaacaggctagcgacaccgggtcaaatgatgcccataataagaaagcagtttctagatccgctgaacaacaacccagcgagaaatctactgaaccaaagacaaaaccccaagacatgatcagcgccggtggagagtctgtggccggcattactgccattagtgggaaacccggggacaaaaaaaaagagaagaagtctctgaccccggccgtaccagtcgagagcaagcccgacaagcctagtggtaagtccggcatggacgctgcccttgatgatctaatcgatactttgggagggcccgaagaaacggaggaagagaatactacgtatacaggcccagaagtcagcgatcctatgtcttcaacttacatagaagagcttggcaagagagaggtcaccattccccctaaataccgagagctcctggccaaaaaggagggcattaccgggccaccagcagactcctccaaacccatcggccccgatgatgctatcgacgcactctcctccgactttacctgtggtagtcctactgcagctgggaagaagactgagaaggaagagagtaccgaggtgctgaaggcacagagcgcgggtaccgtaagatcggcagcacccccgcaggagaaaaagcggaaagtggagaaagataccatgtccgatcaggcactcgaggctctgtcggcgagtttggggacccgacaagccgaacctgaactcgaccttaggagcatcaaagaagtggatgaggctaaggctaaagaagaaaagttggagaagtgtggagaagatgacgaaaccatacctagtgagtataggctgaagcctgcaaccgataaggatggaaaaccgctcctaccagaaccggaggagaagccaaagccccgatctgagtcggagcttatcgacgaactgtctgaagattttgatcggtccgaatgtaaggaaaagcccagcaagccaaccgagaagactgaggagagcaaggctgccgcacccgcaccagtcagcgaagccgtgtgcaggacttccatgtgttcaatacagtccgcaccgcccgagcccgccaccctgaaagggacagtgcccgatgacgctgttgaggcactggccgatagtctcggaaaaaaagaggccgatcccgaggacggcaagcccgtcatggataaagtaaaggagaaagccaaggaagaagatagggagaaactcggggaaaaggaagaaactattccccccgactatcggctggaggaggtcaaggataaagacgggaagccgctgctccctaaagagagcaaggaacagctcccgcccatgtctgaagactttttgcttgacgctctgtccgaggacttttccggtccccagaacgcttccagtctgaaatttgaagatgctaaactggctgcggcaataagcgaagtggtaagccagacaccagcctctaccacccaagcaggggctcccccccgagacacatcacagagtgacaaagacttggatgacgctttggataaactgtcggatagcctgggccagaggcagccagaccccgacgagaataaacctatggaagacaaggttaaagagaaagcaaaagccgagcatcgcgacaaactgggagagcgggatgacaccattccccctgaatacagacaccttttggacgataatggacaagacaaaccagttaagccgcctaccaagaagagcgaggactccaagaaacccgccgatgaccaagatccgatcgacgctctcagcggagacctggatagttgcccaagcacgactgagacaagccagaacaccgcgaaagacaagtgtaaaaaggcagctagcagctcaaaggctccgaagaacggtgggaaagcaaaagacagcgctaagacaaccgaggagaccagtaagccaaaagatgattag

SEQ ID NO: 181410 - DNA, 2376 bp, Artificial Sequence
  Description of Artificial Sequence: Synthetic coding sequence
atgagccagcccggccagaagcccgccgccagcccccggccccggcgcgcagctgcagctagaaggacccacgagcacgtctctgaaaaaacatctgagtctcctagcaagcccggggaaaaaaagggttctgacgagaaaaaggcggcttcgcttgggagcagccagtcttcgagaacctatgcgggcggaaccgctagtgccacaaaggtgtccgctagttctggcgctacatcaaagagtagctctatgaacccaactgagaccaaggcaatcccggtctcccagcaaatggagggtccccacctgcccaacaagaaaaagcacaagaagcaggccgtgaaaactgagcctgaaaagaagtctcagtctaccaaactttcagttgtacacgaaaagaaaagtcaggaaggcaaacctaaagagcatacagaacccaagagcctccccaaacaggccagtgacacagggtcgaatgacgcacataacaagaaagcagttagtagaagtgccgagcagcagccctcagaaaagagtactgaacctaagacgaagccgcaagatatgattagtgccgggggggaaagtgtggctggcattacagccatctcaggcaagccaggcgataagaaaaaggagaagaagagcctgactccagcagtcccagtggaaagcaagcctgataagccttctggtaaatcaggcatggatgctgctcttgatgacctgattgacactctcggaggaccagaagaaacggaagaggagaataccacatatactggtccagaggtgtctgatcccatgtccagcacatatatcgaagagctggggaagagggaggtgacaattccccccaagtaccgggagctgttagcaaaaaaggaaggcattacagggccgccggcggactcctcaaaaccaatcggcccagacgatgccatcgacgctctgagttctgattttacatgcggatcgcccaccgcggcaggaaagaagacagaaaaagaggagagcaccgaggtgctgaaagcccagtccgcggggacagtgagaagcgccgccccgccccaggagaagaagcgcaaggtagaaaaagacacaatgtccgaccaggctctggaggccctcagtgccagtcttggtacacgacaagcggagcctgagctcgacttaaggtccataaaagaggtggacgaggcaaaggcaaaggaagaaaagctcgagaagtgcggagaggacgacgaaactattccttcagaataccgcttaaaacctgcaacagataaggatggcaaaccactgctgccggaacccgaagagaagcccaagccacggtccgaatccgaattgattgacgagctgtcggaagactttgaccgcagcgagtgcaaggaaaaaccctctaaacccacggagaagacagaggaaagtaaagcagcggcacccgcccctgtttctgaagcggtttgcaggacctctatgtgttccatccagtcagctccgccagagcccgctacactcaagggtaccgtccccgatgacgctgtggaggctctagcagattccctcggcaagaaagaggccgatcccgaggacgggaaaccagtgatggataaggtgaaggagaaagctaaggaagaggaccgggaaaagttgggggagaaggaggaaacgataccacccgactaccgattagaggaagtcaaggacaaagatggtaagccccttcttcctaaggaaagcaaggagcagctgccccccatgagtgaagacttcttactcgacgccttatcagaggacttttccggaccacagaatgcatcttccctcaagtttgaggacgcaaaactcgccgccgctattagcgaggtggtgagccagacgccagcttccacgacccaagctggagcccctccacgggacactagtcagtcagacaaggatttggacgatgctctagacaaactatcggacagtctggggcagaggcagccagaccctgacgaaaataaacctatggaagataaggtcaaggagaaggctaaggcagagcacagggacaagttgggcgagcgggacgatactataccccccgagtatagacatctcctcgatgataatggccaggataaacccgtgaagcctccaacgaagaagagtgaagattctaaaaaacccgccgacgatcaggacccgatagacgctctgagtggggatctggatagctgtccatcaactacagaaacatctcagaatactgctaaggataaatgtaagaaggctgccagttcttcaaaggctcctaaaaatggcggcaaggctaaggatagcgccaaaacaacagaagaaacatccaagccaaaagacgactag

SEQ ID NO: 181411 - DNA, 1929 bp, Artificial Sequence
  Description of Artificial Sequence: Synthetic coding sequence
atgaaccccaccgagaccaaggccatccccgtgagccagcagatggagggccctcatcttccgaacaagaagaaacacaagaagcaggccgttaagaccgaacctgagaaaaaatcccaaagcactaaacttagcgttgttcacgagaaaaaatctcaggagggaaagcctaaggaacataccgagccaaaatcactccccaaacaggccagcgacaccggctccaatgacgcccacaataagaaggcggtgtcccgtagtgccgaacagcagcctagcgagaaatccactgagccaaaaaccaaacctcaagatatgataagcgcagggggcgagtcagttgccggtatcactgcaatcagcgggaaacccggagataaaaaaaaggagaaaaaaagtctgactcccgccgtgccagttgaatcaaagcccgataagccaagcggaaaaagtggcatggatgcggcactggatgaccttattgacacacttggcggtcctgaagaaacagaagaagaaaacaccacgtacaccggtcccgaggtgtccgaccctatgtcgagtacctatatagaagaactggggaaacgcgaggtcaccattccacctaagtaccgtgaattactcgccaagaaagagggcataaccggtcctcctgctgactcgtcgaaaccaatcgggcccgatgacgcgatcgacgcgctgtcgagcgacttcacatgcggttcaccgacggcagctggaaaaaaaactgagaaggaagagtcaaccgaagtcctcaaagcacagagcgcaggcacagtacgtagcgccgcaccaccacaagagaagaagcgaaaagttgagaaggatacgatgagcgaccaggcgttggaagcactctcagccagcctggggacccgacaggccgagccagagctcgacctgcgctcaatcaaggaagtggacgaggcgaaggccaaggaggaaaaattggaaaagtgcggcgaagacgatgaaactataccctcagaataccggctgaagcctgctaccgataaagatggcaagccattgctccccgagcctgaggaaaaacccaagcctcggtctgaatcggaactgattgatgagctctccgaagattttgacagaagtgaatgcaaggaaaagccttcgaagcccactgaaaaaacagaagagagtaaggccgcagctccggcacctgttagcgaagcagtgtgtagaacaagtatgtgctcaattcagagtgcccctcctgagcccgcgaccctgaagggaactgtacctgacgatgctgtggaagcactcgcagattcgttgggcaagaaggaagccgaccccgaagatggaaaacctgtaatggacaaagtgaaggaaaaggccaaggaggaggatagggaaaagctaggtgagaaggaagagaccatcccacccgattaccgcttagaggaagtgaaagacaaggacggcaagccacttctgccaaaggagtctaaggagcagctgcctcctatgagcgaagacttcttactggatgctctgagcgaggatttcagcgggcctcagaacgcgtcgagccttaaattcgaggatgcaaagctcgcggccgccatttccgaagtagtttctcagactcccgctagcaccacccaggcgggcgcaccccctcgggatacttcacagtccgataaagatttggatgacgcccttgacaagctgtcagactccctgggacaacgccagccggatcctgacgaaaataaaccaatggaggataaggtgaaggaaaaagccaaggctgagcatcgggacaagttgggggagcgcgatgataccattccacctgaatatcggcaccttctggacgataatggacaggacaagcctgtaaagccaccaacaaaaaaatctgaagactccaagtag

SEQ ID NO: 181412 - DNA, 2085 bp, Artificial Sequence
  Description of Artificial Sequence: Synthetic coding sequence
atggagggcccccacctgcccaacaagaagaagcacaagaagcaggcagtgaagactgagccagaaaaaaaaagtcaatctactaaactgtctgtggtgcacgagaaaaagtcccaggaaggaaaacccaaggagcatacagagccgaagtcccttcctaagcaggcgtccgatactggaagtaacgatgcacataacaagaaggcagtatcgagatcagccgaacagcagcccagcgaaaagagcacggaaccgaaaactaaacctcaagatatgatatccgcggggggtgaatctgtggctggaatcaccgccatctctggaaaacctggcgacaaaaaaaaggagaagaaaagtttgactccggccgtacccgtggagtcaaagccagataagccctctggtaaaagcggaatggatgccgccctggatgacctcatcgacaccctgggcggtccggaggagactgaagaagaaaacaccacatacaccggccccgaagtatccgacccaatgagctcaacctatatcgaggaactcggaaagcgcgaagttacaatcccacctaaatacagggagctcttagcaaagaaagagggcataaccggcccacccgcggacagcagtaaacctattggtccggatgatgccatcgacgctttgtcgtccgatttcacctgtggatctccgacagccgccggtaagaagactgagaaggaggagtccactgaagtcctgaaggcccagtcggccgggaccgtcaggagcgccgccccaccacaggaaaagaagcgcaaggtggagaaggacactatgtcagaccaggcccttgaggcattatcggcttccctgggaacccggcaggcagagccggaactggaccttcgctcaattaaagaggtggacgaggcgaaggccaaggaagaaaaactggagaaatgtggagaagacgatgagaccatccccagtgaataccgcctgaagcctgctaccgacaaagatgggaagccactacttcctgagccggaggaaaagcccaagccgcgaagcgaaagtgaactaatcgacgagttaagcgaggactttgaccggtcagaatgtaaagagaagccgtcaaagcccacagaaaaaaccgaagagagtaaggccgcagcccctgctcccgtcagcgaggcggtatgccggaccagtatgtgtagcatacagtccgctcccccagagccggctaccctgaaaggcacagtccctgatgacgccgttgaggccctggccgactcactcggcaaaaaggaggccgaccccgaggatggaaagcccgtgatggacaaggtcaaggagaaggccaaggaggaagatagggaaaaacttggtgagaaagaggagacgattccccccgattaccgactggaagaagttaaagataaggacggcaagccgctgctgccaaaggaatccaaggaacagcttccccccatgtccgaggattttcttctcgatgctctgtccgaagacttttcaggtccacagaatgccagctctctcaaatttgaggatgccaagttagctgcggctatttcagaagtggtgtcccagacgcccgcttctacaactcaggccggggcgcccccccgggacacttcacagtcagacaaggacctggacgatgcattagataaactgagcgactccctcggccagcggcagcccgaccctgatgaaaataagcccatggaggataaggtcaaggaaaaagcgaaggccgaacatcgagacaagctcggagaaagggacgacactataccccccgagtaccggcatctgctggacgacaacggccaagataagccagtgaaaccccccacaaagaaatccgaagacagtaaaaagcccgccgacgaccaggatccaatcgacgcgctctctggcgatctcgacagctgcccttcaaccaccgaaacttcacagaacacagctaaagataaatgtaaaaaggctgcctcctctagcaaggcgccgaaaaacggcggtaaggccaaggatagtgccaaaactaccgaggaaacctctaaacccaaggacgattag

SEQ ID NO: 181413 - DNA, 2253 bp, Artificial Sequence
  Description of Artificial Sequence: Synthetic coding sequence
atgagccagcccggccagaagcccgccgccagcccccggccccggcgagccgcagcggctagaaggactcacgaacacgtcagtgagaagacttcggagtctcccagcaagcccggtgagaaaaaaggcagcgatgaaaaaaaagcagcgtctctaggaagtagtcagagcagtcggacctacgcagggggtacagcatcagccactaaagtgagtgcctcatccggcgccacctctaagtctagttcaatgaatcccacagagacaaaagccgttaagacggagcccgagaaaaagagccagtcaaccaagcccaagtcgcttccgaagcaggcttccgatactggaagcaacgacgcacataataaaaaagcggtgagcagatctgccgaacagcaacctagcgagaagtctaccgaacccaaaaccaaacctcaagacatgatctccgccgggggagagtccgtggctgggatcacagctatctccggaaaacctggagacaagaagaaggagaagaagagcctgacacccgcagtgcctgtcgagagcaaaccagataaaccctccggaaaatctgggatggacgcagctctggatgatctgattgacacacttggggggcctgaggagacagaggaggaaaatacaacttacacagggcccgaagtttctgatcccatgagcagcacctatatcgaggagcttggtaagcgggaggtgactattcctcccaagtacagggaactgctcgctaagaaagaggggatcacaggaccgccagctgattcctccaaacccataggacctgacgacgctattgacgctctaagcagcgatttcacttgcggctcccctaccgccgctggaaaaaagactgaaaaggaggagagcactgaggtgctaaaggcccagagcgcgggcacagtgaggagtgccgcccctcctcaggagaagaaaagaaaagtggagaaagatacaatgtcggaccaggctctggaagcgctgtccgcttccctggggacgaggcaagccgagccagagctggaccttcggagcatcaaagaggtggatgaggccaaggcgaaggaagagaagttggagaagtgcggcgaggacgatgagactattccatctgaatataggttgaaacccgcaaccgacaaagatggtaaacctctattgccagagccggaggaaaaacctaaaccccggtctgaaagtgaactgatcgacgagctcagtgaagattttgatcgaagcgagtgcaaggagaagccctctaaacctaccgagaagacagaggagagtaaagcagccgcaccggcgcctgtatcagaggccgtttgcagaacatcaatgtgcagtattcaaagcgctccccccgaacctgcaaccctgaagggcactgtccccgacgatgccgttgaggccctggctgactcactgggcaaaaaggaggcagatcccgaggacggcaaaccggtgatggacaaggttaaggagaaagctaaggaagaggatagagagaagttaggagaaaaagaggaaactatcccgcccgattaccgcctagaggaagtaaaggataaggatgggaaacctctcctgcccaaggaaagcaaagagcagctgccccctatgtctgaggattttttgctggatgctctgtccgaagatttcagcggcccccagaatgcatcttcacttaagttcgaggatgcgaaattagctgcagccatctcagaggtcgtgagtcagactcctgcgagcacaacccaagctggagctccgcctagggacacatcccagtccgacaaagacctagacgatgcattagacaaattgagcgacagtctgggccaaagacaacccgatcccgacgaaaacaaaccaatggaggacaaagttaaggaaaaggccaaggctgagcaccgcgacaaattgggcgagcgggatgatactataccgcccgaataccgccaccttcttgacgacaatggccaggacaaacctgtgaagccgcccactaagaaaagcgaggactcgaagaaacctgccgacgaccaagaccctatagatgccctgtctggcgatctggacagctgcccttctaccactgagacttctcagaataccgctaaggacaaatgtaagaaagctgcttcctctagcaaggccccaaaaaacggcggaaaggccaaagattcggccaaaaccactgaggaaacatccaagcctaaagatgattag

SEQ ID NO: 181414 - DNA, 1254 bp, Artificial Sequence
  Description of Artificial Sequence: Synthetic coding sequence
atgctgctgagcgtgcccctgctgctgggcctgctgggcctggccgtcgccgaaccagccgtctattttaaggagcagttcctggacggcgatgggtggacttctcgctggatagaatctaagcataaatcagacttcggaaagttcgtcctgtcctcaggcaaattttatggcgatgaagaaaaagacaagggtctccagacatcacaagatgcacggttctatgccctgagcgcatcgtttgagccattttctaacaaaggccagaccttagtggttcaattcacagttaagcacgagcagaatatagactgtggcggaggctacgtgaaactgttccccaactcactagaccagacagatatgcacggggatagcgagtataacattatgtttggcccggatatttgcggacccggcaccaaaaaagtgcacgttatcttcaactacaaaggcaaaaacgtgctgataaataaggatatccgctgtaaggacgacgagtttacacatttatacactttgatcgttcggccagacaatacctacgaggtcaagatcgataattcacaagtggaatcgggctccctagaggacgactgggattttctgccgccaaagaagattaaggatccagacgcctcaaaaccagaagactgggacgagcgcgctaagatcgatgatccaaccgattccaaacctgaggattgggataagcccgaacacattcccgatcctgacgcaaaaaagccagaagattgggacgaggaaatggatggcgagtgggaaccccccgtcatccaaaatcccgagtacaagggagagtggaaacccagacagatcgacaaccctgactataaaggcacttggatacaccccgagatcgataaccccgagtattcccccgacccctccatttacgcctacgacaactttggtgtgctcggcttagatttgtggcaggtcaaatcaggcacaattttcgacaactttcttattaccaacgatgaggcctacgcagaagaattcggaaacgagacttggggtgtaaccaaggccgcagaaaagcagatgaaagacaagcaggacgaagagcaacggttgaaggaggaggaggaggataagaagcggaaagaggaagaggaagcggaggataaagaggatgacgaagacaaggatgaggacgaggaagatgaagaggataaggaggaagacgaagaagaggacgtgcctggccaagccaaagacgagctttag

SEQ ID NO: 181415 - DNA, 891 bp, Artificial Sequence
  Description of Artificial Sequence: Synthetic coding sequence
atgcacggcgacagcgagtacaacatcatgttcggccccgacatctgtggtccaggtactaaaaaggtacatgtgattttcaattacaagggcaaaaatgtactgattaataaggatatccgctgtaaagatgatgaattcacccatttgtatacactgatcgtccgtcccgataatacctacgaagtcaaaattgataattctcaggtggagtcaggctctctggaggacgactgggacttccttcccccgaagaagatcaaggatcctgatgcttccaagcccgaggactgggacgaaagagccaagattgacgatccaactgacagtaaaccagaggattgggataaaccagagcacatccctgaccctgacgctaaaaaacctgaggactgggatgaagagatggacggcgaatgggagccccccgtaattcagaaccctgagtacaagggagaatggaagcctagacagatcgacaacccagattataagggcacgtggatccatccggagatcgacaaccctgagtattccccagaccccagcatctacgcatatgataattttggcgtgttaggacttgacctctggcaggtcaaatccggcacaatattcgataacttcctaattactaatgacgaagcatatgccgaggagtttggaaatgaaacatggggggttactaaggccgctgagaaacaaatgaaagataaacaggatgaggagcagcgtcttaaggaggaggaagaagacaaaaaacgtaaggaagaggaggaggcggaagacaaggaggacgatgaggataaggacgaggacgaggaggacgaagaggacaaagaagaagatgaggaggaggatgtccccggacaggccaaggacgaattatag

SEQ ID NO: 181416 - DNA, 1155 bp, Artificial Sequence
  Description of Artificial Sequence: Synthetic coding sequence
atggcccgggccctggtgcagctgtgggccatctgcatgctgcgggtcgcgctggcaacggtctattttcaggaggagttcctggacggggaacattggcgtaatcgctggctgcagagcaccaacgactcccggtttgggcactttagactctccagcggcaagttctacggtcacaaagagaaagacaagggccttcagaccacacagaatggtaggttctacgccattagcgctcggtttaagcctttttctaataaggggaaaaccttggtaatccagtataccgtgaaacacgaacagaagatggattgtggaggcggctacattaaagttttccccgcggacatagaccagaagaatctgaatggaaagtctcaatactatatcatgttcgggccagatatatgcggttttgatattaaaaaggtgcatgtgatattacacttcaagaacaaataccatgagaataagaagctgatacgctgtaaggttgatggttttactcatctgtacacactaatcctcaggccagacctgtcatacgatgtaaagatcgatggccagtcaatcgagagcggtagtatcgagtatgattggaatctcacctctcttaagaaggagacatctccagctgagtcaaaagactgggaacagacaaaagacaataaggcgcaggattgggagaaacattttttggacgcctcaacctcgaaacagtctgattggaatggagatcttgacggggattggcccgcccctatgctgcagaagcccccttaccaagacggtcttaagcccgaaggaatccacaaagacgtctggttacacagaaaaatgaagaacaccgattatctgacccaatatgacctgtctgagtttgaaaacatcggagccatcggactcgagctttggcaggtgcggagtggcaccatctttgacaattttctcattaccgatgatgaagaatacgctgacaatttcggcaaagcaacctggggagagacaaaggggccggaaagggaaatggatgcaatccaggcgaaggaggaaatgaagaaggcccgggaagaggaggaggaggagctgcttagcgggaaaatcaacaggcatgaacactacttcaatcaattccaccggagaaatgagctgtag

SEQ ID NO: 181417 - DNA, 1191 bp, Artificial Sequence
  Description of Artificial Sequence: Synthetic coding sequence
atgagcgccaccgaccggatgggcccccgggccgtgcccggcctgcggctggccttactgctgctcctcgttcttgggactcctaagtccggagtccagggccaggaaggcctagattttcccgagtacgatggggtggatcgtgtgattaacgtcaacgccaaaaactataagaatgtgtttaaaaagtacgaggtcttagcgctcctttaccacgaacctcccgaagacgacaaggcttcgcaaagacaatttgaaatggaagaactcattctagaacttgctgcccaggtcctagaggacaagggagtgggcttcgggttggtcgactcagaaaaagatgcggcagtggctaagaagctcggcctaactgaagttgactccatgtatgttttcaagggagatgaggtaatagagtacgatggagagttctcagccgacacaattgtggaatttcttctggatgtgcttgaggacccggttgaacttatcgagggcgagcgcgaactgcaagccttcgaaaacattgaagacgaaatcaagctcatcggttatttcaaaagcaaggactccgaacattataaagccttcgaagatgcggccgaagaatttcatccctatattccattttttgcaacctttgattccaaggtggcgaagaaattgacactgaagctcaatgagatcgacttctacgaagcctttatggaagaaccagtaaccattccagacaagcctaattcggaagaagaaatcgtcaattttgtggaggagcaccggaggtctacactaagaaaattgaagcccgagtccatgtacgagacgtgggaagacgatatggatggtatccacatcgtcgcctttgctgaggaggctgatcccgatggtttcgagttcttagaaacgcttaaggcagtggcacaggataacaccgaaaaccctgatctgagcatcatctggattgacccagacgattttcctcttctcgtgccttactgggagaaaactttcgacattgatttatctgctccacagatcggagtcgttaatgtgactgacgctgacagcgtctggatggagatggatgacgaggaggacctcccaagcgctgaagagctggaagactggttagaggatgtgctcgagggagagatcaatacagaggacgacgatgatgatgatgatgactag

SEQ ID NO: 181418 - DNA, 1173 bp, Artificial Sequence
  Description of Artificial Sequence: Synthetic coding sequence
atgggcccccgggccgtgcccggcctgcggctggccctgctgctgctgctggtgttagggaccccaaagagtggagtgcagggccaggagggcctggatttcccagagtacgacggcgtggaccgagtaatcaatgtgaatgccaaaaactataagaacgtgtttaaaaaatacgaagttctcgctctactgtaccacgagccgcctgaggatgataaagcatctcagagacagttcgagatggaagagttaatcctggagctggctgcacaggtactcgaggacaaaggagtggggtttggcttagtggactctgaaaaggacgcagctgtggcgaaaaaactggggctgaccgaggttgactcaatgtacgtgttcaagggggacgaagtaatcgagtatgacggcgagttttcagctgatactatcgtagaatttctgctggacgttctggaggaccctgtggagcttatcgagggtgaacgggagcttcaggctttcgagaatattgaggacgagataaagctcattgggtatttcaagagtaaggacagcgaacactataaggcattcgaagacgctgcagaagaattccatccgtacattccattcttcgcaaccttcgatagcaaggtcgctaagaagctgacgctgaagctcaacgagatcgatttttacgaggcatttatggaagagcccgtgaccatccctgacaagcctaacagcgaagaagagatcgtgaacttcgtggaagagcatagacgatctacgctgagaaagctgaagcctgagtctatgtatgagacatgggaggacgacatggatgggatacatattgtggccttcgcagaagaagccgatccagacggttttgagttcctggaaaccctcaaggcagtcgctcaggacaatacggagaatcccgacttatccataatatggatcgatcccgacgattttcctctgttggtcccatattgggaaaaaacattcgatatcgatctatctgccccgcagattggcgtggtgaacgtgaccgatgcggactctgtctggatggaaatggatgatgaggaagacctgccttccgccgaagagctggaagactggctggaagacgtgctagagggagagattaatacagaagacgacgatgatgatgacgacgattag

SEQ ID NO: 181419 - DNA, 936 bp, Artificial Sequence
  Description of Artificial Sequence: Synthetic coding sequence
atgagcatgcagcggaccacccggatgtgcagccggagcatgcggtgctggcactcatctacgatgaacccacctcggatgaccagacctcacaaggacaacagcctgggattgacagaggtcgatagcatgtacgtgttcaagggcgatgaggttattgagtacgatggtgagtttagcgccgataccatagtggagtttctcctcgatgtactggaggatccagtcgagttgatagagggcgaaagagagctgcaggcatttgagaatatcgaagatgagataaagttgatcgggtactttaagtccaaagactcagaacactacaaagcctttgaggacgctgccgaggaattccatccatatattccgttctttgccacttttgattctaaagtggcgaagaagctgaccctgaagttgaatgagatagatttctacgaggctttcatggaggagcccgtgaccatccccgataaacccaattctgaggaggagattgtaaactttgtagaggagcacagacgatcaaccctcagaaaactcaagcccgagtcaatgtatgagacgtgggaggacgacatggacggtattcatatcgtcgccttcgctgaagaggccgaccctgacggctttgaattcctagaaactctaaaggcagttgcgcaagataacacggaaaacccagacctgtctataatctggatcgacccggacgactttcccctgcttgttccctactgggagaagacattcgacatcgatctgagcgcccctcagatcggggtggtaaacgttactgacgcggattctgtttggatggaaatggacgatgaggaggatctgccttctgcagaagagcttgaggactggctggaggatgtgctggagggcgaaattaacaccgaagatgacgatgatgacgatgacgattag

SEQ ID NO: 181420 - DNA, 1200 bp, Artificial Sequence
  Description of Artificial Sequence: Synthetic coding sequence
atgaagcggacccacctgttcatcgtgggcatctacttcctgagcagctgtcgggctgaagagggactcaattttccaacctatgacgggaaagaccgtgtcgtctctctctctgagaagaacttcaaacaggttcttaaaaagtatgatctgttgtgtctgtactaccatgaacccgtatctagcgacaaggtgacacagaagcagtttcaactaaaggagattgttctagagttagtagctcaggtactggagcacaaagcaatcgggtttgtgatggtggacgctaagaaggaagccaagctggctaaaaagttgggttttgatgaggaaggctcgctctatatcctgaaaggcgaccggaccattgagttcgacggcgaattcgccgctgatgttctagtggaattcctcctggacctgattgaggaccccgtggaaattatctcctccaaactcgaagtccaagcctttgagagaatagaggactacatcaagttgataggtttttttaagagcgaggactcagaatactacaaagccttcgaagaggcagcagaacatttccagccatacattaagttcttcgcaacattcgacaaaggggttgctaaaaaattgtcacttaagatgaacgaggtggacttttatgagcctttcatggatgagcccatcgcaatccctaataagccctatacagaggaggagttggtggagtttgtaaaggagcaccaacgcccgacactgaggcggctgcgcccagaggaaatgtttgaaacctgggaagacgatcttaatggcatccacatcgtggctttcgccgaaaaatcagatcccgatgggtacgagtttctagagattctcaagcaggttgcacgcgacaatacagacaaccctgatctttccatcctgtggatcgacccagacgattttccgctgctggtggcctactgggagaagacgttcaagatcgacctgtttagacctcagattggagttgttaacgtcactgatgctgatagcgtctggatggagattcctgatgacgacgacttgccaacggctgaagagcttgaggattggatcgaagacgtgctgagcggaaaaatcaatacggaggacgacgatgaggatgatgacgatgatgacaatagcgatgaggaggacaacgacgacagtgatgatgacgacgatgagtag

SEQ ID NO: 181421 - DNA, 1062 bp, Artificial Sequence
  Description of Artificial Sequence: Synthetic coding sequence
atgaagcggacccacctgttcatcgtgggcatctacttcctgagctcatgtagggcagaggaaggactgaacttccccacatatgacggaaaggacagggtggtctctctcagcgagaagaattttaagcaggtgcttaaaaaatatgacttgctctgtctctattatcacgaaccagtcagctccgataaagtgacccagaaacaatttcagctgaaagagattgttctagagcttgtagcacaggtgctcgagcacaaggcaattggttttgtgatggtggatgctaagaaagaagctaagctggcaaagaagctggggttcgatgaggaagggtctctgtatatcctaaagggggaccggactattgagtttgatggagagtttgccgccgacgtgctggttgagttcctactggatctgatcgaagacccagttgagataatttcttccaaactggaggtccaggcgttcgaacgtatcgaggactacataaagcttatcggcttttttaagagcgaggacagcgagtattataaagcattcgaagaggcagcagaacacttccagccttacatcaagttctttgctacattcgacaagggagttgcaaagaaactgagccttaaaatgaatgaggtggatttttacgaaccgttcatggacgagccaatagccattcccaacaaaccctatacagatggttatgagtttcttgagattctgaaacaggttgctagagataacaccgataatcccgatttaagtatactgtggattgaccctgacgattttcctctgttggtcgcctactgggaaaagaccttcaaaattgacctgttcaggccccagataggtgtcgtgaatgtgaccgacgccgatagcgtgtggatggagatcccagacgatgatgatttgccgacggcagaggaactcgaagactggatagaagacgtgctcagcgggaagattaataccgaagatgatgatgaggatgatgacgatgacgataacagcgacgaagaggataacgatgactcggacgatgacgacgacgagtag

SEQ ID NO: 181422 - DNA, 987 bp, Artificial Sequence
  Description of Artificial Sequence: Synthetic coding sequence
atgaagcggacccacctgttcatcgtgggcatctacttcctgagctcctgccgggccgaggaagggctgaattttcctacatatgacggcaaagatcgcgtggtgtctctttcagaaaagaatttcaagcaggtcctcaagaaatatgacttgctgtgtttatactatcacgaacctgttagctctgataaggtgacgcagaagcaatttcaattaaaggaaattgttctggaattggttgcacaggtacttgaacataaggccattggatttgtgatggtggatgcaaaaaaggaggctaaattggccaagaagcttgactataaagcgtttgaggaagcggcagaacactttcaaccctacataaaattttttgctaccttcgacaagggggtggctaaaaaactatcgctgaagatgaatgaggtggacttttacgagccctttatggacgaacccatcgctatcccaaataaaccttataccgaggaggagctggtggagtttgtgaaagaacatcagagacctaccctgcgacgccttagacccgaggagatgtttgagacttgggaggatgatctgaacggaattcatattgtggcctttgccgagaagtctgaccctgatggttatgaattcctcgagatccttaagcaggtcgctagggacaacactgacaaccccgacttgtcaatactctggattgacccggacgacttccccctgctcgtagcttattgggagaagaccttcaagattgacttattcaggccacaaatcggcgtggtgaatgtaactgatgctgacagcgtatggatggaaattcccgacgatgatgatttgcccacagccgaagaattggaggattggattgaagacgtgctgagcggaaagatcaatactgaagatgacgatgaggacgacgacgacgacgataactcagacgaagaagataacgatgattcagatgatgatgatgatgaatag

SEQ ID NO: 181423 - DNA, 948 bp, Artificial Sequence
  Description of Artificial Sequence: Synthetic coding sequence
atggacctgcggcagttcctgatgtgcctgagcctgtgcaccgcctttgccctctccaagccaaccgagaagaaagatcgcgttcaccacgagcctcaactgagtgataaggtgcataatgacgcacagagtttcgattacgaccacgatgcgttcctcggcgccgaagaggctaaaaccttcgaccagctgacaccggaggagagcaaagaaagattagggaagattgttagcaaaatcgacggggacaaggatggttttgtaacggtagacgagctcaaagactggattaagtttgctcagaagaggtggatttatgaggacgtcgagcggcagtggaagggtcacgacctgaatgaagatggactggttagctgggaggagtacaaaaacgcgacatacggatatgtgctggatgatcctgaccccgacgatggtttcaattacaagcagatgatggtaagggacgagagacgctttaagatggctgacaaagatggagacctcattgccaccaaagaagagttcacagcattcttgcaccccgaagaatatgactacatgaaggacattgtggttcaagagactatggaggacattgataaaaacgcagacgggtttatcgaccttgaggagtatataggcgatatgtactctcacgacggaaatacagacgaacccgagtgggtcaaaactgagcgagagcaattcgtggagtttcgagataaaaacagggatggcaagatggacaaggaagagaccaaggattggatcctgcccagcgactacgatcacgcagaggctgaggcgcggcacctggtgtacgaatccgatcagaataaagacggcaaattgaccaaggaggagatcgttgacaagtatgacctctttgtggggagtcaggccacagattttggggaggcactagtcaggcatgacgaattctag

SEQ ID NO: 181424 - DNA, 465 bp, Artificial Sequence
  Description of Artificial Sequence: Synthetic coding sequence
atggacctgcggcagttcctgatgtgcctgagcctgtgcaccgccttcgctctgtccaagcctaccgaaaagaaggatcgagtgcatcacgagccacaactgtcggacaaggtccacaatgatgcccaaagtttcgactatgaccacgatgccttcctcggcgccgaagaggccaaaaccttcgaccagctgaccccagaggagtccaaagaaagattgggtaagatcgtgtccaagatagacggagacaaggatggcttcgtgactgtcgatgagctgaaggactggattttgccaagtgactacgatcatgctgaggctgaagccaggcaccttgtttacgaaagcgatcagaataaagatggaaaactgaccaaggaagaaatcgtcgacaaatacgatctatttgtggggtctcaagccacggacttcggagaagctctcgtcagacacgacgagttctag

SEQ ID NO: 181425 - DNA, 948 bp, Artificial Sequence
  Description of Artificial Sequence: Synthetic coding sequence
atggacctgcggcagttcctgatgtgcctgagcctgtgcaccgccttcgctctgagtaagcctacagaaaaaaaggatcgagtccatcacgagccccagctgtccgataaagtgcacaatgacgctcaatctttcgattatgaccacgacgcatttttaggcgctgaggaagccaagaccttcgatcagcttaccccggaggaatccaaggagagactcggcatgatcgtggacaagatcgatgcagataaggacggatttgtgaccgaaggagaacttaagagctggatcaagcacgcacagaagaagtatatctacgataatgtggagaatcagtggcaagagtttgatatgaaccaagacggattaatcagttgggatgagtacaggaatgtcacttacggcacctacctagacgatcctgacccggacgacggtttcaattataagcagatgatggtacgcgatgagcggcggtttaaaatggcagataaggatggtgatctgattgcaaccaaggaagaatttactgcctttctacacccggaggaatatgactatatgaaggacattgtcgtgcaggagaccatggaggatattgataaaaatgcggacggctttattgatctggaagaatatatcggcgatatgtatagtcatgacggcaacactgacgaaccagaatgggttaagacggagcgcgagcagttcgtcgaattcagagataagaaccgagacggcaagatggacaaagaagagaccaaggactggatcctgccttctgattatgaccacgctgaagccgaggctagacaccttgtctatgagtcagaccaaaataaagacggcaaattgaccaaagaggagatagtggacaaatacgatctctttgtgggatcacaggcgactgatttcggagaggctctcgttcgtcacgatgaattctag

SEQ ID NO: 181426 - DNA, 972 bp, Artificial Sequence
  Description of Artificial Sequence: Synthetic coding sequence
atgaaggagaccgacctgatcatcatggacctgcggcagttcctgatgtgtctttcattgtgcacagcttttgcattgtctaaacctacggaaaagaaggaccgggtgcaccacgagccccagctctcggataaagtgcacaatgatgcgcaaagtttcgattatgatcatgacgcctttctgggggccgaggaagccaagactttcgatcaactgacccccgaagaaagcaaggagagactcgggaaaatagtcagcaagatagacggtgacaaggacggcttcgtcaccgtggacgaactgaaggactggataaagttcgcccagaagagatggatttacgaagacgttgagcgacagtggaaaggtcatgatctaaatgaggacggactggtgagctgggaggagtacaagaacgccacgtacggttacgtcttggacgaccccgatccagacgatgggttcaattacaagcagatgatggttcgggatgaacggaggtttaaaatggccgataaagacggggacttaatcgctacgaaagaagagttcacagcctttctccaccccgaggaatatgactatatgaaagatatagtggttcaggagacaatggaagacatcgataaaaacgccgacggcttcattgacctagaagagtacataggggatatgtatagccatgatggcaatacagatgagccagagtgggtcaaaaccgagcgagagcagttcgttgagttccgggataaaaaccgcgacggcaagatggataaagaagagaccaaggactggattctgcctagcgattatgatcatgccgaggcagaagctcggcacctggtatacgagtcagatcagaacaaggacggcaaactgacaaaggaggagattgtggacaagtacgatttgttcgtgggaagccaggcaaccgatttcggagaggccctcgtgcgccacgatgagttttag

SEQ ID NO: 181427 - DNA, 444 bp, Artificial Sequence
  Description of Artificial Sequence: Synthetic coding sequence
tgaatcgccaccaaggaggagttcaccgccttcctgcaccccgaggagtacgactacatgaaggatattgtagttcaggagaccatggaggatattgataagaatgctgacggcttcatcgatctggaggagtatatcggcgacatgtacagtcacgatgggaatactgacgagccagagtgggttaaaacagaacgagagcagttcgtcgagtttagagacaagaatcgggacggaaagatggacaaggaagagaccaaggactggatcctgccatcagactatgaccacgcagaagcagaagcacgccacttggtgtacgagtcagaccagaacaaggacggtaaactcacgaaagaggaaatcgtggataagtatgatttgttcgtagggagccaggcaaccgatttcggtgaggcccttgtgcggcatgacgagttttag

SEQ ID NO: 181428 - DNA, 675 bp, Artificial Sequence
  Description of Artificial Sequence: Synthetic coding sequence
atggacctgcggcagttcctgatgtgcctgagcctgtgcaccgccttcgcgctgtccaagccaactgaaaaaaaggaccgcgtccatcacgagccccagttgtccgacaaggtccacaatgatgcccaatcctttgattatgatcacgatgcatttctgggggctgaggaagctaaaacgttcgatcagctgactcccgaggaaagtaaagaacgcttgggcaagatagtgagcaaaatcgatggagataaggacggcttcgttaccgttgacgaacttaaggattggattaagtttgcacaaaaacggtggatttacgaggatgtcgagaggcagtggaagggccatgacttgaacgaggatggactggtctcttgggaggagtataagaatgccacctatggatacgtgctggatgatcccgaccctgatgatggcttcaattataagcaaatgatggtgcgggatgagcgaagattcaagatggcagacaaggacggcgacctgattgcaaccaaagaggaatttactgccttcctccacccggaagaatacgattatatgaaagatatcgtggtccaggaaactatggaagatattgacaaaaacgccgacgggtttatagacttggaggagtacataggatggcaggcctatcagggaggagacagatag

SEQ ID NO: 181429 - DNA, 444 bp, Artificial Sequence
  Description of Artificial Sequence: Synthetic coding sequence
atgaaggagaccgacctgatcatcatggacctgcggcagttcctgatgtgtctgtcactttgtacagcctttgctcttagcaagccaacagagaaaaaagatcgagtgcaccatgaacctcaactgagcgacaaagtgcataatgacgctcagagctttgactacgatcatgatgccttcttgggcgctgaagaggccaaaaccttcgatcaattaacccccgaggaatccaaggagcgtctcggtaagatcgtaagcaagatcgacggggataaggacggtttcgtgacggtcgatgagctgaaagactggattaaatttgcacagaaaagatggatatacgaggatgtcgagcgccagtggaagggccatgatctgaatgaagacggcctcgtgtcctgggaggagtacaagaatgctacctacgggtatgtgcttgaatag

SEQ ID NO: 181430 - DNA, 513 bp, Artificial Sequence
  Description of Artificial Sequence: Synthetic coding sequence
atggacctgcggcagttcctgatgtgcctgagcctgtgcaccgcctttgcactgagtaaaccaactgagaagaaagacagagtgcatcatgaacctcagttgagtgacaaagtacataatgacgcgcagtctttcgactacgaccacgatgcatttttgggagctgaggaggccaagacttttgaccagttgactccagaagagtctaaagagcggctggggatgatcgtggacaaaattgacgccgataaggatggctttgtgactgagggagagctgaagtcctggatcaagcatgctcaaaagaaatacatatacgacaacgtggaaaaccagtggcaagaatttgatatgaaccaggacggccttatatcctgggatgagtacagaaatgttacgtatggtacgtatctggacgatccagaccctgacgatggcttcaattataagcaaatgatggttagagatgaacggcgcttcaaaatggccgacagagctcgcgcagtttgctag

SEQ ID NO: 181431 - DNA, 606 bp, Artificial Sequence
  Description of Artificial Sequence: Synthetic coding sequence
atggacctgcggcagttcctgatgtgcctgagcctgtgcaccgccttcgcactctcaaaaccaaccgagaaaaaagacagagttcaccacgagccacagctcagcgataaggtccacaacgatgcccagtcctttgactatgaccatgacgctttcctgggcgccgaggaggcgaagaccttcgaccagttgaccccagaagagtccaaagaaaggctgggcatgattgtcgataaaattgatgcggataaggatggctttgttacagaaggcgagctcaagagttggatcaaacatgctcagaaaaaatacatctacgacaacgtggaaaaccagtggcaggaatttgacatgaaccaggatgggctgattagctgggatgagtatcggaacgtgacctatgggacttatttagacgatccggacccagatgatggatttaattacaaacagatgatggtcagggatgagcggcggttcaagatggcagataaggatggcgacctgattgcaacaaaagaagagatagtcgataagtacgatctcttcgttggtagtcaggcaaccgatttcggggaagcgttggtccggcacgacgaattctag

SEQ ID NO: 181432 - DNA, 798 bp, Artificial Sequence
  Description of Artificial Sequence: Synthetic coding sequence
atggacctgcggcagttcctgatgtgcctgagcctgtgcaccgcctttgccctgtccaagccaactgagaagaaggaccgcgtccaccacgagcctcagctgagcgacaaagtgcacaacgatgcccagtctttcgactatgatcacgacgcgtttttaggcgctgaggaagcaaagaccttcgaccagctgactcctgaagagagtaaggagcgcctcggcaaaattgtgtcaaagattgacggcgacaaagacgggtttgtgaccgtcgatgagctgaaagactggataaagtttgctcagaaaagatggatttacgaagacgtggaaagacagtggaaaggacacgacttgaacgaggatggcctcgtctcctgggaggagtacaagaacgctacttatgggtacgttttggatgacccagaccccgacgatggctttaactacaaacagatgatggtgcgggacgaacgcagatttaaaatggcggacaaagatggagacctgatcgctactaaggaggagtttaccgcgttcctccatcctgaagaatatgattacatgaaggacattgtagtgcaagagacaatggaggatatcgacaagaacgccgacgggtttatagatcttgaggagtacattggtgatatgtactcccacgacgggaacacagacgagtctgaccagaataaagacggcaaactcacaaaggaggagatcgtcgacaaatacgatctttttgtgggcagccaggccactgatttcggcgaagcactcgtccgccacgacgaattctag

SEQ ID NO: 181433 - DNA, 495 bp, Artificial Sequence
  Description of Artificial Sequence: Synthetic coding sequence
atgatggtgcgggacgagcggcggttcaagatggccgacaaggacggcgaccttattgccaccaaagaagaatttacagccttcctgcatcccgaggagtatgattatatgaaggacatcgtggtgcaggaaacaatggaagacatagataaaaatgctgacggattcatagatctggaagaatacatcggcgatatgtactcccacgacggtaacacagacgaacctgaatgggttaaaaccgagcgggagcagttcgtggaattcagggataaaaatagagacggaaagatggacaaggaagagacgaaggactggatcttaccttccgattacgaccacgccgaagccgaagctcgacacctggtgtacgagagtgatcagaacaaggacggaaagttaactaaggaggagattgttgacaaatatgatctctttgttgggtcacaagccactgattttggcgaggcactggtgaggcacgatgagttttag

SEQ ID NO: 181434 - DNA, 972 bp, Artificial Sequence
  Description of Artificial Sequence: Synthetic coding sequence
atgaaggagaccgacctgatcatcatggacctgcggcagttcctgatgtgcttgtccctctgtaccgcttttgctctcagtaagcccaccgaaaagaaggaccgggtccaccatgagccgcaactcagcgacaaagtgcacaacgacgctcagagcttcgattacgatcacgatgctttcttaggagccgaggaggctaaaacattcgatcagctgactcccgaagaatctaaggagaggctaggcatgattgtcgataagattgacgcggataaggatggcttcgtaaccgaaggcgagctgaagtcttggatcaagcatgctcagaagaagtacatttatgacaacgtagagaatcagtggcaagagttcgatatgaatcaggatggtttaataagctgggacgagtaccgcaacgtcacttatgggacctatctggatgatcccgaccctgacgatggattcaattataagcagatgatggtgagggatgaacgaagattcaaaatggcggacaaggatggtgacttgatagctaccaaggaggagtttaccgctttcttgcacccggaggaatatgattacatgaaggatatcgtggtccaggagaccatggaggacatcgataagaacgccgacggatttatagatcttgaggagtacattggcgacatgtactcccatgatggaaacaccgatgaacccgagtgggtgaaaaccgaaagagagcagtttgttgagttcagagataagaacagagatgggaaaatggacaaggaggagaccaaagattggatcctgccctcggactacgaccacgccgaagcggaagcaaggcacttggtatatgagagtgatcagaataaggatgggaaacttacgaaggaggagattgtcgataaatatgaccttttcgtgggctcacaagctacagacttcggggaagctctggtgaggcacgacgaattttag

SEQ ID NO: 181435 - DNA, 1116 bp, Artificial Sequence
  Description of Artificial Sequence: Synthetic coding sequence
atggagctggagctggacgccggcgaccaggacctgctggccttcctcctagaagagtctggtgacttgggcaccgcccctgacgaggccgtacgggcaccattagactgggccttgcctctttcagaagttccgtcagactgggaagttgacgacctactctgttccctgctgagcccacccgccagtctcaacattctttcttcctcaaatccttgcttggtccaccacgaccacacttactccttgcccagggaaacagtctctatggaccttgagtctgagtcttgtagaaaggagggaacacagatgacaccacagcacatggaggagcttgctgagcaggaaattgctcgcttggttctgactgatgaggagaagtcactgctcgagaaggagggcctgatacttccagagaccctgccattgactaagacagaggaacagattctgaagagggtgcggcggaagatacggaacaaacggtctgcccaggaatcacgcagaaaaaagaaggtttatgtcggcgggcttgaatcacgcgtgctaaagtacactgcccagaacatggagcttcagaataaagtgcagctacttgaggaacagaatttgagcttactggatcagctgagaaaactccaagccatggttatcgagatttccaacaaaaccagcagttctagcacgtgtatcctcgtcctgttagtgtcattctgtctccttcttgtgccggccatgtacagttctgacacccgaggtagcctgccagcagagcacggtgtgctcagtcggcagttaagggcactaccctccgaggacccttaccagttagagttgccagctttgcagagtgaggtaccgaaggacagtactcaccagtggctggacgggtccgattgcgtgctgcaggctcctggaaatacatcttgtctgctgcattatatgccacaggctcccagtgctgagcccccacttgagtggccgttccctgacctattctccgaacctttgtgtcggggccctattctaccattgcaagcaaacctgacgcggaagggaggctggctccccactggaagcccctcagttattctccaagataggtactccggatag

SEQ ID NO: 181436 - DNA, 1386 bp, Artificial Sequence
  Description of Artificial Sequence: Synthetic coding sequence
atgaacaccgacctggccgccggcaagatggccagcgccgcctgctctatggaccccatcgactcattcgagctcctggacctgcttttcgaccggcaagacgggattctgaggcatgtcgagctgggcgaaggctggggccatgttaaggatcagcaggtcctgcctaaccctgacagtgatgacttcctttcatcaattctagggagcggcgattccctcccttcatcaccgttgtggagccccgagggatcggacagtggtatcagtgaagacctgccttctgacccgcaggataccccacctcgcagtggccctgcaacgagccccgctggatgccaccccgcgcagccaggaaaaggcccctgcctgagctaccatcctgggaatagttgctccaccaccactcccgggcccgtgatccaggtccccgaagcttcagtgaccattgatctggaaatgtggtcacccggaggtcgcatttgcgcagaaaagccggcagatccggtggatctttccccgaggtgcaacctcacggtgaaggatttgcttttgagtggatcctcaggggatctgcaacagcaccacttgggggccagctacctactgcggccgggagcagggcactgccaagaacttgtgttaaccgaggatgagaaaaaactgcttgccaaggaaggtattaccctgcctactcagcttcctctaacaaagtatgaggaacgcgtgctcaaaaagatcagaagaaaaatcaggaacaaacagtccgcgcaagagtcaaggaagaagaaaaaagaatacattgacggcctcgagaccaggatgagcgcttgtacggcccagaaccaggagcttcagaggaaggttctgcacctcgaaaagcagaatctgagtctcctggagcagctgaaaaagttgcaggccatagtcgttcaatcaaccagcaagagtgcccaaaccggcacatgtgtggctgtgctcctcctatcattcgccctgatcatcctgccaagtatttctccttttgggcccaataagaccgaaagccctggcgattttgcaccagtgagggtcttttcgcggacacttcacaatgacgcagctagtagggttgccgccgatgcagtccctggcagcgaagcccccggtcccagacctgaagcggataccacccgtgaagagtctcctggctcaccaggcgccgattggggtttccaggacacagctaacctgaccaactccacagaggaacttgataacgccacgttggttttaagaaatgcgaccgaaggactgggccaagtagccttgttggattgggtagctcctggccccagtacaggctccgggagggcgggtctcgaagccgcaggtgatgagctctag

SEQ ID NO: 181437 - DNA, 900 bp, Artificial Sequence
  Description of Artificial Sequence: Synthetic coding sequence
atggccagcgccgcctgcagcatggaccccatcgacagcttcgagttactcgacctgctgttcgacaggcaggatgggatcctgcgccacgtggaacttggagagggctgggggcacgtgaaggatcaggtgctgcccaaccccgacagtgacgacttcttgagtagcattctggggagtggcgattctctgccaagtagtccgctgtggagccccgagggaagtgattcaggtatatctgaggacctgccttccgatcctcaggacaccccaccgcggagtggccccgctacatcccccgcgggttgtcacccagcccagccagggaaagggccatgtctgtcataccaccctggcaactcctgctccacgacaacgcccggtcccgtcatccagcagcagcaccatcttggagcatcgtacctccttaggcctggcgctgggcactgccaggaattggttctgactgaagatgaaaagaagttactggcgaaagaaggaatcactctgccgacacagctgcctctgacgaagtacgaagaaagggtcctgaagaaaatccgtcgcaaaattaggaacaagcagagcgcccaggagagccggaaaaagaaaaaagagtatattgatggcttggaaacgcggagttgttgttgtcccctcccaagttcttctagccctccttcagcccttctcgcccctacaaaacctagggcactcggcacccttagactgtacgaatgcagtccggagctctgcactacaatgctgccacctgcatggctcctgatgctttgtcaggccccacgaccacaggatcccgaccctaggctcacccagcccgagaagtctcttcaggaggctcctggtcagaccggggcctcgcgaacaccaagaacttag

SEQ ID NO: 181438 - DNA, 1260 bp, Artificial Sequence
  Description of Artificial Sequence: Synthetic coding sequence
atgaacaccgacctggccgccggcaagatggccagcgccgcctgcagtatggacccaatagactcttttgagctgcttgatctcctgttcgataggcaggatggaattctaagacacgtggaattgggcgaggggtggggtcatgtcaaggatcagcaggttttgcccaaccctgatagtgacgacttcttgagttccattttagggagcggagacagtctgccatcgagccccctgtggagtcccgagggatccgacagtggtatctcagaagatctgccgagtgacccgcaagacactcctccacgcagtggaccagcgacatcacccgctggttgccatccagcgcaaccaggcaaaggcccttgcctgtcataccaccccgggaacagttgcagtacaacgacacccggccccgtgattcaggtgccagaggcatcagtcacaatcgatctggaaatgtggtcaccaggtggccgtatatgcgccgaaaagccagctgacccagtggacttgagcccgcggtgtaacctcacggttaaagacttattgctgagcggctctagtggggacctgcaacagcatcacctgggggcaagttacctgcttcggcccggagcaggacattgccaagagcttgtgctcacggaggacgagaagaagctgctcgctaaggagggaattacactgcccacacagctgccattgacaaagtatgaagagagagtcttaaagaagatcaggaggaaaattcgaaacaaacagtctgcgcaggagagcaggaagaagaagaaagctatcgtggtgcaaagcacatcaaagagcgctcaaaccgggacgtgcgtagctgtgcttctgctttcttttgccctgatcattcttccgagtattagtccttttgggcctaacaaaaccgaatcccctggggattttgctccagtgcgggttttcagccggacgctgcataatgacgcagctagccgtgtcgccgccgacgcggtgcctggctctgaggctcctggcccacgtccagaagcggataccacgcgtgaagaatcccctggctctcccggagccgactggggcttccaagatacagcaaaccttacaaactcgaccgaagagctggataacgcgactctggtcctgagaaacgccaccgaggggctgggccaggtcgccctcttggactgggtggcgcctggacccagcaccgggtctggcagagccggcctggaggccgccggggacgaattatag

SEQ ID NO: 181439 - DNA, 1188 bp, Artificial Sequence
  Description of Artificial Sequence: Synthetic coding sequence
atggacctgggcatccccgacctgctggacgcctggctggagcccccggaagatatattttcaactggcagcgtgcttgaactgggacttcactgtcctccgcctgaagttcccgttactcggctacaggagcaggggttgcaggggtggaaaagcggtggagacaggggatgtggcttgcaggagtccgaacctgaagacttcctgaaattgtttatcgatcccaacgaggtgtattgttcagaggccagtcctgggtctgactccggcatcagtgaggatccttgtcatcctgatagtcccccagcccctcgcgcaacgagctcaccaatgctgtatgaagtggtatacgaggcaggagctctcgaacgaatgcaaggggaaactggacctaacgtaggcctgatcagtatacagctcgaccagtggagcccggccttcatggtgcccgacagctgtatggtgagcgaactcccattcgatgcccacgcacacattctgccacgcgctggcaccgtcgcgccagttccctgtaccactctcctgccctgtcaaactctgttcttgaccgacgaggaaaaacggttactcggccaggagggcgtatcgttgcccagccatttgccactcacaaaagcagaggagagggttcttaagaaagtaaggcgtaaaatcagaaacaaacagtcagcgcaggattccaggaggaggaaaaaggagtacatcgatggattggagagcagggtggccgcttgcagcgcccaaaatcaagaactccagaagaaggtgcaggaacttgagcgccataacatctccctggtggcccaactgagacaactacagaccttaattgcccaaaccagcaacaaggctgctcaaaccagcacttgcgtcctaattcttctcttcagcctagccttgataattctgccttctttctcaccattccagtctcgcccggaggccggaagtgaggactaccagccccacggtgttacctcccgtaatatcctaacccataaggacgtaaccgaaaacctggagacccaagtggtggagtctaggctgcgcgagcccccaggggcaaaggacgctaacggctcaacgcgcacgctactggaaaaaatggggggcaagcctcgaccatcagggaggattcgctccgtacttcacgctgacgagatgtag

SEQ ID NO: 181440 - DNA, 1128 bp, Artificial Sequence
  Description of Artificial Sequence: Synthetic coding sequence
atggacctgggcatccccgacctgctggacgcctggctggagccccctgaagatatcttcagcacaggaagcgttctggagcttggcctgcactgccctccacctgaggtgcccggtcttcaggagtctgagccagaggacttcctgaagctatttatcgaccccaatgaggtctattgctccgaggcatctcctggttccgattcaggtatcagtgaggacccgtgtcatcccgattctcctcccgcaccacgggcgacaagttctccaatgctttatgaagtggtttacgaggcaggagccctagaaagaatgcagggagagacagggccaaatgtggggttgatctcaatacagctggaccagtggtctccggcgttcatggtccccgatagttgtatggtttctgaactgcctttcgatgcacacgcacacatccttcctcgggccggcacagtggctcctgtgccttgcaccactctgctgccctgtcagactctgttcctgacagacgaagagaaacgtctgctaggccaggagggggtaagcctcccttcacatctgcccctgaccaaagcggaggaaagggtgctgaagaaagtgcgccgcaagataagaaacaagcaatcagctcaggattctcggagaaggaaaaaggaatatattgacggactggagtcccgagtagcggcttgcagcgcccaaaatcaggaactgcaaaagaaagtgcaggagctagagcgacacaacatctctctggtcgcccagctcagacagttgcagacccttattgctcagacatctaataaagcggctcagacgtccacatgtgtcctgattctgctattcagccttgcgttgataattctcccttccttctccccctttcagtctaggcctgaagccgggtccgaggactaccagccccacggggtgacatctcgaaatatcctgacgcataaggacgttaccgagaatttggagacccaggtcgttgagtcccggctaagagaaccccctggagctaaagatgcaaatggcagcaccaggacacttctggaaaagatggggggcaagccccgaccttccggcagaatccggtcagtattgcacgcagatgagatgtag

SEQ ID NO: 181441 - DNA, 654 bp, Artificial Sequence
  Description of Artificial Sequence: Synthetic coding sequence
atggacctgggcatccccgacctgctggacgcctggctggagcccccagaggacatcttcagtacggggtcagtgctcgagctcgggctgcactgtccgccccctgaggtaccagtcaccagacttcaggagcaaggtctacaggggtggaagtccggtggagatagaggctgcggactacaggaatcagaaccagaggactttctcaaacttttcattgacccgaatgaggtttactgcagcgaggcttctccgggaagtgattccggaataagcgaggacccctgtcatccggactcacctccagcacccagagctacctccagtccgatgctctacgaggtcgtctatgaggccggagcactcgagcggatgcaaggggagaccgggccaaatgtgggcctcatatccatccagctggatcagtggagccccgcgtttatggtcccagattcctgcatggtttcagaactgcccttcgacgcccatgcccatatcctcccccgggcgggtacggtggctccggtcccttgcacgaccctgcttccctgccagactttgttcctgaccgatgaagagaaacggctactcgggcaggagggcgtctctttgccgtctcaccttccactgaccaaagttacttgtttcccctag

SEQ ID NO: 181442 - DNA, 1188 bp, Artificial Sequence
  Description of Artificial Sequence: Synthetic coding sequence
atggacctgggcatccccgacctgctggacgcctggctggagccccctgaagacattttcagcacaggctcagtacttgaactcggtcttcactgccccccccccgaagtccccgtgactagacttcaggagcagggcctgcagggttggaagagtgggggggataggggatgtggattacaggaatccgaacctgaggattttttgaaactttttattgaccctaatgaggtttactgctccgaggcctcgcctggaagcgatagcggtataagcgaagacccttgtcatcctgattccccgccggccccaagggcaacatcttcccctatgttgtacgaggtggtgtacgaagcaggtgctttagaaaggatgcagggtgaaacaggtcccaacgtgggtctgatcagcatacagctagatcagtggagccctgcttttatggttcccgactcgtgcatggtgagtgagctgccctttgatgcccacgcccacatcttacctagggccggcaccgtcgctccagtgccgtgcacaactcttctcccttgccagacgctcttcttgaccgatgaggagaagcggctactcggtcaagagggagtctcactgccatcccacctgcctctgacaaaggccgaagagagggttctgaaaaaagtgcgcaggaagatccgaaacaagcagtcagctcaggatagtcgcagacgaaagaaggagtacatcgatgggcttgagagtcgcgtggctgcatgctccgctcagaaccaggaattgcagaaaaaagtccaggaattggagagacacaacattagcctggtggcccaactgagacaactccagacactgatagctcagaccagcaacaaagctgcccagacctccacgtgcgtcctgattttactgttctccctggcactcattattctgccaagtttctctcctttccaatcgagaccagaggccgggagcgaggattatcagccgcatggtgtcacctccaggaacatcctcactcacaaggacgtcaccgaaaatttggagacacaggtggtggagtcaagactaagagaaccccccggcgccaaagatgcgaacggatctactaggactttgctcgaaaagatgggagggaagccgcgaccatctggcagaatccgcagcgtcctgcacgccgacgaaatgtag

SEQ ID NO: 181443 - DNA, 1188 bp, Artificial Sequence
  Description of Artificial Sequence: Synthetic coding sequence
atggacctgggcatccccgacctgctggacgcctggctggagccccccgaagatattttcagcacaggcagcgttctggagctgggattgcactgcccccccccagaggttccagtgacaaggctgcaggagcagggcttgcagggttggaagtccggaggtgacagaggctgtggtctccaggagtccgagcctgaagactttttgaagctcttcattgaccccaatgaagtgtactgttccgaagcttcaccgggctcagatagtggaattagcgaagacccttgccacccggattctccacccgctcccagggccacatcgagcccgatgttgtacgaagtggtgtatgaggccggggctctggagagaatgcagggggagaccgggccaaacgtggggctcatttctatccagttagaccagtggagccctgcgttcatggtccctgactcttgcatggtgagcgagctaccattcgatgctcatgctcatatcctcccaagagctggtacagttgccccagttccttgcactaccctcctcccttgtcagaccctcttcctgaccgatgaggagaaacgtctcctcgggcaggagggagtcagtctcccttcacatctgcccctgacaaaagcggaggagagggtgctgaagaaagtgaggaggaagatacggaataagcagagcgcccaggatagtcgccgtcgaaagaaggaatatattgacggcctagagagtcgcgtggcggcctgcagcgcccagaatcaagaattgcagaagaaagtccaggagttggagagacataacatctccttggtggctcagctgagacagctccagacactcatcgcgcagacatcaaataaagccgctcagacctccacttgcgtacttatcctgctgttttccctggccctgattattttgcctagcttctctccttttcagagccgtcccgaggccggcagcgaggactaccagccccacggcgtgactagtcgaaacatcctgacacacaaggacgtcacagaaaatctggagactcaggttgtcgaaagcaggctccgggagccgcccggggccaaggacgccaacggcagcacaagaacgctcctggagaagatgggcggcaaaccaaggcccagcgggcggattcgctctgttttacacgcagatgaaatgtag

SEQ ID NO: 181444 - DNA, 747 bp, Artificial Sequence
  Description of Artificial Sequence: Synthetic coding sequence
atggtgcccgacagctgcatggtgagcgagctgcccttcgacgcccatgctcacatcctgcctcgggctggcacagtcgcacctgtaccttgtaccacacttttgccatgccagaccctctttcttacagacgaagagaagcgcctgcttgggcaggaaggcgtgagcctgccgtcgcacctcccgctgactaaagctgaggagcgggttctcaaaaaagtccggaggaaaatcaggaacaaacaatccgcacaagacagccgacggcgcaagaaggagtatattgatgggttggaatctagagtagccgcttgttctgcacagaaccaagaactgcagaaaaaggtgcaggagcttgagaggcacaatataagcttggtcgcccagctgcgccagctccagactctgattgcacagactagcaataaggcggctcaaacttctacctgcgtgttaattcttctattttccctagccctcatcatccttccgtctttcagtcctttccaatctcgtccggaggctggaagcgaagactatcagccccacggtgtgacctcgagaaatattctgacccacaaagatgttaccgaaaatcttgagactcaggtggtagaatcacgactaagggagccccccggcgcaaaagatgctaacggttccacccgcacattgctggaaaagatgggagggaagccacgccctagtgggcgtatacggagcgtcctccacgccgacgagatgtag

SEQ ID NO: 181445 - DNA, 549 bp, Artificial Sequence
  Description of Artificial Sequence: Synthetic coding sequence
atggacctgggcatccccgacctgctggacgcctggctggagccccccgaggatattttttctaccggcagcgtccttgagctaggcttgcactgtcctcctccagaggtaccggttacgaggctccaggagcagggactgcaggggtggaagagtggcggggaccgggggtgtggactccaagaatctgaacctgaggatttcctgaagctgtttattgaccctaacgaagtctactgctccgaggcctctccgggttccgatagtggtatctcagaggacccctgtcaccccgactcccccccggcacctcgggccacaagcagtcccatgctctacgaggtcgtgtacgaagccggcgcccttgaaagaatgcagggagaaaccggtccaaacgtgggcctgattagcatccaactggaccagtggtctccagccttcatggtcccggattcttgtatggtgtccgaactccctttcgatgcccacgctcacatcctgccgcgggccggtacagtggcccctgtgccgtgcactacgctcgtttag

SEQ ID NO: 181446 - DNA, 687 bp, Artificial Sequence
  Description of Artificial Sequence: Synthetic coding sequence
atggacctgggcatccccgacctgctggacgcctggctggagccccccgaggacatcttttcaaccggctctgtgctcgagctcggtctgcactgcccccctcccgaggtaccaggcctgcaagaatctgagccagaggatttcctaaaactctttatcgacccaaatgaagtgtactgcagcgaagctagcccaggcagtgatagtggaatcagtgaagacccttgccatcctgactcgcccccggctccgagagcgaccagttcccccatgctgtacgaggtcgtctacgaggccggcgctctggagcgcatgcagggcgagaccggccccaatgtgggactgattagtatccagctcgatcagtggtctccggctttcatggtccctgatagctgcatggtatccgagctaccctttgacgcccatgcccacatcctgccaagagctggaactgtggcgccagtcccgtgcacaaccctcctgccctgtcagaccctatttctgaccgacgaagagaagagacttctgggtcaagagggggtgagtttgccatcccatctgccactgaccaaagctgaggaacgtgtgctgaaaaaagtcaggcggaaaatcagaaataagcaatcggctcaggacagtaggaggaggaagaaggagtacatcgacggtttggagagccgctag

SEQ ID NO: 181447 - DNA, 1047 bp, Artificial Sequence
  Description of Artificial Sequence: Synthetic coding sequence
atgagcaagtgcgcccggaagaagtacatcaagaccaacccccggcagatgacaatggagacagttgaatcgcagcacgatggatccataacggccagcctcactgaatcaaaatcagctcacgttcaaacccagaccggacaaaattcaataccggcccttgcacaggtatccgtggctggctcaggaacccggagaggctcaccagccgtcacgctggtgcagctcccctctgggcagacaatacatgtgcagggggtgatccaaaccccacaaccgtgggtgattcagtccagtgagattcataccgttcaggtcgctgcaatcgccgaaactgatgaaagtgctgagagcgagggcgtaatcgattcacataagcgacgagaaatcctgtcccggcggcccagctatagaaaaattctcaatgaactcagttctgacgtgccaggggtccccaaaattgaggaagagcgttccgaggaggagggtacccccccctccatcgccacgatggctgtgccgaccagcatttatcaaacgagtacgggccagtatattgccattgcccaggggggcaccatccagatctcaaatccagggagtgatggtgttcagggcctgcaagcccttaccatgactaactccggggcacccccacctggtgctaccatcgtgcagtacgcagcccagagcgccgacggcactcagcagttcttcgtgccagggtcccaggtcgtggtgcaggccgctaccggcgatatgcctacttaccagatcagagcccccacagcagcgcttccacagggcgtggtcatggccgcttctcctggcagcctccacagtccgcaacagctagcagaggaggcaacgcggaagagagagctccggttgatgaagaaccgtgaggcggcacgcgagtgccggagaaagaagaaggaatacgtcaaatgccttgagaacagagttgctgttttagagaaccagaataagaccctaatagaagaactgaaggcgctaaaagacctgtactgtcacaaagtcgagtag

SEQ ID NO: 181448 - DNA, 900 bp, Artificial Sequence
  Description of Artificial Sequence: Synthetic coding sequence
atgagcaagtgcgcccggaagaagtacatcaagaccaacccccggcagatgactatggagaccgtcgagagtcagcatgacggcagcataaccgcgagtctgacagaaagcaaatctgcccatgtgcagacccagacaggacaaaacagtattccggctctggcgcaggtagccgccatcgctgaaaccgacgagtctgccgaatcagaaggcgtgatcgattctcataaacgacgcgagatcctgtcaagacgtccatcttacaggaaaatcttaaacgagttatctagcgatgtccccggggtgcctaaaattgaggaggaaagatctgaggaggagggaacaccccccagtatcgcaactatggcagtgcccacaagcatctaccaaacctcgacagggcaatatatcgctatcgcgcagggcgggacaattcagatttccaatcctggcagtgatggagtgcaagggctacaagcgctaaccatgaccaattccggcgcccctccaccgggcgctaccatcgtgcagtacgccgcacaatccgctgatggaacgcaacaattcttcgtcccaggctcccaggtcgttgttcaggcggctactggagacatgcccacctaccagatcagagcgcctaccgcggccctcccacagggcgtcgtgatggcagcctctcctggctccctgcattctccccagcaattggcggaggaggctacccggaaacgcgagttgcgcctcatgaagaatagggaagccgcacgggagtgccgccggaagaagaaagaatatgtaaagtgcctggagaatcgggtcgccgtgctcgagaatcaaaacaaaacactgatagaagaattgaaagccctgaaagacctgtactgccacaaggtcgagtag

SEQ ID NO: 181449 - DNA, 738 bp, Artificial Sequence
  Description of Artificial Sequence: Synthetic coding sequence
atggtggccgccatcgccgagaccgacgagagcgccgagagcgagggtgtgatagatagtcacaaaagacgggagattttaagcagacgaccaagttacaggaagatcctgaatgagctttccagcgacgtgcccggagttcctaaaatagaggaagaaagatctgaggaggagggcactccaccgagtatagctacaatggctgtgccgaccagcatataccagacttctaccggacagtatatagccatagcacagggggggaccatccagatcagtaatccaggaagtgatggcgtgcagggtttacaagccctgactatgacaaactcaggggctcctcctccaggtgctacgatcgtacagtacgctgcacagtcagcagatggcactcagcagtttttcgttcccggaagccaggtggtcgtgcaggctgctacgggggacatgcccacctaccagatcagggctcctactgccgctctcccacaaggggtcgtgatggcagccagtcctggctctctgcatagtcctcagcaacttgcggaggaagctaccaggaaaagggaactcagacttatgaagaatcgggaggccgcgaaggagtgccgccggcggaagaaggagtacgttaaatgcctggagtctcgagtggccgttctagaggtacagaacaagaagctcattgaagagctggaaaccctgaaagatatctgctcaccgaagaccgactattag

SEQ ID NO: 181450 - DNA, 288 bp, Artificial Sequence
  Description of Artificial Sequence: Synthetic coding sequence
atgcccacctaccagatccgggcccccaccgccgccctgccccagggggttgttatggccgcttcacccgggagcctgcatagccctcagcagctggcggaagaggcaacacggaagagagagctgagacttatgaaaaatcgtgaggcagctcgggaatgtagacgaaaaaagaaagaatatgttaagtgtctggaaaatcgggttgccgtcctggaaaatcagaacaaaactctgatcgaggaactgaaagctctgaaggatctgtactgtcacaaggtagagtag

SEQ ID NO: 181451 - DNA, 903 bp, Artificial Sequence
  Description of Artificial Sequence: Synthetic coding sequence
atgagcaagtgcgcccggaagaagtacatcaagaccaacccccggcagatgacgatggagacagtggaatcccagcacgatggatcaattaccgccagtcttacagaatctaaaagtgcccatgtgcagactcagactggacaaaacagcattcccgctctggcgcaggttgctgcaatcgccgaaaccgatgagtcagcagagagtgagggcgtgatcgatagccataagaggagggaaatccttagcagaaggccctcctatagaaagattctcaatgaactttcttcagacgttccgggagtcccaaaaatagaagaagagcgcagcgaagaggaaggtacccccccctctatcgcaacgatggcagttccaacatctatttaccagacgtctacgggccagtatatcgcaattgcccagggcggaacaatccaaatctccaatcctggttcggacggcgtgcagggcttgcaagctctgaccatgacaaacagcggcgcacctcccccaggcgcaacaattgttcagtatgcagctcagagcgcagacggcacgcaacagtttttcgtgcccgggtctcaagtagtggtccaggctgcgactggggacatgccaacgtatcaaattcgggccccgacggctgctctgccccagggggtagtcatggctgccagcccaggctcgctgcacagtcctcaacagctcgccgaggaagcaactaggaagcgagaactgcgtcttatgaagaatagggaggcggccaaagaatgtcgacggaggaagaaagaatacgtgaagtgcctcgagagccgagttgctgtgctggaggttcaaaataagaagttaatagaggaactggaaacactgaaagacatctgctccccgaaaaccgactattag

SEQ ID NO: 181452 - DNA, 666 bp, Artificial Sequence
  Description of Artificial Sequence: Synthetic coding sequence
atgaccatggagaccgtggagagccagcacgacggcagcatcaccgctagtctcacagagagtaagagcgcgcacgtgcagacacagacagggcagaattccattcctgcccttgctcaggtcgctgctatcgctgaaactgacgagtccgcagagtccgagggcgtgatagacagtcacaaaaggagagagattttaagccgccgtccaagctaccgaaaaattcttaatgaactgtcctccgacgtgcccggtgtgccaaagattgaagaggagaggtctgaagaagaaggtacaccacccagtatcgctacaatggctgtgccaacatcaatataccagactagtacaggacagtacacggcgaccggcgacatgccaacgtatcagattagggccccaacagccgccctgccccagggtgtggttatggccgcttcacccgggagtctccacagcccccagcagcttgctgaggaagcgacccgtaagcgcgagttgaggctgatgaagaatcgcgaagccgctaaagaatgtagaagaagaaagaaggaatacgtgaaatgtctcgaatcacgtgtcgccgtgcttgaggtacagaataagaaactcatcgaggagctcgagactctgaaggatatctgttcgcccaagaccgattattag

SEQ ID NO: 181453 - DNA, 747 bp, Artificial Sequence
  Description of Artificial Sequence: Synthetic coding sequence
atgagcaagtgcgcccggaagaagtacatcaagaccaacccccggcagatgacaatggagactgtggagtctcagcacgacggatccatcactgcttctttaaccgaatccaaatcagctcacgtgcagacccaaaccggtcaaaattcaattcccgccctggcccaagtggcagctatcgctgagactgacgagtccgccgaaagcgagggcgtgatcgacagtcacaagcggcgcgagattctcagccggagaccgagttatcggaaaatccttaacgagctgtcatctgatgtaccgggagttcctaaaatcgaggaggagcgcagtgaagaagaaggcactccacctagcatcgctaccatggccgtgccaaccagcatttatcagaccagtaccgggcagtacaacgaagagaccgagctcgcccccagccacatggctgcagcgacaggagatatgccaacctatcaaattcgagcgccgaccgccgccctgccacagggggtggttatggctgccagcccaggaagcctacacagcccacagcaactggcagaggaggcaacaagaaagagggagctcagactgatgaaaaaccgcgaggccgctcgggaatgcaggcgcaagaaaaaagagtacgttaaatgcttggagaacagggtggccgtgcttgaaaatcaaaataaaaccctaatcgaggaactcaaagcccttaaggatttgtactgtcataaggttgagtag

SEQ ID NO: 181454 - DNA, 327 bp, Artificial Sequence
  Description of Artificial Sequence: Synthetic coding sequence
atggccgtgaccggcgacgacaccgccgccaccggcgacatgcccacttatcagatccgcgctcctaccgcggcccttccccaaggggtggtgatggcggcatcccctggatcactgcactccccccagcagctggctgaggaggccacacgaaagcgagaactccgcctgatgaaaaatcgcgaagcagcccgagagtgtagacggaaaaagaaagaatatgtgaagtgtctggaaaacagagtggctgtcctggagaatcaaaataaaactctgattgaggagctgaaggcgctgaaagacctgtactgtcataaggtcgaatag

SEQ ID NO: 181455 - DNA, 813 bp, Artificial Sequence
  Description of Artificial Sequence: Synthetic coding sequence
atgtggtggcaccagcacaacctgtgcttccggcggcccatcgaggaggactattcgagcggggacgtagaggaaaaggtggccgccatcgccgagacagacgaaagcgctgaaagcgagggcgtgatcgattcacataagcgacgcgaaatactctcgaggcgccccagttatcggaagatcctgaacgagttaagcagtgatgtgccaggggtgcccaaaattgaggaagaaaggtccgaggaggaagggacacctccgtctatcgccactatggccgtaccaacctctatctaccaaaccagcaccggacagtacattgcgatagctcagggcggaacaatccagatatcaaaccccgggagcgacggggtacaagggcttcaggccctgactatgactaactcaggggccccgcccccgggagccaccatcgtgcagtacgccgctcagtctgcggatgggactcagcagttttttgtaccaggcagccaggtggttgtgcaagccgcaacgggagatatgccaacgtaccagatccgagcccctacagctgccttaccccagggggtggtgatggcagcatcccccggctccttacatagtccccagcagctggctgaggaggcgactcggaaacgtgagctgaggctcatgaagaaccgcgaggccgccaaagagtgcagacgtcggaagaaggaatatgtcaagtgtctggaatcaagggttgcagtcctcgaagtgcagaataaaaaactgatcgaagagctcgagaccttgaaagatatttgctcacccaagacagactactag

SEQ ID NO: 181456 - DNA, 999 bp, Artificial Sequence
  Description of Artificial Sequence: Synthetic coding sequence
atgaccatggagaccgtggagagccagcacgacggcagcatcaccgcctcactgacagaaagcaagagtgcccatgtgcagacacagaccggccagaatagcatccccgcactagctcaggtctcggtggctgggtcaggtaccagaaggggctcgcccgccgtgactcttgtgcagttgccctccggccagacaattcacgtccagggggtcatacagaccccgcagccatgggtgatacagagctcagagatccataccgtgcaggttgccgcaatagctgaaacggatgagtccgccgaatcggaaggtgtcattgactcccataaacggagagaaatcttatctcggcgccctagctacaggaaaatcctgaacgaacttagttcagatgtgcccggtgtgcctaagattgaagaggagcgctctgaggaagagggcacccccccgagcatcgcaactatggccgtacccacatctatataccagactagcacagggcagtacatagcaatagcccagggcgggactatccagataagtaaccccggctcagacggagtgcagggtctgcaggccctgacaatgaccaatagtggcgctcctccaccaggcgcaaccatcgtgcagtatgccgcccaatctgctgacggcacccaacaatttttcgtgcccggaagtcaggttgtggttcaggcagccacgggcgacatgccgacctatcagattcgggcccctaccgccgccttgccacaaggcgttgtaatggctgccagcccggggagcctgcacagcccacagcagcttgctgaagaagcaacgcgcaaaagagagttaaggctgatgaaaaaccgagaggcagctcgcgagtgccgtcgcaagaaaaaggaatatgtgaagtgcctagagaaccgggtcgccgtgctggagaaccagaataagacacttattgaagaattgaaagccctcaaggacctctactgtcacaaggttgaatag

SEQ ID NO: 181457 - DNA, 1002 bp, Artificial Sequence
  Description of Artificial Sequence: Synthetic coding sequence
atgaccatggagaccgtggagagccagcacgacggcagcatcaccgcctcccttactgaatccaagtccgcgcacgtccagacgcagacaggacagaacagcatccccgcgcttgcgcaggtgtcagtggccgggagtggcactcggcgtggctcccccgctgtgactctcgtgcagcttcccagtggtcagaccattcacgtgcagggagtaatacaaaccccacagccttgggtgattcagtcttcagaaattcacactgtgcaagttgccgcaattgctgaaaccgatgagtccgccgagtccgaaggcgtgatcgattctcacaagaggagggagatcctctcgagacgaccttcgtacagaaaaattttgaatgaactttcttcagacgtgccaggggtacccaagatcgaggaggagaggtccgaggaggaagggactcccccatccatcgctacaatggctgttccgacctccatctaccagacctctacggggcagtacattgccattgcccagggcggtacaatacagattagtaaccctggatccgacggtgttcagggcctgcaggctctgacaatgaccaactcgggtgcccctccccccggggccacaatcgtgcagtacgccgcccagtctgccgatggtactcagcagttcttcgtgcctgggagtcaggtcgtggtccaggccgctactggcgacatgccaacctaccagatccgcgcaccaactgctgccttaccacagggggtggtgatggccgcaagccctggctcgcttcatagtccccagcagcttgctgaagaggctacacgcaagcgcgagctgcgcttgatgaagaatcgcgaagccgccaaggaatgccggcgccgcaagaaagagtacgtcaagtgccttgagagcagggtcgcggtcctggaagtccaaaacaagaaactgatcgaggagcttgagacactgaaagatatatgttcgccaaaaaccgattattag

SEQ ID NO: 181458 - DNA, 414 bp, Artificial Sequence
  Description of Artificial Sequence: Synthetic coding sequence
atgaccatggagaccgtggagagccagcacgacggcagcatcaccgcttctcttacagaaagtaagtcagcacacgtccagacacaaactggtcaaaattccattcctgccttagcccaggtggccgccatagccgagacggatgaaagtgctgagtccgaaggagttattgatagccacaagaggcgagaaatattgagccgtaggccatcttatagaaaaattcttaacgaattgagttctgacgtgccaggggttccaaagattgaggaggagagatctgaagaggagggcacccccccatctattgccacaatggctgtgcccaccagtatatatcagaccagtaccggacagtactccatgtacgccgccattagatacgacactgtgctagctctgtcccttctctag

SEQ ID NO: 181459 - DNA, 666 bp, Artificial Sequence
  Description of Artificial Sequence: Synthetic coding sequence
atgaccatggagaccgtggagagccagcacgacggcagcatcaccgcttctctcaccgagtcaaaatcagctcatgtgcagacccagaccggtcagaattctatcccagcattagcgcaagtggccgcgatagcagaaaccgatgaatccgcggagtcagaaggagtgattgatagccacaaacgccgggaaatcctgtcccgccgccccagctaccgcaagattttgaatgagttgtcgtcagatgtaccaggagtcccgaaaatagaggaggaacggagcgaagaagaggggacccctccttcgatcgccaccatggcagtacctacaagcatctatcaaacctccaccggtcagtacaccgccaccggagatatgcctacgtaccaaattcgtgcccccactgcagccctcccccagggagtggtgatggcagcatctccgggctcactccactcccctcagcagctggccgaagaggctacccggaaaagagaacttaggctgatgaagaaccgggaggccgccaaagaatgtagaagaaggaaaaaagagtacgttaagtgcctggaaagccgtgtagccgtcctggaagttcagaataaaaagttgattgaggaactcgaaactttgaaagatatttgctcccccaagacagattattag

SEQ ID NO: 181460 - DNA, 711 bp, Artificial Sequence
  Description of Artificial Sequence: Synthetic coding sequence
atgagcaagtgcgcccggaagaagtacatcaagaccaacccccggcaaatgaccatggagacagttgagagccagcatgatgggagcatcacagcgagtctgactgagtcaaagagcgcccatgtccagactcagaccggacagaacagcattcccgctctggcacaggtagccgcaatcgccgagactgatgagagcgcagaaagcgagggtgtgatcgatagtcacaagcgtcgggaaatcctgagtcgacggcccagctacagaaagatacttaatgaactgagtagtgatgtgcctggcgtgcccaagatcgaagaggaacgctcagaagaagaagggacacccccgtcaattgctacaatggcagtgcctacttctatttaccaaaccagtactgggcagtatacagctactggagacatgccgacctaccagattagggctccaaccgctgctctgcctcagggtgtggtgatggccgcttctccaggtagtttgcattctcctcagcaactggctgaggaagccacccggaagcgtgagcttaggctaatgaaaaatcgtgaggccgcaagggagtgtaggcgtaagaagaaggagtacgtcaaatgtttggagaatcgggtagcagtcctggagaaccagaacaagaccctgattgaggaactcaaagcactaaaagatttgtactgtcataaggtggagtag

SEQ ID NO: 181461 - DNA, 849 bp, Artificial Sequence
  Description of Artificial Sequence: Synthetic coding sequence
atgtggtggcaccagcacaacctgtgcttccggcggcccatcgaggaagactacagcagtggtgacgtggaggaaaaggtagccgccatcgcagagacagacgagagcgctgagtccgagggcgtgattgatagccacaaaaggagagagatattatcaagacgcccctcctaccgaaagatcctgaacgagctctctagtgatgttcctggagtgcctaaaattgaggaagaaaggagtgaggaggaggggactccaccatcgatcgcaacaatggccgttcccacgagcatctaccaaacaagcactggccaatatatcgcaatcgctcaaggcgggaccattcagatctctaatcccggaagcgatggagttcaggggcttcaagcccttacaatgactaacagcggagccccaccaccaggcgccacaatagtacagtacgccgcacagagcgctgacggaacccagcagttcttcgtccccggctcccaggtggttgtgcaggatgaggagaccgagctagcaccttctcacatggccgctgccactggggatatgcccacctaccagattagagcacccaccgctgcccttccacagggcgttgtaatggccgccagccccggtagcctccacagccctcagcagttggctgaggaagcaactcgaaaacgggaactgcggctcatgaaaaatagagaggccgcgaaggagtgccgccgtcgcaaaaaggaatatgttaaatgtctggagtctcgggtcgctgtgctcgaagtccaaaacaagaaactcatcgaagaactggagactctgaaggacatttgtagtccgaaaacagactactag

SEQ ID NO: 181462 - DNA, 1086 bp, Artificial Sequence
  Description of Artificial Sequence: Synthetic coding sequence
atgagcaagtgcgcccggaagaagtacatcaagaccaacccccggcagatgaccatggaaactgtagagtctcaacacgatggctctatcaccgcgagtctgactgaatctaagagtgcacatgtgcagacccagacaggccagaattcgatcccggcactggcgcaggtaagcgtcgccggctccggaacacggagaggcagccctgcagtcacccttgtgcagctgccttccggacagacaatacacgtgcaaggagtgattcagactccacagccatgggtaatccagagctctgagattcatacagtccaagtggctgccatagctgagactgatgagagtgcagagtcagaaggcgtaatagacagtcacaaaaggcgggagattctatctcgccgcccatcctacagaaaaattctgaacgaactttcttccgatgttcccggagtacctaagatagaggaggagcgctccgaagaggaggggacacctccgtccatcgcaactatggccgtccccacatccatctaccagacaagtactgggcagtacattgccatcgcccagggcggcacaatccagataagcaaccctggttccgatggcgtacaaggactacaggcgctaacaatgactaactccggagccccacccccaggggcaactatcgtacagtacgccgcccagtctgccgatggtacgcaacagttctttgtccctggatctcaggtggtagtacaggacgaagagactgaactggcacctagtcacatggccgcagcaactggtgacatgcctacatatcaaatcagagcccctaccgccgcactacctcagggagtagtaatggccgcatcccccggcagcctccacagcccgcagcaactggcggaggaagccactaggaaaagggagctccggctaatgaaaaaccgggaggctgccaaagaatgccgtcgccgaaagaaggagtacgttaaatgcctggaaagccgcgttgctgtattggaagtacagaacaaaaagctgatcgaggaactggaaacactgaaagacatatgttccccaaaaactgactactag

SEQ ID NO: 181463 - DNA, 474 bp, Artificial Sequence
  Description of Artificial Sequence: Synthetic coding sequence
atgagcaagtgcgcccggaagaagtacatcaagaccaacccccggcaaatgacgatggaaaccgtagagtcacagcatgacgggagtatcactgcttccctgacagagtctaaatccgcccacgtgcagacccagacaggacagaactcgatcccggctctcgcccaggtggccgcaattgccgaaaccgacgaaagcgccgaatccgaaggagttattgattctcacaagagaagagaaattctgtcaagacggccctcttatagaaagatcctcaacgagctgtccagtgatgttccaggcgtgcccaagatcgaggaggaaagaagcgaagaggagggcacccctccatccattgccacaatggctgttcctacaagcatttaccagacatcaactggccagtacattgcaatcgcccagggcggtacaattcaaatcagcaacccaggctccgacggcgtacaggggtag

SEQ ID NO: 181464 - DNA, 1038 bp, Artificial Sequence
  Description of Artificial Sequence: Synthetic coding sequence
atgaccatggagaccgtggagagccagcacgacggcagcatcaccgccagcttgaccgagtcaaagagcgctcatgtacagactcaaactggacagaactcgatacccgccctggcgcaagtctctgtggctggatctgggacacggcgtggcagcccagctgtgacactggtccagctgcctagcgggcaaacaatccacgtacagggcgtgatccagacgcctcagccatgggtaattcagtcctcggagatccatactgtgcaggtggccgcgatagcggagacagatgagtctgcagaatcggagggcgtgattgacagtcataaaaggcgagagattctgtctagacgaccaagttacagaaagattctgaatgaactatccagtgacgtgcccggagttcctaagatagaagaagaacggtccgaggaggaaggcacccccccttccatcgctaccatggctgtacctacaagcatctaccagacctctacgggacagtacattgctatcgctcaggggggtaccattcagatttcgaatccaggctccgatggggtgcagggacttcaggcacttaccatgaccaacagtggagcacccccacccggcgctaccattgtgcagtacgccgctcaatccgccgatggaactcagcagttcttcgtgcccggatcgcaagttgtggtccaggacgaagaaaccgagctggctccctcccatatggccgctgccactggggatatgccaacctaccagataagggctcctaccgctgcactcccgcagggtgtcgtgatggccgcctctcctggctccctgcactcccctcagcaactggctgaggaggctaccaggaaacgagagctgcgtctgatgaaaaatcgggaagctgccaaagagtgccggaggcggaagaaggagtatgtgaagtgtctggaaagccgggtagcagtgttggaagtgcaaaataaaaaactaattgaggagctggagactctgaaggacatctgctcccccaagaccgattattag

SEQ ID NO: 181465 - DNA, 858 bp, Artificial Sequence
  Description of Artificial Sequence: Synthetic coding sequence
atgagcaagtgcgcccggaagaagtacatcaagaccaacccccggcaaatgaccatggagaccgtcgaaagccaacacgatgggtccattacggcttccctcactgagtcgaaatcggcacacgtgcaaacgcagactggccagaatagcattcccgctttggcccaagtctcagtggctggctccggcaccaggagaggctctcctgccgtcacactggtgcagcttccatcgggccagacaattcacgtgcaaggagttatccagaccccccaaccctgggtcattcaatcttctgagattcacactgtgcaagtcgctgcaatcgccgagacggatgaatccgcagagtcggagggggtgatcgactcccacaagaggcgtgagatactgagccgacggccctcatacaggaagatcttgaatgagttatcctcagacgtccctggagtccctaaaattgaggaagagcggagcgaggaggagggcactcccccttccatagcaaccatggcagtccccacttcgatttaccagacgtccacaggacaatacaccgcaaccggagatatgccgacatatcagattcgcgctcctaccgccgctctcccacaaggcgtagtcatggcagctagtcccggcagcctccactccccgcagcagctggccgaggaggctaccagaaagagagaactcagactcatgaaaaacagagaagccgccagagaatgccgccgaaagaagaaggagtacgtcaagtgccttgagaacagggtggccgttttggaaaatcagaataagacccttatagaggagttgaaagccttgaaggatctgtactgccataaggttgagtag

SEQ ID NO: 181466 - DNA, 288 bp, Artificial Sequence
  Description of Artificial Sequence: Synthetic coding sequence
atgcccacctaccagatccgggcccccaccgccgccctgccccagggggtggtaatggccgcttctcctggcagcctgcactctcctcagcaattggccgaggaagctaccagaaagcgagagctgagactgatgaaaaaccgagaggcggcccgagagtgtaggaggaaaaagaaggagtacgtaaagtgtctggagaacagagtcgccgtgttagaaaatcagaataaaactttaatagaagagttaaaggcactgaaggacctgtattgtcacaaggtagagtag

SEQ ID NO: 181467 - DNA, 810 bp, Artificial Sequence
  Description of Artificial Sequence: Synthetic coding sequence
atgaccatggagaccgtggagagccagcacgacggcagcatcaccgcttccttgacagaatctaagtccgcccacgtacagactcagacaggccagaattcaattcccgctctggctcaggtctccgttgccggatcaggaacaaggcgcgggtcacccgccgtgacactggttcagctcccgagtgggcagaccatacatgtccagggtgtgattcagactccccagccatgggtgattcaatcaagtgaaatccatacggtccaggttgccgccatagcagagacagacgaatccgccgagagcgagggggttattgactcacataaacgtagagagatactgagccgcagaccctcgtatcggaagatacttaacgagctcagctcggatgtgccgggtgtacccaagatagaggaggagagatcggaggaggaaggaacacctccctcaattgctaccatggccgtacccacatctatataccagacgagcacaggccaatacacggccactggcgacatgcctacttatcaaatcagagctcctactgcggctttacctcaaggcgtggtgatggcggcttcgcctggtagcctgcattcacctcagcagctggccgaggaagctacacgaaaaagggagctccgcctaatgaagaaccgggaggccgctagagaatgccgccggaaaaagaaagaatacgttaaatgtctggaaaatcgagtggcagttctggaaaaccagaacaaaacccttatcgaggaacttaaagcactcaaagatctctattgtcacaaagtggaatag

SEQ ID NO: 181468 - DNA, 585 bp, Artificial Sequence
  Description of Artificial Sequence: Synthetic coding sequence
atggtggccgccatcgccgagaccgacgagagcgccgagagcgagggagttatcgactcccacaagcgacgggaaattctgtcccgtcgacccagttacaggaaaatactgaacgaactgtcatctgatgtgcctggcgttcccaagatcgaagaggagcgcagtgaagaggaaggcaccccgccatctattgctaccatggccgtgccgacctctatatatcagacaagcactggccagtacaacgaagagacggagttggcgccaagtcatatggctgctgccaccggggacatgccgacttatcagataagggccccaaccgccgcattaccccagggggtggtaatggctgcgtctccaggctcacttcacagtcctcaacagctggccgaagaagcaacgcggaagagagaactgcgactgatgaaaaaccgggaagccgcgaaagaatgtagaaggagaaaaaaggaatatgttaaatgcctggaatctcgagtagctgtgctggaggtccagaataagaagttaattgaagagcttgaaaccttgaaggatatttgttccccgaaaaccgattactag

SEQ ID NO: 181469 - DNA, 363 bp, Artificial Sequence
  Description of Artificial Sequence: Synthetic coding sequence
atggccgtgaccggcgacgacaccgacgaggagaccgagctggccccctcgcatatggctgccgcaactggggatatgcctacctaccaaatcagagcacccacagctgctctgccccaaggggtggtgatggctgccagtcccgggagcctgcattccccacaacagctcgccgaagaagcaacacggaaacgggagctgaggctgatgaaaaatcgcgaagcggcccgagagtgcaggaggaagaagaaagagtatgtgaagtgtctggagaatagagtcgccgtcttggagaatcaaaataaaactctgatcgaagagctgaaggcgctcaaggacctgtactgccataaggtggagtag

SEQ ID NO: 181470 - DNA, 291 bp, Artificial Sequence
  Description of Artificial Sequence: Synthetic coding sequence
atgcccacctaccagatccgggcccccaccgccgccctgccccagggagtcgtgatggcagcatctccagggagcctgcactcgccacagcagctggcagaagaggcaacgcggaagcgagaactgagactcatgaaaaatcgtgaggcagccaaggaatgcaggaggcggaagaaagagtatgtcaaatgcttagagtctagggtggccgttctcgaagtgcagaacaaaaagttgattgaggagttggaaacgctgaaggacatctgcagccccaagaccgactactag

SEQ ID NO: 181471 - DNA, 339 bp, Artificial Sequence
  Description of Artificial Sequence: Synthetic coding sequence
atgaaccggacccaggagctgagcggccagctgagcgccgccaccggcgatatgcccacatatcaaattcgcgctccgacagccgccttaccacaaggcgtggtgatggccgcttctccggggtcactgcattccccccagcaactcgccgaggaggcaacccgcaagcgagagctgaggttaatgaaaaaccgcgaagctgctcgtgagtgtaggcgcaaaaagaaggagtatgtcaaatgtctggagaaccgagtggccgtgttggagaatcagaataagacactcatcgaagaattgaaagcccttaaggatctatactgccataaagtggagtag

SEQ ID NO: 181472 - DNA, 939 bp, Artificial Sequence
  Description of Artificial Sequence: Synthetic coding sequence
atgagcaagtgcgcccggaagaagtacatcaagaccaacccccggcagatgacgatggaaacggtggagagccagcatgatggaagcattacagccagcctgaccgaatccaaatccgcgcatgtccagacacagactggtcagaactccattcctgctttggcccaggtggccgccattgctgaaacagatgagtcggcagaaagtgagggggtcatagacagtcataaacgccgggaaattttgagcagacgcccaagttacaggaaaatcttgaacgagctctcatccgatgttcccggcgtccccaaaattgaggaagagcgctccgaggaggaaggcactcctccgtccattgccactatggcagtgcccacgtctatctaccaaacgtcaacagggcaatatatagcgatcgcccaggggggcactattcagatctctaaccccgggagtgatggagtgcagggcctgcaggcccttacaatgaccaactccggtgcacctcctcccggcgcgacgatagtacagtacgcagcccagtctgctgacgggacccagcagttcttcgtgcccggcagccaggtggtggtgcaagacgaggaaaccgaactagcaccaagtcacatggccgccgccaccggcgatatgcctacctatcaaattcgtgcaccaaccgccgccttgccccaaggcgttgtcatggctgcgtcacctggctctcttcactctccccagcagttagctgaagaggcaacaagaaaacgagagctcaggctgatgaagaaccgcgaggccgccaaagaatgccgcagacgaaagaaagaatatgtgaaatgtttggaatcccgcgtggccgtgctcgaagttcaaaacaagaagcttattgaggagctcgagaccctcaaagacatatgtagccctaaaaccgactattag

SEQ ID NO: 181473 - DNA, 660 bp, Artificial Sequence
  Description of Artificial Sequence: Synthetic coding sequence
atgtggtggcaccagcacaacctgtgcttccggcggcccatcgaggaggattactcatccggcgacgtggaggagaaagtggccgccatcgccgagaccgatgaatctgccgaaagcgaaggggtgatcgattcccacaagagaagggaaatattgagcaggagaccctcgtaccgcaagatactgaatgagttatcctcagacgtgccaggggtcccaaagatagaggaagagcgctccgaggaggaaggaacccccccttccatcgccacgatggcagtgcctaccagtatctaccagacgtccaccgggcagtataatgaagagacagagctggcaccctcccatatggccgctgccaccggtgatatgccaacgtaccagatccgagctcctactgccgctctaccccagggtgtggtcatggcagcctctcctgggtctctgcattcgcctcagcagttagctgaggaagctaccaggaagagggagttgagactcatgaagaaccgtgaggcagctaaggaatgtcgacggagaaagaaagaatacgtgaagtgcctggagtcaagagtcgctgtccttgaagtacaaaataaaaagcttattgaagagttggaaacactgaaagatatctgcagtcccaagactgattattag

SEQ ID NO: 181474 - DNA, 366 bp, Artificial Sequence
  Description of Artificial Sequence: Synthetic coding sequence
atggccgtgaccggcgacgacaccgacgaggagaccgagctggccccaagccatatggcggccgctacaggtgacatgccgacgtatcagattcgcgctcctaccgcagcattaccccagggggtggtgatggccgctagccccggatcgctgcatagcccgcagcaactagccgaggaggctaccagaaaaagagagctccgcctgatgaagaaccgcgaagcggctaaagagtgtcggcgccggaagaaagaatacgtgaaatgcctggaaagccgcgtggccgtgctagaggtgcagaacaagaagttaatcgaggagttggagacactcaaagacatctgttccccaaagaccgactactag

SEQ ID NO: 181475 - DNA, 330 bp, Artificial Sequence
  Description of Artificial Sequence: Synthetic coding sequence
atggccgtgaccggcgacgacaccgccgccaccggcgacatgcccacataccagattcgggctcccaccgccgcattaccacagggagtggtaatggccgcctccccgggctccctgcattctccccagcaactggccgaggaagctaccaggaagcgggagctcagacttatgaaaaatcgagaggcggccaaagaatgcaggcgaagaaagaaagaatacgttaagtgtcttgaatctcgagtggccgtgcttgaggtgcagaacaaaaagctcatcgaggagttagagaccctcaaggatatctgctcgccaaagactgattactag

SEQ ID NO: 181476 - DNA, 309 bp, Artificial Sequence
  Description of Artificial Sequence: Synthetic coding sequence
atggccgccgccaccggcgacatgcccacctaccagatccgggcccccactgctgctctgccccagggagtcgtgatggcggcctcacctggaagcctccacagtccccaacaactagcagaggaggctactcggaaacgagagctccggcttatgaaaaatcgagaggccgctagagaatgtaggcgcaaaaaaaaggagtacgtgaaatgtctagagaatcgcgtggctgtgctcgaaaaccagaataagaccctgatcgaagagctgaaagccctcaaggacttatattgtcacaaggtggaatag

SEQ ID NO: 181477 - DNA, 414 bp, Artificial Sequence
  Description of Artificial Sequence: Synthetic coding sequence
atgaccatggagaccgtggagagccagcacgacggcagcatcaccgcctctctcacagagagcaaatccgcacacgtgcagacgcagactgggcagaacagcattccagcactggctcaggttgccgcaatcgccgagactgacgaatctgctgagagcgagggcgtgatagactcgcacaagaggcgcgagatactatcgcgacgtccatcttaccgaaagattttaaacgagctgagcagcgatgtgcctggggtcccaaagatcgaagaagagagatccgaagaggaagggactccgccgtcaatcgccactatggcagtccccaccagcatctaccagacgtccacaggacagtacagcatgtacgcggccatcaggtatgacaccgtcctggccctgtcattactgtag

SEQ ID NO: 181478 - DNA, 618 bp, Artificial Sequence
  Description of Artificial Sequence: Synthetic coding sequence
atgaccatggagaccgtggagagccagcacgacggcagcatcaccgcaagtttgacagaatcaaaatcagcacatgtccagactcaaacaggccaaaactccatccccgcactcgcacaggtcgtagccatagctcaaggcggtacaattcagatatccaatccaggatcagacggtgtacagggcctgcaggctctgactatgacgaactctggagccccaccccccggagcgacaatcgttcagtatgccgcccagtcagccgacggaactcagcaatttttcgttcctgggagtcaggtagtcgtgcaagccgccacaggcgacatgcccacgtatcagatcagggccccaacagccgcactaccacagggcgtggttatggctgcttccccagggtctctgcattccccacagcagctggctgaggaagccacaaggaaacgggaactgaggttgatgaagaatagagaggccgccaaagaatgccggcggagaaagaaagagtacgtaaagtgtctggaatcgcgcgtagctgtacttgaggtacagaataagaagctcatcgaggaattagagacgctgaaggacatctgttctccaaagactgattattag

SEQ ID NO: 181479 - DNA, 813 bp, Artificial Sequence
  Description of Artificial Sequence: Synthetic coding sequence
atgaccatggagaccgtggagagccagcacgacggcagcatcaccgctagccttacagaatccaaatccgcccacgtccagacacagactgggcaaaacagcattcctgccctggcacaggttagtgtggctgggtctggaaccaggcgcgggagtccagctgtcaccctcgttcagctgccttctggtcaaaccatccatgtgcagggcgtaatccagaccccccagccttgggtcattcagagctcggagatccataccgttcaagtggccgccatagctgagaccgatgaatccgcagagtccgaaggcgtgattgatagtcataaaaggcgggagattctgtctcggcgcccgagctatcgcaagatcctcaacgagttatcatctgatgtcccgggcgtgcctaagatagaggaggaacgctctgaggaagagggcacacctccctccattgccactatggccgtccctacttctatttaccagacttctactgggcagtacacagcaacaggagatatgcccacataccagatccgtgccccaacggcagctctgccacagggggtggtgatggctgcatccccggggagtttgcactccccacagcagttggccgaagaagccacacggaaacgcgagctccggctgatgaagaatcgggaagcagccaaggaatgcagacggcggaaaaaggaatacgtcaaatgcctggagtctcgagtggctgtgctcgaagtgcagaataagaaactcatcgaggaactggagacactgaaggatatatgttcccctaagaccgactactag

SEQ ID NO: 181480 - DNA, 342 bp, Artificial Sequence
  Description of Artificial Sequence: Synthetic coding sequence
atgaaccggacccaggagctgagcggccagctgagcgccgccaccggggacatgcctacatatcagatacgggccccaacagcggccctcccacagggagtggtaatggccgcatcaccaggatcactccattctcctcaacagctagcggaggaggctactaggaaacgcgaactgcggctaatgaagaatcgtgaagctgccaaggagtgtaggcggcgcaaaaaggagtatgtgaaatgcttagaatccagagtcgccgtcctggaggtacagaacaagaagctgatcgaggagctggagaccttaaaggatatttgcagccccaaaacagactattag

SEQ ID NO: 181481 - DNA, 465 bp, Artificial Sequence
  Description of Artificial Sequence: Synthetic coding sequence
atgaccatggagaccgtggagagccagcacgacggcagcatcaccgcgagtctaacggagagtaaaagcgctcacgttcaaacacagaccggacaaaactccatacccgctttggcacaggtcgatgaggaaactgagctggcaccgagccatatggctgctgctaccggtgatatgccgacatatcagattcgggccccgacggccgccctcccacagggagttgttatggccgccagtcccggaagcctccattctccccaacaactggccgaggaagccacccgcaaaagagagctccgcctgatgaaaaatcgggaggccgccaaagagtgtagacggaggaaaaaggaatatgttaagtgtcttgagtccagggtggcggtgctcgaggttcagaacaaaaaattaatagaggaattagaaaccctgaaggatatttgcagcccaaagactgattattag

SEQ ID NO: 181482 - DNA, 339 bp, Artificial Sequence
  Description of Artificial Sequence: Synthetic coding sequence
atgagcgccgaggtgcccgaggccgccagcgccgaggagcagaaggagatggaggacaaggtgacgtcaccagagaaagccgaagaagccaagctgaaggcccgctatccccatctggggcagaagccaggaggaagtgactttctgaggaaacggctccaaaaaggacaaaagtacttcgactctggagactataacatggccaaagctaagatgaagaataaacagctgcctacagcagctccagacaaaacagaggttaccggcgaccacatcccaacacctcaggatctgccccagagaaaaccgtccctagtcgctagcaaacttgctggctag

SEQ ID NO: 181483 - DNA, 1926 bp, Artificial Sequence
  Description of Artificial Sequence: Synthetic coding sequence
atgaccgagaagcccgagttccagagccaggtgtacaactacgccaaggataacaatattaaacaggatagtttcaaagaggagaacccgatggaaactagtgtgtctgcaaatacagatcagctgggaaacgagtactttaggcaacccccgccaagatctcctccactgattcactgtagcggtgagatgcttaagtttaccgagaagagccttgctaaaagtattgcgaaggaaagtgccctgaatccatcacagccaccctcctttctttgtaaaacagccgtcccatccaaggaaatccagaattacggcgaaatccccgaaatgtccgtttcttacgaaaaggaggtgactgccgaaggggtggaaaggcccgaaatcgtctccacatggtcttccgccgggatcagctggcgtagcgaagcctgtcgggagaactgtgaaatgcccgattgggaacaatcagctgagtcactacagccagtccaagaggacatggcgttaaacgaggttctgcagaaattgaaacataccaacaggaagcaagaagttcggatccaagagctgcagtgcagcaatttgtacctggagaagagagttaaggagctgcagatgaaaattactaagcagcaggtcttcatagatgttataaacaagttaaaagaaaacgtggaagagttgatcgaagataagtacaagatcatactggagaaaaacgataccaaaaaaaccctgcagaacctggaagaggtgctcgcgaatactcagaagcatttgcaggaatcgagaaatgacaaggaaatgctccagttacagtttaagaagatcaaggccaattatgtgtgcctccaggaaaggtacatgaccgaaatgcaacaaaaaaataagagtgtttcccagtatctcgagatggataagacgctttcgaagaaagaggaggaggttgaaagactgcagcaactaaaaaaggagcttgaaaaggctaccgcttcagcacttgacctcctcaaacgcgaaaaggaggcccaggagcaggagtttctgtcactgcaggaagaattccagaagctcgagaaggaaaatttagaagagcgccagaaactgaaatctaggcttgagaaactcctgacccaggtacggaatctgcaattcatgtccgagaacgagaggacgaagaacattaagctgcagcagcaaatcaacgaagtgaaaaatgaaaacgctaagctgaagcaacaggtggcgagatccgaggagcagaattacgttccaaaattcgagacagcacagctgaaggaccaacttgaagaggtactcaaaagcgatatcacaaaagatactaaaactactcattccaacctgctgcctgactgcagcccctgtgaagagaggctcaaccctgcggacatcaaacgcgcctcccagctggcatccaaaatgcactcgctgctggcattgatggtgggtctgctgacatgccaggacattatcaatagcgacgcggagcatttcaaggaatctgaaaaggtgtcggacattatgctgcagaagctgaagtccttgcacctgaagaagaagacacttgataaggaagtcatcgactgtgactctgacgaagcgaagtcaatccgtgacgtgccaacactccttggggccaagttggacaaataccactcgctgaatgaggagctggattttctggtgacatcttacgaggaaatcatagaatgtgccgaccagaggctggccataagccatagccagatcgcccatttagaagagagaaacaagcacctggaagatttaatcaggaagccacgggaaaaagctcgcaaacctagatcaaaaagcctggaaaaccatccaaagtctatgaccatgatgccagctctgtttaaggaaaatagaaatgatctcgattag

SEQ ID NO: 181484 - DNA, 2475 bp, Artificial Sequence
  Description of Artificial Sequence: Synthetic coding sequence
atgaacaaggactaccagaagttctggagcagccccagcgaccccgtacattttgaggttgacaccagccacgagaaggttgagtcgatgtcggaatctgatacaatgaacgtcagtaatctgtctcagggggtaatgctatcacacagtcctatttgcatggagaccaccggtactacttgtgatctgccccagaacgaaatcaagaactttgagcgggagaacgagtatgaaagcactctgtgcgaagacgcctatggcaccctggacaatctcctgaacgacaataacatcgagaactatagcaccaacgccttgattcaacccgttgacaccattagcataagcagcctgaggcaattcgagacggtgtgcaagttccattgggttgaagcattcgatgacgagatgactgagaagcctgagttccaatcacaagtgtataactacgcaaaggacaataatattaaacaggactcattcaaggaagaaaaccctatggagacatcagtctctgctaacacggaccagctgggcaatgaatattttagacagccccctcctaggagccccccgctcatccattgctccggagagatgctcaagtttactgagaagtctttggccaaatccatcgccaaggagagcgcactcaaccccagtcaaccacctagtttcctttgcaaaacagctgtgccaagcaaagaaatccagaattacggagagatccccgaaatgagtgtgagctacgagaaggaggtcacagccgagggcgtggaaagaccggagattgtgagcacctggagctccgcaggcatatcctggcgcagcgaagcctgtcgagaaaattgtgagatgccggattgggaacagagcgccgagagtctacagcctgttcaggaggacatggcactcaatgaggtactgcagaagctgaaacatacaaatagaaagcaagaagtgaggattcaggagctacagtgcagcaatttgtatttagagaagcgagtcaaggaactgcagatgaaaataacgaagcagcaggtctttatcgatgtaataaataaactcaaggagaacgtggaggaactgattgaagacaagtacaagataatccttgagaagaacgataccaaaaagactctgcaaaatctcgaggaagtcctcgccaacacacagaagcacctgcaggaatccaggaatgataaagagatgctgcagcttcaattcaaaaagatcaaggccaactatgtatgcctgcaggaaaggtatatgacagaaatgcaacaaaagaacaagagcgtcagccaatacctggagatggacaagaccctctccaagaaggaggaggaggtcgagcggctccagcagctaaagaaggagctggagaaggcaacagcctctgccctggatctgctgaaaagggagaaagaagctcaagaacaagagttcctcagcctgcaggaggaatttcagaagcttgaaaaggagaaccttgaggaaagacagaagctcaagagtaggcttgaaaaactcctgacccaggtcaggaatttgcagtttatgtcagagaatgagaggacgaagaatatcaaattacagcagcagataaatgaggttaagaacgagaacgccaagttgaagcagcaagtggctcggagcgaggagcaaaactatgttccaaaatttgagacagcccaactcaaggatcagttagaggaagtgctcaagtccgacatcaccaaggacaccaagactactcactcaaatctcttaccagactgcagtccatgtgaagagaggctaaaccccgctgacatcaaaagagccagtcaacttgcctccaaaatgcatagcttactggccctgatggtgggacttctcacatgccaggacatcatcaactccgatgccgagcactttaaagaaagtgaaaaagtatcggacataatgctacagaagttaaaaagcttgcacctgaagaaaaagaccctcgacaaagaattgctgaaacacaaggatagaattactacgtttcgcgagctcatagccaaagaaaaggctttccaggaccacgcaattaaggtcattgactgcgattcagacgaggcaaagtcaatccgagacgttcctacactactaggggcaaaacttgataagtatcactccctgaatgaggagttagactttctggtgacgtcctacgaggagattatcgagtgtgccgaccagaggttggctattagtcattcacagatcgcccacctcgaggaacggaacaaacatctggaagatctcataagaaaaccaagggaaaaggctaggaagcctcggtccaaaagtttagagaaccatcctaaatctatgaccatgctggcttataatctgtatatctttatcggatatcgactgggtgctgtcgctgacgcttgtaacccatcaactctcggcgggaggggcgggtggattacctag

SEQ ID NO: 181485 - DNA, 2334 bp, Artificial Sequence
  Description of Artificial Sequence: Synthetic coding sequence
atgaacaaggactaccagaagttctggagcagccccagcgaccccgtccacttcgaggtggatacatctcacgagaaggtcgaaagtatgagtgagtccgatacaatgaacgtgagcaacctgagccaaggcgttatgttgagtcactcccctatctgcatggaaaccactgggacaacctgcgatctgcctcaaaacgagatcaagaattttgaaagggaaaacgagtacgaaagcacgctttgtgaagacgcctatggcacactcgacaacctgctgaacgataacaacatcgagaactacagcaccaatgccctgatccagccggtggataccataagcatcagctccctgagacagtttgagacggtgtgtaaatttcattgggtagaggccttcgatgacgagatgacagaaaaacccgaatttcagagtcaggtctataattacgctaaagacaataacatcaaacaggactcctttaaagaagaaaacccaatggaaacctcggtctccgctaatactgatcagcttgggaatgagtacttcaggcaacctccaccacggagcccccctcttatccactgcagtggtgagatgttgaagttcacggagaagagtttggcaaaaagtatcgctaaggagtccgccctgaatccttcccagcccccatcctttctgtgcaagacagcagtgccttctaaagagatccagaactacggcgagatcccagagatgtccgttagttatgagaaagaagtgacagccgagggagtggagaggccggagattgtctccacgtggagctctgctggtatctcctggaggtctgaagcgtgtcgggagaattgcgagatgcctgattgggaacagtctgccgaatccctgcagccagtgcaggaagacatggcgttgaacgaggtattgcaaaagctgaagcatacgaataggaaacaggaggtgcgcatccaggaattgcagtgcagtaatctctacctggagaaacgcgtcaaggaactacagatgaagattaccaagcagcaggtattcattgatgtcattaataaactgaaagagaacgttgaagaattgatagaggataaatataagattatattggagaaaaatgatactaagaagacattgcagaacctcgaagaagtgctggccaacactcagaaacatttacaggagtctaggaacgataaagagatgctgcagctccagtttaaaaaaataaaggcaaactacgtgtgcttgcaagagcgctacatgaccgagatgcagcagaaaaataaaagcgtcagccaatacttggagatggacaagaccctgtcgaaaaaagaggaagaagtcgagaggctgcagcaactgaagaaagaactagaaaaggctacagctagcgctctcgatctgctcaaaagggagaaggaagcccaggaacaagagttcttgtcattacaggaggaatttcagaaactggagaaagaaaacctggaggagcgccagaagctgaaatcacggctggaaaagctgctcacccaggtgcgtaacttgcagtttatgtccgagaacgaacgcacaaaaaacatcaaactacagcagcagatcaacgaggtcaaaaacgagaacgccaaactcaaacagcaggttgccagatccgaggagcaaaattacgtccccaagtttgagaccgctcaattaaaggatcagctcgaggaagtcctgaaaagcgacattaccaaggacaccaaaacaactcacagcaatctactaccagactgcagcccatgcgaagaaagactaaatccagcagacattaagcgtgcgtcccaactggcctccaagatgcattcactcctggccctcatggtgggcctgctgacttgtcaagatattattaatagcgacgctgagcatttcaaagagtccgagaaggtgtcagacattatgctgcagaaactgaagtccctgcacctcaagaaaaagacgctggataaggaagtcatagactgcgactccgatgaggccaagagcattcgtgacgtgccgaccctgctgggggccaagctggacaaataccacagcctgaacgaagaactggattttcttgtgaccagttacgaggagattattgaatgcgccgaccagaggctggccattagccacagccagatcgcccatctcgaggaacgtaacaagcacctggaagacctgattaggaagccacgagaaaaggccaggaagcctcggagcaaaagcctggaaaatcatccgaaatcaatgacgatgatgccagctttatttaaagaaaatagaaacgatcttgactag

SEQ ID NO: 181486 - DNA, 2103 bp, Artificial Sequence
  Description of Artificial Sequence: Synthetic coding sequence
atgaacaaggactaccagaagttctggagcagccccagcgaccccgtccacttcgaggtggacactagccacgagaaggtcgagagcatgtcagagtccgatacaatgaacgttagtaacctgtcacagggagtgatgctttctcactctcccatctgtatggagactaccggcactacatgcgatttgccccaaaacgagatcaagaacttcgaaagagagaatgaatacgagtccactctttgtgaagacgcttacgggaccttagacaatttactgaacgacaataacattgaaaactattccactaacgctttgattcaacccgtagataccataagcattagtagcctgagacaatttgagaccgtgtgcaagtttcactgggttgaagctttcgacgacgagatgaccgaaaagccagagtttcaatcacaggtatataactatgcaaaggataacaatatcaagcaggattccttcaaagaggagaacccgatggaaacaagtgtcagtgctaatactgatcagctgggaaacgaatactttagacagccacccccgcgcagcccgcctctcatccactgttccggtgagatgcttaaatttaccgagaaatccctggccaagtcaatcgctaaggagtctgcccttaatcctagtcaacccccatctttcctatgtaaaaccgccgtgccttctaaggagatacagaattatggcgagataccggagatgtcagtgtcttacgagaaagaagtgaccgccgaaggcgtcgagcgtccagagatcgtgtctacctggtcgtcggccggtatcagttggaggtctgaggcctgcagggagaactgcgagatgccagattgggagcagagtgccgagtcattacagcccgtgcaagaggacatggctctgaacgaagtactgcagaagctgaaacacactaatcgaaaacaggaagtgaggatccaggaactccagtgttccaacctgtacctcgagaaacgagtgaaggagctgcagatgaaaatcaccaaacagcaggtgttcattgatgtaatcaacaagcttaaggagaacgttgaagaactgatcgaggacaagtacaaaatcattctggagaaaaacgacactaaaaagacattgcagaatctcgaggaggtgcttgctaacactcagaaacacctgcaggaaagccgcaacgataaagagatgctacaattgcaatttaagaaaattaaggccaactacgtctgtctccaggagaggtacatgactgaaatgcagcagaagaataaatccgtgtcccaatatctggagatggacaaaactttgagcaagaaggaggaggaggtggagcggctacagcagttaaagaaagagctcgaaaaggccacagcttccgcgctggatttactgaagcgagagaaagaagctcaggaacaggagtttctgtcgttgcaggaagaattccagaagttagagaaggagaacctggaagagcgacagaaactgaagtctagactggagaagctgctcacacaggtccgaaacctacaatttatgagcgagaacgaacgcactaaaaatattaagttgcagcagcagatcaatgaggtcaagaatgagaatgccaaactcaagcagcaggtggcccgcagcgaggagcagaactacgtgcccaaattcgagaccgcccagctgaaggaccagcttgaggaggtgctgaaatctgacataactaaggacacgaagactacccacagcaacctgctccccgattgttctccatgcgaggagcggctaaaccccgcagatatcaaacgagcgtcccaactcgcaagcaaaatgcacagtctgctggctctcatggttggactgctgacttgccaggacattatcaactcggatgccgagcatttcaaagagtctgaaaaggtttccgatattatgctgcagaagctcaagtcccttcatctgaagaagaagacccttgacaaagaactcttaaagcataaggaccgcataacaacattcagagagctgatcgccaaagaaaaggctttccaggaccatgctatcaaggttttccagggcgtgtag

SEQ ID NO: 181487 - DNA, 2520 bp, Artificial Sequence
  Description of Artificial Sequence: Synthetic coding sequence
atgaacaaggactaccagaagttctggagcagccccagcgaccccgtgcatttcgaggtggatactagccacgaaaaggtggagagtatgtcagagtccgatacaatgaatgtgagtaacctgtcccaaggtgtgatgttaagtcactcgccaatctgcatggagacaactggaacaacctgtgatcttccccagaatgagataaaaaatttcgaacgcgagaatgagtatgagagcactctttgcgaggatgcatacggaacactggataacctgctcaacgataataatattgagaattattccacaaatgcgttgatccagcccgtggataccattagcatctcctccttacgccaatttgaaactgtgtgcaagtttcactgggtcgaggccttcgacgacgagatgacggagaagcccgaattccagtcccaggtatataactacgccaaggacaacaacataaaacaggattcatttaaggaggagaacccaatggagaccagcgtctcggcaaataccgatcagctaggtaacgagtatttccgacagccccccccacgaagcccccccctgattcactgttctggggagatgcttaagtttacagaaaagtccctggctaagtcaatagccaaagagagcgcgctgaacccaagccaacctccctctttcctatgcaaaaccgccgtgccttctaaggagatacaaaattatggcgaaatcccagagatgagtgtcagctatgagaaagaggtaaccgctgagggagttgagcgccctgagatcgtgtcaacctggtctagcgccgggatcagctggcgaagcgaggcatgccgagaaaactgtgagatgcctgactgggagcagagcgctgaatcattacaacctgtgcaggaggatatggccctgaacgaggttctccagaagctgaagcataccaataggaaacaagaagtgaggattcaggagctgcaatgtagtaatctgtatcttgagaagagagtcaaagagctgcagatgaaaataaccaaacagcaggtttttatcgacgtcatcaacaagctgaaagaaaatgtggaggagctaatagaggacaaatataaaatcatactggagaaaaatgacaccaagaaaaccctccagaatttggaagaagtcctggcaaacacacaaaagcacctgcaggaatctcggaatgataaagagatgctgcaactacagtttaaaaagatcaaagcgaattacgtgtgcctgcaggaacggtatatgacagagatgcagcagaagaacaaaagcgtgagccagtatctcgaaatggacaagaccctcagcaaaaaagaggaagaggtcgagcgacttcaacagcttaaaaaagagctggagaaagccactgcgtctgcattggacctcctgaagcgtgagaaggaggcacaggagcaagaattcctttccctacaagaggaatttcagaagctcgagaaagagaatttggaggagaggcagaaattgaagagcagactcgagaagctcctgacgcaggtgcgcaacctacaattcatgtcagaaaacgagcgcacaaagaatattaagttgcagcagcagataaatgaggtcaagaacgagaatgcaaagctgaagcagcaggttgcaaggagcgaggagcagaactatgttccaaaatttgagaccgcccagctgaaggaccagttggaggaagtgttaaaatcagacataacaaaggataccaaaaccacacacagtaatctcctgcccgattgttcaccgtgcgaagagaggctgaatcccgccgacatcaagcgcgcgtcgcaactggcatccaagatgcatagccttctcgccctgatggtgggactgctgacgtgccaagatattattaacagcgatgcagaacatttcaaggagagcgagaaggtgagcgatataatgcttcaaaaactcaaatccctgcatctcaagaaaaaaactctggataaggaactattaaaacacaaggatcgcataacgacatttcgggagttaatcgctaaggaaaaagcctttcaggatcatgctatcaaggtgatcgattgtgacagtgacgaggcgaagagtattcgcgatgtacccactctattgggcgccaaactcgacaaataccacagtctgaacgaggagttagacttcttgatcactaagttaggccacctcctggagtcaaaagagaaccattgcaacaggctcattgaagaaaacgacaaataccaaagacatctgggcaacctaattaaaaaggtcacaagctatgaagaaatcatcgaatgcgccgatcagcgtctggctatttcccattctcagatcgcccatctggaggagaggaacaagcacttagaggatctgatccgcaagccacgggagaaggcccgtaaacctcgatccaaatctctggaaaaccacccgaaatcgatgactatgatgcccgcccttttcaaggaaaaccgaaacgacttagattag

SEQ ID NO: 181488 - DNA, 2112 bp, Artificial Sequence
  Description of Artificial Sequence: Synthetic coding sequence
atggccgaccggcggcggcagcgggccagccaggacaccgaggacgaggagagtggagccagtggaagtgactcgggcggctcccccctccggggaggtggcagttgcagtggatcagcgggtggtgggggcagcggaagcctcccaagccagcgtggaggccggactggagccttgcatctccggcgcgtcgaatccggcggagcaaaaagtgctgaggagtctgaatgcgaatcagaggacgggatcgagggtgatgccgtgttatccgactacgaaagcgccgaagacagcgagggtgaggagggggaatatagtgaagaagagaacagcaaggtggaattaaaaagcgaagcaaacgacgccgtaaatagcagcaccaaggaggagaaaggagaggagaagcctgatacaaaatccaccgtgaccggagaacgacagtcaggcgacggccaggaatcaacagagcccgttgaaaataaggtcggcaaaaaaggccctaagcacctggacgatgacgaggacagaaaaaacccagcatacatcccgcggaaagggctgttcttcgagcacgatctgagaggtcaaacccaggaggaagaagtccggccgaaaggccgacagagaaagctctggaaagatgagggacgatgggagcacgataaatttcgtgaagacgagcaagcccccaaaagtcgacaggagctgatcgccctctacggctacgatattcgctcagctcacaatccagacgacatcaagccacgtagaatccgtaagccgcgctacggctcccccccacaacgggaccccaattggaatggagaaaggttgaataagtctcaccgccatcaggggctgggtgggacactgccaccccgtaccttcattaaccgtaatgctgccgggaccggccgcatgtcagctccaaggaactattcccggtcaggagggttcaaggaaggcagagcggggtttcgcccagttgaggcagggggccagcatgggggacgcagcggcgaaaccgttaaacacgagatcagctacagaagccgtaggttagagcagacgtccgtcagagatccatcgcccgaggcagacgctcccgtgttaggttcccccgaaaaagaggaagcggcctccgaaccacctgccgccgctccagatgccgcccctccacctcctgaccggcctatagaaaagaaaagttactctcgcgcccggcgcactaggaccaaggtcggtgacgccgttaagctggcagaggaagtgcccccccctcctgagggcttgatccctgcgcctccggtcccagagacaactccaaccccgcctaccaaaacaggtacttgggaggctcctgtcgattctagtacatccggactggagcaagatgtggcccagttgaatatcgctgagcagaactggtctcccggtcagcccagctttttacagcccagagagcttcgaggcatgccaaatcacattcacatgggggcgggcccacctccacagttcaaccgaatggaagagatgggggtgcagggtggcagagcgaagaggtacagctcgcagaggcaaaggccggtgcctgaaccccccgcgccccctgtccacatcagcattatggaaggacactattacgacccgctgcagtttcaggggccaatctacacgcatggtgactcccctgcccctctgcctccacaggggatgttggtgcagccagggatgaatctgccacacccggggctgcaccctcaccaaacaccagcccccctgcccaatccaggcttgtaccccccccccgtgagcatgagccctgggcagcccccaccccagcaactgctcgctcccacatatttctcagctcctggtgtcatgaacttcggaaatcccagttatccatatgctccaggagctctccccccgcccccccctccccatctctatcctaatacccaggctccttcccaggtgtacggcggggtaacttactataatcccgctcagcaacaggtacaaccgaagcccagcccacccaggcgtacaccccagcccgtcacaattaaacccccacctccagaggtcgtgtcgcgggggagttcctag

SEQ ID NO: 181489 - DNA, 2112 bp, Artificial Sequence
  Description of Artificial Sequence: Synthetic coding sequence
atggccgaccggcggcggcagcgggccagccaggacaccgaggacgaagagagcggcgcctctggatcggatagcggagggtcccccctgcggggaggcggtagctgctctgggtcagccggcggaggtggttctgggagcttaccgtctcaaaggggcggccgaacaggcgccctccacttgaggcgtgttgaatccggaggcgctaagtccgccgaggaatcagaatgtgagtcagaagacggcatagagggtgacgccgtcctgagtgactacgagagcgcggaggatagcgaaggggaggagggcgaatactctgaggaagagaatagtaaggtggagctgaaatcggaagcgaacgacgctgtcaacagctccacaaaagaggagaagggagaggagaagcccgataccaagagcacagtgacaggagaacgacagagcggggacggacaagaatccacggagccggtggaaaataaggtcggcaagaagggacctaagcacctcgacgacgatgaggataggaaaaaccctgcctatatcccaagaaaagggttgtttttcgaacatgacctgcgaggacagacccaggaagaggaggtgcgtcccaagggaagacaaagaaagctctggaaggacgagggaaggtgggagcacgataagttccgggaagacgagcaggcgccaaagtctcgccaggagttaatcgcactgtacggatacgatatccggagcgcacacaacccggacgacatcaagcctagaagaatccgtaaaccacgctacgggtcccctccccagagggacccaaattggaacggcgagaggctgaacaagagccacaggcaccagggcctgggaggtactctaccccctcgcacgtttattaaccgaaacgcggcaggcaccggcagaatgtctgccccacgtaactactcccgaagtggtggctttaaagaggggcgcgctggctttcgccccgtagaagcaggcgggcaacacggcggaaggagtggcgaaacagttaagcacgagatttcctacaggtcacgccgactggagcagacctccgttcgggatccctcacctgaggccgatgcgcccgtgctgggcagccctgagaaagaggaggcagcctcagaaccccccgcagctgctccagacgccgccccgccccctccggacagaccaattgagaagaagagctactcaagagcgcgcagaacacggaccaaggtgggagacgctgttaaacttgcagaagaagtcccccctccacctgaaggcttaatcccggctcctcctgtacccgaaaccactcctacaccacctactaagaccgggacatgggaagcacctgtggattcttcaaccagtggtctcgagcaggatgtggcacagctaaatatcgccgaacagaactggtccccagggcaaccctcctttctgcagccgagagaactgcggggtatgccaaaccacatccatatgggggccgggccaccccctcaatttaaccgcatggaggagatgggtgttcagggcggacgtgccaagagatactcatcccagcgacagaggcctgtacctgaaccacctgcaccccccgtccatatctcaattatggaaggacattactacgatcctctccaattccagggcccaatttacacgcacggcgactcgcctgccccactaccgccacagggaatgctggtgcagcccgggatgaatctccctcaccccggtctccatccccaccagacgccagctccacttcctaacccaggcctgtaccctccaccagtaagcatgtcacccggccaaccaccacctcagcaactgctcgccccaacctacttcagtgcgccaggagtgatgaatttcgggaacccctcctatccgtacgcccccggggccttgccgcctccgccacctcctcacctgtacccaaacacacaggcacctagccaggtgtacggaggtgtgacgtactataaccccgcccagcagcaggtgcagcctaagccttcccccccccgacggacgccccagcctgtgacaattaagcccccaccacctgaagtggtgtcacggggctcctcctag

SEQ ID NO: 181490 - DNA, 1926 bp, Artificial Sequence
  Description of Artificial Sequence: Synthetic coding sequence
atggccgaccggcggcggcagcgggccagccaggacaccgaggacgaagagagtggcgcgtctggcagcgatagtggaggatcccctctccgaggtggcgggtcttgttccggttcagctggaggcggcgggtctggaagcctgcctagccaacgaggagggaggaccggggccttacacctcagacgcgtggagtctgggggagccaagtcagcggaagaatctgagtgcgagtctgaagatgggatagagggcgacgcagtgttgagcgactatgagtcagccgaggacagcgagggcgaggaaggagagtatagtgaagaagaaaactccaaagttgagttgaaatctgaagctaacgacgctgtgaactccagcacaaaggaggagaaaggtgaagagaagccagacacgaagagcaccgtcacaggagaacggcagagcggggacgggcaggaatcaacagagcccgttgagaataaagtgggcaagaaagggcccaaacatttggacgatgacgaagataggaagaatcctgcatacattcctcgcaaggggttgttctttgagcacgatcttcgtggccagacgcaggaggaagaggtccgccccaagggacgtcaaaggaaactttggaaggatgaaggaagatgggaacatgataaattcagggaagacgaacaggcgccgaagagtcgccaggagctgatcgccttgtacggttacgacattaggtctgcacacaatcctgacgacatcaagcctagaaggatccgtaaaccaaggtacggatccccgccgcagagggacccaaattggaacggagagcggctgaataaaagccaccgccaccaagggctgggtggcaccttacctccccggacttttataaacagaaacgccgccgggactggtcgcatgtctgcccctagaaattacagtcgtagcggtggattcaaagagggccgagcagggttcagaccagtggaggcaggcggccagcacgggggacgctccggcgaaacagtcaagcacgaaatttcgtaccgctccaggagactggaacagaccagcgtcagagacccatccccagaggctgacgcacccgtacttggctcccctgaaaaggaagaggctgcctctgagcctccggctgccgccccggatgctgctccaccccctcctgatcgccccatagagaaaaagtcctacagtagggctcgccgtactcggaccaaggttggagacgcggtaaagttggctgaggaagtgcctcctcctcctgagggcctgattccagccccacctgttcccgaaaccactcctactccccctacaaagacaggcacgtgggaggctcctgtggattccagcacgagtggcctagaacaagatgtggcccaacttaacattgcagaacagaattggtctcccggccagcccagtttcctgcagccacgcgaattacggggcatgcccaaccacattcacatgggcgcagggccccctccccaattcaaccgcatggaagaaatgggggtccagggaggaagggcgaagaggtacagcagccagcggcaaagaccagtcccagagccccctgccccaccggtgcatatttctattatggagggccactactatgacccacttcaattccagggacccatttatactcacggagactctccagccccgctgccacctcaaggtatgttggtgcaacccggcatgaatctgccccaccccggcctacatccacaccagacacctgcgtgccccgacagccagactctccgtcattgcgagagttgcctttgctggtctacagtctttagttgcaaggacttcagcatgtgtgggggagtgttttgctactgcttcaaggggtgtcccttcgtcatatctatcgtcacctggcgatag

SEQ ID NO: 181491 - DNA, 543 bp, Artificial Sequence
  Description of Artificial Sequence: Synthetic coding sequence
atgcaggccgagggccggggcaccggcggcagcaccggcgacgccgatggaccaggcgggcccgggatcccggacggccccggagggaacgccggcggccctggggaagccggcgccaccggggggagaggtcccaggggtgctggcgccgcaagagcctccggcccagggggaggagctccacgagggcctcatggcggagccgcatccggtttgaatggttgctgcagatgcggcgctcgaggacccgagtccagattgctggaattctatctagcgatgcccttcgccacacccatggaggctgaactcgcacgaaggtcgttggcccaggacgctcctcccctcccagtaccaggagttttgctcaaggaatttactgtgagcggaaatatccttaccattcgtctcacagccgcagatcacagacagttacagttgtcgattagcagctgcctccagcagctttctcttctcatgtggatcacacagtgcttccttcccgtttttttggcgcagccaccctctggccagcgaaggtag

SEQ ID NO: 181492 - DNA, 570 bp, Artificial Sequence
  Description of Artificial Sequence: Synthetic coding sequence
atgaccgacaagaccgagaaggtggccgtggaccccgagaccgtgttcaagcgcccgcgcgagtgcgactcccccagctatcagaaacgccagagaatggctctgctggcccgaaagcaaggggccggagactctctgatcgcaggctcagccatgtcaaaagctaaaaaactcatgactggacacgcaattcccccttcccaactggacagtcagatagatgacttcacaggattctcaaaagataggatgatgcaaaaacccggatctaatgcgcctgtaggcggaaacgtgacctcaagctttagcggagatgatctcgagtgcagagaaactgcaagttcccctaaatcccagcgtgaaataaatgctgacatcaaacggaagctggtgaaagagcttagatgcgtgggacagaagtacgagaagattttcgagatgctagagggagtccagggccctaccgcggtgaggaaaaggttttttgagtccattataaaagaagctgcccgctgcatgcgaagggactttgtgaagcatctgaaaaagaaattgaaaagaatgatctag

SEQ ID NO: 181493 - DNA, 570 bp, Artificial Sequence
  Description of Artificial Sequence: Synthetic coding sequence
atgaccgacaagaccgagaaggtggccgtggaccccgagaccgtgttcaaaaggccccgtgagtgcgactctccttcatatcagaaacgccagagaatggccctgctggccagaaagcagggcgcgggggatagccttattgcaggctctgccatgtctaaagagaaaaagctcatgaccggtcacgccatcccgccctcccaattagacagccaaatcgacgacttcaccggcttctctaaagaccggatgatgcagaagcccgggtcaaacgccccagtgggtggcaatgtgacaagctccttttcaggcgatgacttggaatgtagggaaaccgctagcagccccaagtctcaacaagagataaatgcagatatcaagagaaagctggtgaaggaactccgctgtgttggccaaaagtatgaaaagattttcgaaatgcttgagggggtccagggccccacagcagtccggaagcgcttttttgagtctatcatcaaggaagctgcacgttgtatgcggagagacttcgtgaaacacttgaagaaaaagctaaagaggatgatctag

SEQ ID NO: 181494 - DNA, 570 bp, Artificial Sequence
  Description of Artificial Sequence: Synthetic coding sequence
atgaccgacaagaccgagaaggtggccgtggaccccgagaccgtgttcaagagacctcgggaatgcgacagtccgtcgtaccaaaaacggcagcgtatggctttgctggcacggaagcaaggggctggcgatagtctgattgcagggtccgccatgtccaaggaaaagaagttaatgacgggacacgccatcccaccctcacagctggactcccagattgacgacttcacaggttttagcaaggataggatgatgcaaaagcctggcagcaacgcaccggtggggggaaatgttacctcttctttctccggcgacgatttagaatgcagggaaaccgctagcagccccaaatctcaacaggagattaacgccgatataaagagaaagctcgtgaaggagctaaggtgcgtgggacagaaatacgaaaagatttttgaaatgcttgaaggagtgcagggccctacagccgtgcgcaaacggtttttcgagtcgataataaaggaagccgctcgatgtatgagaagagatttcgttaaacacctgaagaagaagctgaagagaatgatctag

SEQ ID NO: 181495 - DNA, 570 bp, Artificial Sequence
  Description of Artificial Sequence: Synthetic coding sequence
atgaccgacaagaccgagaaggtggccgtggaccccgagaccgtgttcaagcgaccccgcgagtgtgactccccatcttatcagaagcgtcaaagaatggcccttctcgcacggaagcagggagcaggcgactcgctcatcgcaggctcagcaatgagcaaagagaagaaactgatgacgggacatgcgatccctccctcgcagctggacagccagattgatgacttcacaggttttagcaaagatcgcatgatgcagaaacccggctcaaatgcgcccgttggaggcaacgtgacgtcatccttttctggggacgatctggagtgcagagagacagcttcgagcccaaaatctcagagagagatcaatgccgacataaaacgaaagctggtgaaggagctccggtgtgtcggacagaaatacgaaaaaatctttgagatgctggagggcgtgcagggacctactgccgtccggaaaaggttttttgagtccatcattaaagaggctgcccgatgcatgagacgggactttgttaagcatcttaaaaaaaagctgaagaggatgatttag

SEQ ID NO: 181496 - DNA, 570 bp, Artificial Sequence
  Description of Artificial Sequence: Synthetic coding sequence
atgaccgacaagaccgagaaggtggccgtggaccccgagaccgtgtttaaaagaccccgggagtgcgattcccctagctaccagaaaagacagcgtatggctctcctagcaagaaagcagggcgccggcgatagtctgattgccggcagcgccatgagtaaagagaaaaagcttatgaccggtcacgccattcctcccagccagctcgattctcagatcgatgactttactggattttctaaggatagaatgatgcaaaagcccggaagtaacgcccctgtgggcggcaacgttacttcttcgtttagtggcgacgaccttgagtgtcgggaaactgcctcgtctcctaaaagtcaacgggagataaacgctgacatcaaaaggaagctggttaaggagttgagatgtgttgggcaaaagtatgaaaagatcttcgaaatgctggaaggcgtgcaggggccaaccgctgtacggaagcggttcttcgagagtattatcaaagaggctgcgcgctgtatgcgtcgagactttgttaaacacctcaaaaagaaactgaagaggatgatctag

SEQ ID NO: 181497 - DNA, 570 bp, Artificial Sequence
  Description of Artificial Sequence: Synthetic coding sequence
atgaccgacaagaccgagaaggtggccgtggaccccgagaccgtgttcaaaagaccaagagagtgcgactccccttcctatcaaaagcgccagcgaatggcattgctggcaagaaaacagggcgccggcgattccctcatagctggctcagccatgtcgaaggagaaaaagctgatgaccggacacgcaattccgccctcgcaactggatagccaaattgatgatttcactggcttctccaaggaccggatgatgcagaagccagggtctaatgcccctgtaggtggaaacgtgacaagcagcttcagtggagatgaccttgaatgccgagagactgcatcgagccccaagtctcagcaggaaataaatgctgacattaaacgaaagttggtcaaagagttgcggtgcgttgggcaaaaatacgagaagatcttcgagatgctggagggggtgcagggcccaaccgcggtccgcaaacggttttttgagagcataattaaggaggcggcaaggtgcatgcgccgagactttgtgaagcatctaaagaagaagttaaagcggatgatctag

SEQ ID NO: 181498 - DNA, 570 bp, Artificial Sequence
  Description of Artificial Sequence: Synthetic coding sequence
atgaccgacaagaccgagaaggtggccgtggaccccgagaccgtgtttaagaggccgcgtgagtgtgacagtcctagctaccagaagagacagcgcatggccttgctggccagaaagcaaggggcgggcgactccctgatcgcgggcagcgctatgtccaaggcaaagaagctcatgactgggcacgcgattcccccaagtcaattggattcgcagattgatgacttcactggatttagcaaggataggatgatgcaaaagcccgggtcaaacgcccccgttggcggaaatgtcacttcctccttctcaggcgacgacctggaatgtcgagagaccgcgtccagcccaaagtcccagcaggaaattaacgctgacatcaagaggaagctggtgaaagaactccgctgtgtgggccagaagtatgagaagatattcgaaatgctggaaggcgtgcagggacccaccgctgtccgcaagaggtttttcgaatcaataataaaggaagcagcaagatgcatgcgccgggactttgttaagcacttgaaaaagaaactcaaacgcatgatctag

SEQ ID NO: 181499 - DNA, 570 bp, Artificial Sequence
  Description of Artificial Sequence: Synthetic coding sequence
atgaccgacaagaccgagaaggtggccgtggaccccgagaccgtgtttaagcggcccagagagtgtgacagtcccagttaccaaaagcgccaacgcatggcactcttggcgaggaaacagggagccggtgattccttgatcgctgggtcggctatgtccaaggcaaagaagttgatgactggtcacgccatcccaccaagtcaactggactctcagatcgacgactttaccggtttttctaaggatcggatgatgcagaagcccggctccaatgctcctgttgggggcaatgtgacttcgtccttctcgggggatgacctggaatgccgggagacggctagctcacccaaatcacagcaagagataaatgcggatataaagaggaagctcgtgaaagaacttaggtgcgtcggccagaagtacgaaaagatcttcgagatgcttgaaggtgtacaagggccaacagcggtgagaaagcgcttctttgaatccatcatcaaagaggccgcaaggtgcatgcgtagagattttgtgaagcacctgaaaaagaaattgaagcgcatgatttag

SEQ ID NO: 181500 - DNA, 570 bp, Artificial Sequence
  Description of Artificial Sequence: Synthetic coding sequence
atgaccgacaagaccgagaaggtggccgtggaccccgagaccgtgttcaaaagaccccgggaatgtgactctccctcttatcaaaagcgtcagagaatggctttactcgcgaggaagcagggtgccggcgattccctgatagcaggatcggctatgtcaaaagaaaaaaaactgatgaccggccacgccatccctcccagccaactcgatagccaaatcgatgacttcactggtttctcaaaggacggcatgatgcagaagccagggagtaatgccccggtgggcggcaatgtgaccagcaactttagcggggatgacctcgagtgccgggggatcgcctccagccctaaaagtcagcaggaaatcaacgcggacattaagtgtcaggtagttaaagagatcagatgcttggggagaaagtacgagaaaatctttgaaatgctcgaaggcgtccagggccccacagccgtacggaaacgattcttcgaaagcatcatcaaggaagccgctcggtgcatgaggcgagactttgttaaacatctgaagaaaaagctgaagcggatgatctag

SEQ ID NO: 181501 - DNA, 570 bp, Artificial Sequence
  Description of Artificial Sequence: Synthetic coding sequence
atgaccgacaagaccgagaaggtggccgtggaccccgagaccgtgtttaaacggccacgggagtgcgactctcctagctatcagaagcgtcagaggatggcactgctggctcgtaaacagggggcgggcgactccctgatcgctgggtcagcgatgtccaaagagaagaagctgatgaccggccatgccattccccccagccagctggactcacagattgatgactttaccggcttctctaaggatgggatgatgcagaaaccaggtagtaatgctccagtcgggggaaatgtcacctccaatttctctggcgacgacctcgaatgtagagggatcgcgtctagtccgaaaagccaacaggaaatcaacgctgatatcaagtgtcaggtggtcaaagaaattagatgtctcgggcggaagtatgaaaaaatcttcgagatgctcgagggtgtgcaagggccaacagctgttagaaagcggttctttgagtctatcataaaggaagccgcgagatgcatgagaagagacttcgtcaagcatctgaagaagaaactgaaaagaatgatttag

SEQ ID NO: 181502 - DNA, 570 bp, Artificial Sequence
  Description of Artificial Sequence: Synthetic coding sequence
atgaccgacaagaccgagaaggtggccgtggaccccgagaccgtgtttaaacgcccgagagagtgcgattcaccatcctaccagaagcgccagcgaatggctctcctcgcccgaaagcagggggccggtgatagcctgatcgctgggtcagctatgtccaaggcaaagaaactgatgacaggacatgctatcccaccatcccaactggacagtcagatagatgacttcactggctttagcaaagatcgcatgatgcagaaaccaggtagcaacgcaccggtgggggggaacgtaacgagctccttctcaggcgacgacctggagtgtcgagagaccgcatcctcacctaagtcccaacaggagatcaacgccgacattaagaggaaactggtgaaggagcttagatgtgtaggccagaagtatgaaaaaatcttcgagatgctcgaaggtgtccaggggcccacagccgttcgcaagagattcttcgaaagcatcattaaggaggccgccagatgcatgagacgcgattttgtcaaacacctcaaaaagaagctgaagcgcatgatctag

SEQ ID NO: 181503 - DNA, 570 bp, Artificial Sequence
  Description of Artificial Sequence: Synthetic coding sequence
atgaccgacaagaccgagaaggtggccgtggaccccgagaccgtgttcaagcgccctcgcgaatgtgattcaccttcatatcaaaagcggcagcgcatggccctactggcccgaaaacaaggagccggagatagcctgatagctgggagtgccatgtcgaaagccaaaaaactcatgaccggccatgccattccgccaagccagctggactcccagatagacgactttacgggattttccaaggaccgcatgatgcaaaagcccggaagtaacgctcctgtgggcggcaatgtgactagctcgttttcaggagatgacctcgaatgcagagagactgcctcttcgcctaagtcgcagcaggagataaatgccgacattaagagaaaactcgtgaaagagctgagatgcgttggccagaaatatgaaaaaatcttcgaaatgttggagggagtacagggaccaaccgctgttagaaaaagattttttgaatccattattaaagaggctgctcggtgtatgcgccgcgacttcgtgaagcacctcaaaaagaagttaaaaaggatgatttag

SEQ ID NO: 181504 - DNA, 867 bp, Artificial Sequence
  Description of Artificial Sequence: Synthetic coding sequence
atgagcgccaccggcgaccggcaccccacccagggcgaccaggaggcccctgtgagccaggaaggcgcccaggctgaagcagcgggtgcgggtaatcaggagggtggcgattccgggcctgactcctccgatgtggtcccagcggcagaagtagtaggcgtggccggaccagtcgagggcctcggggaagaagagggcgagcaggccgccggcctagccgcagttcctcgagggggatctgccgaggaggatagcgatattggaccagccacggaagaagaggaggaagaggagggcaacgaggcggccaatttcgacttagccgtggtggcccggcgctatcccgcctccggcatccattttgttttattggatatggttcattctctactccatcgcctgtcacataatgaccacattttgatcgagaacaggcagctgagtcggttgatggtcggacctcatgccgctgctcgtaacttatggggaaacctcccgcccctgcttctgcctcagcgattgggcgccggcgcagctgctcgcgccggcgagggcctgggcctcattcaagaggcggcctcagttcctgaacccgccgtaccagcggacctcgctgaaatggctcgcgaaccagctgaggaagcagctgaagagaagctttcagaggaagctaccgaggaaccagacgccgaagagcctgcaacagaagagcccactgcccaggaggcaaccgccccagaggaggtcaccaaatctcagcctgaaaaatgggatgaagaagcccaggacgcggctggtgaggaggagaaagaacaggagaaagaaaaggatgccgagaataaggtgaagaattctaagggaacttag

SEQ ID NO: 181505 - DNA, 867 bp, Artificial Sequence
  Description of Artificial Sequence: Synthetic coding sequence
atgagcgccaccggcgaccggcaccccacccagggcgaccaggaggcccccgtgtcacaggaaggggcccaggccgaggccgctggcgccggaaaccaggaagggggtgattccggacctgattcatcagacgttgtgccagccgccgaagttgttggcgtcgccggacctgtagaggggctcggcgaagaagagggagagcaggcagccgggttggctgccgtgcccagaggtggttcagccgaggaagattcggacatcggtccagccacagaagaggaagaggaggaagagggaaatgaggcagccaattttgatctggccgtggtagctcgcaggtacccagcaagcggcatccactttgtactgctggatatggtacattccctgctgcaccggttatcccacaatgatcacattttgatagagaatcgccagctaagccgattaatggtggggcctcatgccgcggcacgtaacctttggggtaacctaccccccctgttgctcccccagagacttggggctggggcggctgcaagagcaggcgagggtcttggccttatacaagaggccgccagcgttcctgagcccgccgtaccggccgacttagccgagatggcccgcgagcctgcggaggaggcagccgaggaaaagttaagtgaagaagcgacagaagagccagatgcagaggagccagccaccgaggaaccgacggcccaggaagctaccgctcccgaggaggtcacaaagtctcagccagagaagtgggacgaagaggctcaggatgctgctggagaggaggagaaggaacaagaaaaagagaaagacgccgaaaataaagtgaaaaacagcaaaggaacttag

SEQ ID NO: 181506 - DNA, 867 bp, Artificial Sequence
  Description of Artificial Sequence: Synthetic coding sequence
atgagcgccaccggcgaccggcaccccacccagggcgaccaggaggctcccgtctcccaggagggcgcccaggccgaggctgcgggagcgggtaatcaggagggtggagacagcggacccgatagctcagatgtagttccagcagccgaagtggtgggggtcgctggtccggtcgaaggacttggcgaagaggaaggagagcaggcggctggtctggccgctgttccacgtggtggtagcgccgaggaagacagtgacatcgggcctgctaccgaggaggaagaagaagaagagggaaatgaggcagcaaatttcgatttagccgtggtggcccggcgctaccctgcttcaggaatccactttgtgctgctggatatggttcacagcctgcttcaccgcttatctcacaatgaccacattctgattgagaataggcagttgagtagactgatggtggggcctcatgcggccgcaagaaacctctggggcaatcttcccccactgttgctgcctcaacgactaggagccggggcagccgcacgcgctggggaggggctaggtcttattcaggaagccgctagtgtccctgagcccgctgtgccagcagacctcgccgagatggcccgggagcctgccgaagaggccgcagaggagaaactgagcgaagaggccaccgaggaaccagacgcagaagaacccgctactgaagaacccactgcccaggaagccaccgctcctgaggaggtgactaagtctcagccagagaagtgggatgaagaagctcaggacgcagctggcgaggaagagaaggagcaggagaaggagaaagatgccgagaataaagtaaagaattcgaaaggcacatag

SEQ ID NO: 181507 - DNA, 867 bp, Artificial Sequence
  Description of Artificial Sequence: Synthetic coding sequence
atgagcgccaccggcgaccggcaccccacccagggcgaccaggaggctcctgtgagccaggagggagcacaggctgaggcagctggagccggcaaccaggaggggggggattctggaccggactctagcgacgttgttccggccgcagaggtagtcggcgttgccggtcctgtcgaggggctgggagaggaagagggggaacaggcggctggcctggcggccgtgcctagaggtggctccgcggaagaggacagcgatattggccccgctacagaggaagaggaggaggaggaggggaatgaagccgctaatttcgacctcgccgtggtggcccggcgctaccctgcttcggggattcattttgtactcttggatatggtgcattctctactccaccgcttatctcacaatgaccatatcctgatcgaaaacaggcaactgtctcggttgatggttggtccccatgcagctgcacgcaacttgtgggggaatctgccacccctgctcctgcctcagagactgggcgctggcgcggccgccagagccggagaaggactagggttgattcaggaggccgcctctgttcccgagcctgccgtccccgctgatctagctgaaatggcccgagagccagccgaggaggctgcagaggagaagctttctgaggaggcaacggaggaaccagatgctgaagaacccgccacagaggagccgaccgcacaggaggctacagcccctgaggaggtcaccaagtcacaaccggagaagtgggatgaagaggcccaagatgccgcaggcgaagaggagaaggaacaagagaaggagaaggacgctgagaacaaggtcaaaaatagcaaagggacctag

SEQ ID NO: 181508 - DNA, 867 bp, Artificial Sequence
  Description of Artificial Sequence: Synthetic coding sequence
atgagcgccaccggcgaccggcaccccacccagggcgaccaggaggccccggtcagccaggagggggcacaggctgaagccgccggagccggtaatcaagaaggtggagacagcgggcccgactcttcagatgtagtgcctgccgctgaggtcgttggggtggccgggcctgttgagggcctcggagaagaagagggagagcaggcggccggcttagccgcagtgcctcgaggtggcagtgccgaagaggacagcgacatcgggcctgctaccgaagaagaggaggaagaggagggaaacgaggccgcaaattttgacctcgctgttgttgctcggcggtatcccgctagtgggattcacttcgtactgttagatatggtgcactcccttctgcacaggctgagccacaatgaccacatcctcattgagaatcgccagctcagccgactcatggtaggcccccacgctgcggctcgaaacctgtggggaaatctaccgcctctgttgctgccacagagactcggagctggggcagcggccagagcgggcgagggcttgggccttattcaagaggccgccagcgttcccgagccagctgtcccagccgatctggctgagatggcaagggagccagctgaggaagcggccgaggagaaactttcagaagaagctaccgaggaacccgatgccgaagagccagctaccgaagagcctactgcccaggaggccacggcacctgaggaagtcactaagtcccagcctgagaagtgggacgaagaagcccaggacgctgccggcgaagaagaaaaggaacaagaaaaggagaaagatgccgagaataaagttaagaactcaaaagggacctag

SEQ ID NO: 181509 - DNA, 867 bp, Artificial Sequence
  Description of Artificial Sequence: Synthetic coding sequence
atgagcgccaccggcgaccggcaccccacccagggcgaccaggaggcacccgtgagccaggaaggcgcacaagcagaggcagccggcgcaggaaaccaggagggaggtgactcaggtcctgactcaagtgatgtagtgcctgccgcagaggtggtgggtgttgccgggcctgtggagggactcggggaagaggagggggaacaagccgccggactggccgcggtgccacgagggggttctgctgaggaagacagcgatatcgggcccgccaccgaagaagaagaggaagaggaaggtaacgaagcagctaatttcgatttggccgtggttgcgcggcgatatccagcctccggtattcactttgttcttttggacatggttcattcactgttgcataggctgtctcataacgatcacattctgattgaaaatagacagctgtcccggctaatggtggggcctcatgctgccgctcggaatctgtggggtaaccttcctccattgctgcttccacaacgcctcggagcaggagccgcagcccgggcgggggaaggactggggctaatacaagaggccgcatccgtgcctgagccagcagtacctgctgaccttgccgaaatggcaagggagccggccgaggaggctgcagaagaaaagcttagcgaggaagctacagaggaacctgatgctgaagaacccgccacggaggaacccacagcccaggaagccactgctccagaagaggtgaccaagagccagccagaaaaatgggatgaggaggcgcaggacgccgccggagaggaagagaaagagcaggaaaaggaaaaagatgccgaaaacaaagtgaagaattctaagggcacatag

SEQ ID NO: 181510 - DNA, 867 bp, Artificial Sequence
  Description of Artificial Sequence: Synthetic coding sequence
atgagcgccaccggcgaccggcaccccacccagggcgaccaggaggctcccgtgagccaggagggcgcccaggctgaggcggcaggggcgggcaatcaggaagggggtgactccgggcccgactctagtgacgtggtccccgccgctgaagttgtcggcgtcgccggacccgtggaaggcctgggggaggaagaaggagaacaagccgcggggctggccgccgtgcccagaggagggtctgccgaagaggactcagatatcggccccgctacagaggaagaggaagaagaagagggtaacgaagccgccaactttgatcttgctgtggtcgcgcgtcgctatccagctagcgggatccattttgtgctgctggatatggtgcactcactgctgcaccgcctcagtcataatgaccatatactcatagaaaacagacagctctctagattgatggttggtccccatgctgcagctcggaacctctggggcaacctccccccccttcttttgccacagcgtctgggcgccggcgccgccgcaagggcaggtgagggattggggctgattcaggaagctgcgtcagtccctgagcccgctgtaccggcagatctggcagaaatggctagagaacctgcagaggaagctgccgaggagaaactcagcgaagaggccacagaagaacccgatgccgaagaacctgccacagaggagccaactgctcaggaggcaacagccccagaagaagtgacaaaatcacagcctgagaagtgggacgaagaagcccaagacgccgcaggtgaggaagagaaggagcaggagaaagaaaaggacgccgagaacaaagtcaaaaattctaaagggacttag

SEQ ID NO: 181511 - DNA, 867 bp, Artificial Sequence
  Description of Artificial Sequence: Synthetic coding sequence
atgagcgccaccggcgaccggcaccccacccagggcgaccaggaggcaccagtctcccaggaaggtgcccaagccgaagccgccggcgcaggaaatcaggaaggtggagatagtgggccggattccagcgacgtggtaccggcggccgaggtggtgggtgtggccggaccagtcgagggcctcggagaagaagaaggcgagcaggccgctggactggctgcagtgccccgcggcgggagcgctgaagaagacagcgacatcggccccgccaccgaagaggaggaagaggaggaaggcaatgaggcagcgaactttgatctcgccgttgttgcacgccgctatcccgcctccggcattcattttgtgctgctggatatggtccactccctccttcacagactctcgcataatgatcatatcctcattgagaatagacagctctcacgattgatggtcgggccacatgctgcagcccggaacctctggggaaacttgccaccgttgctcctcccccaacggctaggcgccggcgcagccgctagggccggcgaggggctcgggctcatccaggaggccgcgagcgtccctgaacctgcagtgccagctgatctagcggagatggctagagaacccgctgaagaagccgccgaagagaagctgtccgaggaagccactgaagagcctgatgccgaggagcccgcaactgaggagccaaccgcacaagaggccacggcgcctgaagaggtaacaaagtctcagccagagaagtgggatgaggaggcacaggacgccgctggggaggaagaaaaggagcaggagaaggaaaaagatgcggagaataaagtgaagaactcaaaaggcacttag

SEQ ID NO: 181512 - DNA, 867 bp, Artificial Sequence
  Description of Artificial Sequence: Synthetic coding sequence
atgagcgccaccggcgaccggcaccccacccagggcgaccaggaggcacctgtatcccaggagggcgctcaggcggaggcggccggcgcaggcaaccaagaaggcggcgattccgggcccgactctagtgacgtcgtacctgcagcagaggtagtgggagtggcagggccagttgaaggactaggagaggaggagggcgaacaggcggctggtttagctgccgttccaagaggcggctccgccgaagaggattcagatatcggccctgctactgaagaggaggaggaagaggagggcaatgaggcagctaattttgatctggccgtggtcgccagacgctacccagcatccgggattcactttgttttgctggatatggttcacagtctccttcatagactgagccacaacgatcatatcctgatcgagaataggcagctgtctcgcctgatggtgggaccacacgctgctgcacgcaacctgtgggggaacctcccgcctctgcttctgccccagcggttgggcgcgggcgcggctgctcgggccggagagggcttgggcctaattcaggaggcggcctcagtcccagagcctgccgtgcctgccgatctggctgagatggcccgggaacctgcagaggaggcggcagaagagaaactatccgaagaagcaactgaggaaccagacgccgaagagccagcaactgaggaacccaccgcacaagaagcaacggcccccgaggaggtgacaaagagtcagccagagaagtgggacgaggaagctcaggatgccgctggcgaagaagagaaggagcaggagaaggaaaaggatgcagaaaataaggtaaagaactctaaagggacttag

SEQ ID NO: 181513 - DNA, 867 bp, Artificial Sequence
  Description of Artificial Sequence: Synthetic coding sequence
atgagcgccaccggcgaccggcaccccacccagggcgaccaggaggcccccgttagtcaggaaggcgcccaggctgaggcagctggggcgggaaaccaggaaggcggggattctgggcccgactcatctgatgtggtacccgcagccgaggttgttggagttgccgggcctgtcgaaggtttgggcgaggaggagggggaacaagccgcaggactggctgccgttcctagaggcggcagcgccgaagaagatagtgatatcggcccggcaaccgaggaggaagaggaggaagaggggaacgaggccgccaattttgatctggctgtcgtcgctaggcgataccccgcgagtggtatacactttgtccttctagacatggtccacagcttactgcatagactctctcacaatgatcacattctcatcgagaacaggcaactcagtagactgatggtcggaccccatgccgctgcccgaaatctgtggggaaatctgcctcccctgcttctccctcagagactcggtgctggagctgccgccagagcgggagagggcctggggctcatccaggaggctgcgtccgtccccgaacctgctgtaccagccgatcttgccgaaatggccagagaacccgccgaggaggctgccgaggaaaagctttctgaggaggccaccgaggaacctgatgcagaagagccagctactgaagagccaacagctcaagaggctaccgcccctgaggaggtaactaagtcacagcccgaaaagtgggatgaagaagctcaggatgctgcgggggaggaagaaaaggagcaggagaaggagaaagacgcggagaataaggttaaaaactccaaaggcacatag

SEQ ID NO: 181514 - DNA, 867 bp, Artificial Sequence
  Description of Artificial Sequence: Synthetic coding sequence
atgagcgccaccggcgaccggcaccccacccagggcgaccaggaggcgcccgtgagccaggagggtgcccaagcagaagcagctggggctggcaaccaagaaggaggtgattccggccccgatagctcggacgtggtgccggccgccgaagtggttggagttgccgggcccgtggaaggactcggcgaggaggagggcgaacaggcggccgggttggccgccgtgcctcgcggcggctctgccgaagaggactccgacattggccctgcaaccgaagaagaagaagaggaagaaggtaacgaagcagccaattttgacctagccgtcgtggcccggaggtatcctgccagcggaattcattttgttctgctggacatggtccacagcctcctgcaccggctgtctcataatgatcatatcctcatcgagaatcgacaactctccagacttatggtcggtccacatgccgctgcgagaaacctgtggggaaatttgcctccactcctgctgcctcagaggctcggtgctggggccgctgctagagcaggcgaaggcttaggtttgatacaggaggccgcaagtgttcccgaaccagcagtgcccgcagatttggcagagatggcccgggaacctgccgaagaggccgccgaggagaagctctctgaggaagcaactgaggagccagacgcagaagaacctgctaccgaagaacccactgctcaggaggccaccgcccctgaagaggtcaccaaatcacaaccggagaagtgggacgaagaagcgcaagatgcagccggcgaagaggagaaggaacaggagaaggagaaggatgcagaaaacaaagtcaagaattccaaagggacctag

SEQ ID NO: 181515 - DNA, 867 bp, Artificial Sequence
  Description of Artificial Sequence: Synthetic coding sequence
atgagcgccaccggcgaccggcaccccacccagggcgaccaggaggcacctgtttcacaggagggtgctcaagcggaagccgccggggcaggtaatcaggaggggggagactctgggcccgactcatccgacgtggttcctgccgccgaggttgtgggggtggctggacccgtggaaggcctgggagaggaggaaggggagcaagccgccggcctggccgcagtgccccgcgggggctcggctgaggaagatagcgatatcggtcccgcaacggaggaggaggaggaggaagaagggaatgaagccgccaactttgatctcgcggtcgttgcccggcggtatcccgcctcaggaattcacttcgtgcttctggatatggtccactccctgctgcatcgcttgagtcacaatgatcacatcctgattgagaatcggcagctgagccgcttaatggtgggccctcatgctgcagctagaaatctgtgggggaacctccctccactgctgctgcctcaacggctgggtgctggagcagcagcccgcgccggagaaggactgggattaatccaagaagccgcctcagtgcccgaacctgctgttcccgcagatctcgctgaaatggcaagggagccagccgaggaggctgcagaggaaaagctctccgaggaggcaactgaggagcctgatgctgaggaacccgcgacagaggaacccaccgcgcaggaagcgaccgcacccgaggaggtgaccaaatcccaacctgaaaagtgggacgaggaagcccaggatgctgcaggcgaagaggaaaaagagcaggagaaggagaaggatgcagaaaataaggtgaagaactccaagggaacatag

SEQ ID NO: 181516 - DNA, 867 bp, Artificial Sequence
  Description of Artificial Sequence: Synthetic coding sequence
atgagcgccaccggcgaccggcaccccacccagggcgaccaggaggcccctgtctcacaggagggagcgcaggccgaagcggcaggcgctgggaatcaggaagggggtgatagcggccctgatagcagtgatgttgtgccagccgccgaggtggtgggcgttgctgggccggtcgagggactgggcgaggaggagggcgaacaggcagctggtctagccgccgttcctagggggggttctgctgaggaggattcagacatcgggcccgctaccgaagaggaagaagaggaggaaggcaacgaggcagcaaacttcgacctggccgtggttgcccgacggtaccccgcttccggcatacacttcgttcttttggatatggtgcactccctcctgcacagactcagccacaacgatcacattcttattgagaacaggcagctaagccgtctgatggttggaccgcacgccgccgcacggaacctttggggcaaccttcctcccctgctgctgcctcaacgacttggcgcaggggctgctgctagagctggagaagggctaggcctcattcaggaggctgcatctgtgccagaacctgctgtgccagccgacttggccgagatggctcgggaaccagcggaagaggctgccgaagagaagcttagcgaagaggccacggaagaacctgacgccgaggagccggccaccgaggagcccacagcccaggaggctacagctcccgaggaggtgaccaaatcacaaccagagaaatgggatgaagaagcccaggacgccgccggtgaagaagaaaaggagcaggaaaaggagaaggacgctgaaaataaagtgaagaattccaaaggcacgtag

SEQ ID NO: 181517 - DNA, 867 bp, Artificial Sequence
  Description of Artificial Sequence: Synthetic coding sequence
atgagcgccaccggcgaccggcaccccacccagggcgaccaggaggccccagtctcccaagaaggggcccaggccgaggccgccggagctggcaaccaggaaggaggagattccggccctgatagtagtgacgtagtgcctgcggcagaggtggtgggcgtggcagggcctgtagaaggcctaggcgaggaagaaggggagcaggccgcggggctcgctgccgtaccaaggggggggtctgctgaggaagattctgatatagggcctgccaccgaggaagaagaagaagaggaagggaacgaggcagctaacttcgatctggcagtggtcgctagaaggtatccagctagtggcattcattttgtgctgttggatatggtacactctctgctgcaccgtctgagccacaatgatcacattctgatcgagaatcggcaactgtcccgcctcatggtgggaccccatgctgccgcaagaaatctttggggaaatctgccacctctgctcttgccgcaacggttaggggccggagctgcagcccgggctggcgagggcttagggctgatccaagaagccgccagcgttcctgaaccagccgttcccgcagatctggctgagatggcacgcgagcccgcagaagaggcggcagaagagaaactgtcggaggaggccacggaagagcccgatgcggaggaaccggctaccgaggaaccaaccgcacaggaggcaaccgctccggaggaagttaccaagagccagccagagaagtgggacgaagaggcccaggacgctgcaggagaggaggagaaggaacaagagaaggagaaagacgctgaaaataaagtcaagaactcaaagggcacgtag

SEQ ID NO: 181518 - DNA, 900 bp, Artificial Sequence
  Description of Artificial Sequence: Synthetic coding sequence
atgagcgccaccggcgaccggcaccccacccagggcgaccaggaggcaccagtttctcaagagggcgcacaggcggaggccgcaggtgccggcaaccaagagggaggggactcaggccccgatagctcggatatggtccccgccgctgaagtggtgggtgtggccggacctgttgaaggccttggggaggaggagggagaacaggcggccggtctggctgctgttcctcaaggcggctccgccgaggaagattccgatatcggacctgctacagaagaagaagaagaggaagaggaagggaatgaggctgctaattttgatcttgccgtcgccacacgccgatatccagcggccggaatcggtttcgtgttcctgtatcttgtgcattctctgctgcggagactctaccacaatgaccacatccaaattgccaaccggcacctgagccgcctgatggtcggacctcacgccgccgtccccaacctgtgggataacccccccctgctgctcttgtctcagcgattaggcgctggtgccgccgctccggagggcgaaggtttaggactcattcaagaggctgcttccgttcaagaggctgcttctgtgccggagcctgctgtcccggccgacttggcagaaatggcccgcgaacccgcagaggaggccgccgatgaaaaaccgcctgaggaggctgctgaggagaaattgaccgaggaagccacggaggagcccgccgccgaagaacctacatctgaggaagccgttgccccggaagaggttacaaaaagccagcctgaaaagtgggacgaagaggcacaggatgctgccggcgaggaagagaaagaacaagagaaagagaaggatgtcgaaaacaaagtcaagaacagtaaaggaacttag

SEQ ID NO: 181519 - DNA, 1419 bp, Artificial Sequence
  Description of Artificial Sequence: Synthetic coding sequence
atgaagagcatcctggacggcctggccgacaccaccttccggaccattactactgatctgttgtatgttggtagtaacgacattcagtatgaagatataaagggagacatggcctctaagcttggctactttccacagaaattccccttaaccagttttcgcggaagccccttccaggagaagatgaccgccggcgacaaccctcagctggtgcccgcagaccaggtcaacatcaccgagttctataacaagagcctgtcatctttcaaggagaatgaggaaaacattcagtgcggagagaactttatggacatagagtgtttcatggtactaaatcccagccagcagctggccatcgccgtattgtcactcaccttgggaaccttcaccgtgctggaaaacttactagtgctctgtgtcatcctgcactccaggtctctgcgctgtagaccctcgtatcatttcatcggctcactggccgtagccgacctgcttggaagtgtgatttttgtatattccttcattgacttccatgtcttccacagaaaagactcacggaacgtgtttttgttcaaattagggggcgtcaccgcaagctttactgcaagtgtggggtctctgttccttactgctatcgaccggtatataagcatacaccgccctttggcctataagcgtatcgtgacccgacctaaagctgttgtggctttctgcctcatgtggactatcgccattgttatcgccgtattacccctcctgggatggaattgtgaaaagttgcagtctgtgtgctccgacatctttccccacatagatgaaacctacctcatgttctggattggtgttacaagtgtgctcctgctgttcatcgtctacgcctacatgtacatattatggaaggctcactctcacgccgtccggatgatccaaagaggtacacagaaatccatcattattcatacgagcgaagacggaaaggtacaagtcaccagaccggatcaggcccggatggatatccgcctcgccaagaccttggtgcttatattagtcgttctgattatctgctggggccccttgctggctatcatggtatacgatgtctttggaaagatgaataaactgattaagaccgtttttgccttctgctccatgctgtgcctgttgaactctacggtgaatccaataatctacgctttgcgctccaaggatctcaggcacgcgttcaggagtatgtttccttcatgcgagggaaccgcacaacctctcgataattcaatgggcgattccgactgtttgcataaacacgccaacaatgcggctagcgtgcaccgcgccgctgaaagctgtatcaagagcactgtgaagatcgccaaagtcaccatgtctgtttccaccgacacatccgcggaagctctttag

SEQ ID NO: 181520 - DNA, 1419 bp, Artificial Sequence
  Description of Artificial Sequence: Synthetic coding sequence
atgaagagcatcctggacggcctggccgacaccaccttccggaccattactaccgatctgctgtatgtgggcagcaacgatatccagtatgaggatattaagggagacatggcctccaaactggggtacttcccacaaaagttcccactgaccagcttccgaggcagtccatttcaggagaaaatgactgccggagataatcctcaactggtgccagcagatcaggtcaacatcaccgaattctacaacaagtcactgtctagttttaaggaaaacgaagagaatatccagtgtggtgagaatttcatggacatagaatgttttatggttctcaatccgagccagcagctggcaattgccgtactttcacttactctgggcacttttaccgtcctcgagaatctcctggtgctgtgcgtgattctccactcacggtccctgaggtgcagaccttcataccatttcattggcagcctggccgtagccgacctactcggtagtgtcatctttgtgtattcttttattgacttccatgtgttccacaggaaagactctagaaatgtgtttctgtttaaactggggggagttacagcctcgttcactgcctccgtgggaagcctcttcctgactgccattgataggtacatcagcatccacaggccccttgcgtataaaaggatcgtgactcgacctaaagccgtggtcgctttctgtcttatgtggacgatcgccatcgttattgccgtcctccctctgttggggtggaattgtgagaaattgcagtccgtttgctccgacatctttccccacatcgacgagacttacctcatgttctggataggcgtcacctctgtcctgcttttgttcattgtttatgcctatatgtatatcctatggaaggcacacagccacgccgttaggatgattcagcggggaacacagaagtccattattatacacacctccgaggatggaaaagtacaggtgactcgaccggatcaggctcggatggatatcagattggccaagactctcgtgctgatcttagtcgtgcttattatctgttggggccctctgcttgcaattatggtgtatgacgtcttcggcaaaatgaataagctcatcaaaacagtattcgctttctgttctatgctttgtctcctgaactccaccgtaaatccgatcatctacgccttacggagcaaagacctcagacatgcctttcgatctatgtttcccagttgcgaggggaccgctcaacctctggataacagtatgggcgattctgattgcttgcacaagcacgctaataatgctgccagcgtacaccgcgccgccgaatcatgtataaaatctacagtgaaaattgcaaaggtcactatgtctgtctcgactgatacctccgctgaagctttatag

SEQ ID NO: 181521 - DNA, 1419 bp, Artificial Sequence
  Description of Artificial Sequence: Synthetic coding sequence
atgaagagcatcctggacggcctggccgacaccaccttccggaccatcaccaccgatcttttatatgtggggtccaatgacatccagtatgaagatatcaaaggcgacatggcaagcaaattggggtacttcccgcagaagtttcctcttaccagcttccggggaagtccctttcaggagaaaatgaccgcaggcgacaacccacagctggtacccgccgaccaggtcaacataactgaattttataacaaaagcttgtcttccttcaaagagaatgaggagaacattcaatgtggagaaaatttcatggatattgagtgctttatggtcctcaacccttcccagcagcttgcgatagctgtgctgtccttgactctcgggacctttacggtattagaaaatctgttggtcctctgtgtgatcctgcattcccgttcacttcgctgcagaccaagctatcacttcataggttctcttgccgtcgcggaccttttgggctctgtaatatttgtctattcattcatcgattttcatgttttccaccgtaaggattcccgaaacgtgttcctgttcaagctgggtggcgttactgcttcatttactgctagcgttggtagcttatttctcacggcaatcgacaggtatatttcaatacaccgtcctctggcctataaaaggatcgtgacgcggccgaaggcagtggtggctttctgtttaatgtggacgatcgcaatcgtcatagcagttctgcccctgctcggctggaattgcgagaagcttcagtccgtttgttctgatatctttccacatatcgatgagacttatctcatgttttggatcggagtaacctccgtcctgttactgttcattgtctacgcctacatgtacattttgtggaaggcgcacagccatgctgtccggatgatccaaagaggaacacagaaatcaattatcatccacactagcgaagatggcaaagtgcaggtgactagaccagatcaggccagaatggacattaggcttgctaagaccctcgttctgatcctggttgttctgataatatgctggggaccgctcctggcaatcatggtctatgatgtcttcgggaagatgaataagctgatcaaaactgtttttgcgttctgctccatgctatgcttgttgaacagtacagtgaatcccatcatctacgccctccgcagcaaggacctgcgccacgcttttcggtctatgttcccaagttgcgaaggaacggcccaacctctggacaacagcatgggcgactctgactgcttgcacaaacacgcaaataacgctgcgtctgttcatcgtgctgccgagagctgcatcaaatcaactgtcaaaattgcaaaggtgacaatgtccgtgagtaccgacaccagcgctgaggctctgtag

SEQ ID NO: 181522 - DNA, 1320 bp, Artificial Sequence
  Description of Artificial Sequence: Synthetic coding sequence
atgaagagcatcctggacggcctggccgacaccaccttccggaccatcacaacagacctgctgggttccccctttcaggagaaaatgactgccggggataaccctcagttggttccagctgaccaggtcaacattactgaattctacaataagtcactctctagttttaaggagaacgaagaaaacatacagtgtggcgaaaattttatggacattgaatgtttcatggtgctcaaccctagtcaacaactggctattgcagttctttccctcacactgggaacattcaccgtgcttgaaaatctgctagtcctgtgtgtgatactgcacagtagaagcctgcgatgccggccctcatatcattttattggatctcttgctgtggccgacctcctgggaagcgtgattttcgtatacagcttcattgactttcacgtcttccatagaaaggactcacgaaatgtcttccttttcaagctcggcggggtgacagcctcatttaccgcatcggtcggaagtctgttcctgacagcaattgacaggtatatctcgatccaccgccccctcgcctataaacggatcgtcacccgccccaaggcagtggtggccttctgtcttatgtggaccattgctatcgtaatcgccgtcctcccgttgctggggtggaactgtgagaaactgcagagcgtgtgcagtgacatttttccacatatagatgaaacctatctgatgttctggataggtgtgacctccgtgcttttgctcttcatcgtttatgcatatatgtatatattgtggaaagctcacagccatgcggtgcgcatgatccagcgtggcacccagaagtctattattatccatacaagtgaggacgggaaagtgcaggtgacccggccggatcaggcacgcatggacatcaggctggcaaagacccttgtcttgatcctcgtagtcctgatcatttgctggggtcccttactggctatcatggtgtatgacgtttttgggaagatgaacaaactaatcaagactgtgtttgctttctgcagcatgctctgcctcttaaatagcaccgtgaaccctatcatatacgccctgcgctcaaaggacttgcggcacgctttcagatctatgtttccaagctgcgaggggacagctcagccgctcgacaattctatgggcgacagtgattgcctccacaagcacgccaacaacgccgccagcgtgcaccgcgccgccgagtcctgtatcaagtccactgtcaagatcgccaaagtcacaatgtccgtgtcaaccgacacgtctgcagaggctctgtag

SEQ ID NO: 181523 - DNA, 1419 bp, Artificial Sequence
  Description of Artificial Sequence: Synthetic coding sequence
atgaagagcatcctggacggcctggccgacaccaccttccggaccatcaccacagatctgctgtatgttgggtccaatgatattcaatacgaagacattaagggtgacatggcttcaaaacttggatactttccccagaaatttcctctgacttccttcagaggaagcccatttcaggaaaagatgacagccggcgacaatcctcagctggtacctgccgaccaggtcaacattaccgaattttacaataaatccttgagttctttcaaggaaaatgaagagaatattcagtgcggcgaaaattttatggatattgaatgctttatggtcttaaaccccagccagcagctggcgattgctgtgctaagcctgaccctcggtacatttactgtgttagagaatcttctggtgctgtgtgttatcctccactcacgatcactgagatgccggccttcctatcattttatcggaagtctagccgtcgctgacctcttgggcagcgtaatattcgtttacagttttatcgatttccatgtgtttcatcgcaaagattcaagaaacgttttcctatttaagctggggggagttactgcatcctttacggcctctgtcggaagcttattcctgacagcgatcgatagatacatctccatccaccgccctctcgcctacaagcggattgttactagaccgaaagccgttgtggccttttgtctcatgtggacaatagcaattgtcatcgcagttttgccactgctcggatggaactgtgaaaagctgcagtctgtgtgttctgatattttcccccacatagatgaaacatacctgatgttctggataggagtgacgagcgtgctactcctttttatcgtgtacgcttacatgtacatactatggaaggcccacagccatgctgttcgtatgattcagagaggaactcagaagtccatcattattcacacttccgaagatggaaaggtgcaagtgacccggccggatcaggcaaggatggacatccgtctcgctaaaaccctggttctgattttggtggtgctgatcatctgctggggccctctgctggcaattatggtttatgacgtattcgggaaaatgaacaagttgattaaaaccgtatttgctttttgctccatgctgtgcctacttaattccacggtcaacccaattatttatgccttgcgtagcaaagacctccgtcacgcgttccggtcaatgtttccgagctgtgagggaacagcccaacccctggacaacagtatgggtgatagtgactgcctgcacaagcacgccaataatgcagcgtccgtgcaccgtgcggctgaatcttgtattaagtcaacagtcaagatcgccaaggtgactatgtctgttagcactgacacatccgccgaagctctgtag

SEQ ID NO: 181524 - DNA, 1419 bp, Artificial Sequence
  Description of Artificial Sequence: Synthetic coding sequence
atgaagagcatcctggacggcctggccgacaccaccttccggaccattaccactgatctactgtatgtgggaagcaatgatattcaatacgaggacataaaaggcgacatggcttccaagcttggctactttccccagaagttccccctgaccagtttcaggggatccccttttcaagaaaagatgacagccggagacaatcctcagttggtgcccgctgaccaggttaacattactgaattttacaacaaatcactcagtagcttcaaggagaacgaagagaacatacaatgcggggagaacttcatggatattgaatgcttcatggtgctcaatccatctcaacaactggctatcgcagtgctttccctgacactgggtacattcaccgtgttggagaacctgctggtgctgtgcgtgattttgcatagtagaagcttaagatgccgcccatcctaccacttcattggctctctggccgtcgctgacctcctagggtccgttatttttgtttactcattcatcgattttcacgtattccaccggaaagatagccgcaatgtgttccttttcaagctgggaggggtgactgcatcgttcaccgcatccgtgggttccctctttttgacagcaattgatagatatatctccattcatagacccttggcatataaaaggattgtgacaagacctaaagctgtcgtggccttctgcctgatgtggactattgctattgttatagccgtgcttcctctgttgggatggaactgtgaaaagcttcagtccgtttgctcagacatcttcccacatattgacgaaacatatctaatgttctggattggagttacaagcgtgctgctgctgttcattgtttacgcctacatgtatattctctggaaagcccacagccacgccgtgaggatgattcagcgcggtacccagaagagtatcataattcatacaagcgaggacggaaaagtgcaagtcactaggccagaccaggcaagaatggacatccgcttagcaaagactctagtcctgattttggtagtgttgatcatctgctgggggccactgcttgcaatcatggtgtatgacgtattcggaaaaatgaacaaactgatcaaaactgttttcgccttttgctcgatgctgtgcctcctgaatagcacggtcaaccctattatttacgctcttagatcaaaagatctgagacacgccttcagatctatgttcccatcttgcgaaggtactgcccagcctctggacaatagcatgggagacagcgattgtttgcataagcacgctaacaatgcggccagtgtccatagggcagccgagtcatgtatcaagtccaccgtgaaaattgctaaggtcacaatgtcagtaagcacagacacgtcagccgaggccctatag

SEQ ID NO: 181525 - DNA, 1236 bp, Artificial Sequence
  Description of Artificial Sequence: Synthetic coding sequence
atggccctgcagatcccccccagcgcccccagccccctgaccagctgtacctgggcacaaatgaccttcagcacaaagacctctaaggagaatgaggaaaacatccagtgcggggaaaatttcatggatattgagtgcttcatggtcctgaacccatcgcaacagttggccattgctgtcctgtctctgaccctcggtacctttactgtgctcgagaatctgctggtgctgtgcgtcatcttgcatagtcggagtctccgctgtaggccatcctaccacttcattgggtccctcgcagtggcggatcttcttgggagtgtgatctttgtgtattcattcatagatttccacgtttttcacagaaaagactcaaggaacgtcttcttattcaaactggggggagtgaccgcaagcttcacagcctccgtcggatcgttatttctgaccgcgatcgacagatacatctcgatccaccggccgctagcctacaagcgcatcgtcacccgccccaaagccgtcgttgccttttgcctgatgtggaccatagctattgttatcgcagtgttacccttgctcggatggaactgcgaaaaactccaatcagtttgctcagacatctttccccacatcgacgaaacctacctgatgttttggattggagtcacatcagtcctcctgttattcatcgtgtacgcatatatgtacatcctctggaaagcccactcccacgccgtcaggatgattcagagaggcacccagaagtccatcataatccacaccagtgaagatggcaaggtccaagttacacgcccagaccaggccagaatggacatccgcctggcaaaaacactcgtgctgatactggtggtgctgattatctgctggggcccccttctggccatcatggtgtacgacgtattcggaaaaatgaacaaattgattaaaactgtgttcgcgttttgttcaatgctatgtctacttaactcaactgtgaatcccatcatatatgcgttgaggtcaaaggacctacggcatgcattcagatctatgttcccatcttgtgaaggaactgcccagcctctggacaacagcatgggtgactcggattgcctacacaaacatgcgaacaatgcagcctctgtccacagagcagccgagtcctgcataaagtccaccgtaaaaattgcaaaagtgaccatgtccgtctccactgacacctctgcagaagctctgtag

SEQ ID NO: 181526 - DNA, 1419 bp, Artificial Sequence
  Description of Artificial Sequence: Synthetic coding sequence
atgaagagcatcctggacggcctggccgacaccaccttccggaccatcactacggatctcctgtacgttgggagcaatgacatccagtatgaagatatcaagggggatatggcaagtaaactcgggtattttccacagaagtttccattaactagcttcagaggaagccccttccaggagaaaatgaccgcaggcgacaacccccagctggtgcccgctgatcaggttaacattaccgaattctacaataagtcactctccagttttaaggaaaacgaagaaaacatccagtgcggagagaactttatggacattgaatgttttatggtcttaaatcccagccagcagctagccatcgctgtgttgagccttaccctgggcaccttcacggtgcttgagaacctacttgtcttgtgtgttattctacacagcaggagcctgcggtgtagaccctcttaccactttatcgggtctttagcggtggctgatttgctgggatctgttattttcgtgtatagctttattgatttccacgtctttcaccgcaaagacagtcgcaacgtcttcttgttcaagctgggtggcgtgactgcctcattcactgcctccgttggttccctattcctcaccgccatcgatagatatattagcattcatagacccctggcctacaagcggatcgtgacccgcccaaaagcagtcgtggcattctgcctgatgtggacaattgcgattgtcatagcggtgctgcccctgctgggatggaactgtgagaaactccagtcagtctgttctgacatttttccccacatagacgaaacatatctcatgttctggattggtgttaccagcgtcctgttgttgttcatcgtgtatgcatacatgtatatactgtggaaggctcactcccatgccgtcagaatgattcagcggggcacacagaagtcaattatcatacacacctccgaggatggcaaagtgcaggtcacaaggcccgaccaggccagaatggatatcagactcgcaaagactctcgtgttgatcttggtcgtcctaatcatttgctggggccctcttcttgccattatggtttatgacgtcttcggaaaaatgaacaagttgataaagaccgtttttgctttttgtagcatgctctgcctcctaaacagcactgtcaatcctataatatacgcgctccggagcaaggacttgcggcacgcgtttaggagcatgtttccttcatgtgaggggaccgcccaaccactggataacagtatgggagactctgattgcctgcacaagcatgctaacaacgctgctagcgtgcaccgcgctgcagagagctgcattaaaagtacagtcaagatcgccaaggtgaccatgtccgtgagcactgacacatccgccgaagcgctctag

SEQ ID NO: 181527 - DNA, 237 bp, Artificial Sequence
  Description of Artificial Sequence: Synthetic coding sequence
atgaagagcatcctggacggcctggccgacaccaccttccggaccatcactacagaccttctctacgtcggttcaaacgatatccagtacgaagatataaagggtgacatggcaagtaagcttggatacttccctcagaagttccctttaacttcttttcgggggtctccttttcaggagaaaatgaccgccggcgacaatcctcaactcgtgccagctgaccaggtcaatatctag

SEQ ID NO: 181528 - DNA, 1083 bp, Artificial Sequence
  Description of Artificial Sequence: Synthetic coding sequence
atggaggagtgctgggtgaccgagatcgccaacggcagcaaggacgggcttgacagtaaccctatgaaagactatatgatcctgtcgggcccccaaaagacagctgtggcggtcttgtgtacactgttagggctgttgagcgcactggagaacgtcgctgtcttatacctgatcctgagcagtcaccaactgagacggaagccatcatacctgttcattggttctctcgctggagcagacttcctggcctccgtagtcttcgcttgttcgtttgtgaacttccacgtcttccatggggtggacagcaaagcagtgttcttgctgaagatcggaagcgtcactatgacattcacagcctctgtgggatcactgttactgactgcaatcgatcgttatctgtgcctgcggtatccgccttcttataaagccctcctcacgcggggaagagcactggtcacactggggataatgtgggtgctgtcggcgctggtatcctatctcccactgatgggttggacgtgttgtccccgaccttgcagcgagttgttcccactgattcctaacgactacctgctatcatggcttctgtttatcgcatttcttttcagcggaatcatttacacctatggccatgttctgtggaaagcacaccaacatgtggcttctctgtcaggacatcaggaccggcaagtccccggcatggcccggatgcgtttggacgttcgcctggcgaagaccctagggttagtgctggccgtcttgcttatctgctggttcccagtgttggccttaatggctcactcactggccacaactctgagtgaccaggtgaaaaaggccttcgctttctgtagcatgctttgtctgataaatagcatggtgaatccggttatctatgcacttcggtccggagagattcggtcatctgcccaccactgcctggcacactggaaaaaatgtgtgcggggtcttggatctgaggcaaaagaagaggctccccgatccagcgtcactgagaccgaagcagacgggaaaattaccccgtggccagactcaagggaccttgacctgagtgattgctag

SEQ ID NO: 181529 - DNA, 1083 bp, Artificial Sequence
  Description of Artificial Sequence: Synthetic coding sequence
atggaggagtgctgggtgaccgagatcgccaacggcagcaaggacggcctggactctaatcccatgaaggactacatgatacttagtggccctcagaaaactgccgtggctgtgctctgcactctcctgggtctgctgagcgccctggagaacgtcgccgtgctgtacctcatcctatcctcacaccagcttcgacggaaacctagttatctgttcatcgggagcctggcaggggccgatttcttagcaagtgtcgtctttgcgtgtagctttgttaatttccacgtattccacggggtcgacagcaaggcggtgtttctactgaagatagggtcggtgaccatgacattcacggcctctgtgggttcgctcctgcttaccgcgatcgacagatacctgtgtttgcgctatcctccatcctacaaagccctcttgacccgcggtagggccctggtcacccttggcatcatgtgggtacttagcgccctcgtaagttacctaccactgatgggctggacttgctgcccacgtccatgcagcgaactattccccctcatccccaatgactatttgctttcatggctcctcttcatcgcttttttgttttcaggcatcatttacacctatggccacgtgttgtggaaagcgcaccagcatgtggcctccctgagcggccaccaggacagacaggtgcccggaatggcccgcatgcgcctggacgtgaggctcgcaaagacccttggactcgtcctggcagttctgctaatttgttggtttcccgttttagccctcatggcgcacagtctggcgaccacactttcggaccaggtcaaaaaagccttcgctttctgcagtatgttgtgtctgattaattccatggtcaatcctgtgatatacgcattgcgctctggagaaatccggagctctgcccatcattgtctcgcccattggaaaaaatgcgtgcgaggcttgggatcagaggctaaagaagaagcccctcgctcatccgtaactgagacggaagccgacgggaaaatcactccttggccggattccagagatctcgatctgtcagactgctag

SEQ ID NO: 181530 - DNA, 837 bp, Artificial Sequence
  Description of Artificial Sequence: Synthetic coding sequence
atggacagcatgcccgagcccgccagccggtgcctgctgctgctgccactcttgctcttgctcctgctgctgctcccggcccctgagctcggcccaagtcaggctggggccgaggaaaatgactgggtacgcctcccctccaagtgcgaggtgtgcaagtacgtcgccgtggaactgaagtctgccttcgaggaaacaggcaaaactaaagaggtaatcggtactggctacggaatcctcgatcagaaggcatcaggcgtgaagtacacgaaaagcgaccttagactcatcgaagtgaccgagactatatgcaaacgactgctggattattcgctgcataaagagcggacaggttccaaccgttttgcaaaagggatgtcggagacattcgaaacattgcacaatctggtgcacaaaggagtaaaggtggttatggatatcccatatgaactgtggaacgagacgtcagcagaagttgcagacctgaagaaacagtgcgacgtccttgttgaggaatttgaggaggtcatagaggattggtatcggaaccatcaggaagaagacctgactgagtttctgtgcgccaaccacgtgttgaagggcaaagacacaagctgtctggccgaacaatggagcggcaaaaaaggggacaccgcagctctcggaggtaagaagagtaaaaaaaagagcagcagagccaaggccgccggaggcagaagttcatcatctaaacagagaaaagaactcggcggtctggagggagatccctctcccgaagaagatgagggaattcagaaagcatcccctctgacccatagtccaccagatgagctgtag

SEQ ID NO: 181531 - DNA, 165 bp, Artificial Sequence
  Description of Artificial Sequence: Synthetic coding sequence
atggacagcatgcccgagcccgccagccggtgcctgctgctgctgcccctgctgctgttgcttctactgctactaccggccccagaactggggcccagccaggccggtgccgaagaaaacgactgggtgagactgccctctaagtgcgagggaacctgtggatag

SEQ ID NO: 181532 - DNA, 747 bp, Artificial Sequence
  Description of Artificial Sequence: Synthetic coding sequence
atgggccccgtgcggctgggcatcctgctgttcctgttcctggccgtgcacgaggcatgggccggcatgctgaaagaagaggatgatgataccgaaaggttgccttcaaaatgtgaagtgtgcaaactattgtccaccgaactccaggccgaactctctagaaccggcaggtcgcgggaggtcctggagttagggcaggtactggacacaggcaagcgcaaaaggcacgtgccttacagcgtgagcgagacgcgacttgaagaagctcttgagaacctatgcgaaaggatccttgattacagcgtgcatgctgagagaaaagggagcctacgctatgccaagggccagagtcaaaccatggccacgctcaagggactggttcagaagggcgtaaaggtcgatctagggatcccactggaactctgggatgagccctcagttgaggttacttacctaaagaagcagtgcgagacaatgttggaagagtttgaggatattgtcggagattggtactttcaccaccaggaacagccccttcagaatttcctgtgcgagggccacgtgttacctgcagctgagaccgcgtgcctgcaggagacctggaccggcaaagagattaccgatggtgaagaaaagacagagggggaagaagaacaggaggaggaagaagaagaggaggaagaagaaggcggcgacaaaatgaccaagacaggctcccaccccaagctggatagagaggacctgtag

SEQ ID NO: 181533 - DNA, 798 bp, Artificial Sequence
  Description of Artificial Sequence: Synthetic coding sequence
atgcgggaggagatgagcctgggctgccaggaggccttcgagatctttaagcgcgaccacgcagacagcgtaacaatagacgataataaacagatccttaagcagaggttctccgaagcaaaagccctgggcgaatcaataaatgaggcaaggagtaaaatcggtcacctgaaggaggagattactcagcgccatatccaacaggtagccctaggcatatccgaaaatatggccgtgcctctgatgcctgatcagcaggaggagaagttgcgaagccagctggaggaagaaaaacgtcgatacaagaccatgtttactcgactaaaagctttgaaagtcgaaatcgagcacctacaactcctgatggacaaggcaaaggtcaagctgcagaaagagtttgaagtatggtgggctgaagaagcgacgaacctccaagtgaattctcctgccgtgaattcattagaccacacaaagccttttcttcagaccagcgattcacagcacgaatggtcccaactgctgagtaataagagctctggaggttgggaagtgcaagaccaaggcaccgggcgcttcgacgtgtgcgatgttaacgctaggaagattctgccttccccctgtccgagcccccattcccaaaagcagtcgtccactagtacacccttagaggactctatccctaagcgacccgtttcctccatcccactaaccggggactctcagacggattcggatatcattgcctttattaaagcccgacagagtattctccagaaacagtgtctagggagcaactag

SEQ ID NO: 181534 - DNA, 1185 bp, Artificial Sequence
  Description of Artificial Sequence: Synthetic coding sequence
atggccaacatgcagggcctggtggagcggctggagcgggccgtgtccaggctcgagagtctgtctgctgagagccaccgcccaccaggaaattgtggcgaggtgaatggcgttattgctggagtggctccctcggtggaagccttcgacaagctcatggactccatggtggctgagtttttgaaaaatagtaggattctggctggcgacgtggagacacacgcagaaatggtgcactcagcttttcaggcccagcgcgcatttctcctgatggcctcacagtatcagcagccgcacgagaatgacgtcgctgctctgcttaaaccaatttctgaaaagatccaggaaattcagactttccgcgagcggaacaggggatcaaatatgtttaaccacctgagtgctgtcagtgagagcattcccgccttgggctggatcgccgttagtcccaagcctccgcccttgcctccaccaggcccccccccgctgttcgaaaacgaggggaaaaaagaggaatccagcccctctcggagcgctctgtttgcacagttaaatcaaggagaggccatcactaagggcctcaggcatgtaacagacgatcagaaaacatataagaatccttcactccgagcccaaggcggacagacccagtcacctacaaaatcccacacgcccagtcccacgtctccaaaaagctatccgtcccaaaagcacgctcctgtgctggaactggaggggaaaaagtggcgtgtggaataccaggaggacagaaatgatcttgtgattagcgagactgaactgaaacaggtagcctatatttttaagtgcgaaaaaagtaccattcagatcaaaggaaaagttaatagcattatcatcgataattgcaaaaagctgggtctggtgtttgacaacgtggtcgggattgtcgaagtgattaactcccaagacattcagatccaggtcatgggccgtgtgccgacaattagtatcaacaagactgaaggctgtcacatctatctcagcgaggatgccttggattgcgagatagtctctgccaagtcatcagaaatgaatatactgatacctcaagacggggactatcgggaatttccaatccctgaacagttcaagaccgcatgggacggcagcaagctaattactgagcccgccgaaattatggcctag

SEQ ID NO: 181535 - DNA, 597 bp, Artificial Sequence
  Description of Artificial Sequence: Synthetic coding sequence
atgaagctgtacagcctgagcgtgctgtacaagggcgaggccaaggtcgtccttcttaaggcggcttacgatgtttctagttttagtttcttccagcgtagcagcgtgcaggagtttatgaccttcactagccagctcatagtagagaggagttcaaagggaacaagagcaagtgtgaaagagcaggattacctgtgtcacgtgtatgtgaggaacgacagtctggctggcgtggtcatcgccgataacgagtaccccagtagagtagcctttaccctgttggagaaggtactggatgagttctctaagcaagtcgatcgaatcgattggcccgtgggatcgccagcaacgatacattacccggcccttgatggacacctgtcaaggtaccagaaccctcgcgaggcagacccaatgaccaaagtccaggccgagctggacgagacaaaaatcattctgcacaacacaatggagtctctccttgagaggggtgaaaagctggacgacttagtgtccaaatccgaggtgctgggaacacagtcgaaagccttttacaagactgcaagaaaacagaatagttgttgtgcaatcatgtag

SEQ ID NO: 181536 - DNA, 3036 bp, Artificial Sequence
  Description of Artificial Sequence: Synthetic coding sequence
atgcagaagcccagcggcctgaagccccccggccggggcggcaagcactccagcccaatgggtcgcacttccaccgggtctgcaagcagtagcgccgctgttgcggcttccagtaaagagggaagccccttgcacaagcaatcttctggcccctcctccagcccggcagccgctgcagctccagagaaacctggaccaaaagccgctgaggtgggcgatgatttcctgggagatttcgtggtgggggagagagtgtgggtaaacggagtcaagcccggtgtagtgcagtatctcggcgaaacacagttcgcccccggccagtgggccggtgtggtgctggatgaccctgttggaaagaatgacggagccgtgggtggtgtgagatatttcgaatgccccgcattgcagggaatctttactcgaccctcaaagttgacccgccaacctactgccgaggggtccggatcagacgcccactctgtcgaatcacttacagcccagaatctttccttgcacagtgggacagcaacacctcccctgacctctcgcgtgattcccctgcgagagagcgtgctcaattcctccgtcaaaacaggcaatgagtcaggatcaaatctcagcgactctggatccgtaaagagaggcgagaaggatctgcgccttggagaccgggtgctagtaggaggaaccaaaacaggcgtggtacggtatgtgggggaaacagatttcgccaagggggagtggtgcggtgtggagctcgacgagccgctcgggaagaacgatggcgccgtggccggaactcgctacttccagtgccccccaaaattcgggctgttcgcgccaatccataaggttatccggattgggttccccagtacatcgccggccaaagcaaaaaagaccaagcgtatggcaatgggagtgtccgcccttactcacagccccagtagcagctccatatcgagcgtgtcatcagttgctagctctgtgggcggaagacctagtaggagtggtctgcttacagagacttcttcacggtacgccaggaaaatttctggaacaaccgctttgcaggaagccttgaaggaaaagcagcagcatatcgagcaactcctggcagagcgtgacctcgagagagctgaggtggccaaggcgactagccacatttgcgaggtggaaaaggaaattgctctgctgaaggcccaacacgagcagtatgttgccgaggctgaagaaaaactccagcgtgctagactccttgtggaatccgtgcgcaaggaaaaggttgatctatcgaaccagctggaggaagagcggagaaaggtagaggatctgcagttccgagtggaggaagaatcaatcacaaagggcgacctcgagctgacgaccgtcgccgaaaagagccgggtactacagttggaagaagaactgaccctcagaagaggggaaatcgaagagcttcagcagtgcttactccactcgggcccaccgccaccggaccatcccgatgcggccgagatcctgcgtttaagagagcgactcttgagtgccagtaaagagcaccaaagggagtctggcgttctccgcgacaaatacgaaaaggccctgaaggcctaccaggcggaagtcgataaacttcgagctgccaacgagaaatatgcgcaagaagtcgccggcttgaaggacaaggttcaacaggcaaccagtgagaacatggggctcatggataattggaaatccaagctggactcactggcttctgaccatcagaaaagcctggaggatctcaaagccactttaaattctggacccggagcccagcaaaaagaaatcggagagcttaaggccgtcatggagggcattaaaatggagcatcaactggagctgggcaacctccaagcaaaacacgatctcgagaccgcaatgcacgtgaaagaaaaagaggcgctccgggagaagctgcaggaggctcaggaagaactggccggcctgcagcgacattggcgcgcccagctggaagtccaggcaagtcagcatcgtctcgagctccaggaggcacaggaccaacgaagagacgccgaactccgcgtgcacgagttagaaaaactagacgttgagtacagaggccaagctcaggctattgaattcctcaaggaacagataagcttggccgaaaaaaagatgctggactacgagcggctgcaaagagccgaggcccagggcaaacaagaagtggagtccctgcgggagaaattgcttgtcgcagaaaacagactgcaggccgtggaggctctgtgttccagccaacatacacatatgatcgagagtaacgacatctccgaggagaccatccggacgaaagaaacggtagaaggcctgcaggataaactaaataagcgagataaggaagtgacagcccttacttctcaaacagagatgctgagggcccaagtgagcgccctggagtccaagtgcaaatccggcgagaaaaaagtggatgccctgttgaaggagaaacgtcgcctcgaggctgagcttgagacagtctcccggaagacgcacgacgccagcgggcagctggtgctcatctctcaggaactgctgcgcaaggaacgaagtctcaatgagcttcgcgtgctgcttcttgaggccaacaggcattcacccggacctgaaagggatctgagtagggaggttcataaagccgagtggcgcattaaagaacagaaactgaaagatgacattcgcggactcagagaaaagctgactggcctggacaaggagaaaagtctcagcgaccaacgccggtattcacttatcgatcgcagttcagcacccgagttgctgcggttgcagcaccagttgatgtcgaccgaggatgccctccgtgatgccctggaccaggcccaacaagtggagaaactgatggaggccatgcgctcatgcccagacaaggcccaaactattgggaacagtggcagtgctaatgggatacaccagcaggacaaagcccagaaacaggaagataagcattag

SEQ ID NO: 181537 - DNA, 3141 bp, Artificial Sequence
  Description of Artificial Sequence: Synthetic coding sequence
atgcagaagcccagcggcctgaagccccccggccggggcggcaagcactctagccctatgggaaggacaagtaccggctccgccagcagcagtgctgccgtggcagcgtctagcaaggagggttcccccctacacaaacaaagcagcggacccagcagtagtcctgctgccgccgccgcacctgaaaagcccggccccaaagcggctgaagtgggtgacgattttctgggtgattttgtagtgggcgagcgggtctgggttaacggggtcaaacccggggttgtgcagtatttaggtgagacacagtttgctcctggacagtgggccggtgttgtgcttgatgaccccgtggggaagaacgacggagcagtgggaggcgtcaggtatttcgagtgtcccgccttgcagggcatcttcactaggccgtcgaagcttacacgccagcctacggcagaggggagcggcagtgatgcacacagcgtagaaagtctaaccgcacagaacctcagcctgcacagcgggactgctactcctcctttgacgagcagagtgatccccctgagagaaagcgtgctcaactcttccgtgaaaacaggcaatgaatctggaagtaatctgtcagactctggatctgtgaagcggggggaaaaggacctcagactcggtgatcgcgtgctcgtggggggcactaaaacaggagtcgtgcgctatgtaggcgagacagactttgccaagggagagtggtgcggtgtcgagctggacgagcccttggggaagaacgacggtgccgtcgcgggcaccagatacttccagtgtccccctaaattcggactcttcgctcctatccataaggtcattcggattgggttcccttcgacatcccctgctaaggccaagaagaccaagaggatggcgatgggggtgagcgcattgactcactcaccctcttcttcctcgatttcttctgtcagcagtgtggcttcttctgttggcggacggccaagccggtcaggactgttgaccgaaacctcttctcgctacgcaaggaagatatccggtacaactgccctacaagaggcccttaaggagaagcagcagcatatcgagcagctgttggccgaacgggatcttgaacgggcagaggttgccaaggccacatcccatatctgtgaggtcgaaaaagagatcgcactgcttaaagcccaacacgagcagtacgtcgctgaagccgaggagaaactgcaacgcgcccgactgcttgttgaatcagtacgtaaggagaaggttgacctctctaaccagcttgaagaagagaggcgaaaagtcgaggatttacagttcagagtggaggaagagtccattaccaagggagatctggaaacccagacacagctggaacatgcgcgcataggcgaattggagcagagtttgctactggaaaaagctcaggctgagaggctgttgcgtgagctcgccgacaataggctgaccacagttgccgaaaagagcagggtgctgcagctggaggaagagctgactttgagaaggggggagatagaagaactacagcagtgtctcctgcacagcggccctccgccccctgatcatcctgatgccgccgaaatacttcggctgcgcgaacggctgctgagcgcgtctaaagagcatcagcgggagtctggtgtcctgcgagataaatacgagaaggctctgaaagcctaccaagccgaagtcgacaaactgcgcgcagcgaacgaaaaatacgcgcaggaagttgccggcctaaaggacaaagtgcaacaggccacatccgagaatatgggcctgatggacaactggaaatctaaactggattccctggccagcgaccaccagaagagtctggaggatctcaaagccacactgaactctggccctggtgcccagcaaaaggagatcggtgaactcaaggccgtcatggagggtataaaaatggagcaccagttggagctggggaatctgcaagccaagcacgatcttgaaacagcaatgcatgttaaggaaaaggaggccttgcgcgaaaagttgcaagaggcacaagaggaactggccggtctgcaacggcactggcgggcccaactggaagtgcaggctagtcaacaccggctggaactgcaggaggcccaggatcagcgcagggacgcagaactgagagtccatgagctggagaaacttgacgtggaatatcgtgggcaggctcaggcgattgagtttctgaaagagcagattagtctcgctgaaaagaagatgctggactacgaaaggttacagagagccgaagcacaaggtaagcaagaagtggagtcactcagggaaaagctcctggtggccgaaaatagactccaggcagtggaagccctatgtagctcacagcacacccacatgatcgagtccaacgacattagtgaggagacaatacgtaccaaagagaccgtggaggggctgcaagacaagctgaacaaaagggacaaggaagtgaccgcgctgacctcccagaccgagatgctgcgagcccaggtctccgccttagagtctaagtgcaagtccggcgaaaaaaaggtcgatgcactgcttaaagagaagcggaggcttgaagcggaattagagacagttagccgaaaaacgcacgatgcgagcgggcagctggtcctcattagccaggaactgctaagaaaggagcgctcactgaacgaattgagggtccttctgctggaagccaatcgacattctccaggccccgaacgcgatctttcccgtgaggtgcacaaggcggagtggcggataaaagaacagaagctgaaagacgacatacgcggcctgcgggaaaagctcacaggcctcgacaaagagaagtctcttagcgaccaaaggagatattctctcattgatcggagctctgctccagagctgctgcgcctccagcatcagctcatgagtactgaggatgccctgcgggacgctttagaccaagctcagcaagtagagaagctgatggaagctatgaggagctgtcccgataaggcccagacaataggcaatagcgggagtgctaacggaatacatcagcaagataaggctcaaaagcaggaagacaagcactag

SEQ ID NO: 181538 - DNA, 153 bp, Artificial Sequence
  Description of Artificial Sequence: Synthetic coding sequence
ctggaggaggagcggcggaaggtggaggacctgcagttccgggtggaggaggagagcatcactaaaggcgacttggaggccgaagatcacctgagcccagaaccgtcaatgctcactaccgttgcagagaaaagcagggtgctgcaattgtag

SEQ ID NO: 181539 - DNA, 3141 bp, Artificial Sequence
  Description of Artificial Sequence: Synthetic coding sequence
atgcagaagcccagcggcctgaagccccccggccggggcggcaagcactcctctccgatgggcagaacctctacaggatcagcttccagcagtgcagctgtagcagcgagctcgaaagaaggtagccccttgcacaaacagtcttccggaccctcctctagccctgcagcagctgccgccccagagaagccagggccaaaggcggccgaagttggcgacgatttcctcggcgactttgtggtcggtgagagggtctgggtcaatggtgtgaaacccggtgtggtgcagtacctcggcgagacacaatttgctccaggacagtgggccggcgtcgtattggacgatcctgtcggaaaaaacgacggggccgtgggcggtgttagatactttgagtgtcctgcgctgcagggtatctttacaaggccgtccaagctgacgcggcagcccacagctgaaggctctggaagtgacgcacatagtgtggagagtctcacggcccagaacctgagtttgcatagtgggaccgcaactcccccactgacttcaagagtaattcccctgcgggagtcagtcttgaactcatccgtaaagacagggaacgagtcagggtctaacctatctgattccggatctgtcaagcgcggcgagaaagatctgcgcctcggtgacagggtccttgtgggcggcaccaaaactggcgtggtaagatacgtgggcgagaccgactttgcgaaaggtgaatggtgtggggtggaactcgacgagcccctggggaagaacgatggagcggttgcggggacccgctattttcagtgtccccctaaattcggcttattcgcaccaatccacaaggtgattaggataggctttcctagtaccagcccagcaaaggctaagaaaaccaagcgcatggctatgggcgtgtccgctttgacgcatagcccatcctctagttccataagttctgtgtcatcagtagccagctccgtgggaggacgaccaagtcgctccggtctgcttactgaaacttcctctcgatacgccagaaaaataagcggcacaacagcactgcaggaggcattgaaagagaagcaacagcatattgagcagctcttagccgagagagatctagaacgggccgaggtggctaaagcaaccagccacatttgtgaagttgaaaaggaaattgctctcttaaaggcccagcacgagcaatatgtagctgaggccgaagagaaattgcagcgtgccaggctgctggtggaatctgtacgtaaggagaaagttgatttatccaaccagctcgaggaggaaagaaggaaggttgaagacctgcagtttcgcgtggaagaggaatccataacaaagggtgacctcgaaacccagacccagcttgagcacgcaaggatcggcgagcttgaacagagcctgttgttggagaaggcgcaggctgagcgcctgctgagggaactggcagataataggctaacgactgtagccgagaagtcaagagttctgcagctggaggaggagctgaccttgagacgaggagaaatcgaggagcttcagcagtgtctgttgcattccggtccccctccgcctgatcaccccgacgccgcagagatcctccgtttaagagaacggctgctctctgcttctaaagagcatcaacgagaatcgggtgtgcttcgggacaagtatgagaaggcgctcaaggcctatcaggctgaggtcgacaagctgagagcagctaacgagaaatatgctcaggaggtcgcagggttgaaggacaaggtgcaacaggctacttccgagaatatggggttaatggacaactggaagtctaaattagactcactagcaagcgaccatcagaaaagtctggaagatctgaaagcgacactcaactcaggcccaggggcacagcaaaaggagatcggggaattaaaagctgtgatggaggggatcaagatggaacaccagctggagctggggaacctgcaggcaaaacatgacctcgagacagctatgcacgtgaaagagaaggaggccctacgcgaaaagctgcaagaggcgcaggaggagctcgccggcctgcagcgccattggcgggctcagttagaagtgcaggcaagtcagcaccgacttgagctccaggaagcccaggaccaaaggcgcgacgctgaactacgtgtacacgaactcgaaaagttggacgtcgaatacaggggccaggctcaagctatcgagttcttgaaagaacagatctccctcgcggagaaaaagatgctggattacgaacgattgcagagggctgaagcccaagggaaacaggaagtggaaagcctaagggaaaaactgctggtggctgaaaacaggctgcaagcagtggaggcactctgtagctcccagcatactcatatgatagagagtaatgacatctcggaggagaccatcaggaccaaggagaccgtggaaggattgcaagataagctcaacaagagggacaaggaggtgactgcactgacctcccaaactgagatgctccgggcacaggtcagtgccctcgagtctaaatgtaagagcggagaaaaaaaagttgatgccctgctcaaggagaagagacgcctcgaggctgaactggagacagtgagtcgcaagacacacgacgcctccgggcagcttgttttaataagccaagaactcctgcgaaaggagaggtcactgaacgagctccgcgttttactgctagaggctaaccgacatagcccagggcccgaaagagacctgtcacgcgaggtgcacaaagctgaatggagaattaaggaacagaagttgaaggacgatatccgtggtctccgggagaaattgaccggcctcgacaaggagaagtcactgtccgatcagcgacgctactcactgatcgatcgctcttccgcgcctgagctgctccgactgcagcaccagttgatgtctacagaggatgccctgagagacgctttggatcaagctcagcaggttgaaaaacttatggaagctatgcgcagttgcccagacaaagcccaaacgatcgggaactcagggtcagctaatggaattcatcaacaggataaagctcagaagcaggagaacactcattag

SEQ ID NO: 181540 - DNA, 4827 bp, Artificial Sequence
  Description of Artificial Sequence: Synthetic coding sequence
atgtacagcgcccaccggcccctgatgcccgccagcagcgccgccagccgggggctcgggatgtttgtctggaccaatgtggaacctcggagtgttgccgtatttccgtggcattccctggtgccgtttctcgcaccctcccagccagaccccagcgtccagcccagcgaagcccagcagccggcctcccaccctgtcgctagcaaccaatcaaaggaacctgcagaaagcgccgctgtggcacacgagcgcccgcctggagggactggatcggctgatccagagcgtcccccaggtgctacctgcccggagtcaccagggcctggtcctccacacccactgggcgtcgtagaatccgggaagggccctcctccgaccaccgaggaagaggcctcaggcccaccaggggaacctcgactagactctgaaacggagagtgatcatgacgacgcatttctgtctattatgagcccggagatacagctgccccttccacctggaaagaggcgcacccagagcctgtctgctttgcctaaagagcgagactcttcttccgaaaaagatggccgctcccctaataaacgagagaaggatcatatccgccggcctatgaatgcgtttatgatttttagcaagaggcatagggctctggtgcatcaacgccatcctaaccaagacaacagaacagtgtccaaaatcctgggggaatggtggtacgctttggggccaaaggaaaaacagaaataccacgacctagctttccaggttaaagaagcccattttaaggcgcaccctgattggaagtggtgtaacaaagatcgcaagaagagctcttcagaggcaaagccaacgtcccttggacttgctgggggtcacaaggagacgagagaacgctcaatgagtgaaactggcaccgctgctgcaccaggggtgtcctctgaactgctgtcagtggccgcgcagacgctcctctcatctgataccaaagctcctggatccagctcgtgtggggcagagcgcctgcacaccgttggcgggcctggcagcgcccgtccacgggcttttagccacagtggagtacattctctagacggcggagaggtcgacagccaggcgctacaggagctcacacagatggtctccggaccggcttcgtattccggtccaaaaccttcaacacagtatggagcccccgggccatttgccgccccaggggaggggggcgctttggcagccacgggacgccctccactgctcccgacacgagcaagtcggagccagagagcagctagcgaggacatgacttccgacgaggagcgcatggtgatctgcgaggaagaaggggatgacgacgtcattgccgatgacggattcggaaccactgacatcgacctaaaatgtaaagagcgggtgacagacagtgagtccggtgattctagtggtgaggatccggaaggcaataaggggtttggtaggaaagtgttcagccccgtgatcagatcgtcttttacccattgccgccctcctctcgaccccgaacctccaggacccccagatcccccagtggccttcggtaaagggtacggcagcgctccatcctcctcggcaagcagtcctgcaagtagctcagcaagcgctgccacatcgtttagcctcggttccgggacatttaaggcccaggaatcagggcagggttccaccgccggcccactgaggcctcctccccctggtgccggtggcccagccactccttctaaagccacgcgtttcctacctatggaccccgctacattccgccggaagagacctgaatccgtagggggattagaaccccctggcccttcagtgattgccgctccgccttccggcggagggaatattctgcagactctggtcctgcccccgaacaaggaggaacaggaaggaggcggggcaagggtcccctcagccccggccccatcccttgcatacggcgctcccgcggcgcctctgtcgagaccagccgctacgatggtaaccaatgtggttagaccagtctcctctactccagtacctattgcaagtaaaccctttcccactagcgggcgggcagaagcctccccaaacgatacagccggagctcgcacagagatgggcactgggagtcgggtgcccggtggctcccccttgggggtctccctggtgtactctgataagaagtctgcggctgcaacttctcccgccccccacttagtggctgggcctctattaggaactgtcgggaaggcacctgctaccgtgacaaacctcctggtgggcaccccagggtacggagccccagcccctccggcagtccagtttattgcccagggggctcccgggggcggtactacagcaggctcaggcgccggcgcagggagcgggccgaacggccccgtgccacttggtattctgcaacccggagcgcttggcaaagccggagggattacccaggtgcagtacatcctgcctaccttgccgcagcagcttcaggtcgctcccgcccccgcgcctgctccggggacaaaagccgcggccccgtccgggccagctcccacaacaagtatcagatttaccctccccccaggtacttcgactaacgggaaggtgttggctgcaactgcccctacccccggcatcccgatcttgcaatctgtgccatccgccccacctccaaaagcccagagtgtgtctccagtgcaggcgccgcctcctggtgggagcgctcaactgctgcccggtaaagtgcttgtgcccttggccgcccccagtatgtcagttcgcggcggtggcgctggacagcctctaccgctcgtgtcccctccgttttccgtcccggtgcaaaacggcgcccagcctccttcgaagatcattcagctgacacccgtcccagtgtcaacaccctcaggactggttccaccgctgagccctgctaccctgcccggcccaacatcacagccccaaaaggtgctgctgccttcctctacaagaatcacttatgtgcagagtgcaggaggacacgctttaccacttggcaccagccccgctagctcccaggccgggacagtgacctcatatggcccaacttcctccgttgcgctcgggttcacctcccttgggccctctggaccagctttcgtgcagcccctgctgagcgccggacaggctcccctgctcgcacccggccaagtcggagtgtcccccgtgccctccccccagctgccgcctgcctgcgccgctccaggtggcccggtaataaccgcattttattctggaagtccggcacccacctcatccgctcctctagcccagccgtctcaagccccaccgtccctggtctacacagtcgctacttccacaaccccacccgccgctaccattctgcccaaagggccaccagcccctgcaactgctactccagctccaaccagccccttcccctccgccactgccggatccatgacatatagccttgtggccccgaaggcccagcgaccttctccgaaagctccacagaaagtcaaggcagcaattgcaagcattcccgtcgggagcttcgaagccggcgcgtctggtcgccctggccctgctccacgtcagcctctggagcctgggcccgtgcgggaacccactgcccccgagtcagagttagaagggcagccaacccctcccgccccacctccacttcccgagacatggacgcccaccgcccgcagctctcctcccctgccaccaccagccgaggaacgcacgagcgcgaagggcccagaaacaatggcctcaaaattcccctccagctcctccgactggcgggtgcctggccagggactggagaacaggggggaacctccaacccctccgagtcccgcccccgctccggctgtggctccaggaggaagctctgaatccagctcaggcagggctgccggggacactcctgaaaggaaggaggctgctggcaccggcaaaaaagtgaaagtgcgtcctcctccccttaagaagacctttgattctgtagataacagggtgctgagcgaagtggattttgaggagaggtttgcagaattaccagagtttagacccgaagaagtcctaccctcccccacactacagtcactggctacgtctccccgagctattctgggctcatatagaaagaaacgcaaaaactcgacagatctggattccgcccccgaggatcctaccagccccaaacgtaaaatgaggcgccgctcctcctgcagctccgaacctaatacacccaagtctgctaaatgcgagggagatatttttacatttgacagaaccggaacggaagctgaggatgtcttgggagagctcgaatatgataaggttccatatagtagcttaaggaggaccctggatcagcgacgtgccctcgttatgcagctcttccaggaccacgggttttttccatcggcacaggccacagccgcttttcaggcccgatacgcagacatcttccccagcaaggtgtgcttacaactaaagatcagggaagtgcgtcaaaaaataatgcaggcagccactccgacagaacagcccccaggggctgaagcaccactccctgtgccaccacctactgggaccgccgctgcccccgcccctacaccaagccccgcgggtggccccgatcctacatcaccatcctccgactctggcacagcacaggccgcaccccctctccctcctccaccggagtcaggcccaggacagcccgggtgggagggagcccctcagcctagccccccccctccaggcccttctaccgcagccacaggcagatag

SEQ ID NO: 181541 - DNA, 1002 bp, Artificial Sequence
  Description of Artificial Sequence: Synthetic coding sequence
atgtacaccgccatcccccagagcggcagccccttccccggcagcgtgcaggatcctggacttcacgtctggcgtgtggagaaactcaagccagtgcctgtagcacaggagaatcagggcgtgttcttttccggagactcctatctggtgcttcacaatggacccgaggaagtttctcatctgcacctttggattggccagcagtcgtcaagagatgaacagggagcttgcgccgttctggccgtccatctgaatactctgctgggggaaaggccggtacagcatcgtgaagtacagggcaatgaaagcgatctctttatgtcctacttcccacgtgggctgaaataccaggagggcggcgtagagagcgcctttcataaaacctcaaccggcgcacccgccgctatcaaaaagttgtaccaggtaaagggaaaaaaaaatatccgggccaccgaaagggccctgaattgggactcctttaacactggggactgttttattctcgacctgggacagaatatctttgcctggtgtggcggaaagagcaacattctggagcggaataaggcgcgcgacctggcattggccattcgtgattctgagcgccagggaaaggcccaagtcctcggtcctaaaccggcgctgaaagaagggaaccccgaagaggatctgaccgccgacaaagcaaatgcccaggccgcggccttatataaagtcagcgacgctaccggccagatgaacttgaccaaagtggccgattcatctcccttcgccctcgaactcttgattagcgacgactgctttgtgctggacaatggcttgtgtggtaaaatctacatttggaaagggcgaaaggctaacgaaaaagagcgccaggctgcattgcaggtggccgaggggtttattagcaggatgcagtacgcacctaacacccaggtggagattttgccgcagggacatgagtccccgattttcaagcagttcttcaaggactggaagtag

SEQ ID NO: 181542 - DNA, 861 bp, Artificial Sequence
  Description of Artificial Sequence: Synthetic coding sequence
atggccgacttcgacgaccgggtgagcgacgaggagaaggtgcggatcgctgcaaaatttatcactcacgctcccccaggcgaattcaatgaagtgtttaacgacgtacgcttgttgttgaacaatgacaacttgttaagagagggagccgctcacgccttcgctcagtataacatggatcagttcactcccgtgaagatcgagggatatgaagaccaggttctgattaccgaacacggggacttaggaaatagccgatttcttgaccccaggaacaagattagcttcaagtttgatcaccttagaaaagaggcctccgacccccagccggaagaagcagatggaggcctgaagtcatggagggaatcctgcgacagcgctctgagggcctacgtgaaagatcattattcaaatggattttgtacagtatacgcaaagacaatcgacgggcagcagacgatcatcgcttgtatcgaatcccaccagtttcagccgaagaacttttggaacggacggtggcgctcagaatggaagtttactatcactcctccaaccgcccaggtggtaggagttctaaaaatccaagtgcactactacgaagacggtaatgtgcagctcgtgagccataaggatgtccaggatagtctcacagttagtaatgaagcacagactgcaaaagaattcataaagattatagaaaatgctgaaaatgaatatcaaaccgccataagcgagaactaccagacaatgagcgacacaacgtttaaagctctgaggagacagctgccagtgaccagaacgaagatagactggaacaaaatcctctcctacaaaatcgggaaggagatgcagaacgcctag

SEQ ID NO: 181543 - DNA, 861 bp, Artificial Sequence
  Description of Artificial Sequence: Synthetic coding sequence
atggccgacctggaggagcagctgagcgacgaggagaaggtgcggatcgctgccaaattcattattcatgcccctccaggcgagttcaatgaggtgttcaatgacgtgcgcttgctgctaaacaacgataatctgctcagagagggcgccgcccatgcctttgcacagtacaatctagaccagtttacccctgtgaagatcgaagggtacgaggaccaggtgctgattactgaacatggcgacctgggcaatgggaagttcctggacccaaagaaccgtatctgttttaagtttgatcacctgcggaaggaagcgaccgatccaaggccctgtgaggtcgaaaacgctgtggagagctggcggacttcagtggagacggctctgcgcgcttatgtcaaagaacattacccgaatggcgtctgcacggtgtacgggaagaaaatcgacggacaacagacaataatagcgtgcattgagagtcaccagttccaggccaagaatttttggaatggccggtggcgcagtgaatggaaatttaccatcaccccgtcgactacccaagtggtgggaatcctgaagatacaggtgcactactatgaagatggtaacgtgcagctagtctcccacaaggacattcaggatagccttactgtcagcaacgaggtccagaccgcgaaggagtttatcaagattgttgaagcagcagaaaatgagtaccagaccgctatttcagaaaactaccagacgatgtccgatacaacttttaaggctctaagaaggcagctgccagtaacgaggacaaagattgactggaacaaaatcctttcttataaaatcggcaaagagatgcagaacgcgtag

SEQ ID NO: 181544 - DNA, 519 bp, Artificial Sequence
  Description of Artificial Sequence: Synthetic coding sequence
atggccgacctggaggagcagctgagcgacgaggagaaggtgcggatcgcagccaagttcatcatccatgcaccaccgggcgaatttaatgaggtgttcaacgatgtgcgtttgttgctgaacaacgataacttgttgcgggagggcgccgcccatgcctttgcacaatataacctggatcagttcacccccgtgaaaatagagggatatgaggatcaagtgcttataacagagcacggcgatctcggcaacggcaagtttctggaccccaagaacagaatctgcttcaagtttgaccacctgcggaaagaagcaacggatccccgtccatgtgaagtagaaaatgctgtggaaagctggcggacctccgtggagactgcactgcgtgcttatgtcaaagagcactatcccaacggcgtgtgcaccgaatggtcccttgaagtgagaatggaggtgtataaccacagcttcaaccattcatccgggtggcacctcgaaaacagtgggtcactcctgtag

SEQ ID NO: 181545 - DNA, 900 bp, Artificial Sequence
  Description of Artificial Sequence: Synthetic coding sequence
atgaccctgagcgtgctgagccggaaggacaaggagcgggtgatcaggcgactgctcctccaggctcctccgggggagttcgtgaacgcttttgatgacctctgtctcttgatacgagatgagaagctaatgcaccaccagggggaatgcgcaggccaccagcactgtcagaagtactctgttcctctgtgtatcgacggcaatccagtactgctgtctcatcataatgtaatgggtgactatagattctttgatcatcagagtaagctcagttttaaatacgatctcctgcaaaaccagctgaaagatattcagagtcacggaatcatccagaatgaggcagagtacctgcgggtcgtgctgctctgcgctctgaaactatacgttaatgatcactaccccaaaggcaattgcaacatgctccgcaagacagtaaaaagcaaagagtatctcatcgcctgtatcgaggatcataactatgagaccggcgaatgctggaacggcctgtggaagagcaaatggatcttccaagttaatcctttcctcacacaggttaccggccgcatcttcgtgcaggcccacttcttcagatgcgtgaacttgcacattgaaattagcaaagacttaaaagagtctctggagatcgtcaaccaagcacagctcgccctgtccttcgcaaggctggtggaggaacaagagaataaatttcaggccgcggtgctggaggagctgcaagagctttccaacgaggctctcagaaagattcttcggcgggatctcccagtgacacgaactttgattgattggcatcgcatactgagtgatctgaacttggttatgtatcccaaactgggctacgtgatctattcaaggagtgtactgtgtaactggatcatctag

SEQ ID NO: 181546 - DNA, 834 bp, Artificial Sequence
  Description of Artificial Sequence: Synthetic coding sequence
atgagcgaccagcagctggactgcgccctggacctgatgcggcggctccctccacagcagattgagaaaaacttgtccgatcttattgatcttgtcccttccttgtgtgaggatctattgagttcagtggatcagcctttaaaaattgcacgcgacaaggtggtgggtaaggactacctgctttgcgactataatcgagatggcgatagctaccgctcaccgtggtccaacaagtatgatcctcctttggaggacggcgcgatgccctctgcgcgcctgagaaagctcgaagtggaggctaataatgccttcgaccaataccgcgacctgtattttgagggcggtgttagctccgtttatctctgggatctggaccatgggtttgctggggtaattcttattaagaaagccggtgatgggagcaagaagattaagggctgctgggatagcatacacgtcgtggaggtccaagagaagtcctccggcaggacagcccactataagctgacatccacagtaatgttatggctgcaaaccaacaaatcgggaagtgggaccatgaacctgggtgggtcactgaccagacagatggagaaggatgagaccgtgtccgactgttctcctcacattgctaacatagggcgtctggtggaggacatggaaaataagatcaggtcaacattgaacgagatctacttcggcaagacaaaggacattgtcaatgggctgcgcagcatcgacgccatccctgataatcagaagtttaagcagcttcagagagagctgagccaggtgctcacgcaacggcagatctatattcagccagataattag

SEQ ID NO: 181547 - DNA, 783 bp, Artificial Sequence
  Description of Artificial Sequence: Synthetic coding sequence
atgccccggcagttccaggacaccggcttcagccggcccggcctggggcagccacgtcggtgcgacccagagccacggaaatctgatcagcagttggattgcgcattagacttgatgcgaaggctcccccctcagcagattgagaagaaccttagcgaccttatcgatttggtgccgagtctgtgtgaggatttactgtctagcgtagaccaacccctcaagattgctagggacaaagtggttggtaaggactatctgctatgtgattataatcgtgatggggattcctaccgtagcccatggagcaataaatatgacccccccctggaagacggcgccatgccatccgcgcggctgagaaaactggaagttgaagctaacaacgccttcgaccagtacagggatctgtatttcgagggaggcgtctcttctgtctacctctgggacttagatcacgggtttgccggggtgattctgatcaagaaggctggtgacggctcaaaaaaaattaagggatgctgggattccattcatgtggtcgaagtgcaggagaagagctcaggcagaactgcccattataagctgactagcaccgttatgttgtggctccagacaaataagtctggatcgggcacaatgaatcttggcggttcactgactaggcagatggaaaaggacgaaacagtatccgactgcagcccgcacattgccaacatcggaagattagtggaggtctgtgcggacttctgcagacagatcaaaaccagatcaagcgaggaatag

SEQ ID NO: 181548 - DNA, 834 bp, Artificial Sequence
  Description of Artificial Sequence: Synthetic coding sequence
atgagcgaccagcagctggactgcgccctggacctgatgcggcggttgccccctcaacaaatcgagaagaatctgagtgacctgattgacctggtgcctagcttatgcgaggacctgttgtcttcagtcgatcagccgctcaagatcgccagggacaaggttgtgggcaaggattacctgctctgcgattacaacagggacggcgactcgtacagatcaccatggagcaacaagtatgacccaccattagaagatggagctatgccatccgctagactgcggaagctggaagtggaggccaataatgccttcgaccagtatcgggacctttattttgaaggcggtgtatcatccgtatatctctgggatttagaccacggatttgctggcgtcattctcattaagaaagctggagacggatcaaagaagattaaggggtgctgggatagcattcatgtggtggaggtccaggagaagagttcaggaaggacggcccattacaagctgacatccactgtcatgctgtggctgcaaacaaacaaatccgggagcgggacaatgaatcttggaggttctcttacaaggcagatggaaaaggacgaaaccgttagcgactgttctccacatattgcgaatattggccgcctcgtggaggacatggagaataagatccgctccactctcaatgagatatattttggtaaaactaaagatatcgtcaacgggctgagaagcatcgacgccatacccgataatcagaagttcaaacaactgcagcgagagctgagccaagtattgacacagcgccagatatatattcagccagacaattag

SEQ ID NO: 181549 - DNA, 783 bp, Artificial Sequence
  Description of Artificial Sequence: Synthetic coding sequence
atgcggcggctgcccccccagcagatcgagaagaacctgagcgacctgatcgacctggtgccttctttgtgcgaggacctgttgtcttccgtggatcagcctctgaaaattgccagggataaagtggtgggaaaagattacctactctgtgattataatagggacggtgattcctaccgcagcccgtggtctaataaatacgatccacctctggaagatggcgctatgccatccgcacgactcagaaagctggaggtggaggccaacaacgcatttgaccagtatagagacctttacttcgagggcggagtgtcaagcgtgtacctatgggacctggaccacggcttcgcaggagtaattctgataaagaaggctggcgacgggagtaaaaaaatcaaggggtgctgggattctatccatgtggtggaggtccaggagaaatctagcgggcggaccgcccactacaagttaacttcgactgtcatgctgtggctacaaacaaacaaaagtggcagcggaaccatgaatctgggaggttccctgacacggcagatggagaaggacgagacggtgtccgattgtagtccccatatcgcgaatatcggaagactcgtagaagacatggagaataagattcgctccacgcttaacgaaatctacttcgggaaaacaaaggacattgtaaatggattgcgatctgtgcagacattcgccgacaagtccaaacaggaggccctgaaaaatgacctggtggaggctctcaagcgaaagcagcaatgttag

SEQ ID NO: 181550 - DNA, 1005 bp, Artificial Sequence
  Description of Artificial Sequence: Synthetic coding sequence
atgggcggcccccaggacaaggacgagcggaccatcgccctggtgagaccttggccatgggggcaccaagccctcgatccggcctacggactggacacaatgcacccttctcggcgctctctgccctttccattaaactgccagctggcacgagtcgggaccgccgactacgggtcccctagtgatcagtctgatcagcaactggactgtgcactggatctgatgagacgcctgcccccacagcagatagagaagaacctgagcgacctaatcgacctcgtcccttccctgtgcgaggatctactgtcttccgtggatcagccactaaaaattgccagagataaagtcgtcggtaaggattatttactgtgtgattataaccgcgatggagattcttacagatctccgtggagcaacaagtacgatccgcctttggaggacggagctatgcctagtgcacgcctgagaaaattggaagtggaggccaataatgcatttgatcagtatcgggacctatacttcgagggaggtgtgtcgagcgtgtatctctgggatctggaccatggattcgcaggagtcatcctcatcaagaaggctggggatggctccaagaagattaaagggtgttgggatagcatccacgttgttgaagtacaggagaagagcagcggtagaaccgcccactataaactcacaagtacggtcatgctgtggttgcagacaaataaatcaggaagcggaacaatgaacttgggtggctctctgacaagacagatggaaaaggatgaaaccgtttcagactgctctccccatatagccaacattggaagactggttgaagatatggaaaataagattcgcagtacactcaatgagatttattttggaaaaaccaaagacatagtgaatggcctaagatctgtccagacatttgcggataagtcaaagcaggaggctctcaaaaatgatctggtggaagctctgaaacgaaaacagcagtgctag

SEQ ID NO: 181551 - DNA, 819 bp, Artificial Sequence
  Description of Artificial Sequence: Synthetic coding sequence
atgagcgaccagcagctggactgcgccctggacctgatgcggcggttgccaccccaacagatcgagaaaaatctgtctgacctgattgacctggttccaagtctgtgtgaagatctcctcagctctgttgaccagccactgaagatagcgcgggacaaggtggtcggcaaggattacctcctgtgtgactataatcgcgatggagattcatatagatctccctggtcaaataagtatgatcccccactggaagatggcgccatgccgtcagctcgactgcgaaagctggaagtcgaggctaacaatgcatttgatcaatacagagacctctattttgaggggggtgtgtcttcagtctatttgtgggatcttgaccacgggtttgcaggcgtcatcttgatcaaaaaggccggcgacggctccaagaagatcaaaggctgttgggacagcatccacgtcgttgaagtgcaggagaagagttctggacgcacagctcactataagctgacctcaacagtcatgctttggctgcagacaaacaaaagtgggagcggcaccatgaacttgggcggttccttgacgcgccagatggaaaaggatgaaactgtcagcgattgcagcccgcacatcgccaatatcgggcgcctggtggaagacatggagaacaaaatccgcagcaccctgaacgaaatttacttcggaaagaccaaggatatagtcaatggactgcgcagcgttcagactttcgctgataagagcaagcaggaagccctcaaaaacgacctagtggaggctctgaaaagaaaacagcagtgctag

SEQ ID NO: 181552 - DNA, 621 bp, Artificial Sequence
  Description of Artificial Sequence: Synthetic coding sequence
atgcggcggctgcccccccagcagatcgagaagaacctgagcgacctaatcgacctcgtgcccagtctgtgtgaagatctgctgagcagcgtcgaccaaccactgaagatcgctagggataaggtggttggcaaggactacctcttgtgcgattacaaccgggatggcgattcttaccggtcaccctggagtaataaatatgatcctcccctggaggacggcgcgatgccctcagcccggcttcggaaactcgaagtggaggccaacaacgccttcgatcagtacagggacctgtacttcgaggggggtgtgagttctgtttatctgtgggatttggaccatggttttgcgggcgttatcctaattaaaaaggcgggagacggatcaaaaaaaattaaaggatgttgggactccattcacgtcgtggaggtgcaagagaaaagttctggtcggactgcacattacaagcttacttctacagtaatgttatggctacagaccaacaaaagtggtagcggtaccatgaatcttgggggctccctgactcggcaaatggagaaggatgaaactgtaagcgattgctctccccatatcgctaacatcggccgactggtggagtag

SEQ ID NO: 181553 - DNA, 906 bp, Artificial Sequence
  Description of Artificial Sequence: Synthetic coding sequence
atgcaccccagccggcggagcctgcccttccccctgaactgccagctggcacgcgtgggaacggccgactacgggtcaccgagcgatcagtctgaccaacaactggattgcgccttggatctgatgcggcgcttgcctccgcagcagatcgagaaaaacttatccgatcttatcgacctggtcccttccctgtgcgaagatttgctgagctccgtggaccaaccccttaaaatcgcgagagacaaggtggtcggaaaggactatctgctgtgcgattataaccgcgacggcgattcttaccggtcaccttggtctaataaatatgatccccctctagaggatggcgcaatgcctagcgcgaggctgcgaaaactggaagtggaagcaaacaatgcgttcgaccaataccgcgatctgtattttgagggtggtgtgagcagcgtgtacctttgggacctggatcacggttttgcaggcgtgattctgatcaagaaggcaggggatgggagcaaaaaaattaaggggtgttgggatagcatccatgtcgttgaggtccaggagaagtccagcggaaggacagcccactataaattgacatcaaccgtgatgctttggctccagacaaacaaaagcgggagtggcaccatgaacttgggaggctctcttaccagacagatggagaaggatgagactgtttctgactgttcgcctcatatagcaaacatcggccggctggtggaagacatggaaaacaagatccgcagtacattgaatgagatctacttcggaaagacgaaggatatcgtgaacggactgcgctctgtgcagacctttgccgacaagtctaaacaagaggctctgaagaatgacttggtcgaagccctgaaacgaaaacagcagtgctag

SEQ ID NO: 181554 - DNA, 366 bp, Artificial Sequence
  Description of Artificial Sequence: Synthetic coding sequence
atgctgaaggtgcccagcctgtgcgaggacctgctgagcagcgtggatcagcccctaaagatcgctagggataaagtggtcggaaaggattacttattgtgtgactataaccgcgatggggattcgtaccgctcaccttggtccaacaaatacgacccccctctagaggatggtgctatgccgtccgctcggctgcgtaaactcgaggtggaggccaataacgccttcgaccaataccgagatctgtatttcgaggggggggtgagctccgtgtacctgtgggacctggatcacggattcgcaggggtgatcctgattaagaaggccggggatggttccaagaagattaaagggtgttgggattag

SEQ ID NO: 181555 - DNA, 1047 bp, Artificial Sequence
  Description of Artificial Sequence: Synthetic coding sequence
atgtacaccgccatcccccagagcggcagccccttccccggcagcgtgcaggacccaggcctgcatgtgtggcgggtggagaaactgaaaccggtgccggtagcccaggaaaaccagggtgttttcttttcaggcgactcgtatctcgtgctacataacggtcctgaagaggtgtcccacctccacctctggataggccaacagagcagccgggatgaacagggggcttgcgctgtgcttgccgtccacctgaacactctgcttggcgaacgtcctgtgcaacaccgggaggtgcaggggaacgaatctgacctcttcatgtcttattttccccgcggcctgaagtatcaggaggggggcgttgaatccgccttccacaagacttcaaccggggctcccgcagcgatcaaaaaactatatcaggttaagggcaagaagaatatccgtgctactgaacgagctctaaactgggacagcttcaacacaggcgattgttttatcctcgacctgggccagaacattttcgcgtggtgtggtggcaagtccaacatattggaaagaaacaaggctcgcgaccttgcattggcaattagagattcggaaagacaagggaaggcccaggtagaaatcgtgactgacggcgaggagccagccgagatgatccaggtgctaggccccaagcccgctctaaaggaaggaaaccctgaagaagacctgactgccgataaagcaaacgctcaagccgcagccttatataaagtctccgatgccacaggccagatgaacctcacaaaagttgctgattcttctcccttcgccctggagctgctgattagcgacgactgttttgttcttgacaacggattatgcggtaagatatatatctggaaaggacggaaggcaaatgaaaaggaaagacaagccgcactgcaggtagccgagggttttatctccagaatgcagtacgctcctaatactcaggtggaaatcctgccccagggacacgagtcacctattttcaaacagtttttcaaagactggaagtag

SEQ ID NO: 181556 - DNA, 657 bp, Artificial Sequence
  Description of Artificial Sequence: Synthetic coding sequence
atgtacaccgccatcccccagagcggcagccccttccccggcagcgtgcaggaccccgggctgcacgtctggagagtggagaagttaaagcctgtgcctgtggctcaagagaaccagggcgtgttctttagcggggattcctacctcgtcctgcacaatggccctgaagaagtctcccacctccacctctggattgggcagcagagttcgcgagacgaacagggagcctgcgccgtgttggcagtacacctgaacaccctcctgggagaaagaccggtgcaacacagggaagttcagggcaatgagtcagatctattcatgtcatactttcccagaggactcaagtatcaggagggcggggtggaatcggcattccacaagacctcaacaggcgcaccagcggctatcaagaagctgtaccaagttaaaggaaaaaagaacatacgggcgactgaacgggctctgaactgggactcctttaacactggagactgtttcatcctggacttggggcagaatatcttcgcctggtgcggaggcaagtctaatatcctggaaagaaacaaggcgcgagacctggcgctcgcgatccgggatagcgaaagacaggggaaggcccaggtggagattgtgaccgacggggaggagcccgcctag

SEQ ID NO: 181557 - DNA, 1047 bp, Artificial Sequence
  Description of Artificial Sequence: Synthetic coding sequence
atgtacaccgccatcccccagagcggcagccccttccccggcagcgtgcaagacccaggcctccacgtgtggagggtggagaaattgaaacccgtgcccgtggcgcaagagaaccagggtgtatttttttcaggggacagctacctggttcttcataatggcccagaagaggtgtcacacttgcacttatggattggccaacagtcaagtcgtgacgagcaaggagcctgtgctgtcctggctgtgcacctgaatacacttcttggcgaaagacccgtgcagcaccgtgaggtgcagggcaatgagagtgatctgtttatgagctatttcccccgaggtctaaagtatcaagagggaggcgtcgagtctgcatttcacaagacaagcacgggcgcaccagcagctattaagaaactgtaccaagtcaagggcaagaagaatataagagcaaccgaaagagctctcaactgggactcgtttaataccggtgattgctttatcctggacctgggccaaaacatattcgcatggtgcgggggtaaatcaaatatattggagagaaataaggcccgagatttggctctcgccattcgagacagcgagaggcaagggaaggcacaggtagaaattgtcacggacggagaggagcccgcagagatgatccaggtactgggccctaaacctgccctgaaggaaggaaatccggaagaggacctgaccgctgataaggcaaatgcccaggctgccgcactttacaaagtcagcgacgcaacaggacagatgaacctaaccaaggtagccgactcatctccctttgccttggaacttctgatcagcgacgactgtttcgtgctcgacaatggactttgtggtaaaatctatatctggaaaggacgcaaggccaatgagaaggagcgccaggccgccctgcaggtggccgagggattcataagcaggatgcagtatgccccgaacacacaagtggaaattttgccacaggggcacgaatcccctattttcaaacagttcttcaaagactggaagtag

SEQ ID NO: 181558 - DNA, 1047 bp, Artificial Sequence
  Description of Artificial Sequence: Synthetic coding sequence
atgtacaccgccatcccccagagcggcagccccttccccggcagcgtgcaggacccaggattgcacgtatggagagtggagaaactgaaaccggtcccagttgcccaagaaaaccagggagtgttctttagtggagattcatatttggtgttgcacaatggcccggaggaggtgtctcatctccacctgtggatcggccagcagagcagtagagatgagcagggagcttgtgctgtgcttgctgttcatcttaatacgcttctgggtgaaaggcctgtccaacatcgagaagtgcagggcaatgaatccgatcttttcatgtcctacttcccgagaggcctcaaatatcaagaaggcggggtagaatctgcattccacaagacatcgacaggtgcgcctgcggcaatcaagaaactttaccaggtcaaaggtaaaaaaaacattagagctacggagagggcactaaattgggacagcttcaatacgggcgattgttttattttagatctggggcaaaacatttttgcctggtgtggggggaagagtaacatattggagagaaacaaagcgcgggatcttgcactcgccataagggattccgaaagacaaggcaaggcccaagtagagatcgttacggacggtgaggagcctgcagagatgatccaggtgctgggacctaagccggcgctgaaagagggcaatcccgaagaagacttgaccgccgacaaggcgaatgctcaggccgccgctctatataaggtaagcgacgccaccggccaaatgaatctgacaaaagttgcagactctagtccgtttgcattagaactgctgataagcgacgattgttttgtattggataacggcctatgtggaaaaatctacatctggaaaggacggaaggccaacgaaaaggagcggcaagccgccctacaagtagccgaaggatttatctcacgtatgcagtacgcccctaatacccaggtagagattcttccccaggggcatgagagccccatttttaaacagtttttcaaagactggaagtag

SEQ ID NO: 181559 - DNA, 762 bp, Artificial Sequence
  Description of Artificial Sequence: Synthetic coding sequence
atgtacaccgccatcccccagagcggcagccccttccccggcagcgtccaggaccccggattacacgtgtggcgcgttgaaaagctcaaacctgtaccagtggcccaggagaaccagggggtgttcttttccggggactcataccttgtgcttcacaatggaccggaagaagtgagccatttacatctgtggataggtcagcaatccagccgcgatgagcaaggggcatgtgcggttttggctgtgcacctcaacacgctcctcggggaacgccccgtgcagcaccgagaggttcagggtaacgaaagtgatctattcatgtcctatttcccacgcggacttaagtatcaagaggggggagttgagtccgcattccacaaaacttctacaggagctcctgccgcaattaagaagctctaccaggttaagggcaagaaaaacattagggcaaccgagcgggctctgaactgggactccttcaatacaggagactgctttattctggatcttgggcaaaacatatttgcgtggtgcggcggcaaaagtaacatattggaacggaacaaggcccgggaccttgccctggctattagggactccgagagacagggtaaggcacaagtggagatcgttaccgatggtgaagagcctgccgagatgattcaggtgcttggacccaagcccgctctgaaagagggtaatccggaagaagacttaactgcagacaaggcgaacgcacaggctgcggcactttacaaatag

SEQ ID NO: 181560 - DNA, 762 bp, Artificial Sequence
  Description of Artificial Sequence: Synthetic coding sequence
atgtacaccgccatcccccagagcggcagccccttccccggcagcgtgcaggatcccggattacacgtctggcgcgtggaaaagttaaagccagtcccagttgcacaggagaaccagggcgtgtttttctccggggatagctatttggtgctccataacggccctgaggaagtgagtcatctgcatttgtggatagggcaacagtcgtcacgggacgaacagggcgcttgtgctgtgctggccgtccacctcaatactctgctgggagaaagacccgtacagcacagagaagtgcaaggaaatgaaagcgatttgttcatgtcctatttccctcggggactcaaataccaagagggaggagtggagagcgctttccacaagacatcaactggagctccggctgcgataaagaagttatatcaggtgaagggaaagaaaaacatcagggccaccgagcgggcgttgaattgggactctttcaacacaggagactgcttcattctcgatctgggacagaacattttcgcttggtgcgggggaaagagcaacattctcgaacggaataaagcacgagatcttgccctggctataagagattcagagaggcaggggaaagcccaggtggaaatagtgaccgatggcgaagagcctgccgagatgatccaggtcttggggccaaaacccgcacttaaggaggggaaccctgaggaggatctcaccgcggacaaagcaaacgctcaagccgcagccctgtataagtag

SEQ ID NO: 181561 - DNA, 762 bp, Artificial Sequence
  Description of Artificial Sequence: Synthetic coding sequence
atgtacaccgccatcccccagagcggcagccccttccccggcagcgtgcaggacccaggtctacacgtctggcgtgttgagaagctcaagcctgtgccagtggcccaggagaaccagggcgtctttttttccggggactcctacctcgtcctgcacaatggaccagaggaggtaagccatttgcacttgtggatcggacagcaaagctctagggatgagcaaggagcatgcgccgttctcgcagtccacttaaacacactgttaggcgaaagacctgtccaacacagggaggtccagggcaatgagtcagacctctttatgagttacttcccccgcggactcaagtaccaagaaggcggcgtagaatcagcgttccacaagacatccacgggcgcaccagcggcaatcaaaaagctttaccaagtcaagggaaaaaaaaatattagagcaactgaaagggctctgaactgggattcatttaacacgggcgattgcttcatcttggacctcggtcagaatatttttgcttggtgtggtggcaaatctaacattcttgagcggaacaaagcccgggacctggcactcgccatacgcgactccgaacgtcaggggaaggcacaggtggagatcgtcacggacggagaggaacccgctgaaatgattcaggtgctgggccccaaacctgcgttgaaagagggcaaccctgaggaagacctgacggctgacaaagccaacgcacaggccgccgccctgtacaagtag

SEQ ID NO: 181562 - DNA, 984 bp, Artificial Sequence
  Description of Artificial Sequence: Synthetic coding sequence
atgtacaccgccatcccccagagcggcagccccttccccggcagcgtgcaggacccaggcctgcacgtgtggcgggtggaaaaactcaagccggtgcctgtagcccaggaaaaccaaggtgtgttcttttctggcgattcctatctggtgctgcataacgggcctgaagaggtgtcccacctgcacctcaatacactgctgggcgagagacctgtccaacatcgcgaggttcagggcaatgagtcagaccttttcatgtcttattttcccagaggactaaaatatcaggagggcggcgttgagagtgcatttcataagaccagcacgggggcccccgcagccattaagaaactgtatcaggttaagggaaaaaaaaacattagagccacagaacgggctctgaactgggatagcttcaataccggggactgtttcatcctagacctaggccagaatattttcgcttggtgcggcggaaagtctaatatactggaacgcaataaggcgagggatttagccctcgccatccgtgacagtgagaggcaggggaaggcgcaggtcgaaatcgtgacagacggagaggagccggcggaaatgattcaagtgcttgggcctaagcctgctctgaaagagggaaatcccgaggaagatttgaccgctgataaggcaaacgcccaggcagccgctctgtacaaagtgtcagacgctacaggccaaatgaacttaaccaaggtggccgatagttctccgtttgcgctggaacttctgatttccgatgactgtttcgtgctagacaatggcctgtgcggtaaaatctatatttggaagggaaggaaggcgaacgagaaagaaaggcaggccgccctacaggtggctgagggcttcatatcacgtatgcagtacgctccaaacacccaggtggaaattcttcctcaggggcacgagtcacccatctttaagcagttcttcaaggactggaaatag

SEQ ID NO: 181563 - DNA, 654 bp, Artificial Sequence
  Description of Artificial Sequence: Synthetic coding sequence
atggagggcagcttcagcgacggcggcgccctgcccgagggcctggcggaggaggccgagcctcagggtgctgcctggtctggcgattccggaaccgtttcccagagccactctagtgccagtgggccatgggaagatgaaggcgctgaggacggagctcctgggcgagacctgcctttacttcgccgtgctgctgcaggttacgcggcatgcctcctccccggtgctggcgcccgacctgaagtggaggcccttgatgctagccttgaggaccttctcacaagggtcgacgaattcgttggaatgcttgacatgctgagaggggacagctcacatgtcgtttctgagggcgtacctcgcatccacgcaaaggcagccgaaatgagaaggatctatagtaggatagaccgcctcgaagcgttcgtgagaatggttggtggacgggtggcaagaatggaggagcaggtcactaaggcggaggcggaactgggtacattcccgcgtgccttcaagaagcttttgcatacaatgaacgtccccagcctattttcgaaatcggccccatcacgtcctcagcaagccggctatgaggctccagtgctgttccgcacagaggattattttccatgctgctcagagaggcctcagctgtag

SEQ ID NO: 181564 - DNA, 6678 bp, Artificial Sequence
  Description of Artificial Sequence: Synthetic coding sequence
atggccgccctggtgctggaggacggcagcgtgctgcggggccagcccttcggcgccgccgtctctactgcaggtgaggtcgtctttcaaacggggatggtgggctacccggaggcactgaccgatcccagctataaagctcaaatattagtgctgacatacccactgatcggaaactatgggattccccctgatgagatggacgagttcggtctctgcaagtggttcgaatcctctggcatccacgtggccgcacttgtggtgggagagtgctgtcccactccatcccactggtccgcaacaagaaccctccacgagtggcttcagcagcacggcatacccggcctgcagggggttgacactagggagctgaccaaaaaattgagagaacagggctctttgctgggtaagctcgtgcagaacggtacggagcccagtagtctccctttcctggacccaaacgcacgccccttggtgccagaagtgagcatcaaaacaccacgagtgtttaatactggcggtgcccctcgcatcttggctttggattgcggattgaagtacaaccaaatcaggtgtctatgccagcgcggcgccgaggtgacagtggtgccttgggatcatgctctggactcacaggagtatgagggacttttcctttccaacggccctggcgatcctgctagctaccccagtgttgtgtcaactctaagtagggttctgtccgagccgaaccctcgcccagtgtttggcatctgcctgggacaccagctgctggctctcgcaatcggcgcaaagacttacaaaatgcgctacggtaaccgaggccataaccagccttgtttgctcgtgggctctggaagatgttttctgaccagccagaaccatggatttgccgtggaaacagactctctgccggcggattgggcgcctctcttcaccaatgctaatgacggttccaacgagggtatcgtacataattccctgccgttcttttcggtgcaatttcacccagagcaccaggcgggtccgtccgatatggaactcctgttcgatatcttcctcgagacagttaaggaggctacagcaggcaacccgggtggtcagacggtgcgcgagaggctcacagaaagactttgtccacctgggatccctaccccaggttccggtttgcctccaccacgtaaggtcctgattctgggatctgggggccttagcatcggccaagcaggagagttcgactactctggctctcaggccatcaaggcgctgaaagaggagaatatccagactctactcattaatccgaacatcgcgacagtccagacatcccaaggtcttgccgataaagtgtatttcctccctatcactcctcactatgtgacacaagtgatccgcaatgaacgacccgatggagtcctgttgacattcggtggtcagactgccttgaattgtggggtggagttaacaaaagccggcgttttggctcgctatggagtaagagtactgggcacaccagtggagaccatcgagcttaccgaagatagacgagcctttgctgcgagaatggcagaaataggtgagcacgtcgctccgagtgaggctgcaaactcccttgagcaggctcaggccgcagctgaacggctgggttatccagtgctggtcagagcagccttcgcattgggcggtctggggagtggattcgcgagcaatcgggaggaactcagtgccctggtagctccagctttcgcacatacgagtcaagtgcttgtggacaaatcgctgaaggggtggaaggaaattgaatacgaggtggttcgcgacgcctatgggaactgtgtcacagtgtgcaacatggagaacctcgatccactcggcattcacacaggcgaaagcatcgtggttgcgccatcccaaaccctgaatgatcgagagtatcagctgctgcggcagacggctattaaggtcacacagcatcttggcattgtcggcgagtgcaacgtacagtacgcacttaacccagagagtgagcagtactacatcatcgaggtcaatgcgagactgtcccgatcatccgccctggccagcaaggccaccgggtaccccctggcatacgtcgccgccaagttggctctggggataccactaccagaactacggaactctgtgacgggcggaacagctgcctttgagccgtctgtcgactattgtgtggtgaagataccccgttgggaccttagtaagttcctgagagtgtcaacaaaaataggctcttgtatgaagtccgtcggagaagtgatggggatcggtaggagtttcgaagaagcctttcagaaggctcttagaatggtggatgagaactgtgtgggctttgatcacaccgtaaaacccgtgagtgacatggaactcgagacccccacagataaaagaatattcgttgtggccgccgcattatgggctggatacagtgtggaccggctctatgaactcacaagaatcgacagatggttcttgcaccgcatgaaaagaatcatcgcacatgcccagctgctggagcagcatcgaggtcaacctctaccacccgacttgctgcagcaagccaaatgcttagggttttccgacaaacagatcgcactcgccgtgttaagcacggagcttgccgtacggaaactgcgccaggaattgggaatttgtcccgcggtcaagcagattgacactgtcgctgctgaatggcccgcccagactaactatctttacctcacatattggggaaccacacatgatcttacatttagaacgccccacgtgctggtgttgggtagcggggtgtacagaatcggatccagcgtcgaattcgactggtgtgctgtggggtgcatccaacaactccgcaaaatgggatataaaaccatcatggtgaattataaccccgagactgtcagcacagattatgacatgtgtgaccgcctgtacttcgatgagatcagctttgaggtggtcatggacatctatgaactggaaaaccctgagggggtgatcctctctatgggcggtcagcttcctaataatatggccatggccctgcaccggcagcaatgccgagtcctcggaacttctcctgaggccattgactcagctgagaacaggttcaaattctcccgtttgctggatactatcggcatctcgcagccacagtggcgggagctgtcggacctggagtcagcacggcaattctgccaaacagtcggatatccctgcgttgtgcgccccagctatgtattgagcggagccgccatgaatgtcgcatacactgatggagatctggagagatttttatccagtgcagctgcggtatccaaggagcaccccgtggtaatctccaaattcattcaagaagctaaagagattgacgtcgatgcggttgcctctgatggggtggttgccgccatcgcaattagcgagcacgtggagaatgctggcgtgcacagcggcgacgcaacccttgtgacacctccacaggacatcaccgcaaagaccctggagagaataaaggccatagtgcacgctgtgggacaggagctgcaggtgacaggcccctttaacctgcaattgattgctaaggacgaccagctgaaggtcattgagtgtaatgttagagtttctagaagtttccctttcgtgtccaaaacattgggggtggatctcgtggcactggccacacgtgtgattatgggggaggaggttgagcctgtcggactgatgaccgggagcggggtcgtgggcgtgaaagtaccccagttcagcttttcacgcttggcaggggctgatgttgttctgggggtcgagatgacaagcactggagaggtcgccggcttcggcgaatcccggtgcgaagcctaccttaaggccatgctctccaccggcttcaagattccaaaaaaaaacattctgcttacaatcgggtcctacaaaaacaagagcgaactgctcccgactgtcagacttcttgagtctctcggctacagcctgtacgcaagtctgggaacagctgatttctacacggagcacggtgtgaaggtgacagctgtggactggcatttcgaagaagccgtggacggcgaatgccccccgcagcgatcgatactcgagcagttagccgaaaaaaacttcgagctagtgataaacttgtctatgcggggcgccggggggcgcaggctgtcctcctttgtgaccaagggctatagaacccgccggctcgctgcggacttctctgtgcctctgatcatcgacattaaatgtactaagttgttcgttgaagctctcggccagatcgggcccgcaccccctctgaaggtccatgtcgattgcatgaccagccagaagctggttcgtctgccgggcctcatagatgtccatgtccatctgcgggagcctggtggcacgcataaagaggacttcgcttccggtacagcggccgcacttgccggaggaatcactatggtctgtgctatgcccaacacacgaccacccatcattgacgcccccgctcttgctttagctcagaagctggcagaggcgggagcacgctgtgactttgccttgtttttaggcgcctcctccgagaatgccgggactctgggcacggtggctggcagtgctgcgggcctgaaattgtaccttaacgaaacattctcggagctccgcctggacagcgtagtacaatggatggagcatttcgagacttggccatctcatcttcccattgttgctcacgcagaacagcagacagtggccgcagtcctcatggtggcccagctgacccagcgcagtgtgcacatctgccacgtcgcacggaaagaggagattctgttgatcaaagccgctaaagcccggggactgccagtcacttgcgaggtggccccgcatcatctcttcctgtcccatgatgacttagaacgactcggtccggggaagggagaagtgcgtcccgaactgggaagtagacaagatgttgaggctctatgggaaaatatggctgtcatcgattgttttgcaagcgaccacgctccacacaccctcgaagagaagtgtggctcacgacccccccccggtttccccggactagaaacaatgctcccactgctgctgaccgcagtgtccgaaggccgtttgtccctagatgacctgctgcaaaggctccaccacaaccctcggagaatattccacctgcccccccaggaggacacgtatgtcgaggtggacctagagcacgagtggaccattcccagccacatgccattttccaaagcccattggacaccctttgagggccagaaagtgaaagggacagtacgtagggtggtcctgagaggggaggtggcttacatcgacgggcaggtcctggtccctcccgggtacggtcaggacgtccggaagtggcctcagggcgctgtgccacaactccccccttcagccccagctacgtccgaaatgactactacacccgagcgccccagacggggcatccctggacttccagacggaaggtttcacttgcctcccagaattcatagagcctccgaccccggcctgccagctgaggagccgaaagaaaagtcctcccgaaaggtggcagagccagagttgatgggtacacccgacggaacttgctatcctccgcccccagtcccacggcaagcaagcccccagaatctcggcacgccaggtcttctgcatccgcaaacgagtcctctgctgcactccctcgtaggacagcatattctgtctgtgcagcaatttactaaggatcagatgtctcacctcttcaacgtagcacacacgctgcgaatgatggttcagaaagagagatcattagacatcctgaaaggaaaagtgatggctagcatgttctatgaggtgagcactcggacatcctcatccttcgctgcagctatggcaagactgggtggagctgttttgtcgttctccgaggcgacatccagcgtccaaaaaggagagagccttgccgattccgtgcagaccatgtcctgttatgccgacgtcgtcgtgttgcgtcacccccagcctggagctgtggagctcgctgcaaaacactgcagacgccctgttatcaacgctggggacggcgtgggtgagcatccaactcaggccctgctggacatctttactatacgtgaagaactgggtaccgtgaacggtatgaccatcacaatggtcggcgatctgaaacacggcaggacagtgcattccttggcttgtttgctgacacagtatcgggtatctctcagatatgtcgcccctcctagcctgagaatgcctcccactgttcgcgccttcgttgcttccaggggcacaaagcaggaagagttcgaatccattgaagaagcactaccggacaccgacgtgttatacatgactcggattcagaaagagaggttcggttcaacacaggaatacgaggcgtgttttgggcagtttattttgacacctcatattatgactcgcgcaaagaagaagatggtcgtgatgcacccaatgccaagagtgaacgaaatcagtgtggaagtggatagtgatcctagggccgcttatttcaggcaggccgaaaatggcatgtatatccggatggctctgctcgccaccgtgcttggtagattttag

SEQ ID NO: 181565 - DNA, 1440 bp, Artificial Sequence
  Description of Artificial Sequence: Synthetic coding sequence
atggagaagggcctgaccctgccccaggactgccgggacttcgtgcactccctaaaaatgagatcaaaatatgcactatttctcgtcttcgtagtcatcgttttcgtgtttatagagaaagaaaacaagatcatcagccgagtgagcgataaactcaagcagatcccccaagcccttgctgacgcaaactcaactgacccggccttaatcctcgccgagaatgccagcctcttgagcttgtccgagctggactctgccttcagccagttacaatctcgcctcaggaatctcagtcttcagcttggtgttgagcccgccatggaagccgcgggggaggaagaagaagagcagcggaaagaggaagagccgcccaggcccgcggtggcaggcccacggcggcatgtgctgctcatggcaacaacgaggaccggttcctccttcgttggcgagttctttaaccagcagggaaacattttctacttatttgaacctctgtggcatattgagaggaccgtgtccttcgagccaggcggtgcgaatgctgccggttccgccttagtgtacagagacgtcctcaagcaattgttcctgtgtgatctctatgtgctggagcactttattaccccactaccagaagatcacctgacacagttcatgttcaggagaggctctagccgatccctttgcgaggatccggtgtgtacaccctttgtaaaaaaagttttcgaaaagtatcattgtaagaatcgtcgctgtgggccgttgaacgtgaccctggctgccgaagcttgcaggcggaaagagcacatggcgctcaaagctgttcgaattagacaactcgagttcctgcagcccttagctgaagaccctagattggacctaagagtgatccagctcgtgagagatcccagagcggtgttagcttctaggatggtcgcatttgcaggcaagtacaagacatggaaaaagtggcttgatgatgaaggtcaggacggcttgcgcgaagaggaggtgcagcggctgaggggaaattgtgagagcatccgtctgagcgcagaactgggactgcggcagccagcttggcttaggggtagatacatgctcgtgcgctacgaggatgtagctcgtggcccacttcagaaagctagggagatgtatcggttcgccggaattcccttgactccgcaggtggaagactggatccagaagaatactcaagctgctcacgatggcagcgggatatactcaactcagaagaatagttcagagcagtttgagaaatggcgattctccatgccatttaagcttgctcaggtggtacaagcagcatgtggccctgccatgcgcttattcggatacaaactcgctcgggatgctgccgccctcacaaatcggagtgtttcactcttggaagaaagggggaccttctgggttacctag

SEQ ID NO: 181566 - DNA, 1236 bp, Artificial Sequence
  Description of Artificial Sequence: Synthetic coding sequence
atgcagtgcagctggaaggccgtgctgctgctggccctggccagcatcgcaatacagtatacggccattaggacattcacagccaaatccttccacacctgtccaggacttgctgaagctgggctggctgagcgactctgtgaagagagcccgacctttgcatacaatctgtctcggaagacccatatccttatacttgcgactacccggagtgggtcctcttttgtcggccaactgttcaaccagcatctcgatgtattctacttgtttgagccactgtatcatgttcagaacacactaataccgcggtttacgcagggtaagtcacctgcagaccgccgcgttatgctgggcgcttcacgcgacttgcttcggtcattgtacgattgtgacctatactttctggagaattatataaagcccccccccgtgaatcacaccacggaccggatctttagaaggggggctagccgcgtcttatgctccagacccgtgtgtgaccctccaggaccggctgatttggtgttggaggaaggggattgtgtgaggaagtgcggtttgctgaatctgacggtcgccgccgaagcctgtagagaacgcagccatgttgccattaagacagttcgggtgcccgaggtcaacgacctgagggcgctggtggaagatccacgcttaaatctcaaagttattcagttagtgcgggaccccagaggaatcttagcgagtcgcagcgagacattccgcgacacttaccgtctgtggcgactgtggtatgggaccggacggaagccttataatttggatgtgacgcagctgacaactgtgtgtgaggatttctccaattccgtctcgacaggcctcatgcgaccgccttggcttaaggggaagtacatgcttgtcagatacgaagacctagctagaaatcctatgaagaaaaccgaggaaatttacggattccttggaatcccacttgattcccacgtcgcccggtggatacaaaacaacacaagaggggatcccactttaggcaagcacaagtatggtaccgtgcggaactcggccgcgactgcagaaaagtggcgtttccgactgtcctatgatatagtggccttcgcacagaacgcctgccaacaggtcttagctcagctgggatacaagattgcagcctctgaagaggagcttaagaacccgtcagtgagcctggtcgaagaaagagactttcgccctttctcttag

SEQ ID NO: 181567 - DNA, 1131 bp, Artificial Sequence
  Description of Artificial Sequence: Synthetic coding sequence
atgttcccccggcccctgacccccctggccgcccccaacggcgccgaaccgctggggcgggccctacggagagcaccactcggccgcgccagagccggactcggcggacccccgcttctactcccttcaatgcttatgtttgcagttatcgtggctagctccggcttgctccttatgatcgagcggggtatccttgcagaaatgaaacctcttccactccatcctccaggtcgagaaggaacggcctggcgcggcaaggccccaaagccgggtggcctttcactgcgggccggcgatgcagacctccaggtgagacaggacgttagaaaccgcacactgagagcagtgtgcggccagccagggatgccacgggacccttgggatcttcccgtcggacagagaaggacactcctgcggcatatcttggtgtccgatcgctataggttcctatattgctacgtgcccaaggtggcttgttcaaattggaaacgagtcatgaaggtgctagctggagtgctagactcagtagatgttcggttgaagatggaccaccgcagtgatctggtatttctcgccgatttgagaccagaggaaatccggtaccgacttcagcattactttaagtttctcttcgtccgggagcctcttgaacggctgctctcagcgtacaggaacaaatttggtgaaatccgggagtaccagcaacgctatggggcagagatagtgcgccgttacagagctggagccggaccaagtccagcaggtgatgacgtcacatttccggaatttctgcgctacctagtggacgaggatccggaacgaatgaatgagcattggatgcccgtctaccatctgtgccagccatgtgcagtccactacgacttcgtcgggagctacgagcgattggaggccgacgcaaaccaggtactggagtgggttagggcacctccacacgtgcggttcccagccagacaggcgtggtaccggccagctagtcccgagagcctgcactaccatctatgttctgctcctagagctctccttcaggatgtcttgcccaagtatatcctagatttctctctgttcgcttacccactgccaaacgttaccaaggaagcttgccagcagtag

SEQ ID NO: 181568 - DNA, 1275 bp, Artificial Sequence
  Description of Artificial Sequence: Synthetic coding sequence
atgaccctgcggcccggcaccatgcggctggcctgcatgttcagctctattctcctgttcggcgcagccgggcttctgcttttcatatctctgcaggacccaaccgaattggctcctcagcaggtcccgggtattaagtttaatatccggcccaggcagccccaccatgacctgccccctggcggtagtcaggacggcgatctgaaagaaccaaccgagcgcgtcacacgggacctgtcttccggagctccccgcggcagaaacctcccagcccccgatcagcctcagcccccactgcagagaggtacccgcttgcgcttgcgccagaggcgacggaggctactgatcaagaagatgcccgccgctgccaccatccctgctaacagcagcgacgctccattcatcaggcctggtccagggaccttggacggtcgatgggtgtcgctgcaccgctcacagcaggagcggaagcgggtaatgcaggaagcctgcgctaagtaccgggcttccagcagcagaagggctgttactcctcgccatgtaagccggatcttcgtcgaggaccggcatcgggttctgtactgcgaagtcccaaaagcaggttgctccaactggaagagagtgctcatggtccttgcggggttggcatccagtacggccgacatacagcataataccgtccactacggatctgctcttaaacgactggacaccttcgataggcagggcatcctccacaggctgtctacttacaccaagatgctgtttgtccgggagccctttgaacggttagtgtccgcattccgggataagtttgagcatcccaatagctattatcatccagtgttcgggaaggccattctggccaggtatagggctaacgcctcacgcgaagcccttcggaccggaagcggtgtgagattcccagaattcgtccagtatctgctcgatgtacaccggcctgtgggaatggatatccattgggaccacgtttcgagactgtgttccccctgccttatcgattatgacttcgtggggaagtttgaatctatggaggacgacgccaacttcttcctgtctctgattcgggctcccagaaatctaacctttccaagattcaaagatcgccactcccaggaggcgaggacaaccgcaagaatcgcacatcagtactttgcccaattatcagcactgcaacgccaaaggacatatgacttttattatatggattaccttatgttcaattactccaaaccctttgcggatctctactag

SEQ ID NO: 181569 - DNA, 1275 bp, Artificial Sequence
  Description of Artificial Sequence: Synthetic coding sequence
atgaccctgcggcccggcaccatgcggctggcctgcatgttcagctcaatactgctgttcggcgccgcaggactcttgctgtttatatccctgcaagatcccaccgagctagcacctcagcaagtcccgggcatcaagtttaatatacgcccacggcagccccaccatgatctgccacctgggggttcacaggacggagacctaaaagaacctactgagagggttacccgggatctttcttccggagccccgcgcggtcgaaacctccccgctccagaccaaccccaaccgcccctgcagcgggggacgcgcctgcgcctaagacagcgacgccgccgtctgctgatcaaaaagatgccggccgctgcaaccattcctgcaaactccagcgacgctcccttcattcggccaggaccaggcactttggacgggagatgggtcagtctgcatagaagccagcaggagcgaaagcgcgtcatgcaggaagcatgcgcaaagtaccgcgcctctagcagccgaagagctgtgactccccggcacgtgagccgaatctttgttgaagatcggcatagagtactgtactgcgaagtccccaaggccggatgttccaactggaaaagagtcctgatggtcttggccggcttagcatcttccacagccgacatccagcataatactgtccattatggcagcgcactgaagaggctggacaccttcgatcgccaaggaattctgcacagacttagcacctacacgaagatgctgttcgtgcgcgaaccgttcgaacggttagttagcgctttccgggacaaattcgagcatccgaactcatactatcacccagttttcggaaaagctatactggccagataccgcgctaacgccagtagagaggcccttcgaacagggtctggagttcgcttcccagagttcgtccaatacctgttagatgttcaccgtcctgtgggaatggacattcattgggatcatgtatcgaggttgtgctccccatgccttatcgactatgacttcgtaggcaagttcgaatctatggaggacgacgctaatttcttcctttccctgatccgggccccgagaaatcttaccttccctagatttaaggataggcacagccaggaagcgaggaccactgctaggatcgcacaccagtactttgcccagctctctgccctgcagaggcagagaacatatgacttttactatatggattatctgatgtttaactacagcaagcctttcgctgatctgtattag

SEQ ID NO: 181570 - DNA, 1275 bp, Artificial Sequence
  Description of Artificial Sequence: Synthetic coding sequence
atgaccctgcggcccggcaccatgcggctggcctgcatgttcagctcaatcctcctattcggtgctgccggactgctcctgtttattagtcttcaggacccaacggagcttgcaccccagcaggtccctggcatcaaatttaatattcgtccccgtcagcctcatcacgacctccccccaggcggttctcaggacggcgatttaaaggagcctacagaacgcgttacaagagacttgtcttccggcgccccccgcggaagaaaccttcccgcgcccgatcagccccagcccccgctgcaacgcgggaccaggttgcgcttgagacagaggcgaaggcggcttctgatcaaaaaaatgcctgcggcagccaccatccccgcaaactcatctgacgcacccttcatcaggccgggccctggaactctggacggacgctgggtgtccctgcaccgatcccagcaggagagaaagagagttatgcaggaggcctgcgccaagtatcgcgctagtagcagccgtcgggcagtgaccccgaggcacgtatcccggatatttgtggaagataggcacagggtgctttattgcgaagtgcctaaggcagggtgcagtaactggaagagggtactgatggtgttagctggccttgcgtcgtctacagccgacatccagcataacactgtccactatgggagcgctcttaaacgcttagatacatttgaccgccaggggatcctacatcgactgagtacttacacaaagatgctcttcgttcgggagcccttcgaaagattagtttctgcattccgtgacaagttcgagcaccctaacagttattatcatccagtgttcggaaaagcaatattagcccgctaccgtgccaacgccagtcgagaggctctcaggaccgggagcggggtcagattcccagagttcgtacagtacctcctcgacgtccatcgaccagttggcatggatatccactgggaccatgtgagtaggctctgcagcccgtgtctcatagattacgactttgtgggaaagttcgagtccatggaagatgacgccaacttctttctttctctcatcagggctccaaggaacctgacgtttccacgatttaaagaccgccacagtcaggaggccagaactaccgcccgcattgcacaccaatatttcgcccagctgtctgcccttcaacgacagagaacatacgacttctactacatggattaccttatgttcaattactcgaaaccctttgccgacctgtactag

SEQ ID NO: 181571 - DNA, 1686 bp, Artificial Sequence
  Description of Artificial Sequence: Synthetic coding sequence
atgcggcactgcatcaactgctgcatccagctgctgcccgacggcgcccacaagcagcaggtgaattgccagggtggaccacaccatggacaccaggcctgtcccacctgtaagggggagaacaaaattctgtttagggtcgatagtaagcagatgaaccttcttgcagtactggaagtgcgtaccgaaggaaatgagaactgggggggcttcttgcggttcaagaaggggaagcggtgctcactggtcttcggtcttatcatcatgaccctcgtaatggcatcttatattctgagcggcgctcaccaagaactgctgatttcatcccctttccattacggaggctttccatctaatcccagccttatggactcggagaatccttcggacacgaaggaacaccaccaccagtccagtgtaaacaatatttcttacatgaaggattacccctccatcaaactaataattaattccatcacgacaaggatcgaatttaccacacgccagctgcccgatctggaagatctgaaaaaacaggaactgcacatgttcagtgtgatacccaacaagtttttgcccaattccaaaagcccgtgctggtatgaagagttcagtggacagaacaccacagatccatacctgacaaacagttatgtgctctactctaagcgatttcgttccacctttgacgccctgaggaaagcgttctggggccacttggctcacgcacacggaaagcacttccgtctgcgatgcctaccacacttctacataattggccagcccaagtgtgggactaccgatctgtatgatcgccttcggctgcatcctgaggttaaattcagtgccattaaagagcctcactggtggacgcggaagcggtttggcatcgtaaggttacgggatgggcttagagacagatatcccgtcgaagattacctggacctttttgacctcgcggcccatcagattcatcaggggctccaggcctccagtgccaaagagcaaagtaagatgaataccatcattattggcgaagcaagtgccagcacgatgtgggataataatgcctggaccttcttttatgacaactcaacggatggcgagccacctttccttacacaggactttatccacgcgtttcagccgaatgcacggttaatcgtcatgctgcgtgatccagtggagcggttgtattccgactacctgtatttcgcttctagcaataagagtgctgatgacttccacgaaaaggtcaccgaagcactgcagctatttgaaaattgcatgctagattacagcctgagagcttgcgtttataataacaccctaaacaatgctatgccagtgaggctccaggtgggcctctatgctgtctatcttctggactggctctcagtcttcgacaagcagcagttcctgatcctacggctggaggaccacgcatctaatgtgaaatacacaatgcacaaagtattccagtttctgaacctcggccccttatctgaaaagcaggaggccctgatgacaaagtcccccgcttccaatgcacgcagaccagaggaccgaaacctgggccccatgtggccaattacacaaaagattttgagagatttctatcgaccctttaatgcccgcttggcgcaagtcctggcagacgaggcttttgcctggaagactacatag

SEQ ID NO: 181572 - DNA, 1521 bp, Artificial Sequence
  Description of Artificial Sequence: Synthetic coding sequence
atgcggcactgcatcaactgctgcatccagctgctgcccgacggcgcccacaaacagcaggtcaattgtcagggcggacctcaccatggccaccaagcctgccccacttgcaagggagagaataagatcctcttccgcgtagattcaaagcagatgaacctcctcgccgtgctggaggttaggaccgaagggaacgagaactgggggggtttcctccgatttaagaaggggaagcggtgctccctggtttttggtctcataattatgaccttggtgatggcatcttatattctcagtggagcccaccaggaactgctcatttcttccccatttcattatggcggttttccgagcaacccctcactgatggattcagaaaatccatccgacacgaaagaacaccaccatcagtcatctgtgaacaacatttcctatatgaaagattacccgagtattaaactgatcatcaatagtatcaccacacggattgagtttactaccaggcaactgcctgacttagaagatctgaagaaacaggaactccacatgttttctgtgatccctaataagttccttcctaattccaaatcgccctgttggtacgaggagtttagtggccagaatactaccgatccttatttgactaatagttacgtgctttatagtaagcgcttccggagcacatttgatgcgctgcgcaaagctttctggggccacttagcgcacgctcatggcaagcactttagacttagatgcctcccgcacttctacattatcggacagcccaagtgcggcacgacagacctttacgatcgcctcagattgcatcctgaggtgaagtttagtgctattaaggagccacattggtggactcgcaaaaggttcggaatagtgagactcagagatggtctccgcgaccgctaccccgtagaggattatttagatctgtttgaccttgcggctcatcagatccaccagggcctgcaggcctctagcgctaaagagcagagcaagatgaataccattatcatcggcgaagccagtgcctctacaatgtgggacaacaacgcctggaccttcttttatgacaattcaactgatggagaacctccgtttctgactcaggatttcattcatgcttttcaacccaacgctcgcctaatcgtaatgctgcgtgaccctgttgagcggctgtattcggattatctctacttcgcctcttcgaacaaatccgcagacgattttcatgaaaaggtgaccgaggccttgcagctcttcgaaaactgcatgttagactactctttacgcgcttgtgtgtataataacacactgaacaacgctatgcctgtgtgcactccacctccccggacacctagggccggtccttggcagaaagagctcgtgtgctgttattatgcttccggaattgtgggattgcggttttctattggtactgaaagatccgtgcttatgtgcaaatgctgcagtcctttatttatggatgtgaaggccgagaactag

SEQ ID NO: 181573 - DNA, 624 bp, Artificial Sequence
  Description of Artificial Sequence: Synthetic coding sequence
atgcggcactgcatcaactgctgcatccagctgctgcccgacggcgcccataagcagcaggttaactgccagggcgggccccatcatggccaccaggcttgccccacatgcaagggggagaacaagatcctgtttcgggtagacagcaaacaaatgaacttgttggcggtcctggaagttcggacggaagggaatgaaaactgggggggcttcctgagattcaagaaggggaagagatgtagcctcgtgttcgggctaattattatgacgctggtgatggccagttatatcttgagtggggcccaccaggaactcttgatatcttcaccctttcactacggagggtttccttctaatcctagccttatggattcagaaaacccgagcgataccaaagaacatcatcatcagagcagcgtgaataacatctcttacatgaaggactacccatccataaagttaatcatcaattctatcacaacacgaatcgaattcaccacaagacagctaccagatctggaagacctgaagaagcaagaactccatatgttttcggtgatcccaaacaaattccttcctaagcacaacgcccaggccgagctaggtttgaacgtggcctgctag

SEQ ID NO: 181574 - DNA, 1686 bp, Artificial Sequence
  Description of Artificial Sequence: Synthetic coding sequence
atgcggcactgcatcaactgctgcatccagctgctgcccgacggcgcccacaagcaacaggttaactgccagggcggcccacatcatgggcaccaggcctgcccaacctgtaaaggagaaaacaaaatcttgtttcgggtcgatagtaaacagatgaatttgttggctgtgttggaggtgaggaccgagggtaatgaaaattggggagggttcttacgattcaagaaaggaaaaagatgcagcttggtcttcggattgataattatgacactggtgatggccagctatattctcagcggggctcatcaggaattattgatttcatctccttttcactatggcggattcccctcaaatccttctctgatggatagcgagaatccatctgacaccaaggagcatcaccaccagagttcagtgaacaacatctcatacatgaaggactacccctccatcaagctgattattaactccattaccaccagaatagaattcactacaagacagttacctgacttagaagatcttaaaaagcaggagctgcacatgttttccgtaattccgaataaattcctgccaaattccaaatcaccctgttggtacgaggagttttcaggccagaacacaaccgatccgtatttgactaatagttacgtgttatactccaagaggtttcgatccacgttcgatgctctgagaaaggcattttggggtcatttggcccacgcgcatggcaagcacttcagactgcgctgcttaccgcacttttacatcatcggacagcccaaatgcgggaccaccgatctgtacgatagactgcgcttgcacccagaggtgaagttcagtgcgataaaagagccccactggtggacaaggaaacggttcggcatcgtgcgccttagggatgggctgagggacagataccccgtggaagattacttggacctgtttgacttagcagcccatcagattcaccaggggcttcaagcttcctccgccaaagaacagtctaagatgaatactatcatcatcggggaggctagcgcctctactatgtgggacaacaatgcctggacgttcttctacgacaacagcaccgacggggagccccctttcctgacccaagacttcatccacgcctttcagccaaatgctaggctgatcgtcatgctgagagatccagtcgaacgtctctacagcgattacctgtacttcgccagctcaaacaaaagcgccgacgacttccacgaaaaagtaaccgaagcactccagcttttcgaaaactgtatgttggattactctctgagggcctgcgtgtataataacaccctgaacaacgctatgcccgtgagactgcaggttgggttgtatgccgtgtatctccttgattggttgtcagtctttgacaaacagcagtttctgatcctgaggctcgaagatcatgcctcaaacgtgaagtatacaatgcacaaagtctttcaatttctgaacctggggcccctttctgagaagcaggaggctttgatgactaagtcacccgctagcaacgcccgccgccccgaagatagaaaccttggcccaatgtggccaattactcagaagattctgcgggacttctacagaccattcaatgcccgccttgctcaggtacttgccgacgaggctttcgcttggaaaacaacatag

SEQ ID NO: 181575 - DNA, 1449 bp, Artificial Sequence
  Description of Artificial Sequence: Synthetic coding sequence
atgcggcactgcatcaactgctgcatccagctgctgcccgacggcgcccataaacagcaagttaattgccaaggcggcccgcatcacggtcaccaggcttgccccacatgtaaaggtgaaaataaaattctgtttcgtgtggatagcaagcagatgaatctgttggctgtgcttgaagtaagaactgagggcaacgagaattggggagggtttcttcggtttaagaagggcaaacggtgttccctggtgtttggacttatcattatgacactcgtcatggcctcgtacatactctcaggagcccaccaggagttgctcattagtagtcccttccactatggcggattccccagcaacccatcccttatggacagcgaaaatcccagcgacacaaaagagcatcatcaccagagctctgtcaataacatctcatatatgaaggactatcccagcattaaactcatcattaactccataacaacaaggatagaatttactacaaggcagctaccagacctagaggacttgaagaagcaagagctgcatatgttcagcgtgataccgaacaaatttctgcctaattcgaaatcaccttgttggtacgaagagtttagcggacagaatacaacagacccttacctcacaaatagctacgtactctactctaaaaggttccgaagtacgtttgacgccttgaggaaagctttttggggacacctcgcacatgcgcatgggaaacacttccgactccgatgcctcccacatttctatattatcggccagcctaagtgtggcaccaccgatttgtacgaccgcttaagacttcaccccgaggtgaaattcagcgcaatcaaagaacctcattggtggactcgcaaacgctttggcattgttaggctgcgagacggactcagagatagatatcccgttgaggactatctcgacttgtttgacctggctgctcatcagattcatcaggggcttcaggcatcgtccgctaaagagcagtcgaaaatgaatactatcataattggggaagcatctgcctcaaccatgtgggacaataatgcttggactttcttctatgataacagcaccgatggggaacccccatttctgacgcaggacttcattcacgcctttcaaccgaatgccaggctcattgtgatgctgagagatcccgtggagagactctatagcgattatctgtatttcgcctcatccaataaatctgctgatgatttccacgagaaagtgactgaggcactgcaactcttcgagaactgcatgctcgattactccctgagggcttgtgtctacaataatacattgaataatgcaatgccggtctgtactcccccccctgttcccccagagctggcacccggccggcgttcctggtttgtcgtgatcatgcaggccgccctgtgggtgtgtgtaagcgcatag

SEQ ID NO: 181576 - DNA, 1236 bp, Artificial Sequence
  Description of Artificial Sequence: Synthetic coding sequence
atgggcatgcgggcccgggtgcccaaggtggcccacagcacccggcggccccctgctgcacgcatgtggcttccaagattttctagtaagactgtgacggttctcctcctggcccagaccacctgtctccttctcttcatcatttcgaggcccggtccatcctcaccggccggcggggaggatagagtgcatgtgttagtgttgtcctcctggcggtccggatccagcttcctgggccagctgttttcccaacatccggatgttttttacctgatggagcctgcttggcatgtatggactaccttgagccagggaagcgccgctacactgcatatggcagtgcgcgacctgatgcgcagtatcttcctgtgcgacatggacgtgtttgacgcctatatgccacaatctagaaacctgagtgcctttttcaactgggctacgtcccgcgccttgtgttcccccccggcctgtagcgcgtttccccgggggaccatctcgaagcaggacgtgtgtaaaactctgtgtactcgccagccattttccctggcacgtgaggcctgccgcagctattctcacgtcgtgcttaaggaagttcggtttttcaacctgcaagtactttatcctttgctctccgaccccgccctgaacttgaggatagtccatctggtgcgtgaccccagagcagtccttaggagcagggaggccgcaggacctattcttgctcgtgacaacggcatagtcctggggactaacggcaaatgggtcgaagccgatcctcaccttaggttaatcagagaggtctgccgcagccacgtccgtatcgcagaagcagccactctgaaacccccaccattccttcggggacggtatcgcctggttagattcgaagacctggcccgtgaacctcttgcagagatccgcgcactttacgcattcactggtttaacacttacccctcagctggaagcctggattcataatattactcacgggagcgggatcggaaagccaatcgaagccttccatacttcttcaaggaatgcgaggaatgttagccaggcatggaggcatgccctgcctttcactaagatactgcgggtgcaggaggtgtgcgcaggcgcactgcagttactgggttacaggcccgtgtatagcgcagatcagcagagagatctgaccctggatctcgtgttgccacggggtcctgatcacttcagctgggcaagccccgactag

SEQ ID NO: 181577 - DNA, 1254 bp, Artificial Sequence
  Description of Artificial Sequence: Synthetic coding sequence
atgagccggcacctgccctggatctgcgaccagcggtgcagcagcccctccagcccaggccgctggcctccagctgcccggatgtggctgccccgcttctcttcgaagaccgtgacagtgcttttgctcgcgcaaacgacatgtctgctgttgttcattatatctcgcccagggcccagttcccccgctgggggcgaggatcgcgtacacgtgctcgttctgagttcatggcgctcaggttcttcttttctcggccagctattctctcagcaccccgacgtgttttacctcatggagcccgcatggcatgtttggactacccttagtcaaggaagtgctgcaacactccatatggcggttagggatctgatgagatccatttttctgtgtgatatggatgtgttcgatgcctacatgccccaatccagaaatctgtctgcctttttcaactgggcaaccagcagggcactgtgttcccctcccgcatgttctgcatttccccggggcacaatcagcaagcaggacgtttgcaagactctctgtactcggcagcccttttccctcgcccgcgaagcctgccgttcatacagtcacgtcgtgctgaaagaagttaggttttttaacctgcaggtcctgtaccctctgctatctgatcctgccctgaacctccgaattgtgcatcttgtgagggatcccagggcggtacttcgtagcagagaagctgccggacccattttggctagagacaacggtatcgtgctggggacgaatggaaaatgggtagaagctgatcctcaccttcggctgattcgcgaagtctgtcgtagccacgtacgaattgccgaggctgcaaccctcaaaccgccaccgtttttacggggccggtataggttggtccgattcgaggatttagcccgagaacccctcgctgagatcagagccctttacgccttcacgggcctaacgttaactccacaactggaggcctggatccacaacataacccacgggtccgggatcggcaagcccatcgaggctttccacacgtcatcccgcaacgccagaaatgtgtcgcaggcctggagacacgctctcccttttaccaaaattctgagggtccaggaagtctgcgcgggcgccctgcaactcctcggttatcggcccgtgtactctgccgatcagcagagggatctgaccctggatcttgtgctgccgaggggccccgatcatttttcctgggccagtcccgactag

SEQ ID NO: 181578 - DNA, 1188 bp, Artificial Sequence
  Description of Artificial Sequence: Synthetic coding sequence
atgtggctgccccgggtgagcagcaccgccgtgaccgccctgctgctggcccagaccttcttgctcctgttcctggtgtctcgccctggaccatcctctccggccggaggcgaagctagagtgcacgttctcgtcctgtcatcatggcggagtggctccagctttgtgggtcagttgttcaatcagcaccccgacgtcttctacctgatggaacccgcttggcacgtgtggaccacgttgtcacaaggcagcgccgcaaccctgcacatggctgtccgggacctagttcgatctgttttcctgtgcgacatggacgtgtttgatgcatacttaccatggaggaggaacctgtcagaccttttccaatgggcagtgtccagagctctgtgttctcctccggcctgctcagctttcccccggggcgctattagctcggaagccgtgtgtaagccactttgcgctagacagtcatttaccctggcacgggaggcgtgccgcagctattcacatgtggtgctgaaggaggtgaggtttttcaatctccaggttttatatcctctgctgtcagatccagccttgaacctacgtatagtccaccttgttagagaccctagggccgttctgcgctcacgtgagcagacagccaaagccctcgccagggataacggaatagtgctgggaacgaacggcacctgggttgaggccgaccccgggctccgcgtggtccgcgaggtctgcagatctcatgttcgcatagcggaagctgcaaccttgaaacccccccctttcctgcgtggaaggtaccggcttgtacgattcgaggacctggcccgggaacccctggccgaaataagggcactgtacgcgttcaccggcctgtccctgaccccccaacttgaggcttggatccacaacattacacacggaagcggtccaggtgcccgcagagaagccttcaaaaccagcagcaggaacgccctaaatgtatcacaggcttggcgccacgcattgccctttgccaaaatccggagggtccaggaactatgtgctggtgctttgcaacttctaggatatcgacccgtgtacagtgaagacgagcaaagaaatttggcccttgatttagtgcttcctcgcggcctgaatgggttcacgtgggcctcgagcacggcctcacaccccagaaattag

SEQ ID NO: 181579 - DNA, 1188 bp, Artificial Sequence
  Description of Artificial Sequence: Synthetic coding sequence
atgtggctgccccgggtgagcagcaccgccgtgaccgccctgctgttggcccagacatttcttctcttattcctcgtgagcagacccggcccatctagtcctgcaggcggtgaggcacgggttcacgttctagttttgtcatcttggcgatccgggtcttccttcgtcggacagctctttaaccagcacccagatgtgttctatttaatggagcctgcctggcacgtgtggaccactcttagtcagggaagcgcggcgactttgcatatggcagtgcgggatctggtgaggagtgtctttctttgcgacatggacgtgtttgatgcctacctcccctggcgtcggaatctcagcgatttgttccaatgggcggtgtcacgggctctgtgttcccccccggcgtgttcagctttcccaagaggcgccatcagctccgaagcagtttgtaagcccttatgtgccagacagtctttcaccttagcccgggaagcatgccggtcttactcccatgtggttttgaaggaagtgagattttttaacctgcaggtgttataccctctcctttccgacccagcactcaacctgcgaatcgtgcacctcgtccgggatcctagagcggtcctgcggtcccgggaacaaaccgccaaggcgctagcgagggacaatgggatcgtgctgggtactaatgggacctgggtagaggcagatcctgggctacgggtggtccgagaagtgtgtaggagccacgtccggatagccgaggccgcgacacttaaaccacctccatttcttcgaggaagataccggctcgtacggttcgaggacctggccagagaaccacttgccgagatcagagcactgtatgcctttaccggcctgtccctgacaccccaactggaagcttggattcataatattacacacggtagcgggccgggtgcccgccgagaggcattcaaaacatccagcagaaatgctttaaacgtgagccaggcttggcgtcatgccttgccttttgctaagatccggcgtgtccaggagctttgtgccggggccctgcagctgctgggctacaggcctgtttacagcgaggacgaacagaggaacttggcccttgatcttgtcctgcccagaggattgaacggtttcacctgggcctcaagcacagcgtctcaccccaggaactag

SEQ ID NO: 181580 - DNA, 1461 bp, Artificial Sequence
  Description of Artificial Sequence: Synthetic coding sequence
atgaagggccggcggcggcggcggcgggagtactgcaagttcgccctcctgctcgtgttgtacactctggtcctgctgctcgttccgtctgtgctggacgggggtcgtgacggcgacaaaggagccgagcattgccctggtttacagcgtagcctgggggtctggagcctggaggctgccgccgcaggcgagcgggagcagggcgcggaagcacgggcagccgaagaaggtggagcaaatcagtcccctagattccccagcaatcttagcggggcagttggtgaggccgtttcacgagaaaaacagcacatttacgtgcacgcaacatggcgaaccgggtccagcttcctaggggagctatttaatcagcaccccgacgtattctacctctacgagcctatgtggcatctctggcaggccctatatcctggagacgctgaatctctgcaaggagccctgagagatatgctccgctcactgttccgctgcgatttcagcgtcttacgtttgtacgcaccacccggtgacccagctgccagggcacctgataccgccaacctgacaaccgccgcgctgtttcgctggcggactaataaagtaatttgctctccaccactgtgccctggggcaccccgcgccagggcggaggtgggactcgttgaagacaccgcttgcgagcgctcctgtccccccgtggccatccgggccctggaagcggaatgccggaaatatccagtggtggtgattaaagacgttagactgttggacctgggcgtactggtccctctacttcgtgaccccggactgaaccttaaagtggtccagctgttccgggacccccgcgcagttcacaattctagactgaaatcaaggcagggcctgctaagggaatccatacaggtgctgagaactaggcagcgcggcgatagatttcaccgagtgcttttggctcacggtgtgggtgcacgacccggcggccagtcgagagctctcccggcagcacctcgagctgattttttcctaacgggggcgcttgaggtgatttgtgaagcttggctaagggacctgctgtttgcaaggggcgcccccgcatggttgcgccggaggtatttaagactgaggtacgaagatctggtgcggcagccccgcgcgcagttgaggcgactactaaggtttagcggtcttagggccctggctgctttagacgcctttgctctgaatatgaccaggggagcggcctacggtgctgatcgccctttccacctgtctgcccgcgatgcaagggaagccgtgcacgcatggcgagaacgactgtctcgcgagcaggttcgccaggtggaggcagcatgtgctcctgctatgagactgttggcttaccctcgcagcggggaagagggggacgctgagcagcctagagaaggcgagacgcccttggaaatggacgctgatggcgccacttag

SEQ ID NO: 181581 - DNA, 1593 bp, Artificial Sequence
  Description of Artificial Sequence: Synthetic coding sequence
atgagccggagcccccagcgggccctgccccccggcgccctgcccagactgcttcaggccgcccctgcagcagcccccagggccctcctcccgcagtggcccagacgtccaggccgtcgttggcccgcctctccattagggatgaaagtgtttcgacgcaaagctttagttctgtgcgctggctacgcgctgttactagtcctcacaatgctgaatctacttgactacaagtggcacaaggagcctctacagcaatgtaacccagatggaccactcggtgctgccgccggagccgctggagggagttgggggcgtcccggccctcccccagctgggccaccccgtgctcatgccaggcttgatctgaggacaccgtatcgtcccccagcagcagctgtcggcgccgcacctgctgccgctgccggcatggcaggcgtggctgcccctccaggcaacgggacaagaggaactggtggcgtcggagacaaacggcagttggtctacgtttttacaacttggcgaagcggctcctcctttttcggtgagctgtttaatcagaaccctgaagtgtttttcctctatgagcctgtgtggcacgtgtggcagaaactgtaccctggagatgccgtgtctttgcagggggcagcccgcgatatgctgtctgccctgtacagatgtgacctcagcgtgtttcaattgtactctccagcaggatccggcggtaggaacctgacaaccctgggtatcttcggcgctgcaactaacaaagtcgtttgttcctcccccctctgcccggcatatcgcaaagaagttgtgggtctggtggatgatcgtgtctgtaaaaagtgtcctccgcagaggctggcacgcttcgaagaagaatgtcgaaagtaccgaaccctagtcatcaaaggcgttcgtgtgtttgacgtcgccgtgctcgctcctctgctacgggatccagcgttggatctaaaggtgatccatctggtgcgagacccacgggccgtggcatcttctagaatccggtcacggcacgggctcatccgggagtcactccaggtggtaagatcccgggacccaagagcccatcgcatgcccttcctggaggctgctggccataagctgggcgccaagaaagagggcgtcggtggacctgctgactaccacgcgctcggcgcaatggaagtgatttgcaactctatggctaaaacacttcagactgcgcttcaacccccagattggttgcagggacactatctcgtggtcagatatgaagatcttgtcggcgacccagtcaagactcttcggcgcgtctatgatttcgtcggcctgttagtttcgccggaaatggagcaattcgcactcaatatgacatccggcagcggctcatccagtaaacccttcgtggtcagcgcacgcaacgcaacccaggccgcaaatgcatggcgaactgctctgacttttcaacagataaagcaggtagaagaattctgctatcagcccatggcggtgctgggctatgaaagagtgaactcaccggaagaggtcaaagatcttagtaaaacactcttaagaaaaccccgtttgtag

SEQ ID NO: 181582 - DNA, 1071 bp, Artificial Sequence
  Description of Artificial Sequence: Synthetic coding sequence
atgcaccaccagtggctgctgctggccgcctgcttctgggtgatctttatgtttatggtcgcttcaaagtttatcacgctgactttcaaagacccggacgtttatagcgctaagcaggaatttctctttctgacaaccatgcctgaagtacggaagctgccagaagagaaacacattccggaagagctgaagcccacaggcaaggagcttcccgacagccagctcgtgcagccattagtgtacatggagcgcctggaactgataaggaacgtctgtcgagacgacgctctgaagaatttgtcacacacaccagtcagtaaatttgtgctggatcggattttcgtctgtgacaaacataagatattgttttgccagacccccaaagttggaaacacacaatggaagaaagtgctgattgtgctgaatggggctttctcatctatcgaagaaattcctgagaacgtcgtgcacgaccatgaaaagaacgggctccctcgattaagcagtttctccgatgctgaaattcagaaaaggctcaagacatactttaaattcttcatagtccgagaccccttcgagcgcctgatcagcgccttcaaggacaagtttgtgcataacccaaggttcgagccctggtatcgccacgaaatcgcaccaggcataatccgcaagtaccggcgcaataggaccgaaaccagagggatccaattcgaagatttcgtcaggtacctcggcgaccccaaccaccgttggctcgatctgcaattcggtgaccacattatccactgggtgacatatgtggagctttgtgctccctgtgaaatcatgtacagcgtaattggtcatcacgagacactggaagacgacgccccttatattcttaaggaagccggcatagatcatctcgtatcgtacccaaccattccacctggaatcactgtgtataacagaaccaaggtcgagcactatttcctgggtattagcaaaagggacattcgacgtctgtacgcccgatttgaaggcgactttaagctgttcggctaccaaaagcccgacttcttgctgaactag

SEQ ID NO: 181583 - DNA, 426 bp, Artificial Sequence
  Description of Artificial Sequence: Synthetic coding sequence
atgcaccaccagtggctgctgctggccgcctgcttctgggtgatcttcatgtttatggtggcgagcaagttcattaccctaacctttaaggaccccgacgtgtattcagcaaagcaggagttcctgtttctcactacgatgcccgaggtgagaaaactgcctgaggaaaaacacatcccggaggaattaaaacccaccgggaaggagctgcccgatagccaactggtgcagccactcgtttacatggagcggttagaactcattcgcaatgtgtgtagagatgatgcactgaaaaatctgtctcatacccctgtgtccaagttcgtcctggaccggatcttcgtctgtgataaacataagatcctgttctgtcagacccccaaggtaggcaatacgcagtggaaaaaggtgctcatcgtcttatag

SEQ ID NO: 181584 - DNA, 1071 bp, Artificial Sequence
  Description of Artificial Sequence: Synthetic coding sequence
atgcaccaccagtggctgctgctggccgcctgcttctgggtgatcttcatgtttatggtggcctccaagttcattactttgaccttcaaggatcctgatgtgtattccgcaaaacaggaattcctgttcttgactaccatgccggaagttcgcaagttgccggaggagaaacacattcctgaggaactgaaaccaaccgggaaagaattacccgatagccaactcgtccagccactggtttatatggaacggttggagctgatccggaacgtttgcagggatgatgcgctgaaaaatctgagccataccccggtaagcaagtttgtgctggacaggatctttgtgtgcgacaagcacaaaatcctgttttgccaaacccccaaggtggggaacacccagtggaaaaaagttctcatcgtattaaatggcgccttttcttcaattgaagagatcccagagaatgtagtgcacgatcatgaaaagaatggacttccacgtctgagctcattcagcgacgccgaaatccagaagagactgaaaacctacttcaagtttttcatcgtccgggatccttttgagcggcttatctctgccttcaaagataagttcgttcataaccctcgatttgagccttggtatagacatgagatcgcaccaggtattattcggaagtaccgacggaaccgcaccgaaactcgtggaatacagttcgaggacttcgttcgttatcttggtgatcccaaccaccgatggcttgacctgcaattcggcgaccacatcatccattgggtaacctacgtcgagctgtgtgctccctgcgagatcatgtacagcgttattgggcatcatgagactctagaggatgacgcaccttacatccttaaagaggctggcattgatcacctcgtctcatatccaacaataccaccaggaatcactgtctacaacaggaccaaagtcgagcactatttcctgggcatctccaaacgagatattcgtcgcctatacgccaggtttgagggggatttcaaactttttgggtatcagaaacctgattttctgctcaactag

SEQ ID NO: 181585 - DNA, 195 bp, Artificial Sequence
  Description of Artificial Sequence: Synthetic coding sequence
atgcaccaccagtggctgctgctggccgcctgcttctgggtgatcttcatgtttatggtagctagtaaatttatcactctcacctttaaggatcccgatgtgtattccgcaaagcaggagttcctttttttgaccactatgcccgaggtgaggaaacttcctgaggaaaagcacatccccgaggagctgaagtag

SEQ ID NO: 181586 - DNA, 402 bp, Artificial Sequence
  Description of Artificial Sequence: Synthetic coding sequence
atgcaccaccagtggctgctgctggccgcctgcttctgggtgatctttatgttcatggtggctagcaaattcattaccctcacatttaaggacccggatgtttacagtgccaaacaagagttcctgtttctgactacaatgccagaggtacgcaaactgcctgaggagaagcacatacccgaagaacttaagccgaccggaaaagaactaccggattcacagctggtgcaaccgttggtgtatatggagcggcttgaactcattagaaacgtgtgcagagacgatgccctgaagaatttgtcacatactcctgtgtccaagttcgttcttgaccgaatctttgtgtgtgacaaacacaaaattctgttctgccagacgccaaaagttgggaatacacagtag

SEQ ID NO: 181587 - DNA, 258 bp, Artificial Sequence
  Description of Artificial Sequence: Synthetic coding sequence
atgcaccaccagtggctgctgctggccgcctgcttctgggtgatcttcatgtttatggtcgcatctaaattcattacgttaacatttaaggaccctgatgtgtatagcgctaagcaggagttcctgtttctgactacgatgcctgaagtgcgaaaactcccagaagaaaagcatatcccagaggaactgaaacctacgggcaaagaactgcccgacagtcagctcgtccagcccctggtgtatatggagcgtctatag

SEQ ID NO: 181588 - DNA, 102 bp, Artificial Sequence
  Description of Artificial Sequence: Synthetic coding sequence
atgcaccaccagtggctgctgctggccgcctgcttctgggtgatctttatgttcatggtcgccagcaagttcatcaccctgacctttaaggatcccgactag

SEQ ID NO: 181589 - DNA, 1215 bp, Artificial Sequence
  Description of Artificial Sequence: Synthetic coding sequence
atgcagcggaaggccggcaagaaggagcacgtgcagctgcgggacaagaggaatcaggagccacagtttagagggaatacagcaagaaaatgtgagccccaagcggccgaaggaagagttagtgaatggctacgctgtgacaatatgcaccatcaatggcttctattggccgcatgcttttgggtcatctttatgttcatggttgccagtaaattcataactctcactttcaaggacccagatgtttatagcgccaaacaggagtttctgtttcttacaaccatgccggaagtccggaaactgcctgaggagaaacacatcccggaagagcttaagcccaccggtaaagaactgccagactcacagctggttcagccccttgtgtacatggagcggctggaactcatcaggaacgtatgtcgtgatgacgctttgaagaatttgagtcatacacccgtctcaaagttcgtgctggatcgaatttttgtgtgcgacaagcataagatactattctgccagacaccgaaggtcggcaacacccagtggaagaaggtgctcatcgttctgaacggagccttttcgagtatagaagaaattcccgaaaacgtcgtgcatgatcatgagaaaaacggattgcctcggttatccagcttcagcgatgcggagattcagaaacgcctcaagacttactttaaattctttatcgtgcgtgacccgttcgaacgcctcataagcgcatttaaagacaagttcgtccacaaccccagattcgaaccctggtaccggcacgaaatcgctcccgggattattcgaaagtatagaaggaataggaccgaaaccaggggtatacagttcgaagactttgtcagatatttaggtgatcctaaccatcggtggctcgatctgcagtttggggatcatattattcactgggtgacttatgttgaattatgcgcaccttgtgaaattatgtacagcgtgattgggcatcacgagactttggaggacgatgctccatacatcctgaaggaggctggcattgaccacctcgtttcttaccctacaatcccccctggcatcacagtttacaatagaacaaaagtcgagcattacttcctgggaattagtaagagagacattaggcggttatatgcccggtttgagggagatttcaagctgtttggatatcagaaaccagactttctgctgaattag

SEQ ID NO: 181590 - DNA, 786 bp, Artificial Sequence
  Description of Artificial Sequence: Synthetic coding sequence
atggccagccccgactggggctacgacgacaagaacggccccgagcagtggtctaagctttaccccatcgccaatggcaacaaccagtcacccgttgatattaaaacctcagagactaagcatgacacgagcctcaagcctatatctgtttcctacaaccccgctacagcaaaagaaataataaacgtcggccacagttttcatgtgaattttgaggataatgacaacaggagcgtgctcaagggtggcccattctccgactcctatagactgttccagttccacttccactgggggtcaacgaacgagcacggctctgagcacaccgtcgacggagttaagtactccgccgaactgcatgtggcccactggaacagtgctaaatacagttccctggcagaagccgcctcaaaggctgacggtctagccgttattggcgtcctgatgaaagttggggaagctaacccaaagctccagaaggtgctcgacgccctacaggctatcaaaaccaaagggaaacgggcccccttcaccaacttcgacccttccacccttcttcccagcagcctcgatttttggacctaccccggctctctgacacatcccccattgtacgaatcggtgacttggattatctgcaaagagtcaatcagcgtgtcctcagaacagctagcacagtttcgctccctcctgagtaacgtcgagggagacaacgcagtgcctatgcagcataacaaccgacccactcagcccctgaagggtcgaacagttagggcctccttttag

SEQ ID NO: 181591 - DNA, 786 bp, Artificial Sequence
  Description of Artificial Sequence: Synthetic coding sequence
atggccagccccgactggggctacgacgacaagaacggccccgagcaatggtcaaagttataccccatcgccaatggcaataaccagtcaccagtggatatcaaaacctccgagaccaagcacgatacaagcctgaaacccatctccgtttcctacaacccagccaccgcgaaggaaattatcaatgtggggcacagctttcatgtcaatttcgaggacaacgacaatagatccgttctaaagggcggaccgttttccgactcatatcgtctgtttcagtttcattttcactgggggtctactaatgaacatggctcggaacataccgttgatggcgttaaatattcagccgaactgcacgttgctcactggaattctgccaaatattccagtctggctgaggccgcttcaaaagcggatggcctggcagtgattggcgtgctgatgaaagtgggggaggctaaccccaaactccaaaaagtgctagacgccttgcaggctattaaaactaaggggaagcgagcacccttcaccaattttgatccgtctaccctgctcccttcgtctcttgatttttggacataccccggcagtctgacacaccccccactgtatgagtctgttacctggattatctgtaaggagtcgataagcgtgagcagcgaacagcttgcgcagtttaggtcgctgctgtctaacgtcgagggcgacaacgccgtgcctatgcagcacaacaaccgcccaactcagcctctcaagggacggactgttcgcgcgtccttctag

SEQ ID NO: 181592 - DNA, 786 bp, Artificial Sequence
  Description of Artificial Sequence: Synthetic coding sequence
atggccagccccgactggggctacgacgacaagaacggccccgagcaatggtctaaactgtaccccattgccaacggtaataatcagtcccctgttgacattaaaacgtcagaaacaaaacacgatacgtcattgaaaccaatctccgtctcctacaatccagctacagccaaagagataattaatgtaggtcactcgttccacgtgaactttgaggataatgacaaccgaagtgtgctgaaaggcggccctttctccgattcgtaccgcctgtttcaatttcactttcactggggtagtacaaacgagcacgggagcgagcacaccgtggacggagttaaatatagcgcggagcttcacgtcgcccactggaattccgcaaagtacagcagcctggctgaggccgcttcaaaggcggatgggcttgccgtgataggcgtcctgatgaaagtcggggaggcaaatcctaagctccagaaggttctcgatgctcttcaggctatcaagaccaagggtaaacgggccccctttaccaattttgatcccagcacattgcttccttccagtctcgatttttggacttaccccggaagcctcacccacccacccctgtatgagagtgtaacttggatcatctgcaaggaatctatctctgtatcctccgagcagctagcccagttcagatctctgttgagtaacgtagaaggggacaatgccgtcccgatgcagcataacaatcggccaacacaaccactgaaaggacgcactgtcagagcgtcattttag

SEQ ID NO: 181593 - DNA, 531 bp, Artificial Sequence
  Description of Artificial Sequence: Synthetic coding sequence
atggccagccccgactggggctacgacgacaagaacggccccgagcagtggtcaaagctctatccgattgctaatggcaacaatcagtctccagtggacattaaaacctctgagactaagcacgacacaagcttgaaaccaatatccgtgagctacaatcctgctacggccaaggagatcataaatgtgggacactccttccatgtaaacttcgaagacaatgacaatcggtccgtgctcaagggcggccccttttctgattcctatcggctgttccaattccatttccattggggatcaaccaatgaacacggtagtgagcacacagtggacggagtgaaatattccgccgaactgcatgtagcccattggaacagcgctaaatacagcagtctggcagaagccgcaagcaaggcggacggcctcgcagtcatcggcgtgctgatgaaagtgggagaggccaacccgaagttgcaaaaagtgctcgatgcgctgcaggccatcaaaacaaagggcaaaagggccccctag

SEQ ID NO: 181594 - DNA, 756 bp, Artificial Sequence
  Description of Artificial Sequence: Synthetic coding sequence
atggccagccccgactggggctacgacgacaagaacggccccgagcagtggagcaaactgtaccccattgcaaatggtaataaccagagcccagtggatatcaaaacttctgagacaaagcacgataccagtctgaagcctatctctgtctcttacaaccccgcaacagctaaggaaatcatcaacgtggggcactccttccatgttaattttgaggacaacgataacagaagcgtcctaaaagggggtccattctcagattcttacagacttttccagtttcattttcattggggatccactaacgagcatggtagcgagcacaccgttgacggcgtgaagtattctgctgagctgcacgtggcccactggaacagcgcaaagtacagctcccttgcagaggccgcgagcaaagccgatgggctggctgtcatcggcgtcttgatgaaggtgggggaggccaacccgaagctccaaaaggtccttgacgccctccaagccataaagaccaaaggcaaacgcgccccatttacaaacttcgacccatccactctcttaccttcatctctcgacttctggacataccctggtagtttgacccaccctcccctctacgagtcagtcacttggatcatctgtaaggaaagtatctctgtcagttccgagcaactggctcagttccgtagtcttctttctaatgtcgaaggagacaatgccgtgcccatgcagcacaataacaggccaacacagccatag

SEQ ID NO: 181595 - DNA, 69 bp, Artificial Sequence
  Description of Artificial Sequence: Synthetic coding sequence
atggccagccccgactggggctacgacgacaagaacggccccgagcagtggagcaaactgtacccctag

SEQ ID NO: 181596 - DNA, 450 bp, Artificial Sequence
  Description of Artificial Sequence: Synthetic coding sequence
atggccagccccgactggggctacgacgacaagaacggccccgagcaatggagtaagctgtatccgatagctaacgggaataaccagagcccggtggatatcaaaacatccgagaccaagcacgacaccagccttaagcccatttcggtctcctacaatcctgcaaccgcgaaggagattatcaacgttggccattcgttccatgtgaatttcgaggacaatgataaccggtccgtcttgaaaggcggccccttctctgattcatacagactctttcagtttcattttcactggggatctacaaatgaacatggcagtgaacataccgtggacggtgttaagtacagtgctgagctccatgtggcccattggaatagcgcaaaatactcgagcttagctgaggccgcttctaaggcagatggactggccgtgatcggtgtcctgatgtag

SEQ ID NO: 181597 - DNA, 450 bp, Artificial Sequence
  Description of Artificial Sequence: Synthetic coding sequence
atggccagccccgactggggctacgacgacaagaacggccccgagcagtggtccaagctttaccccatcgccaatggaaataatcagtctcctgtagatatcaagacaagcgaaacgaaacacgacacgtccctgaagccgatttccgtctcttacaaccccgcaaccgccaaagagataatcaatgtggggcactcgttccatgtgaacttcgaggacaacgacaaccgctcagtactgaagggcggcccatttagcgactcatataggctgttccagttccattttcactggggttcaacgaacgagcatggcagcgagcacacagtggatggggtgaaatatagcgccgaattgcacgtagcccactggaacagtgctaagtacagcagcttggctgaagctgcctccaaagcagatggattagcggtcattggcgtcctgatgtag

SEQ ID NO: 181598 - DNA, 357 bp, Artificial Sequence
  Description of Artificial Sequence: Synthetic coding sequence
atggccagccccgactggggctacgacgacaagaacggccccgagcagtggtccaaactctaccctatcgctaatgggaataatcaaagccctgtcgacattaagacttccgagacgaaacatgacacctctctcaagccaatttctgtttcttacaaccccgcaacagccaaggaaattattaacgtggggcactcctttcatgtgaactttgaggacaatgacaatcgctctgtcctgaaaggaggacctttttccgactcttataggctctttcaatttcactttcattggggtagtaccaacgaacacgggtcagaacataccgtagatggcgtgaagtactcagcggagtag

SEQ ID NO: 181599 - DNA, 447 bp, Artificial Sequence
  Description of Artificial Sequence: Synthetic coding sequence
atggccagccccgactggggctacgacgacaagaacggccccgagcagtggtcaaagctttatccaattgctaatgggaataatcagtcgccagtcgacataaagacaagcgagacaaaacatgatacctctctgaagccaatttccgtctcctacaacccggcaaccgcaaaggagataatcaatgtgggccacagtttccacgtgaactttgaggacaacgataacagatcagtgttgaaaggaggtcccttttccgattcgtaccgacttttccagtttcacttccattggggaagtactaatgaacacggtagtgaacatactgtcgacggagttaagtattcagctgaacttcatgtggcacattggaactcagctaagtattcgagtctagctgaagctgcaagcaaggccgacggattagctgtcatcggcgtcctgtag

SEQ ID NO: 181600 - DNA, 786 bp, Artificial Sequence
  Description of Artificial Sequence: Synthetic coding sequence
atggccagccccgactggggctacgacgacaagaacggccccgagcagtggagcaagttatacccaatcgcgaatggtaacaatcaaagtcctgtggacataaagacaagtgaaacaaagcacgacaccagcctcaagccaattagtgtctcttacaaccctgctaccgctaaagagattatcaacgtcggccattctttccacgttaactttgaggacaatgacaaccgctccgtactgaagggtggaccgttttccgattcctaccggctcttccagtttcattttcattggggatccactaatgaacacgggtccgaacacaccgtggacggcgtcaagtacagtgcagaacttcacgttgcacattggaatagcgccaaatactcctcacttgctgaggctgcctcgaaagccgacgggctcgctgttattggggtcttgatgaaagtgggagaggccaaccctaaactccagaaggtgttggacgccttacaagccattaagactaaaggtaagcgggccccttttaccaacttcgatccctcaactctactccctagcagtctcgacttttggacataccctggatctcttacccacccccctctttacgaatcagtaacctggattatctgcaaggaatccatctccgtcagcagtgagcaactcgcacagtttagatctctgttatcaaatgtcgaaggcgataatgccgtgccgatgcagcataataaccggcctactcagccgcttaagggacgcactgtgcgagccagcttttag

SEQ ID NO: 181601 - DNA, 300 bp, Artificial Sequence
  Description of Artificial Sequence: Synthetic coding sequence
atggccagccccgactggggctacgacgacaagaacggccccgagcaatggtcaaagttgtaccccatcgctaatgggaataatcaaagccctgtggatataaaaacctctgagaccaagcacgacacatctctgaaacctatctccgtgagctataaccctgccacagccaaagaaatcataaacgtgggacattctttccatgtgaattttgaggacaatgacaatcgtagtgtgttgaaaggggggcccttcagtgacagttatcgtctgttccagtttcactttcactgggggtag

SEQ ID NO: 181602 - DNA, 786 bp, Artificial Sequence
  Description of Artificial Sequence: Synthetic coding sequence
atggccagccccgactggggctacgacgacaagaacggccccgagcaatggtcaaagctttacccgatagctaacgggaacaaccaatcccctgtggatattaagacttccgagacaaaacacgacacgtcactaaaacctatctctgtgtcctacaatccagccacagcaaaggaaatcattaatgttgggcacagctttcacgtgaattttgaagacaacgacaatagaagcgtgctgaaaggaggacctttctctgacagctatcgacttttccaattccactttcactggggttccacaaatgagcacgggtcagagcatactgttgacggagtcaaatatagcgcggagctccacgtagcccattggaactccgccaagtacagtagtctggctgaagccgccagtaaggctgatgggctcgcggtaatcggagtcttgatgaaagttggcgaagccaatcctaaattacagaaggtgcttgatgccctgcaggctatcaagaccaaaggcaagagagccccttttacaaactttgatccctcaactctcctcccgagttccctcgatttttggacctacccgggctccctaactcatccaccactgtatgaatccgtgacttggattatctgcaaagaatccatttctgtgagctccgaacagttagctcagtttcgcagcctgttatctaatgtcgagggcgataacgccgtgcccatgcagcataataatcggcccacacagcctctcaagggccggactgtacgagcgtccttctag

SEQ ID NO: 181603 - DNA, 786 bp, Artificial Sequence
  Description of Artificial Sequence: Synthetic coding sequence
atggccagccccgactggggctacgacgacaagaacggccccgagcagtggagtaagctgtacccgatcgctaacgggaacaaccagtcaccagtggacataaaaacttcagagactaagcatgacacgagtcttaaaccgatctcagtaagctacaatcccgccaccgccaaggagatcattaatgtaggtcactcatttcatgtaaacttcgaagataacgataaccggtctgtcctgaaaggtgggcccttttcagactcgtataggctttttcagtttcactttcactgggggagcacaaatgagcacggatctgagcatacagttgatggcgtcaaatatagcgctgagctgcatgtggcacattggaactccgcgaaatattcctcccttgccgaggcagcctcaaaagccgatggcctcgctgtcattggagtgttaatgaaggtaggtgaggccaacccaaagctgcaaaaggtccttgatgccctgcaggcgattaaaactaagggcaagagagcccctttcacaaattttgacccttcgacactgctgcccagctctctggacttttggacttaccccggttcacttacacacccgcctctttacgaaagcgtgacctggattatctgtaaagagtccatttctgtgagttcagaacagctcgctcagttccgctctctgctgtctaacgtggaaggagataacgctgtacctatgcagcacaacaataggcccacccagccgctgaaaggacgcactgtgcgtgcgagtttctag

SEQ ID NO: 181604 - DNA, 783 bp, Artificial Sequence
  Description of Artificial Sequence: Synthetic coding sequence
atgagccaccactggggctacggcaagcacaacggccccgagcactggcacaaggacttccccatcgcgaagggagagcggcagtcccccgtcgacattgatacccacaccgccaaatacgacccgtcccttaaacctctaagtgtatcctacgaccaagcaacctcgctacgaatcctgaataacggccatgcgtttaacgtcgaattcgacgattcgcaggataaagccgtgttaaagggtggtcccttagatggaacttacaggttgatccagtttcattttcactgggggagcctagacggccaggggagcgagcatactgtggacaagaaaaagtacgcggctgagctgcacctcgttcactggaatactaagtatggcgatttcgggaaagcggtccagcagccagatgggctggctgtcctaggcatcttcttaaaagttggtagcgccaagccaggcctccaaaaggtggtggatgttttagactctattaagaccaaaggaaagagcgctgacttcaccaatttcgacccccggggcctgcttcctgaatctttggattactggacgtacccaggctcacttacaacaccccctcttctcgagtgtgtgacgtggatcgtcttaaaggaaccaatctcagtgtccagcgaacaggtgcttaaatttcggaagttgaactttaacggggagggcgaacctgaagagctaatggtggacaactggcgcccggcccaaccactgaaaaaccgacaaataaaagcctcctttaaatag

SEQ ID NO: 181605 - DNA, 783 bp, Artificial Sequence
  Description of Artificial Sequence: Synthetic coding sequence
atggccaaggagtggggctacgccagccacaacggccccgaccactggcatgagctgttccctaacgccaagggggagaaccagtcacccgtagagctccacaccaaggatatacgacatgacccctcgctgcagccatggtccgtgtcctatgacggcggatctgctaaaactattctgaacaatgggaagacctgcagggtagtgttcgatgacacatatgaccggtcaatgctacgagggggaccactgccaggcccttatcggctgcggcagttccacctacactggggatcgagcgacgatcatgggagcgagcacaccgtggatggagtgaagtacgccgcagagctgcaccttgtgcattggaaccccaagtataacactttcaaggaagcactcaagcagcgggacggcatagctgttatcggcatcttcctcaaaatcgggcacgagaacggggagttccagatctttcttgatgcccttgataaaattaagacaaagggtaaagaagctcctttcaccaagttcgacccgtcctgcctttttccagcatgtagagattattggacttatcaaggctctttcaccaccccaccctgtgaggagtgcattgtttggttgctactgaaggagccaatgacagttagttctgaccaaatggctaaattacgttcacttctctcttcagccgagaacgaaccccctgtgcctctcgtatcaaactggcgccctcctcagcccatcaacaacagggtggtacgagcctctttcaaatag

SEQ ID NO: 181606 - DNA, 735 bp, Artificial Sequence
  Description of Artificial Sequence: Synthetic coding sequence
atggccaaggagtggggctacgccagccacaacggccccgaccactggcacgagctgttccccaatgctaagggtgaaaaccagtcaccatggtccgttagctacgacggagggagcgcaaagaccattctcaacaatgggaaaacctgccgggtagtcttcgacgacacctacgaccgttccatgctgcgcggaggtccactccccgggccgtatcgcctgcgtcagttccaccttcactgggggagctctgatgatcatggctcagaacacactgttgatggcgtgaaatacgcagctgagcttcacctggtacattggaacccaaaatataacacctttaaggaggctctcaaacagcgtgatggcattgccgtcatcggaatcttcctcaagatcggccatgaaaacggagagttccagatctttctggacgccctggataaaatcaagacaaaaggaaaagaggctccgtttacgaaatttgacccctcctgtctctttccagcatgccgtgactactggacgtaccagggctcctttaccactcctccttgcgaagagtgtatcgtctggttgcttctgaaagagcctatgaccgtgagttccgatcagatggcgaaattaaggagtcttctaagcagtgccgaaaacgagcccccggtacctctggtttcaaattggagacccccccagcccattaacaacagggtggtccgagcttcttttaagtag

SEQ ID NO: 181607 - DNA, 954 bp, Artificial Sequence
  Description of Artificial Sequence: Synthetic coding sequence
atggtggtgatgaacagcctgcgggtgatcctgcaggccagccccggtaagctcttgtggcgcaagtttcagattcccaggttcatgccagcaagaccttgttcattgtatacatgcacatacaagacccgaaaccgagccctgcacccactttgggaatccgtggacttagtccctggcggagaccgacaatccccaattaacatacgctggagagactcagtgtatgatccaggccttaaaccactgaccataagttatgacccagcaacatgtttgcacgtctggaataatgggtattccttcctggtggagtttgaggattctacagacaagagcgtgatcaagggcggccccctggaacataactataggttaaaacaatttcacttccactggggcgccatcgatgcttggggttcggagcatactgtggatagcaagtgcttccctgcagagctacacctcgtccactggaatgcggtccgtttcgagaactttgaggacgcagcactggaggaaaacggcctggccgtcattggtgtttttctgaagctgggcaaacatcacaaggaattgcaaaagcttgtcgatactctgccatcaatcaagcataaagatgcattagtggaattcggttcctttgatccatcgtgcttgatgccaacctgtcccgactattggacttactctggcagcttgactaccccgccactgtccgaaagtgtgacttggataatcaagaaacagccggtggaggtggaccacgaccaactggaacagtttaggaccctgctctttacctccgaaggcgagaaggagaaaagaatggtggataacttcagaccgctgcaacctctgatgaaccgtacagtgcgttcgtcattccggcacgattacgtcctaaacgtgcaagccaagcccaaacctgctactagccaggccaccccgtag

SEQ ID NO: 181608 - DNA, 954 bp, Artificial Sequence
  Description of Artificial Sequence: Synthetic coding sequence
atggtggtgatgaacagcctgcgggtgatcctgcaggccagccccggaaagctgttatggcggaaattccagattcctcgctttatgccagcgaggccttgtagcttgtacacatgcacgtacaaaactaggaacagggctctgcatcctctgtgggaaagtgtggacctcgtgcctgggggggatagacaaagccctattaatatacgttggcgtgactcagtgtacgaccctgggctcaagcctttaactatatcttatgacccagctacatgcctacatgtgtggaacaacggatactccttcctcgtggagtttgaggactcgactgacaagtctgtaattaaaggtggacctctggaacacaactacagactgaaacagtttcatttccattggggagctatagacgcttgggggagcgagcataccgttgactctaaatgcttcccggccgagctgcatcttgtgcattggaacgccgtgaggttcgagaacttcgaggatgctgccctggaggagaacggcctcgcagtgatcggcgtgttcctcaaactaggcaagcaccacaaggaactgcaaaagctcgtggatacgttgccgtctataaagcataaagatgccttggtggaattcggttctttcgatccaagttgtctgatgcctacatgtccggattattggacttatagcgggtccctgaccacccccccccttagcgagtccgtcacatggatcattaaaaaacagcccgtagaagtggaccacgaccagctggagcaatttcgaaccttactctttactagtgagggtgaaaaggagaagcgaatggtcgacaatttcagacccctacagccattaatgaatagaaccgtgagatctagttttcgccacgactacgtgcttaatgtacaggctaaacccaagcctgccacttcccaagctactccatag

SEQ ID NO: 181609 - DNA, 411 bp, Artificial Sequence
  Description of Artificial Sequence: Synthetic coding sequence
atggtggtgatgaacagcctgcgggtgatcctgcaggccagccccggcaagctcttgtggcgtaagtttcagattccccggtttatgcctgcaagaccttgctctctgtacacctgtacttataagacacgaaaccgagccctgcatccactctgggagagcgtcgacctggtacctggaggggacagacaatcaccaataaacataagatggagggactccgtctacgaccctgggctgaaaccactgactattagctatgatcctgctacgtgtctccacgtttggaacaacggatatagcttcctggtcgaatttgaggacagcacagacaaatctgtgatcaagggtggtcccctggaacacaattaccgtctgaaacagtttcatttccactggggggcaatctag

SEQ ID NO: 181610 - DNA, 231 bp, Artificial Sequence
  Description of Artificial Sequence: Synthetic coding sequence
atggtggtgatgaacagcctgcgggtgatcctgcaggccagccccgggaagctcctctggaggaagttccagatcccacgttttatgcctgctaggccatgctcattgtatacatgcacctacaagacgcggaacagagcactgcaccccttgtgggagtcagtggatttggtgccgggtggcgatcggcagtccccgatcaacatacgctggcgggacagtgtttactag

SEQ ID NO: 181611 - DNA, 540 bp, Artificial Sequence
  Description of Artificial Sequence: Synthetic coding sequence
atgcgggccctggtgctgctgctgagcctgttcctgctgggcggccaggcgcagcatgtctcagactggacctactctgagggagccctcgacgaagcgcactggcctcagcactatcccgcctgcggtggacaacgccagagtccaattaacctgcagaggaccaaggtgagatacaatccatcactgaagggactgaacatgacggggtacgaaacccaggcaggcgagttccccatggtgaacaacgggcacactgactggcaggctgagttgtttttgccatctttatcctcaccctgtggtgagggtgccaaacacaagggccaacgccagtggttatgcagcccgtcactagactcatggtgggaggccattattgacggcgggagcctctgggccactctcgccgagtgcgggctacgcgccgaaggtcccgaggagggacgacatatggaagagaaatcaccagccagccagggggcttgttccggaagtcgactgcctataagtagggggccctgtacattttttctatag

SEQ ID NO: 181612 - DNA, 942 bp, Artificial Sequence
  Description of Artificial Sequence: Synthetic coding sequence
atgcgggccctggtgctgctgctgagcctgttcctgctgggcggccaggcacaacatgtcagtgattggacctactccgaaggggcgctggacgaagcccactggccgcaacactatccagcatgcggaggccagcgtcagagcccaataaatctgcagcgaaccaaggtccggtataatccctcactgaaggggcttaatatgaccgggtatgagactcaggcaggtgaattcccaatggtcaataatggacatactgttcaaatatccctgccctcaaccatgagaatgacagttgctgatggcactgtgtacattgcccagcaaatgcatttccattgggggggtgcgagctccgaaatctcaggatccgaacataccgtggacggaatccggcacgtaattgagatacatatcgtgcattataactcaaaatacaaaagttacgacatagctcaggatgcgcctgacggtcttgccgtgctggccgccttcgtagaagtcaagaactaccccgagaatacatactattccaattttattagccatctcgcaaatataaaataccctggccagagaactacactgactggactggacgtccaagatatgctgccacggaatctgcaacattattatacctaccacgggagcctcacaacccccccttgtaccgagaacgtacattggtttgtcctggccgactttgtgaagttatcacgcacccaagtctggaagctggagaactcattgttggaccaccgcaataaaaccattcataatgactaccgccgcacacagcccttgaatcatagagtagtggaatcgaattttcctaatcaaggcaagggacatggaggccatcgaggccggtcacagaaccccagggttcagcctacaagcaccagacaccccctcgccctcgggagtctggaggcctag

SEQ ID NO: 181613 - DNA, 927 bp, Artificial Sequence
  Description of Artificial Sequence: Synthetic coding sequence
atgcgggccctggtgctgctgctgagcctgttcctgctgggcggccaagcccagcacgtgtctgactggacttacagcgagggggcattggacgaggcccattggccccagcattaccctgcatgcggaggccagcggcagtctccaattaacctgcagaggactaaagtgagatacaaccctagccttaaaggactgaacatgacaggctacgagactcaggccggcgagttcccgatggtcaacaacgggcacactgttcagatctccctgccctcaacgatgcgtatgactgttgccgacggtaccgtctatatcgctcagcagatgcattttcactggggcggcgcctcatccgaaatctctggcagcgagcacaccgtggatggcatacgccacgtaatcgagatccacatcgtgcactataacagtaaatacaagagttacgatatcgcacaggatgctcctgatggactagcggttctggcagccttcgtggaagtaaagaattatcccgagaacacctattatagcaacttcatctctcacctggcgaacattaagtaccctggacagaggaccactctcaccgggctggacgttcaggacatgctccccagaaacttgcagcactattatacctatcacgggtcccttacgacccctccatgcacagaaaacgtgcattggtttgtgctggcagatttcgtgaagttaagtagaacgcaagtctggaaactcgagaattcccttttggaccacagaaataagaccatacataatgactacagaagaactcagcccctgaaccatagagtcgttgaatcaaacttcccgaatcaggaatataccctcggttctgagttccagttttatcttcataaaatcgaggaaatcctggattaccttagacgggcgctgaattag

SEQ ID NO: 181614 - DNA, 795 bp, Artificial Sequence
  Description of Artificial Sequence: Synthetic coding sequence
atgaccggccaccacggctggggctacggccaggacgacggccccagccattggcacaaactgtacccaatagctcagggcgatagacaatcaccgattaacatcatctcaagccaggcagtgtatagtcccagcttgcagccactggaactcagctacgaagcctgcatgtcactctctatcaccaataatggccattcagttcaggttgactttaacgactccgacgatcgcacagtggtgacaggaggacccctcgagggtccttaccggctgaaacagttccactttcactggggtaaaaagcatgacgtgggatccgaacacacagtggatggtaagagtttcccgagcgagctccatcttgtccattggaacgctaagaaatattccacttttggcgaggcagcttcggccccagacgggctagcggtggtgggagtgtttttagaaaccggcgacgaacatccaagcatgaacaggctcacagatgcactgtacatggtccgatttaaagggaccaaggcgcagtttagttgctttaatcccaagtgtctcctgccagcttcaagacattactggacataccccgggagtctgaccaccccacccctgagcgagtctgtcacatggattgtgctccgtgagcccatatgcatctcagaacgtcagatggggaagttccgctctctgctgtttaccagcgaggatgatgagaggattcacatggtgaacaactttcgcccccctcaacctttgaaaggccgcgtggttaaggcctctttccgagcctag

SEQ ID NO: 181615 - DNA, 627 bp, Artificial Sequence
  Description of Artificial Sequence: Synthetic coding sequence
atgagcctgagcatcaccaacaacggccacagcgtgcaggtggactttaatgatagcgatgatagaaccgttgtgaccggtggaccattggagggaccctatcgactcaagcagtttcacttccactgggggaaaaaacacgacgtgggctctgagcacacagtggacggaaagagcttccccagtgaactccacctggtacactggaacgccaagaagtacagcacctttggggaggccgcttccgccccggatggcttagccgttgtgggtgtattcctagagacaggagacgagcacccgtccatgaacagattgactgacgccctttacatggtccgttttaagggcacgaaggcacaattctcctgcttcaatcccaagtgcctgctcccggcttcccggcattattggacctaccctgggagccttactacaccgcccctgtccgagtctgtcacctggatcgttctacgtgagccaatatgcatctccgagagacagatgggaaagtttcgctccctgttgtttacctcagaagatgatgagcgcatccacatggtgaacaattttcggccaccacagcctctgaaggggcgagtcgtgaaggctagctttcgggcctag

SEQ ID NO: 181616 - DNA, 873 bp, Artificial Sequence
  Description of Artificial Sequence: Synthetic coding sequence
atggccgacctgagcttcatcgaggacaccgtggccttccccgagaaggaggaggacgaggaggaagaggaagaaggcgtggaatggggctacgaggagggcgtggaatgggggttagtcttccctgacgctaacggggagtatcagagccccatcaacctcaactccagagaagcgagatacgacccatccttgcttgacgtccggctgtcccccaattacgttgtttgccgggactgcgaagtcacgaatgatgggcacacaattcaggtcatcctgaagtccaaatctgtcctgtctggaggtcctctcccacagggacacgagttcgagttgtacgaagtgagatttcactggggtagagaaaaccagcggggcagcgaacacacagtcaatttcaaggcttttccaatggaattgcatctaattcactggaacagtactctattcgggagtattgatgaggccgtcggcaaaccccacggaattgccattatcgctctgttcgtgcagatcggcaaggaacacgtgggcttgaaagctgtgacggagatcctgcaagacattcagtacaagggaaagtcaaaaaccattccctgtttcaaccccaacacactgttgccggatcctctgctcagagactactgggtatacgaaggatccctgacaattcctccatgttcagaaggtgtgacttggattctcttccggtacccattgactattagccagcttcagatcgaagagtttcgccggcttcgcacacacgtgaagggcgcggaattagtggaaggttgtgacggtatactgggtgataatttcaggcctactcagccactctcggacagagtcataagagcggccttccagtag

SEQ ID NO: 181617 - DNA, 987 bp, Artificial Sequence
  Description of Artificial Sequence: Synthetic coding sequence
atggagatcgtgtgggaggtgctgttcctgctgcaggccaacttcatcgtttgcatcagtgcacaacaaaacagtcctaaaatccatgaggggtggtgggcctacaaggaagtcgtgcaggggtcctttgtgcccgtgccgagtttttggggattggttaacagtgcctggaacctgtgttcagtaggtaagaggcagtcaccagtcaatattgaaacttcacacatgatattcgatcccttcctgacaccgctgagaattaatacgggtgggaggaaggtgagcggtacgatgtataacactggccggcatgtgtcattgagactcgacaaagaacatctggttaacatctcaggcggcccgatgacgtactcacataggctagaggagatccgcctccacttcggcagcgaggacagccagggctccgagcacttacttaacggtcaggccttttctggagaggtgcagctgatccattataatcacgaactatatacaaatgtgacagaggcagccaaaagccctaatggtctggtcgttgtttccatcttcattaaagtctctgatagttctaatccttttctcaatcgaatgcttaaccgggatacaatcacccggataacctataaaaatgatgcgtatctgctgcaaggactaaatattgaggagctgtatcctgaaacctcctctttcataacttacgacggaagcatgaccatcccaccatgctacgagaccgcgagctggatcatcatgaataaacccgtctatatcacgcggatgcaaatgcactcactcagactgcttagccagaatcagccttcacagatcttcctcagcatgtccgacaattttcggcccgtgcagccactgaataatcggtgcattcgaactaatatcaacttttctctgcagggcaaggactgtcctaataaccgcgcccagaaactacagtacagagtgaatgagtggttactcaagtag

SEQ ID NO: 181618 - DNA, 1005 bp, Artificial Sequence
  Description of Artificial Sequence: Synthetic coding sequence
atggccagcatccggagccggagcggctgcggcttcaccgagcccgatgagttgtgcatggtgggcgtacgagagaatgcacaacagaattcacccaagattcatgagggatggtgggcatacaaggaggtcgtgcaggggagctttgtcccggtcccaagtttttggggactggtaaacagcgcctggaacctctgctcagtgggtaaacgacaaagcccggtgaatatcgagacgagccatatgatcttcgacccattcctcacaccgctgcggatcaataccggtggtcggaaggtcagcggaactatgtacaacactggccgccatgtctccctgcggctcgacaaggagcacctggtaaacatcagtggaggcccgatgacctactcccatagattggaggaaatcaggctccactttggcagcgaggatagccagggaagtgagcatctcctgaacggtcaggcctttagcggggaagtccaactcatccactataaccatgagttgtacactaatgtgactgaggctgctaagagcccaaatgggttagtggtcgtttcaatttttatcaaggtgagcgattcttccaatccttttctcaatcgtatgctaaacagggacacaattaccaggatcacatacaaaaatgacgcgtatctgctgcagggactgaacattgaggagctgtaccccgagacttcatcatttatcacttacgacggatccatgacgatacccccgtgttatgaaactgcttcttggatcattatgaataagcctgtctatattacccggatgcagatgcactccctgcgtcttctatcccagaatcaaccttcgcaaatttttctgagcatgtccgataatttccgaccggtgcaaccactgaataataggtgtatcaggaccaatatcaacttcagcttgcaggggaaggactgcccaaataaccgggcgcaaaaattgcaatatagggtcaacgaatggctgctgaagtag

SEQ ID NO: 181619 - DNA, 987 bp, Artificial Sequence
  Description of Artificial Sequence: Synthetic coding sequence
atggagatcgtgtgggaggtgctgttcctgctgcaggccaacttcatcgtgtgtatatccgcgcagcaaaactcccccaagatccatgagggctggtgggcctacaaagaagttgttcagggctcttttgttcctgtaccaagcttctggggattagtgaacagcgcatggaacctttgctccgtgggaaagaggcagagtccggtaaatattgagacctcacatatgatctttgatccatttctcactccgctgcgcatcaatacaggaggaagaaaagtttccgggaccatgtataatactgggagacatgtgtcattgcgtctggacaaagaacacctcgttaacatctctggtgggcctatgacgtacagccacaggttggaggaaatcagactgcactttggcagcgaagattcacagggatctgagcatttgctcaacggacaagcgttctccggggaggtgcaactgattcattataatcatgagctgtacaccaatgtcacagaggccgcaaaatccccaaatggccttgtcgtcgtttccatttttattaaggtgagtgatagcagcaatccatttctcaatcgcatgttaaatagggacactattacacgtataacttataaaaacgatgcgtacctgttgcaggggctgaacatcgaagaattgtatccagagacatcaagctttatcacctatgacggtagcatgacaatccccccctgttatgaaactgcctcctggattatcatgaataaacctgtgtacattacccggatgcagatgcatagcttgcgactcctgagtcagaaccagccttcacagattttcctgtcgatgagtgacaacttcagacccgtgcagcctctgaataaccggtgcatcaggacaaatattaatttcagcttacaggggaaggattgtccaaataatcgtgcccagaaacttcagtacagggtgaacgaatggctgcttaagtag

SEQ ID NO: 181620 - DNA, 987 bp, Artificial Sequence
  Description of Artificial Sequence: Synthetic coding sequence
atggagatcgtgtgggaggtgctgttcctgctgcaggccaacttcatcgtctgcatttctgcgcaacagaacagcccaaaaatccacgagggatggtgggcctacaaagaagtagtgcaagggtctttcgtgcccgtgccttctttctggggactggtgaatagcgcttggaatctgtgttccgtgggtaagcgccagagcccagttaatatagagacatctcatatgatcttcgatccctttctgaccccccttcgcattaacaccggtggaagaaaagttagcggcacgatgtacaacacagggagacacgtctccctaaggctggacaaggagcatctggtgaatatctctggcgggccaatgacatacagccaccgtcttgaggaaattcggctgcacttcgggtcagaagattcccaaggatccgagcatctgctgaacggtcaggctttcagcggcgaagtgcagttaatccattacaaccacgaattgtacactaatgtaaccgaggccgccaaaagcccaaatgggttggtggttgtgtcaatctttatcaaagtgtccgacagtagcaatccctttctgaaccggatgctcaatcgagacaccataacaagaatcacgtacaagaacgacgcctacctcttacagggcctaaatatcgaagagctttaccccgagacctcatctttcattacttacgatggctcgatgaccatccctccctgctacgaaacagcctcttggatcattatgaacaagccagtctatatcacccggatgcagatgcacagcttgagactgctgtcacaaaatcagccctcacagatattcctgtcaatgtccgacaactttcggccagtgcagcctctcaacaatcgatgtatcaggacaaacatcaatttttccctgcagggaaaggattgcccaaataatagggcccaaaagctgcagtaccgcgtcaacgagtggttgctgaagtag

SEQ ID NO: 181621 - DNA, 987 bp, Artificial Sequence
  Description of Artificial Sequence: Synthetic coding sequence
atgggcgccgccgcccggctgagcgccccccgggccctggtgctgtgggctgctttaggagccgccgcgcatattggccctgcccccgatcccgaggattggtggtcgtacaaagacaatttgcagggcaacttcgtccccgggccacccttttggggtctggtgaacgctgcttggagcttgtgcgcagtgggtaaacgacaatctccagtagatgtggaactcaagagggtcctctatgatccctttcttccaccactacgactctccacagggggcgagaagctgcgcgggacactgtataataccggcaggcatgtttcatttcttccagctccgaggcctgtggtgaatgtgtctggggggcccctcctctattcccatagactcagtgagttgaggctgctatttggcgctagagacggcgcaggatccgagcatcagataaatcaccagggattctcagcagaggtacagctgatccactttaaccaggagctgtacgggaatttcagcgcagcttccaggggccccaatggactcgcgatcctgagtttgtttgttaacgtcgctagtaccagcaatccattcctgtcccggctgctgaatagagatactatcactaggattagttataagaacgacgcatacttcttgcaggatctgtctctggaactcctcttccctgagtccttcgggttcataacttaccaggggtccctgtctacccccccctgctcagagactgtcacatggatccttatcgatcgagccttgaacatcactagtctccaaatgcactcactgagactcttgagtcaaaaccccccatcccagatattccagtccttgagcggaaactctaggccactccagcccctcgctcaccgggcactcagaggcaatcgggaccctcggcacccggaacggaggtgtagaggcccaaactaccgacttcatgtggatggcgtcccccatggtcggtag

SEQ ID NO: 181622 - DNA, 1065 bp, Artificial Sequence
  Description of Artificial Sequence: Synthetic coding sequence
atgccccggcggagcctgcacgccgccgccgtgctgctgctggtgatcctcaaagagcagccaagctctcccgcgccagttaatggatcaaagtggacatactttggtcctgacggcgaaaactcatggtcgaagaagtatccaagttgcggcggtctcctacagagccctatcgacctccacagcgatatcctgcagtacgatgcgagcctcactccactggagttccagggctacaacttgagcgctaacaaacagttcctcctcactaacaatgggcacagcgttaagctaaacctaccatccgacatgcacatccaaggcctccagagccgctatagcgctacccagttgcatctgcattggggaaacccaaacgacccccacggaagcgaacataccgttagcggccagcacttcgccgccgagctgcatatagtgcactataattcagatctgtatccggacgcctcaaccgcttccaataagagtgaaggcctcgcagttttggcagtgctgatcgagatgggtagcttcaacccttcatacgataagatcttttcccacttgcagcacgtgaaatataaagggcaggaggctttcgtgcccggcttcaacattgaggaactattaccagagagaacagccgaatactaccgctatagaggaagtttgaccacgcccccttgcaaccctactgtgctttggaccgtgttcagaaacccagtccagatctcacaggagcagcttctggctctcgagaccgcactgtactgtacacatatggatgatcccagtccccgggagatgataaacaatttccgtcaggtacaaaaatttgacgaacgcttggtatatacctctttttcccaggttcaggtctgtaccgccgcaggcctgtccctggggatcatcctgtctctggcgctggcggggatcctgggtatatgtatcgtcgtggtcgtctctatctggcttttccggagaaagagcataaaaaagggggacaataagggggtgatttataagcccgccacgaagatggaaactgaagctcatgcctag

SEQ ID NO: 181623 - DNA, 1032 bp, Artificial Sequence
  Description of Artificial Sequence: Synthetic coding sequence
atgccccggcggagcctgcacgccgccgccgtgctgctgctggtgatccttaaggagcaaccgagttctcccgctcctgtgaacggaagcaagtggacctactttggtcctgacggtgagaacagctggagcaaaaagtacccttcatgtggaggactgctgcagtctcctattgacctgcactcggacatactgcagtatgacgcttccctgactccgctcgagttccaggggtacaacctgtcagccaacaagcagtttctccttaccaacaacgggcacagcgtgaagctgaatctcccaagcgatatgcatatccagggcctacagtctcggtacagcgcaacccagctgcacctccattggggtaatccaaacgacccacacggttctgagcacacggtaagtggccagcatttcgccgctgagctgcatatcgttcactacaactctgatttatatccagatgcgtccacagctagtaacaaatctgagggcttggccgtcttagccgttctgatagagatgggaagctttaacccaagttatgataaaatcttctcccatctccaacacgtcaaatataaagggcaggaagcctttgtgcccggattcaacatcgaggaactgttgcccgagcgtacagcagaatactatagatatcgggggtcattgacaacgccaccgtgcaatcccactgtgctgtggacagtgtttaggaatcctgttcagatttctcaggaacagctcctagcattggagacggccctttattgcacccacatggacgaccccagtccgcgtgaaatgatcaacaactttaggcaagtgcagaagtttgatgagcgcctcgtctatacctcgtttagccaggggatcatactgagcctcgctcttgcggggatccttggaatctgtattgtggtggttgtctctatttggctttttcgcaggaaatccatcaagaaaggcgacaacaagggagtgatctacaagccagcaaccaaaatggagaccgaagcacacgcgtag

SEQ ID NO: 181624 - DNA, 852 bp, Artificial Sequence
  Description of Artificial Sequence: Synthetic coding sequence
atgccccggcggagcctgcacgccgccgccgtgctgctgctggtgatactcaaagagcagccctccagccccgctccagtcaatggctctaagtggacttacttcgtgaaactgaacctgccctccgatatgcatattcagggcctgcaatctaggtacagcgcgacccagctgcatctgcattggggtaatcctaatgacccccatgggtccgaacacaccgtgtctggacagcactttgcagccgaattgcatatagttcactataacagtgatctctaccctgacgctagcaccgcaagcaataagagcgaaggactagcagttcttgctgtactcatcgaaatggggtcattcaatccatcctacgacaagatcttctcccatctgcagcatgtaaaatacaagggtcaggaagcttttgtccctggctttaacatcgaagagctgttacctgaacgcactgccgagtactaccggtaccggggttcacttactacgcctccatgtaaccctaccgttttatggaccgtgtttcgtaaccccgtccaaatttctcaagagcagctgctcgctctggagacagctttgtattgtacccatatggacgacccgtcgccccgggagatgataaacaattttcgccaagtgcagaaatttgacgagcgcctggtctacacttccttttcacagggaataattctgtcactggctctggctggtatcttaggcatttgtattgttgtcgtggttagtatttggctttttagacgcaaaagcatcaagaagggcgacaacaagggagtgatctacaagcccgccacaaagatggagaccgaggctcacgcatag

SEQ ID NO: 181625 - DNA, 1014 bp, Artificial Sequence
  Description of Artificial Sequence: Synthetic coding sequence
atgctgttcagcgccctgctgctggaggtgatctggatcctggccgccgatggagggcagcactggacctacgaagggccccacgggcaggaccattggccggcctcatatccggaatgcggaaacaatgctcagtcccccatcgatattcaaactgactctgtgacattcgaccccgacctgcccgccttgcagccccacggttacgaccaaccaggcactgagccacttgacctccataacaatggccacacggtgcagctcagtttacccagtacactgtacttgggggggctgccccggaagtacgtggccgcccagctgcacctgcactgggggcagaaaggaagccctggtggaagcgagcatcagatcaacagcgaggccaccttcgcagaactccacattgtccattatgattcagactcctatgactcccttagtgaagcggctgaacgcccgcagggactggcggttctgggcatcttgatcgaggtgggagagactaagaatatcgcctacgagcatattctgagccatctacatgaagtgaggcataaagaccagaagacttctgtgccacccttcaatttacgggaactgctacctaagcaactgggtcagtactttaggtacaacggttcactgaccacccctccttgctaccagtctgtcctgtggactgtattctacaggcggagccagatcagcatggagcagctggagaaacttcaaggaacactcttttcgaccgaagaggagccaagcaagcttctggtgcagaactacagggctctccagccactcaaccagcgtatggtgtttgcctcatttatccaagctggatcttcatacaccacaggcgagatgctttcactgggagttggtatcctagtgggttgtctatgtctactgctcgctgtatactttatcgcacgcaagattcgaaaaaaacggctggaaaatcgtaaaagtgtcgtgtttaccagcgcacaggccacaactgaggcgtag

SEQ ID NO: 181626 - DNA, 834 bp, Artificial Sequence
  Description of Artificial Sequence: Synthetic coding sequence
atgagcagcggcatccacgtggccctggtgaccggcggcaacaagggcattgggctggccattgtcagggatctgtgccgcctcttcagcggcgatgttgtcctgaccgctcgcgatgtgaccagaggccaagccgcggtacagcaacttcaggccgaggggctcagcccacgttttcaccagcttgacatcgacgatctgcagagtatccgtgcattgagagattttttgagaaaagaatacggaggcctagacgtgcttgtcaataacgctgggatcgcttttaaggtggccgacccaaccccatttcacattcaagcagaagtcactatgaagacaaatttctttggtactagagacgtgtgcacagagttgttgcccctgatcaagccccaaggccgggtggtaaacgtgtcctcgatcatgagcgtgagggcactgaaatcctgctcgccggaactccagcagaagttccgatcggaaaccattaccgaggaggagttagtcgggctgatgaacaaattcgtggaggatacaaaaaagggtgtgcatcaaaaggaaggttggccgagcagcgcttatggagtgactaaaatcggagttactgtgctgtctcggatccacgccaggaaactgtccgaacaacgcaagggtgacaaaatattgcttaatgcctgctgccctggctgggtacgcacagatatggcgggacccaaggccacgaaaagcccggaggaaggcgcggaaacacctgtatacctcgccttactgcctcccgacgccgagggtccacatggacaattcgtaagtgaaaaacgtgttgagcagtggtag

SEQ ID NO: 181627 - DNA, 834 bp, Artificial Sequence
  Description of Artificial Sequence: Synthetic coding sequence
atgagcagctgcagccgggtggccctggtgaccggcgccaaccggggaatcgggctggctattgctcgcgaattatgccggcagttcagtggagacgtcgtgctaacggccagggacgttgcacgtggtcaagccgctgttcagcaattgcaagcggaaggtcttagcccacgcttccaccagttagatattgatgatcttcagtcgattcgagctttaagggatttcctaagaaaggaatacggcgggctgaatgtactggtgaataacgcggcagtggcctttaaaagcgacgaccccatgccctttgacatcaaggcagagatgacactcaaaaccaactttttcgctacgaggaacatgtgcaatgagctgctgccaatcatgaaacctcacggtcgtgtcgtgaatattagttctcttcagtgtctgcgcgcctttgagaattgctctgaggacctccaggagaggttccactctgaaacactgactgagggagacctggtggaccttatgaaaaaattcgtggaggatacaaaaaatgaggttcacgaacgcgagggatggcccaacagcccctacggcgtgtctaagctcggagttactgtgctgtcccgaattctagcacggcgccttgacgagaaacggaaagccgacagaattctggtgaacgcctgctgccccggacctgtcaaaacggacatggacgggaaggatagcattcgtacagtagaggaaggggcggaaacccctgtttatctcgctctgcttccccccgacgctacagaaccccaaggtcagctcgtccatgacaaagtcgtgcagaattggtag

SEQ ID NO: 181628 - DNA, 2169 bp, Artificial Sequence
  Description of Artificial Sequence: Synthetic coding sequence
atgctgaccatgggccggctgcagctggtggtgctgggcctgacctgctgttgggctgtggcctccgccgcaaagctgggggcagtgtacacagaaggcggctttgtggagggcgtcaacaagaagctggggttgctgggcgattccgtggatatttttaaggggattccgtttgctgcgccgaccaaggcactggaaaatccacaacctcaccccggctggcagggaaccctgaaggcgaaaaattttaagaaacgctgtctgcaggccacaatcacccaagatagcacctatggcgatgaggactgcctttatctgaacatctgggtcccccagggaaggaagcaggtgagtcgagatttgccagtgatgatttggatctacggtggggcctttctgatgggaagcgggcatggtgccaattttctaaataattacctgtatgatggggaagaaattgctactagagggaacgtcattgtggtaacctttaattatagggtgggtcccctgggctttctgtctactggagacgcgaacctgccggggaattatggcctgagggaccagcacatggccatagcgtgggtaaaacggaatattgccgcattcggaggagatcccaacaatattaccctatttggcgaaagcgccggtggagcttcggtttccttacagacccttagcccctataataaggggctgattcggagagccatctctcagtcaggagtcgctcttagtccgtgggttatacagaaaaaccctctgttttgggccaagaaagtggctgagaaggtgggctgcccagtcggagacgcggcgaggatggcccaatgcttaaaagttaccgacccaagagctctgacccttgcctataaagtgcccctggcgggccttgaatatccgatgctgcactacgtcgggtttgtccccgttatcgatggcgacttcatccccgcggacccaatcaacctctacgctaatgctgctgatatcgactatattgccgggactaataatatggacggtcatatctttgcctctatcgatatgcctgctattaataaaggcaataagaaggtcacagaggacttctacaagctggtttcggagtttaccatcactaagggcctccgcggtgccaaaacaacgttcgatgtgtatacagaatcatgggcacaggacccatcccaagagaataaaaagaaaactgttgttgactttgagaccgacgtattgttcttggttcctacagagatagcactggcccagcatcgggccaacgcaaagagtgcaaaaacttatgcttacctgttctctcatccttcccggatgccagtgtatcctaagtgggtgggagccgaccatgccgacgatattcagtatgtcttcgggaagcccttcgcgacccccactgggtacagaccccaggaccgcactgtgtccaaggctatgatcgcctattggactaacttcgccaaaaccggggatcccaacatgggcgactctgccgtgccaactcactgggaaccttataccacggagaactctgggtatctggaaattactaagaagatggggtcttcttcgatgaaaagaagcctgcggactaatttccttagatactggaccctcacatatcttgccctgcccacagtcactgatcaggaggccactcccgtgccacctacgggagacagcgaggccacccccgtgcctccaacaggcgatagtgagacagctccggtgcctcccactggagatagtggcgcaccacctgtacctccaactggggactccggagccccacctgtgccgcctacgggggacagcggcgccccaccagttcctccaaccggagactctggagccccccccgtgccccccaccggggacagcggtgcgccgcctgtcccgcccaccggtgacgccggtcctccaccggtcccgccaaccggtgactccggggcaccccctgtgcctccgaccggagattccggagcccctcccgttacaccgacaggggatagcgagactgctcccgttccacccacaggggatagcggagccccaccagtgcccccgacaggagattctgaggccgctccagtaccacccacggatgattcaaaagaagctcagatgcccgcagtcataagattctag

SEQ ID NO: 181629 - DNA, 2064 bp, Artificial Sequence
  Description of Artificial Sequence: Synthetic coding sequence
atgggccggctgcagctggtggtgctgggcctgacctgctgctgggccgtcgcaagcgctgctaagctcggagctgtttacaccgaaggcggcttcgtggaaggcgtcaataaaaagttggggctgcttggagacagtgtcgacatttttaagggaatacccttcgccgctcctactaaggccctcgagaaccctcagccccacccaggctggcagggcacactgaaggctaaaaattttaagaagcggtgtctccaagcaaccataacccaggattccacgtacggggacgaggattgtctatatctgaatatctgggtgccacaaggtcgcaagcaggtgtcacgggacctgccagtcatgatttggatctatggaggtgcattcctcatggggagtggtcacggcgccaatttcctaaataattatctgtatgatggagaagaaatcgcaactagaggtaatgtaatcgttgtcacttttaactatagagtgggtcccttgggattcctcagcacaggcgacgcaaatttgcctggcaattatggtctgcgcgaccagcacatggctatcgcctgggttaagaggaacattgcagcgttcgggggggatcccaacaacattacgctattcggcgaaagcgcaggaggtgcctcggtcagtcttcagacattaagtccatacaacaagggcttgatcaggcgtgccatttcccagtctggagtagcgctgagcccttgggtgatccaaaaaaatccactgttctgggcaaagaaggtagcagaaaaagtgggttgccccgtgggggatgccgcgcgaatggcccagtgtctcaaggtgaccgacccacgtgctttaaccctcgcctataaggttccactggctgggttagagtaccccatgttgcactacgtaggattcgtgcccgttattgacggcgattttataccggccgaccctattaacttgtatgcgaatgccgcagacatcgactatatcgcaggcaccaacaacatggacggtcatatttttgctagcatcgacatgcctgccattaataaaggaaacaagaaagtgaccgaagaggacttttacaagctggttagcgagtttacaattaccaaaggcctgcgcggagccaaaaccacgttcgatgtctacactgagagctgggcccaggacccctctcaggagaacaagaagaagaccgtcgttgactttgagaccgacgtgctgttcttggtccctactgaaattgctctggcacaacacagggcaaatgccaaggatcccaatatgggcgactccgccgtgcccacccactgggaaccttacacaaccgaaaactctggatacctggagattactaaaaaaatgggtagtagtagtatgaaacgctctctgagaactaactttctcaggtattggaccctgacttatctcgcccttcctaccgtcactgatcaagaggcgacacccgtcccacctactggcgattcagaggcaacccctgtcccgcccaccggagacagcgaaaccgccccagtgccaccaaccggcgactccggagccccccccgtcccaccaacgggagacagcggagctccgcccgtaccaccaacaggagactctggagccccaccagtccctcccaccggcgacagtggcgcacctccggttcctcccactggcgatagcggagcacctcccgtccctcctactggggacagcggagcccctccggttcctccaacgggagactcaggcgcacctccagtacccccaacaggagactcaggagcacctcccgtgccccctactggcgacgcaggcccaccacccgtgccccccaccggcgacagtggtgctcccccggtgccccccaccggtgacagcggtgctccccctgtgacaccaacgggagattcagaaacagcccccgtgccaccaacgggcgacagtggggcccccccagttccacccaccggcgacagcgaggccgcccccgttcctcctaccgatgattctaaggaagcacagatgcctgcagtaatccgcttctag

SEQ ID NO: 181630 - DNA, 2271 bp, Artificial Sequence
  Description of Artificial Sequence: Synthetic coding sequence
atgctgaccatgggccggctgcagctggtggtgctgggcctgacctgctgttgggcagtcgcatccgcagctaagttaggagcagtatacacagagggaggatttgtggagggagtcaataaaaagttagggttactgggggattcggttgacatcttcaagggcataccctttgcggctcctacaaaggcattggaaaacccccagcctcatcccgggtggcaaggcacacttaaggcaaaaaacttcaaaaagcgctgtctccaggctactattacccaagattctacctacggagacgaagactgcttgtacctcaacatctgggtgccgcagggacgcaagcaagtgtcccgcgacctccctgtgatgatctggatatacggtggtgcctttttaatgggcagcggtcacggggctaacttcctaaacaattatctgtacgacggagaggaaatagcaacgcgcgggaatgtcatcgtggttacttttaattacagggtcggacccctgggttttctttctactggtgacgccaacctccccggtaactatggactccgggaccagcacatggcgattgcctgggtgaaacggaatatagcagctttcgggggcgatcctaataatatcacgctcttcggtgagtcagcaggcggggcatcagtgtctctccaaaccctatccccttacaacaaaggcctgatccgcagagctatctcccagtcaggggtagcactcagtccatgggtcattcaaaaaaacccattgttctgggctaagaaggtggctgagaaggtggggtgcccggttggagatgcggcaaggatggcacaatgcttgaaggtgacagacccgagagctctcaccctggcgtacaaggtgccactggcagggctggaatatcctatgctacattacgtcgggtttgtccctgtgatcgatggcgactttatccctgctgatcctataaacttatatgcaaacgctgcggatattgattacattgccggcactaataatatggatgggcacatctttgccagcatcgacatgccggctattaataagggaaataagaaggttacggaagaggacttctataagcttgtgtcagagttcactatcacaaaaggactgagaggggcgaagacgacatttgatgtttatacagaaagctgggcccaggacccttctcaggaaaacaaaaagaagacagtagtggatttcgagaccgacgtcctattcctggtgcccactgaaatcgccctggctcaacatcgagctaacgccaaatccgcaaaaacctacgcgtacctgtttagtcatcctagtcgaatgccagtgtaccctaagtgggtcggcgcggaccacgccgacgacattcagtacgtgtttggcaaacccttcgcgactcccacgggctatagacctcaggaccgcacagtaagcaaggcaatgattgcttactggacaaacttcgctaagaccggggatcccaacatgggcgattccgctgtgcccacccactgggagccctatactaccgaaaattccggttacttggaaatcactaagaaaatgggttcttcgtcaatgaaacggagtttgaggactaatttcctccgctactggacactgacatatctggcgcttcctacagtgacagaccaggaggccacccctgtgccccccacgggtgactccgaggccacgccagttcctcctacaggggatagcgagaccgcacccgttccccccacaggagacagcggggcgccccctgttcccccgactggggattctggagcaccaccagtaccacccacgggggattcaggcgctcccccagtgcccccaaccggagacagcggcgccccccctgtgcctccaacaggcgacagtggcgcaccgcccgtgccccccaccggagactctggcgccccgcccgttccacccacaggggatagtggagccccccctgtcccaccaacaggagatagcggggcacccccagtgcctccaaccggggatgccggcccgcctccagtccccccaacgggggacagcggcgctccacccgtcccgccgacaggtgacagtggagccccccctgtgacaccaactggtgatagtgagaccgcccccgtgcctcccacaggcgactctggtgcccccccagtgccaccaaccggcgacagcgaagccgcccccgtgccacctaccgacgactctaaggaggcacagatgcctgccgtaataagattctag

SEQ ID NO: 181631 - DNA, 1707 bp, Artificial Sequence
  Description of Artificial Sequence: Synthetic coding sequence
atgtggctgcgggccttcatcctggccaccctgagcgccagcgccgcgtgggcagggcaccctagttctcctcctgttgttgataccgtccatggaaaggtcctgggaaaattcgtatcactggaaggattcgctcagcccgtcgcaatcttcctggggataccttttgctaagcccccccttggccctttgaggtttacgccaccccaacccgctgagccatggagtttcgtgaagaacgctacatcgtaccccccaatgtgtacccaagatcctaaagccgggcagctcctctctgagctttttaccaaccgaaaggaaaacatcccattgaaactaagcgaggactgcctgtacctgaacatctatacccccgctgacctgaccaagaagaacagactgcccgtaatggtatggattcacggcggggggctcatggtgggtgctgcatctacttatgatgggctggccctggccgcccatgaaaatgttgtcgtggttactatacagtatcggctcggcatatggggcttcttcagcacgggggatgagcactccagaggaaactgggggcatctggaccaggtagcagcgctgcgctgggttcaggacaacattgcaagttttggcggtaatcccgggtctgtgacaatttttggcgaatccgctggtggtgaaagtgtgagcgtacttgttctgtcaccactggcgaagaacttgtttcatcgggccattagtgaatctggcgtggctctgacgtccgtgctcgtcaagaagggggacgtcaagcctcttgcagaacagatcgctatcaccgccgggtgtaagaccaccacttccgccgtaatggtccattgcttgcgccagaaaacagaggaagaattactggaaaccacgctgaagatgaaattcttatcactagacctgcagggagatccaagggaatcccagcccttactaggtacagtcatcgacggaatgttgctgctgaagacccctgaggagttgcaggccgaaagaaactttcacaccgtgccttacatggtggggattaataagcaagagtttggatggcttatccctatgcagttgatgagttaccctctgagcgaaggacagctggaccagaagaccgcgatgtccctcctgtggaaaagctatccccttgtatgcattgccaaggagctaatcccagaagccaccgagaaataccttggggggacagatgacactgtcaaaaagaaagacctgttccttgacctcattgccgacgtcatgttcggagttcccagtgtaattgtcgccagaaaccatagagacgcaggagcccctacttacatgtacgagtttcagtacaggccatctttctcctcagacatgaaacccaagacggtgattggtgaccacggcgatgaactgttttcagtgtttggggcaccgttcctcaaggagggggctagcgaggaagagatccgattgtctaagatggtcatgaaattttgggccaatttcgctcggaacgggaaccccaatggagaagggctcccccattggccagagtacaaccagaaagagggttatctgcaaatcggagctaacacccaagccgcccagaaactcaaggataaggaggtggcattctggaccaatctatttgccaagaaggcagtggaaaagcctccacaaactgagcacatcgaattatag

SEQ ID NO: 181632 - DNA, 1704 bp, Artificial Sequence
  Description of Artificial Sequence: Synthetic coding sequence
atgtggctgcgggccttcatcctggccaccctgagcgccagcgccgcgtgggggcacccttcctcaccccctgtcgttgacacagtgcatggtaaggtcctgggcaaatttgttagtttagagggattcgcccagccagtcgccatcttcttgggtattcccttcgcaaaacctccactcggccctctgcgatttacccccccccagcccgcagagccctggtccttcgtgaagaatgccactagttatcctcctatgtgtacccaagatcccaaggccggccaactgttatccgagctcttcaccaataggaaagagaatattcctctgaagcttagtgaagactgcctgtacctcaatatttacacgccagcagatttaacaaagaagaaccgccttcccgtgatggtttggatccatgggggtggccttatggtaggggccgcaagtacttacgacggcctggctctggccgcccatgagaacgtcgttgtggtcaccatccagtatcggttgggcatctggggcttcttttcaaccggcgatgagcattccagaggcaattggggccatctcgatcaagtagctgccctgcggtgggtacaagacaatattgcaagctttgggggaaatcccggttcggtcacaattttcggtgagtcagccgggggagagtctgtctcagttctggtcctttccccgttagctaagaacctgttccatcgggccattagcgagtctggggtggctctgacaagcgtgctcgtcaagaagggggatgttaagcccctggctgaacagattgctattacagccggttgcaagaccacaacctctgccgtgatggtccactgtctccgccagaagaccgaggaagagcttcttgagacaactctcaagatgaaatttttatcattggatttgcagggcgatcctagagagtctcaaccgctattggggaccgtgatcgacgggatgctgttgctaaaaacgcccgaggaactccaggctgagagaaactttcatacagtgccatatatggtggggattaacaaacaggaattcggttggctgatccccatgcaattgatgagctaccccctgtctgagggccagcttgaccagaagaccgctatgtccctgctctggaaatcttaccctctggtttgtattgctaaggagctgatccccgaggctaccgaaaagtacttgggcggtaccgacgatacggtgaaaaagaaagatctgttcctggacctgattgctgatgtgatgtttggcgttccgtcggttatcgtggcaaggaatcatagggacgccggggccccaacatacatgtacgagtttcagtatcgcccgagcttttcgagcgacatgaaaccaaagacagttatcggagatcatggggacgaactcttttctgtctttggggcccctttcctgaaggaaggcgcttctgaagaggagataagattgtcaaaaatggtgatgaaattttgggcaaatttcgccaggaacggcaatcccaacggagaaggtctgccccactggcccgagtataaccagaaggaggggtatctgcagattggagctaatacacaggccgcccagaaactcaaggataaggaagttgccttctggaccaacttgttcgctaagaaggctgtcgagaaacctcctcagacagagcacatagaattgtag

SEQ ID NO: 181633 - DNA, 1701 bp, Artificial Sequence
  Description of Artificial Sequence: Synthetic coding sequence
atgtggctgcgggccttcatcctggccaccctgagcgccagcgccgcgtgggggcatccttcaagcccgccagtggtggataccgtccatgggaaggtgcttggcaaattcgtctctctcgaaggcttcgcacaacccgtggcgatcttcctgggaatacctttcgcaaaacccccacttggtccactgaggttcacgcctccccagcctgcagaaccctggtcatttgttaagaacgccacttcatacccaccaatgtgcacacaggaccccaaagccggacaattgcttagcgaactattcacgaatcgcaaggagaatattcctctgaaactttctgaagactgcctgtatttgaatatctataccccagccgatcttacaaagaagaaccgtcttcctgtcatggtgtggatacacggcggcggcctgatggtaggtgcagcctcaacatacgatggtctagccctggccgcgcacgagaatgtcgtggtggtcactattcaataccgcctgggtatctggggctttttcagcactggggatgaacatagccgcggtaactgggggcacctcgatcaggtggccgccctccgttgggttcaggacaatatagcttcgttcggcgggaatcccggcagcgtgacaatcttcggggaaagcgctgggggagagtcggtgtcggtcctagtcctatcaccactggctaagaacctatttcatcgggccatttccgaatcaggtgtcgccttaacatcagtgttagtcaaaaaaggagacgtcaaaccacttgccgagcagatcgccatcactgccggatgcaaaaccactacatcagcggtgatggtgcactgtcttcggcaaaaaacagaagaggaactcctggagaccacacttaaaatgaaattcctgtctcttgatttgcagggagacccgcgagagagtcagcccttgcttggcaccgtaattgacggtatgttattgctgaagacccccgaagagctgcaggctgaaagaaactttcatactgtgccatacatggttgggatcaataagcaagagttcgggtggctcatccctatgctgatgtcctaccctctgtcagaaggacagctagatcagaagaccgctatgagcttgctctggaagtcatatcccctggtctgtatagccaaagagctgataccggaggccacagaaaaatacctcggaggaacagacgatacagttaagaaaaaagatttattcctggacttaattgccgacgtgatgtttggggtccctagtgtgatcgttgcccggaaccaccgggacgccggagccccaacctatatgtacgagttccagtaccggcctagctttagttctgacatgaaaccaaaaacggtgattggcgatcatggcgatgaactattctccgtgtttggagcacctttcctgaaggaaggagctagtgaggaagagattcgcctgagtaaaatggtcatgaagttttgggctaacttcgccagaaatggtaaccctaacggagagggcctgccgcactggcctgagtataatcaaaaagagggatacttgcaaataggcgctaacacgcaagcagcccaaaagcttaaagataaagaagtggcattttggaccaatctgttcgccaaaaaagctgtcgagaagccacctcaaaccgagcatattgagctgtag

SEQ ID NO: 181634 - DNA, 1299 bp, Artificial Sequence
  Description of Artificial Sequence: Synthetic coding sequence
atggtgtggatccacggcggcggcctgatggtgggcgccgccagcacctatgatggcctcgcactcgccgcccacgagaacgtcgtcgtggtgacaattcaataccgactgggtatttggggatttttttccacgggtgacgagcattcgcgcgggaactggggccaccttgatcaggtggctgcccttcggtgggtgcaggataatatagcaagttttggcgggaatcctgggagcgtgacaatttttggcgagtccgccggcggtgagtccgtgtcagtgttggtgctgtctcctcttgcaaaaaatttgtttcatagagctatctcagaatcaggcgttgccctgaccagtgtgctcgtgaagaaaggcgacgtaaagccactagcggagcagatcgccatcaccgctggatgcaagacaactacaagcgccgtcatggtgcattgcctgcgccagaaaaccgaggaagagctgctcgagacgaccttgaaaatgaaatttctatcactggacctccagggtgatccccgggagtcacaacctcttttgggtacggtgatcgacggaatgctactgttaaaaacaccagaggaactgcaagcggagcggaattttcatacagtaccatacatggtggggattaataaacaggaattcggctggctgatccccatgcagttaatgtcctatccccttagcgagggccaactcgaccagaaaacagcgatgtctttgttgtggaagagctacccccttgtgtgcatcgcaaaagagctaatacccgaggctaccgagaaatatctcggcggcactgacgacacggtgaagaaaaaggatctcttcctcgacttgattgccgatgtgatgttcggcgtaccctccgtgatagtggcgcggaaccatagagatgctggcgcccctacttacatgtatgagtttcagtaccggcctagtttcagttccgacatgaagccaaagaccgtcattggtgatcatggcgacgagctgttttccgtgtttggagccccatttctgaaggagggcgcatcagaagaagagattcgcttatcaaaaatggtgatgaaattctgggccaatttcgcccggaacggcaatcctaatggcgagggtctcccccactggcccgagtacaaccagaaggagggctacttgcagatcggggccaacactcaggctgcacaaaagcttaaagataaggaggtggccttttggacaaatctgtttgccaagaaggccgttgaaaaacctccccagaccgaacatatagaactgtag

SEQ ID NO: 181635 - DNA, 1716 bp, Artificial Sequence
  Description of Artificial Sequence: Synthetic coding sequence
atggagcgggccgtgcgggtggagagcggcgtgctggtgggcgtggtttgtctgctacttgcctgtcctgccaccgccacgggacctgaggtggcacagcctgaggtggacaccacccttggacgtgttcgggggagacaggtgggggtgaagggtacggatagacttgtaaacgtgttcctggggatcccgtttgcccagccccccctcggtccagaccgcttttctgctccccatccagcccagccctgggagggcgtccgggatgcctccaccgccccccccatgtgccttcaggatgttgagtccatgaatagtagtaggtttgtcctcaacggaaaacagcaaattttttccgtatccgaagattgtttggttttaaacgtttatagccctgctgaggtacccgcaggctctggcagacctgtgatggtctgggtgcacgggggtgccttgatcacaggggctgccacctcctacgacggcagtgcgttggctgcatacggcgacgtggttgtcgtgaccgtccaatatagactgggtgtgcttggattctttagtacgggggatgaacatgcaccgggtaaccagggctttctggatgtcgttgccgcacttcggtgggtacaggagaacattgctcccttcggcggggacctgaattgcgtaaccgtgttcggagggtctgctggcgggtccatcataagtgggctcgtgctgagccctgtggctgccggcctcttccaccgcgccatcactcagagcggcgtgatcactacacctggcattatcgactcacatccttggcccctggcccagaaaattgctaacactctagcctgtagtagtagttccccggcggagatggttcagtgcctacagcagaaggagggagaggagctcgtcctttctaaaaagcttaaaaacacaatctacccactgactgtggacggaaccgtttttcccaaaagccccaaagaactcttaaaggagaagcccttccacagcgttccctttttgatgggagttaataaccacgaatttagctggcttattccccggggatggggactactagatacgatggagcagatgtccagggaagatatgctggcaatttcaacccccgtcctgacttcactcgatgtgccacctgaaatgatgccaacggttatagacgagtatctgggaagcaactccgatgcacaggcaaagtgtcaggcttttcaggagttcatgggagacgtgttcattaacgtgccaaccgtgtctttcagcagatatctgagggattctggcagccccgtcttcttttacgagttccaacaccgacccagcagcttcgccaagattaagcccgcttgggtgaaggccgatcacggggcagagggtgcttttgtgttcggtggtccattcttaatggatgagagtagtaggctcgcctttcctgaagccacagaggaggaaaagcaactttccctgacaatgatggctcagtggacccattttgctcgcacaggagatccaaattctaaagcactacctccttggccccaattcaatcaagcggaacagtaccttgaaatcaatcctgttcccagagcgggacagaagtttcgagaagcctggatgcagttctggagcgagaccctgcccagcaaaattcagcaatggcatcagaagcagaagaacagaaaggcccaggaggatctgtag

SEQ ID NO: 181636 - DNA, 633 bp, Artificial Sequence
  Description of Artificial Sequence: Synthetic coding sequence
atggagcagatgagccgggaggacatgctggccatcagcacccccgtcctgacgagcttagacgtgccacccgagatgatgcctacagtcatcgatgagtacctgggcagcaatagtgacgcacaggcaaaatgtcaagcttttcaagagtttatgggagatgtcttcattaacgtgcccaccgttagcttttctcggtatctcagggattcagggtcaccagtgtttttctacgagtttcaacatcggccaagtagtttcgctaagataaagccagcatgggtcaaggctgatcacggcgcagaaggggcgttcgtctttggcgggcctttcttaatggacgagagcagcagactcgcttttcccgaggcgacagaagaagagaaacagttatcactcacgatgatggcgcaatggacccacttcgcgcggacaggagatcccaactctaaggccctacccccatggccacaatttaaccaggccgaacagtatctggaaatcaaccccgtaccacgggccggccagaaatttcgggaggcctggatgcagttttggtcggaaaccctcccctccaagatccaacaatggcaccagaagcagaaaaatcggaaagcccaggaggacctgtag

SEQ ID NO: 181637 - DNA, 1707 bp, Artificial Sequence
  Description of Artificial Sequence: Synthetic coding sequence
atggagcgggccgtgcgggtggagagcggcgtgctggtgggcgtggtttgtttattactggcatgccccgcgaccgcaaccggtcccgaagtggcacagcccgaagttgacactacgctgggcagagttcgtggtagacaggtcggggttaaggggacagaccgcctggtgaatgtttttctcgggatccctttcgctcagcccccactgggacctgatagattctctgctccacaccccgcgcaaccctgggaaggggtaagagatgccagcacagcccctcccatgtgtctacaggatgtagagtcaatgaattccagtcggtttgtactcaacgggaaacaacagatcttctctgtgagcgaggactgtcttgtgctgaatgtgtatagcccagctgaggtgcctgccggtagcggccgtcccgtaatggtctgggtgcacggaggtgcacttatcacaggagccgcaacttcatacgatggcagcgcccttgccgcttatggggatgttgtagtggtgacagtgcagtaccgactcggggtgttgggatttttttctaccggagatgagcatgcgccaggcaaccaaggctttctcgatgtcgtggccgccttgagatgggtgcaggaaaatattgcgcctttcggcggggacttgaactgcgtgacagtatttgggggcagcgctgggggcagcatcatttctggcctggtgttgagccctgttgccgctggcctcttccacagagcaatcactcagtcaggcgtgattacgactcccggtatcatcgattcacacccctggcctctggctcagaagattgcgaacacattggcttgttcctccagtagtccagccgaaatggttcaatgcctccagcagaaggaaggtgaagagctggtcctcagcaaaaagctgaagaataccatatacccactgacagtggacgggacagtatttccgaagagccctaaggagctcctaaaggagaagccctttcatagtgtgcctttcctcatgggcgttaacaatcacgaattctcctggctgatccccaggggttggggactgttagatactatggaacaaatgtctagggaggatatgctggctatctctacccctgttctgacctccctcgatgtgccacccgaaatgatgcctacagtgatcgacgaataccttggctcgaacagcgacgcgcaggccaaatgccaagcttttcaggagtttatgggggatgttttcattaatgtgcctacagtctcattttctaggtacctcagggactccggttctccagttttcttttacgagtttcagcaccggccatcttccttcgcaaagataaagccagcttgggtcaaggcagatcacggggcagagggtgcctttgtgttcggcggtccctttcttatggatgagtcctcccgcctggaagccaccgaggaggaaaaacagctgtccttaacaatgatggcccaatggacccattttgctcgcactggagatccaaacagcaaggccctgccaccatggccacagttcaaccaggctgagcagtatcttgaaattaatcctgtccccagggccggccagaagttcagagaagcctggatgcaattttggtccgaaacccttccgagtaagatccagcagtggcaccaaaagcagaaaaacagaaaagcacaagaggacctctag

SEQ ID NO: 181638 - DNA, 738 bp, Artificial Sequence
  Description of Artificial Sequence: Synthetic coding sequence
atggccaacgaggcctacccctgcccctgcgacatcggccaccggttggaatacggaggattgggccgggaggtgcaggtggagcacatcaaggcttatgtcaccaaaagccccgtcgacgctggcaaagcagtgatcgtgatccaggatatatttggttggcagttaccaaacactcgttacatcgcagacatgatctcaggcaacggatatactacaatcgtcccagatttcttcgttggccaggaaccctgggatccttccggcgactggtcgatattcccggagtggctcaagaccagaaacgcgcaaaaaatcgatcgggaaatcagcgccattctcaagtacttaaagcagcagtgccatgcccagaagattggtattgtgggattttgttggggcggcacagccgtgcaccacttgatgatgaagtactccgagttcagggccggcgtgtccgtgtacggtatcgtgaaggattctgaggatatatacaaccttaaaaatcccaccctgttcatattcgctgagaatgacgtggttatacctcttaaggacgtatcattgctaacccagaaactgaaggagcactgtaaagtggaatatcaaatcaaaacttttagtggccagacacacggtttcgtgcataggaagagagaggactgttcacccgccgataagccatatattgatgaagccaggcgcaacctgatcgaatggctgaataagtacatgtag

SEQ ID NO: 181639 - DNA, 1260 bp, Artificial Sequence
  Description of Artificial Sequence: Synthetic coding sequence
atgcggggcctgctggtgctgagcgtgctgctgggcgccgtgttcggcaaggaagacttcgtgggccatcaggttctgagaatttcggtggccgatgaggctcaggtccaaaaggtaaaagagcttgaggatctcgaacacttgcaactcgatttttggagaggccccgcacaccccgggtcacctatcgacgtgagagtcccatttcccagcattcaggcggtgaaaatcttcctcgaatctcatggaataagctacgaaaccatgattgaagatgtccaaagtttactggatgaggagcaggaacagatgttcgcctttcgctctcgagcccggagcaccgatacattcaactacgccacatatcacactctggaagagatttatgatttcctcgacttgctggtggcggaaaatcctcaccttgtctccaaaatacagataggcaacacctacgaaggacgccccatatacgtgctgaagttctcaaccggaggcagcaagagaccggctatttggatcgataccggaatccattcgagggagtgggtcactcaggcctctggcgtctggtttgccaaaaaaattacacaggactacgggcaggacgccgctttcacagccattctggataccctcgatatcttcctggaaattgtgacaaatccggatggctttgcattcacccacagcaccaataggatgtggcgaaaaacgaggagtcacaccgctggcagcctctgtattggcgtggaccctaatagaaattgggacgctgggttcgggctgtcgggtgcttcctctaacccctgctcagagacctaccatggaaaattcgccaacagcgaagtggaggtcaagtcaatcgtggattttgtcaaagatcacggcaacattaaagcgtttatatcaattcactcgtactcccagctcctcatgtacccatatggctataaaacagagcctgtgccagatcaagacgagctggaccagcttagtaaagccgccgttaccgcccttgccagcctgtacggcacaaagtttaactacgggtcaattataaaggccatctatcaagcatccggctcaaccatcgattggacttattctcaaggtatcaagtattcattcactttcgaattgcgtgacacaggacggtacggcttcctattgcccgccagccaaatcatacctaccgccaaggagacatggttagcactgcttactattatggagcataccctgaaccacccgtattag

SEQ ID NO: 181640 - DNA, 1098 bp, Artificial Sequence
  Description of Artificial Sequence: Synthetic coding sequence
atggaccgggccgccctgctgggcctggcccggctgtgcgccctgtgggccgctcttttagtgctctttccttacggggcccaggggaactggatgtggctcggaatcgcttcgtttggtgtacccgaaaagttgggctgtgcaaacttgccgctcaacagccgtcaaaaagagctgtgcaaacgaaaaccctatctgctaccatctattagggaaggagcccgactggggatccaggagtgtggaagtcagttccgccacgagcgttggaattgcatgattaccgccgccgcgaccaccgcccccatgggcgcatctcccctgttcggatacgaattgtcaagtgggacaaaggagactgcatttatctatgctgtgatggcagccggtttagtgcactccgtgaccaggagttgctccgccgggaatatgaccgaatgttcgtgcgacaccacacttcagaatgggggttccgctagtgagggatggcattggggtggctgttcagatgacgtgcaatacggtatgtggttctctcgcaagtttctcgattttcctataggaaacaccactgggaaggagaacaaggtccttctggcgatgaatcttcacaataatgaggccggcaggcaagccgtggccaagttgatgtctgtggactgccggtgtcacggagtcagtggctcgtgtgctgttaaaacatgctggaagactatgtcatctttcgagaagatcggtcatttgctcaaagacaagtacgaaaattctatccagatttccgacaagaccaagcgcaaaatgaggcgcagagaaaaggaccaaaggaagatcccaattcataaggatgatctactgtatgtcaacaaatccccaaactattgcgttgaagataagaagcttggaattcccggcacccaagggcgcgagtgcaatcgcacttccgaaggcgccgacggttgtaatctcctgtgctgtgggcggggatacaatacgcacgtggttcggcatgttgagagatgtgagtgtaaatttatatggtgttgttatgtaaggtgcaggcggtgtgagtcaatgacagatgttcatacttgcaagtag

SEQ ID NO: 181641 - DNA, 1254 bp, Artificial Sequence
  Description of Artificial Sequence: Synthetic coding sequence
atgcggctgatcctgcccgtgggcctgatcgccaccaccctggccattgcccccgtgcgctttgacagagaaaaggtctttagggtgaagccgcaggatgagaagcaggcagacataataaaagatctggcaaagactaacgagcttgacttttggtaccctggcgcaacccatcacgtggcggcaaatatgatggtggattttcgcgtgtctgaaaaggagagccaagccatccagagtgctttggatcaaaacaagatgcactacgagatcttgatccatgatctgcaggaagagatagagaagcagtttgacgtaaaagaggacatcccaggacgccattcttacgctaagtataacaattgggagaagatagtggcatggactgaaaaaatgatggacaaatacccagaaatggtcagccgaatcaagatcggctctacagttgaagataacccgctctatgttctgaagattggcgagaagaacgagaggcgaaaggctatcttcaccgactgcggaatccatgcccgggaatgggtgtcccctgccttttgtcagtggttcgtataccaagccaccaaaacttacggccggaataagatcatgaccaagttgttggacagaatgaacttctacatcctcccagtgtttaacgtggatggatatatctggagttggacgaagaaccgcatgtggcggaaaaataggtccaagaaccagaattcgaaatgcatcggcaccgaccttaatagaaacttcaatgcttcatggaactcgatccctaacactaacgatccctgtgctgacaattatcgagggtctgctccagagtccgagaaggagacaaaggcagtgacaaacttcatccgatctcacttaaatgagatcaaagtgtatattacatttcactcatattcacagatgcttttgtttccatatggctacacaagcaagcttccacccaaccatgaagaccttgctaaagttgcgaagatcggcacagacgtcttatcaacacgctacgagactcgctacatttacggtccaattgagtctacaatctatcctatttcaggatcctcgttagactgggcctatgacttaggaatcaagcacacgttcgcttttgaactgagagacaaagggaaattcggatttctactaccagaatcccgaatcaaaccaacttgcagggaaaccatgctcgcggtcaagtttatcgctaagtacatactgaagcacacatcctag

SEQ ID NO: 181642 - DNA, 1260 bp, Artificial Sequence
  Description of Artificial Sequence: Synthetic coding sequence
atggccatgcggctgatcctgttcttcggcgccctgttcggccacatatactgtctcgagacgttcgtgggcgatcaggtactcgaaatagtcccttctaatgaggaacagatcaagaatctgctgcaattagaagctcaggaacatctgcagctggatttttggaagtcccccacaactcccggggagacagcgcacgtgcgtgttccattcgtcaacgtgcaggccgtgaaggtgtttctggagagtcaaggaatagcctacagcatcatgatcgaggacgtgcaggtcctgctggacaaggagaacgaagagatgctgttcaacaggcgccgcgaaagatcaggaaacttcaattttggcgcctaccatactcttgaagagatcagtcaagaaatggataatctagttgcagaacaccctggtctcgtgtctaaggtgaacattggctcttcctttgagaatcgtcctatgaacgtcctcaaattctccaccggaggggacaagcccgccatctggctggatgccggtatccatgcacgagagtgggtgacacaagctaccgcgttgtggactgcaaataagatcgtgagcgattatggcaaggacccctctattaccagcattctggacgctctggacattttcctgctgccagtcactaatcccgatgggtacgtgttttcacagaccaaaaaccggatgtggagaaaaacccgctctaaagtttcaggctcattatgcgttggtgttgatcccaacagaaactgggatgctgggtttggcggccccggcgctagcagcaacccatgcagcgactcttaccacggcccttccgccaacagtgaggtggaggtcaagtcaattgttgactttattaagtcgcacggcaaggtaaaggcctttataacattgcactcttactcgcaactgctgatgttcccctatggctacaagtgcactaagcttgacgatttcgacgagctgtctgaggttgcccagaaggccgctcagagtctgaggagcctgcacggaacaaagtacaaggtcggacccatttgctctgtcatatatcaggcttcagggggtagcatagactggtcatacgattatggcatcaagtacagttttgccttcgaattgcgcgatacggggaggtacggtttcctgctccctgccaggcagattttacctaccgcagaggagacctggctgggcctgaaggcgatcatggaacacgtaagggaccatccttattag

SEQ ID NO: 181643 - DNA, 1167 bp, Artificial Sequence
  Description of Artificial Sequence: Synthetic coding sequence
atgcggtggatcctgttcatcggcgccctgatcggcagcagcatctgcggtcaggagaaattttttggtgaccaagtgttaaggattaacgttcggaatggagacgagatcagtaaactgagccaactagtaaactctaataacttgaaactaaacttctggaagtccccttcttcatttaacagacctgtggatgttcttgttccttccgtgagtctgcaagccttcaaatccttcttgcgatcccaagggcttgagtatgccgtaacaatcgaagatctccaaatttatcacgaaatggataacattgctgccgacttcccagatctcgcacgtagagtgaagattggacactcctttgaaaaccgtccaatgtacgtgctgaagttctctaccggcaaaggggtcagacggcctgccgtgtggctcaatgccgggattcattctagggaatggatttctcaggcaacagcaatctggacggctcgcaaaatcgtatcggattaccaaagggaccccgctatcacgagtatcctcgagaagatggatattttccttctgcctgtcgctaatccggatggatacgtctacactcagactcaaaatagactgtggcgtaaaacacgcagtcgaaatcctggctcatcatgtatcggggcagaccccaatcgcaactggaatgcctcttttgccgggaaaggggcctctgacaatccgtgctcagaggtttaccacgggccgcacgcaaattcagaggtggaagtgaagtcagtagtcgacttcatccagaaacacggtaacttcaaaggcttcattgacttgcattcctactctcagctgctgatgtatccctacgggtacagtgtgaaaaaggcccccgacgcagaggagctggataaagtggctcggctggcagcgaaagctcttgcatcagtgtcagggactgagtatcaggtgggacccacctgcacaacagtctaccccgccagtggcagcagcattgactgggcctatgacaacggcataaaatttgctttcacgttcgaattgagggatacaggcacgtatggcttcctccttccagctaaccagataatccctaccgccgaggaaacctggctgggcctcaagaccatcatggaacatgtgagggacaatctgtattag

SEQ ID NO: 181644 - DNA, 681 bp, Artificial Sequence
  Description of Artificial Sequence: Synthetic coding sequence
atgaagatcgtgagcgactaccagcgggaccccgccatcaccagcatcctcgagaagatggatatcttccttctccccgttgccaatcctgatggctacgtctatacgcagacacagaaccgtctttggcgaaaaacaagaagccgcaatccagggagctcttgtattggggcggaccctaacaggaactggaatgctagttttgcagggaagggggctagtgacaatccctgctcagaggtctaccacggcccacacgccaactccgaagttgaagttaagtcggtggtggactttatccaaaagcacgggaactttaaggggtttattgatctgcacagctatagtcagttgttaatgtacccatatgggtacagcgttaaaaaagcgcctgatgcagaggaactggacaaggtcgcccgactggcagctaaagctttggcttccgtgtccggcaccgaataccaggttggcccaacctgcacaaccgtctaccccgcttctggatcttccatcgattgggcatacgataatggcataaagtttgcattcaccttcgaattaagagatacgggtacatatggtttcctcctgcccgcaaatcagatcattccgacagccgaagagacttggctgggcctgaaaaccatcatggaacacgtgagagacaacctgtactag

SEQ ID NO: 181645 - DNA, 582 bp, Artificial Sequence
  Description of Artificial Sequence: Synthetic coding sequence
atgcaccacctgaacaagacccacagcggcctgatccacatgttctccatcggccgtagctacgaaggcaggagcctgttcatactcaagctgggccgccgctcccggctgaaacgtgctgtgtggatcgattgtggaatacacgcacgggaatggatcggcccggccttttgccagtggttcgtcaaggaggccctactgacctacaagtccgaccctgccatgcgcaaaatgctgaatcacttgtacttctatataatgcccgtattcaacgtggatggctatcatttctcatggacaaatgaccgattttggagaaaaacacgatccaggaatagtcgttttcggtgcaggggggtcgacgcgaatcgcaattggaaggttaagtggtgtgacgtgagtagcggatcgagcatggactgggcttataagaatggtattccttatgcattcgcgtttgaattaagagatacagggtatttcgggttcctcctccctgagatgctgattaaaccgacatgtactgaaaccatgcttgcggttaaaaacatcaccatgcacctactgaagaaatgcccatag

SEQ ID NO: 181646 - DNA, 1314 bp, Artificial Sequence
  Description of Artificial Sequence: Synthetic coding sequence
atgaagtgcctgggcaagcggcggggccaggccgccgccttcctgccactgtgctggctctttctgaagatattacaaccgggccacagccacctctacaacaatcgctatgctggtgataaggtcatacgcttcatacctaagactgaagaagaggcctatgccctaaaaaaaatttcttatcagctgaaagtggatttgtggcagcccagttccatttcctacgtgtccgagggaaccgtgacagacgtgcacatcccgcaaaacggcagtagggctcttttggccttcttacaggaggctaatatccaatacaaagtgctgatcgaagatcttcaaaagactctagaaaaaggcagctctctccatactcaacgaaatcgaagatctctgtctggctataactatgaggtgtaccattcactggaagagatccagaattggatgcaccatcttaacaagacccactctggtctgattcacatgttttccatcgggcgatcctacgagggacggtccctgttcatcctgaagctgggtcggaggtcaagattaaagagggccgtatggatagactgcggcatccatgcgagagagtggatcggtccagcattttgccagtggttcgttaaagaggccttgctgacttacaaatccgatccagcgatgagaaaaatgctgaaccacctctatttctatatcatgcccgtcttcaatgtggatggctatcacttctcatggacgaatgataggttttggaggaagacaagaagccgcaactctcggttcagatgccggggcgtggatgctaaccggaattggaaagtcaagtggtgtgacgagggggcaagcatgcatccgtgtgatgatacttactgtggtccctttccagaatcagaaccagaggtaaaagccgtggccaatttcctccggaagcatcggaagcatatccgcgcttacttgtcatttcacgcctacgcacagatgctgctctatccttatagctacaaatacgctacaattcctaatttcaggtgtgttgaatcagctgcatataaagctgttaacgctttgcaatctgtatacggcgtgcggtaccggtacggccccgctagcaccaccctctatgttagctcaggaagttccatggattgggcttacaaaaacggtatcccctatgccttcgccttcgaattaagggataccggttactttggttttcttctccctgagatgctgataaagcctacgtgtaccgagacaatgttggcagtcaaaaacataactatgcacctgcttaaaaagtgcccgtag

SEQ ID NO: 181647 - DNA, 948 bp, Artificial Sequence
  Description of Artificial Sequence: Synthetic coding sequence
atgaagtgcctgggcaagcggcggggccaggccgccgccttcctgcctctgtgctggctgtttctgaagatactacagcccggccactcccacctctacaacaatagatatgccggagacaaagttattagatttattcccaaaactgaggaagaggcatacgctttgaagaaaatttcttatcagctaaaggtggatctctggcagcctagttcaatctcctatgtgtccgaaggtactgtgaccgacgtgcacattcctcagaacggatcccgagcccttctggcttttctccaggaggccaatattcagtataaggttctcatcgaggatttacagaaaacgctggagaagggcagcagtctccacacgcagaggaatcgtaggtcattgagcgggtacaactatgaagtataccatagcttagaggagattcaaaattggatgcatcacctgaataaaacccactcgggcctgatccacatgttctcgatcggccgtagctatgagggaagatccttattcattttaaagctgggcaggaggtctagattgaagcgagctgtttggattgattgtggcatacatgcaagagagtggatcgggcccgccttttgccagtggttcgtcaaggaggctctgttgacgtacaagtccgaccccgcaatgagaaaaatgttgaaccacctctacttctacatcatgccagtgtttaatgtcgacggatatcacttctcctggaccaatgatcgtttttggcgcaaaacccgatctagaaattcacgttttaggtgtcggggcgtggatgctaatcgaaactggaaagtgaaatggtgtgggaaatttggtaccaattgggaccccgatccaaaggtgtccgccgggtttacactgcagaatatgtcgcctgaggattcccatggcagactcatgtttttctgcatgtag

SEQ ID NO: 181648 - DNA, 1272 bp, Artificial Sequence
  Description of Artificial Sequence: Synthetic coding sequence
atgaagctgtgcagcctggccgtgctggtgcccatcgtgctgttctgtgagcagcacgtcttcgccttccaaagcgggcaggtccttgcagcgctgccccgcacctcgcggcaggtgcaagtgctgcagaacctaacaaccacctacgagatcgtcctttggcagcctgtaacagcagatctgatcgtaaagaaaaagcaagttcatttcttcgttaacgcatctgacgtcgataacgttaaggcccatctgaatgtgtcaggaatcccctgctccgtccttttggcagatgtggaagacctcatccagcaacagatatcaaatgacacggtgagcccccgcgcaagcgcttcctactacgagcagtatcatagcctaaatgagatttatagttggatagagttcatcaccgagcgtcatccagacatgctgaccaaaatacatatcggctcttcattcgagaagtaccctctgtatgttttaaaggtttcaggaaaggaacaggctgcaaagaacgcgatatggatcgattgcggtattcatgctagggagtggatttcaccagccttttgtctgtggtttattggacacattactcagttctatggaatcataggtcagtacaccaatcttctgaggctcgtggacttctatgtgatgcccgtggtgaacgtcgatgggtacgactattcttggaagaagaaccgcatgtggcggaagaataggagtttctacgcaaacaaccattgtatcggaaccgatttaaataggaattttgcctctaaacactggtgcgaggagggggcttctagctccagctgttcagaaacctactgcggactctatcctgagtcggagccagaggtgaaagcagtagcaagtttcctgcggcggaacatcaaccaaatcaaagcctacatttctatgcattcctactctcagcatatcgtattcccctattcttacacgaggtctaaatcaaaggatcacgaggaattgagccttgttgccagcgaagcagtgcgggctattgaaaagatttctaaaaacacgcgctatactcatggacacgggtcagagaccctctatctggccccaggtgggggggatgattggatctatgacctgggaatcaagtattcctttacaattgaactacgggatacaggcacgtatggcttcttgctccctgaacgctatattaaaccaacgtgtagggaagcattcgcagcagtcagcaaaatcgcgtggcacgtcattcgcaatgtatag

SEQ ID NO: 181649 - DNA, 1083 bp, Artificial Sequence
  Description of Artificial Sequence: Synthetic coding sequence
atgaagctgtgcagcctggccgtgctggtgcccatcgtgctgttctgtgagcagcacgtgttcgcctttcagagcgggcaagtgctggcagccttgcccaggacctcaaggcaagtgcaggtgcttcaaaatctgacaacaacatatgagattgtcttgtggcagcccgtaaccgcagacctgatcgtcaagaaaaagcaggtgcacttcttcgtaaacgcctcagacgtcgacaacgtgaaagcacacctaaacgtgtcaggcatcccatgttctgttctgctagctgacgtggaagacctgattcaacaacagatctctaatgataccgtttctccccgtgcctcagcgagctactacgaacagtaccactctctaaatgagatatactcatggatcgaatttattactgaacggcaccccgacatgctcacgaaaattcacattggtagtagctttgagaaatacccactgtacgtgctgaaagtaagcggaaaggaacaagccgcaaagaacgcaatctggatcgattgtggcatccatgctcgggagtggatcagccccgcattttgcctctggttcatcgggcacaacagaatgtggcgtaagaatcggagcttttacgccaataatcactgcatcggcacagatctaaatcggaacttcgctagtaagcattggtgcgaggagggcgcctcttcctcttcctgcagcgagacgtattgtggcctgtaccctgagtctgagccagaagtgaaggccgttgctagttttcttcgtcgcaacatcaaccaaatcaaggcttacattagcatgcacagctacagccagcacattgtcttcccatatagttacacacgaagtaaatccaaggaccatgaggagttgtcactggtggcatctgaggcagtacgcgctatcgaaaaaatctcaaagaacacccgctatacgcacggccatggctctgagacactttacctggcacctggtggcggcgacgactggatctatgacctaggaattaaatactctgttacatctaaccccccagtggagaagctgctgccattgtcactgaagtag

SEQ ID NO: 181650 - DNA, 849 bp, Artificial Sequence
  Description of Artificial Sequence: Synthetic coding sequence
atgctgcccctgctgcggtgcgtgccccgggtgctgggcagcagcgtggccggcctgcgggccgctgcacctgcaagccctttcagacagctgttacagcctgcacctcggctctgcactagaccattcggcttgctgtcagtgagggctggaagtgagaggaggcctggactcttgcgccctagaggcccatgtgcttgcgggtgcggctgtggatctctccacaccgatggggacaaggcctttgtggattttctgtccgacgaaattaaggaagaaaggaagatccagaagcacaagaccttgcccaagatgtccggaggatgggagcttgagttgaacggaactgaggcgaaactcgtgcggaaggtggcaggtgaaaaaataaccgttacattcaatatcaataactcaattccccccacgtttgatggcgaggaggagccgtcacaaggtcagaaggtagaagaacaggaaccggaattaaccagcacgccaaatttcgtggtggaagtgattaaaaacgacgatggtaagaaggcgctcgtcctggattgccattacccagaagacgaggtcgggcaggaggacgaagccgaaagtgacatcttctccatcagggaagtgtcttttcagagtaccggtgagtcagaatggaaggacactaattacactctgaacacagactcgttagactgggccctctacgatcatcttatggatttcttggccgaccgaggagttgataacacatttgccgacgagctggtggagttatccaccgccctggaacaccaggagtacataaccttcctcgaggatctaaagagcttcgtcaagtcacaatag

SEQ ID NO: 181651 - DNA, 3402 bp, Artificial Sequence
  Description of Artificial Sequence: Synthetic coding sequence
atgcggttcgtgctgagcggcaacctgcacggcggcagcgtggtggcatcgtatccctttgacgactctcctgagcataaggccacgggaatctatagcaagacaagtgatgacgaagtatttaagtatctggctaaggcttacgcatctaaccatcccattatgaagactggggaaccccactgtcccggtgacgaagacgagacattcaaggatggcatcaccaatggggcccactggtatgatgtagaaggtggaatgcaggactataattacgtgtgggcgaactgtttcgaaattacgctggagctgagctgttgcaaataccccccagcttctcagttgcgacaggagtgggagaataacagggaaagtctgattactctcattgagaaggtacatattggcgtgaagggctttgtcaaggacagtattaccggctccggcttggaaaatgctacaatttcagtagccggcatcaaccacaatatcaccacagggaggttcggtgatttctacaggctgctggtgcccggcacctacaatctcaccgtagtattgacgggctacatgccccttaccgttacaaacgtggtcgtcaaagaagggcctgcaactgaggtggatttcagcctcaggcctaccgtcacgagcgtaatcccggatactacggaggccgtgagcaccgcatccaccgtggccatccctaatatactgtccgggacctcgagttcctatcagcccattcagccaaaagacttccaccaccatcacttcccagatatggagatctttctgagacggttcgctaacgaatatcctaatattaccaggctgtattcgctcgggaagtcggtagaaagtcgcgaactctacgttatggagataagtgacaatcctggtgtgcatgaacctggagaaccggagttcaagtatatcggaaacatgcacggcaatgaagttgtcgggcgcgaactgctgctgaatctcatcgaatacctgtgcaagaacttcggtacggacccagaggtcacagacttggtgcataatactagaatacacctgatgccttcgatgaaccctgatggctacgagaaaagtcaggagggcgacagcatctccgtcatcggaaggaacaattctaacaactttgacctcaaccgtaattttccagaccagttcgtccagattacggatccgacgcagcctgagacaatagcagttatgagttggatgaaaagctaccccttcgtattgtctgcaaatctgcatggcggctcgctcgtagtgaactacccctttgacgatgatgaacagggcctggctacctacagtaaaagcccggacgacgcagtgtttcagcagatcgcactgtcctacagcaaggagaacagccagatgttccagggcaggccatgtaagaatatgtaccctaatgagtactttccacatggaattacaaatggcgcttcctggtataacgtgcctggaggtatgcaggactggaactatttgcaaaccaactgtttcgaagttacaattgagctgggatgcgtaaaataccctctggaaaaggaattgcctaatttctgggagcagaatagacgcagcttaattcagttcatgaaacaagtgcaccagggcgttagaggatttgtgctggacgcgacggatggacgcgggatcctgaacgccacaataagcgtcgctgagattaatcaccccgtcacaacctataagaccggagactattggagattgctggtgcctggcacatacaagattaccgcatctgcccgagggtacaaccccgtgacaaagaacgtgactgttaagagtgaaggcgcaatccaggtcaactttactctagtcagatcctcgactgattcaaacaacgaatccaaaaaggggaaaggagcctcctcctccacgaacgacgcatcagatcccaccacaaaagagttcgagacacttataaaggatctgtccgcagagaacgggctggaaagcctgatgctgagatcaagtagcaacctggctctggccttgtaccgttaccactcatacaaggatttaagcgaatttctgcgcggactcgtgatgaattatcctcatatcactaacctgactaatctgggccagtccactgaataccgacatatatggtcactggaaatcagcaataagcctaacgtctcagagccagaggagcctaaaattaggttcgttgccgggatccacggcaacgctccagttggcacagagctgttgctcgcactcgctgaattcctctgtctgaactacaagaagaacccggctgtaacacagcttgtcgaccgcacccggatcgtaattgtgccatccctgaaccctgacggccgggagcgcgcccaggaaaaggattgcacgagtaagattggacaaacaaacgctagaggcaaggatctcgacactgactttacaaacaatgcaagtcagcccgagactaaggctattatcgaaaatcttatccaaaagcaggactttagcctgagcgtggctctcgatggcgggagtatgctcgtaacttacccctatgacaagccagtgcagacagtggaaaataaggagacactgaagcatctcgcgagtctgtacgctaacaaccatccatccatgcacatgggccaacctagctgtccaaataagagtgacgaaaatatcccgggtggcgttatgcgtggcgccgaatggcactcacatctgggatccatgaaggattacagtgtaacctatggtcattgtcccgagatcacagtgtatacgtcatgctgttatttcccttcagcagccagactcccatccctgtgggccgacaataagcgtagccttctgagcatgctggtcgaagtgcacaagggtgtccacggctttgtgaaggataaaacaggaaagccaatcagtaaagcggttattgtgctcaacgaaggaataaaggtgcagactaaagaaggcggttacttccatgtcttattggcgcccggtgtgcacaatatcattgctatcgcggacggttatcaacaacagcatagccaggttttcgtgcatcacgacgcagcttcctccgtggtgatcgtctttgatacagacaataggattttcgggctccccagagagctagttgttaccgtctctggagctaccatgtcggcactgatcttgaccgcctgcattatctggtgtatttgctctatcaagtcaaacaggcacaaggacggctttcaccggctcaggcaacatcacgatgagtacgaggacgaaattaggatgatgtcaaccggatccaaaaagtccctgctgagtcatgagtttcaggacgagacagacaccgaagaggagaccttgtacagtagcaaacactag

SEQ ID NO: 181652 - DNA, 1149 bp, Artificial Sequence
  Description of Artificial Sequence: Synthetic coding sequence
atgcggcggcggcggcggctgcagcaggaggacggcatcagcttcgaatatcaccgataccctgagttgcgggaggcattggtttccgtctggttgcagtgcaccgctatctcaagaatctacactgtgggccgcagctttgaggggcgcgagctgcttgtaatcgaactgtccgacaatcccggcgtgcacgagcctggcgaacctgagtttaagtacatcggcaacatgcatggaaatgaagccgtgggtcgtgagttactgatttttcttgcccagtatctctgtaatgagtaccaaaaaggaaacgaaaccatcgtgaacctgatacattccactagaatacacattatgccctccctgaaccccgacggattcgagaaggccgcttctcagcccggcgagttgaaggattggtttgtggggaggtcaaatgcccaggggattgatttgaacagaaatttccccgatctcgaccggatagtatatgtcaatgagaaggaaggggggccgaataatcatctgctgaaaaatatgaagaaaatcgtggaccagaacactaaactggcgcccgaaacaaaggcggttattcattggataatggatatcccttttgtgctgagtgcgaacctgcacgggggagacctcgtggctaactacccatacgacgagactcgtagcggatccgctcacgaatattcctcatctcctgacgacgctatcttccaatcactagctagagcctacagttcgtttaaccctgccatgtcagacccaaataggcccccctgcagaaagaatgacgacgactcaagctttgtagacggcaccaccaacgggggcgcctggtacagcgtccctggaggcatgcaggattttaattatctgtcctctaattgtttcgagattaccgtagaactgagctgtgaaaagttcccccctgaagaaacactgaaaacgtactgggaggacaacaaaaactctctcatatcttacctcgaacagatccatagaggggtgaaagggtttgtaagggaccttcaggggaaccccatcgctaatgcgactatttcagtcgaaggtatcgaccatgatgtaacatctgccaaggacggtgactattggcggctgcttacctggaagctttag

SEQ ID NO: 181653 - DNA, 1431 bp, Artificial Sequence
  Description of Artificial Sequence: Synthetic coding sequence
atggccggccggggcggcagcgccctgctggccctgtgcggcgcccttgccgcatgcggatggttgttgggggccgaagcccaggagccaggagcccctgctgctggtatgagaaggcggcggcgtttacagcaagaggatggaattagttttgaataccaccgatatccagaactacgtgaagctttggtctccgtatggctgcaatgtacggccattagtcgaatatacacagtcggtcggtctttcgaggggcgggagcttttagtgatcgagctgagcgacaatccaggtgtgcacgagcccggggagccagaatttaagtacatcgggaatatgcacggcaatgaggccgtcggtagagagctgctgatttttctggcccagtacctttgcaatgagtatcagaaaggcaatgaaaccattgtcaatctcattcactccacccggatacacatcatgccaagcctgaaccctgacggtttcgaaaaggccgcctctcaaccaggcgaactgaaagattggtttgtggggcggtccaatgcacaagggatcgatctgaatcgcaatttccctgatctggacagaatcgtatatgtgaatgagaaggagggtggaccaaataatcatttactgaaaaatatgaaaaagatcgtcgaccagaacaccaaactggcacccgagactaaagcagtcatacactggatcatggatatccctttcgtgctgagcgccaacctccatggaggcgatctcgtggcaaactacccatacgatgagacgagatctggatccgctcatgagtacagcagctcaccagatgacgccatatttcaaagtctggctcgggcctattcctccttcaaccctgcaatgagcgaccccaataggccgccttgcaggaagaacgacgatgactcaagctttgtcgacgggaccaccaacggcggcgcctggtacagcgtgcctggcggcatgcaggattttaattatttgtcctccaattgctttgagatcacagtggagctctcatgcgagaagtttccccccgaagagaccctgaagacctactgggaggataacaagaatagcctgatcagttatctggaacagatccaccgaggagtcaagggtttcgtacgcgacctccagggcaaccccatagccaacgccaccatcagcgttgaaggcattgaccatgatgtcactagtgccaaggacggtgactattggaggctactgattccaggtaactacaaattgacagctagcgcaccagggtatctggcaataactaaaaaggtagccgtcccttacagcccggccgccggtgtcgactttgaattagagagcttctccgagagaaaggaggaggaaaaagaggagctgatggaatggtggaagatgatgagtgagactttgaatttttag

SEQ ID NO: 181654 - DNA, 1332 bp, Artificial Sequence
  Description of Artificial Sequence: Synthetic coding sequence
atggacttcccctgcctgtggctgggcctgctgctgcccctggtggcggctctggatttcaattatcatagacaggaagggatggaggccttcctgaaaactgttgcacaaaattattcatccgtgactcacctgcatagcatcggcaagtccgtcaaaggccgtaatctgtgggtgttggttgtgggtcggtttccaaaagaacatcggattgggatcccagagtttaagtacgtcgcgaacatgcatggcgatgagaccgtgggaagagaactcttattgcacctaattgattaccttgtcacatcagatggcaaggaccctgaaatcacaaacctcattaactccacccgcatacatatcatgccgtccatgaatcccgacggcttcgaagctgtcaaaaaaccagattgctactactctatcgggagagaaaattacaaccagtatgacctcaaccgtaacttccccgacgccttcgagtacaataatgtcagtaggcagcctgagacagtagccgtaatgaaatggcttaaaacagaaaccttcgtgctatcagccaacctacacggcggggcgctggtcgcttcctacccattcgacaatggcgtgcaagccactggagccctctattccaggtctttaacacccgacgacgatgtctttcagtacctggcccatacatacgccagcagaaaccctaatatgaagaagggcgatgaatgtaagaacaaaatgaactttcctaatggcgtaaccaacgggtactcatggtaccctctgcagggtggaatgcaggactataattacatttgggcccagtgttttgagattactctcgaactctcctgttgcaagtatccgcgcgaagaaaaactgccctcgttttggaacaataataaggcttcactcatcgagtatataaagcaggtgcatcttggtgtcaagggccaggtattcgaccagaatggcaatccactcccaaacgttatcgtggaggtgcaggatcgcaagcacatttgcccataccgcacaaacaagtatggtgaatactacctgctgctgttacccggttcatacataattaacgtaactgtcccgggacacgatcctcacattaccaaagttatcattcccgagaaaagccagaacttctcagccctgaagaaagatatcctgttgccattccaaggccagttggactccatcccagtgtccaacccctcgtgcccgatgatccctctgtatcgcaatttacccgatcacagtgccgcaacaaagccttcccttttcctgttcctggtgagcctcttgcatatattttttaaatag

SEQ ID NO: 181655 - DNA, 1332 bp, Artificial Sequence
  Description of Artificial Sequence: Synthetic coding sequence
atggacttcccctgcctgtggctgggcctgctgctgcccctggtggcggctctggattttaactatcacagacaagaaggcatggaagcctttttgaaaactgttgcccagaactattccagcgtgacacatctgcacagtatcggtaaaagcgtcaagggcaggaacctctgggtgctggtcgttggccgcttcccaaaggaacatcggatcggcatcccagagttcaaatacgttgcaaacatgcatggtgacgaaacggtcggccgcgaattactgctccacctcatcgactacctggttacctcagacggcaaggatccagaaataactaacctaatcaactctacccggatccatatcatgccaagcatgaatccagacggcttcgaggctgtgaaaaagcccgattgttactactcaattgggcgtgagaattataaccagtacgacttaaaccgcaactttccggatgccttcgagtacaacaatgtttctcgccagcccgaaacagtagccgtcatgaaatggctcaagaccgagacatttgttctgagtgctaatttgcatggtggcgccttggtcgcctcttatccattcgacaacggggtgcaggccactggggcactttacagccgctcactgaccccagacgacgatgtgttccagtaccttgctcacacatacgccagtcgtaacccgaatatgaaaaaaggagatgagtgtaaaaacaagatgaacttccccaatggcgtgacaaacgggtactcttggtacccactgcagggcggaatgcaggattacaattacatctgggcgcagtgctttgagattacactggagctaagttgttgcaaatatccacgcgaggaaaagctaccctccttctggaacaataataaggcctctctcatcgagtatataaagcaggtgcacctgggtgtcaagggccaagtgtttgatcagaacggcaatccgctccccaacgtgatcgtggaagtgcaggatagaaaacatatttgcccatatcggacaaacaaatatggagaatactaccttctgttgctgcctgggtcctacattattaatgtgacggtgcctggtcatgacccacacattaccaaggtcatcatccctgaaaagtcgcagaatttcagtgcactgaagaaggacattctcctacccttccaggggcagctggacagtattccagtaagtaaccctagctgcccaatgatacccctgtaccgcaatcttccagaccattccgcggccacaaaaccatctctgtttctgtttctagtcagtttactacatatcttctttaaatag

SEQ ID NO: 181656 - DNA, 1332 bp, Artificial Sequence
  Description of Artificial Sequence: Synthetic coding sequence
atggacttcccctgcctgtggctgggcctgctgctgcccctggtggccgctctggactttaattaccacagacaggaagggatggaagcgtttctcaagacggtagcacagaattactccagcgtgacccacctccattccataggcaaatccgttaagggaagaaatctatgggttctggtggttggcagattcccgaaggaacatagaataggaattcccgaattcaagtatgtggctaacatgcatggagacgaaactgtgggtagggaattactactgcatctgatcgactatctggtaaccagtgacgggaaagatccggagatcactaacctcataaatagcacaaggatccacatcatgccatccatgaacccagacggattcgaagctgtgaagaagcccgactgctactactccatcggtcgcgaaaactataaccagtacgacctcaatcgaaacttccctgatgccttcgagtataacaacgtgtcacggcagccggagaccgtagccgttatgaaatggctgaagactgaaacgtttgtcctgagcgccaatcttcacggcggtgctctcgtggcttcctacccctttgacaacggcgtgcaagcaacgggcgccctctatagcagatcactcacacctgatgatgatgtttttcagtatttggctcacacatatgcttcaagaaatccaaatatgaaaaagggcgacgaatgcaagaacaaaatgaactttccaaacggggtcacaaacgggtactcatggtatcctttacaggggggcatgcaggattataattacatatgggcgcagtgctttgaaatcactctggaactttcctgctgcaagtaccctagagaggaaaaactgccctccttctggaacaacaataaagcctcccttattgagtatatcaagcaggttcatctcggagttaagggccaggtgtttgatcagaacgggaatcctcttccgaatgtgatcgtagaagttcaggatcggaagcacatctgtccctatagaacaaacaaatacggagagtattatctcctactcctccccggatcctatattataaatgttaccgtgccgggacacgatccacatatcaccaaagttatcatcccggagaaatcacagaatttttccgctctcaagaaagacattctgctcccttttcaggggcagctggatagtatcccggtgtccaatccctcttgtcctatgattcctctctatcggaatctgcccgatcacagtgccgctacaaaaccctcactgtttttattcctggtgtctctcctgcatattttcttcaaatag

SEQ ID NO: 181657 - DNA, 411 bp, Artificial Sequence
  Description of Artificial Sequence: Synthetic coding sequence
atggacttcccctgcctgtggctgggcctgctgctgcccctggtggccgccctcgattttaattaccatagacaagagggaatggaggctttcctgaaaaccgtggcgcagaactatagcagcgtgacccatctgcattccatcgggaagagtgtgaagggaagaaacttatgggtccttgtcgtggggagattccccaaagagcaccgcattgggattccggagtttaagtatgttgccaacatgcacggtgacgagactgtgggtagggagttactgctgcacttgatagattatctggtcactagcgatggtaaagatccagagatcacaaatctgattaatagcaccagaatccacatcatgccaagtatgaatccagacggattcgaggccgtcaaaaagccctag

SEQ ID NO: 181658 - DNA, 750 bp, Artificial Sequence
  Description of Artificial Sequence: Synthetic coding sequence
atggacttcccctgcctgtggctgggcctgctgctgcccctggtggccgccctggacttcaattaccaccggcaggagggtatggaggcatttctaaagacggtagcccagaattattcctccgtgactcacctgcattctattggaaagtccgtcaaaggccgcaacttgtgggtcctagtggtgggcaggttcccaaaggaacaccgaattggcatccctgaatttaagtatgtagctaacatgcacggcgatgaaaccgtggggagggaattgctgctgcatttgatagactacctggttacgtctgacggcaaggatcccgagattacaaatctgatcaacagcacccgcattcacattatgccatcaatgaaccctgacggcttcgaagctgtgaaaaagcccgattgctactattcaatcgggcgcgagaactataatcaatacgaccttaaccgtaacttccccgatgcttttgaatacaacaacgtttctcgccagccggaaacggttgccgttatgaaatggcttaaaacagagaccttcgtactgagtgccaatcttcacggaggcgcgctagtggcctcctaccccttcgacaatggggtgcaggctactggtgctttatactctcggagcttgacccccgatgacgacgtgtttcagtacttggcccatacttacgcaagtaggaatcccaacatgaagaagggcgacgagtgtaagaacaaaatgaatttcccatag

SEQ ID NO: 181659 - DNA, 1332 bp, Artificial Sequence
  Description of Artificial Sequence: Synthetic coding sequence
atggacttcccctgcctgtggctgggcctgctgctgcccctggtggccgccttagactttaactatcaccgccaggaaggaatggaggcttttctcaagaccgtggcccagaactactcgtctgtaacacatcttcatagtataggaaagtctgtgaaaggccgtaacctttgggtgctcgtggttggaaggttccccaaagaacatcgaattggcatcccagaattcaagtacgtggccaacatgcacggcgatgaaacagttgggcgtgaactgctccttcacttaatcgattatctggtgacttccgacgggaaggacccagagatcaccaacctgatcaattccacgcgcatccacatcatgcctagcatgaaccctgacggttttgaggctgtgaagaagccagattgttactacagtatcggacgggagaactacaaccaatatgatctgaatcgcaattttcctgatgcgttcgaatataataacgtgtccagacaacctgaaactgtggctgtcatgaagtggctgaaaaccgagacctttgtgctttcggcaaatctgcacggaggagccctcgtggcaagctacccctttgataacggagtgcaggccacaggcgccctttacagcagatcccttacaccagacgatgatgttttccagtacctggcccacacatacgcatcccggaacccaaatatgaaaaagggggacgaatgtaaaaacaagatgaacttcccaaacggggtgacaaatgggtatagctggtatccactccagggcggcatgcaggactacaattatatctgggcgcagtgcttcgaaatcacacttgagttatcttgctgtaagtacccgagggaggagaagcttcccagcttctggaataacaacaaggcgtccctgatcgagtatattaagcaagtgcacctgggggttaagggtcaggtctttgatcaaaatgggaatcctctgccaaacgtcatcgtggaagtgcaagatcggaaacacatttgcccttacagaaccaataagtacggcgagtattatctgctcctgctgccggggagctatatcatcaacgtgacagtaccaggacatgaccctcacatcactaaggtcatcatccctgaaaaatctcagaacttctcagccctcaaaaaggatatcctgctgccctttcaggggcagctagattctataccagtgtccaacccttcctgtcccatgattccactgtaccgaaacctacctgaccactctgcagccactaagccatcgttgttcttgtttctggtcagtctacttcatattttttttaaatag

SEQ ID NO: 181660 - DNA, 1377 bp, Artificial Sequence
  Description of Artificial Sequence: Synthetic coding sequence
atgagcgacctgctgagcgtgttcctgcacctgctgctgctgttcaagttagtggccccggtaacattcagacatcacaggtacgatgacttagtacgtacactgtataaagtgcagaacgaatgtcctggcataacacgggtctatagcatcggtagatctgtggagggccgccacctctatgtattggagttttccgatcacccaggtatacacgagccccttgaacctgaggtaaagtatgtcgggaacatgcatggcaacgaggcgctaggacgggagctgatgctgcagcttagcgagttcttgtgcgaagagttcagaaaccgaaaccagcgcatcgtgcaactgatccaggacactcgaatccacatcctgcccagcatgaatccagacggttacgaggtggctgccgctcagggccccaataagccaggatacctagtgggtaggaacaacgcaaatggcgtcgatctgaatcgcaatttcccagatttgaatacttacatatactataacgaaaagtatgggggcccaaatcaccacctgccacttccggacaactggaagtctcaggtagagcccgaaacccgcgctgtcattcgctggatgcactcctttaatttcgtgctgtccgcgaaccttcacggcggcgcagttgtggcaaattacccctatgataaaagtttcgagcacagggtacgaggagtacgtcggacggccagcacacccactccggacgataagcttttccagaagctggctaaagtgtacagctacgcccatggctggatgttccaaggttggaactgtggtgactattttcctgatggaatcactaatggggcctcctggtactctctgtccaagggcatgcaggacttcaactacctgcacaccaattgcttcgagatcactcttgagctgagctgtgacaaatttccaccagaagaagagctgcagcgggaatggttaggtaacagagaggccctcattcagttcctggagcaggtgcaccaggggatcaaaggtatggttctggacgaaaactacaacaacctcgctaatgccgtcattagtgtgagcggaatcaaccacgatgtcactagcggggatcacggggactacttccggctgttgctccccggaatatacaccgtgtccgccacagcgcccggctacgatccagaaactgtgaccgtaacagtcggacccgctgagcccaccctggtgaatttccacctcaaacggagtatacctcaggtgagccctgtgagacgggccccttcccggcgtcacggagtcagggccaaagttcagccacaggcccggaagaaagagatggagatgcgtcagctgcagcgcggccctgcttag

SEQ ID NO: 181661 - DNA, 615 bp, Artificial Sequence
  Description of Artificial Sequence: Synthetic coding sequence
atgcacagcttcaacttcgtgctgagcgccaacctgcacggcggcgccgtggtcgccaattacccttacgataaatcctttgaacatcgtgttagaggggtgaggcgcacagcctccacgcctacccctgacgataaactgtttcaaaagctggccaaagtgtactcctatgctcatggatggatgttccaaggatggaactgcggtgattactttcctgatggtatcaccaatggcgcatcctggtattcccttagtaaaggtatgcaggacttcaattacctgcataccaactgttttgagataaccctggagctatcttgcgataagtttccccccgaggaggaacttcagagagaatggcttggcaaccgtgaggcattgatccagtttctggaacaggtgcatcagggtataaagggcatggttctagacgaaaactacaacaatctggccaatgctgttatatcagtgtccggcatcaatcacgatgtcaccagtggcgatcacggagattatttccgcttactgctcccaggcatttataccgtaagtgccaccgctcccggttacgaccccgagacagtaactgtgaccgtgggacctgccgaatag

SEQ ID NO: 181662 - DNA, 1638 bp, Artificial Sequence
  Description of Artificial Sequence: Synthetic coding sequence
atgctgcccggcgcctggctgctgtggaccagcctgctgctgctggcccgtcccgctcagccgtgccccatgggatgtgattgctttgtgcaggaagtcttctgttctgatgaagagcttgcgactgtgcccttggacatcccgccgtatacaaaaaacatcatcttcgtcgagacttcctttaccaccctcgaaaccagagctttcggctctaatcccaacctgaccaaggtggtgttcctgaatacacagctctgtcagttcagaccagatgcctttggtggcctgccaagacttgaggacctagaggtgacagggagttccttcctcaacttgtccacaaacatctttagcaacctcacgtcattgggtaagctgaccttgaattttaatatgctcgaggcgctacccgagggtctcttccagcatctcgccgctctggagagcctgcacctacaagggaatcagttgcaggccctgcctagacgcctctttcagcctctaacacatctgaagacattgaacctagctcagaacctcttggcccagctccctgaggaattattccacccattaacatccctacaaaccctgaaactgtccaataacgctttgtcggggctgccccagggtgtgttcgggaagttgggttcactgcaagaactgtttctggatagcaataacatcagcgagttgcccccccaggtcttctctcagcttttttgcttagagcgcctgtggctacagagaaacgccatcactcacttaccactgagcattttcgcaagcctcggaaatctgacattcttgagcctgcagtggaatatgctgcgagttctccccgctggattattcgctcataccccttgtcttgtgggactctccctcacccacaatcaattagaaactgttgccgaaggcacatttgcccatttgtccaacctgcgatccctgatgctgtcttacaacgccatcacacatcttccagccggcatttttagggatctggaggaattagtgaagttgtatctgggctcaaataacctcaccgcactccatccggccctcttccagaatctgagcaagttggagctgctgtctctcagcaagaatcagctgacaacgttacccgaaggcatatttgatactaactacaatttgtttaatctcgccttgcatgggaacccttggcagtgcgattgccacctggcgtatctgttcaactggttgcaacagtacaccgacagactgctgaacattcagacctattgcgcaggtccagcgtatttaaagggtcaagttgtaccagcattgaacgagaagcaactagtgtgtcctgtgaccagggatcatctcggattccaggtgacctggcctgacgagagcaaagccggtggctcttgggatttggccgtgcaagaacgcgcagcccggtcacagtgcacgtatagcaaccccgaggggacggtcgtgcttgcctgcgaccaggcacaatgtagatggctgaacgtgcagttgtccccacaacagggaagtctgggactgcagtacaatgccagccaggagtgggatctccgttccagttgcgggagcctgcggttaacggtttcaattgaggcccgagccgcaggcccctag

SEQ ID NO: 181663 - DNA, 1638 bp, Artificial Sequence
  Description of Artificial Sequence: Synthetic coding sequence
atgctgcccggcgcctggctgctgtggaccagcctgctgctgctggctcgccccgctcaaccatgcccaatggggtgtgactgtttcgtgcaggaggtgttttgttccgacgaggaattggccaccgttccactggacattcccccctatacgaagaatatcatcttcgtggagaccagttttaccaccctcgagactagagcttttggctctaatcccaatctgaccaaggtagtgttcctaaatacgcaactgtgccaattccggccagatgctttcggcggattacctaggttagaagatctggaagttaccggatcctcgttcttaaatctctctaccaatattttcagcaatctgacctctctggggaagctgactctgaactttaacatgctcgaagctttgccggaaggcctgtttcagcacctagctgctcttgagtccttgcacctccaggggaatcaactgcaggccctgcccagacgtctgttccaaccgctcacccatcttaagaccctgaaccttgctcagaatctgctggcccagttgcctgaagaactgtttcatcctctgaccagtctccagaccctgaagttgagtaataatgccctgtccggactgcctcagggcgttttcggtaagctaggctcacttcaagagctgtttctggattcaaataatatctctgaacttcccccgcaggtttttagtcaactgttctgcttagagcgcttgtggctgcaacgaaacgctattacacacctgccactttcgatctttgctagcctcggcaacttgacctttcttagcttgcagtggaatatgctgcgcgtgctgcccgcaggattgttcgcccatactccttgcttagtcggtctgtctctgacgcacaatcaattggaaacagtagcagagggcaccttcgcacacctgagtaacttaagaagtttgatgttgagttacaacgctatcacacaccttcctgcagggatctttagagatttggaagagctggtcaagctgtatttgggctcaaataatctcacagctctccacccagctctgtttcagaatttaagtaaactcgagctcctgtctctgtccaagaaccagctgacgactttacccgaaggcatctttgatactaactacaacctgttcaatttagcactgcacggtaatccatggcagtgcgattgtcatttggcctacctgtttaattggttgcagcagtacacagaccgactgttgaatattcaaacgtattgcgcaggccctgcatatctgaaaggacaggtggtacctgccttgaacgaaaagcagctggtgtgtccggtaacgcgcgatcacctgggttttcaggttacgtggcccgacgagagtaaagctggtgggtcttgggatctcgcagtgcaagaaagagcagccaggtcccagtgcacgtatagcaatcctgaaggaactgtggtcctggcatgcgatcaggcccagtgcagatggctgaacgtgcagctcagtccccagcagggcagccttggcctgcaatataacgcctcacaagagtgggatctgcgatcctcctgcgggtcccttaggctaacggtctcaattgaagcccgagccgctggtccttag

SEQ ID NO: 181664 - DNA, 1431 bp, Artificial Sequence
  Description of Artificial Sequence: Synthetic coding sequence
atggtgggcgccatgtggaaggtgatcgtgagcctggtgctgctgatgcccgggccatgtgatggcctgtttaggagtctataccgctcagtgtccatgcctccaaaaggcgactccggccaaccccttttcttgactccctacattgaggcaggcaaaatacagaaaggtcgggagctctcattggtggggccattccccggccttaatatgaaatcatatgcagggttcttaactgtgaataaaacctacaatagcaatctctttttctggttcttccctgcccagattcagccagaggacgcccccgtcgtgctctggttacaggggggccccgggggttcttccatgtttggtttgtttgtggagcacggcccctatgtcgttactagtaacatgacactgagggatcgcgattttccttggactaccaccctttccatgctgtacattgacaacccggtgggcacaggatttagttttactgacgatacacatggctatgcagtgaacgaggatgacgtggccagggacttgtattctgcactcattcagttctttcagatatttcctgaatacaagaataacgatttctatgttaccggcgagagctacgcagggaaatacgttcctgccattgcacacctgattcattctctcaaccctgtccgcgaggtgaagattaacttgaatgggatagccatcggcgacggttactccgacccagaatcaatcataggaggatatgcggaattcctttaccagattgggctgttggacgagaagcagaaaaagtacttccagaaacagtgtcatgaatgtattgaacacatcaggaagcaaaattggttcgaggcttttgagatattagacaagttgctcgacggggatctgacttcagaccccagctactttcagaacgtaactgggtgcagtaattattacaattttttgcgatgtaccgagccagaagaccagctgtattacgtgaaatttctctcattacctgaagtcaggcaagctattcacgtggggaaccaaacattcaatgacggaactatagtcgagaagtacctacgtgaggataccgtgcagtcagtgaagccctggttgacagaaattatgaacaactacaaagtgctcatatacaacggtcagttagatatcatagtggccgccgcactgacagagaggtccctgatggggatggattggaagggcagccaggagtataagaaggccgagaaaaaggtgtggaaaatcttcaaaagcgattctgaggtggctggctatattcggcaggcaggagacttccaccaggtgatcatccgcgggggagggcatatccttccttatgatcagcctctacgggcttttgacatgatcaaccgcttcatctacggtaaagggtgggatccctacgttgggtag

SEQ ID NO: 181665 - DNA, 1431 bp, Artificial Sequence
  Description of Artificial Sequence: Synthetic coding sequence
atggtgggcgccatgtggaaggtgatcgtgagcctggtgctgctgatgcctggcccatgcgacgggctgttccgctctctgtaccgaagcgtgtccatgcctcccaagggggacagtggccagcccctgttcctcacgccatacattgaggccggtaaaatccagaaggggagagagctgtcgctcgtaggccctttccccggattgaatatgaagagctacgcggggttcctaaccgtgaacaaaacctataactccaatctcttcttctggtttttcccggcccagattcagcctgaggacgctccagtggtgctctggctgcagggtgggcccggcggttcatcaatgttcggattgttcgtagaacatggaccatatgtcgtgaccagtaacatgaccctgcgcgatcgggactttccctggacgacgacactctctatgctgtacatcgacaaccctgtggggacaggatttagtttcaccgatgatactcatggatatgcggtcaatgaagatgatgttgcgcgggacctgtacagtgcactcattcagttttttcagattttcccagagtataaaaataacgacttctatgtcacaggagaatcttacgccggtaagtacgtgcccgccatagcacaccttatccactcactgaatccagtgcgcgaggttaaaatcaacctgaatggaatcgctataggggacggatacagcgatcccgaatctattatcgggggctatgctgaattcctctatcagattggcctcctagatgaaaaacagaagaagtactttcagaagcagtgtcatgaatgtatcgaacacattcggaaacagaactggtttgaggcttttgaaatacttgacaaactcttagatggtgacctgacctctgatcctagttacttccagaacgtgaccggttgctccaattattacaacttcttgagatgcacagaacctgaggaccaattatattacgttaagttcctcagcctgcccgaagtcaggcaggcaatccacgttgggaaccaaacttttaatgacggaacaattgtggagaagtatttgagagaggacaccgtgcagtccgtaaagccttggctgactgaaattatgaataattataaagtactgatctacaatggtcagctggacatcattgttgctgcggctctgaccgagcggagcctgatggggatggattggaaaggtagccaggagtacaaaaaggccgaaaaaaaagtctggaagatctttaagtcagactcggaagtcgccggctacatccgacaggcgggggacttccatcaagtcataatccgtggtggggggcatatcctcccatacgaccagcctttgagagcgttcgatatgattaatagatttatctatggcaagggttgggatccctacgttggatag

SEQ ID NO: 181666 - DNA, 1431 bp, Artificial Sequence
  Description of Artificial Sequence: Synthetic coding sequence
atggtgggcgccatgtggaaggtgatcgtgagcctggtgctgctgatgcccggtccctgcgatggcctcttccggtctctttatagaagtgtctcgatgccacccaaaggagacagcgggcagccactgtttcttactccatatattgaggccggtaagatccagaagggacgggagctttctctggtgggacctttccccggcctcaatatgaagagctacgcaggtttcctgacggtcaataagacttataactccaatctgtttttttggtttttccctgcgcaaatccagcctgaagatgccccagtagtactatggttgcaaggaggtccagggggttcgtcgatgtttggcctgtttgtggaacacggtccctatgttgttacctcaaatatgactctgagagatagggacttcccatggactaccaccctttctatgctttacatagacaacccagtgggtactggatttagctttacggacgatacgcatggctacgcagtcaacgaggatgacgtggcacgagatctgtattccgccctcattcagttctttcaaattttcccagaatataagaataatgatttctacgtgaccggcgagagctacgctggcaaatacgtacccgctatagcacatcttatacactccctgaacccggtgcgcgaggtcaaaataaacctcaatgggatcgcaattggagatggctacagcgacccagagtccataatcgggggatatgccgagttcctctaccagatcggcttgttagatgagaaacaaaagaagtacttccagaagcagtgccatgagtgcatagagcacattcgtaaacagaactggtttgaagctttcgagatactggacaaactgctggatggcgacctgacctctgatcctagctattttcaaaatgtgaccgggtgctcgaattactacaattttctgagatgtaccgagcccgaagaccagctgtattacgtaaagtttctgagtctgcccgaggtgagacaggctatacatgtgggaaatcagactttcaatgatggcacaatcgtcgagaagtatcttcgcgaagacactgtgcagagtgtaaaaccttggctaactgagatcatgaacaactacaaagtgctgatttataatggccagctggatatcatcgtggcggccgccttgactgagaggtccctcatgggcatggactggaagggttcccaagagtataaaaaagcagaaaaaaaggtctggaaaatctttaaatctgattcagaggtggcggggtacatccgacaggcgggcgattttcatcaggtcataattagaggaggggggcatattctgccctacgatcagcctctcagagcatttgatatgatcaacaggttcatctatggcaaaggatgggacccctatgtgggctag

SEQ ID NO: 181667 - DNA, 21 bp, Artificial Sequence
  Description of Artificial Sequence: Synthetic coding sequence
atggtgggcgccatgtggtag

SEQ ID NO: 181668 - DNA, 159 bp, Artificial Sequence
  Description of Artificial Sequence: Synthetic coding sequence
atggtgggcgccatgtggaaggtgatcgtgagcctggtgctgctgatgcccgggccctgcgacgggctctttagatctctataccgaagcgtatccatgccccccaaaggcgacagtggccagcccctgtttctgaccccttatatcgaagctggatag

SEQ ID NO: 181669 - DNA, 132 bp, Artificial Sequence
  Description of Artificial Sequence: Synthetic coding sequence
atggtgggcgccatgtggaaggtgatcgtgagcctggtgctgctgatgcccggcccctgtgacgggttattccgctcgctctacagatccgtgtccatgccccccaaaggagactcaggacagcctctctag

SEQ ID NO: 181670 - DNA, 699 bp, Artificial Sequence
  Description of Artificial Sequence: Synthetic coding sequence
atgttcggcctgttcgtggagcacggcccctacgtggtgaccagcaacatgacattgagggatagggacttcccatggactaccaccctgagcatgctgtacatcgacaatccagtgggtacaggcttctcctttacggatgacacacacggctacgctgtgaacgaggacgatgtagctagggatttgtacagtgcgctcatacagttttttcagattttccctgaatataagaataatgatttttacgtgactggcgaatcatatgcaggcaaatacgtgcctgcaatcgctcacttgatacatagcttaaaccctgtccgtgaggttaagataaacttgaacggaatcgccattggggacggttactcagacccagagagtattataggagggtatgcagagtttctgtaccaaatcggcctgttggacgagaaacaaaaaaagtactttcagaaacaatgccacgaatgcattgagcacattaggaagcagaattggttcgaggccttcgagatactcgacaaactgttagatggagatctcaccagtgacccctcctactttcagaatgtgactggctgcagtaattattacaactttctgcggtgtactgagccagaagatcagttgtattatgtgaagttcctaagcttgccagaagtcagacaggcacccaggggagagtctgacttttag

SEQ ID NO: 181671 - DNA, 1581 bp, Artificial Sequence
  Description of Artificial Sequence: Synthetic coding sequence
atgggccacctgagcgcccccctgcaccgggtgcgggtgccctggcagggactgctccttacggcgagcctgttgacattctggaatccacccactactgctcagcttaccaccgagagtatgcccttcaatgtcgccgagggcaaggaggtcctgcttctggtgcacaacctgcctcagcagctcttcggatactcttggtataaaggcgagcgcgtggatggaaataggcaaattgttggctacgcgattggaacccagcaggccacccccggccctgccaactctggccgcgaaaccatctatccaaacgccagcctcctgatccagaatgtaacacaaaacgatactgggttttataccctccaggtgatcaaatccgacttggtcaacgaggaggcaaccgggcagttccacgtgtatccagaactacctaaaccttcaataagctccaataactcaaaccccgtcgaggataaagatgccgttgccttcacatgtgagcctgagacccaggatactacttatctgtggtggatcaacaaccagtccctgcctgtgtccccccggctgcagctgagcaacggcaatcggactctgactctgctgtcagtgacccggaatgatacaggcccctacgagtgtgagattcagaatccggtgagcgctaaccgctccgaccctgtgacgctaaatgtgacatatggcccagatactccgaccatctcaccaagtgatacctactatcgtccgggcgcaaatctcagtttgagttgctacgccgcatcgaacccccctgcacagtattcttggctgattaatggtacattccagcagagtacacaagagctgttcattcctaatattactgtcaacaactcaggatcatacacatgccatgcaaacaatagcgtcacaggatgcaaccgtacgaccgttaaaacaattatcgtaactgagctcagccccgtggtagctaagccccagattaaggcctctaaaaccaccgtcaccggagataaggattctgtgaatctgacatgcagtaccaacgacaccggtatctccataaggtggttctttaaaaatcagagtcttccgagttcagagaggatgaaactgagtcagggtaacaccaccctgagtataaatccggtcaagcgggaggatgctggaacctactggtgtgaagtatttaaccccatcagcaagaaccagtcggacccaatcatgctgaacgtaaactataatgctctgccacaggagaatggactctctcccggcgctattgcaggtattgtgattggagttgtcgctctggtggctcttatagctgtagccctcgcatgcttcctgcacttcgggaagactgggcgggcatctgaccaacgggacctaacagaacacaaaccttctgtgtcaaatcatactcaggatcactcaaatgacccacccaacaagatgaacgaagtcacttactctacactgaacttcgaggcccagcagcccacgcagcctacaagcgcttctccatcattgactgccactgagatcatctactccgaggtgaagaaacagtag

SEQ ID NO: 181672 - DNA, 1080 bp, Artificial Sequence
  Description of Artificial Sequence: Synthetic coding sequence
atgcccttcaacgtggccgagggcaaggaggtgctgctgctggtgcataatctgccccagcaactcttcggttacagttggtataagggagagcgagtggacggcaacagacagattgttgggtatgcaatcggaacccagcaagctacccccggaccagccaactccggtcgcgagacgatctaccctaatgcttccctgctcatccaaaatgttactcagaacgatacgggattctatacacttcaggtgatcaaatctgatctagtgaacgaggaggccaccggccaattccacgtatatcctgagctgccaaaaccttctataagcagcaataatagcaaccccgtggaggataaagacgcagttgcgttcacctgcgagcccgaaacgcaggatacaacatacctatggtggattaacaatcagtccctccctgtgtccccgaggcttcaactgtctaatgggaaccgaaccctaaccctgctatccgtgacaagaaatgatacaggcccgtatgaatgcgagatacagaaccctgttagtgcaaatagaagtgacccagtgaccctgaacgtaacgtatggtccggacacgcccactatttccccctctgatacatattatcggcccggcgctaacctgtctctaagctgttacgccgcctctaacccccccgctcagtactcttggctgattaatgggacattccagcagagtacccaggagctcttcattccaaacatcaccgtaaacaactctgggtcctacacctgccacgccaataattccgtcacaggttgcaaccggactaccgtgaaaactattatcgtgaccgagatggctttccaccatgtggctaaggctggcttgaagttgctatcatcatcaaaccccccggccagcacctcacagagcgctaagattaccgataatgcactgcctcaggaaaacggtctttcccccggcgcaattgcggggattgtaattggggtcgtggcactcgtggcgcttatcgcagtggccttggcttgtttcctgcacttcgggaagactggatcctcaggccccctccagtag

SEQ ID NO: 181673 - DNA, 1056 bp, Artificial Sequence
  Description of Artificial Sequence: Synthetic coding sequence
atgggccacctgagcgcccccctgcaccgggtgcgggtgccctggcagggactgttgctgaccgcatcactcttgactttttggaatccaccaaccactgcccagctgaccactgagtcgatgcctttcaatgtcgctgaggggaaggaggtccttctgctggtgcacaacttacctcagcaacttttcggctacagctggtataagggagagagggtcgatggcaaccgccagatcgtaggatacgctatcgggacacaacaggccacaccgggtcccgctaactctggacgcgaaactatttacccaaacgcttctctcctcatccagaatgtaactcaaaacgacaccgggttttataccctccaggtaattaagtcggatctcgtaaacgaggaggctaccggacagttccatgtttacccagaactcccaaaaccctccatttcttcaaacaactctaatcccgttgaggataaagacgccgtggcatttacttgtgagccggaaactcaagacactacgtacctgtggtggatcaacaaccaatccctcccagtctcgccaaggttacagctttctaatggaaataggacactcaccctgctgtccgttacaagaaatgataccgggccttatgaatgtgagatacagaaccccgtcagcgccaacaggtcagacccagtgacgttgaacgtcacctatggaccagatacaccaaccattagccccagtgatacttactacaggcccggtgcaaacctgtctttgagttgttacgctgccagcaatccacccgctcagtacagctggttaatcaatggaaccttccagcagtccacccaggagttatttatccctaacattacagtaaataattctgggtcatacacctgccacgccaataatagtgtgaccggatgcaaccggacaacagtcaagaccattattgtcacggagagccctgtgctgggcgaagatgaggccgtcccgggtcagcaccacccccagcacaagccatgtcaggaaggcgggtgttgggacgtgctagtgtag

SEQ ID NO: 181674 - DNA, 759 bp, Artificial Sequence
  Description of Artificial Sequence: Synthetic coding sequence
atgggccacctgagcgcccccctgcaccgggtgcgggtgccctggcagggattgcttctgacggccagtcttctgacattctggaaccctcccactacagcacaactgaccacagagtctatgcctttcaacgtcgctgaaggaaaagaagtgctgttactcgtccataacctgccacagcagctgtttgggtactcttggtacaagggggagagagttgacggcaatagacagattgtgggttatgctatcggcacgcagcaggcgacacccggacccgctaactcaggccgcgagacaatttaccctaacgccagcctgctcatccagaatgtcacccaaaatgataccggcttctacaccctccaggtaattaagtctgacttagtgaacgaggaagcaaccggacaattccatgtctaccataacgccttgcctcaagagaacggcttaagccctggcgctatagccggaatcgtgattggggtggttgcactggtggcccttatagccgtggcactggcttgctttcttcactttgggaagacggggagagcaagcgaccaaagagatctgacagagcataagccatccgtctcaaatcacacacaggaccactccaacgacccccctaacaagatgaatgaagttacatacagcaccctcaacttcgaggcacagcagccaacccagccaacgtcagcttcaccatccttgacagcaactgaaatcatatacagcgaggttaagaaacaatag

SEQ ID NO: 181675 - DNA, 1293 bp, Artificial Sequence
  Description of Artificial Sequence: Synthetic coding sequence
atgggccacctgagcgcccccctgcaccgggtgcgggtgccctggcagggtctgctgttaactgccagcctgcttactttctggaatccgcctactaccgctcagctgaccactgagtccatgccgttcaacgtcgccgagggaaaagaggtgttactgctggtccacaacttgccgcaacagctgtttggatatagctggtacaagggagagcgcgtggacggaaaccgtcagatagtggggtatgcgattggaacccagcaggccacaccgggcccagccaactctggcagagagactatttatcctaacgcctctctgttaattcaaaatgtcacccagaatgacactggattttatacgctgcaggtaatcaagtccgacttggtcaatgaagaagccaccgggcagttccatgtttatcccgagctcccaaagccaagtatatcatcaaataatagcaacccagttgaagacaaagatgcagtcgcttttacttgcgaaccagagacccaagataccacatacttatggtggattaacaatcagtcccttccagtgtcaccgcgcctgcagttaagcaacggaaataggacgttgactctgttaagtgttactaggaacgacaccgggccttacgagtgcgagatccagaatcccgtgagtgctaatcgatctgacccagtcaccttaaatgttacttacggcccagacacacctaccatatcgccctcagacacctattaccgcccaggcgccaatctcagtcttagctgctatgccgcaagcaatccaccagcgcaatactcctggcttataaacggtacattccagcagagcacccaggaactgttcatcccgaatattacagttaacaacagcggatcatatacttgtcatgccaacaactcggttaccggctgcaaccgaactacagttaagactatcatcgtaactgacaacgctctgccccaagaaaatggtctcagtcccggtgccatcgcgggcatcgtcatcggcgttgtggcactagttgctcttatcgcggtggcacttgcctgcttcctccactttgggaaaactggcagggccagcgatcagcgagacctcacagaacataaaccttctgtgagcaaccatacccaggatcattcaaacgatcccccaaacaaaatgaatgaggtgacttactcaacactcaatttcgaggcacagcagcccacccagcctacgtcagcctcaccctcactcacagccaccgaaattatctattcagaagtaaaaaagcagtag

SEQ ID NO: 181676 - DNA, 1386 bp, Artificial Sequence
  Description of Artificial Sequence: Synthetic coding sequence
atgggccacctgagcgcccccctgcaccgggtgcgggtgccctggcaggggctgttgctcaccgcgtcactccttaccttttggaacccccctacaactgcccagctaacaacagaatccatgccatttaatgtcgcagagggcaaggaagttctccttctagtgcacaatttgccccaacagctgttcggctacagctggtacaaaggggagcgcgttgacggcaacagacagatagtgggttatgccatcggaacccaacaggccacccctgggccagccaattctggcagagaaaccatctaccctaatgcgagtctgctgattcagaatgtgacccagaacgacacaggattctacaccctgcaagtgattaagagcgacttagttaacgaggaagccactggccagtttcacgtttatcctgagctgcctaaaccctccattagctccaacaacagtaacccggtcgaagataaagatgctgtggcttttacatgcgaaccagagacacaggacaccacatatctatggtggatcaacaatcagtcgctgcctgtaagtccaagactccagctgtccaacggaaacaggactctgaccctactcagtgtgacaaggaatgacacaggtccttacgaatgcgagatacagaatcctgtctctgcaaaccgctctgaccccgtgaccctcaacgtaacttatggccctgatacaccaactataagtccatcagatacttactacagacccggagcaaacctttccttaagctgttacgccgctagtaacccgcccgctcagtactcctggctgataaacggtacattccaacagtctacacaggaactttttatcccaaatattacagtaaataattccggcagttatacttgtcatgcaaataatagcgttacgggctgtaaccgaactaccgttaagaccatcattgtgacggagcgccagaatctgaccatgctgccacgcttagacagcaattcgtgggcacaggcaatattaccaagcgtcagccagtcagctgagatcactgataacgccctgcctcaggaaaatgggctttctccgggggcaattgcagggatagtcataggcgttgtagcccttgtcgccctcatagccgttgccctggcatgctttttgcactttggcaaaacaggcagagcctctgatcagagagacctcacagagcacaagccaagcgtgtctaatcacacgcaggaccattccaatgatccccctaataaaatgaacgaggtgacctattcgactctcaatttcgaagctcagcagcccacacagcctacgagtgctagcccgagcctgacagctactgaaataatctactcagaagtgaagaaacagtag

SEQ ID NO: 181677 - DNA, 1254 bp, Artificial Sequence
  Description of Artificial Sequence: Synthetic coding sequence
atgggccacctgagcgcccccctgcaccgggtgcgggtgccctggcaagggctactgctaacggcgtcattgcttaccttttggaaccctcccacgacagcccagttaactactgagtccatgccatttaacgtggccgagggcaaagaagtactgttactagtacacaacctgcctcagcaactttttggatactcatggtacaaaggtgaaagggttgatggcaaccgtcagatcgtcggctacgccataggtacacaacaggcaacccccgggcccgctaattctgggagagaaaccatttatcctaatgcttctttacttatccagaacgttacacagaacgacacgggcttttatacgctgcaagtgatcaagtctgaccttgtcaacgaagaggccacagggcagtttcatgtttaccccgagttgcccaagccttctatttccagcaacaacagtaaccctgtagaggacaaagacgctgtggcctttacttgtgagccagaaacacaggacacgacctatctgtggtggattaacaaccagagccttccggtatctccccggctgcagctatcaaatgggaatcgcacacttactttattgagtgtcactcgaaatgacacagggccatacgaatgcgaaatccaaaatcctgtgagcgctaataggtcagatccagtaaccctgaacgtcacctatggtccagatactcctaccatcagtccatctgatacttattacagaccgggcgccaatctgagtctgagttgttatgccgcgtccaacccccccgcccaatattcttggttgattaacggaacatttcaacaatccacgcaggaactgttcatcccaaacattacagttaataacagtggtagttatacatgtcacgccaataactccgtcactggatgcaataggacaacggttaagaccataattgtcaccgaattatctcccgtcgttgcgaagccacaaataaaggcatccaaaactactgttacgggagacaaagattcggtgaatcttacatgtagcaccaacgataccggaatctccatacgatggttctttaaaaaccagtcacttccaagctctgaacggatgaagctgagccaaggtaacacgaccttgtcgatcaacccagtgaagcgcgaggacgccggaacttattggtgcgaagtgttcaatcccataagtaagaaccagagcgaccctattatgttaaatgtgaattgcaagtag

SEQ ID NO: 181678 - DNA, 1437 bp, Artificial Sequence
  Description of Artificial Sequence: Synthetic coding sequence
atgcccttcaacgtggccgagggcaaggaggtgctgctgctggtgcacaacctgccacaacagctttttgggtatagttggtacaagggagagcgcgttgacggcaaccgtcagatcgtggggtacgcaatcggaacgcaacaggcaactccgggcccagccaacagcggccgggaaaccatctaccctaacgcaagcctccttatccagaacgtgacccaaaatgacacggggttttataccctgcaagtgattaagtctgacctagtaaatgaagaggccactgggcaatttcacgtatacccagaactgccaaagccgtcaatctctagcaacaactctaatcccgtcgaagacaaagacgcagtcgcgttcacttgtgagccagaaacacaggatacaacgtacctgtggtggattaataaccagagcttgcctgtgagcccacgcttacagctaagcaatggaaaccggaccttgactctgctgagtgttacgagaaacgacaccgggccatatgagtgtgagatccaaaaccccgtgtctgcaaaccggtcagacccggttaccctcaacgtgacatatggaccggacacccccacgatcagtccatccgacacatactaccgcccgggtgccaatctttccctgagttgctatgccgccagcaacccccctgctcagtatagctggctgattaatgggacgtttcagcagtcaacccaggagctttttattccaaacattaccgtgaacaacagcggcagctacacatgccatgcaaataattcagtcaccggctgcaatcgaactacagtcaagacaattattgtcaccgagctctccccagtggtcgccaagccccaaatcaaagcctccaagactactgtaacaggtgataaggatagcgtgaatttgacgtgttctactaatgatacaggaatttcaattcgctggttctttaagaatcagtcgctgccgagtagtgaacgaatgaaattgtcacagggtaatacaacattgtctatcaatcccgttaaacgcgaggatgctggcacatactggtgcgaggtctttaacccgatctctaagaatcaatccgaccccattatgctgaacgagatggcctttcaccatgtagcaaaagcggggttgaaattgctgtcgagctccaaccctcctgcatctacctcccagagcgccaaaataacagaacgacagaatttaactatgctgcccaggctggattcaaattcatgggcccaggcgatcttgccatccgtaagccagagcgcagagataaccgacaatgcattaccccaagaaaatggcttgtcccccggcgcaatcgcggggatcgtaatcggagtcgtggcacttgttgcccttatcgctgtagctctcgcatgcttcctgcactttggtaagaccgggtag

SEQ ID NO: 181679 - DNA, 966 bp, Artificial Sequence
  Description of Artificial Sequence: Synthetic coding sequence
atgggccacctgagcgcccccctgcaccgggtgcgggtgccctggcaaggcttgctccttacagccagcctcctcaccttctggaacccccctacgaccgcccagctcacaaccgaatccatgccgttcaatgtcgcagaaggcaaggaagtattgctcctggtgcacaacttgccccaacaattgtttggatactcatggtacaagggcgagcgggtggacgggaatcggcagatcgttggatatgccatcggaacacagcaagccacgccaggcccagctaattctggaagagagaccatttaccctaacgcctccctcttgatacagaacgtgacccaaaacgacactggattttataccttgcaggttattaagtctgacctggtcaatgaagaggctacgggacagttccacgtttacccggagttgcctaaaccatccatcagctctaataattccaatcccgttgaggacaaggatgccgtagcattcacttgcgaaccagagacacaggataccacatacctctggtggatcaacaaccagagtctgccagtttcaccgcgtttgcagctgagcaacggaaataggacgctaacacttttgagcgtaactaggaatgatacaggtccctatgagtgcgagatccagaatccagtatccgctaatcgcagcgatccggttacattgaatgtgacctatggaccagataccccaacgatctcaccctcagacacatactaccgccccggggccaatctctcactctcttgttatgccgcttccaatcccccggcgcaatatagctggcttattaacggcacgtttcagcaaagtacgcaggagctgtttattcccaacatcacggtgaataactccggcagttacacttgtcatgcaaataactccgtgaccgggtgtaaccgcacaaccgtgaaaacaatcattgtgaccggcaaatag

SEQ ID NO: 181680 - DNA, 1458 bp, Artificial Sequence
  Description of Artificial Sequence: Synthetic coding sequence
cggggcgaccgggccgccgtgctggaggccttcctggagcccaagctgtcgtcaaccggagaagaccgggcctcacggagacaccacggcgcgccactgtccccaacttctcaatccgcttgtaccctcggactgcttcttacggcttccctgctcactttttggaatcctccaactacagctcagctgacgacagaaagtatgcctttcaacgtcgctgagggaaaggaggtgcttttgctggtgcacaacctgccacagcagctcttcggctatagctggtataagggggaaagagtagatggcaacagacagatcgtggggtatgcaataggtacccagcaggccacgcctggccctgctaatagcggccgcgagactatctatcctaatgcttcactcctgatccagaacgttacccagaacgacactgggttctatacgctccaggtcattaaatcagacctcgtaaatgaggaggccaccggacagttccacgtttatcccgaactgcctaagccaagtattagttccaacaactcgaaccctgtcgaggacaaggacgctgtagcatttacctgcgagcctgaaacccaagataccacctacctttggtggattaataatcagagcctgcccgtctctcccagactgcaattatcaaacggcaatcgtaccctgactctactgtcggttacccgcaacgacacagggccttacgagtgtgaaatccagaaccccgtgagcgccaataggagcgatccagtcacattgaatgtgacatacggaccggacacccccacaatctccccatccgatacatactaccggcctggcgccaacttatcactgtcatgctacgctgctagtaaccctccggcacagtatagttggttgattaacgggaccttccagcaaagcactcaggagctgttcatccccaatatcacggttaataattccggtagctatacctgtcacgcaaataacagcgtcaccggctgtaaccggacaaccgtcaagactatcatagtgacggaactctcaccggtggttgcgaaacctcagatcaaagcaagcaaaacaacggtcacaggtgacaaggattctgtcaacctaacatgctcgacaaatgatactggaattagcatacgctggtttttcaaaaaccaatcgctgccctcctccgagagaatgaagctgagccagggtaacacaacactgtccattaatccagtgaagcgcgaagacgccggcacctactggtgtgaggtgttcaacccaattagcaaaaatcagagcgatcccatcatgctcaacgttaactacaatgcactgccccaggagaacggactcagccccggagccatcgccggtatcgtgatcggggtagtcgccttagtggccctcattgccgtggccctcgcatgcttccttcatttcgggaagacaggctag

SEQ ID NO: 181681 - DNA, 1395 bp, Artificial Sequence
  Description of Artificial Sequence: Synthetic coding sequence
atgggccacctgagcgcccccctgcaccgggtgcgggtgccctggcagggcctgcttctcacagcctcactcttaacgttctggaacccccctaccaccgcgcagctgaccactgagtcaatgccttttaacgttgcagaggggaaggaagtccttctgttggtgcataacctgcctcaacaactattcggttattcctggtataaaggcgagcgcgtggatggcaaccgccagatcgtcggatatgcgatcgggactcagcaggccacccccggtccagccaattccgggcgcgaaaccatttaccccaacgcatctctgctgattcagaacgttacacaaaacgacactggcttctacacccttcaagttatcaagagtgatctagtcaatgaagaagcgactggacaattccatgtttatccggagctgccgaagcccagtatttcctcaaataactccaatcccgtggaagataaggatgcagttgccttcacatgtgaacctgaaacgcaggacactacatacctgtggtggataaacaatcagagtttgccagtcagccctagattgcagctgagcaatgggaaccgaaccttgacgcttctgagtgttacaagaaacgatacaggtccttacgagtgcgagatccagaacccagtctcggctaaccggagtgatcccgttaccctgaacgtcacatacgggcctgataccccaactatatctccatccgatacctactacagaccaggagctaatttgtccctgtcttgttacgcggccagcaatcctccagctcagtattcctggctcatcaacggaacctttcaacagtctacccaagagctattcatcccaaacattactgtgaataactcaggatcttatacctgtcatgctaacaactcagttacgggatgtaacagaacaaccgtgaaaactatcatcgtaactgaactgtcacccgtggttgcaaaacctcagatcaaagcgtctaaaacgaccgtaacaggcgataaagactctgtcaatctgacttgttcgacgaacgatactgggattagcattaggtggtttttcaaaaaccagagcctccctagctctgagcggatgaaactgtctcaaggcaatacaactttaagtatcaaccctgtaaaacgggaggacgcgggcacttactggtgcgaggtgttcaatcccatatcaaaaaatcaaagcgaccctattatgctgaacgttaactataacgctctgccacaggagaacggcctttcccccggagctatagccggcattgtaatcggtgtcgtagcattagtcgctctgatcgcagtcgccctggcatgcttcttacacttcggcaagaccggtagctctggtccattgcagtag

SEQ ID NO: 181682 - DNA, 1107 bp, Artificial Sequence
  Description of Artificial Sequence: Synthetic coding sequence
atgggccacctgagcgcccccctgcaccgggtgcgggtgccctggcaaggactgctactgaccgcgtctctcctaacattttggaaccccccaactactgcccagctgaccaccgagagcatgccttttaatgtggctgagggcaaggaggtcctcctgctcgttcacaacttgcctcaacagctcttcgggtacagctggtataagggggagagagtagacggcaacaggcagattgtgggttatgctatcggtacccagcaggccacacctggtccagctaactctgggcgcgagactatttatcccaatgcttcccttcttatccagaacgtgacccagaacgacacgggcttctatacactacaggtcataaagtctgacctggtgaacgaagaagccactggtcagttccatgtttacccggaactcccaaaacccagtatatcatcaaacaatagtaaccccgttgaagacaaggacgccgtggcttttacctgcgagccagaaactcaggacaccacatacctgtggtggattaacaaccagtctttgcccgtctcgcctcgcctacagctttccaatggcaatcggaccctaacactactttctgtcacaagaaatgacaccggcccctatgaatgtgagattcaaaaccctgtgtctgccaatcggtctgatcccgtcactttgaacgtgacgtatggtccggacaccccaacaatttcaccttcggacacatattacaggccaggcgccaatctgtctctttcctgctatgctgcgagcaacccccccgcccagtactcctggctgattaacggtactttccagcagtcaacacaggaactgttcatcccgaacatcacggttaacaattccggctcttacacatgccatgccaacaacagtgtcaccgggtgcaatcggaccacagtcaagacaatcatagtcacagataacgcattacctcaggaaaacggcttgtcacccggcgctattgcagggatcgtgatcggcgtcgtcgctctcgtagctctcattgctgtggcactcgcatgttttctacatttcggcaagactggcagctctgggccattgcagtag

SEQ ID NO: 181683 - DNA, 906 bp, Artificial Sequence
  Description of Artificial Sequence: Synthetic coding sequence
atgctggccctgcgggtggcccggggcagctggggcgccctgcggggcgcggcatgggctcccggcacaaggccgtccaaaagaagagcctgttgggctctgctgcctcccgtgccatgttgtctgggctgtctcgccgagagatggagactgaggcctgctgcactcggcctgcgcctaccgggaattggccaaaggaaccactgcagcggtgctggtaaggctgcacctcggccagcagctggtgctggcgctgcagccgaagcaccaggcgggcagtggggtcctgcttccacacctagcctgtatgaaaatccatggaccatacctaatatgttatctatgacgagaattggcctagccccagtactgggttacctcataattgaggaggacttcaacatcgccctcggcgtgttcgcattggctggtctcacggaccttttggacggttttatagcgagaaattgggcaaaccagcgcagtgctctgggatcagcattggaccctctcgccgacaagatcctcattagcattctttacgtgtcattgacctacgctgacctgatcccggtgcccttaacttacatgattatcagccgggatgtcatgcttattgcagcagtgttctatgttagatatagaacattgcccacccccaggaccctagctaagtattttaacccatgctacgccacagccagactgaaaccaaccttcataagtaaagtgaacacggctgtacagttgattctggtggcagcgagcttggcagcaccagttttcaattatgcagactctatttatttgcagattctatggtgctttacagcgtttacaactgccgcaagtgcttattcttattaccattacggacgcaagacagtgcaggttattaaagactag

SEQ ID NO: 181684 - DNA, 609 bp, Artificial Sequence
  Description of Artificial Sequence: Synthetic coding sequence
atgccccagtacgagaacccctggaccatccccaacatgctgagcatgacacgcataggtcttgccccagtgctagggtacctcattatcgaggaggacttcaatatcgccctaggcgtgtttgctctagctggtctcactgacctgctggatggcttcattgctcggaactgggccaatcagagaagcgccctgggctccgccctcgacccgctggctgataaaattctgattagtattctctatgtgtccctcacctatgccgatttgatccccgtgccgctgacttatatgattattagcagagacgttatgcttatcgcagctgtcttctacgtgcgctaccggaccttgccaacgccccgaacattagcgaaatactttaatccttgttatgccaccgcccgtttaaagccgacctttatttcaaaggtgaacactgccgtgcaattaattctagtcgctgccagcttagctgccccagtgtttaactacgccgactctatctacctacagatcctgtggtgttttaccgccttcaccactgcggctagtgcttattcctactatcactatggaaggaagaccgttcaggtgatcaaggattag

SEQ ID NO: 181685 - DNA, 618 bp, Artificial Sequence
  Description of Artificial Sequence: Synthetic coding sequence
atgctggccctgcgggtggcccggggcagctggggcgccctgcggggggctgcatgggcacccgggactagaccctccaagcggagagcttgctgggccttgctcccccccgtgccctgttgtctgggttgcttggccgagcgctggaggctgcggccagctgcccttggcctcaggctgcctggcattgggcagagaaaccattgttccggcgcgggaaaggcggccccaagacccgctgctggcgccggcgcggcagccgaggcgccaggtggacagtggggccctgcctcaacaccatcgctctacgaaaatccatggacaatcccaaacatgctatcaatgaccaggatagggctggcacccgtcctcgggtacctgatcatagaagaagatttcaacatagctctgggcgtatttgccttggctgggttaacagacttgctcgacggctttattgcacgaaactgggctaaccagcgtagcgcccttggctcagctcttgatcccttagctgataaaattctgatcagcattctgtatgtctctttaacttacgcagatttgattcctgccaacacatgtcaggtcttccaatcactgctgtgtcactgctag

SEQ ID NO: 181686 - DNA, 12210 bp, Artificial Sequence
  Description of Artificial Sequence: Synthetic coding sequence
atggccagccgggacagcaaccacgccggcgagagcttcctgggctctgacggtgacgaagaggcaactcgggaacttgagactgaggaagaatccgaaggcgaggaagacgaaactgccgccgagtctgaggaagagcctgatagtaggctgagcgaccaggacgaggaagggaaaatcaagcaggagtacatcattagtgaccctagtttctccatggtgaccgtgcagcgcgaagatagtgggatcacatgggagacaaacagctccaggtcctctacaccttgggcctccgaagaatcacagacatccggggtctgctcccgcgaaggatctacggtaaactccccccctggtaatgtttcatttattgtggatgaagtcaaaaaagtgcgcaaacgaacgcataagtccaaacacggttcaccaagtttgaggcgaaaaggaaaccgaaagcgaaattcattcgaatctcaagatgtgcctacaaacaagaaaggatccccccttaccagcgcctctcaggtgctgaccactgaaaaggaaaaatcctatacggggatttacgataaagcgagaaagaagaaaacaacttcaaatacacctccgataacaggagccatttacaaagagcataagccactggtcttgcgtcctgtttatatcggcacagtgcagtacaagatcaagatgttcaattcagtgaaggaggaactgattcccctccagttttacggaacattgcctaaaggatatgtgattaaggagattcattatagaaaagggaaggacgcatcaatcagcctggaacccgacctggataatagcggctccaacaccgtatcaaaaacgcgcaagctggtcgcacagtctattgaggataaagtcaaggaggtgtttccaccctggcggggggccctctccaagggaagcgagagcttgacattaatgttttctcatgaagaccagaaaaaaatctatgccgactctccactgaatgcaacctccgcactggagcatacggtgccttcctattcatcctcaggaagggccgaacaggggattcaattgcggcacagccaatctgtgccacagcagccggaagacgaagcgaaaccacacgaagtggaacctccttccgttacgccagataccccagctactatgttcctgcggaccacaaaggaagaatgtgagctggcaagtcccgggaccgccgcatcggagaacgattcttccgtgtctccgagctttgccaacgaggttaagaaagaggatgtctactcagcccatcacagcatctctcttgaggctgccagccctggtttggcagcctccacacaggatggcctggaccctgaccaggagcagcctgatctgacctctatagaaagagccgagcccgtgtctgccaaattaacacccacacaccctagcgtcaagggcgagaaagaggagaatatgctcgagccaagcatttctctttcagaacctctgatgctggaggaacctgaaaaggaggagattgagacaagccttcccattgcaattactcctgagccagaggacagcaatctggtggaagaggagatagtcgaactggattatcccgagtcaccactggtgtcagagaagccctttcccccccacatgagtcctgaggtcgagcacaaggaagaggaattaatccttcccctcttagccgcatcctcgccagagcacgtggccctgagtgaggaagagagagaggagatcgcctcagtgtccaccggctctgccttcgtgagcgagtacagcgtgcctcaggatctgaatcacgagctccaggagcaggagggcgaacccgtcccaccttcaaacgtggaagcgatcgccgaacatgccgtcctttctgaggaggagaacgaggaatttgaggcttactcgcctgccgcagcacctacctctgagtccagcttatcaccctccaccacagagaagacctctgaaaaccagagtcccctcttcagcacagtgacacctgaatatatggtgctttccggagacgaggcaagtgagagcggatgctacactcctgattctacctcagcctctgaatatagcgtgccatcacttgcaactaaagagagtctgaaaaagaccattgataggaaaagtcccttgattctcaagggcgtgtccgaatatatgatcccctcggaagagaaggaggataccggctcattcacaccagcagtagcgcccgccagcgagccatctctgtctccgagcacaaccgagaaaactagtgagtgccagtccccacttccctcgacagcaaccagcgagcacgtggtgccgtcagagggcgaagacctcggctccgaacggtttactccagatagtaagttgatcagtaaatacgccgctcctttgaacgcaacacaagagtcccagaaaaaaattattaatgaggcctcacaatttaaaccaaagggaatttcagagcataccgtcctctctgtggatgggaaggaggttatcggaccctcctctcccgatctggtcgtagcatccgaacactcctttcctccccatactacagagatgacgagcgagtgccaagcccccccgttgagtgctacccccagcgaatatgtggtactgtcagatgaagaggccgtggagcttgaacggtataccccctcctctacctccgcttcagaatttagcgtcccaccctatgccaccccagaagcacaagaggaagagatcgtacaccgctctttgaacttgaagggagcatcgtcccctatgaatctgtccgaggaagatcaagaggacatcggcccattcagcccagacagcgcttttgttagcgagttctcatttcccccttatgccacccaggaagctgagaagcgggagttcgaatgtgattcccccatttgtctgacttccccctccgaacataccatccttagtgatgaggacacggaagaagccgaactgtttagccccgacagcgcaagccaggtgtctattccaccatttcggatttccgagacagaaaaaaatgaactggaaccagacagcttacttacggcagtaagcgcgtctggatattcatgcttctccgaggccgatgaagaggacattggcagcaccgcggcgacgccagtttctgagcagttttcctccagtcagaaacagaaagccgagaccttcccactgatgtccccactggaagaccttagtttacctccaagcacagacaagagcgaaaaagctgagatcaagcccgagattccaactaccagcacctcagttagcgagtaccttattctggcacagaaacaaaaaacccaggcatatctcgagccggagagtgaagacctcattccaagtcaccttacaagcgaggtggagaaaggcgaacgggaggcctcctcctccgtcgcagcgataccagcggcactgcctgcgcagtccagcatagtcaaagaggaaacaaaaccagcttccccacattcagtgctcccagattctgttccagcaatcaaaaaggaacaggagccaaccgccgcccttactcttaaagcggcagatgaacagatggcactgagcaaagtccggaaggaagaaatcgttccggatagtcaggaagcaactgcacacgttagccaggatcagaaaatggagccacagccacccaacgtacctgagagcgaaatgaagtattctgttctgcctgacatggtcgacgagccaaagaagggcgtcaagcctaagctggtgttgaacgttacttctgaactggaacaacgcaaactgtctaaaaatgaaccggaggtgatcaagccctactcaccattaaaggagacctctctcagcggtcctgaagcgctatcagccgtcaagatggaaatgaaacatgactccaagataactactactcctattgtgctacatagtgcttcaagcggcgtagaaaagcaggtagagcacggccctcccgcactggcgtttagtgcattatcagaggagattaaaaaggagattgagcccagctcatcaacaacaactgcctctgtgactaagctcgactctaatctcaccagggccgtgaaagaagaaattccaacagattcgtctctgataactcctgtggatcggcccgttctaaccaaggtgggcaaaggggagctggggtccgggctgccgccattggtgacatctgcagacgagcattcagtgctggccgaagaggacaaggtggctattaagggcgcctcgcccattgagacatctagcaaacatctcgcctggagcgaagctgagaaggagataaaattcgactccttgccatccgtaagcagcatcgccgagcattccgtgttgtcagaagtggaggcaaaggaagtgaaggcagggctgcccgtcattaagacaagctctagtcagcatagtgacaagtccgaggaggcgcgagttgaggataagcaagacctgctcttttccacggtgtgtgactctgagaggttggtgtcatcccagaaaaagagcctgatgtcaacaagcgaggtgctcgaacccgagcacgaactcccactgtccctgtggggagaaattaaaaagaaagaaaccgagcttccgtcctctcagaatgtgtcgcccgcttctaagcacattattccaaagggtaaagatgaggagactgcctcctcctctcccgaactcgagaatttagcctctggtttagctcccactttactgcttctatcagatgataaaaacaaacccgccgtggaagtgagctctacagcccagggagacttcccaagcgagaagcaggatgtcgcactggcagagctcagcctggaaccagagaaaaaagacaagcctcatcagccacttgagctgcccaatgccggttccgaattttcgtccgatttggggaggcagtccggcagcatcggtactaaacaggcgaaaagccccatcaccgaaactgaagatagcgtgctggaaaagggtcctgccgagttaagatctcgcgaagggaaggaggagaatagggaactgtgcgcctcttcaaccatgccagccatcagtgaacttagcagtctgctgcgggaggaatcccagaatgaggagataaagcctttcagccccaagatcatcagccttgagagcaaggagccaccggcatctgtagcagagggagggaatccggaagaattccaaccctttacattttccctcaagggtttatcagaggaggtgagccatcctgcggactttaagaagggcggaaaccaggaaatcggccctctgccacccactggcaacctcaaagcacaggtcatgggcgacatcctggataaattgtcggaggagaccgggcacccaaactcttcccaagtacttcaatccattactgaaccaagtaaaatcgcaccttctgatctgcttgtggaacagaagaaaaccgagaaggctctgcatagtgatcagaccgtgaaacttcctgatgtgagtacttccagcgaagataagcaagatctaggcattaagcagttctctctgatgcgagaaaatctgcctcttgagcaatccaagagcttcatgactactaaaccagccgatgttaaggaaaccaaaatggaggagttcttcatcagtccaaaggacgaaaactggatgctcggtaaaccagagaatgtggcctcacagcatgagcaaaggattgcagggtccgtccagctggactctagcagttccaatgaattgaggccggggcagctgaaagcggcggtgtcttctaaggaccatacttgcgaagtgagaaagcaggtgctgcctcactccgccgaggaaagccatctgagtagccaagaagctgtgagtgccctcgacaccagcagcggtaatactgagactctgagctcaaagagttactcatcagaagaagtaaaactcgcagaagagccgaaaagcttagtgctggctggcaatgtcgagaggaacatagccgagggaaaggaaattcattcactcatggaatcggaatccctgctactagagaaggcgaacacagaactgagttggcctagtaaggaggactcacaggagaaaattaagctgcctcctgagcgcttcttccagaagcctgtcagtggtctgtcagttgagcaggttaagagcgaaacaatctcatcctctgtcaagacagcccactttccagcggaaggcgtggaaccagcacttgggaacgagaaggaggctcatcggtcaacacccccctttccggaggaaaagcctttagaggaatctaagatggtgcagagcaaggtcattgacgacgcagacgaaggcaagaaaccttcccctgaagtcaaaatccccacccagaggaagccaatcagttccatacatgcacgagagcctcagtctcctgaatctcccgaagtgactcagaatccccccacccaaccaaaggtcgctaaaccagatttaccagaagaaaagggcaaaaagggaatatccagctttaaaagctggatgtcgtcactgtttttcggcagctccacccccgacaacaaggtggccgagcaagaagacctcgagacacagcctagtcctagcgtggaaaaagcagtcacagtaattgaccccgagggaaccatacccacaaactttaatgttgccgaaaagcccgctgatcattccctgtccgaggtcaagctaaagaccgccgacgagcctaggggaactctagtgaaatctggcgacgggcagaacgtaaaagagaagtctatgatcctgtcaaatgtggaggaccttcagcagcccaagttcatctcagaggtctcaagggaggattacgggaaaaaggagatttcgggggacagcgaagagatgaacataaattctgtcgtgacaagtgccgatggcgaaaacctggagattcagagttattccctgatcggcgagaaactggttatggaggaagcaaagaccattgtgccgccccacgtgaccgacagcaaacgggtgcagaagcccgcaatagctcccccctctaaatggaacatcagcatctttaaggaagagcctcgtagcgaccagaaacagaagtcattactctccttcgacgtggtggacaaggttcctcagcagccaaagtcagcctcatccaatttcgcctccaagaacattactaaagaaagtgaaaaacccgaatccattattcttccagtggaggaaagcaagggcagcctcattgatttttcagaggaccgtctcaagaaggagatgcaaaatcccacatcgctgaaaatctcagaggaggaaaccaagcttagatcagtctctccaacggaaaaaaaggataacctggagaatcgatcctacaccttggcggaaaaaaaggtcttggctgagaaacagaactccgtggcacctctggagctgcgagatagcaacgaaattggaaaaacccagataacgctcggctctcgcagcaccgagctgaaagaatcgaaagccgatgccatgccccagcacttttaccagaacgaggactacaacgagaggcccaaaatcatagtgggatcggagaaagagaaaggcgaggagaaggagaatcaggtgtacgttttgagcgagggaaagaaacagcaggagcaccagccttattcagttaatgtggccgaatctatgtcaagggagtccgacatctccctgggtcattcgttaggcgagacacagagctttagccttgttaaagccacctctgtgacagaaaagagtgaggccatgctcgccgaagctcatccagaaatcagggaggcaaaggcagtaggcacacagcctcaccccctcgaagagtccaaagtgctggtcgaaaaaaccaagacctttctccccgtggcactgagctgtcgggatgaaatcgaaaaccactcactgtctcaggagggtaatttagtgcttgagaaatcctccagggatatgcccgatcacagcgaggaaaaggaacagttccgcgagtccgagttaagcaagggcggttccgttgacatcactaaggagactgtaaaacaaggctttcaagagaaggctgtgggcacgcagcctagaccactagaggagtcaaaggtgctggtggaaaagaccaaaacattcctccccgtcgtgttaagttgccatgatgaaatagaaaaccacagtctgtctcaagagggcaatttggttctggagaagagcagcagggatatgcccgatcacagtgaggagaaggagcagtttaaggagtccgagttatggaaaggcggttccgtggacataactaaggaatccatgaaggagggcttccccagcaaggagtctgaacgaactctggcccggccattcgacgagacaaagagttctgaaactccgccttatttgctgtcccccgttaaacctcagactctggcttctggggcatccccagagattaatgccgtgaagaagaaagagatgccaaggtccgagctgacaccagagcgccacaccgttcacactattcagactagcaaggacgatacttcagatgtgccaaaacagtccgtcctcgttagcaagcaccatctggaggctgctgaagatactcgagtgaaagagcccttaagttccgcgaagtccaactacgcccagttcatatctaacaccagcgcatctaatgcagataaaatggtatcaaataaggagatgcctaaagagccagaggatacctacgccaagggtgaggactttaccgtcacatccaagcctgctggtctcagtgaggaccagaagaccgcgttcagcatcatatccgaggggtgtgaaatccttaacatccatgcaccagcctttatttctagcatcgaccaagaggagtctgaacagatgcaagataagctggagtatttagaggaaaaagcttcgttcaagaccatccccctgcccgatgattccgaaactgttgcgtgccacaagaccttaaaaagcaggctggaggatgagaaggtgacccctcttaaagagaataagcagaaagagacgcataagacaaaggaggagatctctacagactcagaaaccgacttgagctttattcagcccacaattccatccgaagaggattacttcgaaaagtataccctcatcgactacaacatcagccccgatccagagaaacaaaaggcaccccagaagctgaatgtggaggagaaactctctaaggaggtgactgaagagaccatttccttccctgtgtcaagtgtcgaatccgccctcgagcatgagtacgacttagtgaagctggacgagtctttttacggtccggagaaggggcataatatcctgtcccacccagaaactcagtctcagaattcggctgaccggaacgtgtcaaaagacaccaaacgggacgtggattccaaatctcctggcatgcccctttttgaagcagaagagggtgtgctaagtagaacccagatctttcctacaacaatcaaggtaatcgaccccgaatttcttgaggagccaccagctctggctttcctttataaagacctgtatgaagaagcagtgggcgagaagaagaaggaggaggaaacggcctccgagggcgactcagtgaactccgaggcttccttcccaagccgcaattctgatacagacgacggaactggaatttatttcgagaaatacatcttaaaagacgatattcttcacgacacttcactgacgcaaaaagaccagggccaggggctggaagaaaagagagtcggtaaagatgatagttaccagcctatagctgcagaaggtgaaatctggggcaaatttggtacgatttgccgggaaaaatcccttgaggaacagaagggggtttatggtgaaggtgaatcagtggatcacgtcgaaactgtgggcaacgtggccatgcagaaaaaggcaccgatcacggaggatgtgcgggtggctactcagaaaatttcttatgctgtgccatttgaagatacgcatcacgtgttagagcgggccgacgaagccggctcacatgggaacgaagtgggaaatgcatctccagaggtgaatctgaacgttcccgtccaggtcagctttcctgaagaggagtttgcttcaggggcaacgcatgtacaagagaccagcctggaggagccaaagatcttagtaccaccggagccctctgaagagagactgagaaattcacccgtgcaagacgagtacgaatttaccgagtctctccataacgaagtcgtaccacaagatatcctgtccgaagagctttcatccgaaagcactccagaggatgttctaagccagggcaaggaatcttttgagcatattagtgaaaatgagttcgcaagtgaagctgagcagtccaccccagcagaacagaaggaactgggctcagagagaaaagaggaggatcaattgtcttctgaggtggtaactgaaaaggcccagaaggaactcaagaagtctcagatcgacacatattgctatacttgtaagtgccctatctcagcgaccgataaggtgttcggaactcacaaagaccacgaggtctccaccctggataccgccatttctgccgtgaaagtacagctcgctgagttccttgaaaatctccaggagaaatcactgcgaatcgaggccttcgtgtcagagattgagagcttcttcaatacaatcgaagaaaactgtagtaagaacgagaaaaggctggaagagcagaacgaggagatgatgaagaaagtgctggcccagtacgatgaaaaagctcagtcctttgaggaagttaagaagaagaagatggagtttttgcatgaacagatggtgcattttctgcagtctatggacaccgccaaggacacactggaaactattgtgagggaggcagaggagctggatgaagccgttttcttgacatcatttgaagagatcaatgaacgcttactgtccgcaatggagagtaccgcctctcttgaaaaaatgcctgctgcattctctctgtttgaacattacgatgactctagtgctagatcagaccagatgttgaaacaagttgcagttccccagccccctcgactggagcctcaggaaccaaactccgcaacaagcactaccatcgccgtttactggagcatgaataaagaggatgtgattgacagtttccaggtctactgcatggaggagccgcaggatgaccaggaggtgaacgagctggtggaagagtacagactcaccgtgaaggagtcttactgcattttcgaagacctggagcccgatagatgttaccaggtgtgggtgatggctgtgaactttactggctgttcactgccatcagagcgtgccatctttagaacagcacccagcacccctgtgatccgagccgaggactgcaccgtatgctggaatactgcaaccatacggtggaggcccaccacacctgaggcaacagagacctataccttagaatattgcagacaacacagcccggagggcgaaggtttaagatccttttctggcatcaaaggtcttcagctgaaagttaacctacagcccaacgataactacttcttctacgtgcgcgccattaacgcattcggcacgagtgagcagtctgaggcagctcttatttccacgcgtggcacaagatttctgctgctgagagagaccgcgcatcctgccctgcatatatcatccagtggcacagtgattagcttcggcgagcggcgtaggctcaccgagatacccagcgttttgggtgaggagctcccttcttgtggtcagcactattgggagaccactgtgacggattgtcccgcctatcggctgggtatttgctcgtctagtgccgtgcaggccggcgccctggggcagggtgagacaagctggtacatgcactgctcagagccccagaggtatactttcttctatagtggtatcgtgtccgacgtgcacgtcaccgaacgacccgcacgggttggcattctcttggattataacaaccaacgcctcatcttcatcaacgcggagagcgagcaactgcttttcatcatccggcacaggttcaatgagggggtccatcctgctttcgctctggaaaagccaggcaaatgcacgttgcatctcggcatcgagccacctgatagcgtgcggcacaagtag

SEQ ID NO: 181687 - DNA, 678 bp, Artificial Sequence
  Description of Artificial Sequence: Synthetic coding sequence
atggacctgcgggccggcgacagctggggcatgctggcctgcctgtgtactgtactgtggcatctcccagccgttccagctctaaataggacaggagatcccgggccaggtccgtccatccagaaaacctacgatctgacaaggtatctcgaacatcagctaaggtctctggctggaacataccttaattacttgggccctcctttcaatgagcctgacttcaatcccccaagactgggtgcggagaccttgcccagagcgaccgtggatctcgaagtctggaggtcgttgaacgacaagctgcgactgacacagaattatgaagcatatagccacctcctgtgctacctgcgcggactaaataggcaggcagctaccgcagagctgcgaagatccctggcgcacttctgtacaagcttgcagggcctgctgggttcaatcgccggagtcatggccgctctagggtacccgcttccacagcctttgcctggaactgaacctacttggacacctggcccggcccattctgacttcctgcagaaaatggacgacttctggctcttaaaggagctccagacttggctctggcggtccgcgaaggatttcaaccgcctgaaaaagaaaatgcagcctccagctgcggctgtgaccctgcacctgggggcccacggcttctag

SEQ ID NO: 181688 - DNA, 648 bp, Artificial Sequence
  Description of Artificial Sequence: Synthetic coding sequence
atgctggcctgcctgtgcaccgtgctgtggcacctgcccgccgtgcctgctttgaacagaaccggtgacccgggaccaggcccatcaatccaaaaaacctatgatctgaccagatacctggagcaccagctaagatctctggcagggacatatctgaattacttggggcccccttttaacgaaccggatttcaaccctccaagactgggcgctgagactctgcctagggcaacagttgacctcgaggtctggcgcagcctgaatgacaagctgcgcctcacgcaaaattacgaagcttacagccaccttctttgctacctgcgtgggctgaaccggcaggcagccaccgccgaactgcgacggagcttagcacatttctgtacatcactccagggtcttctgggatctattgccggggtgatggccgctctgggctatccgttacctcagcctcttcccgggacagagcccacttggaccccaggtcccgctcattccgacttcctacagaaaatggacgacttttggctgctgaaggagctccagacgtggctgtggagatccgcaaaggacttcaaccgcctcaagaaaaaaatgcagccccccgctgctgctgtcaccctacacctcggggcacatggcttttag

SEQ ID NO: 181689 - DNA, 648 bp, Artificial Sequence
  Description of Artificial Sequence: Synthetic coding sequence
atgctggcctgcctgtgcaccgtgctgtggcacctgcccgccgtgcctgctttgaacaggaccggagatcctgggccaggcccaagcatacagaagacatacgacctgacgaggtatttggagcatcagctgcgttccctggcggggacttatcttaattacctgggtcctcctttcaacgagcccgacttcaatccccccaggttgggggccgagaccttacctcgagccacagttgacttagaagtgtggagaagtctcaatgataaactgcgcctcacacagaactacgaagcctacagccatctcctatgttaccttcgtggcctcaaccgacaggccgctacagccgagctccggagaagcctcgcgcacttctgcacctctctgcagggtttactgggttcgatagcgggcgtcatggccgcgctgggttatcccttaccacagccattacctgggactgaacctacatggacaccaggtcctgcacattccgattttctgcagaagatggacgacttttggctgctgaaggaactccaaacatggctctggcggtctgctaaagatttcaacagactcaagaaaaagatgcaaccccccgctgccgccgtcaccctgcacctcggggcccacggcttctag

SEQ ID NO: 181690 - DNA, 1881 bp, Artificial Sequence
  Description of Artificial Sequence: Synthetic coding sequence
atgctggccttcgccgcccggaccgtggtgaagcccctgggcttcctcaaacctttttcgctcatgaaggcctccagtcggtttaaggctcatcaggatgctcttccccgcttgcctgtgccaccactccagcagtctttggatcactatctgaaggccttacagcctatagtgagcgaggaggagtgggcgcataccaagcagcttgtagacgagttccaagccagtggtggcgttggcgaacgcctgcagaaagggctcgagcggagagccagaaaaaccgagaattggttgtccgagtggtggcttaagacagcttacctgcagtacagacaacccgtcgtgatttactccagcccaggggtgatgctccccaaacaggacttcgtcgatctccagggtcagctccgttttgcagctaaactgatcgagggagtccttgacttcaaagtgatgatcgataatgaaactctgcccgtcgagtacttaggaggcaagcctctgtgcatgaaccaatattaccagatcctgtccagttgcagagtgcccggtcccaaacaggacaccgttagcaattttagcaaaaccaagaagccacccacacacattacagttgtgcataattatcagttcttcgagctggacgtgtaccacagtgacgggaccccattgaccgccgaccagatttttgtgcagttagaaaagatctggaatagctcgcttcaaactaataaagagccggtgggtatcctgacgtctaatcaccgaaattcgtgggctaaagcatacaatactctgataaaagataaggtgaatcgtgactctgtgcgttctatccagaagtcgattttcactgtctgcctggatgcaacaatgccccgggtgtccgaggacgtgtacaggtctcatgtagcaggccagatgctccatggcggcgggagcagactcaacagtggcaataggtggtttgataagactcttcagttcattgtggcggaagatggtagttgtggtttggtttatgagcacgcagctgctgagggaccccccatcgtgactctgctggactacgtcattgagtatactaagaagcctgaactggttaggtctcccctggtgcctctgcccatgcccaagaaactgagattcaacatcacaccagaaatcaaaagcgatatcgaaaaggcaaaacaaaacctgtccatcatgattcaggacctggatatcacagtgatggtgtttcaccactttgggaaagacttcccaaagtccgagaagttgtccccagatgcatttatacagatggctcttcagctcgcttactacagaatatatggccaggcctgcgctacctatgagtccgcttctctgaggatgttccaccttggaagaaccgataccatcaggtcagcgtctatggactccctaacctttgtgaaagcaatggacgatagttccgtcaccgaacatcagaaggtggaactgctgaggaaggccgtccaggctcaccgtgggtacactgatagagcaataaggggcgaagcgtttgatcggcacctattaggacttaaacttcaggcaatcgaagacctcgtttctatgccggatatcttcatggatacgtcttatgccattgcgatgcattttcatctcagcacttctcaagtgcctgccaaaactgattgcgtcatgttttttggtcccgtggtcccggatggttacggagtctgctacaatccaatggaggctcacatcaacttcagcctctcagcgtacaattcttgtgcagaaactaacgcggctagactggcacactacctggagaaagccctcctagatatgagggcccttttacagtcccacccacgagcaaaactctag

SEQ ID NO: 181691 - DNA, 1638 bp, Artificial Sequence
  Description of Artificial Sequence: Synthetic coding sequence
atgctggccttcgccgcccggaccgtggtgaagcccctgggcttcttgaaacccttcagcctcatgaaagccagtagccgtttcaaggcccatcaggatgccctgccaaggttgcccgttccaccattgcaacagtccttagaccattacctgaaagccctgcagcccattgtgtccgaggaggagtgggcccacaccaaacaactcgtggacgaattccaggcctccggcggcgtcggagaaaggctccagaagggcctcgaacggcgcgcccgcaagacagagaattggttgtccgagtggtggctgaagaccgcatacttacagtatcgtcagcccgtggtcatatactctagtcccggggtgatgctgcccaagcaagacttcgtggacctgcaagggcaactgaggttcgccgctaaactcatcgaaggcgtacttgattttaaggtgatgatcgataatgagaccctccccgtggagtaccttggtggcaagcccctatgtatgaaccaatattatcagatcctgtcctcatgcagagtccctggtccgaagcaggacaccgtttctaactttagtaaaactaaaaagccccctacgcatattaccgtggtccacaactaccaatttttcgaactcgatgtatatcactcagacggtactcctcttactgcggaccagattttcgtgcagttagaaaagatttggaactccagcctccagaccaacaaggagcccgtcggcatactgacctctaatcaccgtaatagctgggcaaaagcatacaacactctcattaaggacaaggttaacagggatagcgtccgttcgatccaaaaaaagaaacctgaacttgtcagatctccccttgtgcctttgcctatgccaaagaagttgaggtttaacattacccccgagatcaagtccgatatagagaaggcaaaacagaacctcagcatcatgatccaggatctagacatcactgtcatggtgtttcatcacttcgggaaggacttcccaaagtccgagaagctaagccccgatgctttcatccagatggccctacagctagcttactaccggatctacggccaggcctgtgcaacttacgaatccgctagcctacgtatgttccacctgggcagaaccgacaccataagatcagcatcaatggactctctgacattcgtaaaggccatggacgacagcagcgtgacggagcatcagaaagtggaactgctgcggaaggccgtgcaggcccatcggggctacaccgaccgggccatccggggggaggccttcgacagacacttgctgggattgaagctgcaggctattgaggatctggtgtctatgccggacatctttatggatacctcctatgccatcgctatgcatttccatctcagcaccagtcaagtgccagcaaagacagattgtgtcatgttcttcggccctgtagtccccgatggctatggagtgtgctacaatcccatggaggcccacatcaactttagtctgagcgcttataacagttgcgccgagactaacgctgccagactggcccattatttagaaaaagccctgttagacatgcgcgctctgctgcagtcccatccaagagccaagctgtag

SEQ ID NO: 181692 - DNA, 2322 bp, Artificial Sequence
  Description of Artificial Sequence: Synthetic coding sequence
atggccgaggcccaccaggccgtggccttccagttcaccgtgaccccggacggaatcgacttgagactcagccacgaggcgctgcggcagatctacttgtccggccttcacagctggaaaaaaaaatttatccggtttaagaacgggattattactggcgtttaccccgcaagcccgtctagctggctaatcgtcgttgtcggtgtgatgacaacaatgtatgctaaaattgacccttctcttggaatcattgccaaaattaataggactctcgaaacggcaaactgcatgagctcacaaacaaaaaatgtggtctctggcgttctcttcggtaccgggctgtgggtggcactgatcgtaacaatgcgatactcccttaaggtcctcctcagctaccacgggtggatgttcacggagcacgggaagatgtcccgagctaccaagatctggatgggcatggttaagatcttctccggtcggaagccaatgctatacagcttccagacctcgctgcccaggctgcctgtccctgccgttaaagatacggtgaacagatacctgcagtccgttcgcccactgatgaaggaggaggactttaagcgcatgaccgccctcgcacaagattttgcagttgggctggggcctcggctccagtggtaccttaaattaaagtcttggtgggcaacaaactacgtgtcggactggtgggaggaatatatttaccttcgggggagagggccattgatggtgaacagtaattattacgcgatggacctgctgtacatactccccacacatatacaggcggcgagagcaggcaatgctatccatgcaatattactgtatcgaaggaaactggacagagaggaaatcaaacccatacgccttctgggctccacaatcccactatgtagtgcgcaatgggagcgcatgttcaatacttcacgaattcctggcgaggaaacagataccatacagcacatgcgcgattcaaagcatatcgttgtttatcaccgcggccgttacttcaaagtgtggctgtaccacgatggccgactactgaagcctagggaaatggagcagcaaatgcaacggatactggacaataccagcgagcctcagccgggcgaagccagactggctgctctgactgctggggatagagtaccttgggcacgctgtagacaggcttatttcggccgcggtaagaacaagcaatctttggacgctgtagagaaagctgccttcttcgtgacactggatgagaccgaagaggggtaccgatctgaggaccccgacacgtccatggactcttatgcaaaatccctgcttcacggaaggtgttacgaccgatggtttgacaaatccttcacatttgttgttttcaagaacggcaagatgggattaaacgccgaacattcttgggctgatgctcccatagttgcccatttgtgggagtacgttatgtcaatcgacagcctccagctggggtacgctgaagatggccactgtaaaggggatatcaatcctaacatcccctaccccaccagactgcaatgggatatccctggcgaatgtcaggaggtcatcgaaactagtctcaataccgccaatctgctggcgaacgatgtggactttcattccttccccttcgtggctttcggtaagggtattattaaaaaatgcaggacctcaccagatgctttcgtgcaactcgccctgcagctggcccactacaaggatatgggtaaattttgcttgacctacgaggcatcaatgacacgcttatttagggagggccgtacagaaacggtgcgctcctgcacgacagagtcctgcgattttgtgagagctatggttgacccagctcaaactgtcgagcaaagacttaagctgttcaagctggctagcgagaagcaccagcatatgtaccggcttgctatgactgggagcggcatcgataggcatctcttctgcctgtacgtagtgtctaaataccttgccgtggagtcccccttcctgaaggaggtgttgagcgagccatggcggctgagtacaagtcagaccccccagcagcaggtggagctgttcgaccttgagaacaatcctgagtatgtgagcagtggcgggggattcggccctgtcgctgatgatgggtatggggtatcatacattttggtgggggaaaacttgataaactttcacatatccagcaagttcagctgcccagagacggactctcaccgattcggacgtcacttgaaggaggccatgacagacatcattaccctgtttggcttaagctccaattcaaagaaatag

SEQ ID NO: 181693 - DNA, 2271 bp, Artificial Sequence
  Description of Artificial Sequence: Synthetic coding sequence
atggccgaggcccaccaggccgtggccttccagttcaccgtgacccccgacggcatcgaccttcgcctaagccacgaggctctccgacagatttatctgtcagggctgcactcctggaaaaaaaagtttattcggtttaagaatggaattatcactggagtgtaccctgcttctccttcctcttggcttatcgttgtcgttggagttatgacaactatgtacgctaaaatcgatccctcactggggatcattgcgaagatcaatagaacactcgagaccgctaattgtatgtcctcccaaaccaagaatgtagttagcggcgtcctgttcggtaccgggctgtgggtggcacttatcgtgacaatgcggtattctttgaaggtgttattgagctatcacggctggatgtttaccgagcacgggaaaatgtcccgcgccacaaaaatatggatgggcatggtcaagatctttagtggccgcaagcctatgttgtacagcttccagacaagcctcccccgtctgcccgtgcctgctgtaaaagacacagtgaaccgatatctgcagagcgtacggcctctgatgaaggaagaggattttaagcggatgacagccctggctcaagacttcgcagtggggttgggacccagactacagtggtaccttaaactgaagagttggtgggccactaattatgtgagcgactggtgggaagagtacatttatttgcggggaagaggtccactaatggttaattccaactactacgccatggatctattatacatattacctacacatatccaagccgcccgggcgggaaacgcaatacatgctatattgttgtaccgtcggaagttggacagggaggaaattaaaccgatcaggctgctcggatctaccatccctttatgctctgcacaatgggagcgaatgttcaacacatccagaataccaggcgaggaaaccgacaccattcaacacatgagagattctaagcatatcgtagtctaccaccgggggagatacttcaaagtgtggctctaccacgatggtcggcttctgaaacctcgggagatggagcagcagatgcagcggattctcgacaatacaagcgagccgcagcccggcgaagctcgactcgccgctcttaccgcgggggaccgggtcccctgggctcgatgccggcaggcatacttcggccgcggtaaaaataagcagtccctcgacgctgtggaaaaggcagccttctttgttaccctggacgaaaccgaggaaggctataggtcagaagatcctgacacctcgatggatagctacgcaaagtcacttctccacggtcgatgctatgacaggtggttcgataagtcatttactttcgtcgtatttaagaatggcaagatgggcctgaacgccgaacactcttgggccgacgctcccattgtggctcacctgtgggaatacgtgatgtctatcgattccttacagctcggctatgctgaggatggtcattgcaagggtgacattaacccgaacatcccctatccgactcggctgcagtgggacatacccggagagtgtcaagaagtaatcgagacctccttgaacacagccaacctgctggcaaatgatgtggatttccactctttcccatttgtcgcatttggcaaagggattatcaaaaaatgtaggacatcaccagacgcgttcgtgcagctggccctccagctggcacattataaagacatggggaaattttgcctgacgtacgaagctagcatgacccggctgttccgcgagggtcgtacagaaaccgtccgttcttgcaccaccgagagctgtgattttgtccgagccatggtcgaccctgcccagaccgttgaacagcggcttaagttgttcaaactcgccagcgagaagcaccaacacatgtaccgcctggccatgacaggctccggcatcgacaggcaccttttctgcctttacgttgtaagcaaatatctcgcagtggaatcccccttcctgaaagaagtcctgtccgagccatggcgactctcgacatcacagacccctcagcagcaagttgaactgttcgatttagagaataatcccgagtacgtgagcagtggcggtgggtttgggcctgtggcagacgacggctacggtgtaagttatatattggttggagaaaatctgatcaacttccatatcagcagcaaattttcctgtcccgaaactggcataatttctcagggtcctagcagcgacacctag

SEQ ID NO: 181694 - DNA, 2322 bp, Artificial Sequence
  Description of Artificial Sequence: Synthetic coding sequence
atggccgaggcccaccaggccgtggccttccagttcaccgtgacccctgatggtatagacctacgactgtcccatgaggcattgaggcagatctacctgtccggacttcattcatggaagaaaaagtttatacggtttaaaaacggaatcattactggggtgtacccggcttccccaagcagctggttaatcgtggtggttggcgtaatgaccactatgtatgccaagatcgaccctagcctgggcatcattgccaaaataaataggacactcgaaaccgcaaactgtatgtcgtcccagacaaaaaatgtggtaagcggagtgctgttcgggactggcctctgggtggcactgatcgtgactatgaggtactctctgaaagttttactgagctatcatggttggatgtttacagaacatggcaagatgagcagggcaactaaaatttggatgggcatggtcaagatattctcgggtcgtaaacctatgttgtacagctttcagacaagcctgccgagacttccagttcccgctgtgaaggacactgtgaacagatatctgcaatctgtgcgacccctgatgaaggaggaagattttaagcgtatgactgccctcgctcaggactttgctgttggactcggaccacggttacagtggtacctgaagcttaagtcttggtgggctaccaactacgtgtccgattggtgggaagagtatatttatctgcgagggagaggcccccttatggtcaactcaaattattatgccatggatctcctgtatatcctgccaacacacatccaggccgcccgcgcaggcaacgcaattcatgccatacttctttacaggcggaagctggacagggaggagattaagcccattcgactgctcgggtcgacaatccctctgtgtagcgcgcagtgggagcggatgtttaatacaagccgaattcctggggaggagaccgataccatacagcacatgcgagactctaagcacatcgtggtctatcaccggggacgctatttcaaggtgtggctctaccatgatggccgcctgctgaaaccacgagagatggagcagcaaatgcagagaatcctagacaacactagtgagccacagcccggcgaggcacggctggccgccctgaccgctggcgacagagtgccgtgggcccgttgcagacaggcatattttggccgggggaaaaataagcagagtcttgatgctgtggaaaaggccgcctttttcgtgacgttggatgagaccgaagaggggtacagaagcgaggatccagataccagcatggactcttatgccaaatccttattacacgggcggtgctacgatcgctggttcgataagagtttcacattcgttgtttttaaaaacggcaaaatgggtctgaacgccgaacacagctgggcagatgcacccatagtggctcatctgtgggaatatgttatgtcaatcgatagcctgcagcttggctacgctgaagacggacactgcaagggggacattaacccaaacataccgtaccccacaagactgcagtgggatattccaggcgagtgtcaagaggtaatcgaaacaagcctgaacaccgctaatctgttagcaaacgatgttgacttccactcttttcctttcgtcgccttcggaaagggaattataaaaaagtgccggacctccccggacgccttcgtgcaactcgccctgcagctggcccactacaaggacatggggaagttttgtctcacttatgaagcttctatgactagactgtttagggaaggccgtacagaaactgtgcgatcatgtacaaccgaaagttgtgactttgtcagagccatggtggatcctgcacagactgtggagcagaggctcaagctgttcaagctcgcctcagagaaacaccagcatatgtatcgcctggccatgaccggatccggaatcgaccggcacctgttctgcctttacgtagtgagtaaatacctggccgtggagtccccgtttttgaaggaggtgctgtccgagccatggaggctttctacaagtcagactcctcaacagcaggtggaactgtttgaccttgaaaataatccggagtatgttagctctggtggcggatttggacccgttgcagacgacggatatggcgtctcctacatactggtgggcgaaaacctcatcaattttcacatttccagtaaattcagctgtcctgagacagatagccaccggttcggacggcacctgaaagaagcaatgacagacattatcactctcttcggtttatcgagcaactctaagaaatag

SEQ ID NO: 181695 - DNA, 2322 bp, Artificial Sequence
  Description of Artificial Sequence: Synthetic coding sequence
atggccgaggcccaccaggccgtggccttccagttcaccgtgaccccagacgggatagacctgagattgagccacgaagctttgcggcaaatttacctttctggactgcactcctggaaaaagaaatttatacggttcaagaatgggatcataactggtgtatatcccgcttccccaagctcctggctgattgtagtggtgggtgtgatgaccaccatgtacgctaaaatagacccgagtctcggcataatcgccaagatcaacaggactctagagacagcgaattgcatgtcatctcagacgaaaaacgtggtgagcggcgtgttattcgggacggggttatgggtggctctcatcgtgacaatgaggtactcacttaaggtactcttatcttatcacggttggatgttcaccgagcatggcaagatgtcccgcgctactaagatttggatgggaatggtgaagatctttagtggcaggaaacccatgctgtactcttttcagacttctttgcctcgcctgccagtccctgcagtgaaagatactgtaaaccgctatctgcagagcgtgagacctctcatgaaagaggaagatttcaagcggatgaccgcgttggcccaagacttcgctgtaggcctggggcctagactccagtggtaccttaaactgaaatcgtggtgggcaacaaactacgtgtccgactggtgggaagagtacatctacctgaggggacgcggtccccttatggtgaacagtaactactacgcgatggacctcttgtacatcctccccacacatatccaagccgcacgcgctggcaatgccatccatgccatacttttatatcgtcgcaagcttgatagggaggaaatcaagccaattcgcttgttggggtcaacaatacccctatgcagtgcccaatgggagcggatgtttaataccagcagaattcccggagaggaaactgacacgattcaacacatgagggactctaagcacattgtcgtgtaccatcgcgggcggtatttcaaggtctggctatatcacgacggacggttgctgaagccacgagaaatggaacaacaaatgcagcgaattctggataatacctcagaaccccagcccggcgaggccagattggctgccctgacagcaggggatagggttccatgggcccgctgcaggcaggcttattttgggaggggtaaaaataagcagtctctggacgccgtcgagaaggcagccttttttgtgaccttggacgaaaccgaggagggctataggtctgaggatccagataccagcatggatagctatgcgaagagcttactgcatgggcgttgttatgacaggtggttcgataaaagcttcaccttcgtggtttttaaaaacggaaaaatgggcttgaatgctgaacacagctgggcggatgctccgatagttgcgcacctatgggagtacgtcatgagcattgattcactgcagcttgggtacgctgaggatggacactgtaagggggatatcaatcccaacatcccatacccaacaaggctccagtgggacatccccggagaatgccaggaagtgattgagacaagcttgaatacagcaaatcttcttgctaacgatgttgactttcattccttcccctttgtggcatttgggaagggcattataaaaaagtgtcggacatcacccgatgcgtttgtccagctggccttacaacttgcccactataaggatatggggaagttttgcctcacttacgaagctagcatgacgcgcctgttccgcgaaggccggaccgagacggtacgctcctgtactacagagagttgcgacttcgtccgcgccatggttgatcctgcacaaaccgtggaacagcgcctaaaactcttcaaattagcatccgagaaacaccaacacatgtatagactagccatgactggcagcggtatcgatcgccacctcttctgcctgtatgttgtgtcaaaatatctggcggtggagtctccattcctaaaggaagtgctgtccgagccatggagactctcaacatcccagacaccacagcaacaagtcgagctgtttgatcttgagaataaccctgagtatgtttcttctggcggaggattcgggccggtggcagacgacggttacggagtatcctacattcttgtgggcgaaaatctcattaatttccatatctccagcaagttcagttgcccggaaaccgactcgcaccggtttggcagacacctgaaggaagccatgaccgatatcatcactctgtttggattgagctctaacagcaaaaaatag

SEQ ID NO: 181696 - DNA, 2271 bp, Artificial Sequence
  Description of Artificial Sequence: Synthetic coding sequence
atggccgaggcccaccaggccgtggccttccagttcaccgtgacccctgatggtatcgatcttaggttgagccacgaggccctccggcagatctacctgtctggcctacactcctggaaaaagaaatttatacggttcaagaatgggattataactggcgtgtatccggccagtccatcctcttggctgatagtcgtagttggtgtgatgacaaccatgtatgctaagattgaccccagcctgggcatcatcgcgaagatcaatagaactttggagacagccaactgcatgtcctcacagactaagaatgtggtcagtggcgtcttgttcggtactggactatgggtagcactgattgttaccatgcggtacagcctcaaggtcttattgtcgtaccacgggtggatgtttaccgaacacggtaaaatgtcacgggccactaaaatctggatggggatggttaagattttttcgggccggaagcccatgttgtatagctttcagacaagtctgcctagactcccagtgcctgctgtgaaggatactgtgaatcggtatctccagagtgtgagacctctcatgaaagaagaggattttaagaggatgaccgctcttgctcaggattttgccgttgggcttggccctcggctgcagtggtacctgaaactcaagagctggtgggcaactaattacgtcagtgattggtgggaggaatacatctatttaaggggccggggcccgctaatggtgaattccaattattatgcaatggacctgctgtatatcttacctacgcatatacaggccgccagggcaggcaatgctatacacgccatcctgctttatcgacgcaagctagatcgcgaggaaatcaaaccaatccgactgcttggatctacaatcccactttgttccgcccagtgggagagaatgtttaacacatctaggatccccggggaggaaactgatacgattcagcacatgagggacagtaagcacattgttgtctatcacagaggaaggtacttcaaggtatggctataccacgacgggcggctcctcaagcctcgggagatggagcagcagatgcagaggatcctggacaacacctcggaacctcagcctggcgaagcacggctcgccgctctgacggctggcgatagagttccttgggcccggtgccgccaggcctattttggacggggcaagaataaacagtcactcgacgctgttgagaaggccgccttcttcgtaactctggacgagacagaagaaggttataggtccgaggaccccgacacctccatggatagctatgccaagtccctactgcacggccggtgctatgataggtggttcgataagagcttcacctttgtagtgtttaaaaatgggaagatgggactcaatgccgagcatagctgggccgacgcccctatcgtcgcccatctttgggaatatgtcatgtcaattgacagcctgcagcttgggtacgcggaggatggccactgcaagggggacatcaaccctaatatcccatacccaactcgcctgcagtgggatattcccggagagtgtcaggaggtgattgaaaccagtctgaacaccgctaatctgctggctaacgacgtcgatttccacagcttccctttcgtcgccttcggcaaggggatcatcaaaaaatgtaggacttcccccgatgcctttgttcaactcgctctccagttagcccactataaggacatgggcaagttttgtctgacctatgaagccagcatgacaaggctgtttagagaaggccggactgaaactgtcagaagctgtactactgaatcatgcgactttgtaagagcaatggtggaccccgctcagacagttgaacagcgcctcaagcttttcaaactcgcctctgagaaacatcagcacatgtatcgcctggcaatgaccggctctgggatcgataggcatctgttctgcctttacgtggtgagtaagtaccttgccgtggagtcacccttcctgaaggaggttctgtctgaaccttggcgcctgtcgacttcccagaccccccagcagcaggtcgagcttttcgacttggaaaacaacccagagtacgtgtcatccggtggggggtttggacctgtggcagatgacggatatggtgttagctatattctggtcggtgagaacctgattaactttcatatctccagtaagtttagttgtccagaaactgggataattagccagggtcccagctccgatacctag

SEQ ID NO: 181697 - DNA, 2319 bp, Artificial Sequence
  Description of Artificial Sequence: Synthetic coding sequence
atggccgaggcccaccaggccgtggccttccagttcaccgtgaccccagacggggtggactttagattgtcaagagaggcactgaagcacgtctatctgtcaggcattaactcctggaagaagcgacttattaggatcaagaatggaatcttgcgtggcgtttacccaggcagccctactagctggctcgtcgtgataatggcaacggtcgggtcctctttttgcaatgttgacatctccctgggccttgtgagttgcatccagagatgcttaccacaggggtgcggtccttaccagacaccacagacgcgggcactgctttcaatggcaattttttcgaccggcgtgtgggtgaccggaatcttcttttttagacagacattgaagctcctgttatgttaccacggctggatgttcgagatgcacggcaaaacctccaatctgactagaatctgggctatgtgtatccgcctgctgagttctcgccatcctatgctctatagctttcagacatcgctaccaaaactgccagtaccccgtgtcagcgccacaatccagcgctacctggagagcgtgcggcctctactggatgatgaagagtactatcgtatggagctgctcgccaaagaattccaggacaaaacagcgcccaggctgcagaaatacctcgtgctgaagagctggtgggccagcaactacgtttcagactggtgggaagagtatatatatctccgcgggaggtctcccctcatggtcaattccaattactacgtgatggacttggtgctaattaaaaacaccgatgtgcaggccgctcgcttaggcaacatcatacatgccatgataatgtataggagaaagctagaccgtgaggaaattaagcccgtaatggccctgggaattgtgcctatgtgtagttaccagatggaacggatgttcaacactacccgaatcccaggaaaagacacggacgtcttgcagcacctgtcagatagccggcatgtggccgtgtatcataaggggagattttttaaactatggttatatgaaggggcccgcctcctgaagccccaagacctggagatgcagtttcagaggatcctggacgacccatcgcccccccaacctggggaggagaaattggccgccctcacggccggcggacgcgtcgaatgggcccaagcacgacaggcatttttctcatcaggtaagaacaaggcagcactggaagccattgaaagagcggctttttttgtggctctcgacgaagagagttatagctacgatcctgaggatgaggccagcctatccctctacggcaaagctctcctacacggcaactgctacaatcgctggtttgataagagttttactctgatcagctttaagaatggccagctgggactcaatgctgaacatgcttgggccgatgcccccattattgggcatctttgggagttcgttctgggaacagattcgttccacctcgggtacaccgagactggtcattgcctgggcaaacccaatcccgccctggctcctcctacaaggctgcagtgggatatccccaagcaatgccaggctgtcatcgaatcatcatatcaagtggcgaaagcgttggccgacgatgttgaactttactgcttccagtttctcccgtttggcaaaggattaatcaaaaagtgtagaacctccccagacgccttcgtccagatagctctgcagctggcccactttcgagatagaggcaagttctgtcttacctacgaggcaagtatgacacggatgttccgagaaggcagaacagagaccgtccggtcgtgcacatccgaaagcacggccttcgtccaggctatgatggaaggatcccacactaaagctgatttaagagatctcttccagaaggctgccaaaaaacaccaaaacatgtatcggttggctatgacaggagctggaattgaccggcacttattctgcctgtacctcgtgtctaagtacctaggtgtcagttccccattccttgccgaagtgctgtcagagccatggcgcctgtccacttcccaaattccccagagccaaattcgcatgttcgaccctgagcaacaccctaaccacctcggagccggcggcggatttggccccgttgctgacgatggatacggggtgagctatatgatcgccggcgagaacactatctttttccacatctcttccaagttttcatcgtcagagaccaacgcacagaggtttggcaatcacatcaggaaggccctcctcgatatcgccgaccttttccaggtacctaaagcttacagctag

SEQ ID NO: 181698 - DNA, 2319 bp, Artificial Sequence
  Description of Artificial Sequence: Synthetic coding sequence
atggccgaggcccaccaggccgtggccttccagttcaccgtgaccccagatggggtcgactttcgattgtctcgcgaggccctaaaacacgtgtacctttcaggaatcaatagttggaagaagcggctgatacgaattaagaacgggatcctgcgcggcgtatatcctggaagcccaactagctggctggtcgtaattatggctaccgtgggctcctctttttgtaatgtggacataagtctgggattagtttcctgtattcaacgatgtctcccccagggatgcggtccgtatcagaccccgcagaccagagccctattaagcatggccatcttcagcaccggggtgtgggttaccggaatcttttttttccgccaaaccctgaaattgctgctctgctatcacggttggatgttcgaaatgcacgggaaaacttctaatttgactcggatctgggctatgtgtatcaggttactctcctcgaggcaccccatgttatatagctttcagacttctctgcccaagctgcccgtgcctagggtgagcgccaccattcaacggtacctggagagcgtgcggcccctcctcgacgatgaagagtactaccgaatggagcttcttgccaaggaattccaggacaaaaccgcgcctcgcctgcagaagtatctggtgctgaagtcgtggtgggcaagcaattacgtgagcgactggtgggaagagtatatatacctgcgtgggcggtctcccttgatggtcaacagtaattactatgtgatggaccttgtgttgatcaagaataccgatgtgcaggctgcccgcttgggcaatatcatccatgccatgattatgtaccgacgaaagctggacagagaagagataaaaccagtcatggctcttggcatcgtgcctatgtgctcgtaccagatggagcggatgtttaacaccaccaggatcccaggaaaggacacagatgtgttgcagcatctctcggattctcgtcacgtcgccgtttaccataaaggtagattttttaaattgtggctgtatgagggcgcaaggctgctcaagccacaagacctggaaatgcagtttcagagaattctcgacgaccccagccccccccagccaggggaggagaaactggcagctctgacagctggagggcgggttgagtgggcgcaagcacgtcaagctttcttctcttccggaaagaataaggcagccctggaggccatcgagcgcgccgccttctttgtggctttagacgaagagtcttacagctatgaccccgaggacgaggcctccctgtcgctctatggcaaagccctgttgcacggaaattgttacaaccgatggttcgataaaagctttacattaatttccttcaaaaatggccaattaggcctgaatgccgaacacgcatgggcagatgcaccaatcatagggcatctctgggagtttgtgctgggaaccgactcattccatctgggttacactgaaaccggacattgcctgggaaagccgaaccctgccctggccccccctacgcgccttcagtgggacattcctaagcagtgccaagcagtcatcgaatcatcttaccaggtcgcgaaggcccttgcagacgatgtggagctctattgtttccagttcctcccttttggtaagggcctgataaaaaaatgccggacatctcccgatgcttttgtccagattgcattgcaacttgctcatttcagagaccgcggcaaattttgtctgacatacgaggcctccatgacaaggatgtttcgagaggggaggaccgagactgtccggtcttgtacgagcgagtcaactgcctttgtgcaggcaatgatggagggtagtcacactaaagcggacctccgtgacctgttccagaaagcagccaagaaacaccagaatatgtacaggctggccatgaccggtgctgggatagaccgacacctgttctgtctttatttggtgtcaaaataccttggagtatccagcccttttttggccgaggtgctatccgaaccgtggcgcctctcaacttcccagatcccgcagagtcagatccgcatgtttgatcccgagcagcatccaaatcacctgggtgccggtggcggatttgggccagtggccgacgacggatatggagtgtcctatatgatcgctggggagaataccatattctttcacattagtagtaagttttcttccagtgagacgaatgcccaaagattcggtaatcacattcgaaaagcacttctggatattgccgacctctttcaagtgcccaaggcttatagttag

SEQ ID NO: 181699 - DNA, 2319 bp, Artificial Sequence
  Description of Artificial Sequence: Synthetic coding sequence
atggccgaggcccaccaggccgtggccttccagttcaccgtgacccctgacggagttgactttcgcctcagtcgggaggccctgaagcacgtctacttgtcagggataaacagctggaaaaaacgacttattaggataaagaatgggatacttaggggcgtataccccggttcccccaccagctggttagtcgtgattatggctacagttgggagtagtttctgcaatgtggacatcagcttaggactggtttcctgcattcaaagatgtctccctcagggctgtggcccctaccagacccctcagacaagagcattgcttagcatggccattttctccaccggcgtctgggttacaggcatttttttcttccggcagacactgaaactgctgttatgttatcatggatggatgtttgagatgcacggaaagacttcaaatctgacgaggatttgggccatgtgcatacgactactgtcttctcgccatcccatgctgtactcctttcagacttcactcccaaaactcccagtgccgcgagttagcgccacaattcaaaggtatctggagagcgtacgaccactgcttgatgacgaagagtactaccggatggaactccttgccaaggagttccaggacaagaccgctccacggctccagaaatacctagttttaaagtcttggtgggccagcaactacgtctcagactggtgggaagaatatatatatctgaggggacggagccccttgatggtcaacagtaactattacgtcatggacctcgttttgatcaagaataccgatgtgcaagctgccagactgggaaatatcatccacgccatgataatgtatcgacgcaagcttgatagggaagaaatcaaacccgtaatggctttggggatcgtccctatgtgttcctatcagatggaacgtatgttcaacaccaccagaatcccaggcaaagacacagatgtcctccaacatctttcagattctcgccatgtggccgtgtatcacaagggccgattcttcaagctatggctgtatgaaggtgcaagactgttaaaaccccaggatctggagatgcagttccagcgaattttagacgacccctcaccccctcagccgggcgaagagaaactagctgctctaacagccggcgggagagtggaatgggcgcaggccaggcaggcgtttttttcatccggcaaaaacaaggccgcccttgaggctattgagcgggccgctttctttgtcgctttggacgaggaaagctattcatatgaccctgaggatgaggcctcattatccctgtacgggaaggctctgctccatgggaattgttataaccgctggtttgacaagagtttcactttaatttcattcaaaaacggacagctggggctcaacgccgagcacgcttgggcagatgccccgattatcgggcacctgtgggagttcgtcttgggtactgatagcttccaccttggttacaccgagacgggacactgcctgggcaagccaaacccagccttggccccacccactagactgcagtgggatatccccaagcagtgtcaagccgtcatcgagtcatcatatcaagtggcgaaagcgctcgccgacgatgtggaactttattgcttccagtttctaccttttggtaaagggcttattaaaaagtgcaggacaagccccgacgcctttgtacagatagctctgcaactcgctcacttccgcgatagggggaagttctgcctgacctacgaggccagcatgaccagaatgtttagggagggccggaccgaaacagttaggtcctgtacgagcgagtcaacagccttcgtgcaagccatgatggagggcagccacaccaaagccgacctgagggacctcttccagaaagctgccaagaagcatcagaatatgtataggctggcaatgaccggagctggcatcgatagacacttattttgcctgtacctcgtttcaaaataccttggcgtgtcaagcccattcctggccgaagttttgagtgagccctggaggctgtcaacttcacagattccacagagccaaatccggatgttcgaccccgagcagcaccctaatcatctaggtgccggaggtgggttcgggcccgtcgccgacgacggctacggcgtgagttatatgattgctggtgagaataccatcttttttcacatcagtagcaaattcagtagttcagaaacgaatgcccaacgatttgggaatcatatcagaaaagccttgctggatatcgccgacctgtttcaggtacccaaagcctattcctag

SEQ ID NO: 181700 - DNA, 2319 bp, Artificial Sequence
  Description of Artificial Sequence: Synthetic coding sequence
atggccgaggcccaccaggccgtggccttccagttcaccgtgacccctgatggtgtcgattttcgcctatcccgcgaggctctcaaacatgtttaccttagtggaattaattcttggaagaagagactgataagaatcaagaacggtattctgagaggagtttatccaggtagtcctaccagctggctggtggtgattatggcgacagtcggctcctcattctgcaatgtggatatatcccttgggctggtgtcctgcatccagcggtgcctgccccagggctgcggtccctatcaaaccccccaaacacgcgcccttctgagcatggccatcttctcgactggcgtgtgggtgaccggcatttttttcttccgtcagactttgaagttgctgttatgctatcacggctggatgttcgaaatgcacggcaaaacttccaacttgacccggatttgggccatgtgtatccgcctgttgtcctcaaggcaccccatgttgtatagcttccaaacatccttgcccaagctgccagtgcccagggtcagtgccactatccagcggtatttggagagcgtgcgccccctcttggacgacgaggagtactatcgcatggagttgctagcaaaagagttccaggacaagaccgctccacggctccagaagtatttagtactgaagtcatggtgggcatctaactacgtgagtgactggtgggaagagtacatttatctgcggggacggagcccactcatggtgaatagtaactattacgtcatggacctggtgctgatcaaaaatacggacgttcaggccgccaggctgggcaacattatacacgcaatgattatgtatcggcgcaagctggaccgggaggagatcaagccggtgatggcactcggcattgtgcctatgtgtagctaccaaatggaacgtatgttcaacaccacccgcattccagggaaggataccgatgtgctgcagcacctctccgacagtagacacgtggccgtgtaccacaaaggacgcttctttaagctgtggctgtatgagggggctcggttgctcaaacctcaagacctagaaatgcagttccagcggatcctggacgacccctcccccccacagccaggcgaagagaagttagcagcactgacagcaggagggcgagttgagtgggcccaggcccgacaagcctttttctctagcggcaaaaataaagcagctctggaagccattgagagagctgcattttttgttgctttggacgaggagagctacagctacgatccagaagacgaggcgtccctgtccctgtatgggaaggccttactgcacggtaactgctacaatcgctggttcgataaatcatttactctgattagcttcaagaacggtcagttaggcctcaacgcagagcacgcatgggccgacgctcccataattggccacttgtgggagtttgtacttgggaccgacagtttccatttgggttatacagaaactggacactgtcttggcaaacccaatcctgctctggctccacctacaagactgcagtgggacattccgaagcagtgtcaggccgttattgagtcgtcctaccaggtggctaaggcactcgctgacgatgtcgaactgtactgctttcagtttctgccctttggcaaaggcctgatcaagaaatgtcgtaccagtcccgatgcattcgtgcaaatagccctccaattggcccattttcgcgacagaggcaaattttgcttaacttatgaagcctcaatgacaaggatgttcagagaaggaaggacagaaaccgtacgttcttgtacttcggagagcacagcttttgtgcaggccatgatggagggttctcatacgaaagccgacctacgagatctttttcagaaggccgccaaaaagcaccagaacatgtacaggctggctatgacaggggcaggaatcgaccgccatttgttttgtctgtacttggtcagcaaatacctcggcgtctccagcccctttctggcggaggtgctctctgaaccttggagactatcgacctcccagatcccccagtcccagatcagaatgtttgacccagagcaacatcccaaccacctcggcgccggtggcggattcgggcccgttgcggatgacggttacggcgtgtcctacatgattgccggcgaaaacactatcttcttccacatctcctctaagttcagttctagtgagaccaacgcgcaacgtttcgggaatcacatccgcaaagcactcctggacatagctgacctttttcaggtgcccaaggcctacagctag

SEQ ID NO: 181701 - DNA, 378 bp, Artificial Sequence
  Description of Artificial Sequence: Synthetic coding sequence
atggccgaggcccaccaggccgtggccttccagttcaccgtgacccccgacggagtcgatttccgcttgtctcgtgaagcgctcaagcacgtgtatctctctggaatcaacagctggaaaaagaggctcatcagaattaaaaatggcattttaagaggtgtataccctggatcacccacgagctggcttgtcgtcattatggcaacggtcggcagttcattctgtaatgtggatatatcactgggtctggtttcttgtatccaacgctgcttacctcagggttgtgggccataccagacaccccaaactcgggccctgctaagcatggctattttctccacaggcgtatgggtcactggtatattcttcttcaggtag

SEQ ID NO: 181702 - DNA, 1704 bp, Artificial Sequence
  Description of Artificial Sequence: Synthetic coding sequence
atggagctgctggccaaggagttccaggacaagaccgccccccggctgcagaagtatctcgtcctgaaatcctggtgggctagcaattatgtctctgattggtgggaggaatatatttatctacgaggaagaagccctctgatggtgaacagtaattattacgtgatggatcttgtgctgatcaaaaacaccgatgttcaggccgcacgattaggcaatatcatccatgctatgatcatgtatcgcagaaaattagatagggaggagattaagcctgtgatggccttaggcatagtcccgatgtgctcttaccagatggagcgaatgtttaataccactcgaattcctggcaaggacaccgacgtcctgcaacacctatctgatagtaggcatgtcgccgtttaccacaaggggcggtttttcaaactgtggctgtacgagggcgcaagactgcttaaaccccaggacctggagatgcagtttcagagaatcttagatgacccatctccaccccagcccggcgaggagaagctggccgctctcaccgctgggggtcgagtggagtgggcccaagcccggcaagcctttttctcctccggcaaaaataaggctgcattggaggctatcgaaagagccgcttttttcgtggcactggatgaggagtcttatagctatgatcctgaagacgaagcctccctgtccctctacggcaaagctctgctccatggaaactgttataacaggtggtttgacaagagctttaccctgatctccttcaagaacgggcaacttgggctgaatgcggaacacgcctgggccgacgcaccaataatcggacacctgtgggagttcgtgcttggaaccgactcttttcacctcgggtataccgagaccgggcattgtctgggaaagcccaaccccgccctggcacctcccacacgtctccagtgggacatcccaaaacaggccgttatagagagctcctaccaggtcgccaaagcacttgccgacgacgtcgaactgtattgcttccagtttctgccgttcggcaaaggattgattaagaagtgtagaactagtcctgacgcttttgtgcagatcgccctgcaactggcacactttcgggatcgggggaaattttgcctgacctatgaggcttccatgactaggatgttccgggaaggacgcactgaaactgtacggagttgcacctccgagtccacggcattcgtgcaggccatgatggagggttctcataccaaggcagacctgagggacctcttccagaaggccgcgaagaaacaccaaaatatgtaccggcttgccatgaccggcgccggcatcgatcggcacctgttttgtttatatttggtaagtaagtacctgggggtgtcttctccgttcttggctgaagtactgtccgagccgtggcgactcagtacgagccaaattccccaatcccagatccggatgtttgacccggagcagcaccccaatcatcttggcgccggaggtggctttggtcctgtggctgacgatgggtatggggtttcatatatgatcgccggagagaatacaatcttctttcacatatcctccaaattctccagcagcgaaactaatgcccaacgtttcggaaatcatatcaggaaagcgctactagacatcgcagacctttttcaggttcccaaggcttactcttag

SEQ ID NO: 181703 - DNA, 2076 bp, Artificial Sequence
  Description of Artificial Sequence: Synthetic coding sequence
atggccgaggcccaccaggccgtggccttccagttcaccgtgaccccagacggcgtggatttcagactgtctagagaggccttgaaacacgtgtacctgtcagggattaatagctggaagaaacgactgatccgaatcaagaatggcatcttgcgcggagtgtatccaggtagccccaccagctggttagtggtgataatggccaccgtaggcagctcattttgtaatgtcgacattagtctgggtctagtatcttgcatccaaaggtgcctcccacaaggttgtggcccctatcagacccctcagaccagagccctgctgagcatggcaattttctcaacaggcgtatgggtgactgggatcttcttcttcaggcagactttgaagctgttgctgtgctaccacggatggatgttcgagatgcatggcaagactagtaacctgacacgcatttgggccatgtgcataagactgctgagctctagacaccccatgctgtacagcttccagacatcgctgcctaaacttcctgtcccgcgggtatcagccaccatacaaagataccttgagtcggttcggccccttctagatgatgaggagtattatcggatggagctgctagccaaagaatttcaggacaagactgcccctagactccagaagtacttagttttgaaatcatggtgggcctccaactacgtgtccgactggtgggaggagtatatctatctgcgcggcaggagtcccctgatggtgaatagcaactactatgtgatggatttagttctgatcaaaaatacggacgtgcaagctgcaaggctgggcaatataatccatgctatgataatgtatcggagaaagctggaccgggaggaaatcaagcccgtgatggctctggggattgtgccaatgtgcagttaccagatggaaagaatgttcaacactacaagaatccctggaaaagacacggatgtcctgcagcatttgtccgactcgcggcatgtggccgtctaccacaagggacggttcttcaagctgtggctctacgaaggagcaagattgctgagtttgtatgggaaggctctgctgcatggcaactgctataaccggtggttcgataagagctttacactgatttctttcaagaacggacagttgggactgaacgcagagcacgcctgggccgatgctccaattattggacatctgtgggagtttgtcttgggaactgactcctttcacctggggtacactgagacggggcattgtctgggcaagccaaatcccgcactcgccccccctacccgactccagtgggacatacccaagcagtgccaggccgtgatagagtcttcttatcaggtggccaaggcgttggccgacgacgtggagctttactgtttccagttcctcccttttgggaagggactcataaaaaagtgtcggaccagccccgacgcattcgtacagatcgcactccagctggcacatttccgagatcgtggaaaattctgcctgacttacgaagcctccatgaccagaatgtttagagagggcagaactgagacagtgcgaagttgtacttccgagagtaccgcgtttgttcaggccatgatggaaggaagccacacaaaagctgacctgcgtgaccttttccagaaggccgctaagaagcaccagaatatgtatcgcctcgctatgactggggcagggatcgataggcacctgttctgtctctacctggtgagcaaatacctgggcgtcagtagtcccttcctcgccgaagttctgtctgaaccttggcggcttagcacttcgcagatcccccagagccagatccgtatgttcgatcccgaacagcaccccaaccacctgggagctgggggagggttcgggcctgttgctgacgatggatacggagtttcatatatgattgcaggcgagaacactattttctttcatatctcttcaaagttctcttcatccgagaccaatgcgcagcgctttgggaaccacatcaggaaagctcttctcgacattgcggacctgttccaggtgcctaaggcttattcttag

SEQ ID NO: 181704 - DNA, 2217 bp, Artificial Sequence
  Description of Artificial Sequence: Synthetic coding sequence
atggccgaggcccaccaggccgtggccttccagttcaccgtgacccccgatggtgttgattttcgactctctcgggaggcgttgaaacacgtctacctgagcggcatcaactcatggaagaagcgcctgattcgtattaaaaatggtatactgcgaggcgtgtaccccggaagtcccaccagttggctggtcgttatcatggcgaccgtcggctccagcttctgcaacgtcgacattagccttggacttgtatcttgcattcagaggtgtctgccccagggatgtggcccctaccaaacaccacagactagagcacttttgagcatggctatattttcaacaggagtgtgggtaacaggcatcttcttcttcagacagaccctgaaattgctgctgtgctaccatggatggatgttcgagatgcacggtaagaccagcaacctgactagaatttgggcctatctggaatccgtccggccgctactggacgatgaggaatattacaggatggagctgttagctaaggagttccaggataaaactgctccccgcctgcagaaatacctggtgctcaagagctggtgggccagtaattacgtctctgactggtgggaggagtacatctatcttagaggtcgcagccctctaatggtcaactccaattattatgtgatggacctggttctcatcaagaacacggacgttcaggcagctagactgggcaatatcatccacgctatgatcatgtaccggcggaaactggaccgtgaggagattaagcctgttatggccttggggattgtgcccatgtgcagctaccagatggagagaatgttcaacaccacacgtattcctggcaaagacaccgacgtcctgcagcatctgagtgattcccgacatgtcgccgtatatcataaaggccgcttctttaaattatggctgtatgagggcgctcgcctgctaaagccacaggatctcgagatgcagtttcagagaattcttgatgatccctcccctcctcagcccggagaggagaagctcgccgccctgacggcaggcggacgcgtcgaatgggctcaggctagacaagccttcttcagctccgggaagaacaaggccgcactggaggctatcgagagggccgcctttttcgtggctctcgatgaggagagctattcctacgacccggaggacgaggctagcctctccctctatgggaaggctctgttgcatgggaactgttataaccgctggttcgataagtcctttacattaatctccttcaaaaatggccagctgggcctcaacgcagagcatgcgtgggctgatgcaccgatcatcgggcacctctgggagttcgttcttggaacagattccttccaccttggctacacagagacaggccattgcttgggaaagcctaatcccgcactcgcaccaccaacacgcctgcagtgggacatcccaaagcagtgccaagccgtgatcgagtcaagttaccaggtcgcaaaagctttagctgatgacgtggagctgtattgcttccagtttctgcccttcggtaagggattaatcaaaaagtgcaggacctcaccagatgcattcgttcagattgccctgcagttggcgcacttcagggatcgggggaaattttgcctaacctatgaggcctccatgaccagaatgtttcgcgagggcagaaccgagacggtcaggagttgcacctctgaaagcaccgcctttgttcaagctatgatggagggatctcataccaaggcagacctccgtgatctctttcagaaagcggccaagaaacaccagaacatgtataggctagccatgactggcgccggcatcgacagacatcttttttgcctgtatcttgtaagtaaatatctgggcgtaagcagtccctttctggccgaagttctgtcagagccttggaggttgtctacttcacagattcctcagtcccagattcgtatgtttgacccagaacagcaccctaaccatctaggagcaggtgggggtttcggacctgtagcagacgatggctacggggtgagctacatgattgccggagagaacacaatctttttccatatttcctccaaattttcttcatccgaaacaaatgctcagcgctttgggaatcacattcggaaggctctgttggatattgcagatctttttcaagtccccaaggcatatagttag

SEQ ID NO: 181705 - DNA, 1458 bp, Artificial Sequence
  Description of Artificial Sequence: Synthetic coding sequence
atgctgttcagctaccagcggagcctgccccggcagcccgtgcccagcgttcaggataccgtgagaaagtatttggagagcgtaaggccaattctgagcgatgaggattttgactggaccgccgtgctcgcccaggagtttctaaggttacaggcctccctcctgcagtggtacctccgactgaagagttggtgggccagtaactatgtttccgactggtgggaggagttcgtctatttgcggagtagaaacccacttatggtaaatagcaattattatatgatggatttcctgtatgtgacccctacaccactgcaagccgcccgcgccggcaacgcagttcatgccctgctactgtatcggcatcgcctgaacaggcaggaaattcccccagtgcgcggcccacagtgggtccgcgacggcggtgttgtattatggcccttagggcacgtagggcccggtagacagctcactgcccacggtttcctccagacactcctcatggggatgcgtccattgtgctccgcccaatatgaaaagatcttcaacacaacccgcatccccggggtgcagaaagactacattaggcacctgcatgactctcaacacgtagctgtgttccaccgagggcgattctttcgtatgggcacccattcccggaatagcctgttgtcccctcgtgctctggaacagcagtttcagcgcattcttgacgatccaagtcctgcatgcccacacgaggaacacctggcagcacttacggccgcccctaggggcacctgggcgcaggtgcggacatcactgaaaacgcaggcagccgaggcacttgaggctgtggagggcgctgccttcttcgttagtttagacgccgaacctgccggtctcaccagagaagaccccgccgctagcctcgacgcctatgctcacgcccttcttgctggaaggggccacgacaggtggtttgataagtcttttacattaattgtattctccaacggaaagttgggactcagtgtagagcatagctgggccgattgtccaattagcggccatatgtgggaattcactctggccacagaatgcttccagcttggctattctaccgatggacattgcaaggggcatccagatcccactctgccccaaccacagcgactgcaatgggacctgcctgatcagatccatagttctattagtctggcgctgagaggagccaaaattctcagcgagaatgttgactgtcatgtggtgcctttcagcctgtttgggaagagttttattcgaaggtgccacctgtcatctgacagctttattcagattgcacttcaactcgcccactttagagtcagctgggtgccgcacccccagccaccgcaggggctatcccctcctgaaccaccccgccccgcccctccccgcttcctagttgtcgccgccatcgttggccggccctcctag

SEQ ID NO: 181706 - DNA, 2412 bp, Artificial Sequence
  Description of Artificial Sequence: Synthetic coding sequence
atggccgaggcccaccaggccgtgggcttccggcccagcctgacctcggatggagccgaagtagagttgagtgctcccgtgctccaagagatttatctcagcggcttgcggagttggaaaaggcatctctcgcgcttctggaatgattttctcacaggcgtcttccccgcaagccccctgagctggttattcctgttcagtgccattcagctggcctggtttttacaactagaccctagccttggactgatggaaaagatcaaggaattgttacctgactggggcggccagcaccatggattaagaggggttttggcagctgccctctttgcaagctgtctctggggggccttaattttcactctgcacgtggccctgcggctactgctgagctaccatgggtggctgctggagcctcacggagctatgtctagtccgactaagacatggctggcgttagttcgaatattttccgggcgacatccaatgctgtttagttatcaaaggtcccttccgaggcagcccgtcccctcagtgcaggacaccgtgagaaagtatctcgagtccgtgaggcccatcctgagtgacgaggattttgattggactgccgtcctcgcacaggaattccttcgcctacaggcctcactgctccagtggtacctgcggctgaagtcttggtgggctagtaactacgtcagtgattggtgggaggagtttgtgtacctgaggtcaagaaacccgctcatggttaactcaaactactatatgatggatttcttgtacgtcacccccactccacttcaagccgcacgcgccgggaacgccgttcatgcgcttctgttgtatagacatagactcaataggcaggagatacctcccacactcctcatgggtatgcgacccctgtgctctgcccagtacgaaaagatcttcaataccacacgaattccgggcgttcagaaggactacattaggcacctccatgactcacagcacgtggccgtcttccacagaggccgcttctttaggatggggacccacagcagaaatagccttctcagtcctagggcactggagcagcagttccagagaattctggacgacccaagtcccgcatgtccacatgaggagcatctagccgcacttacagcagcccctcgtggtacctgggcccaggttaggacaagcctcaagacccaggctgcagaggctctagaagccgtggagggcgcggctttttttgtctccttggatgccgagcccgcaggactgacacgggaagatccggccgcgtccctagacgcatacgctcatgccttgctggcgggcagaggacacgacaggtggttcgataagtctttcacactgatcgttttttcaaacggcaagcttggtttgagcgttgagcacagctgggccgactgtcctatttctggacatatgtgggagtttacattggctaccgagtgctttcagcttgggtactccaccgatggccattgtaaagggcaccccgacccaactctgccccagcctcagcggctccagtgggacctacccgaccagatccacagtagtatttccctcgcattgcggggtgcaaagattctttccgaaaacgtcgattgccatgttgtgccgttctccctgtttgggaaatctttcatcaggcgttgtcatctttcttccgattcgtttatccagattgcactgcagctggctcatttccgagaccggggtcagttttgtctgacgtatgagtctgccatgacccgtcttttcctggagggacgcacagagacggtgcggagctgtaccagagaggcttgtaacttcgtgagggcaatggaggacaaagaaaaaactgacccccaatgtctagccctcttccgggtggctgtcgataagcaccaggcgttactgaaggcggctatgagcggccagggtgtcgatcggcacctgttcgccctgtacattgtaagccggttccttcacttgcaatccccattcctgactcaagtccatagtgaacagtggcagctgagtacctcccagattcctgtgcagcagatgcatttgttcgacgtgcataattaccccgactacgtgagctcgggcggtggctttggccctgctgatgaccacgggtacggggtcagctacattttcatgggcgatgggatgatcacattccatatctcttctaagaaatcctcaacaaaaaccgactcccatagactgggccagcacattgaggatgctctgctggacgtggctagcctgtttcaggcaggccagcatttcaaacgacgattcagagggtcggggaaggagaattcccgccatagatgcggttttctttcccgacagacaggcgcaagcaaagcctctatgacatcaaccgatttctag

SEQ ID NO: 181707 - DNA, 2145 bp, Artificial Sequence
  Description of Artificial Sequence: Synthetic coding sequence
atggccgaggcccaccaggccgtgggcttccggcccagcctgacctcagatggggccgaggtcgagctgtcggcacccgtgctgcaggagatttatcttagcggtttgcggagttggaaacgccatctgtctcgcttttggaacgacttcttgacgggagtgttccccgcatccccactctcctggctgtttttgttctctgctattcagctggcctggtttttgcagttggatccgagcctgggcctgatggaaaaaatcaaggaacttttgcctgactggggcggtcagcatcatggtctgcgcggggtgctagctgccgccctgtttgcctcctgcttgtggggcgccctcatattcaccctccacgtcgctctccggctcttactgtcttaccacggttggctgctcgagccacatggggccatgagttctcctacaaagacttggctagcactcgtgcgcattttctcaggcaggcatcccatgcttttttcctaccaacgcagcttgccccggcagcctgtgcccagtgtccaggacacagtgagaaagtatctggaatcggtcaggcctatcctcagtgacgaggacttcgactggaccgctgtgctggcccaggagttcctgagactccaggcgtcactgctgcagtggtatttgagattgaagtcttggtgggcttctaattatgtatctgattggtgggaagagttcgtgtatctcagatcacggaatcccttaatggtcaatagcaattactacatgatggacttcctctacgtgacacctacccccttgcaagcagccagagccggcaacgctgtccatgctcttctactttataggcaccgactgaacaggcaagagattccgccaacacttttgatgggtatgaggcctttgtgctccgcccagtatgagaaaatctttaatacgaccagaatcccaggtgtccagaaagactacatcagacatctccatgattcccagcacgtcgccgtgttccatagaggtcgattcttccgaatgggcacacactccaggaacagtctcctctctcctcgcgcactggaacagcagttccagagaattctagacgacccaagccccgcctgtccacacgaggaacacctggcggctctgaccgccgctccacgaggcacttgggcccaggtgaggacatctctgaaaacacaggccgctgaagcactcgaggcggtggaaggtgccgctttctttgtgagcctcgatgcagaacccgccggtctaacgagagaagaccctgccgcatctttggacgcgtacgctcacgcattgttagcgggaaggggccatgacagatggtttgacaaatcctttaccctgatcgtgttctctaacggcaagctgggactctccgtcgaacatagctgggcagactgccccataagcggccacatgtgggaattcaccctggccacagaatgtttccagcttggctacagcaccgacggtcactgcaaaggccaccccgacccgacgctacctcagccacagagactgcaatgggatttgcccgatcagattcatagtagcatcagcttggcccttaggggcgccaagattctgtccgaaaacgtagactgtcacgtggtgccgttctcgttattcgggaagtcgtttatcagacgttgccacctgtcttctgattctttcattcagatcgccctacagctagcccactttagagaccgggggcaattttgtctgacttacgaatctgccatgacccgtttgtttctcgaaggaagaaccgagaccgtgcgttcttgtacccgagaggcctgtaatttcgtgcgcgccatggaagacaaggagaaaaccgccgatgaccatggctatggtgtgtcctatattttcatgggtgacgggatgattactttccacatcagctctaagaaaagttcgacgaagaccgactcccacaggcttggacagcatatcgaagatgcgctgctcgacgttgcgtcgttgttccaggccggacagcatttcaagcgcagatttagagggtctggcaaggaaaactccagacatcgctgtggatttttgtctaggcagaccggagcatcaaaggccagcatgacatccacagatttctag

SEQ ID NO: 181708 - DNA, 2412 bp, Artificial Sequence
  Description of Artificial Sequence: Synthetic coding sequence
atggccgaggcccaccaggccgtgggcttccggcccagcctgaccagcgatggggccgaggtggagctgtctgcccccgtgctccaggagatctatctgtcggggctgcggagctggaagcggcacctcagtcgtttctggaatgatttcctcacaggggtgtttccggcttccccactgagttggctttttctgttctctgcgatccagcttgcctggttcctccagcttgatccatcactgggtttgatggagaagataaaagagctgctgcctgactgggggggccagcaccacggattgcggggtgtccttgcagctgctctttttgccagctgtctttggggtgccctgatttttacccttcatgtcgcactaaggctactcctaagctaccacggatggttgttggagccccacggggctatgagcagtcccacaaagacttggctagctcttgtccgaatcttcagcggacgtcatccaatgcttttctcataccagcgaagcctcccaagacagcccgtccccagcgtacaggatacagtgcggaaatatttggagtctgttcgtcctatcttgtctgacgaggactttgattggaccgctgtcctcgctcaagagttcttacggcttcaggcatcattgctccagtggtacctgaggctcaagtcgtggtgggcttctaactatgtcagcgattggtgggaggagttcgtatacttaaggagtcggaatcccctcatggttaattctaactactatatgatggattttctgtacgtcactccgaccccactgcaggccgcccgggcagggaatgcagtccatgcacttctgttgtataggcaccggttgaataggcaggagattcccccaacgcttcttatgggtatgaggccactttgctccgcccagtacgaaaagattttcaacaccactcgtattcctggcgtgcagaaggattatatccggcacttgcacgatagccagcacgtagctgtcttccataggggtcggtttttcagaatgggcacccacagcaggaatagccttctcagccctcgggccttagagcaacaatttcagaggatcctggatgatccttctccagcatgcccccacgaagagcacctcgccgccctgaccgcagccccacgtggtacatgggcgcaagtgaggacttctttaaaaacccaggctgcagaagccctggaagccgttgagggcgctgctttctttgtgtcgttagacgccgagccagccggtcttactagagaggaccccgccgcttctctagacgcgtacgcccacgccttactcgccggcagagggcacgataggtggtttgacaagagtttcaccttgattgtgtttagtaatggcaagctgggattgtcagtagagcattcttgggccgactgtccaatctccggccacatgtgggaatttaccctggccaccgagtgcttccaattggggtattcaactgacggccactgtaaaggtcaccccgaccctaccctccctcagccacagcggcttcagtgggatttgccagatcagattcactcaagcatatcgctcgcattgcggggggctaagatccttagcgagaatgttgattgccacgtggtgccttttagcctattcgggaaaagttttattcgccgatgtcatttaagttctgatagctttatccaaattgccctccagctggcgcactttcgggacagaggccagttctgccttacgtacgagtctgcaatgactagattgttcctggaagggcgtactgaaacagtgcggtcctgcactcgagaggcttgcaacttcgtccgtgctatggaagataaggagaagacagaccctcagtgcctcgcactgttcagggtggcggttgataagcaccaggctttgcttaaagctgctatgtccggacagggggtggacagacatctgtttgctctgtacatagtgtcccggtttctccatctgcagtccccattcctaacccaggtgcactccgaacaatggcagctgtccacatcccagatacctgtgcaacagatgcacctgttcgatgtccataactatcctgactacgtgtcaagcggggggggcttcggaccagcagacgaccatggctatggggttagttacatctttatgggggatgggatgataacattccacataagctctaaaaaaagttccactaagactgattcacaccggcttggtcaacatatagaagacgcgctgttagatgtcgcatccctctttcaggccggccaacactttaagcgccgctttcgagggagcgggaaagaaaactcacgccatcggtgtgggttcctttccaggcagaccggcgcatccaaagcatccatgacatctacggacttttag

SEQ ID NO: 181709 - DNA, 2379 bp, Artificial Sequence
  Description of Artificial Sequence: Synthetic coding sequence
atggccgaggcccaccaggccgtgggcttccggcccagcctgacctccgatggcgcagaggtcgaactgagcgcgcccgttcttcaggagatatatctgagcggactgcggtcttggaagagacacttgtcccggttctggaatgacttccttactggcgtttttcccgcttcaccgctcagctggctctttctgttttctgccattcagctcgcctggttcctgcaactagatccatcattgggccttatggaaaagataaaggaacttctgcctgactggggagggcagcatcatggcctccgtggagtactggcggccgcgctgtttgcctcctgcctgtggggcgctctcattttcaccctgcacgttgccctgaggctactgctgtcttatcacggctggttgctggagccgcacggagcaatgtcttcccctaccaaaacctggctggctttagttcgcatctttagtggccgccacccaatgctcttctcctaccaacgctcactgccgaggcagccggttccatccgtacaagatactgtgaggaagtacctggaaagtgttcgccccatcctgagcgatgaagatttcgactggacggcagtactcgcgcaagaattcttgaggctgcaagcctcactgctccagtggtacctgcggttaaagagctggtgggctagcaattatgtcagcgattggtgggaggagttcgtgtaccttcgctccagaaacccgcttatggttaattcaaattactacatgatggccgccagagctggcaacgcagttcatgccctgctactatacagacataggctgaacagacaggagatccctcctacattacttatgggcatgagaccgttgtgttccgcccaatacgagaagatcttcaacaccactaggataccaggtgtccagaaagattacatcaggcacttgcacgattcacagcacgtggccgtctttcatcgcgggaggttctttagaatgggcacacacagtcgaaacagccttttgtcccccagggcgctggaacagcagtttcaacgaattctggacgaccctagccccgcctgcccgcacgaggagcacctcgcagccttgacagccgcccctcgaggcacctgggcgcaggtcagaacatctttaaagacccaggcggccgaggcgctggaagccgtcgagggcgcagcattctttgtctccctggatgccgagcccgccggtctcactcgcgaagaccctgccgccagtctggatgcttatgctcacgcactgctggccggccggggccacgaccgctggttcgataaatcctttacactgatcgtttttagtaacggcaagctcggcctgagcgtcgaacactcatgggcagattgccccattagtgggcacatgtgggagttcactctggccaccgaatgtttccaactggggtactccactgacggacattgtaagggacaccctgatcccaccttgccccaaccgcagcgcctccagtgggacctgcccgaccagattcactcttctatctccctggcccttaggggcgccaaaattctgtccgaaaatgtggattgccatgtagtccctttctcattgtttggcaagtcctttattagacgatgccacctatcctccgacagcttcatccaaattgctctccagctcgcccattttagagatcgtgggcagttttgcctgacgtatgaatccgccatgacgcgcctcttcctcgaaggacggaccgaaaccgtcaggagttgtaccagggaagcatgcaatttcgtgagagcaatggaggacaaagaaaagaccgatccccagtgtctggcactcttccgtgttgcagtggataaacaccaggcgttactgaaggctgctatgtccggccagggtgtagaccggcacctatttgcactgtacatagtgagcaggttcttgcatctgcagtccccctttcttacacaagtgcatagcgagcaatggcagctgagcacctcccaaattcccgtgcagcagatgcacctgtttgacgtgcacaactacccagattacgtgagctccggcggcgggtttggccctgcggacgatcacggttatggagtttcttatattttcatgggcgatgggatgatcacgttccacatttcctctaaaaagagttctactaagacggatagtcatagacttggacagcacatagaggacgctctcctggacgtggcctccctatttcaggctggtcagcacttcaagcgccgcttccgcggttccggcaaggagaattctcgtcatcggtgcggtttcctttcacgtcagacaggagcatctaaggcttcgatgaccagcacagacttctag

SEQ ID NO: 181710 - DNA, 2412 bp, Artificial Sequence
  Description of Artificial Sequence: Synthetic coding sequence
atggccgaggcccaccaggccgtgggcttccggcccagcctgacctctgacggcgccgaggttgagctgagtgcaccagtcctgcaggagatatacctgtccgggctgcggtcctggaagcgccatctctctaggttttggaacgattttctcacgggtgtcttccctgccagcccactgtcctggctgttcttgttcagcgccatccagctcgcctggttcttgcagctggacccttcccttggtcttatggaaaagatcaaagaactgctgcctgattgggggggacagcaccacgggttaagaggggtgctcgcagctgctctttttgcatcttgtctgtggggggcccttatatttaccctgcatgtggccttaaggctccttctaagctatcatggctggcttctcgaaccccacggtgctatgtcttccccgaccaagacttggcttgcactcgtgagaatctttagcgggcggcacccaatgttatttagctaccagcgaagtctgccaaggcagcccgtgcctagcgtccaggataccgttcgcaaataccttgagtccgtccgccccattctatccgatgaagatttcgattggaccgccgtgctcgctcaggaattcctacgcttacaggcttctctactacagtggtacctgcggctgaagtcatggtgggccagtaactacgtttctgactggtgggaggaatttgtctaccttagaagtaggaaccccttaatggtaaatagcaattactacatgatggacttcttgtatgtcacccccacaccattgcaagccgctagagccggtaatgctgtgcacgctttacttttgtacagacacaggttgaacagacaggagataccccccacattgctgatgggaatgagaccactctgctctgcccagtatgaaaagatttttaacacaactcgaataccaggcgtccagaaagattatattcgccacttgcatgattctcaacacgtcgcggttttccatcgtggacgcttcttccgcatgggcactcatagcaggaactccctgctgagtcctcgcgcgctggaacagcagtttcaacggatcctggacgatccatccccagcgtgtccacacgaggagcacctcgcggccctgacggctgccccccggggaacctgggcacaggtccggacgagcttgaagactcaagcagccgaagcgctggaggcagtagaaggagccgccttctttgtctctctggacgccgaaccggccggtctgacacgagaagatcctgcagcctcgctcgatgcctatgcacacgcacttctcgccggccggggccacgacaggtggttcgataagtcttttaccctcattgtattttctaatggcaagctcgggttatctgtggaacattcatgggccgactgccctataagtggtcacatgtgggagtttacattggccactgagtgttttcagctcggctattcaaccgatggacactgcaagggacacccagatccaaccctgcctcagccccagagattacagtgggacctccctgaccagatccacagcagcatcagtctagctctccggggcgctaaaatcctctcggagaatgtggattgtcatgtagtcccattttcactgtttggcaaaagcttcattcgcaggtgtcacttaagttcagattccttcattcagatcgctctgcaactggctcacttcagagaccgcgggcagttctgccttacctatgagagtgctatgaccaggttatttctggaagggaggactgaaactgtgcgtagctgcaccagggaagcctgtaacttcgtgagagccatggaggacaaggagaaaaccgacccacagtgcctggccttatttagggtggcagtggacaagcaccaggctttgctgaaggcagctatgtctggtcagggcgtagaccgccaccttttcgctctctacatcgtatcacgttttcttcatttgcaaagcccttttctgactcaagtgcacagtgaacagtggcagctgtccacctctcagatccccgtgcagcagatgcatttgttcgatgtgcacaattaccctgactacgtgtctagtggcggagggtttggacccgcagatgatcacggatatggcgtgtcttatatttttatgggagatggtatgatcaccttccacatatcttctaagaagtcttcgaccaagaccgactctcaccggctgggacagcatatcgaggatgcccttctggatgtggcttccctcttccaggccggacagcattttaagaggaggtttcgaggctcaggcaaagaaaacagcaggcaccggtgcggattcctgtccagacagactggagcctccaaggcttcgatgacgagtacagatttctag

SEQ ID NO: 181711 - DNA, 1524 bp, Artificial Sequence
  Description of Artificial Sequence: Synthetic coding sequence
atggaccccaagctgggccggatggccgccagcctgctggccgtgctgctccttctattggagagagggatgttctcttctccttcaccccctccagcgctcctcgagaaggtgttccaatacatcgatctccatcaagacgagtttgtacaaacgctgaaagagtgggtggccatcgaatctgactctgtccagccggttccgaggttccggcaggagctgttccggatgatggccgtcgccgcggataccctgcagaggctcggagcccgagttgccagtgtggacatgggccctcagcagctgcccgatggccaaagtctgcctatccctcccataattttggctgagctgggtagtgaccctaccaaaggaaccgtgtgcttttacgggcatttagacgttcagcctgccgatcggggtgacggatggctcaccgacccctatgtgctgaccgaagtagatggcaaactctatgggcggggtgccactgacaacaagggcccagtgctggcatggattaatgctgtaagcgccttccgagctcttgagcaagaccttcctgttaatatcaagttcatcatcgaggggatggaggaagccggttccgtggccttggaagaactggttgagaaggaaaaagaccgcttctttagtggcgtggattacatcgtcatttccgacaatctttggattagccagcgaaagccagcgatcacctatgggacaaggggaaatagctacttcatggtcgaggtgaaatgcagggatcaagactttcatagtggcacctttggaggtatactgcacgaaccaatggccgaccttgtggcactcttggggtcactggttgactcttccgggcacatcttggtgccagggatttacgacgaggtcgttcccctgaccgaggaggaaattaatacgtataaggcaatccacctggacctggaggagtataggaatagctcccgtgtggagaagttcttgttcgataccaaggaggaaatcttaatgcacctgtggcgatacccctcccttagtatccatggcatagagggggccttcgacgaacctggaacaaagactgtcattcctggacgcgtgatcggaaagtttagcataagactggtgccgcacatgaacgttagtgcagtggagaaacaggtgactaggcacctagaagatgtgttctcaaagcgcaattcaagcaacaagatggttgtgagtatgaccctaggcttgcacccatggatcgctaacattgacgatacccaatacctcgccgccaaacgtgcgattagaactgtgttcggtacagaaccagatatgatacgcgatggttcaacaatacccatcgccaaaatgttccaagagatcgtacataagtccgtcgtcctgatacctctaggcgctgttgatgatggcgaacacagtcagaatgaaaagattaataggtggaactatatagaaggaactaaactgttcgcagctttctttctggagatggcacagctgcactag

SEQ ID NO: 181712 - DNA, 2484 bp, Artificial Sequence
  Description of Artificial Sequence: Synthetic coding sequence
atgctgctgtgcctgagccccgcctggctgatgaaggtgcccgccccaggacaacctggggaagccgccctcctggtgtctaaggccgtttccttccatccaggaggtctgacttttctggatgatttcgtgccacccagacgagccacctattttctcgcgggtttaggcttaggcccagggagggggcgcgaagcggccgagctcgcgcgtgatctgacctgccctactggggccagcgctgagttggcccggctgctcgaggaccggctgctgactcgccagcttctggcacagcaaggcggtgtggctgtgcccgctaccctggcgttcacctacaaaccccccggtctgctgcgggggggagacgctagcctgggtcttagactagtggagcttagcgggaaagaggggcaggaaacacttgtgaaggaggaggtggaagccttcctaaggagcgaagccctgggggatattctgcaggttgccgtgaagctatcggggtggagatggcgcggacggcaggcatggcgactccacccgagggctgaactgggtgctgttgtcgataccgtgttggccctgctagaaaagttggaggaggaggaatctgtgctggtggaagctgtttacccccctgcccaacttccatgttccgacggccccagtccgggccctggcctggccgtgcggatttgtgccgttgtgtgcaggacccagggggatcgaccgctcctgagcaaagttgtatgtggcgtgggaaggggcgatagaccgctccggcatcataactcactgcctagaaccctggaagtagccctggcgcagtgcggtctcggagaggaagctcaggtcgcggccgtgaggcaaagagtgaaggcagccgccgaggctgcattggcagccgtgctggccctcgaagccgggctttcagccgaacaacgcggcggcagacgagcgcacacagactttctcggcgttgacttcgctctgacggctgctggtggcgtactgactcctgtggccttagagctcaacggaggcctatgcctggaagcctgcggagccctggaagggttatgggcggcccctaggttggggcccgccgctgacgaggctgtggcagcacccctggtcgagacaatgctccgtcgcagcgcacgatgtctaatggaaggaaagcaactgcttgtcgttggggccgggggtgtgtcgaaaaaatttgtgtgggaagccgccagggactacggcctgcagttacaccttgtcgaatccgacccaaaccacttcgcatcccagctcgtgcagacattcatccatttcgatatgactgaacacagacgcgatgaagaaaatgcgagactcctggcggagctggtgcgcgcccgcggcttgaagctggacggctgcttttcttactgggatgattgcctggttctgacagccttactttgccaagaactgggcctcccctgtagttccccggctgctatgagacttgccaagcagaaaagcctcacacagctccacctgctgcaccaccacgggccaccgtggcctgctcccagcttacatgcagtcccatgctgtcctctggaatcagaggcagacgtagaaagagccgtccaccaagtgccattgcctggagtgatgaagttggagttcggcgctggggccgtgggagtacggctcgtcgaagacgctcctcagtgccatgaacacttctcacggattacgagagacctgcagggtgaggcggatcacccgggtattgggctaggatggggcaatgcgatgctgctgatggagttcgtggagggcactgagcatgatgtcgacttggttctgttcggaggcaggctgctcgcagcattcgtgagtgacaatgggcccacgcgcctgccaggattcaccgaaactgccgcctgcatgcctacaggactcgcacctgaacaggaagcccaaatggtgcaggccgcgtttcggtgttgccttggctgtggcctccttgatggtgtgtttaacgttgaactgaagctcaccggcgcgggcccgcggctgatcgagataaatcctcgcatgggcgggttttacctccgcgactggattctggaactgtatggggtagatctcctccttgccgcagtcatggtcgcttgtggtctgaggcctgcattaccaacccgccctcgcgccagaggccaccttgtgggggtgatgtgtctggtaagccagcacttgcaggcgttgagtagtacagcctctagagagacacttcaggccctgcatgatcgcggcctgctgcgtctcaatttgttggaggaggctttggtgcccggagagtatgaggagccttactgctccgtcgcctgtgccggcccatcccctaccgaggcacgcttgaggctgctaggcctctgccaggggttgggaatcgacggaccatcgtatcctgtggcccatttcctgtctcattttaaatag

SEQ ID NO: 181713 - DNA, 2484 bp, Artificial Sequence
  Description of Artificial Sequence: Synthetic coding sequence
atgctgctgtgcctgagccccgcctggctgatgaaggtgcccgccccaggacagcccggcgaagcagcactcctggtttccaaagccgtgtcatttcatcccggcgggttgaccttcttggatgacttcgtgcctccaagacgagccacctactttttggccggcctgggtctaggtcctggtcggggccgtgaggccgctgaattagctagagacttaacatgtcccacaggggctagcgccgagcttgcgcgcttgctggaagatagactcctcacccgtcagttactggcgcagcaaggcggcgtggccgtgcccgcaaccctggcattcacctacaaacctccaggcttgctccgggggggggacgcatccttaggattgaggctggtcgagttgtcgggaaaggaaggccaggagactctggtgaaagaggaggtggaagccttcctgcgaagtgaggcactcggcgatatccttcaggtagcggtcaagttgtcaggctggcggtggcgcggtcggcaggcctggcgcctgcacccccgagctgagcttggcgctgtggtcgatacggtgctggccctcttggaaaaactggaggaggaagagagcgtccttgtcgaggctgtgtaccccccagcacagctaccgtgctccgacgggcccagcccaggccctggtctggcagtacgaatttgcgccgttgtttgccggactcagggggaccgccccctgctgtcaaaagtagtctgcggagtcgggcggggtgatcgccctctcaggcaccacaacagcttgccgcgcacactggaggtagccctcgctcagtgtgggctgggtgaggaagcgcaagtggctgccgtccgtcaacgggtgaaggcggccgcagaagccgcactcgctgcagtgctagcactggaggccggcctgagtgctgagcaaagaggcggcaggagagctcacacagactttctaggcgtcgattttgccctcacagcagccggcggagtcctcactccagttgcccttgagctcaacggcggactttgcctcgaggcatgtggagcacttgaggggctttgggccgcacctagactcggtccagccgccgatgaggccgttgctgccccactggtcgagaccatgcttagaagatcagctagatgccttatggagggtaaacagctcctcgtcgtgggcgctggcggagtgagtaagaaatttgtgtgggaggccgccagggattacggcctacagctccacttggtagagagcgacccaaaccatttcgcctcacaattggtgcagacattcatacactttgacatgaccgagcatcggcgcgacgaagagaatgcacgtctgctggctgaactggtgagggcgcgtggcctcaagctagacgggtgcttcagttattgggacgactgtttggtgctaactgcactgctgtgccaggaactgggccttccttgctcttccccggcagccatgcggctggcgaaacaaaagtccctcactcaactgcatctcctccatcaccatggaccaccctggcctgccccaagcctccatgctgtaccttgttgtcctttagaaagtgaggccgacgtcgagcgtgccgtgcaccaggtgcctctcccaggagtcatgaagctggagtttggcgccggcgccgtaggcgttagactggttgaggacgctccacaatgtcacgaacacttcagccgaatcacccgagatctgcagggggaagccgatcaccccggtataggcctgggctgggggaacgcaatgctccttatggagtttgtggaagggacagagcacgacgtcgatctcgtcctgtttggtggaagactgctggcagcatttgtttctgataatggtcctacaaggctccccggttttactgaaacagcggcatgcatgcccacaggcctcgcccctgagcaagaagctcagatggtccaggccgcatttagatgctgcctgggttgcggcctgctggacggcgtcttcaacgttgagctcaaattgaccggggctggtcctcgtctgatagagattaatccacggatgggcggtttctatctgagagattggatattggaactgtacggtgttgatctcctgcttgctgccgtgatggttgcatgtggtttgcgacccgccctacctaccagaccacgcgcccgggggcatctcgttggggtgatgtgcctggtcagccagcatttacaggctttgagcagcacagcctcgcgcgagaccctgcaggctcttcacgaccgggggctgcttagactgaatctgctcgaagaagcactcgtgccgggcgagtatgaggagccttattgttctgtggcctgcgccggcccaagccccacagaggctcggttgaggctcctaggactttgtcaagggctgggcatcgacggtccaagctatcccgtggcacacttcctttcacacttcaagtag

SEQ ID NO: 181714 - DNA, 2853 bp, Artificial Sequence
  Description of Artificial Sequence: Synthetic coding sequence
atgctgagcctggaccccagcggccccgagtgggactgccccctgggatcgaaggatctcgaagaggaaggaccgtggggcggcggttccgggctacctcccaccggatgctttcccggaagctggcggcaggacgtcggtctcgactgtaagggtagtcctgaaggcgccgaagcaagagcctggacagtgtattactatagtctgctccagagttgtctgcagcaagctgggctgccagaaacacaggataggggacaggtcccgaggactggctgtcccggagccgaggtgactctgtgtgtcctgggatcccctagtacattcctgccggtactactcgaaggaggcgtgcagagtccggggaacatgctgctatgtttatcccctgcttggttgatgaaagtgcccgctccaggacagcccggcgaagcagcgctgctggtgtctaaagcagtcagctttcaccccgggggccttaccttcctggatgactttgtgcccccacgtcgagccacatacttcttagccggtctcggcctggggccagggcgcgggagggaggcggctgaactggcccgcgatcttacatgtccgactggagctagtgctgagctcgctagacttctggaggacaggctgttgacaaggcaactgctggctcagcaaggtggcgtagccgtacctgcgaccctcgctttcacgtataagccacccggcctgctgcgaggaggggatgcctcgttaggccttagactggtcgagctcagtggaaaggaaggacaggagacactggtgaaggaagaggtagaggcatttctccggagtgaggctctgggcgatattctgcaggttgcagtcaagctctccggctggcgttggcgcggccggcaggcctggcgcctgcatcctcgtgccgagctaggagccgttgttgacacggtgctggccttattagaaaagctagaggaggaagagtccgtcctcgtcgaggctgtttatcctcctgcccagcttccctgctctgacgggccttcccccggccccgggctagcggtgcggatctgcgccgtagtatgcagaacgcagggcgatcggccccttctgagtaaggtggtatgtggggtggggcgaggggatagacccctgaggcaccataacagcttacctagaacgctcgaggtagcattagcccaatgtggactgggagaggaggcacaggttgcagctgtccgacaacgggtgaaagcagccgcagaagccgctcttgccgccgttctggctctcgaagctggtctgagtgccgagcagcgcgggggccggcgggcacacaccgacttcttgggcgttgactttgctctgacagcggctggtggggttctaacacccgtcgctctggagcttaatggggggctctgtctagaggcttgtggagctctggagggcctgtgggctgctcctcggctgggtcccgccgctgatgaggcagttgcagcccctctggtagagactatgctgaggcggtccgcccggtgcttgatggagggcaagcagctgctagtggtcggcgctggcggcgtgagtaaaaagttcgtgtgggaggctgctcgcgactatggcctccagctacacctagttgaaagtgaccctaatcacttcgccagccagctcgtccaaacatttattcatttcgacatgaccgagcatcgccgggatgaagagaatgcccgcctgcttgcggagcttgtgagagccaggggtctgaaactggacggctgtttttcctactgggatgactgcctggtgcttacagcgctgctatgtcaagagctcggcttaccttgttctagcccagccgctatgcggcttgccaaacagaaatccctgactcagctccacttgctgcaccaccacggtcccccctggccggctccatcattacatgccgttccgtgctgcccactcgaaagtgaagcagatgtcgaacgcgcagtccaccaagtccccttgccgggggtgatgaagctggaattcggggccggcgcggtgggggtcaggctagtggaagatgcaccccagtgccacgagcatttcagtcgcattacgagggatttacagggagaagcagaccaccctggaattggcttagggtggggcaacgcaatgctactaatggagtttgttgagggtaccgagcatgatgttgatcttgtgctgtttggcggaaggctgctcgccgctttcgtctctgataacgggcccacgcgacttcctggattcactgagaccgctgcatgtatgccaaccgggctggcccccgaacaggaagctcaaatggtgcaggccgctttccggtgctgtctggggtgtggcctcctggatggagtcttcaatgtggagttgaaattgacgggtgcagggcctcggttgatcgagatcaaccctagaatggggggattttacctgcgggactggatcctcgaattatatggcgttgatctattgctggcggccgtaatggtggcttgtggactaaggcccgcgctgccaactaggccacgagccagggggcatcttgtcggtgtaatgtgccttgtcagtcagcatttacaagctttgagcagtaccgcctcccgagagactcttcaagccctgcacgatagaggactgctgaggctgaatcttctcgaagaagcgctggtgcccggggagtacgaggaaccttattgcagcgtcgcgtgcgccggcccatctccaaccgaagcaaggctcaggttacttgggctgtgtcagggcctaggcatagacggcccgtcgtacccagtggcccactttctgagccattttaagtag

SEQ ID NO: 181715 - DNA, 2775 bp, Artificial Sequence
  Description of Artificial Sequence: Synthetic coding sequence
atgctgagcctggaccccagcggccccgagtgggactgccccctgggttcaaaggaccttgaagaagaggggccgtgggggggtgggagcgggctgccacccaccggttgtttcccgggctcctggaggcaggacgtgggcttggactgcaaagggagccccgaaggcgccgaagcccgggcctggacagtttattattacagcctgctgcagtcctgcctgcagcaggcaggccttcctgaaacccaggatcggggtcaggtgcctagaaccgggtgtcccggcgcggaggtgacattgtgcgtcctgggatccccatcaacctttctgcccgtcctactggagggaggagttcagtcccctggcaacatgttactctgtctcagccccgcatggttgatgaaggtacctgcacctggacaaccgggcgaggcggcactgctggtgtccaaagctgtgagcttccaccctggaggtctgactttcttggacgatttcgtcccccccaggcgagctacttactttctggcgggactcggcctcggcccggggcgcgggcgcgaggctgctgagctggctcgtgatttgacatgtccaactggcgctagtgctgaactcgcccggctcctggaggacagactgcttacgcgtcagctgctcgctcagcaagggggggtcgcagtccctgccacactagcgtttacatacaagcctccaggcctgctgcgcgggggggatgcgtctctgggcctgagactagtcgagctatccgggaaggagggtcaagaaaccctggtcaaagaagaggtggaagcattcttgagaagcgaagccctaggcgatattctccaagtggctgttaagctgtcaggctggagatggcgtggcaggcaggcgtggcgactacacccgcgtgcggaactgggtgccgtggtggacacggtcctagctcttcttgagaaacttgaggaagaggagagcgtgctggtcgaggcggtgtatccgcctgcacaacttccatgctctgatgggcctagccctggtccaggactggctgttcggatctgtgcggtggtgtgccggacccagggagatcggcctctcctatcaaaggttgtttgcggcgtgggtagaggcgataggccgctgcgccaccacaactcgctaccacgcactttggaggctgctctggcagccgtgctggcccttgaggcaggactgtcggcggagcagcggggggggcgcagggctcatacagatttcctaggtgtcgacttcgcgctcaccgcagctgggggcgtcttgactccagtagcactggaactgaatggtggactttgtctggaagcatgcggagccctggaaggactctgggcagctccccgcctgggtcctgctgccgacgaggccgtggccgctcccctggtggaaaccatgttacgacggagcgcccgctgcctgatggaagggaaacagctcctggtcgtcggcgctggcggagtctccaagaaattcgtttgggaggcagcaagggactatggtctgcagctgcatctagttgaatctgacccaaaccactttgcaagccagttagtgcagacttttattcactttgatatgaccgagcatcggcgggatgaggagaacgcacgcttgctcgctgagttggtgcgagcccggggcctcaagctcgacgggtgtttctcttactgggacgattgtctggtgttaacggctctgctgtgtcaggagttgggactgccctgctccagcccagctgccatgagactcgctaagcagaaatccctaacccaattacatcttctacaccaccacggccctccttggcccgctccctctctgcacgccgtgccatgctgtcccctggagtccgaagctgacgtggaaagggccgtgcaccaggtgcctctcccaggtgttatgaagttggagttcggtgccggagcagtgggggtgagactggttgaggacgcgcctcaatgtcacgagcacttctcacgaatcacacgagatctgcagggtgaggctgaccacccagggatcggacttggctggggcaatgccatgctgctcatggagttcgtggagggcaccgaacacgacgtcgatcttgttctgtttggcggaagactgttggcggcctttgtcagcgacaatggccctactcgcctcccaggcttcaccgagaccgccgcctgtatgcctacaggccttgccccagagcaggaggcccagatggttcaggcagcatttcggtgctgcctaggctgtggactccttgatggggtattcaatgtcgagctgaaattgacaggcgccggacctcgacttatcgaaatcaatcctcgaatgggcggcttctatttgcgtgactggatcctcgagctctatggagtcgaccttctcctggcagccgtcatggtcgcttgcgggttgcgcccagcgttacccaccagacccagggcaaggggccaccttgtgggagtcatgtgccttgtctcacagcacctccaggcactatcgtcaaccgccagtcgggaaacgctacaagcactgcacgatcggggcctgcttcgactgaaccttcttgaagaggcccttgtgcctggggaatatgaggagccttattgcagcgtggcctgcgccgggcccagtcccaccgaagcccgcttgagattgctcggtctctgccagggtttaggcatcgatgggccctcctacccagtcgcacacttcctaagccactttaagtag

SEQ ID NO: 181716 - DNA, 903 bp, Artificial Sequence
  Description of Artificial Sequence: Synthetic coding sequence
atgtgccccctggcccaccccgcccaggacctgcccctgctgcccagccagttgtccttagatcccagcggacctgagtgggattgtcctctgggctcaaaagatttggaggaggagggtccctgggggggcgggtcggggctgccccctactggatgcttccctgggtcatggaggcaggatgtgggactggattgcaaaggaagcccagaaggggctgaagcacgggcctggacggtgtactattattcgctgctgcagagttgtttgcagcaggcaggtctcccagagactcaagacagggggcaggtgccccgaaccggctgtccgggtgcggaagttaccttgtgcgtactgggaagtccgtctaccttcctacccgtactactggaaggtggagtgcagtctccgggcaacatgctcttatgtctaagccctgcttggctgatgaaagttccagctcctggtcagcccggcgaggccgcccttctggtcagtaaggctgtatccttccaccctggcggcttaacgtttctggacgatttcgtccctccccgccgcgctacttactttctagctggattaggcctgggcccagggagaggccgtgaagcagcagaacttgctagggatctcacctgtcccacgggagccagtgcagagctcgctaggctcctggaggaccgcctactcaccaggcagctactggctcagcaaggcggcgtggcagtacctgccaccctcgcgtttacttacaaacctcccgggctcctgagagggggcgatgcttcgctcggactccggctggtggagctttcaggcaaagaagggcaggaaacacttgttaaagaagagaggacctggctcgggccaaaaccatggaccaacccagggaagacctag

SEQ ID NO: 181717 - DNA, 2775 bp, Artificial Sequence
  Description of Artificial Sequence: Synthetic coding sequence
atgctgagcctggaccccagcggccccgagtgggactgccccctgggctcaaaggatctggaagaagaaggcccatggggtggagggtcagggctcccccccaccggctgttttcccggatcatggagacaagacgtcgggctcgattgtaaagggagccctgagggggcagaagctagggcatggacggtgtactactacagtttgttacagtcgtgtctccaacaggccgggcttcccgagactcaggatcgaggccaagtgcctcgaactggctgtcctggggccgaagtgaccctttgtgtgctcggctcgccctctacgtttctgcctgttttgctggaaggcggcgtgcagtccccgggaaatatgttgctgtgtctgtcgcctgcatggcttatgaaggtacctgcccctggccaaccaggtgaagctgctttgttggtctcgaaggccgtgagcttccatcccggaggactgaccttcctggatgacttcgtcccgccccgtcgtgccacatatttcctggccggactgggactgggtccaggtagagggagagaagcagcagagttagctcgcgatctaacctgtccaacaggggcctctgccgagttagcgcggctgctggaggaccgcttgttgactcgccaactccttgcacagcagggaggcgtggccgtccccgctacgctggctttcacctataaacccccaggtctcctacgagggggagacgcatccttagggctccggctggtggagttgtctggcaaagaggggcaagagactctcgtgaaggaggaagtggaggcattcctgagaagcgaggccctgggcgatatcctccaggttgccgtgaaactgagtggatggcgttggcggggcaggcaggcgtggaggcttcatccacgggctgagctcggtgccgtggtggataccgtgctggcgctgctggagaagctggaggaggaagagtctgtgcttgtggaggccgtgtatccacccgcccagctgccctgttccgacggacccagccctggacctggccttgcagtaagaatatgtgctgtcgtgtgccgcactcagggagatcgccctttgctatcgaaggtcgtatgcggagttgggcgtggcgaccgtcctcttcgtcaccacaactccctgcctcggaccctggaagtcgccctggccgccgtgttggctctcgaagcaggcctatcggcagagcagaggggaggtaggcgcgctcacactgactttcttggcgttgatttcgccctaaccgccgccggcggtgttctcacaccagtggccttggagctgaacgggggactttgcttagaagcttgcggggctttagaaggcctgtgggccgccccacgcctggggcctgcggcagatgaagccgtcgcagcaccactagtggagacaatgcttcggaggtccgcccggtgcttgatggaagggaagcagctgctggtagtgggtgcggggggtgtgtctaaaaagttcgtgtgggaagctgctcgagattatggtcttcagctgcatctggtggagtcagaccctaaccactttgcctcacagctggtgcagacattcatccattttgatatgacagagcacagacgggatgaggagaatgccagactgttggccgagctggttcgggcgcgtggtctgaaactagacggctgtttttcatactgggatgattgcctggtgttgaccgccttgctgtgtcaggagctcgggctgccctgttctagtcctgccgcgatgcggctggccaaacagaaatccctcacccagctccatctgctccaccatcacggccctccctggcccgcacccagcctgcatgcggtgccatgttgtcccctagaaagtgaggctgatgtagaacgcgccgtgcaccaggtgccactgccaggcgtgatgaaactggagttcggcgccggtgcggtaggggtcaggctggtcgaagatgcccctcagtgccatgaacacttttccagaatcactcgggatctccagggggaggccgatcatccaggaataggtttagggtgggggaacgctatgttactgatggagttcgtggagggcaccgaacacgatgttgacctagtgctgttcggaggccgtctcctggcagccttcgtttccgacaacggccctaccagactgcccggctttacagaaaccgccgcctgcatgcccacaggactagctccagagcaggaggcccagatggtgcaagcagcctttcgctgttgtctcggatgcggtctccttgatggtgtcttcaacgtcgagctgaaattaacaggtgcgggcccccgcctgatcgaaatcaaccccagaatgggggggttctatttaagagactggattctggaactgtacggtgtggatttgctattagccgctgtaatggtcgcttgtggtttgcgccctgcactgcctacaaggccccgcgcacgcggacatttggttggagtgatgtgcctcgtcagtcaacacctgcaggcccttagtagcaccgcgagccgagagaccctgcaggcactgcacgaccgggggctgcttcgcctcaatctgcttgaagaggctctcgtccctggagagtacgaggagccatactgttccgtggcctgcgctggaccgtcacccaccgaagcacgtctccgcctcctgggactgtgtcaagggcttggaatcgatggcccatcctacccagtggcccactttttgagccactttaaatag

SEQ ID NO: 181718 - DNA, 1206 bp, Artificial Sequence
  Description of Artificial Sequence: Synthetic coding sequence
atggagcccggccggcggggcgccgccgccctgctggccctgctgtgtgtagcatgcgctttgcgagccggccgagcccaatacgagcgctactcttttcggagtttccctcgcgacgagctgatgcccttggagagtgcatatcgtcacgcacttgataagtatagcggtgagcactgggccgagagtgttggctacctggagatttcccttagattgcataggctcctcagagacagtgaagccttctgccacagaaactgctctgcggctccccagccagaacccgctgcgggcctagccagctaccccgagctgcggctgtttggaggcctcctgcgccgcgcccattgccttaaaaggtgcaagcaagggctgcccgctttcagacaaagccagcccagtcgcgaggtgctggctgactttcagcgtcgtgagccttacaagttcctgcaattcgcatattttaaagccaataaccttccgaaagccattgcagccgcccatacattccttctgaaacaccccgatgacgagatgatgaaacgcaatatggcatactataagtccctccctggagcagaggattacatcaaagacttagaaaccaaaagttatgaatccctgttcataagagcagttagagcatacaacggcgaaaattggcggactagtattactgatatggaattggctctcccagattttttcaaggcattctatgaatgcttagctgcctgcgaaggatcccgagagattaaagacttcaaagacttttacctctctatcgcagaccactatgttgaagtgttagaatgcaaaattcagtgcgaggagaatctcactcccgtgatcggcggctatcccgtcgagaaatttgtcgccaccatgtatcactacctacagtttgcatactacaaattgaatgacttgaagaatgcagctccctgcgctgtctcctatctgctctttgaccagaatgacaaagtaatgcagcagaatctcgtgtactaccagtaccatcgggatacttgggggcttagcgatgaacactttcagccccgcccagaagccgtgcagttctttaacgttactacacttcaaaaagaactgtatgattttgcaaaggaaaacatcatggatgacgatgagggtgaagtcgtagagtatgtggatgacctccttgagttggaggagacttcgtag

SEQ ID NO: 181719 - DNA, 789 bp, Artificial Sequence
  Description of Artificial Sequence: Synthetic coding sequence
atggagcccggccggcggggcgccgccgccctgctggccctgctgtgcgtggcctgtgcgctccgggccggcagggctcagtatgagaggtacagcttcagatcgtttcccagagatgagcttatgcccctagaatctgcttaccggcatgctctcgacaagtattccggagaacactgggctgagtctgttggctacctggaaataagcctcaggctgcacagactgctacgcgatagtgaggctttttgccacagaaactgctcagccgcaccccagcccgagcctgcagccggtctcgcctcctatcccgaactgcgtctgtttggcggcttgctgcgacgagcgcattgtctcaaaaggtgcaagcaagggcttcctgccttccgacagtctcaacccagtagagaggttcttgctgattttcagcggagggaaccatataagtttctacagtttgcatactttaaggccaataacctccccaaagccatcgccgcagcacacaccttcctcctcaagcatccggatgacgagatgatgaagaggaacatggcatactataaatccctgcccggcgcagaagactatcttaaaacttggaagccatctcacatgaaagcgtgtagctcagaacagtgtggccacactacagtgcggacaggcgagcacccttctcagacctggagctggccgttcccaacaagtagcaaaccattcacgtccgtgtcgcagccagccagagtgcctgggcggagtaggacgagtcgcattagtacattcccttag

SEQ ID NO: 181720 - DNA, 789 bp, Artificial Sequence
  Description of Artificial Sequence: Synthetic coding sequence
atggagcccggccggcggggcgccgccgccctgctggccctgctgtgcgtagcttgcgctctccgggccggacgcgctcagtatgagaggtatagcttccgttcctttccgcgtgatgaactcatgcccctggagagcgcgtaccgccatgctttagataaatattcaggagagcactgggcagaatccgtgggctacctggagataagcttaaggctccatcgcctgctgagagacagtgaggctttttgtcacagaaactgctccgcagcaccccagcccgagcctgcagcggggctcgcctcgtatcctgaacttcggttgtttggcgggctcctgaggcgggcccactgtctgaaaaggtgcaaacaaggcctgcccgccttccgtcagtcccagccgtctcgagaagtgttggctgactttcagcggagggaaccttataagtttctccagtttgcctatttcaaagcaaacaatctgccgaaggcaattgcggctgcccatacgtttctattaaaacaccccgatgatgagatgatgaaaaggaacatggcctattacaaatcactgcctggtgcagaagactatatcaaggacctagagacaaagagctatgaatctctattcatcgaacagtgcgggcacacaactgtcaggacaggtgagcacccatcccaaacctggtcctggcccttccccacttcctccaaaccttttactagcgtaagccagcccgctagagttccgggtcggtctcgtacatcgcggattagtactttcccatag

SEQ ID NO: 181721 - DNA, 1167 bp, Artificial Sequence
  Description of Artificial Sequence: Synthetic coding sequence
atggagcccggccggcggggcgccgccgccctgctggccctgctgtgtgtggcttgcgccctcagagccggacgcgcccagtacgaacgatacagtttcaggagtttcccccgggacgaattaatgcccctggagtccgcctaccgtcatgccctggacaaatacagtggggagcactgggctgagagcgtccgcgacagcgaagctttttgtcaccgaaattgcagtgcggctccccagcccgagccggccgcgggactggcaagctatcccgaactgagactgttcgggggcctcctgcgacgtgctcactgccttaaacggtgcaaacaggggcttccagcattcagacaaagccagcccagcagagaggtgctcgcagattttcagcggcgagaaccctacaaattccttcagttcgcgtactttaaggcaaacaacctgcctaaagctatcgccgctgcccatactttcctgctcaaacatcctgatgacgaaatgatgaaacggaacatggcttactacaaatcactccctggcgcagaagactatatcaaggacctcgaaaccaagagttacgaatccctttttatcagagccgttcgggcatataacggcgagaattggaggacaagcattactgatatggaactcgcccttccagacttcttcaaagcgttctatgaatgtcttgccgcttgcgagggatccagagaaataaaggattttaaggacttttacctctctatagccgatcactacgtcgaggtgctggaatgtaagatccaatgcgaggaaaacctcacacctgttatcgggggctatccagtggaaaaatttgtggctactatgtaccactatcttcaatttgcgtactacaaactgaacgacctgaaaaatgcggctccatgtgcagtttcgtacttgctgtttgatcagaatgacaaggtaatgcaacagaacctcgtctactatcaatatcatcgcgacacgtgggggctcagtgacgaacactttcaacccaggccagaagccgtccagttttttaatgtgacgaccctgcagaaggaactgtacgactttgcaaaagaaaacatcatggacgacgacgaaggcgaggtcgtggagtatgtagacgacctgctcgagcttgaagaaacctcatag

SEQ ID NO: 181722 - DNA, 3471 bp, Artificial Sequence
  Description of Artificial Sequence: Synthetic coding sequence
atggccagcctgctgcccctgctgtgcctgtgcgtggtggccgcccacctggctggcgcccgagacgccacccctacagaggaacctatggccaccgcacttggcctcgagagaagatctgtgtacacaggtcaacccagtcctgcactggaggactgggaggaggcaagcgaatggactagctggtttaatgtggaccacccgggaggtgacggggactttgagagcctggcagcaataagattttactatggccccgccagagtctgtcctagacccttggcgctagaagcgcgcaccacagactgggccctcccctccgcggtgggggagagagtacatctgaacccaacacggggtttttggtgtctcaatcgggagcagcctcgcggcagacgttgctctaactatcacgttagattccgatgtcccctggaggcctcttggggcgcctggggcccctggggcccatgctctggctcctgtgggcccggcagacgactccggagacgtcactgccccagccccgcgggggacgcctgtcccggaagacccctggaagcacagaagtgcgtgcggcctaggtgtcccggatgttctctggatacatgtgagtgcccggatcatattcttctagggagcgtggtgacgccttccgggcaacctctcctcggagcgagagtatccctgagagaccagccaggcaccgtcgccacatccgacgcgcatgggacatttagggtgccaggcgtgtgtgctgactcaagagcgaatatacgagcacaaatggatggcttcagcgccggagaggcccaagcccaggcaaacggctctatctcagtagtgacaataattttagacaagctggagaaaccgtatctcgtgaagcaccccgagagcagagttagagaggcaggtcaaaacgtgaccttctgttgcaaggcctcgggcacacccatgccaaaaaaatacagttggtttcacaacggcaccctgctcgaccgcagggctcatggctacggagcccacctggagctgcggggacttcggccagatcaggcagggatctatcactgtaaagcctggaacgaagctggcgccgtgcggtccggaacagccaggctgaccgtgttagcacccggacagccggcttgcgaccccaggcctcgggagtaccttatcaagctgccggaagattgcggtcagcccggatctggtccggcctatctggacgttggtctttgtccagacactaggtgtccgtcactggcagggtcgtctccaaggtgtggcgacgcctcctccaggtgttgcagcgtgagaagactggaacgccgggagattcattgcccgggctacgtcctgcctgtgaaagttgtggcagaatgtgggtgccagaagtgcctgcctccacgtgggctggttagaggaagagtggtggcagcggactcgggagaaccgctgcgcttcgcccgaatcctgctgggccaggagcccatcggcttcacagcctaccagggggacttcactatagaggttcccccaagcactcagaggctcgtggtaacatttgtcgatccatctggagagttcatggatgctgtgagagtgctgccttttgacccaagaggcgccggtgtctaccacgaagtgaaggcaatgaggaagaaagccccagttatcttgcataccagccagtccaatacaatccctctgggcgaactggaagatgaggccccgttgggcgaactggtcctacccagcggagcattccggagggctgacggcaaaccatattccggccccgttgaggcccgcgttacattcgtggaccctcgcgacctaacatctgcagcctctgccccaagcgacctcagattcgtggacagcgatggcgaactagcgcccctccgcacatatggaatgtttagcgtggaccttagggcgccaggctccgcagaacaattacaggttgggcccgtcgccgtgagggtcgccgcttcgcagatacatatgccggggcacgtggaagccctgaaattgtggtctcttaatcccgaaaccggtctgtgggaagaagaaagtgggtttaggagagaagggtcttcgggcccccgggtccgcagagaggaaagggtgttcctcgttggcaacgtggaaatccgcgagagaaggctgttcaatttagacgtcccggagaggcgccgatgcttcgtcaaagtccgcgcttacgctaacgacaagtttacgccctctgaacaggttgaaggcgtggtggtaaccttggttaatctggaacctgcacccggtttctcagctaatcctagggcttggggtaggtttgattctgccgttacagggcccaatggggcctgtctgccagctttctgcgatgccgaccgccccgacgcctatacagctcttgtaactgcaaccctggggggcgaggagctggaacccgcgcctagtctgcctcgtcccctgcccgctactgtgggggtgacccagccttaccttgacagactgggctaccgaaggacggatcacgacgacccagcttttaagaggaatggatttcgcataaatctcgccaaacctcgaccaggcgatccagctgaagccaatggacccgtttacccttggagatcgctgcgcgaatgccagggagcacctgtgaccgcatctcattttcggtttgccagggtcgaggccgataagtatgagtacaacgtcgtgcccttccgcgaaggcacgcctgcctcctggacaggagacctgctggcatggtggccaaaccctcaagagtttcgcgcttgctttcttaaggtaaagatccaagggccccaggagtatatggtaaggagtcacaatgccggtggctcccacccccggactcgaggccagctttatggcttgagagatgcacgttctgttagagaccccgagaggcccggaactagcgctgcatgcgtggagtttaagtgttcaggtatgctctttgatcagaggcaggtagacaggaccctggtcaccattatgccccagggcagctgtcgaagagttgccgtgaatgggctcctacgggactacttaacacgccaccccccgcccgtccccgctgaagatcctgccgcttttagtatgctggccccacttgaccccctgggacataattatggagtttacacagtcaccgatcagagtccaaggttggccaaggaaatagccatcgggcgctgcttcgacgggagttccgacggtttttctcgggaaatgaaggcagatgccggaaccgccgtgacatttcagtgcagggaacccccggctgggaggcccagcctctttcagaggctgcttgagagtcccgccacagctttgggcgacattaggagagagatgtcagaggctgcccaagcacaagcacgggcaagcggccctctgaggacccgaaggggccgtgtaagacagtag

SEQ ID NO: 181723 - DNA, 3555 bp, Artificial Sequence
  Description of Artificial Sequence: Synthetic coding sequence
atggtgggcaccaaggcctgggtgttcagcttcctggtgctggaggtgacttctgtcctagggcgccagactatgcttactcagtccgttcggagagttcagccaggcaaaaagaatccctccatctttgcaaagcctgctgacaccttagaaagccctggagagtggactacctggttcaacatcgactatcccggcggaaagggggattatgagcggcttgatgccataaggttttactacggcgaccgggtgtgcgcacgacccctgcggcttgaggcacgtactactgactggaccccagccggctcaactgggcaggtagtccatggcagccccagggaagggttttggtgcctgaaccgcgaacagcgccccggtcagaactgctcgaattacacagttcgctttctctgcccacccggaagccttcgccgggataccgagagaatatggtcaccgtggagtccttggagtaaatgtagcgctgcctgcgggcagactggagttcagactagaacccgcatatgtctagctgagatggtatcactctgttctgaagcctctgaagaaggacagcactgcatgggacaggactgcaccgcctgtgatctgacatgtcccatgggacaggtgaatgccgattgcgacgcttgtatgtgtcaggattttatgctccacggcgccgtgtcgctccccgggggagccccggcgtccggggccgcaatctacttgctcacaaagacaccgaagctgctcacccaaaccgactcagacggcagatttagaatccctggcttgtgcccagatggtaaatccatcctgaaaatcacaaaagtcaaattcgcccccatcgtgctcaccatgccgaagacatctctcaaggctgccaccatcaaagcagagttcgtgagagccgagacaccgtacatggtaatgaaccctgagactaaagcccggcgggccggccagtctgtgtccttatgctgtaaggccactggcaagccccgacccgacaagtacttttggtatcataacgataccctcctggaccctagcctgtataagcacgaatcaaagttggtcttaaggaagttacagcagcatcaagcaggggaatatttttgcaaggcccagtctgatgcaggcgccgtgaagtctaaggtggctcagctcatcgtcatagctagcgacgagacaccgtgtaacccagtccctgagagctacctcatcaggctcccacatgactgtttccagaacgcgaccaactctttctattatgatgtggggaggtgtcctgtcaagacatgtgctggacagcaggacaacggaattcgatgtagggacgctgttcagaattgctgcggcattagcaaaaccgaagagcgcgaaatccagtgttcgggctatactctgcctacaaaggtggccaaggagtgctcctgtcagcgttgtacggaaactaggtctatcgtcagaggacgcgtctcagcagccgataacggggagcccatgagattcggccatgtctacatgggaaatagccgggtgtccatgactggatataagggaacttttactctgcacgtgccccaggacactgaaagactggtgttgactttcgtcgaccggctgcaaaagtttgtgaatacaacaaaggtgctgccattcaataagaaaggaagtgcagtttttcatgaaatcaagatgctgcggcgtaagaaaccaatcaccctggaagcaatggagacaaatatcatcccactgggggaagtcgtgggcgaggatcctatggctgaattggagattccttccaggtctttttacaggcagaacggtgagccttacatcggcaaagttaaggcgtccgttacattcctggaccctaggaacatctcgacggctactgcggcccagactgacctgaactttattaatgatgagggagacacctttcctttgagaacatacgggatgttctcagtggacttccgggatgaagtgacaagtgagccactgaacgctggtaaagtgaaagttcacctcgacagtactcaagtaaagatgcccgagcacatctctactgtcaagctttggtcactcaatccggacaccgggctctgggaggaagaaggggactttaagttcgaaaatcagaggagaaacaagcgtgaagaccgcacatttttagtgggtaacctcgagattcgggagcgcaggttgtttaaccttgacgttccggagtcacgtagatgtttcgtaaaggtgagagcttacagatccgagagatttctgcccagcgagcagatacaaggcgttgtgattagtgtgattaatctggagccccggaccggcttcctctcaaacccacgcgcttggggaaggtttgattcagttattaccgggcccaatggcgcttgtgtgcctgcgttttgtgatgatcagtctccggacgcgtactctgcgtatgtcttagcttcactggccggagaggaactgcaggcagtggagagttctcccaagtttaatcctaacgcaatcggcgtgcctcaaccctaccttaacaaactgaactacaggcgaacagatcacgaagaccctagggtgaagaaaactgcattccagattagcatggcgaaaccgcgcccaaactcagccgaggagtccaacggccctatttacgctttcgaaaatctcagggcctgcgaggaagctcctccgagtgccgcacactttcgcttttaccaaatagagggcgataggtacgactacaacaccgtgccctttaacgaggacgaccccatgtcttggactgaagactatttggcttggtggccgaagcccatggagtttcgagcctgctatattaaggtgaaaatcgtgggcccgttggaggtgaacgtgcgaagccggaatatgggggggacccacagacagactgtaggcaaactgtacggcattcgtgatgttaggagtacccgggaccgggatcagccgaacgtaagcgctgcgtgccttgagttcaagtgtagtggcatgctctatgaccaggatcgggtggaccgaacgctggtcaaggtgatccctcaggggtcttgtcgaagggcgtccgtgaaccccatgctgcacgaatacctggtgaaccacctcccactggctgtgaataatgacacctccgagtatacaatgctggcccctctcgaccccctcggtcataactatggaatatacaccgtcactgaccaggatccaagaaccgctaaggaaatcgcattaggccggtgctttgacggcacaagtgacgggtcttcccggatcatgaagtccaatgtgggggtggcccttactttcaactgcgttgagagacaggtgggtcgacagagtgcgtttcagtatctgcaaagcacgcccgcacagagcccagccgcgggaacagtacaggggcgcgtaccttcccggcgtcaacaacgcgcctcacgaggcggtcagcggcaagggggtgtggtcgcatccctgaggtttcctcgcgtggcccagcagcctctcattaactag

SEQ ID NO: 181724 - DNA, 8148 bp, Artificial Sequence
  Description of Artificial Sequence: Synthetic coding sequence
atggccgccgccgccggcggcggcagctgccccggccccggcagcgccagggggcgcttccctgggaggccccgtggagctggcggtgggggggggagaggaggcagaggaaacggtgctgaaagggtgcgggtggctcttcgacggggcggcggcgccaccggtccaggaggtgcggagccaggggaagacaccgcactccttaggctgttggggctacggcgcggacttcggcgcctgcgccgcctttgggccggccccagggtgcaaaggggccgcggaagaggtcgcggcagggggtggggcccaagtcgaggctgcgtaccagaagaggaaagcagcgatggagaaagcgatgaggaggagtttcagggatttcattccgatgaagatgtggcaccttcatctctgagaagtgccctgcgctcccagagaggcagagcccccagaggcaggggcaggaagcataagacgacaccattgcctcctccacgcctcgctgacgtggcaccaaccccgccaaagacacccgcccgcaagagaggagaggaaggaacagagaggatggtgcaggcactcactgaactcctccggcgcgcacaagccccacaggcacctagatcgagggcgtgcgaaccaagtactccccgacggagccgtggcagaccacccgggcggcccgccgggccatgccggaggaaacagcaggctgtcgtagttgccgaagcggctgtgacgataccgaagcctgaacccccacctccggtagtgccagtgaagcaccaaacaggaagctggaaatgcaaggagggacccgggcctggtcccggtaccccccgtcgcggaggtcaatcttctagaggtggtaggggtggcagagggagaggccgcggcggggggttgcctttcgtgataaagtttgtgtctcgggccaagaaagttaaaatgggccagctcagtctaggcctcgaaagtggacagggccaaggacagcatgaagaatcatggcaggacgttccccaaaggcgtgtagggagcggacaggggggtagcccttgctggaaaaaacaggagcagaaactcgatgatgaggaggaagagaaaaaggaggaggaagaaaaggataaggagggggaggaaaaggaggaacgcgccgtggcggaagagatgatgccggccgcggagaaggaagaagctaagttgccccccccaccgcttaccccccctgcaccttcaccccccccgccacttcccccacctagcacaagcccaccaccacctttatgtccaccacctccgcccccggtgtcgccccctcccctaccgtccccccctcccccaccggcccaggaggagcaagaagaatcgcccccccccgtggtgccagccacttgcagtcgcaagaggggacggccacctctgaccccatcacaacgtgccgagcgtgaggccgcacgtgccggtcctgaggggaccagcccccccaccccaactccgtctacagcaacaggagggcctccggaggacagccccactgtggcccctaaatctaccacatttctcaagaatataaggcaatttatcatgcctgttgtttctgctcgctcctctagagtcatcaagacccccaggaggtttatggacgaagacccgccaaagcccccaaaagtggaggtgtcccccgtcctgagacccccaataactaccagccctcctgttcctcaggagccagcccctgtcccaagccccccacgtgccccaaccccaccaagcactccagtgccacttccagagaagaggcgctccatcttgcgcgaacccacctttagatggacctcgttgactagggagcttcctccacctccaccagccccaccgcctcctcccgcaccctctcccccacccgcccccgcaacctcctcacgccggccactgctcctgagagcccctcagtttacccccagtgaagctcacctcaagatctacgagtccgtcctgacccccccacccctaggcgctccagaagcccccgaacctgagcctcccccagccgacgacagtcccgctgagcccgagcctagggctgtgggaaggacaaaccatctctccttaccacgttttgccccagttgtgaccacgcctgtgaaagccgaggtgagccctcacggtgcacctgcgctatccaatggcccccagacccaggcacaactgcttcagccccttcaggcactgcagactcagctgctccctcaggccctacctcccccacaacctcaactgcagcctccccccagcccccagcaaatgccgccattagagaaagccaggatcgccggcgtgggctccctgcctcttagcggcgtggaggagaaaatgttttcattgctgaagagggccaaggtgcagttattcaagatcgaccagcaacaacagcagaaagttgctgcctcgatgcccttgtccccaggcggccaaatggaggaggtggctggagccgtgaaacagatatcagacagaggcccagtgaggtccgaggacgagagcgtagaagccaagcgcgagcgaccttctggaccggagtctcccgtgcaaggtccccggatcaaacacgtctgccgacatgctgccgtggccctgggccaggcacgtgccatggtgccagaggacgtgccaagattaagtgccctgccattacgggatcgccaagacctggctacggaggacaccagctcagcctcagagaccgagtccgtccctagccgttcacggcggggtaaggtcgaagctgccggtcctggtggcgagtcagaaccaaccgggtctggggggacccttgctcacactcctaggcgaagtctccctagccaccatggcaagaagatgcgcatggctagatgcgggcactgccgcggctgcttaagggtccaggattgcggttcgtgtgtgaattgcctggataaacccaaattcggcgggcctaacaccaagaagcagtgctgcgtataccgcaaatgcgataagatcgaggctcgtaaaatggaacgactcgctaagaagggcaggaccatagttaagacattactgccatgggactctgatgagtcaccggaggcctcaccaggtcctccggggcctcgaaggggcgcaggggcagggggtcccagggaggaagtggttgctcaccccggacccgaagaacaggactctctcttgcagcgcaaaagtgcgcgcaggtgcgtcaaacagagaccctcttacgacatcttcgaggacagtgacgactcagaacccggcggccccccagcccctcgtcggagaacacctagggaaaatgagctaccacttcccgaaccagaggagcagagtcgaccgagaaaacctactctgcaaccagtgctgcaacttaaagcgcggcgacgcctagataaggatgcactggcccctgggccattcgcctcctttcccaacggatggaccgggaagcaaaagtcaccagatggagtgcaccgtgtcagggtggattttaaggaggattgcgatctggaaaacgtatggttgatgggaggcctaagcgtactcacttctgtgcccgggggcccgccaatggtgtgccttttgtgcgcttccaaaggactccatgagctcgtcttctgtcaggtttgttgtgatccctttcaccccttctgcctggaggaagcagaacgccctctgccccaacaccacgatacgtggtgttgtcgccgttgcaagttttgtcacgtctgtggccgcaagggccgtgggagcaagcacctgcttgaatgtgaacggtgccgccatgcctatcatcctgcctgcctgggcccaagttaccccacccgagccaccagaaaacgaagacattggatttgctcggcctgtgtaaggtgtaaaagctgcggcgcaacgcctgggaagaattgggatgtagagtggtctggggactattctttatgcccccgatgcactcaattgtacgagaagggaaactattgtcctatctgcacccggtgctatgaagataatgactacgagagtaagatgatgcagtgcgctcaatgcgatcactgggtgcatgcgaagtgcgaaggcctttcagacgaggactacgagatcctgagtggcctgccagactctgttttgtatacttgtgggccctgtgctggagcggcccagcctaggtggagagaggcactcagcggggcgctgcagggcggactccggcaggtcctgcaggggctgctgagttccaaggtagttggcccattgctcctctgtactcagtgcggcccagacggtaagcagctgcaccccggcccatgcggcctgcaggccgttagtcagcgctttgaggatggccattacaagagcgtgcattctttcatggaggacatggttggtattctaatgagacatagcgaagaaggggagactcctgaccggagagccggaggacaaatgaagggcttacttttgaagctgttggagtcagccttcggttggtttgacgctcatgacccaaagtattggcgacgctccacaaggctgcccaacggcgttttgcctaatgccgtgctgcctccgtccttggaccacgtgtacgcacagtggcgccagcaagaaccggagacccccgagagcggacagccacctggtgaccctagtgccgccttccaagggaaggatcccgcggctttttctcatctggaggatccgcgccagtgtgctctgtgcctgaaatatggggatgctgacagcaaggaggctggtagactgttgtacattggccagaacgagtggacacatgtgaattgcgccatctggtctgctgaagtcttcgaagagaacgacggcagtctaaaaaacgtgcatgccgctgtcgcccgaggcaggcagatgcggtgcgaattatgtttaaagccgggcgctacagtcggctgctgcctgtcctcctgtctgtccaacttccactttatgtgtgccagagcctcatactgtattttccaggacgataagaaagtattttgccaaaagcataccgacctgctcgacggcaaggaaatcgtgaatccagacggcttcgatgtgctccgtcgggtgtatgtagacttcgagggcattaacttcaaacgtaagttcttgaccgggctggagcccgatgcgataaacgtcctgatagggtcaataaggatagacagcctggggaccctatcggatctcagtgattgcgagggtagactgtttcccatagggtaccagtgttctcggctctattggtctaccgtggatgcacgacgccgctgttggtatagatgtcgtatcttggaatacagaccttgggggcctagggaggagccagcgcatctcgaggctgctgaagaaaatcagacaatcgtgcattctcctgcgcccagcagtgagcctcctggtggcgaggatcctcccttggacactgatgtgctcgtccccggtgcccctgaaagacacagccctatacagaatcttgacccacctttacgccccgacagcggttctgctcctccgcccgcacctcgctcattcagcggcgcccggatcaaagtgcccaattatagtccaagccgaagacctctcggaggcgtcagcttcggtcctttgccaagtcccggctctccaagctccctgacccatcacattccgacagtaggagaccctgattttcccgctccacctcgtaggtcccgacgtccatcgccacttgctccccgcccccccccttcccgctgggcaagcccccctctgaagacatcccctcagttgcgagtcccaccccccacttctgtcgtgactgccttgacgcccaccagtggagagcttgcaccgccaggcccagcgccttccccacctcctccagaggacctcggaccagacttcgaggatatggaggtggtaagtgggctgtcagcggccgatctggactttgccgcatctttactgggcacagagcccttccaggaagagattgtggccgccggtgctatgggaagttcacacggtggccctggggacagctcagaggaggaatcctcccctaccagtagatatattcactttcctgtgactgtggtgtccgcccctggcttggcccccagcgccactccaggcgcgccaagaatcgaacagctcgatggcgtggatgacggcaccgattccgaagccgaggcggtgcagcagccgcggggccaaggcaccccaccaagcgggccaggggtcgtgagagctggcgtgttaggggctgccggtgaccgggcacgtccacccgaggatctgccgtccgaaattgtggacttcgtcttgaagaacctgggcggtcctggcgacggcggggctgggccacgcgaagagtccctgcccccagctccccccctggccaatggctcacagcccagccagggacttaccgctagtcctgcggaccctactagaaccttcgcttggctgcctggagcccctggagtgcgggttctgagcttggggcctgcgccagagcctcccaagcctgccactagcaagattatcctggtcaacaaacttggacaggtgtttgtcaagatggcaggcgaaggagaaccagtgccccctcccgttaagcagcctcccctgcccccgacgatatctcccactgcaccaaccagttggactctgccacctggcccgctccttggagtgctgcccgttgtgggcgtggtcagaccagcgcccccacccccgccaccacctctcaccttggtgctatctagtgggcccgcaagtcctccccggcaagcaataagggtgaagcgcgtgtccaccttctccggacgctcccccccagcaccaccaccatataaggctccccgtttagacgaggatggcgaggccagcgaggacacccctcaggtcccaggtctgggatcgggaggcttctcccgcgtccggatgaaaaccccaaccgtgcgcggcgtgctagatctcgatagacctggggagcccgcaggcgaagagagcccagggccacttcaagagcggtcgcccctgctccctttacccgaagacgggccacctcaggttccggatggtccaccagacttgctgctggaatctcagtggcatcattatagcggggaagcctcatcttccgaggaggaacccccctctcctgacgataaggagaaccaggctcccaaaagaacaggcccccaccttagatttgaaatcagcagcgaggacggattcagcgttgaagctgaatccctggagggggcgtggcggactctgattgaaaaagtgcaagaggccagaggacacgcgcggctgcgccacctctctttctccggcatgtctggcgccagactattaggaattcatcatgacgctgtcattttccttgcagagcagcttccaggggcgcaaaggtgccaacactataagtttagatatcatcaacagggcgaaggccaggaggaacctcccctaaatccacatggagcagccagagccgaggtgtaccttcgcaaatgcacattcgacatgtttaattttttagctagccagcacagggttctccctgaaggagccacttgtgacgaggaggaggacgaggtacagctgcgctctacacgcagagctactagtttggagcttccaatggcaatgagatttcggcacctgaagaagacatccaaagaagccgtgggggtttaccgctcggcgatccacggtaggggattgttttgtaaaaggaacatcgatgctggcgagatggtgatcgaatatagcggaattgtgatccggtcagtgctgacggacaagcgcgagaaattctacgatggcaaaggaatcggctgttatatgtttcgaatggacgattttgatgtggtcgacgcaacaatgcacggtaacgctgccaggtttatcaatcattcatgcgaacctaattgcttctctcgcgtgatccacgtggagggacagaaacacatcgtgatttttgctctgcgtcgcatcctgagaggcgaggagctcacctatgactataaattcccaatcgaagacgcgagtaataaattgccctgcaactgtggtgcgaagcgttgtcggaggtttctcaactag

SEQ ID NO: 181725 - DNA, 2115 bp, Artificial Sequence
  Description of Artificial Sequence: Synthetic coding sequence
atggtgcccgacaccgcctgcgtgctgctgctgaccctggccgccctgggcgcctccggccagggacaaagtcccctggggagtgacctagggccacagatgttgcgagagctgcaggaaacgaatgcagcactccaagatgtacgggagttgctgcgacagcaagttcgcgagatcactttcctaaagaataccgtgatggaatgtgatgcctgtggcatgcagcagagtgtacggaccggcttaccaagcgtgcgccctctgttgcactgcgcccccggcttctgcttcccaggcgtagcctgcatacagacagagagtggggctagatgcggaccatgtcccgcaggctttactggaaacggctcccattgtactgacgtgaacgaatgtgaaacagggcagcataactgtgttcctaattccgtctgcataaatacccggggcagctttcaatgtgggccctgccaaccaggctttgtcggcgaccaagcgagcggctgccaaaggagagcacagcggttctgccctgatggcagccccagcgagtgccatgagcatgctgactgcgtgcttgagagggacggaagccgcagttgcgtatgcgcggttgggtgggctgggaacgggattttgtgcggcagggacacagatttagatgggtttcccgatgagaagctgaggtgccctgaacgccagtgccgcaaggacaactgtgtgacagttcctaactccggccaggaagatgtagacagagatggcattggggatgcttgcgaccctgacgctgacggtgatggtgtgcctaacgaaaaggataattgcccactggtgaggaacccagaccaacggaacacagacgaagacaagtggggtgacgcttgtgataattgcagaagtcagaaaaacgacgaccaaaaggataccgaccaggatggccggggggatgcctgtgatgacgacattgatggggatcggattagaaaccaagctgacaattgtccacgggtccccaactccgaccaaaaagacagtgatggcgacggcattggggacgcttgtgataactgtccacagaaaagcaatcctgaccaagccgatgttgatcatgatttcgttggagatgcttgtgactcagatcaagaccaggacggcgatgggcaccaggactcaagagataattgtcctactgtacctaacagcgcccaggaagacagcgaccatgacggtcagggagatgcctgcgatgatgatgatgataatgacggtgtcccagactcaagagataactgccgcttggtcccgaaccccggccaggaggatgcggaccgcgatggagttggagatgtgtgccaggacgacttcgacgccgataaggtggttgacaagatcgatgtgtgcccagaaaacgccgaggtcaccctgactgatttccgcgctttccaaaccgtggtgctggatcccgagggtgacgcccagatagatcccaactgggtagtattgaatcagggaagggagattgtgcagaccatgaatagcgaccccggcttggctgtggggtatacggccttcaacggggtggactttgaagggacttttcatgtgaataccgtaaccgacgatgactatgccggattcatattcggctatcaagattcatcatctttctacgtggtcatgtggaagcagatggaacagacatattggcaggctaacccctttcgcgccgttgctgaaccaggtattcagctcaaagctgttaaatcctcaacaggtcccggggagcagcttcggaatgccctatggcacacaggcgacacagaatcccaagtcagactgttgtggaaggaccctcgcaacgtaggatggaaggacaaaaaaagctatcggtggttcctacaacatcggccgcaggtcggctacattagagtccggttctatgaggggccagaactggttgcggattcaaatgtcgtgctcgatacaaccatgagagggggacggttaggcgtgttctgtttttcccaggagaacattatctgggccaatctgcggtatcggtgtaatgataccatccctgaggattatgagacacatcagttaagacaggcctag

SEQ ID NO: 181726 - DNA, 2235 bp, Artificial Sequence
  Description of Artificial Sequence: Synthetic coding sequence
atggtgcccgacaccgcctgcgtgctgctgctgaccctggccgccctcggggcctcgggacaggggcaatccccactgggtagcgacctcgggccacagatgctgcgcgagctgcaggagaccaatgctgcgcttcaggacgttcgggagcttctgcgccagcaagtgagagagatcaccttcctcaagaacacggttatggagtgtgatgcctgtgggatgcagcagtccgtgaggaccggcctccccagtgttaggcctcttcttcactgtgctcctggtttttgctttcccggcccatgtcctgctgggtttacgggcaacgggtctcactgcactgacgtcaatgaatgtaatgcacatccttgtttcccgagagttagatgtatcaatacctctcctgggtttaggtgtgaggcatgcccaccaggatacagcgggccaacccatcagggggtggggctggccttcgctaaggccaacaaacaagtttgcaccgatattaacgagtgtgagacaggccagcataattgtgtgcctaacagcgtgtgcatcaacacaagggggtcgtttcagtgtggaccttgccagcccggctttgtgggggaccaggcttctggctgccagcggcgagcccaacgcttctgtccagacggaagcccgtctgaatgccacgagcacgctgattgtgtcctggaaagggatgggagccgttcatgcgtgtgcgctgtaggatgggcaggtaacggaatcctgtgcggtcgggacaccgacctcgatgggttccctgacgaaaagcttcgatgccccgagcgtcagtgccgtaaggacaactgcgtcacagtccctaactccgggcaggaggacgttgaccgtgacgggatcggcgatgcttgcgacccagacgctgacggtgatggcgtccctaatgagaaagataattgccctctggtacgcaacccagatcagagaaacacggacgaagataaatggggtgatgcgtgcgacaactgccggagccagaagaatgatgaccagaaagacacagaccaagacggccggggggatgcctgcgatgatgatatcgacggcgataggattcgtaatcaggcagataattgcccgcgcgtgccaaactctgatcaaaaagattcagacggagatggtattggcgacgcctgtgacaactgcccacaaaaatccaaccccgaccaggcagacgtggatcatgacttcgtgggcgatgcatgtgattccgaccaagaccaagatggagatgggcaccaggactcacgggataattgtcccaccgtccccaactctgcacaggaagacagcgaccatgacggccagggcgacgcgtgcgacgacgacgacgacaatgatggcgtgcctgacagccgtgacaattgtagattagttcctaaccctggccaggaggacgccgaccgcgatggagtgggagatgtatgccaggatgactttgacgctgacaaagtggtggacaagatcgacgtgtgccccgagaacgcggaagtgactctgaccgattttagagcattccaaaccgtggtgctggaccctgagggagatgcacaaattgaccccaattgggtagtactgaatcagggccgggagattgtacagacgatgaattctgaccctggattggctgtgggttatactgcctttaacggggtcgatttcgaaggaaccttccacgtgaatactgtgactgacgatgactacgccgggtttatttttggataccaggactcatcttccttttacgttgtgatgtggaaacagatggaacagacttattggcaggcgaacccttttagggctgtagccgaacctggcatccagctgaaggccgtcaagagcagtaccggccctggggagcagctgaggaatgcgctttggcacaccggggacactgagagccaagtgcgcctgttatggaaagatccacggaacgtcggttggaaggacaaaaagtcttaccgatggtttctgcaacatcgccctcaggtcggatatatccgggtgagattttacgaaggaccggagctcgtggctgactcaaacgtagtgctggataccactatgaggggcggcaggctgggagtcttctgtttcagtcaggaaaacattatctgggccaatctgcgctatcggtgcaatgacactatcccggaagattacgaaacacaccagctgcgacaggcttag

SEQ ID NO: 181727 - DNA, 2394 bp, Artificial Sequence
  Description of Artificial Sequence: Synthetic coding sequence
atggccgccctggcctacaacctgggcaagcgggagatcaaccactacttttctgtgcgcagcgctaaagtgctggcacttgtagccgtcctgttattggccgcttgtcatctggcatcccggcgttaccggggcaacgattcttgcgaatacttgctgagcagcggcaggttcctcggggagaaagtctggcagccacatagctgtatgatgcataagtacaagatttctgaagccaaaaattgtcttgttgataaacatattgccttcattggcgatagtagaatacgacagctattttacagcttcgtgaagattatcaacccacagttcaaggaagagggaaacaagcatgagaatattcctttcgaggataaaaccgcctccgttaaggttgacttcctatggcaccccgaggtcaatggttccatgaagcaatgcatcaaagtctggacagaggattcaatagcaaaaccccatgtgatcgtggctggagccgccacatggtctattaaaatccacaatggcagctccgaagcactgagtcagtataagatgaatatcacttcaattgctcctctcctggaaaaactagcaaaaacatctgatgtgtattgggttctccaagatccagtctacgaagatctgctatcagagaatagaaagatgataacgaacgaaaaaattgacgcctacaatgaggccgctgtgagcatcctcaattcatccacccggaattcaaagtccaacgtcaaaatgttcagcgtctctaaattgatcgcccaggagacaattatggaatcgctggatgggctgcacctgccagagtcctcaagagagactacagctatgattctcatgaacgtctattgcaataagattctgaaacctgtggatgggtcctgctgccagccccgacctcccgtgaccctgatacaaaagctggcagcctgcttcttcactttgtctatcatagggtatcttatcttctacattatccataggaatgcccataggaagaacaagccttgcactgatctggaaagcggagaagagaaaaaaaatatcatcaacacaccagtgagttctctggagattctcctccagtctttctgtaagttaggcctgattatggcatacttctacatgtgtgacagggcgaacctctttatgaaggaaaataaattttacacacatagttcatttttcatccctattatatacatattagtcctcggagttttctacaacgaaaataccaaggagacaaaagtcctcaatcgagaacaaactgatgagtggaagggttggatgcagctggttatcttaatatatcacatttcaggtgcgtctaccttcctccccgtttacatgcatattcgagtccttgtggcggcttacctgttccagactgggtatggccacttcagctacttttggataaagggtgatttcggcatttaccgagtgtgccaagtgctgttcagactgaactttctagttgtggtgctgtgcatagtgatggatcgaccatatcagttctattactttgtgccattggtcaccgtgtggtttatggtaatttacgtaaccctggccctctggccccaaatcattcagaagaaggcaaacggaaactgtttctggcacttcgggcttcttttaaagctagggtttttactgctatttatttgcttcctggcttattctcagggagcttttgagaagatcttctcgctgtggcccctgtcaaagtgcttcgaacttaaaggaaatgtctacgagtggtggttcaggtggagactagaccggtatgtagtgttccacgggatgttgtttgcttttatctatctcgccctccagaagcgacaaattctcagtgaagggaagggtgagccactgttcagtaataaaattagcaactttctgctcttcatcagtgttgtgagctttcttacctatagtatttgggcatcgagctgtaagaataaggcagagtgtaacgaactccacccttccgtgtctgtggttcagattctggcctttatcttaatccggaacatccccggctatgccagaagcgtgtacagcagcttctttgcctggttcggaaagatctcgctggaacttttcatctgccaatatcacatctggttggccgctgacactcggggaattctggtgttgatccctggaaatcccatgctcaacataatcgtatccacgtttatcttcgtctgcgtggctcatgagatttcccagattaccaacgacctggcgcaaatcataattccaaaggacaatagttctctcctgaaacggctggcctgtattgctgcttttttttgtggcctactgatactgtcctctatccaagacaagagcaaacactag

SEQ ID NO: 181728 - DNA, 2721 bp, Artificial Sequence
  Description of Artificial Sequence: Synthetic coding sequence
atggccggcaacgtgaagaagagcagcggcgccggcggcggcagcggatccggtgggtcgggtagcggtggattgatcgggctcatgaaagatgctttccaacctcaccatcaccaccaccaccatctgtccccccatcccccaggtactgtagacaaaaaaatggtggaaaagtgttggaagctgatggacaaggtggtccgactgtgccaaaacccaaaactggcactgaaaaactcgccaccttatatcctcgaccttttacccgatacttatcagcatttacggaccatcctgtctaggtatgaaggaaagatggaaaccctgggggagaatgaatactttagggtgtttatggagaaccttatgaagaagacaaaacagactattagcttgtttaaggagggcaaggaaagaatgtatgaagaaaattcccagccaagaagaaacctgacaaagctcagcctcattttctcacacatgctggctgagctcaaggggattttcccctctgggctctttcagggagatactttcagaatcacaaaggccgacgccgccgagttctggaggaaagcttttggggagaagaccatcgtgccttggaaatcttttagacaagctctgcatgaagtgcacccaatttccagcggcctagaggcaatggccctcaagagcacgattgacctgacatgcaacgactatatcagcgtttttgagttcgatattttcacccgattgttccagccttggagctcactgcttcggaactggaattccctggcggtcactcacccaggctatatggcttttctgacttacgatgaagttaaggctagactgcaaaagttcatccacaagcccgggagttatatatttagattgagttgtaccaggctgggccaatgggcaataggctatgtcaccgcggatggtaacatacttcagacgatcccccataataagccccttttccaagctctcatcgatggtttcagggaggggttctacctgtttccagacgggagaaaccagaacccggatctgacgggcttgtgcgagcccaccccccaggaccacatcaaagtcacccaggagcagtatgagctgtattgcgaaatggggagcacgttccaattgtgcaagatctgcgcggagaatgacaaggacgtcaaaatagaaccttgcggccatctcatgtgcaccagctgtctgacgtcttggcaggagtcagaaggacagggctgcccattctgtcgctgcgaaatcaagggcacggagcctatagtggtcgaccccttcgatcctcgcggcagtggctcccttctgaggcagggggcggagggggcaccctctccgaactacgacgacgacgacgatgagcgagctgacgacaccctctttatgatgaaagagctagctggggccaaggttgagcggcctccatcacccttctcgatggccccacaagcaagcctcccacctgttcctccaaggctcgatctgctgcctcaaagagtctgcgtgccctcctcggcgtcggccctgggcaccgcaagcaaagctgcaagtggatcactccataaggataagccgctgccagtgccacctacactgagggatttgccaccaccaccgccacccgaccgaccttactcagttggagccgagtccaggccgcagcggcgccctcttccatgtacccccggcgactgcccctcacgagacaaactgcctcccgttcccagctctaggctgggtgactcctggctgccccggccaatccctaaagtcccagtgtctgctcccagctcgtcggatccctggactgggcgcgagctgacaaatcgacacagtctcccgttttcactgcctagccagatggagccaagacctgatgttccacgcctgggttccacttttagtctggacacctctatgtctatgaatagttcacccctggtcggcccagaatgtgatcatcctaaaatcaaaccaagttctagcgctaacgcaatttactccctcgctgcaagacccttgcccgtgccgaagctcccccccggtgagcaatgcgagggggaggaggacacagagtatatgactcccagctcacgtcctttgagaccattggatacatcccagagcagtcgcgcttgcgattgcgaccaacagatagactcatgtacatatgaggccatgtacaacatccagagtcaggcccccagcatcaccgagtccagtactttcggtgaaggcaatttggcagccgctcacgctaacactggcccagaagagtccgagaacgaggacgatggctacgatgtgcccaaaccacctgtgcctgccgtgctggctcggaggacactaagcgacatcagcaatgccagctcctcttttggttggctgagcctcgacggtgaccctaccactaacgtcacagagggatcccaggttcctgaaaggcctccaaagccattcccaagaagaatcaactccgagcggaaggccggatcctgccagcagggaagcgggcccgctgcctctgccgctacagcatccccccaactcagctcagaaatcgaaaacctcatgtctcagggctactcgtaccaagacatccaaaaggccttagtgatcgctcagaataatatagagatggcaaaaaatatccttcgcgagtttgtttctatttccagccctgctcatgtcgccacttag

SEQ ID NO: 181729 - DNA, 2949 bp, Artificial Sequence
  Description of Artificial Sequence: Synthetic coding sequence
atggccaacagcatgaacggccggaaccccggcggccggggcggcaacccgcgcaagggaagaatcctgggcatcattgatgccatacaggacgcagtgggccccccaaaacaagccgccgctgatagaagaactgtggaaaagacttggaagctgatggataaagtcgttaggctgtgtcaaaacccaaaattgcaactcaaaaattccccgccttatatcctggatatccttccagacacatatcagcacttgcgtctgatactgagcaagtatgatgacaaccagaagctcgctcagctgtctgaaaatgagtacttcaagatatatatagattcacttatgaagaagagtaaacgggccataagactattcaaagagggaaaggaaagaatgtatgaagagcagagccaagacagacgcaatttgaccaaactgtcgctaattttcagccatatgctcgccgaaattaaagccatcttccctaacggccagttccagggggacaactttaggattaccaaggcagatgccgccgagttttggcgcaaatttttcggggacaagacaattgtcccatggaaggtgtttcgccagtgtctacacgaagtgcatcagataagttcagggctagaggcaatggctttaaagagcactattgacttaacgtgtaacgactatatctcagtctttgaatttgacatttttactcgtttgttccagccatggggtagtatcttaagaaattggaacttcctagccgttacacaccctgggtacatggccttcctgacctacgacgaggtcaaggctcgcttgcaaaaatactccactaagccaggaagttatatcttccggctctcttgtactcgccttggacagtgggcgataggctacgttacgggcgacgggaacatcctgcagacaataccccataataagcctttgtttcaagctcttattgacggcagcagagagggtttttacctgtatccagacgggaggagctataaccccgatttgaccggtttgtgcgagcccactccccatgaccatatcaaagttacccaggagcagtatgagctatattgtgagatgggttccacctttcagctgtgcaagatttgtgccgagaacgataaagatgtaaaaatagaaccctgcggccatttgatgtgtacatcttgccttacagcctggcaggaatcagacgggcagggatgccccttctgtcgttgtgagatcaagggcaccgaacctattatcgtggatccttttgacccccgggacgaggggtctagatgctgctccataatagaccctttcggcatgcccatgctggacctggatgacgatgacgaccgagaggaatccctgatgatgaaccgactcgcaaacgtgcgcaagtgcactgaccggcagaattctccggtcacctctccaggcagtagccccttggcacagagacggaagccccagccggacccactgcagattcctcatctgagtctaccgcccgtgccacccagactcgacctcattcagaagggaatcgtgagatctccttgcggatctcccaccggctcccctaaaagctccccttgtatggtgagaaagcaggacaaacccctgccggctcctccaccaccactgcgcgatccccccccccctccacccgagagaccgcctcctataccccccgataaccgcctgagccgtcatattcaccacgtggaaagcgtaccgtctcgggatccaccaatgccgctggaggcgtggtgtccacgagatgtgttcggcactaatcagctcgtggggtgtaggttgctgggcgaggggagtcccaaaccggggatcaccgcatcatctaatgtgaatggcagacactccagagtcgggtctgatcccgtgctcatgcgaaagcaccggaggcacgacttgcccctggaaggcgcaaaagtgttcagcaatggtcatcttgggagtgaggagtatgacgtgcctccccgcctatccccaccacccccagtgacgacccttctaccatccatcaaatgcacggggcctcttgccaattctctgagcgaaaaaactcgcgaccctgtcgaagaagacgatgacgaatataaaataccttccagtcatcctgtgagcttgaacagtcagccatcacattgtcataatgttaagcctccggtgaggagctgcgataatggacattgcatgctgaacggtacacacggccccagttctgagaagaaatccaatatacccgatcttagtatatacctcaagggagatgtgttcgactcagccagtgatccggtacccttgccccccgctagacctccaaccagggacaacccgaaacacggaagttccttgaacagaacgccttccgactacgacctcctgattccacctttaggtgaggacgcctttgacgccctaccacctagcctaccgcctccccccccccccgcccgccatagtctgattgagcacagtaaaccccctggaagctctagcaggccatcttccggccaggatctcttcttactgccatcagacccttttgtcgatcttgcttccggccaggttccccttccgcccgctagacggctcccaggcgagaacgtaaagacaaatcgtacaagccaggactatgaccaattgccatcctgctccgatggaagccaggccccagctcgcccgcccaagcctcgaccacgaaggacagcccccgagattcatcataggaagccccatggccctgaggcagcattggaaaacgttgacgccaaaatagcgaaattgatgggcgaaggatacgcttttgaggaggtaaagcgtgccctggagatcgcacagaacaatgtggaagtcgctcgaagcatcctcagagaattcgccttccctccacccgtcagtccacggctcaacctttag

SEQ ID NO: 181730 - DNA, 2883 bp, Artificial Sequence
  Description of Artificial Sequence: Synthetic coding sequence
atggccctggcccccggccccgacgcccacgcccacctgcccccccttatcgaactcaaatttcagatggcgaattctatgaatgggagaaacccagggggtagaggcggcaatccacggaagggccgcattctcggcattatcgacgccattcaagacgcagtcggcccgccaaaacaagctgcagccgacaggcgcaccgtagaaaaaacgtggaaactcatggacaaagtggtgcgtctctgccagaacccaaagttacaactgaaaaactccccgccatatatactagatattctgcccgacacataccagcacctgaggcttattttatctaagtatgacgacaaccagaaactggcccaactgtccgagaacgaatacttcaaaatctatattgattctttaatgaagaagtccaaaagagctattagactttttaaagaggggaaggaaaggatgtacgaggaacagtcccaggacagacgcaacctcacaaagctgtcactgatcttttcccatatgctcgcagagataaaggccatattcccgaacgggcaattccagggggacaattttcgcattaccaaagccgatgcagctgagttttggcgtaagtttttcggagataagaccattgtgccatggaaagtgtttaggcaatgcttacatgaagtgcatcaaatctcatctggcctggaggcgatggcattaaaatccacaatcgacctcacgtgtaatgactatattagtgtttttgaatttgatatttttaccaggttgtttcagccgtggggctctattttgagaaattggaatttccttgctgtgactcaccccggctatatggcatttcttacgtacgatgaggtcaaggcccggctccagaagtacagtaccaaaccgggctcctacatattccgacttagctgcacccgcctggggcagtgggcgataggatatgtcaccggggatggcaatattctgcagaccatcccacataataagccccttttccaagcactgattgacgggagtcgcgaagggttttatctgtacccggacgggagatcctacaacccagacctgaccggcctatgtgaacccacacctcatgaccatatcaaggttacacaggagcagtacgagctttattgcgagatgggcagcaccttccagctatgcaaaatctgcgcggaaaatgataaggatgtgaagattgaaccttgcgggcatctcatgtgtaccagctgtctcaccgcctggcaggaaagcgatgggcagggatgtcctttctgccggtgcgaaatcaagggtactgagccaatcatagtcgacccctttgacccaagggacgagggaagcaggtgttgcagcattatcgacccttttggcatgcccatgctcgacctagacgatgatgacgatcgtgaagagtccttgatgatgaatagacttgccaacgtgagaaagtgtactgatcggcagaactcccccgtgacttctcccggatcaagccctcttgcccagaggcgtaagccacaaccagacccacttcagatccctcatttgagcctgccgcctgtgcccccacggcttgatctgatccagaaggggatagtgaggagcccttgcggctctcctactggatcaccaaaatcatccccatgcatggttaggaagcaggataaaccgctgccagctccacctccgccattgagggatccgcctcccccccctccagagcgaccacccccaatccctccagacaatcggctgtcgcgccatattcatcacgtggagagcgtaccatccagggaccctcccatgccactggaagcgtggtgcccgcgagacgtctttgggacgaatcagctggtgggatgccgcctgctgggagagggttctccaaagccaggtattaccgcctcaagtaacgtgaatgggaggcattccagagtgggatccgacccagttctcatgcgaaagcacaggagacacgatctgcctctggagggggctaaagtattttccaatggtcacctcgggtccgaggagtacgatgtcccaccaagattgtctccccctcctcctgttacaactttgcttccctccataaagtgcacagggcccttggctaattctctgtccgagaagacgcgggacccggttgaagaggacgacgacgagtacaaaatcccttcttctcaccctgtaagcctgaactcccaaccgtctcactgccataacgtgaaaccgcctgttcgctcttgcgataacggccattgtatgctcaacggaactcacggcccaagttcagagaaaaagagcaacatccccgatctttccatctatcttaagggcgaagatgccttcgatgcattgccccctagtctgccacctccgccccctcccgcccgccatagcctgatagagcatagcaagcccccaggatccagtagccgcccctcttctggacaggatctttttcttctgccgagcgaccccttcgttgacttagcatccggtcaagtgcccctgccacctgctcggaggctaccaggtgagaacgtcaagaccaacagaacctcgcaggactatgaccagctgccatcttgctcggatggctctcaagccccggctaggcccccgaaacctaggccccggcgaacagcccctgaaatccatcaccgcaaaccccacggccccgaggccgccctagagaacgttgacgcaaagattgccaagctgatgggagagggctatgcttttgaagaagtcaaacgcgcgctagaaatcgcacagaataatgtcgaggtagcccgcagtatcctgagggagttcgcattccctcctcctgtttccccccgactcaatctgtag

SEQ ID NO: 181731 - DNA, 2313 bp, Artificial Sequence
  Description of Artificial Sequence: Synthetic coding sequence
atggccaacagcatgaacggccggaaccccggcggccggggcggcaatcctaggaaaggacggatccttgggatcatcgatgctatccaggacgcagtgggaccacccaaacaggccgccgccgacagacggacggtggagaagacttggaagctgatggataaagtggtccgcctgtgccagaaccctaagctacaactaaagaactcccccccctatatacttgacatcctgcccgacacctaccagcatctgcggctcattctaagcaaatatgatgacaaccagaagttggcccagctcagtgagaacgaatacttcaagatctacatcgacagcttgatgaaaaagagtaagagggccatccggctgttcaaagaaggaaaggagagaatgtacgaggagcagagtcaagatcgccgaaacctcactaagctgagtttgattttttctcacatgctagcggaaattaaagccatattccctaatgggcagttccagggtgataacttccggatcacaaaggcggatgctgcagagttctggaggaagtttttcggcgacaagacaatcgttccatggaaagtgttcaggcagtgtctgcacgaagtccaccagatttcttccgggctggaagccatggctctgaagtcaacgattgacctgacttgcaacgattacatttccgtattcgaattcgatatcttcacacggctgttccaaccctggggcagtatactgaggaattggaatttcctggccgtgacccaccccggctatatggccttcttaacctacgacgaagtcaaagcgcgcttgcagaaatactctacaaaacctggtagttatatattcagactgtcgtgtacaagactcggccagtgggccatcggctatgtcaccggcgacggcaacattctgcagaccatcccccataacaaacctctctttcaggcactgatcgatgggtctcgcgaaggtttttacctgtatccggacggacgatcctataaccccgatctaacaggcctctgtgagcctacccctcacgaccacattaaagtcacacaagagcaatatgaactgtactgcgagatgggtagcactttccagctgtgtaaaatttgtgcggaaaacgacaaggatgtaaagatagagccctgcgggcatctcatgtgcactagttgcctgacagcgtggcaggagtctgacgggcaaggctgccccttttgtaggtgtgaaatcaaggggacagagccaatcatcgtcgatcctttcgaccctcgcgacgaggggtctcggtgctgctccattatcgacccctttgggatgccaatgctcgacctggatgacgatgacgatcgcgaagaatcacttatgatgaaccgtctcgccaacgtccgcaagtgcactgatcgacagaattcaccagtaacaagtccggggtcttcaccattagctcaacggcggaagccccagccagaccctctccagatcccccacctctccctacctcccgttccacccagattagacttgattcagaaagggattgtgcggtcaccatgcggcagtccaacaggatccccaaaaagctctccctgtatggtgcgtaaacaggacaagcctcttccagcccctccacctcccctgcgagaccctccccctccccctcctgaaagaccaccgccgattccccccgataatcggctcagccgacacattcaccatgtcgagtcagttccaagtagagaccctcccatgcccctagaggcatggtgccccagagatgtgttcggcacaaaccaactggttggatgccggttactcggggaaggctcaccaaaaccaggaattacagcttcttccaacgtaaatgggaggcactctcgcgtgggcagtgaccccgtgttgatgagaaagcatcgccgtcatgatcttcctcttgagggagcaaaggtgttcagcaatggccacctggggtcagaagaatacgacgtgccaccccggttgtcacctcctcccccggtgaccacactactgccatccattaagtgcaccggtccccttgctaactctctgtctgagaagacaagagatcctgttgaggaagacgacgacgagtataagattcccagtagtcacccagtatccctgaacagccagccatcccattgccataatgtaaaaccgcccgtgcgctcctgtgataatggccactgcatgctcaatggcacacacgggcccagctcagaaaaaaagagcaacatccccgacctgtccatatatttaaagggtacttataggatctag

SEQ ID NO: 181732 - DNA, 2433 bp, Artificial Sequence
  Description of Artificial Sequence: Synthetic coding sequence
atggccaacagcatgaacggccggaaccccggcggccggggcggcaatccccgtaaagggcgaatcctgggtataattgatgccattcaggacgccgtgggaccccccaagcaagctgccgccgataggcggacagtcgagaaaacttggaagcttatggacaaggtcgtgaggctgtgtcagaatccaaaactccaactcaagaacagccctccatacatccttgacatcttacccgatacctaccagcatcttcgtctgattctttcaaagtacgacgataatcagaagcttgcacagcttagtgaaaatgaatactttaagatttatatcgactcactcatgaaaaaatctaaacgggctatccgactgtttaaagagggcaaggagcggatgtacgaagaacagagccaggatagaagaaatttgacaaagctttcattgatattctctcacatgctggcggagatcaaggctattttccctaatgggcagtttcagggcgacaactttcggattaccaaagcggacgccgccgagttttggcggaaatttttcggtgataagacaatcgtgccttggaaagttttcagacagtgtctgcacgaggtgcatcagatcagcagtgggttagaggccatggccctgaagagcaccattgatctaacctgcaacgattacatctcagtgttcgagttcgacattttcacccggttattccagccctggggaagcattctgaggaattggaactttttggcggtcacgcaccccgggtacatggcctttctgacttatgatgaagttaaggcaagactgcagaaatactcgactaaacctggctcttacatttttaggctgtcatgcacaagactgggacagtgggcaattggctatgtgacaggggatggaaatatccttcagaccatcccccacaataagcccctgtttcaggcgctgatcgatggatctcgtgaaggcttctatttgtatcccgacggcaggtcctataatccagacctgaccggactgtgcgaacctactccgcacgatcacattaaagtcacacaagagcagtacgagctctactgcgagatggggtccaccttccaattgtgtaaaatttgcgcagagaatgataaagacgtcaagattgaaccctgcggtcatcttatgtgcaccagctgtttaaccgcctggcaggaatctgacgggcagggctgtcctttttgtcgctgtgaaattaagggaacagaaccaatcatcgttgatccctttgacccacgcgacgaggggagcagatgctgcagcatcatagacccgtttggcatgccaatgttagatctggatgacgacgacgatagagaggagagcctaatgatgaaccgcctggccaatgtgagaaaatgcactgaccggcaaaatagccctgtcaccagcccagggagcagccctctcgcgcaacgacggaaaccgcaacctgacccgcttcaaatcccacatctgagtcttccccctgtccctcctagactcgacctgatccagaagggcatagtccggtccccatgcgggtcccctacaggcagccctaaaagcagtccgtgtatggtgagaaaacaggataagccattgcctgctcccccacccccccttcgggacccaccgccaccccctcctgaaagaccacccccaattccccccgataatcggttatcacgccacatccatcacgtcgagtccgtgccaagccgagacccgcccatgccactagaggcctggtgtcctagagacgtgttcggcactaatcagctcgtgggttgtcgactcctgggcgaggggtcacctaaacccggaatcaccgcttcatccaatgtaaacgggcgccacagcagggtgggctctgaccctgttctaatgcgaaagcataggcgccatgacctccccttagaaggagctaaagtattttctaacggccatctcggcagcgaagagtatgatgtgcctcctaggctctctccaccaccccccgtcacaaccctcctaccatctatcaagtgcaccggcccactggccaattcactgtcagaaaaaaccagggatccagttgaggaagatgacgatgagtacaagatacctagcagccatccagtcagtctgaacagtcagccctcgcattgccacaacgtgaaaccaccagtcagatcgtgtgataacggacattgcatgctgaacggcactcacgggcctagctctgagaaaaagtccaacataccggatctcagtatttacctgaaaggcgatgtgttcgattcagcctcagacccagtccctttgccccccgcccgcccaccgacccgagacaacccaaagcacggctcaagtctcaacaggaccccatccgattacgacctgctgatacctccacttggttag

SEQ ID NO: 181733 - DNA, 420 bp, Artificial Sequence
  Description of Artificial Sequence: Synthetic coding sequence
atggccaacagcatgaacggccggaaccccggcggccggggcggcaaccctagaaaaggaaggatcctgggtattatcgacgccatccaggatgccgtggggccccctaaacaagcggcggcagaccggcgaaccgtagagaaaacctggaaactgatggataaggtcgtcaggttgtgccagaatcctaaattgcaactgaagaactcacccccctacatactcgacatcttgccagacacatatcagcacctaaggctcatactatccaaatacgatgacaatcaaaagttggcccaactcagcgaaaatgagtattttaagatatacatcgactcgctgatgaagaagtcaaagcgcgctatacggctgtttaaagaaggcaaggagcgtatgtacgaggagcagtcccaagattag

SEQ ID NO: 181734 - DNA, 684 bp, Artificial Sequence
  Description of Artificial Sequence: Synthetic coding sequence
atggccctggcccccggccccgacgcccacgcccacctgcccccccttattgagctcaagtttcagatggccaattccatgaacggtcgtaacccaggcgggagaggtggtaatcctaggaagggaaggattctcggtatcattgacgccattcaagatgccgtcgggccccccaaacaggcagccgcagacaggaggacagtggaaaaaacatggaagctgatggacaaggtcgtgaggttgtgtcagaacccgaagctgcaactaaaaaactctcccccttacatcctggacatcctgccagacacttaccagcaccttcggctcatattgtctaaatacgatgataaccagaagttggcgcagctatctgagaatgagtatttcaagatctatatcgactctctgatgaagaaaagcaaacgcgcaattcgactgtttaaggagggcaaagagagaatgtacgaagaacagagccaggatcgcactattgtgccctggaaggtgtttaggcagtgtcttcacgaagttcatcagatttcatctggcctggaggccatggccctgaagtccacaattgatctcacctgtaatgattacattagtgtgttcgagtttgacatttttacacggcttttccaggtgagtgacaatttcacagaatacctaatctatcttacctag

SEQ ID NO: 181735 - DNA, 1425 bp, Artificial Sequence
  Description of Artificial Sequence: Synthetic coding sequence
atggccctggccgtggccccctggggccggcagtgggaggaggccagagctttaggcagagcggttcggatgcttcagcggttagaggagcagtgcgtggatccgcggctgtccgtgtcaccaccaagtcttagagatctcttaccacggacagcccagttgctccgagaagtggcccactctaggagagcagcgggtgggggggggccagggggacccggagggtctggggattttctgcttatctacttggctaatttggaggccaagagccgacaggttgccgctttgctaccccctagaggcaggcgctccgcaaatgacgagttgttcagagcgggctccagattgcggcggcaactggccaaattagcaataatcttttcccatatgcacgccgagctgcacgctctgtttcctggtggaaagtactgcggccatatgtaccagctcacaaaggcgcccgctcacacattttggcgcgagtcatgcggcgcacgatgcgttctcccttgggccgaattcgaaagcctgcttggaacttgtcaccctgtggaaccgggttgcaccgccctggccctgcggactactattgacctcacctgctctggccatgtgtcaatttttgagttcgacgtcttcaccaggcttttccagccttggcccacactcctgaaaaattggcagctgttggctgtgaatcacccaggctatatggcgttcctgacttatgacgaagtgcaggagcggctccaggcatgtcgagacaagcccgggtcatatatctttcggccatcatgcactcggttgggccagtgggctatcggttacgttagctccgatggttctatattgcagacgatcccagctaataagccgttgtcccaagtgttgctcgaaggacagaaagacggcttttatctatatcctgacggtaaaacccacaaccctgatctcaccgagcttggacaggcagagccacagcagaggatacatgtgtccgaggagcaattgcagctgtactgggctatggacagtacatttgaattgtgtaagatctgcgctgagtctaataaagacgtcaagatagagccttgcgggcatctgctctgcagctgttgcttggcggcctggcagcattccgactctcaaacttgtccgttctgtcgttgcgaaatcaagggttgggaggctgtgtccatctaccagtttcacggccaggccaccgccgaagacagcggcaattctagcgatcaagagggtcgggagctcgaattgggacaagtcccactcagcgccccccctctcccgcctagacccgatctcccgccgcgcaagccccggaacgcccagccgaaagtgcgcctcttgaaagggaatagcccacctgcagccctggggccccaggatccagctccggcctag

SEQ ID NO: 181736 - DNA, 1287 bp, Artificial Sequence
  Description of Artificial Sequence: Synthetic coding sequence
atggccctggccgtggccccctggggccggcagtgggaggaggcccgcgccctgggtcgtgctgtgcgcatgttgcagcggctggaggagcagtgcgtggaccctcgtttgtctgtatcccctcccagcttacgagacctactgccacggaccgcccaacttctacgagaggtcgcccacagccggagagccgctggcggtggggggccgggcggtcccggcggatcgggggactttctcctcatctaccttgccaacttggaggctaaatcacgacaggtcgctgccctgttacccccaaggggaaggcgatcagctaatgatgagctctttagggccggctctcgcctgcgacgccagctagctaagcttgcaataatcttctcccatatgcacgccgagctgcatgccttattccccggcggcaagtactgcggccacatgtatcagcttactaaggcacctgcacacactttctggcgcgagagctgcggtgctcgctgtgtgttgccctgggcagaatttgaaagcctactcggcacatgtcaccccgtggagccgggctgcactgctttggcactccgaacaactatagacctaacctgtagcggtcatgtcagtatattcgagttcgatgtgttcaccaggctgtttcagccttggcccacattgctgaagaactggcaactgctggccgtgaaccacccgggatacatggccttcctgacctatgatgaagttcaggagcgactgcaggcctgccgggataagccaggaagctacctctaccccgatggaaagactcacaacccagacctcaccgagcttggtcaagccgaaccacaacagcgcatccatgttagcgaagaacaactgcagctctattgggctatggatagcacattcgagctctgtaaaatatgcgctgagtccaataaggatgttaaaattgagccctgcggccaccttctatgtagctgttgcctggccgcctggcagcacagcgactctcaaacatgtcctttctgtcgctgtgaaatcaaaggttgggaggcagtttctatataccaattccatggccaggccactgccgaagacagcgggaattcaagtgaccaggaaggccgcgaattagaacttggacaagtacctctttctgctcctccccttccacctagaccggatttgccaccccgtaaacctcggaacgcacagcccaaggttcgactcttaaagggaaacagtcccccagccgctctcgggccacaagatcccgcccctgcctag

SEQ ID NO: 181737 - DNA, 2355 bp, Artificial Sequence
  Description of Artificial Sequence: Synthetic coding sequence
atgagcgaccagaagaaggaggaggaggaggaggccgccgccgccgctgcaatggccacagaaggaggaaagacctcagagccagaaaataacaacaaaaagccaaagacttccggctctcaagacagtcagccctccccactggcactactggcggcaacgtgcagcaagataggcactccaggagagaatcaagccacaggccagcagcagatcataattgaccctagccagggcctggttcagttgcaaaatcagccccagcagctagaactcgtaaccactcagctggccgggaacgcgtggcagctggttgctagcactccacccgcttcaaaggaaaataatgtttcacagccggcctcgtcttcatcttcgtcctctagcagcaacaacggcagtgccagcccaaccaagacgaagtccggaaacagcagtactcccggacaattccaagttatccaagttcagaacccaagtgggagcgtccagtatcaggtcatcccccagctccaaaccgtcgaaggtcagcagattcagatcaatccaacatcctcatcctcactgcaggacctgcaggggcaaattcagctaatctctgccggaaacaatcaagcaattctcactgcggccaatagaactgctagtgggaatatcctcgcccagaaccttgccaatcagactgttccggttcagatacgccctggtgttagtatcccattacaactccagaccttacctggaacccaggcacaggttgtgaccacacttcccatcaatattgggggcgttacactagccttacctgtgattaataatgtcgccgcaggcggagggacggggcaagtcgggcagccagccgccactgctgacagtggaacatcaaatggcaaccagttggtttctactcctacgaatactaccacctccgcatccactatgccagaatcacccagcagtagtaccacctgcaccacaacagcctctaccagcctcacctccagcgacactcttgtatcgtcagctgacactggccagtacgcttctaccagcgcaagcagcagtgagcgaaccatcgaagagtctcaaacgcccgccgcaactgaatctgaggctcaaagctcctcacaattgcagcctaatggaatgcaaaacgctcaggaccagagcaatagcctgcagcaggtccaaatcgtcggacagcctatccttcagcagatccagattcagcagccccagcagcagatcatccaggctatacctccacagtccttccagctccagtccggccagactatccaaactattcagcaacagccactgcaaaacgtacaacttcaagccgtaaaccccacccaagtgctgattcgggcccctaccttgacacctagcggacagatcagttggcagactgttcaggttcagaacatacaaagtctgtctaatttgcaggtgcagaatgcaggactgagccagcagctgactatcaccccagttagttcttcaggaggaaccacactggcccagatcgcaccagtcgccgtggcgggcgcccctattaccctgaacaccgctcagctcgcttcagtaccaaaccttcagaccgtcagcgtggcaaaccttggggctgcgggagtacaggtgcagggtgtgccagttaccattacatcagtcgcaggacagcagcagggccaggatggcgtgaaggtgcagcaggccaccatagctcctgtgaccgtagccgtcggggggatcgcaaacgcgaccataggagccgtcagccccgatcaattgacacaggtgcatctgcaacagggacagcagacgtcagaccaggaggtccagccaggaaagcgactgcggcgagtcgcatgctcatgtcccaactgcagagaaggcgaaggacgaggatcaaacgagcccggaaagaaaaagcagcacatctgccatatcgagggatgcggaaaggtttatggaaaaacaagccacctgcgtgctcatctgagatggcacaccggagagcgcccctttatctgcaactggatgttctgtggaaaacggtttaccaggagtgatgagctgcaacggcaccgccgaacccatactggggagaaaagatttgagtgtccagagtgctccaagagattcatgcgtagcgatcacctgagtaaacacgtcaagacccatcagaacaaaaagggaggaggaaccgctctggctatcgtgaccagcggggagctcgattccagtgtgactgaggtgttggggtccccccgcattgtcactgtggcggcaatctcccaggattctaatcccgccacccccaacgttagcaccaacatggaagagttttag

SEQ ID NO: 181738 - DNA, 1476 bp, Artificial Sequence
  Description of Artificial Sequence: Synthetic coding sequence
atggaccacaccgacaacgagctgcagggcaccaacagcagcggcagccttggcgggctagacgttcgtcgacgcatccccattaaacttataagcaagcaagccaataaagccaagcccgcaccccgcacccagagaaccatcaatcgaatgcccgctaaggcgcccccgggcgatgaggaggggttcgactacaacgaggaagagcgctatgattgtaagggaggtgaactgttcgctaatcaacggcgctttccaggtcacttattttgggactttcaaattaatattcttggcgagaaagacgacactccggtgcacttttgcgataagtgtggactcccaataaaaatatacggacgaatgatcccttgtaaacacgtgttctgctacgactgcgctatactccatgagaaaaagggggacaaaatgtgtcctggctgttctgatcccgttcagagaatcgagcagtgcacacgtggttcacttttcatgtgttctatcgtacagggatgcaaaaggacatatctgtcgcagcgcgacctgcaggcgcatattaaccataggcatatgcgtgctggaaaacccgtgacccgcgccagtcttgaaaatgttcatcctccaatcgcccctccacccaccgaaattccagaacggtttatcatgccccccgataagcaccatatgagccatatccccccaaagcagcacattatgatgccccccccacctttgcagcatgttccccatgaacattataaccagccgcatgaggacatacgtgcaccccccgcagagttgagtatggcacccccccctccaagaagtgtgagtcaagaaaccttcaggatctctactcggaagcattccaacctcattaccgtgccaatccaggacgatagtaatagcggcgccagagagcccccacctcctgcacccgcccccgctcaccaccatccagaataccagggccagcctgtggtgtcccacccccaccacattatgccacctcagcaacattacgcacccccacccccacctcctcctccgataagccatcccatgcctcaccctccccaagcagccgggactcctcatctcgtgtacagccaggcacctcctcctcccatgaccagtgcgcctccccccatcacgcctccccccggccacatcatagcccagatgcccccttacatgaaccatccaccccctggcccaccaccaccccagcacggcgggccccctgtgactgcaccgcctccacatcactacaaccccaattctctgccccagtttaccgaagatcaagggacactgagcccaccgttcacacagccaggtgggatgtctccgggaatctggcctgccccccgcggacccccacctcctcctagactgcagggcccaccgagccagacacccctgcctgggccacaccaccctgatcagacaagataccggccatactaccagtag

SEQ ID NO: 181739 - DNA, 1113 bp, Artificial Sequence
  Description of Artificial Sequence: Synthetic coding sequence
atgatcccctgcaagcacgtgttctgctacgactgcgccatcctgcatgagaaaaagggagataagatgtgtcctggctgctctgaccccgttcagaggatagagcagtgcacacggggcagcctgttcatgtgcagcatcgtgcaaggctgtaaacggacatacctgtctcagcgcgacctgcaggcccatatcaatcatcggcatatgagggccgggaagccagtgactcgggcctctcttgaaaacgtgcaccctccaatcgccccacctcctaccgagatccccgaacggttcatcatgccccctgacaaacaccacatgagtcacattccaccgaaacagcacattatgatgcctccgcccccgctccaacacgtgcctcatgagcactataaccaaccccatgaggacattagagctccccccgccgagctcagcatggccccaccgccgcctagatccgtatcccaagaaactttcagaatatccactagaaagcactctaacctgatcactgtgccaatacaggacgactccaattctggcgctcgcgaaccgcctcccccagctccggctccagcacatcatcacccagaatatcagggtcagcctgtagtctcgcatccccatcatataatgcctccccagcaacactacgctccccccccgccccctccccccccaatctcacatcctatgccacatccaccccaggccgccggtacccctcaccttgtttactctcaggctccacctccccctatgacatccgcgcctccgccaatcacaccacctcccggccacataattgcacagatgccgccttacatgaatcacccgccacccgggcctccccctccacagcacggcggccctcctgttacagcacccccaccacatcactacaacccaaattcccttccccagttcactgaggaccagggcactctgagtccgcccttcacccaacctggggggatgagccccgggatctggcctgcaccacgagggcccccgccgccaccacgactccagggtccaccttctcagactccattacctggaccacaccaccctgaccagacccgttacaggccctattaccagtag

SEQ ID NO: 181740 - DNA, 681 bp, Artificial Sequence
  Description of Artificial Sequence: Synthetic coding sequence
atgaaggtgctgatcctggcctgcctggtggccctggccctggccagggaaaccatcgagagtctgtcctccagcgaagagtccatcaccgaatataaacagaaagtcgagaaagtgaaacatgaggaccaacaacaaggggaagatgagcatcaggataaaatttacccctcattccaacctcagccactgatttacccattcgtagagccaatcccttacgggtttctcccccagaatatcctgcccctggcacaacccgccgttgtccttccagtgccccagcccgaaataatggaagtcccaaaggccaaagataccgtgtacacaaagggaagggtcatgcccgttctaaaatccccgacaatccctttcttcgatccacagattcctaaattaacagatttggagaatctccacttgccactcccattgctgcagccattgatgcagcaggtccctcagcccattccccagacccttgccctgccaccccagcccctgtggtccgtgcctcagcctaaggtattgcctatccctcagcaggttgtcccctatccccagcgagccgtcccagtgcaagctctgttactgaaccaggagctgctgttgaatccaacgcaccagatctatcctgtgacccaacctctggcgcccgtgcacaatcctatttcagtgtag

SEQ ID NO: 181741 - DNA, 549 bp, Artificial Sequence
  Description of Artificial Sequence: Synthetic coding sequence
atgaagagcttcctgctggtggtgaacgccctggccctgaccctgccctttctagccgtcgaagtgcagaaccaaaagcagcccgcatgccatgaaaatgacgagcgcccgttttaccagaaaactgccccctatgtccctatgtattacgtaccaaacagttatccatactacgggactaatttgtaccagcgccgccctgccatcgccatcaataatccatatgtgccacggacctattacgcaaaccccgctgtcgtccgcccacacgcccagattccccagaggcagtaccttcccaacagccaccccccgacagtggtccggcggcccaacctgcacccgtcattcatcgctattccccccaagaagattcaggataagatcattattccaactattaacacaatagcaacagtggaacccacgcctgcccccgctacagagcccactgttgactcagtcgtgaccccagaggcattctctgaatctatcatcactagtacacccgagacaaccaccgtcgccgtgactcctcccaccgcctag

SEQ ID NO: 181742 - DNA, 978 bp, Artificial Sequence
  Description of Artificial Sequence: Synthetic coding sequence
atggccagcagcagcggcagcaaggccgagttcatcgtgggcggcaaatataagctggtgaggaaaatcggaagtgggagtttcggggacatatatctggccattaacatcaccaacggcgaggaagtggccgtcaagctcgaaagccagaaggccaggcacccccagctgctgtacgaaagcaagctttacaaaatccttcagggcggggtgggcatcccccacatcaggtggtacggtcaggagaaagactataacgtgctggtgatggacctactcgggcccagcctggaagatctgtttaatttttgctcccgccgatttaccatgaaaacagtactcatgttagcagatcaaatgatcagtaggatagagtacgtgcatactaagaactttatccaccgggacataaagccagacaacttcctgatgggcatcggacgccactgtaacaagcttttccttattgattttgggcttgcaaaaaaataccgcgataacaggacccgccaacacattccttatagggaagacaagaacctgacgggcaccgctcgctatgcatccattaacgcacatctgggcatcgaacagtcgcggcgcgatgatatggaatcactggggtatgtccttatgtattttaaccgcacctccctaccgtggcagggactaaaggcggcaactaagaagcagaagtatgagaagatctccgaaaagaaaatgtccacccccgtagaagtcctttgcaaagggttcccagctgaatttgccatgtacctgaattactgtcgagggctgcggttcgaggaggcaccggactacatgtatcttcggcaactgttccggatcctgttccggacgctgaaccatcagtatgattacacttttgactggacgatgcttaaacagaaggcagctcagcaggccgcgagctccagtggccaagggcaacaagcacaaacgccaactggcttctag

SEQ ID NO: 181743 - DNA, 978 bp, Artificial Sequence
  Description of Artificial Sequence: Synthetic coding sequence
atggccagcagcagcggcagcaaggccgagttcatcgtgggcggcaagtataaactggtgcggaagattggttctggtagttttggtgatatctacctggctatcaatattaccaatggagaagaggttgcagtgaaacttgaaagccagaaagccaggcatccccagctcttgtacgagagcaagctgtataaaatactccagggaggcgtcggtataccgcatattagatggtatggccaggagaaggactacaatgtactggtaatggacttactcggccccagtttagaggatctcttcaacttctgttcacggaggtttactatgaagactgtcctgatgctagctgaccagatgatcagtcggattgaatatgtgcacaccaagaatttcattcaccgcgatataaagccagataacttcctaatgggaattggcagacattgtaataaactgttcctcattgattttggcttagctaaaaagtatcgggacaaccgcacaagacagcacatcccatatcgtgaggataagaatctgaccggcactgcaaggtacgcctctataaatgcccacttgggaatcgaacagtcaagacgggacgatatggagtcacttggctatgtgttgatgtacttcaaccgtacaagtctgccgtggcagggccttaaagcggctaccaaaaagcaaaagtacgagaaaatcagtgagaagaaaatgagcactccggtggaggtcctctgcaaaggattccctgcggagttcgccatgtacctcaattactgtcgggggctgcgtttcgaagaggctcccgattacatgtatcttaggcagctgttcaggattctatttcgcacgttaaaccatcaatacgattacaccttcgactggaccatgttaaagcagaaagcagcccagcaggctgccagttcatctgggcagggacagcaggctcaaactcctacaggcttttag

SEQ ID NO: 181744 - DNA, 1014 bp, Artificial Sequence
  Description of Artificial Sequence: Synthetic coding sequence
atggccagcagcagcggcagcaaggccgagttcatcgtgggcggcaagtacaaacttgtgaggaagattgggtctggcagcttcggcgatatctacttagccataaacattactaatggcgaagaagtggccgttaagctggagagccagaaggccaggcaccctcagctgctctatgaaagtaagttatacaagatcctacaggggggagttggcattcctcacattcggtggtatggccaggagaaggattacaatgtcttagtgatggatctgctggggccctccctggaggatctgttcaacttctgcagtcgcaggttcaccatgaagaccgtgcttatgctggctgatcagatgatctctagaattgagtatgtgcacacaaagaatttcatacatagggatatcaagccagacaacttcctgatgggtatcggtaggcattgcaataagttatttcttattgacttcggcctagcaaaaaagtatcgtgacaatcgtacccgccaacacatcccatatcgcgaggacaaaaatctgactggcaccgctcgatacgcgtcaatcaacgcacatttgggaatcgaacagtccagaagagatgacatggaatctttaggatacgtgctgatgtacttcaaccgtacttctctgccctggcaaggcttgaaagcagcgaccaagaagcagaagtacgagaaaatctctgaaaaaaagatgagcaccccagtcgaagtcctgtgcaaaggattcccagcagaattcgcgatgtatctgaattactgccgtggactgcgttttgaggaagcacccgattacatgtacttgaggcaactttttcgtattctgtttagaaccctcaatcatcaatatgattacaccttcgattggacgatgctgaaacagaaagcggcccagcaggctgcatcatcttctggacagggtcagcaggcgcagacacctacaggcaaacaaacagataaaaccaagtccaacatgaagggcttttag

SEQ ID NO: 181745 - DNA, 1098 bp, Artificial Sequence
  Description of Artificial Sequence: Synthetic coding sequence
atggccagcagcagcggcagcaaggccgagttcatcgtgggcggcaaatacaagttggtgagaaaaattggctcagggagctttggcgacatatatctggcgatcaatatcaccaacggagaggaggttgccgtgaagttagaatctcagaaggctaggcatcctcagctgttatacgaatctaagctgtacaagatcctccaaggaggggtagggataccacacatccggtggtatggtcaggaaaaggactacaacgtcctagtgatggaccttctgggcccatctctggaagatctcttcaacttctgctctaggcgcttcactatgaagacagttcttatgctggccgatcagatgatctcccgaattgagtacgtgcacaccaagaactttatacatcgcgacatcaaaccggataactttctaatggggatcggcagacactgtaacaagtgtctcgaaagtcccgtggggaaaaggaaaagaagcatgacagtgtccacatctcaggatccaagcttcagtggactgaaccaactgttcctcatcgacttcggcctagcaaaaaagtacagagataaccggactcggcagcatataccttacagggaggacaaaaacctgaccggaaccgccaggtacgcaagcattaatgcccacttgggcatcgagcagagtagaagagacgatatggagtcactgggctacgtcctcatgtactttaacagaacctccttgccctggcaagggctgaaggcagccaccaaaaagcaaaagtatgagaaaatcagcgagaagaagatgagtacgccggtggaggttctctgcaaaggtttcccggccgaatttgctatgtatctgaattattgcaggggactgcgattcgaggaagctcccgactatatgtacctgagacagctgttccgaatcctttttcggacactgaatcaccagtacgactacacatttgactggactatgttgaagcagaaggctgcgcaacaggcggcaagctcttcgggtcagggacagcaagcccagacacctaccggaaagcagacagacaagactaagagtaacatgaaaggattctag

SEQ ID NO: 181746 - DNA, 1029 bp, Artificial Sequence
  Description of Artificial Sequence: Synthetic coding sequence
tgccgggaggagatcagccggatcgagtacatccacagcaagaactttatacatagggacgtgaaaccagacaacttcctgatgggcctgggcaaaaagggcaatttggtgtacatcatcgattttggactggcaaaaaaatatcgtgacgcgcggactcatcagcatataccatatcgggagaacaagaacctcacaggaactgctcgctacgccagcatcaacacacaccttggcattgaacaatcgcgaagagacgacctcgagtcactggggtatgtgctgatgtacttcaatctgggctcccttccttggcaggggttgaaggccgctaccaaacgccagaaatatgagaggatatccgaaaagaagatgtcaacccccattgaagtgttatgcaaaggatatcccagcgaatttgcgacatatctgaatttctgccgttccctgcgtttcgacgacaaaccggattactcatacttgaggcagctgttccgcaacctgttccacagacagggattctcctatgattatgtatttgactggaacatgctgaagttcggcgcttctagagccgcagacgatgccgagagagagcggagggaccgcgaagaacgccttagacactctagaaacccggctacccgaggactgccaagtacggcctctggccgcctgagggggacccaggaagtggcccctcccacacctttgacccctacttctcacactgccaacacctcaccaaggcccgtttctgggatggaacgggagagaaaggtgagtatgcgcctgcacagaggtgcgcctgtaaacatatccagtagcgacctcacaggccgccaagacacaagtcgaatgagcactagccaggtgggggcggaattgcccggtggtcgctgggcctctggatatcccgtgcgagttaaaagtggcctgtggttccttcaaggattcttctttccattctttcctccattccttagggtgtttaacttggcccgggtatggaggcttggctgtcgctag

SEQ ID NO: 181747 - DNA, 1248 bp, Artificial Sequence
  Description of Artificial Sequence: Synthetic coding sequence
atggagctgcgggtgggcaaccggtaccggctgggccggaagatcgggagtgggtcttttggcgacatttacttagggacagacatagctgctggcgaagaagtggctattaaactggagtgcgttaagaccaaacacccacaactccatatagagagcaagatttataagatgatgcaggggggcgtcggcattcctaccattcgatggtgtggtgcagagggcgactataatgtgatggttatggaacttctcggcccatctctggaggatctgtttaatttctgctctcgcaagttctcactcaagactgtactccttttagccgatcaaatgattagccgcatcgagtacatacactcgaagaacttcatacaccgggatgtcaaaccagacaattttctgatgggattgggcaagaaaggcaatttagtgtacatcattgattttgggctggctaaaaagtatcgtgatgcaagaactcaccagcacattccctatagggagaacaagaaccttactggaaccgcccggtacgcttcgatcaacacccatctgggcatcgagcaaagtcggagagacgatctggagtccctgggatacgtgttaatgtacttcaaccttggctccctaccatggcagggcctcaaggctgccaccaaacgccaaaagtatgagcggataagtgagaagaaaatgtccacaccgatcgaggttctttgtaagggctaccccagtgaattcgcaacctacctaaatttctgtcggagcctgaggtttgacgataagccagattatagctacctccgccaactctttcgcaacttgttccacagacaaggcttctcttatgattacgtttttgactggaacatgctgaaatttggcgcctcgagagccgccgatgacgccgagagagagaggagggacagggaggagcgtctccgccatagcagaaatccagccacacggggactgccttccaccgcaagtggccgcctccggggcacgcaagaggtggcgcctccaacccccttgacccctacctctcacaccgctaacacaagtccgcgtccagtcagcgggatggaacgcgaaaggaaggtgagtatgcgcctgcacagaggtgcacctgtaaatatcagttcaagcgatctcacaggcagacaggacacatcgaggatgtcgacgtcccagattccaggacgggtcgcctcctctggcctgcagtccgtggtgcaccggtag

SEQ ID NO: 181748 - DNA, 1230 bp, Artificial Sequence
  Description of Artificial Sequence: Synthetic coding sequence
atggagctgcgggtgggcaaccggtaccggctgggccggaagatcggttccggcagttttggggatatatacctgggaaccgacatagcagccggcgaggaagtggctatcaagctagagtgcgtcaagactaagcatccacagctacacatagagtcaaaaatctataagatgatgcagggcggcgtcggaattccaaccatcagatggtgtggggccgagggagattataatgtgatggtgatggaactgttgggtcccagcctggaagacctgttcaacttctgttcccggaagttctctctcaagactgtcctgctgctggctgatcagatgatctctcgtatagaatacattcacagcaagaactttattcacagggatgtgaaacccgataacttcctgatgggactcggcaagaaaggaaacctggtctacatcatcgatttcggtttagccaaaaaatatcgggacgcgaggacccaccagcacattccataccgagagaataaaaacctcacgggcactgccaggtatgcgtccattaatacccatctgggaatcgaacaatcacgacgcgatgatctcgagagcctcggatacgtgttgatgtattttaatctgggatctctgccatggcaagggttgaaggcagccacaaagcggcagaagtatgaacggatcagtgaaaaaaaaatgtctaccccaatcgaggtgctttgcaaggggtacccttctgaattcgccacttacctgaatttctgccgctctctgcgctttgatgataaaccagactacagctacctgagacaactctttcggaacttgtttcacagacagggcttctcatacgactacgtattcgactggaacatgctcaaattcggggcaagtcgtgcggccgacgacgccgagcgcgagaggagagaccgggaggagcggctgagacatagcaggaaccccgctacccgcggcctgccatccaccgcctccgggcggctgagaggcacgcaagaggtggcacctcccacaccactcacgccaaccagtcataccgcaaacaccagtccaaggccagtctcaggtatggagagagaacgcaaggtgtctatgcgcctgcataggggagcacccgtcaatatatcctcgtcggatttgacaggcagacaggataccagccgcatgtccactagccagaactctattccattcgagcatcatggcaaatag

SEQ ID NO: 181749 - DNA, 1077 bp, Artificial Sequence
  Description of Artificial Sequence: Synthetic coding sequence
atgatgcagggcggcgtgggcatccccaccatccggtggtgcggcgccgagggcgattataacgtcatggtgatggagcttctcggaccttccttggaagatttgttcaatttttgctctcgcaaattttctctgaagactgtgctcctgctggcagaccagatgatttctcgtatcgagtatatccatagcaaaaatttcatccatcgtgacgtgaagccagataactttttaatgggattgggaaagaagggtaacctggtgtacataattgatttcgggctcgctaagaagtaccgcgatgcccgcacacatcaacacatcccctatcgtgaaaataagaatctcaccgggacagctcgttatgcctcaatcaacacgcatctcggcatcgagcagtcacggcgggacgatctggagtcattgggctacgtgctgatgtattttaatctcggaagcctgccatggcagggtctgaaagcggccactaagcgccagaaatacgagagaatctccgagaaaaagatgtctacccctatcgaggtcttatgcaaggggtacccctcagaattcgccacctatctcaacttctgcagatcactcaggttcgatgataaaccagactacagctacctcaggcaattgttcaggaacctctttcataggcaaggcttctcctacgattacgtctttgattggaacatgctcaagtttggggcctccagggcagcagacgatgccgaacgggaaagacgcgatcgagaagagaggttgcgccattcgcgcaatcctgccacaaggggccttcccagcacagccagtggtcgcctgagaggaactcaggaggtggccccgcccacaccccttacccctacatctcataccgcaaatacttctcccaggcccgtgagcggcatggaaagggagcggaaggtgtctatgagactccacagaggagctccagtgaacatctctagttctgatcttacaggaaggcaggacacctcccggatgagtacgtcacagatccccggcagagtggcatcaagcggcctgcagtccgtggttcaccgatag

SEQ ID NO: 181750 - DNA, 381 bp, Artificial Sequence
  Description of Artificial Sequence: Synthetic coding sequence
atggagctgcgggtgggcaaccggtaccggctgggccggaagatcggatctggctcatttggggacatctacctcggcaccgatatcgctgccggagaggaagtagccatcaaactggaatgtgtgaagacaaagcacccccagcttcacatcgaatcaaaaatctacaagatgatgcagggcggcgtgggcattcctacaatcagatggtgcggggctgaaggagactataatgtgatggtgatggagctcctgggcccctctcttgaggatcttttcaacttttgtagccgcaagttctccctgaaaacagtgctgcttctcgcggatcagatgaacaacccggaggaaatgacatggagcttgtgggccacgtgttag

SEQ ID NO: 181751 - DNA, 1251 bp, Artificial Sequence
  Description of Artificial Sequence: Synthetic coding sequence
atggagctgcgggtgggcaacaagtaccggctgggccggaagatcggcagcggttctttcggagatatatatctcggcgcaaatattgccagcggagaggaagttgccattaaactagagtgcgtcaagacaaagcaccctcagctgcatatagaatctaagttctataagatgatgcaggggggcgtgggcatcccctccatcaagtggtgcggtgctgaaggtgattataatgtgatggtgatggagcttcttggtccaagcctagaagatttgttcaacttctgcagccggaaattttccctgaagaccgtgctgctgctggcagatcagatgatcagcagaattgaatacattcattcaaagaactttatacaccgtgacgtcaagccagataacttcctgatggggctgggcaagaaaggcaatctcgtgtatataattgatttcggcctggctaagaagtacagggacgcacggacgcaccagcacattccctaccgagaaaataaaaacctcaccggcactgcccgatacgctagcatcaatacacatctgggcatcgagcagtctcgcagggacgacctggagtcacttggctatgtgctgatgtacttcaatctcggctccctgccctggcagggccttaaggccgccaccaaacgacagaagtacgagaggattagcgagaaaaagatgagcacacctattgaagtgctttgcaaaggatatcctagcgagttttcaacttacctgaacttctgccgcagcctcaggtttgacgataaaccggactattcttacttgcgacagttgtttagaaacctgtttcaccggcagggattctcttatgactacgtgtttgactggaatatgctgaaatttggcgcggcaaggaatcctgaagatgtagatcgggaaagaagggagcacgagcgggaggaaaggatgggacaactcagagggtccgcaacaagggccttgccgcccggcccccccacgggggcgaccgccaaccggctgcggtccgcggcggagcccgtcgcgtctactccagcgtcaagaatccaaccagctgggaatacctccccacgtgcaatttcacgtgtggaccgagagagaaaagtaagcatgcgcctccaccgcggcgctccggcaaacgtcagctcttctgacttaactggccggcaggaggtatcacgtatccctgcctcacaaacaagtgtgccatttgaccacctcggcaagtag

SEQ ID NO: 181752 - DNA, 360 bp, Artificial Sequence
  Description of Artificial Sequence: Synthetic coding sequence
tgacggaaccccgaggacgtggaccgggagcggcgggagcacgagcgcgaggaacgaatgggacagctccgcggctccgcgacgagggcactgcctcctgggcctcccacaggagcgacagctaaccgacttcggtctgcagccgagccagtggctagcaccccagccagtcgcatacagcctgccggaaacacctccccgcgcgccatcagccgcgtggatcgcgaaagaaaggtaagcatgcgcctgcaccgaggggcccccgccaacgtgtcttcctctgacttgaccggccgccaggaggtgagccgcatcccagcttcacagacttcagtgccgtttgaccacctgggcaagtag

SEQ ID NO: 181753 - DNA, 1251 bp, Artificial Sequence
  Description of Artificial Sequence: Synthetic coding sequence
atggagctgcgggtgggcaacaagtaccggctgggccggaagatcggatctgggtcctttggagatatctatctgggagccaacatagcctccggggaggaggtcgccataaaattggagtgtgttaaaaccaagcatccccagctccacatagaatcgaaattttataaaatgatgcagggcggggtgggaatcccatcaattaagtggtgcggggctgagggcgactacaatgttatggtcatggaactgctagggccaagcttggaagatctgttcaatttttgctctagaaagttcagcttaaaaaccgtgctgttgctcgctgaccagatgatttctcgcatcgagtatatacactccaagaactttatacaccgcgatgtgaagcctgacaatttcttgatgggtttaggcaagaaaggaaacctcgtgtacattatcgattttggcctggcaaagaaatacagggatgcacgcacccatcaacacatcccatatcgcgagaataaaaatctgacgggcactgcaaggtatgcctccattaacacccatctcgggatagaacagtctcgaagggacgatctcgaaagccttggatacgtgcttatgtactttaatctggggtcactcccctggcaaggactgaaggcggcaactaaaagacagaagtacgaacgcatttccgaaaagaagatgtccacgccgatcgaggtgttatgcaagggctacccgtcagaattctccacctatctgaacttctgtcggtctttacgcttcgacgacaagcccgactactcctacctgcgtcagttattcaggaaccttttccaccggcagggcttctcttatgactatgtcttcgactggaatatgctgaaatttggggcagcgagaaatcccgaggatgtggatcgagagcggagagagcatgagcgagaagaacggatgggacaactgcgaggctcagccacacgagccctgccccctggtccaccaacgggggcaaccgccaatcgcctccgctccgcagccgagccagtcgcctccactccagccagccgcatccagccggctggcaacacctccccacgcgctatttcacgcgtagatagagagagaaaagtgtccatgcgactccaccgtggcgcccctgctaatgtatcttctagcgatctaaccggcaggcaagaagtttcacgtatcccagctagtcagacgtcggtcccttttgatcatctggggaagtag

SEQ ID NO: 181754 - DNA, 1251 bp, Artificial Sequence
  Description of Artificial Sequence: Synthetic coding sequence
atggagctgcgggtgggcaacaagtaccggctgggccggaagatcgggagcggatctttcggtgatatctatctgggtgcaaacatcgcatcgggcgaagaggtagcaataaaattggaatgcgtgaaaaccaagcatccccagctgcatatcgagtcgaagttttataaaatgatgcagggcggcgtcggcatacctagcatcaaatggtgcggagccgagggagattacaacgttatggtcatggagcttctggggccatccctggaagatctatttaatttttgcagcagaaagttttcactgaagactgtcctcctgttagctgatcagatgatatcacgcatcgaatacatccactctaaaaattttattcacagggatgtgaagccagataacttccttatgggccttgggaagaagggtaacttagtgtacattatagacttcggactggcgaagaagtatcgcgatgccaggacgcaccagcatatcccttatcgggaaaacaagaatttaaccggaacggcacgatatgccagtatcaacacccacctggggatcgagcagagcagaagagacgacttggagagtctcggatacgttctgatgtactttaatttaggctcactgccgtggcagggactcaaagccgccactaaaagacagaagtatgaacgcatctcagaaaaaaaaatgagtacaccgattgaagttctgtgcaaagggtacccctcggagtttagtacgtacctcaacttttgtcgctcactcagattcgacgataagcctgactattcatatctcaggcaattatttaggaatctgttccacaggcagggattctcctacgactacgtgttcgattggaatatgcttaagttcggggcagctagaaacccggaagatgtggacagggagagaagagagcatgagcgggaggaacgcatgggccagttacggggaagcgcaacacgggccctgccacccggtccccctactggcgcaaccgcaaaccgcctgcggtctgcagccgagccagttgcatcaactccggcaagccgtattcagccagcgggcaatactagccccagagccatatccagggtggacagagagcgaaaggtcagtatgcgactgcaccgcggagccccagcgaacgttagtagcagtgatctgaccggcagacaggaagttagcagaattccagctagccagacctctgtccctttcgaccacctcggaaagtag

SEQ ID NO: 181755 - DNA, 1251 bp, Artificial Sequence
  Description of Artificial Sequence: Synthetic coding sequence
atggagctgcgggtgggcaacaagtaccggctgggccggaagatcggctccggaagcttcggcgacatatacctaggcgcaaatatcgcttccggcgaagaggtggcgattaaattggaatgtgtcaagactaagcacccccagctgcatattgaatcaaaattctacaagatgatgcagggaggcgtcgggattccttcaatcaaatggtgcggcgctgaaggcgattacaatgtcatggtgatggagcttctggggccatctttagaggacctttttaacttctgctccagaaagttctcattgaagactgttctattgctggcagatcaaatgattagcagaatagaatacatccatagcaagaattttattcatagggacgtcaagccggataactttctaatgggacttgggaaaaagggcaaccttgtgtatattattgattttgggttggccaaaaagtatcgcgacgcccgcacccatcagcatattccctatcgcgagaataaaaacctgaccgggactgcaaggtatgctagtatcaacacccacttgggtattgagcaatcccggcgcgacgacttggagtccttagggtatgtgctcatgtactttaatttgggcagcttgccatggcagggtttaaaagccgcaactaaaagacagaagtacgagcggatttctgaaaaaaaaatgtccacacctatcgaagtgttatgcaaagggtacccaagcgaatttagcacctacctcaacttctgccggagcctgagatttgatgacaagccagattactcgtaccttcgacagctctttcgcaacctcttccataggcagggcttcagctatgattacgttttcgattggaacatgctgaaattcggtgcagcgcggaaccccgaggacgtcgatcgtgagaggagagagcatgaaagggaggaacggatgggtcaactgcggggatccgcaaccagggccctgccacctggaccccccaccggcgcgacagcgaataggttgcgatcagccgctgagccagtggctagcacgcccgcttcccggatacagcctgcaggcaatacttcgcccagggcgataagccgtgtggatagggaacggaaagtgtccatgcgtctgcaccggggggcccccgcgaatgtctccagctctgatcttacaggcaggcaagaagtgagtcgtatacccgcaagccagacctccgtcccatttgaccacctggggaagtag

SEQ ID NO: 181756 - DNA, 1251 bp, Artificial Sequence
  Description of Artificial Sequence: Synthetic coding sequence
atggagctgcgggtgggcaacaagtaccggctgggccggaagatcggctccggatcttttggggacatatacctcggtgcaaatattgcatccggggaagaagtagcaattaaacttgagtgtgtaaaaaccaagcatcctcagctccatattgaatcgaaattttacaaaatgatgcaggggggagtagggatccctagcataaagtggtgcggagccgagggtgattataacgtgatggtcatggaattgcttggaccttctctagaggacctctttaatttttgtagtcgtaaattctctctcaagacggtactcctcctggccgaccagatgatttcacgcattgagtatatccatagcaagaattttattcatcgagatgtaaaacccgacaatttccttatgggacttggcaagaagggaaacctggtgtacatcattgacttcgggctggctaaaaagtaccgcgatgcacggacacaccagcatattccttatagagaaaataagaacctgacaggcacggccaggtatgcctcgatcaacacacacctgggaatagagcagtcaagacgggacgacctagagagtctgggctacgtcctgatgtattttaacttgggctctcttccctggcagggattgaaggctgccaccaaacggcagaaatatgagagaattagtgagaaaaagatgtccacacctattgaggtgctgtgcaaggggtatccaagcgaattttctacttatctgaacttctgtagaagcctgagatttgatgataaaccggactactcatatctccgccagctgtttcggaacttgtttcatagacagggattttcatacgactatgttttcgactggaacatgctcaagtttggagcggcccgcaatcccgaggatgtggaccgtgaacggagagagcatgaaagagaggaaagaatgggacagttaagaggctcagccacccgcgcactccctcccggccctccaaccggagcaaccgccaatagacttcggagcgccgccgagccagtggcttccacccccgcctccagaatccagcctgccggcaacacaagtccacgcgctataagcagagtggaccgcgagcgtaaagtcagtatgcgacttcatcgaggggcccctgccaatgttagttcttctgacctcacaggaagacaagaagtttcgaggattccggcatctcagacctcagtcccttttgatcacctagggaagtag

SEQ ID NO: 181757 - DNA, 678 bp, Artificial Sequence
  Description of Artificial Sequence: Synthetic coding sequence
atggagctgcgggtgggcaacaagtaccggctgggccggaagatcggctcgggatcgttcggggacatttacctgggcgccaatatcgccagcggcgaggaagtggcaattaaactcgagtgtgtaaaaaccaaacacccacagttacacatcgagtcgaaattttataagatgatgcagggtggcgtaggaataccgtcaattaaatggtgcggggctgagggcgattacaacgtcatggtgatggagctcttaggccccagcctggaggaccttttcaatttctgttcgagaaaatttagcctgaagacagtgctgctgttagcggatcagatgatttctagaatagagtatatccattcaaaaaacttcatccacagagacgtgaaacctgacaactttctcatggggctcggaaaaaaagggaacctggtctatattatcgacttcggtctggccaaaaagtacagagatgctcgcactcaccagcatatcccgtatagggagaataagaacctaaccggaaccgctcgctatgccagcattaatacacacctgggtattgagcagtcaagaagagacgatctagagtctctgggctacgtgttgatgtattttaacctcggttcactgccttggcaagggctgaaggcagccaccaagaggcagaagtactag

SEQ ID NO: 181758 - DNA, 435 bp, Artificial Sequence
  Description of Artificial Sequence: Synthetic coding sequence
tgacggaacctgttccaccggcagggcttcagctacgactacgtgtttgactggaatatgctgaagtttggcgctgccagaaaccccgaagacgtggatcgggagcggagggagcacgaaagggaggaaagaatgggccagcttcgcggtagtgcaaccagggccctgccgcccgggccacctacaggcgcaacagcgaaccgattacgttcagccgccgagcccgtggcaagtacacctgcctccagaatccagccagcaggcaacacatccccccgagccatctctcgtgtggatcgggagaggaaggtctctatgcgactgcaccgcggggctcctgcaaacgtttctagctccgacctgacaggtcggcaggaagtatcccgcattccagcctcacagacttcagtccctttcgaccacttgggaaagtag

SEQ ID NO: 181759 - DNA, 1182 bp, Artificial Sequence
  Description of Artificial Sequence: Synthetic coding sequence
atggaccaccccagccgggagaaggacgagcggcagcggaccaccaagcccatggctcagaggagtgcacactgttcccgcccatcaggctctagttcaagttccggagtgctgatggtggggcccaatttccgcgtgggaaagaagataggttgtggaaactttggggaattgcgactcggcaagaacctctacaccaacgagtacgtggccataaaattggagccaattaaatcgcgtgcgcctcaacttcatctcgaataccggttctataagcagctgggctcagctggggagggcctgccacaggtttactattttggtccgtgtgggaaatacaacgcaatggttcttgaattactcggaccctccctggaagaccttttcgatctgtgcgataggacctttactcttaagaccgtcttaatgatcgccatacagctgttatcaagaatggagtatgtccactccaaaaacctgatatatagagatgtgaagcccgaaaactttctgataggtcgccagggaaataagaaagaacacgtgatccatatcatcgactttgggctggccaaggaatatattgaccccgaaaccaagaaacacatcccttaccgcgagcacaaatcactaactggcacggctcgatacatgtccatcaatacacaccttggaaaggaacagagcaggcgcgacgacctggaggccctgggacacatgttcatgtacttcctgcgggggtctctcccttggcagggcttaaaggctgatactcttaaggagcgctatcagaagattggtgacactaaaagaaacacacccattgaagccctctgcgaaaacttcccagaggagatggcaacctacctccggtacgtgcgcaggttggacttttttgagaagcccgattacgagtaccttcggacccttttcacggacctgttcgagaagaaaggatatacatttgattacgcttacgactgggtcgggcgccctattcctacccccgtgggctctgtccatgtggatagcggcgcttcagcgatcacacgggaatctcacacacaccgtgaccgcccctctcaacagcaacctctgcgcaatcagtcacttaggactgtgactgctgaacattatgacgtgaacaactctgccatttggcacagggggaggggcacatag

SEQ ID NO: 181760 - DNA, 1269 bp, Artificial Sequence
  Description of Artificial Sequence: Synthetic coding sequence
atggaccaccccagccgggagaaggacgagcggcagcggaccaccaagcctatggctcagcggtccgcacactgttctcgaccatcagggtcatcatcctcttcaggcgtgttaatggttgggccaaatttccgtgtcggcaaaaaaattggatgtggcaattttggcgagctaaggttaggcaaaaacctgtatacgaatgagtacgtcgcaatcaagctggaacccatcaagtcgcgggccccacagctgcatctcgagtatagattttacaaacagctgggatctgccggtgagggactgccacaggtgtactacttcggtccatgtggaaaatacaatgctatggtgctggaactgctggggccttcccttgaagatctgtttgatctttgcgatcggacatttacgttaaagactgtgctgatgattgctatacagctcctgtcaaggatggaatatgtgcactctaaaaacctgatctatagggacgtcaaaccagaaaactttctgattggcagacagggaaacaaaaaggagcacgtgatccatatcatcgactttgggctcgcaaaggagtacatagaccccgaaaccaagaaacatatcccctaccgggaacacaagagcctgaccggcacagcacgttatatgtcgattaacacccatctgggtaaggagcagtctcgtagagacgatttggaggccttgggacacatgttcatgtacttccttagaggatcactgccatggcaggggctgaaggcagacacactcaaagagcgttaccagaaaattggagataccaaacgcaacactcccatcgaggctttatgtgaaaactttcccgaggaaatggccacttatttgcgttacgtacgccgcttagatttcttcgagaaaccagactatgagtacttaagaacacttttcactgacttgttcgagaaaaaaggctacacgttcgattacgcctatgactgggtcggtcggcccataccaacccctgtgggctccgtgcatgtcgacagcggggctagtgcaatcacgcgcgaatcccatacacatagggacaggccgagccagcagcaacccctgcggaatcaagtggtttccagtaccaacggagaactcaatgtggatgaccctacaggggcccattctaacgccccaattactgcacatgccgaggtggaagtggtggaagaggctaaatgttgctgtttcttcaaaagaaagcgaaagaagacagcccagagacacaagtag

SEQ ID NO: 181761 - DNA, 1137 bp, Artificial Sequence
  Description of Artificial Sequence: Synthetic coding sequence
atggaccaccccagccgggagaaggacgagcggcagcggaccaccaagcccatggcccagagaagcgcacactgttcaaggccttctgggtcatcctcaagctccggcgtcctgatggtcggaccgaactttagggtgggcaagaagatcggttgtggaaattttggggagctgagattaggcaagaatctctatacgaacgagtatgtggccattaagctggagctcctaggaccctctctcgaggatctcttcgatttgtgtgatcggacctttactctcaagacagtgctcatgattgcaattcaattgctgagccggatggagtatgtgcatagcaagaatctgatatatcgtgacgtgaaacctgaaaacttcctcataggccgccaaggaaacaaaaaagaacacgtgatacatatcattgacttcggtcttgcaaaggagtatattgatccggaaacgaaaaagcatatcccttaccgcgaacataaaagccttacaggtacagccagatacatgtccatcaacacacacctcggtaaggaacagagtcgccgggatgatctggaagccctcggccacatgtttatgtatttcttgaggggatctctcccttggcagggtctgaaagcggatactctgaaagagaggtatcagaagatcggggacaccaagaggaacactcctatcgaagctctgtgcgaaaactttccggaagagatggctacctacctgagatatgttaggcggcttgactttttcgaaaaacctgattacgagtacttgcgcacgctattcaccgatctgtttgaaaagaagggttacacttttgattatgcatacgactgggtgggacgtcccatccccacccctgtcgggtccgtccatgtggattcgggagcttctgccatcactagggagagccacactcatcgtgataggccatctcagcagcagcccctgcgaaatcaggtggtcagctcgaccaatggggagctcaacgtcgacgaccctacaggggcacatagcaacgctccgataaccgcacacgccgaggttgaagtggtcgaggaggccaaatgctgttgcttctttaaacgcaaaaggaagaaaacagcacaaaggcataaatag

SEQ ID NO: 181762 - DNA, 1248 bp, Artificial Sequence
  Description of Artificial Sequence: Synthetic coding sequence
atggacttcgacaagaagggcggcaagggcgagaccgaggagggcagaaggatgtctaaggccggaggcggtaggtctagtcacgggattagatcaagcggcacatcaagtggcgtgttaatggttggcccaaattttcgggttggaaagaagattggttgtggaaatttcggtgagctccgactcggcaaaaatctgtatacgaatgagtacgtggcaattaagcttgagcccattaaatctagggctccacagctccacctggagtacagattctataaacagttatctgccactgaaggcgtcccacaggtctattatttcggaccctgtggaaaatacaatgctatggtgctggagcttcttgggccctcactagaagatctattcgacctttgcgatcggacttttacccttaaaaccgtgctcatgattgcgatacaactgatcactcgcatggagtacgtacacacgaagagcttgatttaccgagatgtcaagccagaaaacttcttggtgggacggccaggcaccaagaggcaacacgccatccatattatcgactttggacttgcgaaggagtacatagacccagaaacgaagaagcatattccttacagagagcacaaaagtctcaccggaaccgccaggtatatgagcatcaacacccacctagggaaggagcagtctaggcgcgacgatctcgaagccttgggccatatgtttatgtactttctccgcggctcgctgccttggcagggtttaaaggcagacactctcaaggaacggtaccagaaaatcggcgatactaagagagcgacgccaatcgaagtgctgtgcgagaatttccctgaagagatggccacttacctgagatacgttcgcagactcgacttctttgaaaagccagactacgattatctcaggaagcttttcactgatctctttgacaggagtggcttcgtttttgactacgagtatgactgggcggggaagcctttgcctacacctatcggaacagtgcacacagatctgccgtcacagccacagcttagagacaagacacagccacactcaaaaaatcaggcgctgaatagtacgaatggtgagctcaacgctgacgatcctaccgctggccacagtaatgctccaatcacggcgcctgctgaggtagaagttgcggatgagactaaatgctgttgcttcttcaaaagaaggaaaagaaaatccctgcagcgccacaagtag

SEQ ID NO: 181763 - DNA, 645 bp, Artificial Sequence
  Description of Artificial Sequence: Synthetic coding sequence
atgagcatcaacacccacctgggcaaggagcagagccggcgggacgacctggaagcactggggcatatgtttatgtactttctcagaggttcattgccctggcagggtctgaaggccgatacactgaaagagagataccagaaaatcggggacacaaaacgagcaacccctatagaagttctctgtgaaaactttcccgaggagatggcaacctacttgcgctacgtgaggaggctggacttcttcgagaagccagattatgattatctcaggaaactcttcaccgatctattcgaccggagcgggttcgtgttcgactatgagtacgactgggcggggaagccacttccaacaccgatcggtacagttcacaccgatctgccgagccagccacagctacgggataagacgcagcctcccgagtccagtccctgttccccgttggggagagacctcgttcggggacctcggggccccccaacggccgcgcagggacagaccttagctggctctcagaatgccgattgtagaggcagggcctggctaagacgtccccaccccagggacgtgggctcactgccctcatgtaagaccctcgcagaaatcagtacacccgtgtcctcaccacctctccaggaacactag

SEQ ID NO: 181764 - DNA, 1272 bp, Artificial Sequence
  Description of Artificial Sequence: Synthetic coding sequence
atggagaacaagaagaaggacaaggacaagagcgacgaccggatggcccgtccctctggcagatctggccacaatactcgggggaccggctctagttctagtggcgtcctcatggtaggacccaatttccgggttggtaaaaagatcggctgcggcaactttggggaattgaggttgggaaagaacctgtatactaacgagtacgttgctatcaagctagaacccatgaaatccagggcaccccagttgcacctggaatataggttttacaagcagctggggagcggcgatggtattccacaggtctattacttcggtccatgtgggaagtacaacgcaatggtcctggagttgttgggaccatcccttgaagatctgtttgacctttgtgaccggactttctccctcaagacagtgttgatgatagctatccagctgatcagccgaatggaatacgtacattccaaaaatcttatttaccgcgatgtcaaacccgaaaacttcctgatcggtcgcccgggaaataagactcaacaggtgatccacatcatagactttggcttggcgaaagagtatatcgaccctgagactaaaaaacacataccatacagagagcataagagcctaaccggcaccgccaggtacatgagcattaacacccacctcggtaaggagcagtccagacgcgacgatctggaagctctcggtcacatgtttatgtactttctgaggggctctctgccctggcagggcctgaaagccgataccctaaaagaaaggtatcagaagataggggacaccaaacgggctacacctatcgaggtcctgtgcgagaacttccccgagatggccacatacctgcgctacgtccgaaggctcgacttcttcgaaaaaccagattacgactacctgcgaaagctgtttacagatctctttgatcggaaaggatatatgtttgactatgaatatgactggatcggcaagcagctgcccaccccagtaggcgccgtacaacaagacccagctctctcatctaatagggaagcacatcagcacagggataagatgcagcagtccaagaatcaggtggtatcctccaccaatggcgagctgaacacagacgatcctactgctggccgaagcaatgctcctataaccgccccgacagaggttgaagtgatggacgagaccaactgtcagaaggtccttaacatgtggtgttgctgcttcttcaagcgcagaaaacgcaaaaccatccagagacacaagtag

SEQ ID NO: 181765 - DNA, 1368 bp, Artificial Sequence
  Description of Artificial Sequence: Synthetic coding sequence
atggagaacaagaagaaggacaaggacaagagcgacgaccggatggctagacccagtggtcggtccgggcataacacaagggggactgggtctagctcgagtggcgtgctcatggttggtcccaactttcgggtgggaaagaaaattggctgcgggaacttcggcgagctcagactgggaaagaacctctacacaaatgagtatgtggcaattaaacttgaacccatgaagagccgggctcctcagctccaccttgagtatcgcttttataagcaactgggttccggcgacggaattccacaggtgtactactttggtccttgcgggaaatacaacgcgatggtacttgagctcctgggtccgtccctggaagatcttttcgacctctgcgaccggaccttctccctgaagacagtgctgatgatcgcgatccaacttatttcaaggatggagtatgtccatagcaagaacctgatctatagggacgttaaacctgagaactttttgatcggacgcccaggcaataaaacccagcaggtgatccatattatcgatttcgggcttgccaaggaatacatcgaccccgaaactaaaaaacatattccttacagggagcataagagcctgaccggcacagctaggtatatgagcatcaacacacatctcgggaaggagcaaagtaggagggatgatctggaggctctcggccacatgtttatgtattttctgagaggctccttaccctggcagggcttgaaagccgataccctgaaagagcgttatcagaaaatcggcgacaccaaacgtgccacccccatcgaagtgctgtgcgaaaatttcccagagatggccacctatcttcgctacgtacgccgtctcgattttttcgaaaagccggattatgactacctgagaaagctgttcaccgatttgttcgaccgaaaagggtatatgtttgactatgaatacgattggatcggcaagcagctgcccactcctgtgggcgctgtgcagcaggatcccgcactttcttccaaccgcgaggctcatcagcacagagataaaatgcagcagagcaagaatcagagcgctgaccatagagccgcatgggactcacaacaggccaatccgcatcacctgagggcccatcttgcggccgataggcatggaggttctgtccaagtggttagcagcacaaacggcgagttgaatactgatgacccaaccgccgggaggagtaacgccccaataaccgcaccaacagaagtggaggtgatggacgaaacgaactgccaaaaggttttgaatatgtggtgttgctgctttttcaagcgtcgcaagcgcaagacgatacagagacataaatag

SEQ ID NO: 181766 - DNA, 1344 bp, Artificial Sequence
  Description of Artificial Sequence: Synthetic coding sequence
atggagaacaagaagaaggacaaggacaagagcgacgaccggatggcccggccctcaggaagaagtgggcataatacccggggaaccggtagcagcagtagtggggtcctgatggtggggcccaactttagggtgggaaagaagataggctgcggtaattttggtgaactgagactggggaagaatttgtatacgaatgagtatgtggcaatcaaacttgaacctatgaaatcaagagcacctcagttgcacctggaatacagattctataaacagctgggatcgggcgacggaattccgcaagtgtactatttcggtccatgcggaaaatacaacgctatggttttggagttgctagggccaagtctggaggacctctttgatttgtgtgacagaactttctccctgaagactgtgcttatgatagccatacaattaatcagtcgaatggaatacgtgcactctaaaaacctgatatatcgggatgtgaaacctgaaaattttctcattggcaggcctggcaacaaaacccaacaggtcatccacataattgactttggactggcgaaagaatacatcgaccccgagaccaaaaagcacataccataccgggaacacaaaagtctcacaggtactgccagatacatgtccatcaacacacatctgggcaaggagcagtctcgccgggatgatctggaggcattaggtcacatgttcatgtatttcctgcggggatctctgccttggcaggggttaaaggctgacacactcaaggagaggtaccagaaaatcggggacactaaaagagccactccaatagaggtgctctgtgaaaactttcccgagatggctacttatctgcggtatgtgagacgcctcgatttttttgagaagccagactacgattatctacgaaagctcttcaccgacttgttcgacaggaagggctacatgtttgattatgagtatgactggatagggaagcagctccctacaccagtcggggcagtccagcaagatccagcactcagctctaatcgagaggcccatcagcaccgcgacaagatgcagcagagcaaaaatcagtctgccgaccatcgggctgcttgggatagtcagcaggccaatccacaccacttgagagctcaccttgccgccgataggcatggcgggtccgtccaagtggtgtccagtaccaatggtgaattaaatactgacgacccaactgccgggcgcagtaatgcaccgattacagcgcccacggaagtcgaggtgatggatgagacgaagtgctgctgtttttttaagcgcaggaaacgaaagaccattcaacggcataaatag

SEQ ID NO: 181767 - DNA, 1344 bp, Artificial Sequence
  Description of Artificial Sequence: Synthetic coding sequence
atggagaacaagaagaaggacaaggacaagagcgacgaccggatggcccggccgtctggcagatcaggtcacaatactcgggggacaggaagcagctcctcaggtgtactcatggtaggccctaacttccgtgtcggtaaaaagatcggatgtgggaacttcggtgaacttcgtctgggaaagaacctctacactaatgagtatgtagcgataaagttggagcctatgaagagcagagctccacagctccacctcgaataccgattctataaacaactaggttctggcgacggtattcctcaggtttattactttggcccatgcggcaagtataatgccatggtgctcgagttgcttgggcccagcctggaagaccttttcgatctttgtgaccgcactttctctcttaaaactgtcctgatgatcgctatccaactgatatctcgcatggagtatgtgcactcaaagaacctaatatatagagacgtgaagcccgaaaactttcttatcggccgccccgggaataaaacccagcaagtgatccacattatagactttggccttgctaaggagtatatcgaccctgagacaaaaaaacacatcccgtatagggagcacaagtcactcacaggcactgctaggtacatgtccataaacacgcacctggggaaggagcagagcagacgagacgacctggaggcacttggacacatgtttatgtatttcctgcggggtagtctgccatggcaaggccttaaggccgataccttgaaagagcgatatcagaagatcggggacactaaaagagccacgccaattgaggttctgtgtgaaaattttcccgagatggctacatacctacgatatgtgagacgactggattttttcgagaagcccgattatgactatctgcgcaagttattcaccgatttgttcgaccgcaaaggctatatgttcgattacgagtacgactggatcggaaaacaactcccaacgcctgtaggagcggtacagcaagacccagctctgtcttcaaatcgggaggctcatcagcatcgtgataagatgcagcagagcaaaaatcaatcagccgaccatagggctgcctgggatagtcaacaagcaaatccccaccacctgcgggcccaccttgccgcagacaggcacggtggctcggtccaggtagtgagttccacaaacggcgaattaaacaccgacgatccaacggcgggtcggtccaatgcacccatcacggctccaactgaggtggaagtgatggacgagacaaaatgttgttgcttctttaagcggcgcaagcggaagactattcagcgacataaatag

SEQ ID NO: 181768 - DNA, 1368 bp, Artificial Sequence
  Description of Artificial Sequence: Synthetic coding sequence
atggagaacaagaagaaggacaaggacaagagcgacgaccggatggcccggccatcagggcgatcaggtcataatacccggggcacaggctccagttcctcaggcgtactgatggtcggtccaaactttcgcgtgggcaagaagatcggctgtggcaatttcggagaattgcggctagggaagaatctgtacactaatgaatacgtagctattaagctcgagcctatgaaatctcgggccccgcagcttcacctggaatacagattttataagcagctcggcagcggcgacggaatcccgcaggtgtattattttggcccatgtggaaagtacaatgccatggtgcttgagctcctcggtccgtcactggaggatctttttgatctgtgtgacagaacattttccttgaaaaccgtccttatgattgcgattcagctaatctctcggatggagtacgtgcactccaagaacctgatataccgagacgtgaaaccagagaactttctcatcggcagacctggaaataaaacacagcaggtcattcacatcatagatttcggactggcaaaggaatacatcgacccggaaaccaaaaaacatattccctaccgggaacacaaaagcttgaccggaacagccaggtatatgtcaattaacacccatttgggcaaggagcagagtcggcgtgatgacctggaagcactgggacatatgtttatgtacttcctgcgcgggagcctaccgtggcagggcttgaaggctgacaccctgaaagagcgctaccagaagatcggcgacactaaacgggctaccccaatcgaagtcttgtgcgagaactttcctgagatggccacctatctgcggtatgttagacgtcttgatttctttgagaaaccggattatgattacttgaggaagctgttcactgacttgtttgataggaaaggatacatgttcgactacgagtatgattggataggcaaacagcttcccactccagtgggggccgtgcagcaggaccctgccctgtcatccaaccgggaggcacaccaacatcgagacaagatgcagcagagcaaaaatcagtctgcggaccatcgggccgcatgggactctcagcaggccaatcctcaccacctcagggcacacctagcagctgatcgccatggggggagcgtgcaggtggtctcctccactaatggagagctgaatactgatgatcctacagcaggtcggagtaatgcacccatcaccgccccaactgaggtggaagtgatggatgagaccaactgccaaaaggttctcaatatgtggtgctgctgcttttttaagaggcggaaacgcaagacaatacagcgccacaagtag

SEQ ID NO: 181769 - DNA, 1275 bp, Artificial Sequence
  Description of Artificial Sequence: Synthetic coding sequence
atggagaacaagaagaaggacaaggacaagagcgacgaccggatggctaggccatcagggcgatccggccacaacacgcgaggaacaggtagtagcagcagcggtgttctcatggtagggccgaacttcagagtcggaaaaaagattggctgtggaaattttggggaacttcgtctcgggaagaatctgtacaccaacgaatatgtcgctattaaactggagccgatgaaatcacgcgctccgcaactgcatctggaatatcgcttctacaaacagctcgggtccggtgacggaatcccacaggtgtattatttcggaccgtgcggcaagtataacgcaatggttttagagctgctggggccaagtctggaagatcttttcgatctctgcgatcggactttcagcttgaagaccgttttaatgatcgccatccaacttattagccggatggaatacgtgcatagcaagaacctgatatatcgagatgtcaaacccgaaaattttctcataggcagaccgggcaataagacgcagcaggtgatccacataatcgactttggcctcgctaaggagtacatcgacccggagaccaaaaagcacattccttaccgcgagcacaaatccctgactggaaccgcaagatacatgtcgatcaatacccacctgggaaaggagcagtcacggagagacgaccttgaagcactagggcacatgttcatgtacttcctgaggggctcactgccgtggcaggggctcaaggcagacactctgaaggagcgataccaaaagattggtgacacaaagagagccacacccatcgaggtgttatgtgagaacttccccgaggaaatggccacgtacctgcggtacgttcgtcggctagacttcttcgagaaaccagactacgattatctccgaaagctgttcacagatctgttcgatcgaaaaggctacatgtttgattatgagtatgactggattggcaaacaactgcctacccccgtcggggctgtacaacaagatcccgctctgagctcgaacagagaggcccaccagcacagagacaagatgcagcagtcaaagaaccaggtcgttagctccactaacggggaactgaataccgatgatcctacggctgggagaagcaacgctcccatcacagcccctaccgaggtcgaagtcatggacgagacaaattgccagaaagtgctgaatatgtggtgctgctgctttttcaagaggcgtaagagaaagactatacagcggcacaaatag

SEQ ID NO: 181770 - DNA, 1272 bp, Artificial Sequence
  Description of Artificial Sequence: Synthetic coding sequence
atggagaacaagaagaaggacaaggacaagagcgacgaccggatggctcggcccagtggccgttcaggtcacaatacccgaggcaccggtagctcgtcatccggggtgctgatggtaggtcccaatttcagagtaggtaagaagataggatgcggtaatttcggcgagctgagactgggcaaaaatctctatactaatgagtacgtggctataaaactggagcccatgaagagtagagccccacaactgcatctcgaatatcgattctacaagcagcttggttccggtgatggcataccgcaggtatattatttcggcccttgtgggaaatataacgctatggtgttagagctgctggggccttctctggaagatctcttcgatctttgcgacagaacattcagcctgaagactgtactaatgattgctatccagttgatttcacgtatggagtatgtgcacagcaaaaacctgatttaccgcgacgtaaagccagagaacttccttattggccgcccgggtaacaagacccagcaggttatccatataattgacttcgggctggccaaagagtacattgaccccgaaacaaaaaagcacatcccgtatcgcgagcataagagcttaactgggacggccagatacatgtcaatcaacactcatctgggcaaggagcagtctcgccgggatgacctagaggcactgggacacatgtttatgtacttcctgcgtggcagtcttccctggcagggcctgaaagctgatacactgaaggaaagatatcagaaaataggggatactaagcgggctactccgattgaggtcctctgcgaaaattttccagagatggcgacatatctccggtacgttcggaggctggacttctttgagaaacccgattatgactacctgagaaagctgttcacagacttgtttgacagaaaaggctatatgtttgattacgagtacgactggattgggaaacaactgccgaccccggttggggcagtgcaacaagaccctgcactgagctcaaatcgagaagcccatcagcacagggacaagatgcagcagtccaaaaatcaagtcgtttctagtacaaacggcgaactgaataccgacgaccccacagccggacggtccaatgcccctattaccgctcccacagaagtagaagtaatggacgaaactaattgtcagaaggtgctcaacatgtggtgctgttgcttttttaaaaggaggaagagaaagaccattcagcgccacaaatag

SEQ ID NO: 181771 - DNA, 648 bp, Artificial Sequence
  Description of Artificial Sequence: Synthetic coding sequence
atgagcagcagcgaggaggtgagctggatcagctggttctgcggcctgcgggggaacgagtttttttgtgaagttgatgaggattacatccaggataaattcaacctgactgggctgaatgaacaggtgcctcactaccggcaagcacttgacatgattcttgacctggaacccgatgaagaattggaggacaaccccaaccagtctgacctgattgagcaggcagcagagatgctgtatggattgatccacgcccgatacatattgactaatcgaggtatcgcccagatgctcgaaaagtatcaacagggtgacttcggctactgcccccgggtgtactgcgagaaccagcccatgctgccgattggcctttcagacatacccggggaggcgatggtgaaactgtactgtcccaaatgtatggatgtctataccccaaaatcaagccggcatcatcacaccgacggcgcctactttggtaccgggtttccacacatgctcttcatggttcacccagaatatcgacctaaacggcctgccaatcagttcgttcctaggctgtatgggttcaaaatccatccgatggcttaccaactccaactgcaggcagctagtaatttcaagagccctgtgaaaacgatccgctag

SEQ ID NO: 181772 - DNA, 648 bp, Artificial Sequence
  Description of Artificial Sequence: Synthetic coding sequence
atgagcagcagcgaggaggtgagctggatcagctggttctgcggcctgagaggtaatgagtttttctgtgaagtggacgaagactatatccaggataaattcaatttgacgggtttgaacgaacaggtgccacactatcgtcaggcgctggacatgattcttgatctcgaacccgatgaagagctcgaagataaccccaaccagtcggacctcatcgagcaggccgcggagatgctttatggcctgattcacgctcgatacatattaactaacagggggatcgctcagatgctggagaagtaccaacagggggatttcggttattgccctcgcgtttattgcgagaatcagccaatgcttccaattggcctgagtgatatccccggggaggctatggtgaaactgtactgtccaaagtgtatggacgtgtacacccccaaaagctcaagacaccaccatacagatggcgcgtattttgggactggttttccacatatgcttttcatggtacaccccgagtatcgaccgaagcggccagcaaaccagttcgtgcccaggttatacggtttcaagatccatccaatggcctaccaattgcagcttcaggctgcttcaaacttcaagtcacccgttaaaactatcagatag

SEQ ID NO: 181773 - DNA, 648 bp, Artificial Sequence
  Description of Artificial Sequence: Synthetic coding sequence
atgagcagcagcgaggaggtgagctggatcagctggttctgcggcctgagaggaaatgagtttttttgtgaagtggacgaggactatattcaagacaagttcaacctgacaggcctgaacgaacaagttccccattataggcaggcccttgacatgatcctcgatctcgaacctgacgaagaattggaagataatccaaaccagtccgatctgatcgagcaggctgcggagatgttatatggcctgattcatgctcggtacatcctgacaaaccgcggaatcgctcagatgttggagaaataccagcagggagacttcggctactgtccccgggtttactgcgaaaaccagcccatgctgccaatcggcctaagcgacatccccggtgaagccatggttaaactgtactgtccaaaatgcatggacgtttacaccccaaagagttcacgccaccatcatacagacggagcctatttcgggacaggtttcccgcacatgctcttcatggtgcaccccgagtaccgacctaagaggcccgccaaccagttcgtaccgcggttgtatggctttaagattcatcctatggcataccaactacagctgcaggctgcctcaaactttaagtcaccagttaagactatccgctag

SEQ ID NO: 181774 - DNA, 648 bp, Artificial Sequence
  Description of Artificial Sequence: Synthetic coding sequence
atgagcagcagcgaggaggtgagctggatcagctggttctgcggcctgcgagggaatgagttcttttgcgaggttgacgaggactacattcaggacaagttcaatctgacaggtctgaatgagcaggtaccccattacaggcaggccctggatatgattcttgaccttgagccagatgaggaactggaggacaatccaaaccagagcgatctgatcgaacaggccgctgagatgctgtacggtcttatccacgcacgatatattcttactaaccgcggcatcgcccagatgctggagaaataccagcagggagactttggctactgccctcgcgtgtattgtgagaaccaacccatgctacccattggactgtcagacattccaggagaggccatggttaagctgtactgtccaaaatgtatggacgtttacactcctaagagctcacgacaccatcacacagatggcgcttatttcggcactggctttccacatatgttattcatggtccacccagaatatcgacccaagaggcctgccaatcagttcgtcccaaggctatacggatttaaaattcaccccatggcttaccagttgcagctgcaagccgcttccaatttcaaaagtcctgtgaagacaatcagatag

SEQ ID NO: 181775 - DNA, 687 bp, Artificial Sequence
  Description of Artificial Sequence: Synthetic coding sequence
atgagcagcagcgaggaggtgagctggatcagctggttctgcggcctgcggggaaatgagttcttctgcgaggtggacgaggattacatccaggataaatttaacctcacagggctaaacgagcaggtgccccactatcgccaggctctggacatgattctagaccttgaacccgatgaggagttagaggacaatccgaatcagagcgacctaatagaacaggccgcagagatgttatatggtcttatccacgcgaggtatatacttacgaacagagggatagcacagatgctggagaagtatcagcagggcgactttggctattgtcctagagtgtactgtgagaatcagcccatgctgcccatcggactgtcggatatccctggtgaggctatggtcaaactctattgccctaagtgtatggacgtgtatacacctaagtcctcccgccaccaccatacagacggtgcttattttggaacaggttttccgcatatgctgttcatggttcacccagagtatcgccctaagaggcccgcgaaccagttcgtcccaagcagttgttcccgtcatcccgatgtccccttattgcccaggcggcgacccttttgcaggatgcattttcggctgcgcgaggtgtatcatcagcaactgattccagtccacggggatcatcacttgctctag

SEQ ID NO: 181776 - DNA, 648 bp, Artificial Sequence
  Description of Artificial Sequence: Synthetic coding sequence
atgagcagcagcgaggaggtgagctggatcagctggttctgcggcctacggggtaatgaatttttttgcgaggtcgacgaggattacattcaggacaagttcaacctaactggactcaatgagcaggtgccacactaccgacaggcactggatatgatcctggatctggaaccagacgaggaacttgaggacaaccctaaccagagcgaccttatcgaacaagccgctgaaatgctgtacggcctgattcatgcacggtatatcctcacaaaccggggaatagctcagatgctggaaaagtatcagcaaggcgacttcggatactgcccccgtgtgtactgcgagaaccaacccatgctccccattgggctgtctgacatccctggagaggctatggtaaagttgtactgccctaaatgcatggacgtctacacacctaaatcatctcgtcaccaccacaccgacggagcttacttcggcacgggcttccctcacatgctttttatggtgcacccagagtatcggcctaagcgcccagccaatcagtttgtgcccaggttgtatggttttaagattcaccctatggcttaccagctgcagctgcaggctgccagcaattttaaaagcccagtgaagaccatccggtag

SEQ ID NO: 181777 - DNA, 648 bp, Artificial Sequence
  Description of Artificial Sequence: Synthetic coding sequence
atgagcagcagcgaggaggtgagctggatcagctggttctgcggcctgagagggaacgagttcttttgtgaagtcgacgaagactatattcaggacaaatttaaccttaccggcctcaatgagcaggtcccccactatcgacaagcactcgatatgattctggaccttgagccagacgaggaactggaggacaatcccaaccagtctgaccttatcgagcaagccgctgagatgctgtacggcttgatacatgctcgttatatcctgacgaacaggggcattgcccagatgctggagaaataccaacagggagatttcgggtactgcccgcgcgtatattgtgaaaaccagccaatgctgccaatcggcctgtccgacatacccggggaggcaatggtgaaactttattgcccaaagtgtatggacgtctatacacctaagtcaagcagacatcaccatacagatggtgcctattttgggactgggttcccccacatgctgttcatggtgcatcctgagtaccgccccaagcgtcctgccaatcagttcgtcccacggctatacgggtttaagatccaccccatggcttatcagctgcagctgcaggccgcatccaattttaagagccctgtgaagaccatccggtag

SEQ ID NO: 181778 - DNA, 705 bp, Artificial Sequence
  Description of Artificial Sequence: Synthetic coding sequence
atggagaagtgcaagggcaccagccggatggccggcaccaccagcgctgatgtaaaaatgtcctcctccgaggaggtgagctggatttcctggttctgtggactgagagggaacgagtttttttgtgaagtagatgaagactatattcaagacaaattcaatctgaccggtctcaacgagcaggtaccacactacagacaagctctcgacatgattcttgacctggagcccgacgaggaattagaagacaacccaaaccaatctgaccttatcgagcaggccgccgaaatgctgtatggccttatccatgctagatacattctcaccaaccgcggcatcgctcagatgttggaaaagtaccaacaaggagacttcgggtattgcccgcgagtgtactgcgaaaaccaaccaatgcttccaattgggttatcagacattcctggcgaggccatggtcaagctctattgtccaaaatgtatggacgtctatactccaaagtcctcaagacatcatcacactgatggagcatattttggtaccgggttccctcacatgctcttcatggttcatcccgaatatcgcccaaaaagaccagccaatcagtttgtgccacggctttacgggtttaagatacatcctatggcctatcaattgcagctccaggccgcctctaacttcaaatcacccgtgaagacaattcgctag

SEQ ID NO: 181779 - DNA, 648 bp, Artificial Sequence
  Description of Artificial Sequence: Synthetic coding sequence
atgagcagcagcgaggaggtgagctggatcagctggttctgcggcctacggggaaacgaattcttttgtgaagttgacgaagattatatccaggacaagttcaatctaactggtctgaatgaacaggtcccccattatagacaggccctagacatgatactggacttggagccagacgaggagctcgaggataatccaaaccagagcgatctgatagaacaggcagccgaaatgttgtacggacttatacacgctcgttacatcctgaccaatcgcgggattgcccagatgctggagaagtaccagcaaggtgattttggctactgtccccgagtgtattgtgagaaccaacccatgcttcccattggcctttctgatatcccaggcgaggctatggtgaagttgtattgccctaaatgcatggatgtctatacacccaaatcctctagacaccaccatacagatggagcctatttcgggacagggttcccgcacatgctgtttatggtccaccctgaatatcggcccaagcgccccgctaatcagtttgtgccaagattatacggattcaaaatccaccccatggcctaccagttacagctgcaggcagcttctaacttcaaatcccccgtcaagactattcggtag

SEQ ID NO: 181780 - DNA, 687 bp, Artificial Sequence
  Description of Artificial Sequence: Synthetic coding sequence
atgagcagcagcgaggaggtgagctggatcagctggttctgcggcctgaggggcaacgaattcttttgtgaggttgatgaagactatatccaagataagttcaatctgacaggactcaacgagcaggtccctcactaccgacaggctctggatatgatcctggacctggaaccagacgaggaactggaagataaccctaaccagtccgacctcatcgaacaagcagccgaaatgctgtacggcctgattcatgctcggtacatcctcactaacaggggtatagcgcagatgctggagaagtaccagcaaggtgacttcggatattgcccgcgtgtatactgtgagaaccagcctatgttaccaattggtctatcagatattccaggcgaagctatggttaagctgtactgtcccaagtgtatggacgtctacacccctaaatcttcccgccaccatcacactgatggtgcctacttcggtacaggatttcctcacatgttgtttatggtccacccagagtaccgccccaagcgacccgccaatcagtttgtgccctcatcgtgtagtcgccatccggacgtgcccttattgcctcgaagacgccccttctgtcgcatgcactttaggctccgtgaggtctaccatcagcagctcattcccgtacatggcgaccaccatctgctgtag

SEQ ID NO: 181781 - DNA, 687 bp, Artificial Sequence
  Description of Artificial Sequence: Synthetic coding sequence
atgagcagcagcgaggaggtgagctggatcagctggttctgcggcctgagaggcaatgagtttttctgtgaggtggatgaagattatattcaggataagttcaacttgaccggcctcaacgaacaagttcctcactaccgccaagcattagatatgatcctggacttagagccagacgaggagcttgaagataatcccaaccagtctgacctcatagaacaggccgcggaaatgctgtatggcctgatacacgctcgctacattctaactaatcgtggtatcgctcagatgttagaaaaatatcagcaaggcgacttcggatactgcccgagagtgtattgtgaaaatcagcccatgttgcccataggtttaagcgatatccccggtgaggccatggttaaactgtattgtccgaagtgtatggacgtgtatacccccaagtcttccagacatcaccataccgacggtgcatatttcggcacgggctttccacacatgctgtttatggtacatccggaataccggcctaaacgaccggccaatcagttcgtccccagctcgtgtagccgccaccctgacgtgcctcttctgcctcggcggcgccccttctgccggatgcacttcaggttacgtgaggtctatcaccaacagctgattccagtgcatggggaccaccacctcctatag

SEQ ID NO: 181782 - DNA, 648 bp, Artificial Sequence
  Description of Artificial Sequence: Synthetic coding sequence
atgagcagcagcgaggaggtgagctggatcagctggttctgcggcttgaggggtaacgagttcttttgtgaagtagatgaagattacatacaggacaagttcaatctcacaggcttaaacgaacaggtcccacattaccgccaagctctggatatgattctggacctggaaccagatgaagaactcgaggacaaccccaaccagtccgatcttatcgagcaggctgctgaaatgttgtacggtttaatccacgcccgttatatcctgacgaatcgtggcatcgcgcagatgctggagaaataccagcagggcgacttcggctattgcccccgcgtttattgcgagaaccagcccatgctgcctatcggactgagtgatatcccaggcgaggcgatggtaaagctgtactgccctaagtgtatggatgtctacaccccaaagtcctcaaggcaccatcatactgacggcgcctactttggaactggatttcctcacatgctgtttatggtgcatcctgagtacaggccaaaacggccagctaaccagttcgtccctcgcctgtacggcttcaagatccacccaatggcctaccagctgcagctccaggctgcaagcaactttaagtcccccgtgaaaaccataagatag

SEQ ID NO: 181783 - DNA, 705 bp, Artificial Sequence
  Description of Artificial Sequence: Synthetic coding sequence
atggagaagtgcaagggcaccagccggatggccggcaccaccagcgccgacgtgaagatgtcgtccagcgaagaagtcagttggatttcctggttctgcgggctgcgcggtaatgagtttttttgcgaggttgacgaagattatatccaagacaagttcaacttaactgggttgaacgagcaagtgccacattaccgtcaagctttggacatgattctggacctggaacccgacgaagagctggaagataacccgaatcagtcagacttgatcgagcaggccgctgaaatgctgtacggccttatccatgcgcggtacatcctaaccaacagggggattgcccagatgctggagaaataccagcaaggagatttcggttactgcccccgtgtgtactgtgagaaccagcctatgttacccattggattatcagatattcctggcgaggcgatggtgaagctgtactgcccaaaatgcatggacgtgtatacgcctaaatccagtaggcaccatcatacggacggcgcatattttgggacggggttccctcatatgctgtttatggtccatcccgagtatcggccaaagcggcctgcgaaccagttcgttccccgcctgtatggatttaaaatacaccctatggcatatcagctgcagctgcaggcggcttcaaactttaagtcgcctgttaagacgatcagatag

SEQ ID NO: 181784 - DNA, 648 bp, Artificial Sequence
  Description of Artificial Sequence: Synthetic coding sequence
atgagcagcagcgaggaggtgagctggatcagctggttctgcggcctgagaggcaacgaattcttctgtgaggtcgacgaggactatatccaggataaattcaatctcacggggttgaacgagcaggtgcctcactaccgccaagcgctggacatgattctggatctggagcctgatgaggagcttgaagataacccgaatcagagcgatttgatcgaacaggccgctgaaatgctgtacgggctgatacatgctagatacatcttgaccaacaggggtattgcccaaatgcttgagaagtaccaacaaggggactttggttactgcccccgggtatattgcgaaaaccagccaatgctacccattggcttgagcgacatccctggcgaggccatggttaaactttactgtcccaagtgcatggatgtttacacacccaaatcttcgagacatcaccacactgatggggcttacttcggtaccgggtttccccacatgctgttcatggtgcacccagagtaccgcccaaaaaggcccgcgaatcagtttgtccctcggttgtatgggttcaagattcatccaatggcttaccagctgcaactgcaggccgcctctaacttcaaatccccggtgaaaacaatacgctag

SEQ ID NO: 181785 - DNA, 705 bp, Artificial Sequence
  Description of Artificial Sequence: Synthetic coding sequence
atggagaagtgcaagggcaccagccggatggccggcaccaccagcgcagatgtgaaaatgtcctcttcggaagaagtgtcatggatcagttggttttgtgggttgagagggaacgagttcttctgcgaggtggacgaggattacattcaggacaaatttaatctaactggcctcaacgagcaagtgcctcattacaggcaggctctcgatatgatcttagacctagagcctgatgaagaacttgaagacaatcccaatcagtctgatctgatcgagcaggccgcggaaatgttgtacgggctcatccatgcacgttatattctaactaacaggggcatcgctcagatgttagagaagtaccaacaaggtgactttggttattgcccgagagtgtactgtgaaaatcagcctatgctgcctatcggactgagtgacattcccggagaggcaatggtgaaactgtactgccccaaatgtatggacgtctacaccccaaaatccagcaggcatcatcacacagacggggcttacttcgggacggggtttccacacatgctgtttatggtccatcccgaatataggccaaagcgtccagccaaccagttcgtaccccgactctatggatttaaaatccatccgatggcttaccaactgcagctgcaggccgcgagcaattttaaatcccctgtgaaaacaattaggtag

SEQ ID NO: 181786 - DNA, 705 bp, Artificial Sequence
  Description of Artificial Sequence: Synthetic coding sequence
atggagaagtgcaagggcaccagccggatggccggcaccaccagcgctgacgtcaaaatgagttcgtccgaggaggtttcatggatctcttggttttgtggtctcagaggcaatgagtttttttgcgaggtggatgaagattatatccaggacaaatttaacctaacgggacttaacgaacaagtgccacattataggcaggccctcgacatgatcctggatcttgagcctgacgaagaacttgaggacaaccccaaccagtccgacctgatcgagcaggctgcagaaatgctgtatggtctgattcatgctcggtacatcttgaccaatcgcgggatcgctcagatgctcgaaaagtaccagcaaggcgattttggctactgtcctcgcgtgtactgcgagaatcagcctatgctgcccattggtctctccgatatcccgggcgaggccatggtcaaattgtactgtccaaaatgcatggacgtgtacactcccaaatcttcaaggcatcatcacacagatggcgcgtacttcgggaccgggtttccacatatgctattcatggtgcaccctgagtacaggcctaaaagacctgcaaaccagtttgttccgcgtctgtacgggttcaagattcatcccatggcttatcagctgcagctgcaggctgcatcgaacttcaagagccctgtaaaaacaatccgatag

SEQ ID NO: 181787 - DNA, 648 bp, Artificial Sequence
  Description of Artificial Sequence: Synthetic coding sequence
atgagcagcagcgaggaggtgagctggatcagctggttctgcggcctgcgcggcaatgaattcttttgcgaggtggacgaagactatatccaggacaagttcaacctgaccggacttaatgagcaggtgcctcattacagacaggccttggatatgatccttgacctggaacccgacgaagaacttgaggacaaccccaaccaatccgacttgattgaacaagcagctgaaatgttgtacggtctaatccatgctcgttacattctcaccaatcgcggtatcgcccaaatgctggaaaaataccagcaaggtgatttcggctattgccctcgggtgtactgtgaaaaccagccaatgttgcctatagggctttccgacataccaggagaggcgatggtaaaactgtattgtcccaaatgtatggatgtttacacaccaaagtcttcaagacatcaccacacagacggagcatatttcgggactgggttccctcacatgctttttatggtacatccagagtataggcctaaacgacctgccaaccagtttgttcctaggctatatggcttcaagattcatcctatggcctaccagctgcagcttcaagctgctagcaactttaaatcgccggtcaaaactatcagatag

SEQ ID NO: 181788 - DNA, 648 bp, Artificial Sequence
  Description of Artificial Sequence: Synthetic coding sequence
atgagcagcagcgaggaggtgagctggatcagctggttctgcggcctgagagggaacgagttcttttgcgaggtcgatgaagattatatccaggacaagtttaacctcactgggctgaatgaacaggtaccccactaccggcaggccttagacatgatccttgatctcgagccagacgaggagctggaggataaccccaaccaaagtgatcttatcgagcaggcggccgaaatgctgtatgggttaattcatgctaggtatattctgaccaataggggaattgcccagatgctggagaagtaccagcagggggacttcggatactgtccacgggtttactgtgagaaccaacctatgctccctatcgggcttagtgacatccctggagaagccatggtcaagctctactgcccaaagtgcatggacgtctatacacctaaaagttctcggcatcatcataccgatggagcatacttcggtacagggttcccacatatgctgttcatggtgcatcctgagtataggcctaaacgacctgctaaccaatttgttccacgactctacgggttcaagatacatcctatggcttaccagttacagttgcaagccgccagcaactttaagtcccccgttaaaaccataaggtag

SEQ ID NO: 181789 - DNA, 705 bp, Artificial Sequence
  Description of Artificial Sequence: Synthetic coding sequence
atggagaagtgcaagggcaccagccggatggccggcaccaccagcgccgacgtaaagatgtcatcctccgaggaggtaagctggatatcctggttctgtggacttagaggaaatgagttcttctgtgaagtggatgaagactatatacaagacaaatttaacctgacaggactcaacgagcaggtgcctcattatcgccaggcactggatatgatcctggaccttgaaccagacgaggagcttgaagacaaccccaaccaatcggatcttatcgagcaggctgccgagatgctctatggactgatccacgcacgctatatcctcaccaatcgtggaatcgcacagatgcttgaaaagtatcagcaaggggactttggatactgcccgcgtgtgtactgtgaaaaccaacctatgctgcctatcggcctatccgacatacccggggaagctatggtgaagctgtattgtcctaagtgtatggatgtatatactcctaagtcttcacgccatcatcacactgacggcgcctacttcggcaccggattccctcacatgctcttcatggttcatccagagtatcggcccaagaggcctgcaaaccagtttgtcccacgcttgtatgggttcaagatacatccgatggcataccagctgcagcttcaggccgcaagtaactttaagtccccggttaagacgatccggtag

SEQ ID NO: 181790 - DNA, 648 bp, Artificial Sequence
  Description of Artificial Sequence: Synthetic coding sequence
atgagcagcagcgaggaggtgagctggatcagctggttctgcggcctgagagggaacgagtttttttgcgaagtggatgaggattacattcaggacaagttcaatctgacaggcctcaacgagcaagtgccccattatcgccaggcacttgatatgatcttagatcttgagcccgatgaggagctcgaggacaatccaaaccaaagcgatttaatcgaacaggccgcagagatgttgtacgggctcatacacgcccgctatatccttacaaatcgcggcattgcccagatgttggagaagtatcagcagggtgatttcgggtactgcccccgggtgtactgcgaaaaccaaccaatgctgccgattggactgtcagatattcctggggaagccatggtgaaactatattgcccaaaatgcatggacgtatacacacctaaaagcagtcgacaccaccacactgacggggcgtactttggaactgggttccctcacatgctatttatggtccacccagagtaccgcccgaagagaccagcgaatcaattcgtgcctcgcctctacgggttcaagattcaccctatggcgtatcagctgcagctgcaagcagcctcgaactttaaatcccccgtgaaaacgattcggtag

SEQ ID NO: 181791 - DNA, 687 bp, Artificial Sequence
  Description of Artificial Sequence: Synthetic coding sequence
atgagcagcagcgaggaggtgagctggatcagctggttctgcggcttgagggggaatgagtttttttgcgaggtggacgaagattacatccaagataagttcaacctgacgggcctcaatgagcaggttcctcattatcggcaggcccttgatatgatactcgatctagagccggacgaggaactggaagacaatcctaaccaaagtgatctaatcgagcaggctgcagaaatgctatatggactgatccacgccagatacatactgaccaatcgcggcatagcacagatgctcgagaaataccaacagggtgacttcggatattgtccaagggtgtattgtgaaaaccagccaatgcttcctataggactaagcgatatacctggagaggcaatggtgaagctctactgtccaaaatgcatggatgtctatacaccaaagagtagtcgtcaccaccatacggacggagcgtatttcggcaccggcttccctcacatgttattcatggtgcatcccgagtaccggccgaagcgtcccgccaatcagttcgtaccgagcagctgcagccggcatcctgatgtaccactgttgccaagaaggaggcccttctgcaggatgcacttcaggctcagagaagtgtaccaccaacaactgattcctgtgcatggggaccaccacctactgtag

SEQ ID NO: 181792 - DNA, 705 bp, Artificial Sequence
  Description of Artificial Sequence: Synthetic coding sequence
atggagaagtgcaagggcaccagccggatggccggcaccaccagcgcggacgtcaaaatgagttcttcagaagaggtttcctggattagctggttttgcggcttaaggggtaacgaatttttctgtgaagtggacgaggattacatccaggacaaattcaacctcaccggattgaacgagcaggttcctcactacagacaggcactggatatgatcctggatctcgagccagacgaggaacttgaagataatccaaatcagtcggacctgatcgagcaggcggctgaaatgctgtacggcctgattcacgctcgatatatactcacaaatagaggaattgctcagatgctggaaaagtatcagcagggggactttggctattgtccccgagtgtattgtgaaaatcaaccaatgctgcctattggtctctcggatattccaggagaggctatggtcaagctgtactgtcctaaatgcatggatgtctataccccaaaaagcagtcggcaccatcacaccgatggtgcgtatttcggaaccggcttcccgcacatgcttttcatggtacaccccgagtaccggccaaagcgacctgctaaccagtttgtgccaaggttgtatggatttaaaattcatcccatggcgtaccagttgcaacttcaagctgcttctaacttcaagtctcctgttaagaccatacgttag

SEQ ID NO: 181793 - DNA, 648 bp, Artificial Sequence
  Description of Artificial Sequence: Synthetic coding sequence
atgagcagcagcgaggaggtgagctggatcagctggttctgcggccttagaggcaacgaattcttctgtgaggttgatgaagattatatacaggacaagttcaacctgacaggcttaaatgagcaggttccccactatcgacaggcactcgatatgatactcgaccttgaaccagacgaagaactggaagacaatcccaaccagtcagatttgatcgaacaggcagctgaaatgttgtatgggctgattcacgcacgctacatattgaccaatcgaggaatcgcacagatgctcgaaaagtatcaacagggggactttggctactgtcctagagtgtactgtgagaaccagcctatgctacccatcggcctaagtgacatccccggtgaggccatggtcaagctgtactgccctaaatgtatggatgtgtacacaccaaagagctctagacaccatcacacagacggagcctacttcggtaccgggttccctcacatgctgttcatggtgcaccccgagtatcggccaaaacgcccagccaatcaattcgtccccagactttatggcttcaagattcaccccatggcctatcagcttcagctgcaagccgctagtaatttcaaaagccccgtgaaaactatcaggtag

SEQ ID NO: 181794 - DNA, 648 bp, Artificial Sequence
  Description of Artificial Sequence: Synthetic coding sequence
atgagcagcagcgaggaggtgagctggatcagctggttctgcggcctcagaggtaacgaattcttttgcgaagtagatgaggactacatccaagacaaattcaacctgacaggattaaacgagcaggtgcctcattaccgccaagcgttagacatgatacttgatttagagcccgatgaagaactagaggataatccaaaccagagcgacctcatcgagcaggccgcagagatgctttacgggctgattcacgctcggtacatactcacaaataggggcatagctcagatgctcgagaaatatcagcagggagattttggatactgccctagggtgtactgtgagaatcagcccatgctgcccatcggactgagcgacatcccaggggaggccatggtgaagctgtactgccctaagtgcatggacgtctacacccccaagagtagtaggcatcatcacaccgatggagcctactttgggactggttttccccacatgctgtttatggtgcacccagagtaccgaccaaagcgacccgccaatcagttcgtcccaagactctatggtttcaagatccatcccatggcttatcagctgcaattgcaggcagcttccaactttaagtcacctgtgaaaacaatcaggtag

SEQ ID NO: 181795 - DNA, 648 bp, Artificial Sequence
  Description of Artificial Sequence: Synthetic coding sequence
atgagcagcagcgaggaggtgagctggatcagctggttctgcggcttacggggaaatgaatttttttgtgaggtggacgaagattatattcaggataagttcaatttaacaggcctgaacgaacaggtgcctcattacagacaggcattggatatgattctggatctcgagccagatgaggagctggaagataatccaaaccaaagcgacctaatcgaacaggctgctgaaatgctgtatgggctgatccacgcacgctacatcctaaccaacaggggcatcgcacaaatgctggaaaagtaccagcaaggggactttggctactgtccaagggtttattgtgagaatcaacccatgctccctattggactctcggacatcccaggtgaagccatggtcaaactgtattgtcccaagtgcatggacgtctacacgccaaagagtagtcggcaccatcacactgacggggcatactttgggactggttttccccacatgctctttatggtccatccagaatatagacctaagcgcccggccaatcagttcgttccaaggctgtacggattcaaaattcacccaatggcttatcagctccagctccaggccgcctccaatttcaaatcacccgtcaagaccatcaggtag

SEQ ID NO: 181796 - DNA, 648 bp, Artificial Sequence
  Description of Artificial Sequence: Synthetic coding sequence
atgagcagcagcgaggaggtgagctggatcagctggttctgcggcctacgaggcaatgagttcttttgcgaggtggacgaagactacatccaggataaattcaacctgaccggcctgaatgagcaggtgccccattacagacaggctctggatatgatactggatctggagcctgatgaagaactggaagacaatcctaaccaatctgacctgatcgaacaggccgcagagatgctgtatggcctgatccatgcacgatacattctcactaaccgaggcatcgcacagatgctcgagaagtatcaacagggagacttcgggtattgtcctcgggtttactgtgaaaatcagccaatgttgcctattgggctatcagatatccctggcgaagctatggtcaagctatactgtccaaaatgcatggacgtctatacacccaaatcgtcccgacatcaccacaccgatggtgcgtacttcggcaccggtttcccccacatgctgtttatggtacatccggagtaccgcccaaagcgcccagcaaatcagtttgtgccacggctttacggctttaagatacaccccatggcatatcaattgcaactgcaggctgctagcaattttaagtctccagtgaagacgatcaggtag

SEQ ID NO: 181797 - DNA, 648 bp, Artificial Sequence
  Description of Artificial Sequence: Synthetic coding sequence
atgagcagcagcgaggaggtgagctggatcagctggttctgcggcctgcggggaaatgaattcttttgtgaagtggacgaagattatattcaggataagttcaatctgaccggattgaatgaacaggtgccacactaccgccaggcactcgatatgattctcgacttggagcctgatgaagaactggaggataaccccaatcaaagtgacctgatagagcaggcagccgagatgctgtacggacttattcatgctagatatatcttgactaaccgggggattgcccagatgctggaaaagtatcagcagggtgattttggctactgcccccgagtttattgtgagaaccagcccatgctgcccatcggtctttcggatatcccgggggaagcaatggtgaagttatactgtccaaagtgtatggatgtgtacaccccaaagtcctcccgacaccaccacacagacggggcttattttggcactggtttcccccacatgctgttcatggtacatcccgagtataggcctaaacgcccggctaatcagttcgtgccgagattgtatggctttaaaatccatccaatggcatatcagcttcagctgcaggccgcaagcaatttcaagagccctgtgaagaccataagatag

SEQ ID NO: 181798 - DNA, 648 bp, Artificial Sequence
  Description of Artificial Sequence: Synthetic coding sequence
atgagcagcagcgaggaggtgagctggatcagctggttctgcggcctgcgtggcaacgagttcttttgtgaagtggatgaggattacatccaggacaagttcaatctgacagggttgaacgagcaagtgcctcactatcgccaggctcttgacatgattctcgatttggagcccgacgaggagttggaggacaatcccaatcagagcgatctgatcgagcaggccgccgagatgttatatggactgatacatgccagatacatcctgactaacaggggcattgcgcagatgctcgaaaagtaccagcaaggggactttggttattgtcccagggtttattgcgagaaccaaccaatgctgccgatcggcttatcggatattcccggtgaggcaatggtcaagctgtactgtcctaaatgtatggacgtctatactcccaaatcgagccgtcaccaccacacggacggcgcctattttggaaccggttttcctcatatgctttttatggtgcaccctgagtatcggcctaaaaggcctgcgaatcaattcgttcccaggctctatggtttcaaaatacatcccatggcttatcagcttcaacttcaggcggcttcaaactttaaatcgcccgttaagaccattaggtag

SEQ ID NO: 181799 - DNA, 648 bp, Artificial Sequence
  Description of Artificial Sequence: Synthetic coding sequence
atgagcagcagcgaggaggtgagctggatcagctggttctgcggcttaagagggaatgaattcttttgcgaggttgacgaggactatatccaagacaagtttaaccttaccggtctgaacgagcaagttcctcattataggcaagctctggatatgatcctcgatctcgaaccagatgaggaactggaagataatccaaaccaatccgatcttattgagcaggcggccgaaatgttatacggtctcatacatgcccgatatatcctgacgaatagagggatagcccagatgctggaaaagtatcaacagggcgactttggctactgcccaagggtgtattgtgagaatcaacctatgctgcccattggactgtctgacatcccaggggaagccatggttaaactatactgccctaagtgtatggacgtatacacccctaagtcctctcgacatcaccataccgacggtgcttattttggtaccggatttccccacatgctgttcatggtccatcctgagtacagaccgaagcgccccgccaatcagtttgtcccaagattatatgggtttaagattcaccccatggcataccaactgcagctgcaggcagccagcaatttcaaaagcccagtaaaaacgattaggtag

SEQ ID NO: 181800 - DNA, 648 bp, Artificial Sequence
  Description of Artificial Sequence: Synthetic coding sequence
atgagcagcagcgaggaggtgagctggatcagctggttctgcggcctcagaggcaacgaattcttctgtgaggttgacgaggattacatccaagataagttcaatctcaccggactcaacgagcaggttccacactatcggcaggcgctggatatgatccttgacctggaaccagacgaggaattggaagataaccctaaccagtcggaccttattgagcaggccgctgagatgctctatggcctaatccatgctaggtacatattaactaatagaggcatcgcccagatgcttgagaagtatcagcagggggatttcggatattgcccacgggtttactgtgagaatcagcccatgctaccaattggattgtctgacatccctggcgaggctatggttaagttgtattgtcccaagtgtatggacgtctatactcctaaatcgtcccgtcatcaccataccgatggcgcgtatttcgggaccggctttccccacatgctgttcatggtgcacccggaatatagacctaagagacccgcaaatcagtttgtcccacgactgtacggattcaaaatacaccccatggcctaccagctccaattgcaagcagctagtaactttaaatcccccgtgaagacaatcagatag

SEQ ID NO: 181801 - DNA, 648 bp, Artificial Sequence
  Description of Artificial Sequence: Synthetic coding sequence
atgagcagcagcgaggaggtgagctggatcagctggttctgcggcctcagaggcaacgaattcttttgtgaggttgatgaggattatattcaagacaagttcaatttgacagggctgaacgagcaagtcccgcactatcgtcaagcgctggatatgattctcgaccttgaacctgacgaagaactggaggacaatccaaaccagagtgacttgatcgaacaggcagctgaaatgctgtacgggctgatacatgccaggtacatcttaacaaaccgaggcattgcacagatgctcgagaagtaccagcagggcgacttcggctattgtcctagggtttactgcgagaaccagcccatgttgcctatcggcctgagcgatatacccggcgaagcaatggtgaagctgtactgccctaaatgcatggacgtttatacgcccaaaagctctcgacaccaccataccgacggcgcatacttcggcaccggatttcctcacatgttgtttatggtccaccccgaatacaggcccaaaaggcccgccaatcagttcgtgcctagactatacgggttcaagattcatccgatggcctaccagctgcagctgcaggccgctagcaacttcaagagccccgtcaaaactatcagatag

SEQ ID NO: 181802 - DNA, 4296 bp, Artificial Sequence
  Description of Artificial Sequence: Synthetic coding sequence
atgggcaaggagcaggagctggtgcaggccgtgaaggccgaggacgtcggaaccgctcagcggctccttcagcggcccagacctggcaaggccaaactactggggtctactaagaaaatcaatgtgaacttccaagacccggatggtttcagcgcactgcatcacgcagccctcaatggaaacacggaacttatatccttattactggaagcgcaggctgcagtagatattaaggataacaagggaatgagacctctgcactatgccgcatggcaggggagaaaagagcccatgaagctggtgttaaaggcaggatctgccgtcaacattccgagcgacgagggtcacattccactgcacctggcagcgcagcacgggcactatgacgtcagtgaaatgctactccagcatcaatccaacccttgcatggtcgataacagtggaaagactccgctagatctggcttgtgaatttggaagagtgggcgtggttcagcttctcctgagttccaacatgtgcgcagctctgttggaacctcgccctggcgacgccacagaccctaatgggacatctccgttgcatctcgccgccaaaaacggccatatcgatatcatccgcctccttctgcaggccggaatcgacattaaccgccagacaaagagtgggaccgcactgcatgaagctgccctttgtggcaagacggaggtggtaagactgctactggactctggcatcaacgcgcatgtgagaaatacttatagtcagacggcacttgacatcgtgcaccagttcactaccagtcaggcatctagagaaatcaagcagctccttagggaagccagcgcagccctccaggttcgcgccacgaaagattattgcaataattatgacctcacttccctgaatgtgaaagccggcgatattatcacagttttggagcaacaccccgacggaaggtggaagggctgtattcatgataaccgaacgggaaacgacagggttggctatttcccctcatcactcggcgaagctatcgtcaaacgagccggatctcgcgccggaacagaacctagtctgccgcagggctcaagtagttccggacccagcgccccccccgaagaaatctgggtactgcggaagccattcgccggcggcgacagatctggctcgattagtggaatggccggcgggagaggtagcggcggccacgccctacacgctggctctgaaggagtaaagctgttagcaacagtcctttcccagaagtccgtctctgagtccggcccaggcgattctcccgccaaaccacccgagggttccgcaggggtggctcgctcccagcctcctgtggcgcatgcaggacaagtttatggagaacagccaccaaaaaaactggaaccagcctcagaaggaaaaagctccgaagctgtgagccaatggctgactgcattccaactgcaactgtatgcgccaaatttcataagtgcaggctacgacctgcccaccatcagccggatgactcccgaggacttaaccgccatcggcgtaacgaaaccaggccatcgcaagaaaatcgctgccgagatctctgggctgtcaattcccgattggctgcctgagcataagccggcaaacttggcggtgtggttaagcatgataggtctggcacagtactataaggtgctggtggacaatgggtacgagaacattgactttatcactgacataacatgggaggacctccaggagattggaatcacgaagctgggacaccaaaaaaagcttatgctggccgtgcggaagttagcggaactgcaaaaggcagaatatgcaaagtacgaggggggcccccttagaaggaaagcgccccagagtcttgaggtcatggcgatcgagagcccgccacctccagaacccacccctgcagactgccaaagtcccaaaatgaccacatttcaggactcggaactgtcagatgaactgcaggccgcaatgaccggaccagccgaagtcggccccactaccgaaaagccttccagtcacctgccgccaaccccccgagccacgacacgccaggattctagtctgggaggacgggcccggcacatgagttcttcccaagagcttttaggagatggaccccccggtccgagcagtcccatgtcgcggtctcaggagtatctgttggacgaaggacctgcccctgggaccccgccaagggaggcccgccctggccgccatggtcacagcatcaaacgtgcctcagtgccaccggtccccggcaaaccacggcaggtcctaccccctgggaccagccacttcacccctcctcagacccccacaaaaactagacctggcagccctcaggccctgggcgggccgcacgggccagcccccgccacagctaaagttaagcctacaccacaactgctacctcctacagaaagacctatgagccctcgatcactgcctcagtcacctacacaccgaggattcgcgtacgttttaccccagcccgtcgagggcgaggtcggaccagccgcacctgggcctgctcctcctcctgtacccactgccgtgccaactctgtgcttacctccggaggccgacgcggaacccggtcggcctaaaaagagagcccactccctaaatcggtacgcggcaagcgactccgagcccgagagagacgaactcctggtgcccgctgccgccgggccttatgctacagtgcaaaggcgcgtaggtcgaagccattcggtgcgcgcccctgcgggagccgacaaaaatgtgaacagaagccaatcattcgccgtgcgccctaggaaaaaaggacctcctccgccaccccccaagaggtccagtagtgctcttgcgtctgcaaacctggcagatgaacccgttcctgatgctgagccagaggatgggctgctgggtgtgcgggcccagtgcagaagagcttccgatctcgccgggtcggtagatacaggttctgccggctcggtgaaatcgattgctgccatgctggagctgtccagtattggaggaggcggaagggctgctaggagaccacccgagggacatcctaccccccgaccggcatcccccgaacccgggcgcgtcgccacggtgctcgcaagtgtcaagcacaaagaggctatcggtcctggcggcgaggtggtgaacagaagacggaccctgtcagggcctgtcaccgggctgttagctacagcacgtcgcggcccaggtgagagcgctgatcccggtccttttgtggaggacggcaccggacgccagaggccccgcgggcctagcaaaggggaggcaggagtggaaggacctccactggcaaaggtcgaagcatctgctaccctgaagaggagaatcagagcgaaacaaaatcagcaggaaaatgtcaagtttatattaactgagagcgataccgtgaagaggaggccaaaagctaaggaaagagaagccggcccagagcctccaccaccactgtcggtgtaccataacggcactggcactgtcagacgtcgcccggccagcgagcaggccggcccgcctgagctacctcctcccccgccacccgctgaacctccccctactgacctcgcacacttaccccctcttcctcctcccgaaggggaggctcgtaaaccggccaagcctccggtgtcccccaaaccagtgctcacgcagccagtaccaaaactgcaaggtagccccacccctacatcaaagaaagtccccctccctggaccgggaagtcctgaagtgaaacgtgcacacggcacgccccccccagtgagtcccaagcccccaccacctcctacggcccccaagcccgtgaaagccgtggccggactgccgagcggatccgcaggcccttcaccggctccttctcccgctcgtcagccaccggccgcactcgccaagccacccggtaccccccccagtctgggagccagccccgctaagccgccttcgcccggcgctcccgctctgcatgtgcctgccaagccacccagggccgcagccgcagccgctgctgccgcggctgcccctcccgcacctcccgaaggcgccagccctggcgactccgcgagacagaaactagaggagacctctgcttgtctggcggcagctctgcaggctgtggaagagaagatccggcaggaggacgcccagggccctagagacagtgccgccgagaagtccacaggctcgattcttgatgacatcggcagcatgttcgacgacctcgccgaccagcttgacgctatgctggaatag

SEQ ID NO: 181803 - DNA, 2115 bp, Artificial Sequence
  Description of Artificial Sequence: Synthetic coding sequence
atgtgcgccgccctgctggagccccggcccggcgacgccaccgaccctaatggaacatctcccctccacctggcagccaagaacggacacattgatatcatcagactgctcctccaagctggcatagatatcaaccggcaaacaaagtccggaacagctctgcacgaagccgcgctctgtggaaaaactgaggtggtgaggctgttgcttgacagcggcataaacgcacacgtgaggaatacatactctcaaacagcattggatatagtgcatcagttcactacctctcaggccagcagagagatcaaacagctcttgagggaggcttcagccgctctccaggttagggctacgaaggactattgtaataattacgacctgacttccctgaatgtcaaggcgggtgacatcatcaccgtgctggagcagcatccggatggccgctggaaaggatgtatccacgataacaggacgggcaatgacagagtaggctattttcccagtagcttgggcgaggccattgtaaaacgtgctgggtccagggcgggtaccgagccttcgcttccacagggctcttccagcagcggaccaagcgccccccccgaggagatctgggtactgcggaagccattcgccggcggggaccgaagtggtagtattagtggaatggctgggggcaggggaagcggcggtcatgccttgcacgctggctctgagggggtgaaattactggctaccgtactgagtcagaaaagcgtatcagaatcagggcccggtgattccccagccaaaccgccagaaggcagcgccggtgtggcaagatcccagccccccgtcgcacacgccgggcaggtgtacggtgagcagccaccgaagaagctcgaaccagcgtccgaggggaaatcctcagaggctgtgagccagtggctgaccgcattccaactacagctgtatgcgcccaacttcatctcagcaggttacgatctgcccacgatatcccgcatgacacccgaagacttaactgctattggagtcaccaagcccggccatagaaagaagatcgcagctgaaatttcagggctgtctattccagactggctgccagagcacaaacctgctaatctggccgtctggctctcaatgattgggcttgcgcagtattacaaggtcctggtcgataacggttacgagaatattgattttatcacggatattacctgggaagacctccaggagatcggcattacaaagttaggtcatcagaagaagttgatgttagccgtgcgaaaactggccgagctccaaaaggctgaatacgctaaatatgaaggcggacctctcaggagaaaagccccccagagcctagaagtgatggcgattgaatcgcctccccctccagaaccaacccccgctgactgtcaatccccgaagatgactacttttcaggattccgaactttcagatgagctccaggcggccatgacagggcctgctgaggttggccctactactgaaaagccaagtagccatcttcctcccacaccccgggctaccacccgacaggatagtagcctggggggacgggctcgtcacatgagctcatcacaggagctcctgggggacggccctccagggccatcctccccaatgagccgatcccaggagtacctgctggacgaaggaccagcacccggtacacctccaagagaggcccgcccaggccgacacgggcacagcatcaagcgtgccagcgtcccgccggttcctggtaaaccgagacaggtcctgccccctggaacttctcacttcacgcctccccagactcctacaaagacaaggccaggctctccgcaggctctgggtggaccacatggacctgcccctgctaccgccaaggtgaaacccacgccgcagcttctcccccctactgagagacccatgtccccaaggagcctaccacaaagtccaacacagagaacagggcctggacccgcccagaattgtccctctgggagaccagccagccgttctggggcggcacagggaacaggagatcagggccagggcccaccagcccccccgcacccccagaatatcagctaccaggagtactag

SEQ ID NO: 181804 - DNA, 3609 bp, Artificial Sequence
  Description of Artificial Sequence: Synthetic coding sequence
atgggccgggagcaggacctgatcctggccgtgaagaacggcgacgtaaccggcgtgcagaagctcgttgccaaagtgaaggctaccaaaactaagctgttgggcagtactaagcgactaaacgtcaactaccaagacgcagatggcttttccgccctgcaccacgccgccttaggtggctccctcgagttgattgccctgttgctggaggcccaggctactgtggatatcaaagacagtaatggcatgcggcccctgcactacgccgcatggcagggtcgcctcgagcccgtccggttattacttcgcgcgtctgccgctgtgaacgccgcctccctggatggtcagatccctctgcatctggccgcccagtatggacactatgaggtatccgagatgctccttcagcatcaaagcaacccgtgtctggtgaacaaagcaaaaaagaccccccttgatttggcatgcgagtttggcaggctgaaggtggctcaactcttgttgaattcccacttgtgcgtggcgctgcttgaaggggaggctaaggacccgtgcgacccgaattataccacaccactccacctggcagccaagaacgggcatcgtgaggtgattagacaattacttcgtgcaggcattgagattaataggcagactaaaaccggaaccgctctgcatgaagccgctctgtatggaaagaccgaagtggtcaggctgcttctggagggcggggtggacgttaatattcggaacacgtataatcaaactgctctggatatcgttaatcagtttaccacctcacaggcctctcgcgaaatcaagcaactgttgagggaagctagcggcatccttaaagtccgtgcactaaaagatttctggaacctgcacgaccccactgcactgaacgtgagggctggagatgtaatcacagtactcgaacaacaccccgatggcaggtggaaggggcacatccatgaatcacagcgtggcacggacagaatcggatattttccccctggcatcgtggaagtggtctcgaagagggtgggcatccctgccgcccgcctgccaagcgcccctactccactcaggcccggcttcagccgcaccccccagccacccgcggaggaaccaccgcaccccttaacatactcacagctcccacgagtcggcctctcaccagactccccagccggcgaccggaactcagtcgggtcagaaggatctgtcggttcaattcggagcgcgggatccggccagagctctgagggcaccaacggacacggccctggtcttttaattgaaaatgcacaaccccttccctctgcgggcgaggatcaagtgctgccgggactgcatccccccagtttggccgacaatctgtcccaccgccccttggcaaattgtagatcaggagagcagatttttacccaagatgtccgtccagagcagctgttggagggcaaggacgcccaggctatccacaactggctgtctgaatttcagctcgaggggtacaccgcacacttcctgcaggcaggttatgacgtgccaaccatttcccgtatgacgcccgaggatcttaccgcgattggcgtaaccaagcctggacacaggaaaaaaatcgcctccgagattgcacagctttcaatcgccgaatggctgccgagctatatcccaaccgatctcctggaatggctgtgcgccctgggactgcctcagtatcataaacagctcgtatcaagtggatatgattccatgggcttagtagcggatttaacatgggaggagcttcaagagattggtgttaataagctcggccatcagaagaaactgatgctcggggtgaagagacttgccgaattgcggaggggtctgctccaaggggaggccttaagcgaaggggggcgcagactggctaagggtccggagcttatggctatcgaaggtctggagaatggtgaagggcccgccactgctgggcctagactcttaacttttcaaggcagcgaactttcccccgagctccaagccgcgatggctggaggcgggccggaaccattacctctgcctccagctaggtcgccaagtcaggaaagcatcggagcccgaagcaggggcagcggccatagtcaggagcagcctgcgccccagcctagcggcggcgacccttctcccccacaggagagaaacctacctgaaggcacagaacggccacccaaattgtgctcctctcttccaggacagggaccccctccgtatgtgtttatgtaccctcagggaagcccctcctcaccggctcctgggcctcctcctggagccccttgggctttttcctatctggcagggccgccagctaccccccccgatccaccacgcccaaagcgtaggtctcattccctgtcacgccccgggccaacagaaggtgatgccgaaggcgaggctgaagggcccgttggcagtacgttgggcagctatgcgaccttaacccggcgcccaggcagaagcgctttggtacggacgtctcctagcgtgactcccacacctgccagaggaacacctcggtctcagtcttttgcacttagagccagacggaagggtcctcctcctcccccccctaagcgcttatctagcgtcagcggaccctcacctgaacccccaccacttgatgaatccccaggaccaaaggaaggagccaccggcccacgccggcggacactgagcgagcccgctggaccctctgagcctcccggtcctccagcccccgctggacccgcaagcgacaccgaggaagaggaaccgggccctgagggcaccccccctagccggggctcttccggtgagggtctgccctttgccgaggagggcaatctcacgatcaagcaacgccccaagcccgcaggcccgcccccccgggaaaccccggtgcctcccgggttagacttcaacctcacagaatccgataccgtcaagcgacggcctaagtgccgcgagagagagcccctccagaccgctctgctggcctttggggtggcttcagccactcctggtccagccgcacccctgccttcccctacaccaggagagtctccaccagccagtagtctaccacagccggagccaagctcactgcccgctcagggagtccccactccattggctcccagtcccgccatgcagccccccgtccctccttgtcccggaccagggctagagtcttccgccgcttcacggtggaatggtgaaaccgaaccccctgccgcccctgccgccctcctgaaagtaccaggggccggtacggcacccaaaccagtgagtgtcgcatgcacacagctggcattttctggccctaaactcgcccccaggctcggccctaggcccgtgccacctcctagacccgaatcaactggcacagtcgggcccggtcaggcccagcaacggctggagcagactagttcctccctggctgccgccctgcgcgcagccgaaaagagcatcggtacaaaggagcaggaaggaactccttctgcaagtacaaaacacatcctggacgacatttcgactatgttcgatgcgttagctgaccagctcgatgcaatgctcgactag

SEQ ID NO: 181805 - DNA, 3363 bp, Artificial Sequence
  Description of Artificial Sequence: Synthetic coding sequence
atgcggcccctgcactacgccgcctggcagggccggctggagcccgtgagacttctattgcgagcctctgctgccgttaatgccgcgtccctggacgggcagatccccttgcacctagccgcccagtatgggcactatgaggtgagcgaaatgcttttgcagcatcagagtaatccttgcctggtcaacaaggcgaagaaaactcccttggatctcgcttgtgaatttggcaggctgaaggtagcgcagttgctgctcaacagccatctatgtgtcgccctgctggagggagaggccaaggatccctgcgaccccaactacaccacacccctgcacctggcagcaaaaaacgggcatcgcgaggttattaggcagctactgagggcgggaattgagatcaaccgacagactaagactggcactgctcttcatgaggccgccctctacgggaaaacagaggtcgtcaggctgttgttggaggggggggtcgacgttaacatcaggaacacatacaaccagacagccctagacatcgtgaatcaattcaccacatctcaggcatcccgcgagatcaagcagctgcttcgagaagcttccggaatcttgaaggtgagggcccttaaagacttctggaacctccatgacccaaccgctctcaacgtccgtgctggagacgtgatcaccgtgttggagcagcatccggatggtcggtggaagggccatatacatgagtcccaacggggtacagacaggattggctatttccctccaggaattgtcgaggtcgtgagcaaaagggtcggtataccggccgccagactaccaagcgcccctactccattgcgtcccggatttagccgtactccgcagccacccgctgaagagccaccgcaccccctgacctattcccagcttccccgggtgggtttgagtcctgatagtccagccggcgaccgaaacagtgtcggctccgaagggtcagtcgggtctattcgttcagcaggaagcggtcagagcagcgagggcactaatggacacggtccaggcctgctgattgaaaacgcgcagcccttaccaagcgccggcgaagaccaagtcttacctggacttcatcctcccagcttggcggataacttgtcacatagacccctggccaattgccgttccggcgagcagatttttactcaggacgtaagaccggagcagttgctcgaagggaaagatgcccaggctatacataactggttgagtgagtttcagttggaggggtatactgctcattttctgcaggccggttatgatgtcccaaccatctcccggatgacgccagaggatctgaccgccattggcgtgacgaaaccagggcatagaaagaaaatcgctagcgagattgctcagctgtctattgcagagtggctgccaagctacattcccaccgaccttcttgagtggctttgcgccctggggctcccccagtaccataaacagctggtatcttctggctatgattcaatgggattggtggccgacctaacctgggaagaactgcaagagattggcgtgaataagttggggcatcagaagaagcttatgctgggcgttaagcgcctggccgagctgcggagaggcctcctgcaaggcgaagcgctatctgaggggggccgacgcttagcaaagggtccggaattgatggctatcgagggtctggagaacggagaagggcctgcgaccgccgggccccgtctgctgacatttcagggtagcgaactctccccagagcttcaggccgcgatggcagggggtgggccagaacctcttcctttaccgcccgctaggagcccatcccaagagtccatcggggcccgaagcagaggcagcgggcacagccaggagcaaccagcccctcagcctagtggtggcgacccgtcccctccccaggaaaggaacctccctgagggaaccgagcgcccaccaaagctctgctcaagcttgcctggtcagggtcctccaccatatgtattcatgtacccacaggggtctccgtcctcccccgctccaggacctcccccaggagccccttgggccttctcttacctcgctggcccgcctgcaactccccctgatccaccgaggccgaagcggcgctcccatagtttatctagacccggcccaacagagggtgacgcggagggcgaggctgaaggcccagtgggatccactctgggcagctatgcaactctgacacgccgtcctggacgcagcgccctggttagaacttcccccagcgttacccccacccctgccagggggaccccaagatcccagagtttcgccttgagggctcgacgcaaggggcctcctccccctcccccgaagagactgagcagtgtatctggcccctcacctgagcctcctcccctggatgagtcacctggccccaaagagggcgccacaggacccagacggcgcaccttgtctgaacctgctgggccctcagagccacccgggcctcctgcccccgctgggccagcctccgacacagaagaggaggaaccaggtccagagggaacaccccccagtcgggggtcatcaggagaggggctgccctttgccgaagaggggaaccttactataaagcaaaggccgaaaccagctggaccccccccccgagaaactccagttccacccggtctggacttcaatctcacagagtccgatacagtgaagcgtagaccaaagtgcagggagagggagccgctgcaaaccgccttattagcttttggagtcgccagtgccacacccgggccggcggctcccctccccagcccaacaccaggagaatcccctcccgcctctagcctccctcaaccagagccatcttcactccctgcccagggcgttcccacacctctggccccatctcctgccatgcaacctccagtgccaccgtgccccgggccgggcctcgaaagctctgcagcctccaggtggaacggagagaccgaacccccagcggcccctgctgctcttcttaaggtaccaggcgctggcaccgcacctaagcccgtcagcgtagcttgtacccagttagcattcagtggacctaagctagcaccacgcctagggccccgaccggttccgcccccccgaccggaaagtacaggcacggtcggcccgggacaagcccagcagcggctggaacagactagtagtagcctggccgcagccctaagggctgcagagaaatcaatcggaacgaaggagcaggaaggtactccctccgcctcaacaaagcacattctagacgacattagtacaatgttcgatgctctagccgaccaattagatgcaatgctggactag

SEQ ID NO: 181806 - DNA, 1026 bp, Artificial Sequence
  Description of Artificial Sequence: Synthetic coding sequence
atggccgacgagaagcccagcaacggcgtgctggtgcacatggtgaagctgctgattaagacttttctcgacggcattttcgacgatctgatggaaaacaacgtgttgaataccgacgaaattcatctgataggtaaatgcctcaaattcgtggttagcaatgccgaaaatcttgttgacgacatcacagagactgcccagacagcaggcaaaatctttcgtgagcacttatggaattccaagaaacaactaagctcagatatctcttctgatggcgagagggaggccaacatgcctgggctgaatattaggaacaaggaatttaactatcttcacaaccgcaacggatctgagttagatctccttggaatgcgcgatctgctggagaatttgggatactccgtggtaattaaggaaaatctgaccgctcaggaaatggagactgccttgcggcagtttgccgctcatcctgagcaccagtctagcgatagtactttcctcgtgttcatgagccacagtattctgaatggcatatgcggcacgaaacactgggaccaggaacctgacgttctgcacgacgacacaatattcgaaatatttaacaatagaaattgtcagagcctcaaggataaaccaaaggtcataataatgcaggcatgtagagggaatggggctggcattgtctggttcaccaccgatagtggcaaggctggggcggacacacatgggcgtctgctccaaggcaacatatgcaatgacgctgtgaccaaagctcacgtggaaaaagacttcattgccttcaagtcaagcactcctcacaatgtttcctggaggcatgagaccaatgggtcagtttttatttcacaaatcatctactactttcgagaatattcatggtcccaccacttggaagagatattccagaaggtgcagcacagcttcgagacaccaaatatcctgactcagctgcctacaatcgaacggttgagtatgacccggtatttctacctgttccctggaaattag

SEQ ID NO: 181807 - DNA, 1026 bp, Artificial Sequence
  Description of Artificial Sequence: Synthetic coding sequence
atggccgacgagaagcccagcaacggcgtgctggtgcacatggtgaaactgctcattaagactttcctggacgggatcttcgatgatctgatggaaaacaatgtgctaaacacagacgaaatccacttgattggaaaatgccttaaattcgttgttagcaacgccgaaaatctggtagatgatataaccgagacagcgcagactgcaggcaagatctttcgggagcatctttggaattccaagaagcagctgagcagcgatattagctcagatggagaacgggaagctaacatgccaggtctaaacatacggaataaagaatttaattacctgcacaaccggaacgggtccgagcttgatctgcttgggatgagggacctgctggaaaacttggggtacagcgtggtgattaaagagaacctgactgctcaagaaatggaaaccgctctcaggcaattcgccgctcaccctgaacatcaatccagtgacagcacatttcttgtgttcatgtcccatagtattctgaacggaatctgtggtacaaagcattgggaccaagaaccagatgtgttgcacgacgatacgatcttcgaaatcttcaacaaccgtaactgccagtctctgaaggacaagccaaaggtgattatcatgcaggcctgccggggcaacggagctggaattgtgtggtttactacggattcaggaaaggccggagccgatacccacggtcgactgttgcaggggaacatttgtaatgacgccgtcacaaaggcacacgtcgagaaagattttatagcattcaaaagttccacccctcacaatgtgtcatggaggcatgaaaccaacgggtctgtgttcatcagtcagattatctattactttcgagagtattcttggtcccaccacttagaggagatcttccaaaaagtgcagcactccttcgagaccccaaacatcctgacccaactgcccacaattgagaggctgagcatgactaggtacttctatctgttcccaggcaattag

SEQ ID NO: 181808 - DNA, 834 bp, Artificial Sequence
  Description of Artificial Sequence: Synthetic coding sequence
atggagaacaccgagaacagcgtggacagcaagagcatcaagaacctggaaccaaaaattatccacggaagcgagagcatggatagcggcatttcgctggacaactcctacaagatggactaccccgagatgggtctgtgcatcatcattaataacaaaaattttcataaatctactgggatgaccagtcgatcaggcacagacgttgatgccgcaaaccttcgtgagacattccgcaacctaaaatatgaagtgcgcaacaagaacgatctgaccagagaggaaatagtggaactgatgcgcgatgtttccaaggaggatcatagcaaacgttcatccttcgtctgtgtcctcctgagtcacggagaagagggcatcatctttggtacaaacgggcctgttgatcttaagaagatcactaactttttccggggtgacagatgcagatctctcaccggcaaacctaagctttttatcatacaggcatgtcgaggcaccgaactggattgcgggatcgagactgactctggtgtagatgatgacatggcttgtcacaagatccccgttgaagccgacttcctgtatgcgtactcaactgccccgggctattactcttggcgcaattccaaggatggctcttggtttatccagtcgctttgtgctatgctcaaacagtatgccgacaaactggaattcatgcacatcctaacacgggtcaatcgaaaggtggcaacggaattcgagtcctttagctttgatgccacatttcacgcaaagaagcagattccctgtatcgtgtccatgttgaccaaagagctgtacttctaccactag

SEQ ID NO: 181809 - DNA, 471 bp, Artificial Sequence
  Description of Artificial Sequence: Synthetic coding sequence
atgagcgacgccctgatcaaggtgagcatggagaacaccgagaacagcgtcgacagtaagagtatcaaaaatctagaaccaaagatcatacatggctctgaaagtatggattcaggaatctctcttgataattcatacaaaatggattaccccgaaatgggactgtgcataatcatcaacaataaaaatttccacaagtctactggcatgacgtctaggtccggaacggatgtagatgccgccaaccttagggagacctttcggaatctaaaatatgaggtccggaacaagaacgacctgaccagagaggagattgtagagctcatgagggacgtctccaaggaagaccacagcaagcgcagtagctttgtgtgtgtcttgctgagtcacggagaagagggaatcatttttggtacaaacggccccgttgatttaaaaaataacaagctgtttcagcgcggaagcttgtag

SEQ ID NO: 181810 - DNA, 354 bp, Artificial Sequence
  Description of Artificial Sequence: Synthetic coding sequence
atggagaacaccgagaacagcgtggacagcaagagcatcaagaaccttgaacctaagattatccacggttcagagtcaatggatagcggtatctctcttgacaactcgtataaaatggattaccccgaaatggggctatgcattattattaacaacaaaaattttcataaaagtaccggaatgacatcaagatcagggaccgatgtagatgccgcgaatctgagggagacgttcagaaatctgaagtacgaggtacgtaataagaacgacctcacaagagaggaaatcgtggagctgatgcgcgacgtaagcaaggaggaccacagcaagcgctcttctttcgtgtgcgtttag

SEQ ID NO: 181811 - DNA, 834 bp, Artificial Sequence
  Description of Artificial Sequence: Synthetic coding sequence
atggagaacaccgagaacagcgtggacagcaagagcatcaagaacttggaaccaaagatcatacacggctctgagtcgatggatagtggtatctccctggataacagctataagatggattacccggagatgggcctgtgcatcataattaataacaagaatttccacaaatctaccggtatgacctcccggtctgggactgatgttgatgccgctaacctcagagagacctttaggaacttgaagtacgaagtcagaaacaagaatgacctgacaagagaggagatcgtggaactgatgagagatgtcagtaaagaagaccactccaagcgatcttccttcgtgtgtgtgctcttgagccacggagaggaaggcatcatattcggcacgaatggccccgttgacctcaagaagatcacgaactttttcaggggtgaccggtgcaggagtcttacagggaaacccaagttgtttattattcaggcctgccgcggcaccgagctcgactgtgggatagagaccgattctggcgtcgatgatgatatggcttgtcacaagattcctgtggaagcggactttctttatgcctatagtacagctcccggatactactcgtggcggaactccaaggatgggtcatggtttattcaatctttgtgtgccatgttaaaacaatacgccgataagttggaatttatgcacatccttactcgcgtcaatagaaaggtggcaaccgagttcgaatcattctccttcgacgcaactttccacgccaagaagcagattccctgtatcgtcagtatgctgaccaaggagctgtatttctaccactag

SEQ ID NO: 181812 - DNA, 966 bp, Artificial Sequence
  Description of Artificial Sequence: Synthetic coding sequence
atggccgacagcatgcaggagaagcagcggatggccggccagatgctgctgcagacattttttaacattgatcagatttcccctaacaaaaaagctcatccgaatatggaggctggacctcctgagtcgggcgagtccactgacgcgttaaaactgtgtcctcacgaggagttccttcggctgtgcaaggaacgggcagaagaaatataccctatcaaggaaaggaataaccgaactcggcttgccctgatcatttgtaatactgagtttgatcacctacctccgagaaacggggcagactttgatattacagggatgaaggaactcctggaaggactggactattccgtagacgtagaagagaacctcaccgcacgcgacatggagtctgctctaagagcatttgctacacgccctgagcataaatcctccgactcaaccttcctggttctcatgtcacacggcatcttggaaggaatatgcggaactgttcacgatgagaaaaaaccggatgtcctgctgtacgatacgatcttccagatcttcaacaacagaaattgcctgagccttaaggataagcctaaggtgataatcgtccaagcatgccggggcgcgaaccgcggggagctctgggtgagggacagcccggctagtctggaagtggcctcctctcagagcagcgaaaacctggaagaggacgccgtgtacaagacccatgtcgagaaggactttatcgcgttctgctctagcacgcctcacaacgtctcatggagggattcaaccatgggcagcatcttcatcacacaactgatcacctgcttccaaaagtacagctggtgctgccacctggaggaagtatttagaaaagtccagcaatcatttgagacgccccgggcaaaagcgcaaatgcccacaattgagagactctcaatgacacgctacttctatctgtttcccggtaactag

SEQ ID NO: 181813 - DNA, 213 bp, Artificial Sequence
  Description of Artificial Sequence: Synthetic coding sequence
atggagaagaaggagtgccccgagaagagcagcagcagcgaggaggaactacctaggcgggactccggcagctccaggaacattgatgcctctaagctgattcgcctgcagggatcaaggaagctcctcgtggacaactccatcagggaattgcaatatacaaaaaccggcatcttctttcaagccgaggcttgtgttactaatgatacgtag

SEQ ID NO: 181814 - DNA, 3099 bp, Artificial Sequence
  Description of Artificial Sequence: Synthetic coding sequence
atgcccggccgggccgaggccggcgaggccgaggaggaggccggcgccggaagcggctcagaggccgaggaagacgcactttgggaacggattgagggcgtgcggcacagattggctcgagcattaaatcccgcaaaactgactccttaccttaggcagtgtagggtgatagatgaacaggatgaggaagaagtgctgagtacataccggttcccctgtagggtcaatcggaccggcaggctcatggatatactgcgatgccggggaaaacggggctatgaggccttcctggaagcccttgagttctactaccccgagcactttacactccttacagggcaggagccagcgcaacgttgttcaatgatcttagacgaggaaggtcccgaggggctgacgcagtttctcatgactgaagtccgacgtcttcgagaagccagaaaatcccagctccagagggagcagcagctccaggccaggggcagagtgctcgaggaagaaagggccggcctcgaacagcgtctgagggaccaacagcaggcccaggagaggtgtcaacgtttgcgggaagattgggaagcggggagcctggagctccttaggctaaaggacgagaactatatgatcgccatgcgcttggcacagttatctgaagagaagaacagtgctgtgctacgctcaagagatcttcagcttgctgtggatcagttgaaactgaaggtttctcggctggaggaggagtgcgcgctgttacgtagagcaagaggaccaccacctggcgctgaagaaaaggaaaaagagaaagagaaggagaaggagccagataacgtcgaccttgtaagcgaactccgcgccgagaaccaacgtctcaccgctagtttgcgggaactgcaggaaggcctgcagcaagaagccagccggcctggtgctcctggaagcgagcgcattctgttggacattctagaacacgattggagggaggcccaggatagtcgccaggagctgtgccagaagctgcacgccgttcagggcgagctgcagtgggcggaagagctccgggaccagtatttgcaagagatggaggatttgagattgaaacaccgtacattgcagaaagactgtgatctctataagcacaggatggcaacagtgctggctcaactggaagaaatcgagaaggagcgtgaccaggccatccaaagccgggaccggattcaactgcagtattcgcagtcattgatcgagaaggaccagtatcgtaagcaagttcgcggcttggaggccgaacgcgacgaattactcactacccttacctccttagaaggaaccaaagccttgctggaagtccagctgcagagagctcaggggggtacatgcctgaaagcttgtgcatccagccattccctctgcagcaacttaagttctacatggtctctcagcgaatttcctagtccactgggcggccccgaggccactggcgaggcggctgtaatgggaggaccagaacctcataatagcgaagaggccacggactccgagaaggaaataaatcgactttccatcttaccattccctccatccgccggttcaatactgagacgtcagcgtgaggaggaccccgctccccctaaaaggtccttcagctctatgtctgacatcacaggctccgtgactctgaaaccctggagccctggcctcagttcctcctcctcttccgacagcgtttggccactgggcaaacctgagggtctgctggcaagagggtgtggattggattttctcaataggagcttagccattcgcgttagcgggcgaagtcctccagggggtccagaacctcaggacaagggccccgatggactgtcattttacggtgataggtggagcggagctgtggtgcgtcgggtgctctcgggacccgggtctgcccgcatggagccgcgggaacagcgggtggaagccgcaggcctcgagggagcttgcctggaggccgaggctcagcagagaaccctgctctggaaccaggggagcactctgccatctttgatggacagcaaggcttgtcagtcattccacgaggctctcgaggcctgggccaagggcccaggggccgagcctttttacatccgggcgaatctgacgctgccagaacgcgcagatccacacgccctgtgtgtgaaggcacaggagattctgcgactagttgactctgcatacaaacggagacaagagtggttttgcacgagagtcgaccccttgaccctgagagatctagatagaggtaccgtgccgaattaccagagagcgcagcagcttttggaagtgcaggagaaatgtctgccatcttcacggcatcgcgggcctagatcaaacctgaagaaacgcgccctggaccagctacgactggtgagacctaaaccagtgggtgctccagctggcgatagccctgatcaactgctcctggaaccatgcgccgagcctgagagaagcctgcggccctattctctggtgcggcctctgcttgtgtccgccctcagacctgttgtgcttctgccagaatgcctggcccctaggcttattaggaacctcttggacctgccctcctctaggctggatttccaagtgtgtccagccgagtccttatctggggaggaactgtgcccatcttctgctccaggggcccctaaggcccagcccgccacacccggactgggatcaaggattagggccattcaggaatctgtcggtaaaaagcattgccttcttgagctcggagcccggggggtacgcgagctcgtgcaaaacgagatataccccatcgttattcacgtggaagttacagaaaaaaacgttagagaggttcgaggactgctgggcagaccaggttggcgtgattcggaattattgcgacagtgtcggggctctgagcaggtactgtggggccttccttgttcttgggtgcaggtacctgcccatgaatggggccatgctgaggagcttgctaaagtggtgagggggaggatcttacaggagcaggcacgcctcgtttgggtggaatgtggaagctctaggggctgcccatcttccagcgaggcgtag

SEQ ID NO: 181815 - DNA, 3099 bp, Artificial Sequence
  Description of Artificial Sequence: Synthetic coding sequence
atgcccggccgggccgaggccggcgaggccgaggaggaggccggcgctggttcgggttccgaagccgaagaagatgcactctgggaaaggatcgagggagtgcgacatcggctggcgcgagccctgaacccagctaagcttactccttacctcagacaatgtcgagtcatcgatgagcaggacgaggaggaagtactgtccacttataggttcccctgcagggtcaacagaactggccgactgatggacatcctccgttgcaggggcaagcggggctatgaagccttcctggaagccctggaattctactatccggagcattttactctgctgaccggacaggagccggcgcagcgctgcagtatgattctagacgaggagggacctgaaggattgactcagtttttaatgacagaagtgcgcagattgcgagaagcacggaagagccagttgcagcgggagcaacagcttcaggcgcggggcagggtcctcgaggaggagcgcgctggccttgaacagcgccttcgggatcaacagcaagctcaggaaagatgtcagcgcttgagagaggactgggaagccggctctcttgagctgctgcgccttaaagatgagaattacatgatcgctatgcggctggcacagctgtccgaagaaaagaactcagccgtattgagatccagggacctgcagctagccgtggatcagctgaagctcaaagtgtcgcgcttggaagaagagtgtgccctgctgcggagagctcgcgggcccccacctggggctgaagagaaagaaaaggaaaaggagaaagaaaaagagcccgataacgttgatctggtcagcgagctgcgagctgagaaccagcgtctaactgcttccctgcgcgagttacaggaggggctgcaacaggaggcatctcggcccggcgccccagggagcgagcgtatacttctagacatcctagaacatgactggagggaggctcaggacagtcgacaggagttgtgccaaaagctgcacgccgttcagggtgaactgcaatgggctgaggaactgagggatcagtacctgcaggaaatggaagatctcaggctgaagcaccggaccctacaaaaggactgtgatctgtacaagcacaggatggctacagttctggcgcagctcgaggagatcgagaaagagagggatcaagccatccagtctcgggaccgaatacagctccagtacagccagtctctgattgagaaagaccaatacagaaagcaggtaagaggcctcgaagccgagcgcgacgaacttcttacaacacttaccagccttgagggcaccaaagcgctgctggaggttcaacttcaacgggcccagggaggcacatgtctcaaagcctgtgcgagttcccatagcctgtgttccaatctgagctccacctggtctctgtctgaatttccatcccctttaggaggtccggaagccaccggtgaggccgccgtgatgggtggacctgagcctcacaattctgaggaggctacagattccgagaaagaaattaatcggctgagcatattgccttttcctccttccgcgggaagcatcttgcgccggcagagggaggaagaccccgcacccccaaagcggagcttcagtagtatgtctgacattacggggtccgtaactcttaagccctggagccccgggctcagctcatctagcagttccgattctgtgtggccattggggaagcccgagggactccttgccaggggttgcggactcgacttcttgaacaggtccctggccattcgagttagcgggagaagccctccaggagggcccgaaccacaggataagggacccgacgggctgtccttttatggcgaccgttggtccggtgcagttgtcaggcgcgtccttagcggccccggcagtgcccgcatggaacctagggaacagcgtgtggaggccgcaggcctggaaggcgcatgccttgaagctgaagcacagcagagaacactgttatggaatcagggttcgactctgccctctctaatggattccaaagcttgccaatcattccacgaagccctggaggcgtgggctaaaggacccggtgcagaaccattctatattcgggccaacctgactctcccagaacgcgcggacccccacgctctctgtgtgaaagcccaggagatcctgaggctggtcgatagtgcatacaaaaggagacaggagtggttctgtacacgtgtggatcccttgaccctgcgagacctggatagaggtactgttcctaactatcaaagagcccagcaactcctggaggtgcaagagaaatgcctgccatccagcaggcaccgggggcccaggagtaacttgaagaagcgcgcgcttgaccagctgagacttgttagacccaaacctgtaggggctccggccggcgactctccggaccagctgctgctcgaaccctgtgccgaacctgagaggtccttacgcccctactccctggttcggcctctcctcgtatctgcgctacgcccggttgtcctcctccctgagtgccttgcccctcgcttaataaggaatctgcttgatttgccttccagcagacttgacttccaagtctgccccgccgaatccctgtccggggaggagctatgtccctcgtctgctcctggggccccaaaggcacagcctgcaactcctgggttgggatcgcgcataagggccatacaggagtctgtcgggaagaaacactgtcttttagaattgggagctcgaggagtacgcgagcttgtgcagaatgaaatttatcctattgtgattcatgtggaagttaccgaaaagaacgttcgggaggtgcgcgggctgctggggagacccggctggagagactctgaattgcttaggcagtgtcggggttccgagcaggtcctttggggtctcccctgctcttgggtgcaagtaccggcgcatgagtggggtcacgccgaggaacttgccaaagtggtgcgcggaagaatactgcaggagcaggcacggctggtatgggtggaatgtggcagttctcgtggctgtccctccagctcagaggcctag

SEQ ID NO: 181816 - DNA, 2241 bp, Artificial Sequence
  Description of Artificial Sequence: Synthetic coding sequence
atgggcgtgggcgtgggcctgggcaacggcctgcggctgctgccctggatggaagcttcccgacccggagcccccgggtctgagaggatcctcctagacattttagaacacgactggagagaggcccaggattcaaggcaggaactatgtcagaaactacacgcagtccagggcgagctgcagtgggcagaagagctgagggatcagtatttacaagagatggaggacctgcgcttgaagcaccggacattgcagaaggattgtgacctatataaacatcgcatggcaaccgttcttgcccagctggaggaaatcgaaaaggagcgggatcaggcaatccaatctagagacagaattcaactgcagtactcgcagagcctcatcgagaaggatcagtacagaaaacaggtgaggggactggaggcagaaagggacgagcttcttacgactctcacctctcttgaagggaccaaggctctgctggaagtgcagctgcagcgggcacagggcgggacgtgtctcaaggcttgtgcatcctcccactccctgtgctcaaatcttagcagcacctggtctcttagcgagtttccttctcctctcggaggacccgaggctaccggcgaagctgccgtgatgggtggcccggagcctcacaatagcgaggaggctacagacagtgagaaagaaattaatcgactgagtatcctccccttccccccatcggctggcagtattttgcgacgccagcgggaagaagaccccgctcccccaaaaaggagtttctcttcaatgtctgatatcacgggatctgtcactctcaaaccttggtctcctgggctttcatcgagcagtagttcagacagtgtatggcctttaggaaagccagaagggctcctagcccgtggctgtggtctggactttctaaacagatcgctggccattagggtgagtggccggtcaccgccgggcgggcctgaaccccaagataagggtcccgacggattaagcttctatggagacagatggagcggtgctgtcgtgcgacgcgtgctgagcggcccggggtccgccagaatggagcctagggagcaacgtgtggaggcggcaggcctggagggggcctgcctcgaggccgaggctcagcagagaaccctcctgtggaatcaaggctccactctaccatctctgatggattctaaggcatgtcagtccttccatgaggctctcgaagcctgggccaagggacccggggctgagcctttttacatacgggccaacctcaccctgcccgagagagctgacccgcatgctttgtgcgttaaggcgcaagagatactgagactggtcgatagtgcctacaagagacgccaggagtggttttgcacccgcgtggatcccttgactctcagagacctagatcgtgggaccgtaccaaactaccagagagcgcagcaattgctcgaagtccaagaaaaatgtctaccctcctccagacatcggggacctaggtcaaaccttaagaaacgtgcgctggaccaactccggctggtcagaccaaagccagtcggggcgccggccggtgacagccccgatcaattactgctggaaccttgcgctgaacctgaacgcagtctgagaccatactcattggttagacctctcctagtgagcgccctacgccccgttgtgctgctccccgagtgtctggcaccgcgcctgattcgcaacttgctggatttgcctagcagtcgcctcgatttccaggtatgtcctgcggagagcctcagcggcgaggagttgtgtccatcatctgccccgggcgcgcctaaggcccagcctgccacacctggattgggttcaagaatccgtgcaattcaggaatccgtgggaaagaagcactgcttgctggagttaggcgctaggggagtgcgtgaactggttcagaacgagatctacccgatagtgatccacgtggaggtgactgagaaaaatgtgcgggaagtacgcgggctattgggcaggccaggctggagggactcagagctcctgcggcagtgcagaggaagcgagcaggtgctttgggggctaccctgcagttgggtacaggtccctgctcacgaatggggccatgccgaagaattagcgaaggtcgtgaggggcaggatcctccaggaacaagcccgcttggtttgggtagagtgtggatcctctagaggctgtccatctagttccgaggcatag

SEQ ID NO: 181817 - DNA, 1443 bp, Artificial Sequence
  Description of Artificial Sequence: Synthetic coding sequence
atggaggacctgcggctgaagcaccggaccctgcagaaggactgcgatctctacaagcatcggatggctacagtactcgcccagctcgaagagattgaaaaagagagggaccaggccattcagtcccgtgaccggatccagctgcaatatagccagagcctcattgaaaaagatcagtaccgtaagcaggttagagggctcgaggccgaaagggacgaactgcttaccacccttaccagtctggaaggtacgaaagcgctgctcgaggtgcagttacagcgcgcacagggcggcacctgcctgaaagcatgtgcatctagtcactccctgtgttcaaacctttcatccacatggtctcttagcgagtttcccagccctttaggtggtcccgaagcaaccggagaggccgccgtgatggggggaccggaaccccataatagcgaggaagccacggacagtgagaaagagattaataggctcagtatcttaccctttccccctagtgctggatccattctgcgtcgacaacgggaggaggaccctgccccacccaaacgctccttctctagcatgtccgatattacaggctcagttactctgaagccatggagtccagggttgtcctccagctcctcctctgatagcgtctggccgctgggcaaacccgagggactcctggcaaggggttgcggtcttgactttttaaataggagccttgccattagggtgagcggccggtcaccaccaggcggcccggagccgcaggacaaggggcctgatggtctgtccttttacggagatcgctggtctggcgctgttgtgcgcagagtcctgtcgggacctggatccgcccggatggaaccacgggagcagcgagtagaggcagcgggactcgaaggcgcttgtctggaggccgaagcgcagcaaaggaccctactctggaatcagggctcaactttgccgtctttgatggacagcaaggcatgccagagttttcacgaggccctcgaagcttgggctaagggtcccggcgccgaaccattttatattcgcgctaatcttacactccctgagcgtgcggaccctcacgccctgtgcgtgaaggctcaggaaatactgcgcctagtggatagtgcatacaaaaggaggcaggaatggttctgtactcgcgtggacccactgacactgcgggacttagatcgagggactgtgcccaattatcagagagctcaacaattgctcgaagtacaggagaagtgccttccaagcagcagacatcgtggaccacggtctaatctcaagaagcgggctctggatcagctgaggctggttcgccccaaacctgttggtgcgcctgctggggactcccctgaccaacttttgttggagccctgtgccgagccagaaaggagcttgcgcccatactccttggtgagaccctag

SEQ ID NO: 181818 - DNA, 222 bp, Artificial Sequence
  Description of Artificial Sequence: Synthetic coding sequence
atgcccggcggcggccccgagatggacgactacatggagaccctgaaggacgaagaagacgcactctgggaaaacgtcgagtgcaaccgccacatgctcagcagatacatcaaccctgctaagttgacaccatacctgaggcaatgcaaggtgatcgatgagcaggatgaagatgaggtgttgaacgctcccatgcttccttccaagattaatcgggcctag

SEQ ID NO: 181819 - DNA, 3465 bp, Artificial Sequence
  Description of Artificial Sequence: Synthetic coding sequence
atgcccggcggcggccccgagatggacgactacatggagaccctgaaggacgaggaagatgctctgtgggaaaatgtcgagtgcaatcggcacatgctaagtcgctacattaatcccgccaagttaactccttatctgcgacagtgcaaggttatagatgagcaggacgaagatgaggtgctgaatgctcctatgttgccatctaaaatcaaccgcgcagggagattactggacattttgcacaccaaggggcagcgcgggtatgtagtctttcttgagagcctggaattctactaccctgagttgtataagcttgtaacgggcaaggaacctacgaggcggttctcaacaatcgttgtagaagagggacacgagggactgacccatttccttatgaacgaggttataaaacttcagcagcagatgaaagctaaagacctccagcgatgcgaacttcttgcacggctgcgacagttggaggacgaaaagaaacagatgaccctcactcgggtggagctcctcaccttccaggaaaggtattacaaaatgaaagaggaacgggatagctacaatgacgagcttgtcaaggtcaaagacgacaattacaacttagctatgaggtatgcacagcttagtgaagagaaaaatatggcggtaatgcgaagccgggatctgcagctcgaaattgaccagctgaaacacagacttaataagatggaagaggagtgtaagctcgaacgaaaccaatccctgaagttgaagaatgatattgaaaatcgcccaaaaaaggagcaggtgctcgaactcgagcgcgaaaatgaaatgctgaagaccaagaatcaggaacttcaaagcataatacaggccgggaagcggtcactgcccgacagcgacaaggccatcctggatatcctagagcatgatcgcaaagaggccctggaggataggcaggagttagttaataggatctacaacttacaggaagaggcaaggcaggcagaggaactgagggataaatatttggaggaaaaagaggacttagagttgaagtgttctacactgggcaaagactgcgagatgtataagcacaggatgaatacagttatgctgcagctggaggaagtggaaagagagagggatcaggcatttcattcgcgggacgaggctcaaacacagtatagccagtgcctcattgagaaggacaaatataggaaacagatacgagaactcgaagaaaagaatgacgaaatgaggatagagatggtgcgtagagaggcttgcatagtcaacctggaaagtaagttacggaggctctccaaggattcaaataacctagatcagagcctgcctcggaacctaccagttaccattatctcccaagatttcggagatgccagtcctagaaccaacggacaggaggcagacgactcatccacctctgaggagtcacccgaggacagcaaatacttcctgccctaccacccacctcaacgacgaatgaacttaaaaggaattcagttgcagcgtgcaaaaagtcccatcagcctgaaacgcaccagtgacttccaggcgaagggacacgaagaagaaggaacagacgcttcaccctcaagctgcggtagcctccccattacaaatagtttcactaaaatgcaacctccgcgctctcgatctagcatcatgtccatcactgcagagccccccgggaatgattccatcgtcagaagatataaagaggacgccccccacaggtctaccgtagaagaggacaacgactcagggggctttgacgcgcttgatcttgatgatgatagccacgaaagatattcgtttggccccagttcgattcattcctctagttcaagtcaccagtccgaagggcttgatgcttatgatttggaacaagtgaatctgatgtttaggaagttctcccttgagaggccctttcggccgtcagtgacctcggtcgggcatgttagaggacccggcccaagtgtgcagcataccaccctgaatggggacagcctgacgtcccaactgacccttttgggggggaatgcacgcggttctttcgtgcactctgtcaagcctgggagtctcgcagaaaaggccggcctgcgggaggggcatcagctccttttacttgaggggtgcatccggggagagcgccaaagtgtgccgctggacacttgcaccaaagaagaggcccattggacaatacagaggtgttcagggccagtgactcttcactataaagtcaaccacgagggataccggaaactggtgaaggatatggaagacgggttgatcaccagcggcgattccttttacattcgcctcaacttaaacatctcctcacagctcgatgcctgtacaatgagccttaagtgcgacgatgtcgtacacgtccgcgatacaatgtatcaagacagacatgagtggctctgtgccagggtggatcccttcaccgaccatgacctggacatgggaacaatcccttcatacagccgggcgcaacagctgcttctggtgaagctccagcggttaatgcataggggttctcgggaggaggtagatggaacacatcatacccttagggcccttcggaatactttacagccagaggaggctctgtctacaagcgacccccgggtaagcccccgattgtccagggcctccttcctgttcggccagttgctccagttcgtttccagaagcgagaacaaatacaaacgcatgaactccaatgagcgggtccgtataatttcggggtcccctctgggatctctcgcacggtctagcctggacgctaccaaactgttgaccgaaaaacaggaagaattggaccccgagagtgagctgggtaagaacttgtctctcatcccatattcccttgttcgagcattttactgcgagaggagacgcccagtgctgttcacacctacagtgctcgctaagacgctggtacagcgtctgctgaactccgggggcgccatggaatttactatttgcaaaagtgacattgtcacgcgtgatgaattcctacggaggcaaaagacggagaccatcatttatagccgggaaaagaatccgaatgcctttgagtgtatcgctccagccaacattgaggccgtagctgcaaagaacaagcactgtctgctcgaagccggtattggctgtaccagagacttgattaaatctaacatctatccaattgtgctgttcatcagggtgtgcgaaaagaacatcaaaagattccgcaagttgctgcctaggccggagaccgaagaagagtttctccgcgtgtgcaggctgaaggagaaagagctcgaggcactcccatgtctgtacgccaccgtagagccagacatgtggggttccgttgaagagctcctgcgtgtagtgaaggataaaataggggaggaacaacgcaagacaatatgggtagatgaggaccagttgtag

SEQ ID NO: 181820 - DNA, 3114 bp, Artificial Sequence
  Description of Artificial Sequence: Synthetic coding sequence
atggccaccgagagcacccccagcgagatcatcgagcgggagcggaagaagttactggagattctgcagcacgatcccgactctattctggacaccttaacatccagacgcctaattagtgaagaagaatatgagacactggagaacgtaaccgaccttttgaagaagtcgcggaaactgttgattcttgtgcagaagaaaggtgaggcgacctgccaacacttcctcaagtgcttgttcagcacattcccacagagcgccgcaatctgcggcttgaggcacgaggtcctgaagcatgagaacaccgttcccccacagagcatgggggctagctcaaactccgaggacgctttctcccccggtataaagcagcctgaagcgcctgagattactgtgttcttcagcgaaaaagagcacctggacttggagacaagtgaattctttcgtgataagaaaacctcttacagggaaactgcgctgagtgccagaaaaaatgagaaagaatacgatacccctgaagttacgctgagctattctgttgagaaggttggttgcgaagtgccagctactatcacatacatcaaagacgggcagagatacgaggagttggacgattctttgtatctcggtaaggaagagtacctcggttccgtggatacccctgaagacgccgaggcaactgtcgaggaggaggtgtatgatgatcctgagcacgtggggtatgatggcgaggaggatttcgaaaacagcgagacaacagagttttcaggtgaggagccatcttacgagggctcagaaacaagcttgtcattagaggaagaacaggaaaagagtatagaggagaggaaaaaagtcttcaaggatgtgctgttatgtctgaatatggatcggagtcgaaaagttctgccagactttgtgaagcagttctccctggaccgcgggtgtaagtggacacccgaatctccaggcgacctggcttggaactttctgatgaaagtgcaagctcgagacgtaacagcgcgagacagcatcctgagccacaaggtcttggacgaagattccaaagaagacttattagccggcgttgagaacctcgagatccgggacatccaaactatcaatcccctagacgtcttatgcgcaacaatgctgtgctcggattccagcctgcagcgccaggtgatgtcgaacatgtaccagtgtcaattcgctctccccctgttacttcccgacgcggagaataataagagtattctgatgttgggcgccatgaaggatatcgtgaaaaaacagagtacacagttttccgggggccccaccgaggacacggagaaatttcttactttgatgaaaatgcccgtgatctccttcgtgcggctgggatactgcagtttttcgaaatctaggatcctgaacacacttctttcccctgcacagctcaaactccacaagatttttctgcaccaagacctgccactgttggtcctaccccgtcagatcagcgatggcctggtggaaatcacatggtgttttcctgactctgatgatagaaaagagaatccgttcttccagaagcctgtcgcgctcgccaacttgcggggaaacctagagtccttttggactcagtttggatttctcatggaggtgagctcagctgtattcttttttactgactgcctgggagaaaaggaatgggacctgctgatgtttctcggcgaggccgcgattgaacgatgttacttcgtattatccagccaggccagggagtccgaggaagcacagatttttcagagaattctgaatctcaagcctgcccagctgctgttttgggaacgaggggacgctggcgatcgaaggaagaatatggagggacttcaagccgcccttcaggaggttatgttttctagctgtttacgctgcgtcagcgtggaagacatggctgcattggcgcgagaattggggattcaggtcgacgaagattttgagaacacacaaaggatacaagtctctagcggagaaaacatggcaggtacagccgagggtgagggccagcagaggcacagccagctgaagtcctccagtaagtcccaggccctcatgccaatccaggagcctggtacccagtgcgaattatctcagaacctgcagaatctgtatgggacccccgtgtttaggccagtcctggaaaattcttggctgttcccaacacgcatagggggcaacttcaaccatgttagcttgaaggcatcctgggtgatgggccgccccttcggctccgagcaaagacccaaatggttccacccactgccattccagaatgctggtgcccagggccgcggtaagagcttcggcattcagagctttcatccacaaatcttctattccggagagcggttcatgaagttttctcgcgttgctaggggttgccatagtaacggaacatttggccgcctgccaaggcctatctgccagcatgtgcaggcgtgtcctgaaaggcctcaaatgatgggaactctggagagatctagagccgtcgcctctaaaatcgggcactcctacagcctggatagtcagccggcccgcgccgtggggaaaccatggccacaacaagcctgcacaagagtcacagagctcaccgaggctacggggaagttaattagaacatctcacatcggtaagccacatcctcaatcatttcagccagctgcggctacacagaaactgagacccgcttctcagcagggagtgcaaatgaagacacagggtggcgcatcaaatcctgctttgcagataggcagccatccaatgtgcaagagttcccaatttaaaagcgatcagtctaaccccagcacggtgaagcatagtcagccaaagcccttccactctgtcccgagccagccaaagtcatcacagacaaaatcatgccaatcacagccctcacaaactaaaccatccccttgcaagagcacccagcccaagccgtcccagccctggccacctcagtccaagccatcccagccccgtccaccccagcccaaaagttcttccacgaatccttcccaggccaaggcccatcattccaaagccgggcaaaaacggggaggcaagcattag

SEQ ID NO: 181821 - DNA, 933 bp, Artificial Sequence
  Description of Artificial Sequence: Synthetic coding sequence
atggccaccgagagcacccccagcgagatcatcgagcgggagcggaagaagttgctagagatcctccagcatgacccagacagcatcctggatacattgacctccaggcggctaatcagcgaggaagagtatgagactttagagaacgtgactgatctactgaaaaaaagtaggaagctgctcattctcgtgcagaagaagggagaggccacatgtcagcactttctgaaatgcttattcagtacttttccacagagtgccgcaatttgtggattacgtccagaggtgctgaagcacgaaaacactgttcccccacagagcatgggggcgtcctccaattcggaggacgcattttccccgggcataaagcagcctgaagctcccgagataaccgtgtttttctctgagaaggaacaccttgacttggagacatcagagttctttagagataagaagacttcctacagggagacagctcttagcgcacggaagaacgaaaaagagtacgatacacctgaagtgaccctgtcttactccgtggaaaaagttgggtgtgaggtgccagcgactataacatacattaaggacgggcagcggtatgaagagttagatgatagtctttatctgggaaaagaagaatacctgggatcagtggatacacccgaagacgccgaagccactgtggaggaagaagtgtacgacgaccccgagcacgtaggatatgatggagaggaagatttcgaaaatagtgagaccacggagttctccggcgaggaacccagttatgagggctccgagacatcacttagcttagaagaagagcaggaaaagagcatcgaggggtggtcccgcacacacggcctgaagcgcagctcgcacgtgggtttgcctaagtgttgggactacaggagagagccgccatgcctggcatag

SEQ ID NO: 181822 - DNA, 1446 bp, Artificial Sequence
  Description of Artificial Sequence: Synthetic coding sequence
atggccaccgagagcacccccagcgagatcatcgagcgggagcggaaaaagctacttgaaatcctgcagcacgatccggattcgatactagacaccctaacctctcgacgccttatatcagaagaggaatacgagaccctcgagaacgtaaccgatctactcaaaaaatctaggaaattgttgatcctggttcagaaaaaaggagaggccacctgccagcatttcctgaaatgtttgttctcgacgttcccccagagcgcggccatttgtggtctcaggcacgaagtgctcaaacacgaaaataccgtacctccacagtcaatgggggcctcctctaactccgaggatgctttctcgcccggcataaaacagcccgaagctccggaaatcaccgtcttcttttccgagaaagaacatttagatctggaaaccagcgagttcttccgcgataaaaaaacctcatatagggaaactgccctcagcgccagaaaaaacgaaaaagagtatgatactcctgaggttaccctgtcatactcagtagagaaggtgggatgtgaagtccccgccaccattacatatattaaggacggccagcgctacgaggaactggatgatagcttgtacctcggcaaagaggagtacttgggctccgttgatacccccgaggatgccgaggcgacagtcgaggaggaggtgtacgatgacccagaacacgttggctatgacggagaggaggacttcgagaacagcgaaaccaccgaattttctggagaggagcctagttacgagggaagtgagaccagcctgagtcttgaagaggagcaggaaaaaagcatcgaggagaggaaaaaggtatttaaggacgtgctgctctgccttaacatggaccgaagcaggaaagtgctgccagatttcgtcaagcagttctccctggaccgcgggtgtaagtggactcccgagtcgcccggcgacctcgcctggaatttcctgatgaaagttcaggcacgggatgtgacagccagggattccatattatcccacaaggtactggatgaggattctaaagaggacttgctggccggggttgagaatcttgaaatacgagacattcaaactatcaaccctttagacgtgttgtgcgcaaccatgctatgctctgatagcagtctgcaacgccaggtcatgagcaacatgtatcaatgtcagttcgctctgcctctcctgctgccagatgctgagaataataaaagcattctgatgctaggcgccatgaaggacatcgtaaagaagcagtctacccagtttagtggaggacctaccgaagataccgaaaaattcctgactctgatgaagactctgaaaaccctcagggaattcaaatttcctcttgagaaaacatggctgggccagctcaaggtcagggtttctaaggataccgtgtcttag

SEQ ID NO: 181823 - DNA, 570 bp, Artificial Sequence
  Description of Artificial Sequence: Synthetic coding sequence
atggtgctggagcaccccgcccgggtggagcccttctacgccgtgttggagagtccaagcttttcactgatgggaattctgctgaggatagcttcaggtacccgcctgagcatcccaataaccagcaacacactcatttattaccacccacacccagaggacattaagttccacttgtacctggtcccctccgacgctctcttgactaaggccattgatgacgaggaggatcggttccacggcgtccgcctgcagacgtcccctccaatggagccactgaactttggaagtagttacattgtttctaattctgcaaatttgaaggtgatgccaaaggaactgaaactttcctatcgaagtcccggtgagatccagcatttctccaaattttacgccgggcagatgaaggaaccaatccagctcgagattacagagaagaggcacggaaccctggtgtgggatacggaggtgaagccagtggacttgcagttagtggctgcatctgcaccaccaccgttcagcggactcctgtggcaacgacagccgctgaaccccccacctgcaaggtag

SEQ ID NO: 181824 - DNA, 1296 bp, Artificial Sequence
  Description of Artificial Sequence: Synthetic coding sequence
atgatgcggcagcggcagagccactactgcagcgtgctgttcctgtctgtcaactatttaggcgggacattccccggagacatttgttcggaggaaaaccagattgtgagctcctatgctagcaaagtgtgcttcgagattgaagaagactacaaaaatcgacaattcctgggcccagagggcaatgttgatgtcgaactgattgacaagtccactaatcggtattccgtgtggttccctactgcagggtggtatctttggagcgccaccggtctgggctttctcgtgagggacgaagtgacggtgacgatcgcatttggaagctggtcccagcatctggccctcgacctgcagcaccatgaacaatggttagtagggggaccattattcgacgttactgctgagcccgaggaagctgttgcagaaatccatttgcctcacttcattagcctgcagggggaagtggacgtgtcatggttcctggttgcacacttcaagaacgagggtatggtactggagcaccctgctcgcgtggagcctttctacgcagtgctagaatcccccagctttagtctgatgggaattctgctgaggatagcctctgggacccggcttagtatacctataacttctaacactctcatttattatcacccacaccctgaagacattaagtttcatctctacctcgttccctcggatgcgttactcacgaaagctatcgacgacgaggaagataggtttcatggggtgagactgcagacaagccctccaatggaaccccttaatttcggctcctcatacatagttagtaattccgccaacctcaaggttatgccaaaggagctcaaactctcctaccggtcacctggcgagatacagcatttcagcaagttctatgccggacaaatgaaagagcccatccagctggaaattacggagaaaagacatgggacactggtttgggacactgaggtgaagcccgtagacctgcagctggttgctgcctctgccccccctcccttcagcggggccgccttcgtcaaggagaatcatagacagcttcaggcccgaatgggcgaccttaaaggggtcctggatgatctccaggacaacgaggtcctgaccgaaaacgagaaagagttggtggaacaggaaaaaaccagacagtctaagaatgaggccctgctatcaatggtcgaaaaaaagggggatctcgccctcgatgtgctgttcaggtccatttccgaacgagatccttatctggttagctatctgagacagcaaaatctgtag

SEQ ID NO: 181825 - DNA, 1614 bp, Artificial Sequence
  Description of Artificial Sequence: Synthetic coding sequence
atggagaagaaggagtgccccgagaagagcagcagcagcgaggaggagttaccgcggagggactctggctcaagccgaaacatcgatgcctcaaagcttatcaggctgcaggggagccgcaaattactggttgacaacagcatccgcgaactacaatacacaaagaccgggatttttttccaggcagaggcctgtgtgactaatgacacggtctatcgggaactcccttgcgtctctgagacactttgcgacatttctcacttttttcaggaggacgacgaaaccgaggccgaacctctcctttttcgggctgttccagaatgccagctctccgggggggatatacccagcgttagcgaggaacaggagtccagcgagggtcaagacagcggtgatatctgttctgaggagaatcagatcgtaagctcttacgcatccaaggtgtgttttgagatcgaagaggactataagaatcgccagtttcttggcccagaaggcaatgtcgatgtggagctcatcgacaagtccaccaatcgatatagtgtatggttccctacagccggatggtatctttggtctgctacgggcttagggttcctggtacgtgacgaggttactgtcacaattgcttttgggagctggagccagcacttggccctggatctccagcaccacgaacagtggctggtgggaggacctctctttgatgtaaccgccgagccagaggaagcagtagccgaaattcacctgccacactttatttccttgcaggccggcgaggtcgatgtttcgtggttcctcgtggcccacttcaagaacgagggcatggtgttggaacaccctgctcgtgtcgaacctttctatgcagtgcttgagagccctagctttagccttatgggcatcctcctgaggatagcatcagggactcgcctgagtattcccataacatctaataccctgatctattaccaccctcaccccgaggatattaagttccacctgtacctggtgcccagtgatgccttactgaccaaagctatcgatgacgaggaggatcggttccacggggttagattgcagaccagtccaccgatggagcctctgaactttggcagttcatacattgtgtcaaacagcgccaacctcaaggtgatgccaaaggaacttaagctctcctaccgtagccccggcgagattcagcacttctctaagttttatgccggacagatgaaagagcctatccagctggaaataaccgagaaaagacacggtaccctcgtttgggatacagaagtgaaacctgtggacctacagctcgtcgcggcctcagcccctccccctttcagcggcgcggctttcgtgaaggagaaccacaggcagctgcaagcccgcatgggtgatttgaaaggggtgctcgatgatctgcaagacaatgaggtgctgactgagaatgaaaaggaactagtagagcaggagaaaacaaggcagtccaaaaatgaggccctcctgtccatggtggaaaagaaaggcgacctggcattggatgtgttatttcgcagcatttcagaacgcgatccctacctcgtgagctatctgcggcagcagaatctgtag

SEQ ID NO: 181826 - DNA, 1464 bp, Artificial Sequence
  Description of Artificial Sequence: Synthetic coding sequence
atggagaagaaggagtgccccgagaagagcagcagcagcgaggaggaactgccccgaagggtatatcgagagttaccctgtgtgtccgaaactctttgtgatatcagccacttctttcaagaggatgatgagaccgaagccgagcctctgctctttagggcagtccccgagtgccagctgagcgggggtgacattccctcagtttctgaggagcaggaaagttcagaaggtcaagattctggagatatctgctcagaagagaatcagatcgtgtcctcgtacgcgtccaaagtctgttttgaaattgaggaagactacaaaaataggcaatttctgggcccggaaggtaacgtggacgtcgaactcatcgacaagagtactaaccggtactcggtgtggtttccaaccgcgggatggtacctttggagtgcaacgggcctcggcttcctggtcagagatgaggtgactgtcacaatagcattcggatcatggtcccagcacctggccctggaccttcagcaccatgaacagtggttggtgggggggccccttttcgacgtaaccgcggagcctgaagaagccgtggccgagatacacttgccacattttatcagcctccaagctggtgaggtcgatgtgtcgtggtttttggtggctcatttcaaaaatgagggaatggtcttggaacatccagctagagtggagcctttctacgccgtgctggagtcaccttcatttagcctgatgggaatactcctgcgtatcgccagcgggactcggctgagtattcccatcacctctaataccttgatttactaccaccctcaccctgaggacatcaaatttcatctctacctggtgccgtcagacgccctgctgaccaaagcaatcgacgacgaagaagacagatttcacggagtgaggctccagacatcaccaccaatggaacctctcaactttgggtcttcttacattgtgtctaactccgccaatttgaaagtaatgcccaaggaactaaagcttagctacaggtcccctggggaaatccagcacttctcgaagttctatgctggacaaatgaaagagcccatccagcttgaaatcaccgagaagcgacacgggacactcgtatgggatactgaggtcaagcccgtggatctgcagctcgttgctgcatccgcccctccccctttctccggggccgcctttgttaaggagaaccatcgacagctgcaggcgcggatgggtgacctcaaaggggtcctcgacgatttgcaggataacgaggtactcacagagaacgaaaaagaactagtggagcaggagaagacacgacagagcaagaatgaagccttactcagcatggtggagaaaaaaggcgatctcgctctggatgtcctttttcggtcaatctctgagcgtgacccatacctagtttcatatttgaggcagcaaaatttatag

SEQ ID NO: 181827 - DNA, 1101 bp, Artificial Sequence
  Description of Artificial Sequence: Synthetic coding sequence
atgagcgactacgagaacgacgacgagtgctggagcgtgctggagggctttcgagtcaccctcactagtgtgatagatccaagccgcataacaccctatctgcgacaatgtaaagtcctgaacccggacgacgaagaacaggtcttgtcggaccctaacctggtgattcgcaaacgaaaggtcggagtactcctcgacatccttcaaaggaccggccacaaaggatacgtggccttccttgagtctctggaactctattaccctcagctctataagaaagtcactgggaaagaacccgcccgtgtgtttagtatgatcatcgacgcctctggggagtccggtcttacacaactgctgatgacagaggtgatgaaattgcagaaaaaagtgcaggatctgacggctctgctttcaagcaaggatgattttataaaggagttgagagtgaaagattccttgcttagaaagcatcaggaaagagtgcaacgattgaaagaggagtgtgaggccggatctagagaactgaagaggtgcaaagaggagaattacgacctagccatgcgccttgcccatcagagtgaggagaagggagccgctctcatgaggaacagggatttacagctggagatcgatcagctgaaacactctctgatgaaagcggaagatgattgcaaagtcgagaggaagcatacccttaagctgagacacgcaatggaacagcggccgagccaggaacttttgtgggaactgcagcaggagaaggcccttctgcaagcaagggtacaggaacttgaagccagtgtgcaggaggggaaactggaccgttccagtccctacattcaggtactggaggaagattggcggcaggccctgcgggatcatcaggagcaggccaacacaatcttcagcttaaggaaagacctccgccagggagaagcccgacgccttaggtgcatggaagagaaggaaatgtttgagctgcagtgtctggcgctcaggaaagattctaagatgtacaaagatcgcatagaggcaatcctgctccagatggaagaagtcgctattgagcgcgaccagagcacacagatggaaggactttag

SEQ ID NO: 181828 - DNA, 1611 bp, Artificial Sequence
  Description of Artificial Sequence: Synthetic coding sequence
atgagcgactacgagaacgacgacgagtgctggagcgtgctggagggatttagagtgacactcacttcggtgatcgatccttccagaattaccccttacctccggcaatgcaaggtactgaacccggatgacgaggagcaggtactctctgatccaaatctcgttattagaaagcgaaaagtcggagtgctgttggacattctccaaaggactggccacaaaggttacgtggcgtttctggagtccctggagctgtattacccccagttatacaagaaagtcacgggaaaagagccagcccgggtgtttagtatgattattgacgcaagcggtgaaagtgggcttacccagttactcatgactgaggtgatgaagttgcaaaagaaggttcaggatctgactgccttgttatcatcaaaggacgacttcatcaaggaactgcgagttaaggattcactgctgcgcaagcatcaagagagagtgcagcgcctgaaggaggaatgcgaggctggcagtcgggaactcaagcggtgtaaggaggaaaactacgacttagccatgagactggctcaccagagtgaagagaagggcgcggctctcatgaggaatcgcgacctccagttagaaatcgaccagctgaagcactccctaatgaaggcggaagacgattgtaaagtggagcggaaacacacattaaaattaagacatgcaatggaacagagaccctcccaggaactcctctgggagttgcagcaggaaaaggcgttgttacaggcaagagtccaggaactcgaagccagtgtgcaggagggcaaattagatagatcttccccttacatccaggtcttagaagaagactggagacaggccctcagagaccaccaggaacaagcaaatacgattttttcacttcggaaagacttacgccaaggcgaggcccgacgactgagatgcatggaagagaaagaaatgtttgagctgcagtgcctcgcactgagaaaagacagcaagatgtacaaggatcggattgaggccatcctgctgcagatggaagaggtcgctatagaaagggatcaagccatcgccactcgggaggagctccatgcgcagcatgccaggggactgcaggagaaagacgccttaaggaagcaggtgagagaacttggtgaaaaggccgatgagctccagctgcaggtttttcagtgcgaagcccaactcctggccgtagagggtcggctgagacggcagcagctcgagactctggtgttaagctctgaccttgaggatggttcaccccgtcgcagccaagaacttagcctaccgcaggaccttgaggacacacagctttctgataagggttgcctggcaggcggcggttctcctaagcagccatttgccgcactgcaccaggagcaggtcttaaggaacccacatgacgccgggttgtcctccggggaacccccggaaaaagaacgtcgccgactgaaggaatccttcgagaattatagacggaaacgggcacttaggaagatgcaaaaaggctggcggcagggtgaagaagatcgtgagaacaccactgggagtgataacacagacacagaagggtcgtag

SEQ ID NO: 181829 - DNA, 1479 bp, Artificial Sequence
  Description of Artificial Sequence: Synthetic coding sequence
atgagcgactacgagaacgacgacgagtgctggagcgtgctggaggggttcagagttaccctcactagcgtgatcgatccaagtcggattaccccatacctgcgacaatgtaaagttctgaaccccgacgatgaggagcaggtattgagcgatcctaacctggtcatccgaaagcgaaaggttggtgtgctgctggatatactccaaaggacaggtcataagggctacgtggcctttctggagtctctggagctgtactatccccagctgtataagaaggtgaccggcaaggagccggctagagttttctcaatgattatcgatgcttcaggcgagagcgggctcactcagctgcttatgactgaggtgatgaaactccaaaaaaaggttcaggacctcacagcactgctatccagtaaggatgacttcattaaggagttacgggttaaggactcgctgctgcgcaagcatcaggagagggtgcagagactcaaggaggagtgcgaagccggtagtagggaattaaaacgatgcaaggaggaaaactatgacctcgccatgcgcctggcccaccagagcgaagagaaaggagccgcattgatgcggaacagagacctccaactcgaaatcgatcaactaaaacattctctcatgaaggctgaagacgactgtaaagtcgagcgcaagcacaccctgaaactccgacacgcgatggaacagcgcccgtcccaggaactcctatgggagcttcaacaggaaaaagccctgctgcaggcacgggtgcaggagcttgaggcctcagtgcaagagggcaaacttgaccgctcgtctccttatattcaggtgcttgaggaagactggcggcaggccctgcgggaccaccaggagcaggcaaacactatcttttccctgcggaaggatctgcgtcaaggcgaagcgaggcgtctccgttgtatggaggagaaagaaatgtttgagctccagtgccttgctctgcggaaggacagcaagatgtataaagataggatcgaagccatcctcttgcagatggaagaggttgccatagagcgggaccaagctatcgccactcgggaagaactccacgcacaacatgctcgcggattacaagaaaaggacgcactgagaaaacaagtccgggagcttggggaaaaggccgatgaactccagctgcaagtatttcagtgcgaggctcaattgctcgccgtagaaggcaggctgagaagacagcaactcgagacattggtgctgtcaagcgatctggaggacgggagccctagaagatcgcaggaattgagcttgccccaggacctggaagatacacagctctcggataagggctgcttggccggcgggggcagtcctaagcaacctttcgccgctctccaccaggaacaggtcctccggaatccgcatgatgcaggtcctgccgggctgccaggaataggagccgtgtgctag

SEQ ID NO: 181830 - DNA, 3501 bp, Artificial Sequence
  Description of Artificial Sequence: Synthetic coding sequence
atggacctgggcaccgccgagggcacccggtgcaccgacccccccgccgggaaaccagctatggctcctaagcgaaagggcggactcaaactgaacgccatctgcgcaaagctttctagacaagtggtagtggaaaaacgtgccgatgccggctcgcataccgagggcagccctagtcaaccaagagatcaggagaggagtgggcccgagtctggcgctgcccgggcgccacgaagcgaggaggataagcgacgcgccgtgattgagaagtgggtgaacggtgaatactctgaagaacccgccccgactcctgtgctgggaagaatagctagagaagggcttgaactgccacctgagggtgtctacatggtgcagcctcagggttgcagcgatgaggaagaccatgccgaggaaccaagcaaagacggtggcgccttggaggaaaaagactccgacggggccgctagtaaggaggatagtggaccatccacccggcaggcatcaggggaggccagttctctacgggattacgcggcatcgactatgactgagtttttggggatgttcggctacgacgatcagaatacacgagatgagcttgctagaaagatcagcttcgagaagctgcacgcaggctcaacccctgaagccgcaacttcaagcatgctgcccacatctgaggacaccctaagtaaacgggcccgttttagcaaatacgaggaatatattcgtaagctgaaggccggagagcaattatcttggccggctccctcaacaaagaccgaggagagagtgggtaaagaggtggtgggaacactacccgggctgcggctgcctagctctactgcgcacttggagacgaaggctacaatcctgccgttgccctcacactcaagcgttcagatgcagaatttggtagcgcgtgccagcaagtatgattttttcattcagaaactgaagacgggcgaaaatctaaggcctcagaacggcagtacgtataaaaagccctctaaatatgatttggaaaacgttaaatacttacacctgttcaaaccgggtgaaggcagtcccgatatggggggagccattgcctttaaaaccggcaaagtcgggaggccgtcaaagtacgacgtccgcgggatccaaaagccgggacccgccaaggtgcctccgaccccttctcttgctcctgccccattagcaagcgtgccctccgcacctagtgcgcctgggcctgggccagaaccgcccgcctccttgagtttcaacactcctgagtatttgaaatcaacattttcgaagacggattccatcacaaccggtaccgtgtccacagtcaagaacgggcttcccacggacaaaccggcagtgacagaggatgtgaatatctatcagaagtacatcgcccgattctctggctctcagcattgcggacatatccattgcgcctatcaatacagagaacattaccattgtctcgatcccgagtgtaactatcaaagatttacctcgaagcaggacgtcattaggcattacaatatgcataaaaagagggataactcattacaacatggattcatgagattctcaccgcttgatgattgcagtgtgtactaccacggttgccatctgaacggcaagtctactcactatcattgcatgcaggtcggctgcaacaaggtgtatacgtcaaccagcgacgtcatgacccatgagaacttccataagaagaatacacagctgatcaatgacggcttccaaagattccgggccaccgaggactgcggcaccgccgactgtcagttctacggacagaaaacaacacacttccactgccgccggccaggatgtacatttactttcaagaataagtgtgatattgaaaagcacaaaagttatcatattaaggacgacgcatatgcgaaagacggtttcaaaaaattctacaagtatgaggaatgtaaatacgaaggatgtgtgtacagcaaagctaccaatcatttccattgtattcgagctggctgtggttttacattcactagcacttctcagatgacgtctcacaaacgcaagcatgagaggcgccacatcagatcctcaggagctcttgggcttccgccttcgctgctaggtgccaaagatactgagcacgaagaatcttctaacgacgatctcgttgacttttccgctctatcctcaaagaactcctctctctctgctagcccaacctctcagcagagctccgccagtttggcagccgcaaccgcagccaccgaggccggtccgtcagcgactaagccacctaattctaagatcagcggactgttgccacaaggcctgccggggtctatccctttagcccttgccctcagcaattccgggttgccaacccctacgccttatttcccgatcctggctgggcggggatccacgtctctgccagtcggtacgcctagccttctgggcgctgtgtcatcaggatctgccgcctctgctacacctgacaccccaactctggtagcaagtggagctggagattcagccccagtggccgcagcgtccgtacccgcgcctcctgcctccatcatggaacgtattagtgcgagcaagggattaatctcccccatgatggcacgcttagcagctgcagcactgaagccatcagcaacctttgacccgggatcagggcagcaggttacccctgcccggttcccacctgctcaagttaagccagaaccaggagagtccactggagcgcctggtccacacgaggcttctcaggatcggtcgcttgatcttactgtcaaggagcccagcaacgagagcaacggtcacgctgtgcccgctaattcaagcctgctgtcatcccttatgaataaaatgagtcagggcaaccctggactcggctcactgctgaatatcaaagccgaggccgagggctcacctgccgcagaacctagcccattcctgggcaaggcagtcaaggccctcgttcaggaaaagcttgcggagccatggaaggtttacctgagacgattcggaaccaaggatttttgtgacggacagtgtgacttcctgcataaggcacactttcattgtgtggtagaggagtgtggcgcactgttctcaaccctggacggtgcaattaagcacgcaaactttcacttcagaactgaagggggcgccgcgaagggaaatactgaagcagcattccccgcctctgccgccgaaactaaaccacccatggcgccatcttctcccccagtgccccccgtgacaaccgctactgtgtcctcactggagggccccgctccaagtccagcctccgttcctagtactccaaccttacttgcatggaagcagctggctagcacaattccccagatgccccagatccccgcctctgtgccgcacctgcccgcaagcccgctcgctaccacatccttggaaaatgcgaagccccaggtcaagcctggttttctccaattccaggagaaatag

SEQ ID NO: 181831 - DNA, 5280 bp, Artificial Sequence
  Description of Artificial Sequence: Synthetic coding sequence
atggacctgggcaccgccgagggcacccggtgcaccgacccccccgctggcaagcctgcaatggctcctaaaagaaaaggcggcttgaaactcaacgcaatctgtgctaaactgagtcggcaggtggttgtggaaaaacgcgccgacgccggcagccacactgagggatcaccttctcagccaagagaccaggagcgctctgggcccgagtccggcgcggcccgggcacctcggagcgaagaggacaagaggagagcagtgattgagaagtgggtaaacggcgagtatagcgaggaaccagctccaacccccgtgctgggccgaattgctcgggagggcctggaactgccacctgagggtgtgtatatggtgcaaccacagggatgttccgacgaggaggatcatgcagaagagcctagcaaagatggtggagctcttgaagagaaggatagtgatggagccgcgagcaaggaggatagtggccctagtacccggcaagcaagcggcgaagcttcctcgctgcgggattacgccgcaagcactatgactgaattccttggaatgtttgggtacgatgatcagaatactagagatgaactagcgcgaaagatctcgttcgagaagcttcatgcagggtccacgcctgaggcagcaacctctagtatgcttcctacctcagaagacaccctctcgaagcgggctaggttctccaaatatgaagagtacatccgcaagcttaaagcaggtgagcaattgtcgtggcctgccccatcaaccaaaactgaagaacgcgtaggcaaggaagtagtgggcaccttacccggcttgcggcttccaagctcaacagcgcacctcgagactaaggctaccatattacccctgccttctcatagctccgtgcagatgcagaacttggtcgcccgtgcctcaaagtacgatttctttatccagaagctcaagaccggtgaaaacctgcggccccagaatggtagtacttataagaagccttccaagtacgatctagaaaacgtgaagtacctgcacctgttcaagcctggagaggggagcccagatatgggtggcgccatagctttcaagacaggcaaggtcggtcgccctagcaaatatgacgttcgtggaatacaaaagcccggtccagcaaaagtgccacctaccccctctctggcccccgcccctctcgccagcgtccctagcgcccccagcgcacctgggccaggcccagagccacccgcctccctttcctttaatacgccagaatatctgaagagcaccttctctaagacagattccataacgacagggacagtgagcactgtaaaaaacgggcttcctacagacaagcctgcagtaacagaggacgttaacatctaccagaaatatattgcgcgctttagcggtagtcagcattgtggacatatacattgtgcctaccaatatagagaacattaccactgtctggatccagaatgtaattaccagcggtttacttcaaaacaggacgttatccggcattataatatgcacaagaagagggataacagtttacagcatggtttcatgcgcttctcccctctggacgattgtagtgtttactaccacggctgccacctgaacgggaaaagcacccactaccactgtatgcaagtgggctgcaataaggtctatacaagcacgtccgatgttatgacgcatgaaaacttccataagaagaacacccagctgatcaatgatggctttcagaggtttcgtgctactgaagactgcggcaccgccgattgtcagttttatggacagaagacaactcattttcattgccggcgtcccgggtgcacattcacattcaaaaataagtgcgacattgaaaagcataaaagctaccacatcaaagatgatgcatacgccaaagacggcttcaagaaattctataagtacgaagagtgcaagtacgaagggtgtgtttactccaaagccactaatcacttccactgcataagagctggatgtggatttacattcacaagcacttctcaaatgacttcacataaacgcaaacacgagagacgtcacatacggtcctcaggggcactgggcctccccccctctctcctgggcgccaaggacacagaacacgaagaatccagcaatgatgatctggtggacttttctgccctttccagcaagaattccagcttgtctgcctcacccaccagccagcagagtagcgcttcccttgctgccgccaccgcagctacagaggcaggtccctcagctaccaagccaccaaatagtaagatcagcgggctattaccccagggcttacctggatcaattcctctggctctggcgctcagcaattctggccttccaacaccaacaccctattttccaatcctcgcagggagagggtccacatctcttccagtgggtactccatcccttctaggggccgtaagtagcgggtccgccgcctcggccacccctgacacaccaacgctcgtagccagcggggcgggggattccgcgccagtagcggccgccagcgtacccgcaccaccagcttctatcatggaaagaatcagcgcctcaaagggcctaatctcacccatgatggcccgcttggccgccgctgcacttaagccaagcgccaccttcgatccaggtagcggacaacaggtgacaccggcacggttcccacccgctcaggtcaagcctgaacctggtgagtccactggcgcgcccggaccccatgaagccagccaggatcgcagcctggacttgaccgtaaaagagccatctaacgaaagcaatggtcacgccgtgccagccaacagctctttattgtcttcgcttatgaacaagatgtcacagggcaatcccggattaggctcattgctcaatatcaaagccgaggccgaggggtcccccgccgcggagccgtcgcctttcctgggaaaggccgtcaaggctctggtgcaggagaagctcgccgagccctggaaggtgtacctacggagatttggaacaaaggacttttgtgacggacaatgcgacttcttgcataaggcacactttcactgtgtggtggaagagtgcggcgccctcttttccacacttgacggggccataaagcacgcaaattttcactttcggaccgaaggaggcgcagctaaggggaacacggaggcagcgttcccagcttccgccgcagaaaccaaaccccctatggctccaagtagtccccctgtgcctccagttaccactgctaccgtctccagtctggaggggccagccccctccccagccagtgtgccctcaacccctacccttctggcgtggaaacagttggctagcaccatcccacagatgccacaaatccccgccagtgtcccacatttgcctgcctctcccctggccactaccagtcttgagaacgccaagccacaggttaaaccagggtttcttcaattccaagagaacgacccctgtctggcaacggactgtaagtacgccaacaagtttcacttccattgtctcttcggaaattgcaagtatgtatgtaagacttctggcaaagcagagtcacactgcctggatcacatcaaccctaacaataacctggtgaacgtgagagaccagttcgcctattattctttgcaatgtctgtgtccaaatcagcattgtgagttccgcatgcgcggtcattatcattgtctccgaacaggttgctacttcgtgacgaacatcacgacgaagctcccttggcatattaaaaagcatgaaaaagccgagaggagagctgccaatggattcaagtattttacaaaaagagaggaatgcggcagactaggatgcaagtacaaccaggtaaattcgcactttcactgtattcgtgaaggctgccaattctctttcctgctgaaacatcagatgacttcccacgcacggaagcatatgagaaggatgctaggaaaaaactttgaccgggtgccccccagtcagggcccacccgggctcatggacgctgaaaccgatgagtgtatggattacaccggatgtagcccaggagccatgtcctccgagagctccactatggatcgcagctgctcctcaaccccagtcggcaatgaaagcactgccgccggaaataccattagcatgccaacggcatctggcgccaagaaacgattctggattatagaggacatgagcccatttggtaaacggagaaagacagcatcaagccggaagatgctggatgaaggaatgatgctcgagggctttcgcagatttgacctatacgaggactgcaaggatgcagcctgccagttcagcctgaaagtcacccattatcactgtacaagggaaaactgtggctataagttctgtggacgcacccatatgtacaagcacgctcagcatcatgacagggttgacaatctcgtactcgacgactttaagcgctttaaggcatccctgtcttgtcacttcgccgactgcccattcagtggtacaagcacccacttccactgcctcaggtgtcgttttcgctgtaccgatagtacgaaagtcaccgcacaccgaaaacaccacggtaaacaggatgtcatctcagcagctgggttctgccagtttagctcgtctgcagactgtgccgttcccgactgcaaatacaagctgaaatgctcccacttccattgcactttcccgggctgccgccacactgttgttggtatgtcccagatggactctcacaagaggaagcacgagaagcaggaacggggcgagcccgcagctgaggggcctgcaccaggccctccaataagtctggatggctcattgtcactaggcgcagagcccggaagtctcctcttccttcagtcggcagctgcagggctgggcttagcactcggtgatgcgggcgacccagggccccctgatgctgccgcacctggccctagggagggcgctgcagccgccgcggcagcagccggcgaaagcagtcaagaagacgaagaggaggagctcgagttacctgaagaggaggccgaggatgatgaagacgaggatgatgatgaagacgacgatgacgaggatgatgatgaggacgatgatgatgaggacctgagaaccgatagtgaggaatctctgccagaggccgctgctgaggccgcgggggcaggggcccgcactcccgcactcgccgcgctcgctgcccttggggccccagggcctgcacctacggccgctagttccccgtag

SEQ ID NO: 181832 - DNA, 4332 bp, Artificial Sequence
  Description of Artificial Sequence: Synthetic coding sequence
caggagctggaggccgccctgcaccgggacgacgtggagttcatcagcgacctgattgcatgtctgttgcagggctgctatcagcgacgcgacattacgccccagacctttcactcataccttgaggacataatcaactatcggtgggagctagaagagggaaagcctaacccgctgcgagaagcaagctttcaggatctgccccttaggactagggtggaaatcctgcaccggttgtgcgattacagacttgatgccgacgatgtgttcgacttgcttaagggcttggatgccgatagcttgcgagtggaacccctaggggaagacaactctggcgccctctattggtacttctacggcacacgaatgtataaagaagaccccgtccaaggcaagagcaatggagaacttagccttagccgggaatcggaggggcaaaaaaacgtatcctcaatccccggtaagactggtaagaggcgtggcaggccacccaagcgcaaaaaactgcaggaggaaattctgttgtctgaaaaacaggaggagaactcactggcgtccgagccccagaccagacatggaagtcaaggccctggccagggtacttggtggctcttgtgccagaccgaggaggaatggcggcaggtcaccgagtccttccgagaaagaacatctctaagagagcgacaattatacaagctgctgtctgaagatttcctgcctgagatatgtaacatgatagcccaaaaggggaagaggccgcagcgtaccaaggctgaactacaccctcggtggatgtctgaccacctgagcataaagcctgtgaagcaggaagaaacaccagttcttactcggatcgaaaagcagaaacgtaaggaggaagaggaagagcgtcagatcttgctagcagtccagaagaaagagcaggagcagatgctgaaggaggagcggaaacgcgaactggaagagaaagtaaaggctgtggaagggatgtgctcagtacgtgttgtctggcgcggtgcctgtcttagcacctccagacctgtggacagagcaaaacggagaaagctaagagaggagagggcttggttgcttgctcagggaaaagaacttccacccgagctgtcccacctggaccccaactctccgatgcgggaggaaaaaaaaactaaggacctcttcgagttagacgatgacttcactgccatgtataaggtcctggacgttgtgaaggcacacaaagactcttggcctttcctggaacctgtggatgaaagctatgcccccaactattatcaaataatcaaggctcctatggacatctcgagtatggaaaaaaagctgaatggcgggctatactgtacaaaggaggagtttgtaaacgacatgaaaaccatgttcaggaattgtcgcaagtataatggcgagtcctctgaatacacaaagatgagcgataaccttgagcgctgttttcaccgcgctatgatgaaacactttcccggggaagacggagatactgacgaggaattctggatccgcgaggatgaaaagcgagaaaaaaggagaagtagggccgggcggagtggtggatcccatgtctggacccgaagtcgagatcccgagggcagtagtcggaagcagcaacccatggagaacggtggaaaaagcttgcctccaactagacgcgcgccctccagcggcgacgaccagagcagctcaagcacccaacctcccagagaagtaggcacatctaatggtcggggtttcagtcatcccctccattgcggcggcactcccagccaggccccctttctgaatcaaatgagaccagccgttcctgggaccttcgggcccctgagagggtcagatccagctaccctgtatggcagcagtggggttcccgagccacatcccggtgagcccgtgcaacagcgacagccgttcaccatgcagccccctgtgggaattaattcactgaggggtccgagactagggaccccggaggaaaaacaaatgtgtggtggactgacacacttgtctaacatggggccgcaccccgggtcgctccagctaggccaaataagcggccctagccaggacgggagtatgtacgcgcccgcgcaatttcagcccggcttcatccctcccaggcatggaggagcgccagcaaggcctcccgattttccagagagcagcgagatcccgccttcacacatgtaccgctcgtacaaatacctcaaccgtgtccattctgccgtgtggaacggcaaccacggcgcaaccaatcagggcccgttaggacccgacgagaagccgcacctcggaccaggacccagccatcagccccgcacactcggacacgttatggattcccgtgtcatgagaccgccggtgcctccaaaccagtggacagagcaatcaggatttctcccacatggggtgccaagctccggatacatgaggccaccatgcaaatccgccggccaccgactgcagcctccgcccgttccagccccctcaagcctgtttggggcccccgcccaagccctgagaggggtgcaaggcggcgatagcatgatggacagcccagaaatgattgctatgcaacagctcagcagcagggtttgccccccgggcgtcccgtatcacccacaccagcctgcccaccctcgcctgcctggtccatttcctcaggtggcgcaccccatgtctgttacagtatcggccccaaaacccgctttgggcaacccagggcgggcacctgagaacagcgaggcccaggagcctgagaatgaccaggctgaaccactgcccggcctggaagagaagccaccaggtgttggtaccagtgaaggtgtttacttaactcagctgccccatcctacacctcctctacagacagattgcacacgacagtcctccccccaggagcgggagaccgttggccccgagttgaaatccagttcttcagagagtgctgataactgtaaggcaatgaagggaaagaacccttggccctccgactccagttatcctggtcctgcggcacaagggtgtgtgagggacctgtctactgttgcggacagaggggcgctatccgagaatggggtgataggggaagcctcaccctgtgggtccgagggaaaagggctagggagtagcggctccgaaaagctcctgtgcccaagaggcaggaccctccaggagaccatgccctgtaccgggcagaacgctgcaacccctccatcaacagatccaggtctcacaggagggactgtcagccaatttcctcccctctatatgccgggcctggaataccctaacagcgcagcccattaccatattagtcctggtctccagggcgttggtccagtgatgggtgggaagagccccgcaagccatccccagcactttcctcctcgaggcttccagagcaaccacccccattccggcggatttccccgataccgccctccccagggtatgcgctattcgtaccatcccccaccccagccctcttatcaccattaccagcggacaccctattatgcgtgcccgcagtccttctccgattggcagaggccactgcatccccagggctctccgtcagggcccccagcaagccagcctccacctccacgctcgctcttctcagataaaaatgccatggcctccctccagggctgtgagacactgaacgccgccctcacgagccccacacgaatggacgcagtcgcagcaaaggtgcccaatgatgggcagaatccaggtccagaggaggagaaacttgatgaatcaatggaaaggcctgaatccccaaaagaatttcttgacctggacaatcacaacgcagctacaaagagacaatcatctctgtctgcaagcgagtatctctacggtacacccccgccattgtcatccggtatgggctttggctcgagtgccttcccgccacattccgtgatgttacagactggacccccctacacacctcagcgtcctgcatcacactttcagcctagggcatactcaagcccagtcgccgctctcccacctcaccatcccggagccacacagccgaatggcctatctcaagagggacctatttataggtgccaggaggagggactcgggcactttcaggctgttatgatggaacagatcggaactcgttctggaatcagaggcccttttcaggaaatgtataggcctagtgggatgcagatgcacccagtccagtctcaagcctccttcccaaaaacgccaaccgccgcgaccagtcaggaggaagtgccccctcataaacccccaaccctccctctggatcagtcctag

SEQ ID NO: 181833 - DNA, 1371 bp, Artificial Sequence
  Description of Artificial Sequence: Synthetic coding sequence
gagctggaggccgccctgcaccgggacgacgtggagttcatcagcgatctgatcgcatgcctactccaaggatgctatcagagacgagatattaccccccagacttttcattcatatcttgaggacatcattaactacagatgggagctcgaagaaggaaagcccaaccctctgagggaagccagctttcaggaccttcccttgcggacaagggtagaaattctccatcgtctgtgcgattaccgacttgacgcagacgacgtatttgaccttctgaagggtcttgacgccgactcactccgcgtggaacccctcggcgaagataattccggcgctctgtattggtatttttacgggaccagaatgtataaggaagaccccgtgcagggtaagagcaacggcgagctgagcctatcccgcgaatcggaagggcagaaaaatgtgtcctcaatccccggcaaaacgggcaaacgccgcgggcggccacctaaacgcaagaagctacaagaggagatcctgcttagcgaaaagcaggaagagaacagcctggcttctgagccacagaccagacacggcagccaggggcccggacagggcacctggtggctgctgtgtcagacggaggaggaatggcgtcaggtgactgagagctttcgggagcgaactagcctcagggaacgccaactatacaaactgctttccgaagacttcctgccggaaatctgtaatatgatcgcccagaaggaaacaccagtccttaccaggattgaaaagcagaaacggaaggaagaggaggaagagcgccaaattctgttagccgtccagaagaaggaacaggagcagatgcttaaggaggaaagaaaacgagagctggaagagaaagtgaaggctgtcgagggcatgtgtagcgtgagggtggtctggaggggcgcctgcttgtctacctctcgtcccgttgatcgagcaaagaggcggaaacttagagaagagcgggcatggctgctagctcaggggaaagaactgccccctgagctctcccacctcgacccaaattcaccaatgagagaagaaaagaagactaaagatctgttcgagctagatgacgactttacagccatgtataaagtgctggacgtggtcaaggctcacaaggatagctggcctttcctcgagcccgtcgatgaaagttacgcccccaactactaccagatcataaaagcacccatggatatctcaagtatggaaaaaaagctgaacggcggattatattgtaccaaggaagagtttgttaatgacatgaaaacaatgttcaggaattgtcggaaatataatggcgagtctagcggcaagcaggggcgctcgctgtgttag

SEQ ID NO: 181834 - DNA, 1584 bp, Artificial Sequence
  Description of Artificial Sequence: Synthetic coding sequence
atggccgacagccgggaccccgccagcgaccagatgcagcactggaaggagcaaagagcagcccagaaagccgacgttttaaccacaggcgccggcaacccggtgggtgacaagctcaacgttatcacagtaggcccccggggacctctgttggtgcaagacgtcgtctttacagacgaaatggcccacttcgatcgggagagaatcccagagcgggtcgtgcacgccaaaggcgcaggtgcatttggttactttgaagtcacgcacgacattaccaaatacagtaaggctaaggttttcgaacacattgggaagaaaacgccaattgcggtccggttctctacagttgctggcgagagcgggtcagcagataccgtgcgggacccacgagggtttgccgtgaagttctacacggaggatgggaattgggacctcgtcggaaacaatacaccgatcttctttatcagagacccaatcctgttcccttctttcattcattctcagaaacgcaacccccagacccacctcaaagaccccgacatggtctgggacttctggtctctccgacctgaaagcctccaccaggtctcattcctatttagtgatcgcgggattccggacggtcatcgtcacatgaacggctacggatcacacaccttcaaactcgttaacgccaatggcgaggccgtttattgcaagtttcattataaaacggatcagggcataaagaatctgtccgtagaggacgcagcaagactgtcacaggaagatcccgactacggtatcagagatctttttaatgctatagcaacaggcaagtatccatcgtggacattctatattcaggttatgacattcaatcaggccgaaacctttccttttaaccccttcgatttgactaaggtatggccccataaagattaccctttgattccagtcggaaaattagtactaaacagaaatcccgtgaactatttcgctgaggtggagcagattgcctttgatccctcgaacatgcctcccgggatcgaagcatcccctgacaagatgcttcaagggcggctgttcgcctacccggatacccatcgccatcgactgggaccaaattatctccatatccccgtgaattgtccctacagagctagagtggcaaactatcagcgtgatggcccgatgtgtatgcaagacaaccagggaggagcaccgaactattatcctaatagctttggggccccagagcagcagccctctgcactagagcacagcatacagtactctggcgaggtccgacgattcaatactgccaacgatgataacgtcacacaggtgagggcattctatgtcaacgtgttgaacgaggaacagcgtaagcggctctgcgaaaacattgccgggcatctgaaggacgcccagatctttattcagaagaaagcggttaaaaactttaccgaagtgcatcccgattatggcagtcacattcaagcactgttggacaaatacaatgcagagaaacccaagaacgctatccatacctttgtacaatctggaagccatctagcagcaagagagaaggccaacctgtag

SEQ ID NO: 181835 - DNA, 816 bp, Artificial Sequence
  Description of Artificial Sequence: Synthetic coding sequence
atgcccgaggccccccccctgctgctggccgccgtgctgctgggccttgtactgcttgttgtgttgttgctcctgttacgccactggggatgggggctgtgtcttatcggttggaatgagttcatccttcagcctatccacaatctacttatgggcgatacgaaagagcagcgcatcttgaatcatgtcttgcagcacgctgaaccaggcaacgcccagtctgtcctcgaagctattgacacctactgcgaacagaaagagtgggcaatgaatgtgggcgataagaagggcaagatagtggatgcagtaattcaggaacaccagccctctgtcctcctcgagctaggcgcatactgcgggtattccgccgtgcggatggcaaggctattgtccccgggggcacgattgattacaatcgagatcaaccctgattgcgcagctattacacagcgtatggtggattttgccggcgtgaaagacaaagtcaccctggtggtgggtgccagccaggatatcatacctcagcttaagaagaagtacgacgtggatactctggacatggtctttctagatcattggaaggatcgttatctccccgacacactcctgctggaggagtgtgggctcttgaggaagggtactgtgctgctcgcagacaatgtcatctgccctggggccccagattttctggcacatgtgagaggctcctcttgcttcgagtgtactcactatcaaagctttctggaataccgagaggttgtggacggtttggaaaaggctatctataaaggacctggatctgaagccggtccatag

SEQ ID NO: 181836 - DNA, 816 bp, Artificial Sequence
  Description of Artificial Sequence: Synthetic coding sequence
atgcccgaggccccccccctgctgctggccgccgtgctgctgggcctggtcctattagtggtcttgctgctgctgctgaggcactggggctggggactttgccttatcggatggaacgagttcatactgcagcccatccataatttactcatgggcgacaccaaagagcagaggatcctgaatcacgtcctccagcatgctgagccaggcaatgctcagtccgtgctcgaggcaatagacacatattgcgagcagaaagagtgggctatgaatgttggggacaagaagggaaagatcgttgacgccgtcattcaggagcatcagcccagtgtcctcttggagttgggagcctattgcggatatagcgccgtgcgcatggcccggttgctttccccgggggccaggcttattacaatagaaattaatcccgactgtgccgccattacccagcgaatggtggattttgccggcgtcaaggacaaagtcacgctggtggtcggtgcaagccaggacatcataccacagctcaagaagaagtacgatgtggatactctggatatggtctttctggaccattggaaagacaggtacctccctgacactctcctgctcgaggagtgcggacttctacggaagggaacagtcttgctcgccgataacgtgatatgcccgggagcaccagattttctggcccacgtccggggtagctcctgcttcgagtgtacccactaccagagttttctcgaataccgagaggtggtcgatggattggagaaggcaatatataaaggacccgggagcgaggcaggaccatag

SEQ ID NO: 181837 - DNA, 816 bp, Artificial Sequence
  Description of Artificial Sequence: Synthetic coding sequence
atgcccgaggccccccccctgctgctggccgccgtgctgctgggcctagtcttgttggtcgtgctcttactgctgctccgccactggggatggggactgtgtttgataggttggaatgagtttatcctccagcctatccataacttgttgatgggggacaccaaagagcagcgcatcctcaatcacgtcctccagcatgccgaacccggcaacgcccaaagcgtgttagaggccattgacacgtattgcgaacaaaaggagtgggccatgaatgtgggtgataagaagggcaagatcgtcgatgccgtcatacaagaacatcagcccagtgtcctcctggaactcggagcctactgcggttattctgcagtccgaatggctcgactcctgtctcctggcgccagactcatcacaattgagataaaccccgattgcgcagccatcacacaacgtatggttgattttgcaggcgtgaaggacaaggtcacactggttgtcggagcctcacaggatatcatcccccaattgaagaagaagtatgacgtggatacccttgacatggtgttcctcgatcactggaaagatcggtacctacctgatacactgctgctggaggaatgcgggctgctgcggaaaggcactgtgctactggctgacaacgtcatatgccctggagcccctgatttcctggcacacgtgcgcgggtcatcatgcttcgagtgcacacattatcagtcatttctcgagtaccgggaagtggtggacggcctcgagaaagcgatctataaaggcccgggaagcgaggccgggccctag

SEQ ID NO: 181838 - DNA, 666 bp, Artificial Sequence
  Description of Artificial Sequence: Synthetic coding sequence
atgggcgacaccaaggagcagcggatcctgaaccacgtgctgcagcacgcagagcctggcaacgctcagagcgtactggaagccatcgatacatactgtgaacaaaaggaatgggcaatgaatgttggtgataagaaggggaaaattgtggacgccgttattcaggaacaccagccaagcgtgcttcttgagttaggggcttattgcggctattcagccgtgaggatggcaagactgctgagtcccggagctagactgatcacaattgagatcaaccctgattgcgccgcaatcactcagaggatggtggactttgcgggcgtgaaggataaagtcaccttagtggtcggcgcgtcccaggatattattccacagctgaaaaagaaatatgatgtagataccctggacatggtgttcttagatcactggaaagataggtatctccctgatactttgcttctcgaagaatgcggattactgagaaaggggacagtactactggccgacaacgttatttgtccaggcgctcccgatttcctggcccatgtccggggcagctcttgctttgagtgcacacactaccagtcttttcttgagtatcgtgaggtggtggatgggctggagaaggccatatataaggggcctggctctgaagccgggccctag

SEQ ID NO: 181839 - DNA, 672 bp, Artificial Sequence
  Description of Artificial Sequence: Synthetic coding sequence
atgcccgaggccccccccctgctgctggccgccgtgctgctgggcctcgtgttattagtggtgctgctcctgctgcttaggcattggggttggggcctctgtttgatcggatggaacgagttcattcttcagcccattcacaacctgctgatgggggacaccaaggagcaacgtatactcaatcacgtcctccagcatgcagagcctggcaatgcacaatcagttctcgaggccatcgatacctattgcgagcagaaagagtgggcaatgaacgtcggagacaagaagggaaaaattgtggacgcggtgattcaagaacaccagcccagtgtgctgctggaacttggagcctattgcggctattccgccgtgcggatggctaggcttcttagcccaggagcgcggcttatcacgatagagatcaaccccgactgcgccgctattacccaacgcatggtggacttcgcaggtgtgaaagacaaggtgactctggtggttggggctagccaggatataatccctcagctgaaaaagaagtacgatgtggatactctggatatggtgttcctcgaccattggaaggaccggtacctaccagacacccttctgctggaagagtgcggcctcctgcgcaagggtaccgttctactggcagataacgtgatatgctag

SEQ ID NO: 181840 - DNA, 666 bp, Artificial Sequence
  Description of Artificial Sequence: Synthetic coding sequence
atgggcgacaccaaggagcagcggatcctgaaccacgtgctgcagcatgcggagccaggaaacgcccagtctgttctagaggctatcgacacctactgtgaacagaaggagtgggcaatgaacgtgggagacaaaaagggtaaaattgttgatgctgtaattcaggagcaccaacctagcgtcctgcttgagctgggggcgtactgcggttactctgccgtccgcatggcacgactgctgtcacccggagcaaggcttataacaattgagattaacccagactgtgcagccataactcagcggatggtggacttcgccggggtcaaagacaaggtaactttggtcgtgggcgctagtcaggatatcatcccacaactaaagaaaaaatatgacgtagacaccctggatatggtatttctcgatcactggaaggatagatacctgcctgacaccctcctgctcgaggagtgcggccttctgcggaaaggcacagtacttctggccgataacgtgatatgtcctggagcccccgattttctggcacatgtgagaggctcaagctgctttgagtgtacacactaccaatcttttttggagtatcgagaagttgtggacggattggagaaggccatttataagggcccgggcagcgaagctggaccctag

SEQ ID NO: 181841 - DNA, 2664 bp, Artificial Sequence
  Description of Artificial Sequence: Synthetic coding sequence
atggccaacggcaccctgacccggcggcaccagaacggccggttcgtgggcgacgcagaccttgagagacagaagttttcagatctcaagcttaatgggcctcaagatcactcacacctcctctacagtaccatacctagaatgcaagagcctggccagattgtcgagacgtatacagaagaggatccagaaggagccatgtctgtggtttccgttgagacctccgatgatgggaccacccgcaggacagagaccaccgttaaaaaggtcgtgaagactgtcacaacccgtactgttcagccggttgccatgggcccagatggccttccagtggatgcctcctccgttagcaataactacatccagacactgggaagagatttccgaaaaaacggaaatgggggtcccgggccctatgtgggacaggcagggacagctacgcttccccgcaacttccattatccccctgacgggtactctcggcactacgaagatggatatcccggaggatctgataattacggctccctgagtcgagttacccggatagaagaacgctataggcctagtatggagggttacagagccccctcacgccaggatgtgtatggacctcaaccacaagtgcgcgtgggcggaagctccgtagacctacatagattccatcccgagccctacggcctggaagatgaccagcgctccatgggatatgacgatctggactacggtatgatgtctgattacgggacggctagacgcaccggtaccccttctgatcccagacgcaggttgcggtcctacgaggacatgatcggcgaggaagttccctctgatcagtattattgggcccctttggcccagcatgaaaggggatctctggccagtttagattcgctgagaaaaggtggacctcctccccctaactggaggcagcctgaactgccagaggtgattgcaatgctgggcttcaggctcgatgccgtgaagtcaaacgccgccgcctacctgcagcatctatgctaccggaacgacaaggtcaagaccgatgtgagaaaactcaagggaattcctgtgctcgtgggactgcttgatcacccaaaaaaggaggtccatctgggggcctgcggagcgctgaagaacatctcattcggccgggatcaggacaacaagattgccatcaagaactgcgatggcgtgcccgcactggtgagattactgcggaaagcgcgggacatggacctgacagaggtgatcaccggcacgctctggaatctttcatcccatgattccattaaaatggagatcgtggaccacgcactccatgcactcacggatgaggtcattattccccacagcggatgggaacgggaaccaaacgaagattgtaagccacgccatattgagtgggaaagtgtgcttacaaacacagcggggtgcctgcgcaacgtgtcaagcgagcgcagcgaggccagacgcaaactgcgagagtgtgacggcctcgtggacgccttaatatttatcgtgcaagccgaaattgggcagaaggactctgattccaagttggtggagaattgtgtttgcctgctgagaaatctctcataccaagttcatagggaaatcccccaggccgagcgttaccaggaggccgcccctaacgtggccaataataccggtccgcacgcagcatcatgttttggagcaaagaaagggaagggcaaaaaacccatcgaggatccagcaaatgataccgtggattttccgaaacgaactagtccagctagggggtacgaactcctatttcaaccagaggtcgttcggatctatatttcccttctaaaagaaagcaaaacacccgcaatcctcgaggcaagcgcaggggcaattcagaacctttgcgcaggacggtggacatacggacgctatatccggtcggcattaagacaagaaaaagctctgagcgcgatcgccgacctgttgactaacgagcacgagcgggttgtcaaagccgcctctggggcactccgcaatttggcagttgacgctcgcaacaaggagctaatagggaagcacgctatccctaatttggtgaaaaatctccctgggggacaacaaaatagctcttggaactttagcgaagatactgtgatttctatactgaatactatcaacgaggtgatcgctgagaacttagaggccgccaaaaagctgcgcgagacgcagggcatcgaaaaactcgtattgatcaataaatccgggaatagaagcgagaaagaggtgcgggcagctgcgttggtgctgcagaccatctggggttacaaggaactcaggaagccgctcgagaaggaggggtggaaaaagtccgattttcaagtgaacctcaacaacgccagccgtagccagtcgagccacagctacgacgattcgaccctcccgctgatcgaccgcaaccagaagtctgacaataattactctacacctaacgagagaggcgaccacaaccgcacccttgatagatcaggggaccttggggatatggagcctttgaagggaactacccccctcatgcaggatgaaggtcaggagtcactggaggaagaactggatgtcctcgtactggatgatgaaggcggtcaggtgtcctatccctctatgcaaaaaatttag

SEQ ID NO: 181842 - DNA, 1755 bp, Artificial Sequence
  Description of Artificial Sequence: Synthetic coding sequence
atggacggctggcggcggcccctgcagagcgtgggcaaggtgtgcgaaaagaacatgaaaacctctgagatgcatacaatgagtggggcccaaacagggagaaaagaaaaaggagaccctctcaacatcgcaatagataaaatgacaaagaagactagggatttgcggcgccaactgcgtaaggctgttatggatcacattagcgatagctttcttgagactaacgttcctctactggtgctgatcgaagctgcaaagtcgggcaatgaaaaagaggtcaaggagtatgcccaggtgttccgagagcacgctaacaaactggtggaagtcgccaaccttgcctgttctatctcaaacaatgaggaaggcgttaaacttgtaagaatggccgctacccagatagatagcctctgccctcaggtcatcaatgctgcgctcaccctggcagcacgaccacagagtaaggtggctcaagataatatggatgtctttaaggaccagtgggaaaagcaggtcagggtgttgactgaggctgtggatgacattacctccgttgatgacttcctgtcagtgtccgagaaccacatattagaagacgtgaataaatgcgtgatagctctccaggaaggggatgtggacacactggatcgaacggctggagccattaggggtagggcagctcgggtgattcatatcattaacgctgagatggaaaattatgaggccggcgtgtacaccgaaaaagttctggaggccacgaaactgttatccgagacagtgatgcctagattcgccgagcaggtggaagtcgctatagaagcattgtccgccaatgtccctcagccctttgaagagaatgagtttattgacgccagtagactagtgtacgacggtgtccgcgatatcaggaaggctgttctcatgatccggacgccggaagagcttgaagacgattccgattttgaacaggaggactacgacgtgcggagtaggacgtccgtacagaccgaggatgatcagctcatcgctggccagtctgccagagccattatggcacagcttccccaggaggagaaagccaagatcgccgagcaggtcgagatattccatcaggagaagtcaaagttagacgctgaggtggctaagtgggatgacagcggtaatgacatcattgttctcgctaagcagatgtgtatgatcatgatggaaatgacagactttacaagggggaaggggcccttaaagaatacctcagatgtcattaatgcagcaaagaaaatcgcagaggccggcagtcgcatggataaattggccagagcagtggccgaccagtgtccggactccgcttgtaagcaggatctgttggcatacttacagagaattgcgctgtactgtcaccagctgaacatctgcagtaaagtaaaggctgaggttcagaatttggggggggaacttattgttagtggcctggattcggccacaagcctgatccaagcggcaaagaatctcatgaatgccgtggttcttactgtgaaggcttcttatgtagcctcaaccaagtaccagaaggtgtatggaaccgcagctgttaacagcccagttgttagctggaagatgaaagcccctgagaagaagccgctggtgaagcgagagaaacctgaggagttccagacccgtgtgaggaggggctcacagaagaaacatatttcgcccgtgcaggccctgagcgaattcaaggcaatggactccttttag

SEQ ID NO: 181843 - DNA, 2820 bp, Artificial Sequence
  Description of Artificial Sequence: Synthetic coding sequence
atgagcggcctgatctgcctgcagtacggcctgtggcacggccagaagattgatttcggggggccaagacgcctgctgcagaggaacagaggtgaagggtctatgacaagtgccacttcaccaattatcctgaagtgggatcctaagagcctggaaattcggaccctgactgtggagcgattactggagcctctggttactcaggtaacaaccctggtgaacacatcgaataagggcccttctggtaagaaaaagggaaggtctaaaaaggcgcacgttctggctgctagtgtagaacaggccacccagaatttcttggaaaaaggggaacaaattgctaaagagtcccaggaccttaaagaggagctggtagcagccgtcgaagatgtccggaagcagggggagactatgagaatcgccagctctgaattcgcagacgacccgtgttcaagtgtcaaaaggggtaccatggtgcgtgctgcacgtgcactgctgtctgcagtcaccagattattgatactggctgacatggccgatgtaatgcgcctgctcagccatctgaaaattgtggaggaagctctagaagcagtgaagaatgccactaatgaacaggatcttgctaatcggttcaaggagttcgggaaagagatggtgaaactaaactacgtcgcagcccgccgccagcaggaattaaaggaccctcattgcagggacgagatggctgccgcgaggggagccctgaaaaagaacgccaccatgctgtatacagcaagccaggcgttcctgcgtcacccagacgtggcggccacacgggctaaccgggattatgtgttcaaacaggtgcaagaggcaatagccgggatctccaatgccgcacaggcgacaagtccaactgacgaggccaaggggcatacagggatcggagagctggccgccgccttgaatgagtttgataacaagatcattctggacccaatgacctttagcgaggcaagattcaggccgtcgctcgaggagcgcctggaaagtattatttcaggggcagcactgatggccgacagctcttgtacgcgggatgataggcgcgaacgcattgtagccgagtgcaatgccgttcggcaagcccttcaagatctgctgagcgaatatatgaataacaccggacgaaaggagaagggtgatcccctgaacatagctatcgacaagatgaccaaaaagacacgcgacctgcgaagacagctgaggaaggccgttatggatcacattagcgattcattcttagaaacgaatgtccctttgcttgtgctcatcgaggctgcgaagtccggcaatgaaaaagaggtgaaggagtacgcccaagttttccgcgagcacgctaacaagttggtggaggtagccaacttggcatgtagcattagcaacaacgaggagggcgtgaaactggttaggatggctgctacacagatagattccctgtgcccccaggtgattaatgctgctctgaccctggcagcacgtccgcagtcaaaggtcgcacaggacaacatggatgtgttcaaagatcagtgggagaaacaagttcgggtccttaccgaggccgtcgacgatattacatccgttgacgactttctgagtgtgtccgaaaaccatattcttgaggatgtaaataaatgcgtcattgcattgcaagagggagatgtcgacactctcgaccggacagcgggtgccatacgcggcagggccgcccgggtgatccacatcattaatgccgaaatggaaaactatgaggccggtgtgtataccgagaaggttcttgaggccacgaaactattaagcgagacggtaatgcctcgattcgctgagcaggttgaagtggcaatcgaggcactgtccgccaatgtcccacagccctttgaggaaaacgaattcatcgatgctagccgcctagtgtatgacggggtcagggatatccgcaaggccgttctcatgattcgaaccccagaggaactcgaggatgacagcgattttgagcaggaagactatgatgtgagaagccggactagcgtacagacggaggatgaccagctgatagctggacaaagtgcacgcgccatcatggcacagctgccccaagaagagaaagccaagatcgccgaacaggtggagatttttcatcaagaaaagagtaagctcgatgccgaagtcgccaagtgggatgattctggtaacgacatcatcgtgcttgctaaacagatgtgtatgattatgatggagatgacagacttcacaaggggaaaggggccacttaagaacacaagcgacgttatcaacgccgccaaaaagatcgcagaggccggaagcagaatggacaagctggcccgagcggtcgcagaccaatgccccgacagcgcgtgcaagcaggacctattggcgtatctccagcggatagcactctattgtcaccaactgaacatctgtagcaaagtaaaggcagaagtccagaatctggggggtgaattaattgtgagcggactggactccgctacatctcttatccaggccgccaagaatctgatgaacgctgtagttctgactgtcaaagccagctacgtggcctccactaagtaccaaaaggtctatggcactgcagcggtaaactcacctgttgtatcctggaaaatgaaagcccccgaaaagaagcccctggtgaagcgggaaaagccagaggagtttcaaactcgggttcgccgcgggtcacagaagaagcatatcagccctgttcaggccctatccgagttcaaggccatggattctttctag

SEQ ID NO: 181844 - DNA, 2862 bp, Artificial Sequence
  Description of Artificial Sequence: Synthetic coding sequence
atgaccagcgccaccagccccatcatcctgaagtgggaccccaagagtctggaaattaggaccctgacggtggaaagactgctagagcccctcgtcacacaagtaacgactctcgtgaatacgtcaaacaaggggccgagcggcaaaaagaaaggcaggtcaaagaaagcacatgttctggccgcctcagttgaacaggcgacccaaaactttctggagaaaggggagcagattgccaaggagagccaggacctgaaagaagagctggttgccgctgtagaggacgtccggaagcagggagaaacaatgcgcattgcctcctctgaattcgcagatgatccttgcagcagtgtcaaaagaggaacaatggtcagggcggccagagccctgctttctgccgtaactagattgcttattctggcagatatggccgatgtcatgaggctccttagccatctgaaaattgtcgaggaggctctcgaggctgtgaaaaacgctaccaacgaacaggacctcgctaaccgtttcaaagaattcgggaaggaaatggttaaacttaattacgttgctgccaggcgccagcaggagcttaaggatccacactgtcgggacgaaatggcagcagcccggggggcactgaaaaaaaacgcaacaatgctgtacaccgctagtcaggcattcttacgccatcctgacgttgccgctacaagggcaaaccgggactatgtcttcaagcaggtgcaggaggccatagcggggatctctaatgccgcccaggcaacgtctccaaccgacgaggcaaaaggccataccggtattggagaacttgccgctgccctgaacgaattcgacaacaagattatactcgaccctatgacattctctgaagctaggttccggcctagcctggaagagagacttgagtcaatcatctcaggagccgccttgatggccgactcgtcgtgtaccagagacgatcgccgggagaggattgtcgctgaatgcaatgccgtgagacaggcccttcaagaccttctgtctgagtacatgaataacaccggacgaaaggaaaagggcgaccccctaaatattgcaatcgataagatgacgaagaagaccagagatctcaggagacaactgcgaaaggcagtgatggaccacatctctgactccttcctggagacaaatgtcccactgcttgttttaatcgaggcggcgaagagcggtaatgagaaagaagtcaaggaatacgcccaggtctttcgagagcacgctaacaaactggttgaagtggctaatcttgcttgttctatttccaataacgaggagggcgtaaaactggtacggatggccgccacgcagattgattcactctgcccacaggtgatcaacgccgcgctcacgctggccgctcgacctcagagtaaggtggctcaggacaacatggatgtcttcaaggaccaatgggagaagcaggtgcgggtgctgacagaagctgtggatgatatcacatccgtggacgacttcttaagcgtgtctgaaaaccacatcctggaggacgttaataaatgtgttattgcgctgcaggaaggtgatgttgatacactagatcgcaccgctggagctatccggggcagggccgccagggtgatccacattatcaacgccgaaatggaaaactacgaggccggtgtttataccgagaaggtgctggaggcaaccaagttgctgagcgagaccgtaatgcctcgctttgctgaacaggtggaggtggccatcgaggctctcagcgccaatgtgccccagccattcgaagaaaatgagtttattgacgcgtctaggttagtgtatgacggcgtccgtgacattcgaaaggctgtgctcatgatccgcacccccgaagagctcgaggatgattccgattttgagcaggaggactacgacgtgcgctctaggacctctgtgcaaactgaggacgatcagctgattgcaggtcaatccgccagagctatcatggcccaactgccccaagaagagaaggcaaaaatagctgagcaagttgaaatctttcaccaagagaagtccaaactcgacgccgaagttgccaagtgggacgatagcggaaacgacattattgtgttggcaaaacagatgtgcatgatcatgatggaaatgactgattttacacgtggaaagggccccctcaaaaacacctcggatgtgataaacgccgctaaaaagatcgctgaggccggatccagaatggataaactcgccagggcagtcgctgatcagtgtccagacagcgcttgtaagcaagatttactcgcttatctgcagcggattgctctgtattgtcaccaactaaatatatgttctaaagtgaaggccgaggtccagaacttgggaggcgaactgatcgtgagtggtacaggagtccaaagtacctttactaccttctacgaagtagattgcgacgtgattgatggaggccgtgctagccagcttagcacacacctcccaacatgcgccgaaggagcccccattggaagcggatcctctgacagttcaatgctggactctgctacttcgctcatccaagctgctaaaaatctgatgaatgcagtagttttaacagtcaaggcaagctatgtggcatcaactaaatatcagaaggtttatggcaccgcggcagtgaattcgccagtcgtgtcttggaaaatgaaggctccggagaagaagccattagtgaaaagagagaaaccggaggagttccagacccgtgtaagacggggctctcagaagaaacacattagtcccgttcaggccctgtcagaatttaaagcgatggatagcttttag

SEQ ID NO: 181845 - DNA, 354 bp, Artificial Sequence
  Description of Artificial Sequence: Synthetic coding sequence
atgaccagcgccaccagccccatcatcctgaagtgggaccccaagtccctagaaatccgaacactgaccgtggaacgattgttagagccacttgtcacccaggtgaccactctggttaacacatctaacaaaggtccctctggtaagaaaaagggacggagtaagaaagcccacgtgctcgctgccagtgtcgaacaggccacacaaaactttcttgaaaaaggcgaacaaatagccaaagaatctcaggatctcaaggaagagcttgttgcggccgtggaagacgtaagaaagcaaggagagacaatgagaatagcgagtagtgagttcgctgacgatccctgtagctcctag

SEQ ID NO: 181846 - DNA, 201 bp, Artificial Sequence
  Description of Artificial Sequence: Synthetic coding sequence
atgaccagcgccaccagccccatcatcctgaagtgggaccccaagtcgctagaaatacggaccctcaccgtggaaagactgcttgagcctctagtgacacaggttacaactctggtcaatactagtaacaagggcccaagtgggaagaaaaagggccggtctaagaaagcacatgttctggcagcttcggtagaacaatag

SEQ ID NO: 181847 - DNA, 2718 bp, Artificial Sequence
  Description of Artificial Sequence: Synthetic coding sequence
atgaccagcgccaccagccccatcatcctgaagtgggaccccaagtccctagagatccggacccttacggttgaacgcctccttgagccccttgttacccaggtgacaacgttagtcaacacatctaataaagggcctagtggtaaaaagaagggcagaagtaaaaaagctcacgttctggcagccagcgtggagcaggccacccaaaatttcctagaaaaaggcgaacagattgctaaggagagccaagacctcaaggaggagctggtagcagccgtcgaagacgtcaggaagcagggcgaaacaatgcgtatcgcaagttccgaattcgcggacgatccctgcagtagtgtcaagagggggaccatggtacgggccgcccgggcactcctttctgccgttacccgactcctgattctcgcggatatggcagacgtgatgcgtcttctcagccatctaaaaatagtggaagaggctctggaagctgttaagaacgccactaatgagcaggatctggccaaccgattcaaagaatttggcaaagaaatggtgaagcttaactatgttgctgcccggcgccagcaggaattgaaagacccccattgtcgcgacgaaatggcagcagcccggggcgccttgaagaagaacgccacgatgctatacacagccagtcaagccttcttacgtcaccccgatgtcgccgccactcgtgctaatcgcgactacgttttcaaacaagttcaggaagccatcgccggaatcagtaacgcagcccaggcaacctcccctacagatgaagctaaaggccacacagggataggtgaacttgccgcagctctgaacgaattcgacaataaaataatactagaccccatgacatttagtgaggccagattccgcccctccctggaggaacggctggagagcatcatatcaggcgccgctctcatggccgattcaagctgcacccgggacgatagacgtgaacggatcgtggccgaatgcaacgcagtgcgacaggccctccaggatctgctgtccgagtacatgaataacaccggaagaaaggaaaaaggcgatccactcaacatcgctattgataagatgaccaagaaaacaagggacctgcgccgccagctacgcaaagccgtaatggatcatatatctgactctttcctggagaccaacgtgcccctgttggtcctcatcgaagctgccaagtccgggaatgagaaagaagttaaggagtacgctcaggtctttagggaacatgcgaataagctggttgaagtggcaaatctggcttgcagtatttctaacaacgaggagggcgtgaagctggtcaggatggctgccacacaaatcgattccctgtgcccacaggtgatcaatgcagctcttaccctggctgctagaccccagtcgaaggtcgcccaagacaacatggacgtcttcaaggaccaatgggagaagcaagtgcgtgtcctcaccgaggctgtggatgacatcacaagtgtcgatgactttctgtcagtatcagaaaaccatatcttggaggacgtgaacaaatgtgtcatagctcttcaggagggggatgttgacactttagatagaaccgccggtgcaattcgcggtcgagccgcccgcgttatccatatcattaatgctgagatggagaactacgaggccggcgtgtacactgagaaagtgctggaggccaccaagttactgagtgaaaccgttatgcctaggttcgcagagcaggtcgaggttgccatcgaggctcttagcgcaaacgtgccccagccctttgaggagaatgagttcattgatgctagccgacttgtttatgacggggtacgtgacatacgcaaggcagtccttatgataaggacaccagaagagctggaagatgatagcgatttcgaacaggaggattacgacgttcggagccggacctccgttcaaacagaagatgatcagctcatcgccggacagagtgccagagccatcatggcacagctgccccaggaagagaaagccaaaattgcggaacaagttgagatcttccaccaggagaaatcaaaactggatgctgaagtggcgaaatgggacgattccggtaacgacattatcgtcctagccaagcagatgtgcatgattatgatggaaatgaccgatttcaccaggggcaagggccctctcaagaacacgtcagatgtgattaatgccgcaaaaaaaatcgccgaagctggaagcagaatggacaaactggcccgagctgtggccgatcagtgccccgattccgcatgcaagcaggatctgctcgcctacttacaaagaatcgcactctattgtcaccagttaaatatctgtagcaaggtgaaggcggaggtgcagaatctaggcggcgaactgatcgtgtctggacttgactccgccacttccctgatccaggccgccaagaatcttatgaatgctgtggtcctaaccgtgaaagcttcgtatgtggctagcacaaaataccaaaaagtgtacggcactgccgcagtgaactccccagtggtgtcttggaagatgaaggcccctgaaaagaaacccttagttaagcgggaaaaaccggaggagttccaaacgcgggtacggcggggttcgcagaaaaaacatatttcccctgtacaagctctctccgaatttaaggccatggactcattctag

SEQ ID NO: 181848 - DNA, 2718 bp, Artificial Sequence
  Description of Artificial Sequence: Synthetic coding sequence
atgaccagcgccaccagccccatcatcctgaagtgggaccccaagtcactcgagatcaggaccctgactgtcgagaggctgctagagccactagtaactcaggtcacaactcttgtgaacacatcaaacaaaggcccctccggcaagaaaaagggtagatccaagaaggcgcacgttttggccgcttccgttgagcaggctactcagaatttcctggagaagggagagcagatcgcaaaagagtcacaggatcttaaggaggagctggtggcagctgtggaggatgtacgtaaacagggtgaaactatgcggattgcaagctcggagttcgctgatgacccctgctcatccgtaaagcgcggtacaatggtgagggccgcgagagctttgctgagcgcagtaaccaggcttctgatcctcgcagacatggcagatgtcatgaggctcttgagtcacctgaagatagtcgaagaggctctggaggccgttaagaatgccactaacgagcaggatctcgcaaataggttcaaggagtttggaaaggaaatggtcaagcttaactatgtggctgcacggcgacagcaggagctgaaggacccgcattgcagggatgagatggcagcagcaaggggcgcgctcaaaaagaatgcgaccatgctgtatacagcgtctcaagcctttctccgccaccctgatgttgctgcaactcgagctaatcgtgattatgtgttcaaacaggtccaagaggctatcgccggcatctccaacgccgcccaagctaccagccccaccgatgaggccaaggggcatactggcattggagaattagccgctgcactgaatgagttcgacaataagatcattttggaccctatgactttttctgaagcaagatttaggccttcactggaagagcggcttgagagcattatttcaggcgcggctctaatggcagattcatcatgtaccagagacgatagacgtgagcggatcgtggcggagtgcaatgcagtaagacaggccctgcaagatcttttgtcagagtatatgaacaataccggtcgtaaggagaaaggagacccccttaatattgccattgataaaatgactaagaaaacccgcgatctgagaaggcagcttaggaaggctgtgatggaccacattagcgatagcttcctggaaacgaacgtaccccttctagtgctcatcgaggcagctaaaagcggaaacgaaaaggaggtcaaggaatacgcccaagtatttcgggaacacgctaacaaactggtggaggtggcaaatctcgcttgtagtatcagtaataatgaggaaggcgtaaaactggttcgcatggccgctactcaaattgattcactgtgccctcaagtgataaacgctgcattgactctggccgcacggccccagtcaaaagtggcccaggataacatggacgtgttcaaggaccagtgggagaaacaagtgagagtactcacggaagcagtggatgacattactagcgtagacgattttctgtccgtgtcagaaaatcatatacttgaagacgttaataaatgcgtgatagcccttcaggagggcgacgttgacaccttagaccgcacagcaggcgcaatcagaggcagagctgctcgtgtcatccatattattaacgcagaaatggaaaactacgaggcaggcgtgtacacggaaaaagtgcttgaggcaactaagcttctgtctgaaacagtgatgccccgttttgccgaacaggtcgaagtcgcgatcgaagccttatctgctaatgtgccgcaaccttttgaggaaaatgagttcatcgatgctagccgcctggtgtatgacggggtccgcgacattcgcaaagccgttttgatgatccgcacccccgaggaactggaggacgactctgacttcgagcaggaagactatgatgtgcgcagtagaacgtcagttcaaactgaggacgaccagctcatcgctggtcagagcgccagggccatcatggcccagctgccacaagaggagaaagccaagattgccgagcaggttgaaattttccatcaagagaaatcgaagttagacgctgaggtcgccaagtgggacgacagtggcaacgacattatagtcctggctaaacagatgtgcatgatcatgatggaaatgacagactttactaggggcaaaggaccgctcaagaatacaagcgacgtcatcaacgcagcaaagaaaattgcagaggccggatctcgcatggacaagttggcccgcgcagtcgcagatcaatgtccagatagcgcatgtaaacaggacctgctggcttatctccagcgtatcgcgctgtactgtcaccaactgaatatatgtagtaaggtcaaggctgaagtccagaacctgggaggcgagctcattgtctccgggctggattcagctacgtccttaatacaggccgccaagaaccttatgaacgctgttgttcttaccgtgaaagcttcttacgtcgcttctacaaagtaccagaaagtttacgggactgccgctgtgaatagtcccgtggtctcttggaagatgaaggctccggaaaagaagcctctagtgaaacgagagaagcccgaggagttccagacaagagtccggagaggctcccaaaagaaacacatatcccccgtacaagccctctccgagtttaaggccatggactcattctag

SEQ ID NO: 181849 - DNA, 2583 bp, Artificial Sequence
  Description of Artificial Sequence: Synthetic coding sequence
atgaccagcgccaccagccccatcatcctgaagtgggaccccaagtcactggaaatccgtaccctcacagtagagagattgctggaacccctcgttacacaagtcaccacactcgtgaacaccagtaataaaggtccatctggcaagaagaagggtagatccaaaaaagcacacgttctcgccgcatccgtggagcaggcgacccagaactttctcgaaaagggggagcagattgcaaaggaaagccaggacctcaaggaggaactggttgctgccgtcgaggacgtgcgcaagcagggagagaccatgaggatagcttcatctgagtttgccgacgatccctgttccagcgtgaagcgtggaacaatggtccgtgccgctagagccctgttatccgccgtaaccagactcctcatcttggccgacatggcagatgttatgagacttttatcacacctgaaaatcgtagaagaagcactcgaggccgtcaaaaacgctactaacgagcaggatttggctaatcggttcaaggagtttggcaaagagatggtcaaacttaattacgtggccgcccggaggcagcaagagctcaaggaccctcactgtagagacgaaatggccgcagcccgaggggcactgaagaaaaatgctacaatgctctacactgcctctcaggcgtttctgaggcatcccgatgttgccgctactagagccaaccgagattatgtattcaagcaagtacaggaggctattgcgggcatctccaacgcagcccaggccacttcccccacagatgaagcgaagggccatacaggtatcggggagctggctgccgcgcttaatgaatttgacaacaagatcattctggatcccatgacgttctccgaagctcgtttccgccctagtcttgaagaacggctggagtctattatctcaggcgcggcactaatggctgattccagttgtactagggacgaccgccgggagcgcattgtagcggagtgcaacgccgtgcgtcaggccctccaggacttactgtccgagtacatgaataacacaggcagaaaggagaagggggatcctctcaacatcgctatagacaaaatgaccaagaagacaagggacttgcgacgccagttgaggaaggccgtcatggatcatatctctgattcatttctggaaaccaacgttcctcttcttgtgctcatagaagcggctaagagtggaaacgagaaagaagtgaaagaatacgcgcaggtgtttagggagcatgccaataagctagtggaggttgcaaacttagcctgcagcatctccaacaacgaggaaggggtcaagctggtgagaatggccgcaacccaaattgattcattgtgtccacaagttatcaatgccgcgctgacgttagctgcccgccctcaatctaaggtcgcccaagataatatggatgtatttaaagatcagtgggagaaacaggttcgggtccttacggaagcagtggatgacatcacgtctgtcgacgatttcctgtcagtaagtgagaatcatattctggaggatgttaataagtgtgtgattgcattgcaggagggagatgtggacactttagacaggactgccggtgcaatcagaggacgcgcagccagggtgatccacattattaatgccgagatggagaactatgaggcaggtgtgtacacggagaaggtcctcgaggctactaaactcctgtccgaaaccgtaatgcctcggttcgcagagcaggtggaggtcgcaatcgaggctctcagcgctaacgtgcctcagcccttcgaggagaatgagttcatcgacgccagtagactggtgtacgacggggtaagagacatacggaaagcagtgctgatgatccgcacgcctgaggaactggaagacgactctgattttgagcaagaggactatgacgtccgctctcggacctccgttcagaccgaagacgatcagctcatcgcgggccagagcgccagggcaatcatggcgcagctgccccaggaagagaaggccaaaatcgctgagcaagtggaaattttccaccaagagaagagtaaactggatgcagaagtggcaaagtgggacgactcaggcaacgatatcatcgtcctggccaaacagatgtgtatgatcatgatggagatgactgacttcacccgaggcaaagggcctttgaaaaatacgagtgacgtgattaacgccgccaaaaagatagccgaggcggggagtcgtatggacaagctggctagagccgtagctgatcaactcgattcagccacgtcccttattcaggctgctaagaacctgatgaatgccgtcgtcttgacagtaaaggcgagctacgttgcctcaactaagtaccagaaggtctacggcactgcggccgtgaactcgcccgtcgtctcctggaagatgaaagccccagagaagaaacccttggtcaaacgtgagaaacccgaggaattccaaacacgggtccgacgggggtcacagaaaaagcatatttccccagtacaagctctcagtgaatttaaggctatggattcattctag

SEQ ID NO: 181850 - DNA, 2718 bp, Artificial Sequence
  Description of Artificial Sequence: Synthetic coding sequence
atgaccagcgccaccagccccatcatcctgaagtgggaccccaagtcactggagattaggacactgaccgtggaacgcctgcttgagcctctggtaacacaggtcaccactctggtcaacacctctaataagggtccctcaggaaaaaaaaagggccggtctaaaaaggcccacgtcttagccgcttcagtggagcaggctactcaaaactttctggaaaaaggcgagcagattgcaaaggagagtcaggatctgaaggaagagctcgtggctgccgtggaagacgtcaggaaacaaggtgaaactatgaggattgcctcctctgaattcgctgatgacccatgctcatccgtcaagcggggcaccatggtgagagcggccagagcactcctgagtgctgtgacaagattgcttatcctcgcggatatggccgatgtaatgaggttactctcacacctgaagattgtagaggaagcactcgaggctgtaaagaacgcgactaacgaacaggatttggcaaatcggttcaaggagtttgggaaagagatggtcaaactcaactatgtggccgcaagacgccagcaggaactgaaggacccacactgccgcgacgaaatggcggccgccagaggcgctttgaagaaaaatgctactatgctatacacagcctcccaggcttttcttcgccatcctgacgtcgccgcaactagagccaaccgggactatgtgtttaagcaggtgcaggaagccatcgccggcatatccaatgctgcccaagcaactagtccgacagatgaggccaaaggccacactggaatcggtgagctggctgccgcactaaacgagtttgataataaaatcatcctggaccctatgacattctcggaggcgagattcagacctagcctggaggagcgcctggagtccataattagcggggcagcgctaatggccgattcctcttgcacgcgcgacgaccgtcgggagaggattgtggccgaatgcaatgcggtgagacaagccctacaggatctattatcagaatatatgaataacactggccgaaaagagaagggggatcctctaaatattgcaatcgacaagatgaccaagaaaacacgcgatctgcggcgccagttgaggaaggcagtcatggaccacatcagtgactcatttttagaaactaacgtcccgcttctggtgctgattgaggccgccaagagtggtaatgagaaagaggtgaaagaatacgctcaagtattcagagaacacgcgaataagctagttgaggtcgccaacctggcctgctccatttctaacaatgaggagggggtcaaactggtgcggatggccgccacacagatcgattccttgtgccctcaagttattaatgccgccttaacactggccgcccgtccacagtctaaagtggcgcaggataacatggatgttttcaaggatcagtgggagaaacaagtcagagtcttaactgaggcggttgacgatatcacttccgtggacgatttcctgtccgtgtcggaaaaccacatactggaggatgtcaacaaatgcgtgatcgctcttcaggaaggcgacgtggataccctagataggacagcgggcgcaatacgcggccgggccgctcgagtgattcacatcattaatgccgagatggagaactacgaggctggggtctacaccgagaaggttctggaggctaccaagctgctctccgagacagtaatgcccaggttcgccgagcaggtcgaagtagctatagaggctctgtccgctaacgtgccccaaccattcgaagagaatgaattcattgacgcaagcagactggtttacgacggggttcgggatattcggaaggctgtcctgatgatcaggacacctgaagaactagaggacgacagcgacttcgagcaagaagattacgacgtgaggtcacgcacatcagtccagacggaagacgatcagttaatcgccgggcaatcagcccgagccattatggcccaacttccgcaggaggaaaaggccaagattgccgagcaagtggagatcttccatcaggaaaagagcaaactggatgccgaagtagcgaagtgggacgactctggcaacgatataatcgttcttgcaaaacagatgtgcatgattatgatggagatgactgactttactaggggaaagggcccattgaagaatacaagtgacgtgatcaacgctgctaaaaagattgccgaagccggatctcgcatggataagctggcaagagccgtggctgatcagtgccctgatagcgcctgtaagcaagatctcctggcctatctgcaaaggatcgccttatactgccatcaactgaatatttgttcaaaagtaaaggcagaagtgcaaaatctcgggggggagttgatcgtttccggtctcgacagcgcaacaagtttaatccaggctgccaagaacctgatgaacgcggttgtgctcaccgtaaaagcctcttatgtcgcatcaactaaatatcagaaggtatacggtacagccgcagtgaattctcctgtggtttcgtggaagatgaaggcgcctgaaaaaaagcccctcgtgaagagggagaaacctgaggaattccaaacccgggttaggcggggaagccagaagaagcatatttcccccgtgcaagccctgagcgagttcaaagccatggacagcttttag

SEQ ID NO: 181851 - DNA, 582 bp, Artificial Sequence
  Description of Artificial Sequence: Synthetic coding sequence
atgagcgccgagacccccatcaccctgaacatcgacccccaggacctccaggtgcagacctttaccgtcgaaaagctactggagcccctaatcatccaagtgaccacattggtgaattgtcctcaaaacccgagctccagaaagaagggtcgttcaaaacgggcctccgtcttgctagcttccgtggaggaagcaacttggaatctcttagacaaaggcgaaaaaatcgcgcaggaagccactgtcctgaaggatgaactgactgccagtctggaggaagttaggaaagagtccgaggccctcaaagtgagcgctgaaagatttaccgacgacccatgtttcctgccaaagagagaggccgtcgtgcaggccgcccgggctctgctcgccgcagtaacaagactcctgattctggctgacatgatagatgtgatgtgcctcctgcagcacgtctcggctttccaaagaacatttgaatccctgaagaatgtagccaacaagagtgacctgcaaaaaacatatcagaagctgggcaaagaactggagaacctcgattatctggcattcaaacggcagcagtag

SEQ ID NO: 181852 - DNA, 705 bp, Artificial Sequence
  Description of Artificial Sequence: Synthetic coding sequence
atgacccagctgcccgaggccgagaaggagaagatcgccgagcaggttgctgactttaaaaaagttaagtcaaaattggacgctgaaattgagatctgggacgacacctccaatgatattattgtgctggcaaaaaacatgtgcatgattatgatggaaatgaccgattttactagaggcaagggccccctcaaacacacaaccgacgtgatctatgcggccaaaatgatttctgagagtggaagcagaatggacgtcctcgcccgccagattgctaatcaatgtcctgacccgtcatgtaaacaggacttgctggcatatttggagcagattaaattttactcccatcagttaaaaatttgcagccaagtcaaggctgagattcaaaatctgggaggcgagctcataatgagcgccctggatagcgtgactagtctaatccaggcggccaaaaacctcatgaatgccgtcgtgcagacagtgaagatgagctatattgcatctacaaagattattcggatccaatccccagccggccccagacatccagtggtgatgtggaggatgaaagccccagccaagaagccattaataaagcgcgaaaagcccgaagagacctgcgcagcagttcggcgtgggagcgcaaaaaagaaaattcaccctttacaggtgatgtccgaattccggggacggcagatatattag

SEQ ID NO: 181853 - DNA, 2688 bp, Artificial Sequence
  Description of Artificial Sequence: Synthetic coding sequence
atgagcgccgagacccccatcaccctgaacatcgacccccaggacctgcaggtgcagactttcaccgtggagaagttacttgaaccactcataattcaggtgaccacactggtgaattgtccacagaaccccagctccaggaagaagggccgctcaaaacgagcatctgtcctgcttgcgtccgtcgaggaggcaacatggaatctactggacaaaggcgagaagattgcccaggaggcaacagttctgaaggacgaattgaccgcctctctcgaggaggtgcgcaaggagtctgaagctctgaaagtcagcgctgaacgtttcaccgatgatccctgcttccttccaaaacgggaagccgtcgtccaggctgcacgggctctcctggcagccgtgactcggttgttaattttggccgatatgatcgacgtgatgtgcctcttgcagcacgtgtccgctttccagcgaacctttgagagcttgaaaaacgtagctaacaagagcgacttacagaagacctaccagaaactgggtaaagagttagagaaccttgactacctggctttcaaacgacagcaggacctgaaatcacctaatcaaagagacgagattgccggtgccagagctagcctgaaggagaactccccactgctacacagcatttgcagtgcctgcctcgagcactctgacgtcgcttctctgaaggcctcgaaggacacagtgtgcgaggaaatccagaatgccctaaatgttatttctaacgcatcgcaagggatccagaatatgacaaccccacctgagccgcaggcggccactctgggcagcgcccttgacgaacttgagaatctcattgtcctgaatccattaaccgttacagaagaggagatacggccatcccttgaaaagagactggaagccatcatctcaggagctgcccttttggcagactcgtcctgcacgcgagacttacacagggagcgcattatagccgaatgtaatgcgattaggcaggcactgcaggatctcctttcagaatacatgaataacgcagggaagaaggagcgctcaaacaccttgaacatcgcactcgacaacatgtgtaagaagacacgtgacctgaggagacagcttcggaaagccattattgatcatgtgagtgactcttttctagacaccaccgtaccactgctggttctaatcgaggcagccaaaaacggtagagaaaaggagattaaggagtatgcagcaatttttcacgaacatacctctaggctggtagaagtggctaacctcgcttgctcaatgtccacgaacgaagatgggattaagatcgtaaaaattgcagccaaccaccttgagacattgtgcccacagatcattaacgccgcccttgcactcgcggcccgacctaagagtcaggcggtgaagaataccatggagatgtataagcgcacctgggaaaaccacattcatgttctcacagaagccgttgatgatattacatccatagacgacttcctcgcagtgtcagaaagtcacatcctggaagatgtgaataagtgcataatcgctttacgggaccaggatgcggacaatttagacagagctgccggtgcaattcgggggcgcgccgcccgcgtggcccacatcgtgacaggagagatggacagttacgagccaggagcctacacggaaggcgtgatgagaaatgtcaactttctgactagtaccgtaattcctgagttcgtcactcaagttaatgtcgccttggaggcgctctcaaagagcagcttgaacgtgctcgacgataaccagtttgtggacatttcaaagaagatatacgacactatccacgacataaggtgtagcgttatgatgataaggactccagaggaactggaagacgtgtccgacctggaagaagagcacgaagtacggagtcacactagtattcaaacggaaggcaagacagatcgtgcgaagatgacacagctacccgaggcagagaaagaaaaaattgccgagcaggtcgcagactttaagaaggtcaagagcaagctagacgctgagatagagatctgggatgacacctctaatgatataatcgtgctcgccaaaaacatgtgcatgatcatgatggagatgactgacttcacacgcggcaaaggacccctgaaacacaccactgacgtgatctacgctgcgaagatgattagcgagtctggatccagaatggatgtcttagccaggcagattgccaaccagtgccccgacccgagttgcaagcaagaccttctagcatacctcgagcagatcaaattttattcccaccaactcaagatatgcagtcaagtgaaggccgagatacagaacctcggcggcgagctcataatgtccgctttggacagcgttactagcctgatccaggccgcaaagaatctgatgaacgccgtggttcagactgtgaagatgtcttacatcgccagcactaagataattaggattcagagccctgctggtcccaggcacccagtcgtcatgtggaggatgaaagcgcctgccaagaagcctctgataaagagggagaaacccgaggaaacatgcgcagcagtccgacggggatccgccaaaaagaagatacatcccctgcaggtaatgagtgagtttaggggccgtcagatctactag

SEQ ID NO: 181854 - DNA, 2688 bp, Artificial Sequence
  Description of Artificial Sequence: Synthetic coding sequence
atgagcgccgagacccccatcaccctgaacatcgacccccaggacctccaggtccaaacgttcacagtcgagaagctgttagagccgttgataatccaggtgacgacactggtgaactgcccgcagaaccccagctctcggaagaaaggcaggagcaaacgggcttctgtgctactagcttcagtcgaggaagcgacttggaacctgctggataaaggggagaaaattgcccaagaagcaactgtcttaaaggacgagcttacagctagcctggaggaggtacggaaagagtccgaggcactgaaggtttctgctgaacggttcacggacgatccatgttttctaccaaaacgcgaggctgtcgtccaagccgcccgggctcttctggctgcagtcacacggttgctcatcctggcagacatgatcgacgtaatgtgcctactgcagcatgtgagcgccttccagagaaccttcgagtccctgaaaaatgtggcaaataaatcagatctgcaaaaaacctaccaaaagctcggtaaggagcttgaaaacctagactatttggcattcaaacggcagcaggaccttaagtctcccaatcaaagggatgaaatagccggggcccgtgccagcctgaaggagaatagcccgctgttgcactcgatctgtagtgcatgcctcgaacatagcgatgtggcgtctctgaaggcctcaaaagacaccgtatgtgaagagatccaaaacgcccttaatgtgattagtaacgcttctcaagggatacagaacatgacaaccccacctgagccccaggccgcaacgctcggttctgccttggatgaactggaaaatctcatcgtacttaatcccttgactgtgacagaggaagagatacgcccctccctggaaaagcggctcgaggcaataatctccggtgccgctcttttggccgattcgtcgtgtacacgcgacctgcatagggagagaatcattgccgagtgcaatgccattcgacaggccctgcaggaccttttatcagagtacatgaacaatgccgggaaaaaggaacggagtaatactctgaacatcgctctggacaacatgtgcaagaagacgcgcgatctccgccgccagctgaggaaagcaatcatagatcatgtatccgacagtttccttgatacaacagttccattgcttgtcctcatcgaagccgccaaaaacgggagagagaaggagatcaaggagtacgctgcaatcttccacgaacacacaagtcggctcgtggaggtagcgaacctggcatgttccatgtcgacgaatgaggacggaattaagattgtgaagatcgccgccaatcacctcgagaccttatgtccccagattattaacgccgccctcgctttggctgcgcgacccaaaagccaggccgtcaagaatactatggaaatgtacaagaggacatgggaaaatcatatccacgtcttgacagaggctgtagacgatattacgtccatcgacgactttctggctgtttcggaatcccatattctggaagatgtaaataagtgtataattgcgctgcgggaccaggacgctgataatttagatcgcgctgccggggccatcaggggccgcgccgccagagttgcgcacattgtgacaggcgagatggactcttacgaacccggggcttacacggaaggcgtgatgcgaaacgtaaacttcctgacttcaacagtcatccccgagtttgtgacccaagttaatgtggccttagaggccttgagcaagtcttctctgaacgttttagatgacaaccagtttgttgacatatctaagaagatttatgataccatacacgacattcgctgctctgtgatgatgatccgcacccccgaggaattggaggatgtaagcgatctcgaggaggaacatgaagtcagatcccacacttccatacaaactgaaggcaaaacagatcgtgcaaaaatgactcaactgccagaagctgagaaggagaagatcgccgagcaggtggccgattttaagaaagtaaagtccaaactggacgctgaaattgagatctgggatgacaccagcaatgacatcatcgtgctggccaagaatatgtgcatgatcatgatggagatgaccgacttcacaagaggcaagggcccgctgaagcatactacagatgtgatctacgccgcgaagatgatctccgaatcgggttctaggatggacgtgctggctcggcagattgccaaccagtgtccagatccaagctgcaagcaggatctgctcgcgtatctcgagcagattaagttctactcacaccagctgaagatttgttctcaagttaaggccgaaatccagaatttagggggggaactcataatgagtgcgctggactcagtaacgtccctgattcaggccgccaagaatctgatgaatgccgtggtccaaactgtgaaaatgagttatatagcatccaccaaaatcataaggatccaatcccccgctggtccccgacatccagtggtgatgtggcggatgaaagcccctgccaagaaacctcttattaagagagagaagcccgaggaaacctgcgctgccgtgagacgaggaagcgcgaagaagaaaattcatcccctgcaggtgatgtccgagtttcgcggacgacaaatctattag

SEQ ID NO: 181855 - DNA, 1131 bp, Artificial Sequence
  Description of Artificial Sequence: Synthetic coding sequence
atgagcgccgagacccccatcaccctgaacatcgacccccaggacctgcaggtgcaaacgttcacagtggaaaagctgttggagccgttgatcattcaggttactactctagtgaactgccctcagaatcctagctcaagaaagaagggccgatctaagagagcgtctgtcttgctagcgtctgtggaggaagcaacctggaatctgctggataagggagaaaagatcgcacaggaagctaccgtccttaaagacgagttgacagcttctctggaagaggtccgtaaggaatcagaagccctcaaagtttcagcagagaggtttacagatgatccatgtttcctgcctaaacgggaagctgtggtgcaggccgcccgggccctcctggctgcagtaacccgcctgttgatcctggcagacatgatagatgtgatgtgcctgcttcaacacgtgagtgcattccaacggacattcgagagtttgaagaatgtcgcaaataagagcgacctgcaaaagacatatcagaagcttggcaaggaattagagaacctggactatctcgctttcaaacgtcagcaggatctaaaaagtcctaatcagcgggacgagatagctggggctcgggcatcccttaaggagaattcacccctgctgcattctatatgtagcgcatgcttagaacactctgatgtagcgtccctgaaagcttccaaggacacagtatgtgaggaaatacaaaatgcattaaatgtgattagcaatgcctcccaggggatccaaaatatgactacaccacccgaacctcaagcagctacactcggatctgccttagatgagcttgagaacctgatcgtgctgaatcccctcaccgtaacggaagaagaaattcgcccgtccctggaaaagaggctcgaagccattatatcaggcgctgccttgttggctgactcctcctgcaccagagacctccatcgggaacgcattatcgctgagtgtaacgcaatccgccaggcactgcaggatttactcagcgagtatatgaacaacctgtgtaaccaaaagagcgatcttggcctgacaggtgttaagatcaagcttttagaggagtgtattatcttttggtccctgtag

SEQ ID NO: 181856 - DNA, 582 bp, Artificial Sequence
  Description of Artificial Sequence: Synthetic coding sequence
atgagcgccgagacccccatcaccctgaacatcgacccccaggacctgcaggtgcagactttcaccgttgaaaaactgctggaacctctcattatacaggtgactaccctcgtcaactgcccacaaaaccccagttcccggaaaaaaggtagaagtaagagagcctccgtactgctcgcgtcagttgaggaagctacctggaacctgcttgacaagggggagaagatcgcacaggaggctacagtgcttaaggacgaactgactgcttccctggaagaagtgcgcaaggaaagcgaagcgctgaaggttagtgccgagcgatttaccgacgacccatgcttcctgccaaaacgagaggcggtggtgcaagccgccagagcgctgctggcagccgtaacccgccttctcattttagccgacatgatcgacgtaatgtgcttgctgcagcatgtgtctgccttccagcgcacattcgaaagtttaaagaacgtggctaacaaaagcgacctccagaaaacttatcaaaagctgggtaaggaattggagaatctggattacctagccttcaaaagacagcagtag

SEQ ID NO: 181857 - DNA, 1131 bp, Artificial Sequence
  Description of Artificial Sequence: Synthetic coding sequence
atgagcgccgagacccccatcaccctgaacatcgacccccaggacctgcaggtccagacctttacagtggagaaactactggaacccctgattatccaggtgactaccctggtcaactgtcctcagaatccaagcagtagaaagaagggaaggagtaaaagagcatccgttctgctggcctccgtggaggaggcaacctggaatctcctcgacaaaggggagaaaattgcccaggaagccaccgtgcttaaagacgagcttacagcttcgctggaagaggtgagaaaggagtcagaagcactcaaagtctccgctgaacgattcactgacgacccctgtttcctgcctaaaagagaggcagtagtccaggctgctcgcgccctgctcgcggccgtgacccggctgctaatcctggctgacatgattgatgtgatgtgtctcctccaacacgtctctgccttccagcggacctttgagtcccttaagaatgttgctaacaaatcagacctacagaagacctatcagaagctgggcaaggagttggagaatctggattatctggcattcaagcggcaacaggacctgaagagcccgaatcaacgggacgagatcgccggagcaagagcaagccttaaggaaaacagtccattactgcactccatttgcagcgcctgccttgaacactccgatgtggccagtctaaaggctagcaaagacacagtctgcgaggaaatccagaacgccttgaacgtgatcagtaacgcctcacaggggatacagaacatgactactccgcctgagccacaagctgctacgctcggaagcgcactcgatgaattggagaacttgatcgtcctgaatccactgaccgtgaccgaagaagagattagaccaagcctcgaaaaacgtctcgaagccataatttctggcgccgccctgctcgcagattcttcctgtaccagggacctgcaccgagagcggatcattgccgagtgtaacgctatccggcaggccctgcaggatcttttgtcagagtacatgaataatctctgtaatcagaaatctgatttaggcctcacaggtgtgaaaataaaattactcgaggagtgtatcattttttggtcgttatag

SEQ ID NO: 181858 - DNA, 2205 bp, Artificial Sequence
  Description of Artificial Sequence: Synthetic coding sequence
atggccgccagccccggccccgccggcgtgggcggcgccggcgccgtgtatggatcaggctccagcggtttcgccctggacagcggcttagaaatcaagacaaggtccgtcgaacagacattactccccctagtgtctcaaattaccactctgatcaaccacaaagataatacgaaaaagtccgataaaactctgcaggccatccagagggttgggcaggcagtaaacctggccgtgggtagattcgtgaaagtcggcgaagcaatcgccaatgagaactgggatctgaaggaagaaattaacattgcatgcatagaagcgaagcaagctggggaaacaatcgcagcgctgactgatatcaccaatttgaaccacttggaaagcgacggtcaaatcacaattttcacagataagactggcgtaatcaaagctgcacgtctgctgttaagttccgtcacaaaagtgttgctcttagctgacagggtggtaattaaacagatcatcacctcgcggaataaggtgctggcaaccatggagcgcctggaaaaggtgaattcttttcaggagttcgtccagatcttctctcagtttgggaacgaaatggttgagttcgcgcatctgtcaggcgatagacagaacgatctgaaagatgagaaaaaaaaagcgaaaatggccgctgccagggcagtattagaaaagtgtaccatgatgttactgaccgcgtctaagacttgcttacggcatccaaactgtgagtccgcacacaagaataaggaaggcgtattcgatcgcatgaaagtagctctagacaaggttatcgagatagtgacagattgcaagcccaatggtgagacagatatctcttccatttccatatttacaggcatcaaggagttcaagatgaacattgaagccctgagggagaacctgtattttcaatcaaaggagaacctgagcgtcacactagaggtgatcctggagcgtatggaggattttaccgattcagcatacacaagccacgagcacagggagcggattctagagcttagtacacaggcccgcatggagctccagcagcttatttcggtgtggatacaggctcagtctaagaaaacaaagtccattgctgaagaactggaactgagtattctgaaaattagccattcattgaatgagctgaaaaaagaactgcacagtaccgcaacacagctcgccgcggacctcctcaagtaccatgccgatcatgtcgtcctaaaagcactcaaactaacaggtgtcgagggaaacctggaagctttggccgagtatgcctgcaagctgagtgagcaaaaggagcaattggtcgagacgtgccgcctgctgcggcatatttctggcacagagcctttggaaatcacatgtatccatgctgaggagacgttccaagtgactggccagcagattatcagcgccgctgagacacttaccctccatccatcgagtaaaatcgcaaaagaaaatctggatgtgttctgcgaggcctgggaatcccagatatctgacatgagcaccctgttaagggagattaacgatgtgttcgaagggcgacgcggcgaaaagtatgggtacctaagtctccccaaaccaatgaagaataacgcaaacctgaagagtctcaagcccgataaaccggactctgaagagcaagctaagatcgccaagctgggtctgaagctcggcctactgacttccgacgcagactgtgaaatcgagaaatgggaagaccaggaaaatgagatcgttcagtacggacgcaatatgagctcgatggcatattcattatatttgttcaccaggggcgagggacccctgaagacctcacaggatttgatccaccaattggaggtatttgctgccgaaggcctcaaactgacttcctctgtccaggcgttcagtaaacaactgaaggatgacgataagctcatgctgctacttgaaatcaataaactgattcccttatgccaccaactgcagacagttactaaaacatctctccagaataaagttttcttgaaggtggataaatgcatcacaaaaactcggtccatgatggctctgctggtacagctcctctcactgtgttacaaattactcaagaagctgcagatggaaaacaatggttgggtctctgtcacgaataaggacaccatggactcaaaaacttag

SEQ ID NO: 181859 - DNA, 1953 bp, Artificial Sequence
  Description of Artificial Sequence: Synthetic coding sequence
atggccgccagccccggccccgccggcgtgggcggcgccggcgccgtttacggctccggcagctcaggtttcgctcttgacagtggcctggagatcaaaacacgatcggtggagcaaacgttgctgcccctggtgagccagataaccaccctgatcaaccataaggacaatacaaaaaaatcagataagaccctccaggcaatccaaagagtgggacaggctgttaatttagccgtggggcggtttgtgaaagtcggcgaagctatcgcaaatgagaattgggaccttaaggaggagattaacattgcctgtatagaggccaagcaggctggggagactatagctgcgctgacagatataaccaaccttaaccacctggagtcggatggccagattacaatctttaccgataaaactggagttatcaaggctgctaggcttcttctgagttccgtgacaaaggtgctgttattagcagatcgggtcgtgattaagcagataatcaccagccggaacaaagtgctagccacaatggagcgattggagaaagtaaactcctttcaagagtttgttcagatcttctcccagttcggtaacgagatggtagaattcgctcacctgtccggagaccgccagaacgatctcaaggacgaaaagaaaaaagctaagatggccgctgcccgtgcagttctagagaagtgtacaatgatgctactaactgcctccaagacttgccttcgacatccaaactgtgagtcagcacataaaaacaaggagggcgtcttcgataggatgaaggtcgctctggataaagtgatcgaaattgtgacggactgtaaacccaatggggagactgatatttccagcatttctatatttacaggaataaaggagtttaagatgaatatcgaggctttgcgcgagaacctgtattttcagagtaaggaaaaccttagtgtcacattggaagtgatactggaacgtatggaagactttacagacagcgcctatacttctcatgaacaccgtgagaggattcttgaactgagcacccaggcccgcatggagctgcaacagcttatttctgtgtggatacaggcgcagagcaaaaaaacgaaatctatcgccgaagaattggaattgagcatcctgaagatcagtcactcacttaatgaattaaagaaagaaatcatctctgccgcagaaaccctaactctccacccaagtagcaagattgccaaggagaatctggatgtcttttgcgaggcttgggaatctcagatatccgatatgtctacactgttgcgggagataaatgatgtgttcgagggccgacgcggggagaagtacggctatttatctctcccaaagcctatgaagaacaacgcaaacctgaaatcactaaagcccgacaagccagatagtgaagagcaggctaagatcgccaagctcgggctaaagctgggcctgctgacatctgacgccgattgcgaaattgaaaagtgggaggaccaagagaatgaaattgtgcaatacggacgaaatatgagtagtatggcatattcgctttacctctttaccagaggggagggtccactgaaaacctcccaggacctaatccatcagctggaggtgtttgccgccgaaggattgaaactgaccagtagcgtgcaggcattcagtaaacaacttaaagacgatgataagctgatgcttcttctggaaataaacaaactcattcccctttgccatcaactccagacagtgacaaagacaagtctccagaataaggtgtttctgaaagttgacaaatgtattaccaagaccaggtccatgatggcactgctggttcaactgctgagtctgtgctataaattgctcaaaaaactccaaatggagaataatggatgggtgtcagtcacaaataaggacacaatggatagcaaaacctag

SEQ ID NO: 181860 - DNA, 552 bp, Artificial Sequence
  Description of Artificial Sequence: Synthetic coding sequence
atggccgccagccccggccccgccggcgtgggcggcgccggcgccgtgtatggttccggctcgtcgggcttcgcgttggattcgggactcgagattaagacaaggagcgtagagcaaaccctgctgccactggtatcccagattactactttgatcaaccataaggacaacacaaaaaaaagcgacaagactctgcaggctatccaacgcgttggccaggcagttaacctggcagttgggaggttcgtgaaggtgggggaggccatagctaacgagaattgggatctcaaagaggaaataaacatcgcgtgcattgaagccaaacaggccggcgagaccattgccgccctgactgatattaccaacttgaaccacctagagtccgacggccaaatcactattttcaccgacaagactggcgtgattaaggcagccagactacttctgagttccgttacaaaagttctactgctcgcggacagagttgtaatcaaacagataatcacatcccgcaacaagcgtctcaccatctacaatctgcgccactcgtag

SEQ ID NO: 181861 - DNA, 408 bp, Artificial Sequence
  Description of Artificial Sequence: Synthetic coding sequence
atgagcagcatggcctacagcctgtacctgttcacccggggcgagggccccctcaagacatctcaggacctcattcatcagctggaggtgttcgctgccgagggtctgaagctgacgagctcggtccaggcctttagcaaacaacttaaagacgatgataagctaatgctgttactggaaatcaataagctgattcccctttgtcaccagctgcagactgtgactaagaccagcctgcaaaacaaagtgtttctgaaagtcgataaatgcatcactaaaactcgctccatgatggcactgcttgttcagctactgagcctatgctataagctgctaaaaaaacttcagatggaaaataacggctgggtgagcgtgaccaacaaggatactatggattcaaagacatag

SEQ ID NO: 181862 - DNA, 2157 bp, Artificial Sequence
  Description of Artificial Sequence: Synthetic coding sequence
atggccgccagccccggccccgccggcgtgggcggcgccggcgccgtgtacggctctggaagcagcggttttgcactggactctggacttgagatcaagacaagaagtgtggagcagacactcctgccactggtatcacagattacaacattgatcaatcacaaggataacaccaaaaaatctgacaagaccctgcaggctatccagcgggtcggtcaggcagttaacctcgcagtggggcgctttgtcaaggtgggcgaggccatagctaacgagaactgggatctgaaggaagagatcaatatagcgtgcatcgaagcaaaacaggctggtgagacaatcgctgccttgactgatattactaacctgaaccacctggagtccgacggccagatcacgatttttaccgacaaaacaggagtcattaaagctgcacggttgttgttgtcttctgtcacaaaggttctgttactggcagatagggtcgtgattaaacagattattacaagccgcaacaaagttctcgctactatggaacggctggagaaagtcaattcatttcaggagttcgtgcagatttttagccagttcgggaatgagatggtggaatttgcgcacctcagcggtgatcggcagaacgacctgaaagacgagaagaagaaagcaaaaatggccgcagccagggctgtgttggaaaagtgtaccatgatgctgcttaccgcctcaaaaacatgcttgcggcatcctaactgtgagagcgcccataaaaacaaggagggggtttttgatcggatgaaggtcgccctcgacaaagtaatcgaaattgtcaccgattgcaagcccaatggcgagacggatatctcttcaatttccatcttcacaggaatcaaagaattcaaaatgaacatcgaagcactgagggaaaacttgtattttcagtccaaagagaacttgtccgttaccctcgaggtgatcttggaaagaatggaggacttcaccgatagtgcttacacgagccacgagcatagagagcggatcctagagttatcaacccaggcgcgcatggagctgcagcagttgattagtgtctggatccaggcacagtcaaaaaaaactaaatccattgcagaagagttggagctctctattctcaaaatttctcacagcctgaatgagcttaagaaggaactgcacagcaccgcaacccagttagccgccgacctgttgaagtatcacgccgatcatgtggttctgaaagctttgaagctgacaggcgtcgagggcaatcttgaagcactcgctgagtatgcctgcaaactgtctgaacagaaggagcagctggtcgaaacttgcaggctcctgagacacatcagtgggactgagccactcgagataacgtgtatccatgctgaggagacattccaggtaacaggacagcaaatcatttcagccgccgaaaccctcactcttcatccttcgtcgaaaatcgcgaaagaaaacctggatgtcttttgtgaagcgtgggagagtcaaatcagtgatatgagtaccttactgcgcgagatcaatgatgtcttcgaggggcgccggggggaaaagtatgggtatctgtcgctcccgaagcctatgaagaataacgctaatctgaaaagcttgaaacccgacaagcctgactcggaggagcaggcgaaaattgccaaattggggctcaaactgggcctgctgacatctgacgccgactgtgagattgagaagtgggaagatcaggagaacgagattgtgcagtatgggcgcaacatgtcgtccatggcctattctctatatctgtttaccaggggagagggtcccctaaaaacctctcaggacttgatccaccaactggaagtgttcgctgccgaggggctcaaactaacctcttcggtgcaagcattcagtaagcagctgaaggacgacgacaagctaatgcttttgctggaaatcaacaagctgattccgctctgtcaccagcttcaaacagtgaccaagacctctctgcagaacaaggtctttttaaaggtcgataagtgcattacaaagacacggtcaatgatggcccttctcgtgcagcttttgtctctttgctacaagttgctgaaaaaatccgagacgcgctactag

SEQ ID NO: 181863 - DNA, 2802 bp, Artificial Sequence
  Description of Artificial Sequence: Synthetic coding sequence
atggacgacagcgaggtggagagcaccgccagcatcctggccagcgtgaaggagcaggaggcccaattcgaaaagctgacaagagcactggaagaggagaggagacatgtgtccgcacaactggaacgagtcagggtcagccctcaggatgcaaatccgttaatggcaaacgggactctgactagaagacaccagaatggtaggtttgttggcgatgcggatttggaacgccagaagttctcagaccttaagctgaacggaccccaggaccattcccatctgctgtattcaaccatccctcgcatgcaggaaccaggtcaaattgtggagacgtataccgaggaagaccctgagggcgccatgagcgtggtcagcgttgaaacttcagatgacggtactacgcggaggactgagaccacagtgaaaaaagttgtgaaaacggtgacgacacgaacagtccagccggtggcaatgggccccgacgggctgcccgtcgacgcatcaagcgtgtctaataactacattcagacgctggggcgagacttccggaaaaatggaaacggaggacccggtccatatgtcggtcaagccgggacagctactctgccacgcaattttcactacccacccgacggctattcccgccactacgaagacggctaccccggaggatcggacaactatggctcactctcaagggtgacacgtatcgaagagcggtaccggccctctatggaagggtaccgagcaccaagccgccaggatgtgtatggcccccagccacaagtacgcgttgggggtagctccgttgatctccaccgtttccatcccgagccatacgggctcgaggacgaccaaaggtcgatgggttacgatgacctggattacgggatgatgagcgactatggaacagccaggaggactggaactcctagtgatcctagacgacggctgaggagttatgaggatatgatcggcgaggaagtccctagcgaccagtattactgggcccccctggctcagcatgagagagggtcccttgctagcctggactctttgcgaaagggtggtccaccaccccctaattggagacagcccgaattgcctgaggtgattgcgatgctgggtttccgcctggatgccgtgaagagtaatgccgctgcctacttgcagcacctgtgttatcgtaacgacaaggtgaagacagatgttcgcaaactgaaggggattcctgtcctggttggcctcctagatcaccccaaaaaggaggtgcatctcggcgcctgtggcgccctgaagaatatctctttcggccgcgaccaggacaacaagatcgctatcaaaaactgtgacggggttcctgcactggtgagacttctgaggaaggcaagagacatggatctcaccgaggttattacagggaccctctggaacctctcttcccatgactcgatcaaaatggagatagtggatcacgccctccacgccttgactgacgaagtgatcattcctcattccggctgggagcgcgaacccaatgaggattgtaaaccgcgtcatattgaatgggagtcagtcctcactaacaccgctgggtgtctgcgtaatgtaagcagcgagagatccgaggcaagacgaaaactgagagagtgcgatggcctcgtggacgcactgattttcatcgtacaggccgagattggacagaaagactccgacagtaagctggtagagaactgcgtgtgcttgttgcggaacttgagttatcaggtacatagggagattccacaggccgagcgataccaggaagccgccccgaacgtggcaaacaatacaggaccccacgccgcttcttgttttggcgccaaaaaggggaaggggaagaagcccatcgaagaccctgccaacgatacagtcgatttcccgaagcggacatcccctgcgagggggtatgaactgctttttcaaccagaagttgtccggatttatatctccctcttgaaggaatcaaaaaccccagcaatcctcgaggcgagtgccggcgctatccagaacctgtgcgccggcagatggacctatggccgctacatacgatctgccttgaggcaggagaaagccctgagtgccattgcagacttattaacgaatgagcacgagagggtggtcaaagccgcctccggggccctgcgcaatctcgccgttgacgctcggaataaggaactcatcggcaaacatgctatccccaatcttgttaagaatcttcctgggggccagcagaactcgtcatggaattttagtgaggatacagtgatttccatcttgaacacaatcaacgaagtgattgccgagaacttagaggctgcaaaaaagcttcgagagacgcagggtatcgagaagctggttctcattaacaaaagtggcaatagaagcgagaaggaggtccgtgccgccgcattagttcttcaaacaatctgggggtacaaagaactccggaaaccccttgagaaggagggttggaagaaatccgactttcaggtgaatctcaataatgcctccagaagccagagttcgcactcatacgacgattcaaccttacctctgatagacagaaaccaaaagtcggataaaaaaccggatcgcgaagaaatccagatgtccaacatgggctccaataccaagtccttagataataattacagcacccccaatgaaagaggggatcacaaccggaccctggatcggagtggtgatctgggtgacatggaacctctaaaaggcactaccccacttatgcagaagatctag

SEQ ID NO: 181864 - DNA, 2844 bp, Artificial Sequence
  Description of Artificial Sequence: Synthetic coding sequence
atggacgacagcgaggtggagagcaccgccagcatcctggccagcgttaaggaacaagaagctcagttcgaaaagctgaccagggccctcgaggaggagcgcaggcatgtgagtgcccagcttgagcgcgtgcgggtgtctcctcaagatgctaatccgctgatggcaaacggtacactgacacggcgccaccaaaacggcaggttcgtcggcgacgcagatctggagcgccagaagttttctgaccttaaactgaacgggccccaagaccatagtcatctgctgtacagcacaatccccaggatgcaggaaccagggcagatagtggagacgtacacagaggaggaccccgagggagcgatgagtgtggtgtctgttgagacctccgacgatgggactacgcggcgcaccgaaaccaccgtgaagaaagtggtgaagacagttacaactaggacggtccagccagtagctatgggtcctgacggtcttccagtggacgccagtagtgtgagcaataactacatccagacccttggacgtgactttcgcaagaacggtaacgggggaccagggccatatgttggtcaagcgggaaccgctacactgccccgaaatttccactatcctcccgatgggtattcccggcactatgaagatggttaccccggcgggagcgacaactacggttccctgagtagggtgactaggattgaagagcgctatcgaccttcaatggaaggctatcgagcacctagcaggcaggacgtatatggccctcagcctcaagtacgcgttgggggaagctcagtggacctgcatcgcttccaccctgaaccttatggattggaagacgatcagaggagcatgggctacgatgatcttgactatgggatgatgtctgactatgggaccgctagaagaaccggcacaccctcagacccaagacgcagactgaggtcctacgaagacatgatcggagaggaagtgccatctgatcaatactattgggcacccctagcccagcacgagcgcggcagtttggcctcattggacagcctaagaaagggggggcccccgcctcctaactggcggcagcctgagctgccagaagtgattgcgatgctgggttttcgtttggatgccgttaagtctaatgctgcagcatacctgcaacatctgtgttacagaaacgacaaggtgaaaaccgatgtgcgaaagcttaaaggcattccagtcctcgtcggattgcttgaccaccctaaaaaggaggtccacctaggcgcgtgcggcgccttgaagaacatctccttcggtcgcgaccaggataacaagatcgctattaagaactgtgacggagtacccgccctggtgaggctcttgcgaaaagcccgcgacatggatctcactgaggtcatcaccggaactctgtggaatctgagcagtcatgattccatcaagatggagatcgtcgaccatgcgctacacgccctgacagatgaggtgataatccctcactcagggtgggagagagagcccaacgaggattgcaagcccagacacattgagtgggaatccgtacttactaacaccgctggatgtctgcggaatgtatcttccgaaaggagtgaggcgcggagaaagttaagagaatgcgatggactggtggatgcactgatttttattgtgcaggccgagataggacaaaaagacagcgactccaaacttgtcgaaaattgcgtttgcctgttgagaaacttgtcttaccaggtgcatcgcgaaattccgcaggctgagcgctatcaagaggcagcaccgaacgtcgccaataatacagggcctcacgctgcttcctgcttcggcgcaaaaaagggcaaggacgaatggttttctagaggcaagaagcccattgaggaccctgccaacgatactgtagatttcccaaaacgcacctcccctgctaggggctatgagctcttattccaacctgaagtagtgcggatttatatcagtctcctgaaggaatctaagaccccggccatcttagaggcatctgcgggagctatccagaatctgtgtgcaggacgttggacatacggacggtatattaggagtgcactccggcaggagaaagctctaagtgcaatcgcagatctactcaccaatgagcacgaacgcgtcgtcaaagctgcgagcggggccctcaggaatttggcagtggatgcaagaaataaggagctcattggcaaacatgcaattcctaacctcgtgaaaaaccttcctggcggccaacagaacagctcctggaactttagcgaagatacagttatcagcatacttaacaccattaatgaagttatagctgagaatctcgaagcggccaaaaaattgagagaaacacagggaattgaaaagttagtgctaatcaacaagtccggtaaccgcagcgagaaagaggtccgcgcagcagcactggtgctacagactatatgggggtacaaagaactccggaagcctctggaaaaagagggatggaaaaagagcgatttccaggtcaacctgaacaatgcatcgagatctcagtcttctcactcgtacgacgactccactctgcctttgattgataggaaccaaaagtctgacaacaactactccaccccaaatgagcgcggggaccacaaccggactttggatagatcaggggacctgggcgacatggagcctcttaaaggaactactcctctgatgcaggacgagggccaggaatctctggaagaggaactggatgtgcttgtactcgacgatgaaggaggacaggtctcctacccgtcaatgcagaagatctag

SEQ ID NO: 181865 - DNA, 2889 bp, Artificial Sequence
  Description of Artificial Sequence: Synthetic coding sequence
atggacgacagcgaggtggagagcaccgccagcatcctggccagcgtcaaggagcaggaagcacagtttgagaagcttacgcgcgcactggaggaagagcgaagacacgtctcggctcagctcgaacgggtcagggttagtccgcaggacgcaaatccgttgatggccaatggcacactgactaggcggcaccaaaatgggcgattcgtaggagacgcggatcttgagaggcaaaaatttagcgatctcaagctcaatggccctcaggatcattcacacttactctactccactattcccagaatgcaggaacccggccagattgtggaaacttacaccgaggaggatccggaaggcgctatgtcggtagtgtctgtagaaacctccgacgatgggaccacccgacgcaccgagaccaccgttaagaaggtcgtaaaaacagtgactactcggacggtgcaacctgtggcaatgggtcccgacggcctgcctgttgacgcgagttctgtgtcgaacaattacattcaaactcttgggcgtgattttaggaaaaacggaaatggcggacctggtccctacgtgggacaggcaggaacagcaactcttccaaggaatttccattatccaccggacggttattcaagacactatgaagatggctatcccggggggtcagacaattatggctctttgagccgggtgacgcgaatagaggagcggtaccgcccaagtatggagggctatagggctccaagtagacaagatgtatacgggcctcaacctcaggttcgtgtggggggctcttctgtggacctgcacaggttccaccccgagccgtatggactcgaagacgatcaaagaagcatgggctatgatgatctcgactacggcatgatgagcgactacggaactgctaggaggactggcacaccaagtgacccccgacgtcgtttgaggtcttatgaggatatgatcggcgaggaggtcccctccgaccagtactactgggcacccctcgcacagcacgagcgaggcagtctagcatcacttgacagcttgcggaaaggaggccctcctcccccgaattggcggcagcccgaactgccagaggtaatcgccatgctgggcttccgtctggacgccgtgaaaagcaacgccgctgcatatctacagcacctgtgctaccgtaatgataaagtgaagaccgacgtgcggaagctgaagggtatcccagttctggtggggctgctcgatcatcctaaaaaagaggttcacctgggagcttgcggtgccctgaaaaatatctcattcggaagagaccaggacaataagatcgcaatcaaaaactgtgatggggtaccagccctggtcaggctgttaagaaaagcgagggacatggacctgaccgaagtcatcaccgggacactgtggaacttgtcctctcacgattcaattaagatggagattgttgatcatgcgctgcatgcgcttacagacgaagttataatcccccactcaggctgggagagggagccgaatgaggattgcaaaccacgtcacattgagtgggagagcgttctgaccaacacagccggttgcttgaggaatgtgagtagtgaaaggtccgaggcgaggcgcaagctgcgggaatgtgacgggctcgtggacgccctgatctttattgtgcaagctgagataggtcagaaggactctgacagcaagctggtggagaattgcgtctgcctcctgcggaacctgtcttatcaggttcacagagagattcctcaggccgagcgttatcaggaagcggctccaaatgttgccaataacactgggcctcatgctgcctcttgctttggggctaagaaaggaaaggggaaaaagcctatagaggatcccgctaatgatacagtggacttcccaaagaggacaagcccagcacgggggtatgaactgctttttcagccggaggtggtcaggatatatatttctctgctcaaggagagcaaaacccctgcaatccttgaggcatccgccggggccatccaaaacctgtgcgccggcagatggacgtatggcaggtatatcagaagtgctctgaggcaggagaaagccctgagtgctattgcggacttgcttacgaatgaacacgagagggtggttaaggccgcttcaggtgcactgagaaatctcgccgtcgacgcgcgtaataaagaactgattgggaagcacgctattcccaatctagtgaaaaacctgccaggtggacagcagaatagtagttggaatttctccgaggatacagtgatttccatcctaaacacgataaatgaggtaatcgccgagaacttggaagccgccaagaagcttcgcgagactcaaggcatcgagaagttggtgctgatcaataagtccggcaatcggtcagagaaagaggtgagagcagcggctcttgtgctccaaactatctggggttataaggagctgaggaaacctctagaaaaggagggatggaagaaatcagattttcaggtcaatctgaataacgcatcaagatctcagagcagtcacagctacgacgattcaaccctgccgctgatcgaccgcaatcagaagtcggataaaaagcctgatagggaggaaattcagatgtctaacatggggtccaacaccaagagcctcgacaataattacagcaccccaaatgaacgcggggatcacaaccggaccctggatcggtccggggacctcggagatatggaacccttgaaggggactacgcccctcatgcaggatgaggggcaggaatcactcgaggaagagctggacgttcttgtgctcgatgacgagggaggacaggtgagctaccccagtatgcagaaaatttag

SEQ ID NO: 181866 - DNA, 2826 bp, Artificial Sequence
  Description of Artificial Sequence: Synthetic coding sequence
atggacgacagcgaggtggagagcaccgccagcatcctggccagcgttaaagaacaggaggcccagttcgaaaaactaacacgagcactggaggaagagcggcggcatgtgagcgcccagttggaacgtgtgagagttagcccccaggacgcaaatcccctgatggctaatggcaccctgacccggaggcaccagaacggaaggtttgttggagacgccgacctggagcgacagaagtttagcgatctaaaactgaacgggccccaggatcactcccatcttctatactcaaccatacccagaatgcaggagccaggccagatcgtagagacctacacagaggaggatcccgagggggccatgtctgtagttagtgtcgagacctccgatgacgggactacaagaagaaccgaaacaacagtcaagaaggtggtcaaaactgttactacacgcactgtacagcccgtggcaatgggtcccgacggccttcccgttgacgcttctagcgtctccaacaactacatccaaaccctgggccgcgatttccgcaagaatgggaacggaggacccgggccctacgttgggcaggcaggtacggccaccctgcctaggaactttcattatcctccagacggctactctaggcactatgaagacgggtaccctggtggatctgacaactatgggagcctgagtcgggtgaccaggatcgaagagagatatcggccaagcatggaggggtatcgggcgcctagccgccaagacgtgtacggacctcaacctcaggtcagagtgggcggcagttccgtggacctgcaccgttttcatcccgagccttatggcttggaggatgaccaacgctcaatgggctatgacgatcttgattatggcatgatgagtgactacggcaccgcccgacgcactggcaccccctccgatcctcgcagacgtctccggtcatacgaagacatgattggtgaagaggtgccttccgaccagtattactgggctcccctcgcacagcatgagcgtgggagcctagcctcacttgattccctgcggaagggtggcccccctcctcccaattggaggcagcctgagctgccagaggtgatcgccatgcttgggttcaggctggacgcagtgaaaagcaatgctgccgcctatctacaacacttatgttataggaatgacaaggtgaagacggatgtgcgaaagctaaaggggatccccgtgctggtcgggttattagaccatcccaagaaagaggtacacctgggtgcctgtggggcactgaaaaatatctcttttggacgcgaccaagataacaaaattgccattaagaattgcgatggagtgccagccctggtgaggctgctgagaaaggcgcgcgatatggacctgactgaagtaattaccggaaccctgtggaacttgagcagccacgatagcattaagatggaaattgttgatcacgcactccatgccttgactgacgaagtgatcatcccccattccggctgggaaagggaacctaatgaggactgtaagcccagacatatcgagtgggagtccgtcttaacgaacaccgctggctgtctgaggaatgtgagttctgaacgctccgaggcccgtaggaagctgcgggaatgtgacggcctggtggacgccctgatcttcatcgtgcaggccgagatcggccaaaaagattcggattccaagctggtagagaactgtgtttgtttgttgaggaatctgtcctatcaggtgcacagggaaattcctcaggctgaacgttatcaggaagccgcccctaacgtggcaaataataccgggccgcacgctgcttcctgtttcggcgcgaaaaagggcaagggaaagaagcccatcgaggatcctgccaacgacacagttgattttccaaagagaacctctcctgcccggggatacgagttactgttccagcctgaagtggtccgcatctatatcagcctcctgaaagagagtaaaacgcctgctatcctagaagccagcgcgggcgccatacagaatctctgcgcggggcgctggacatacggcaggtatattcgctcagctcttaggcaggagaaagcactgtccgctattgcagacctgttaaccaacgaacacgaaagggtggtcaaagcagccagcggtgccttacggaacctggcggtggacgctcgcaataaagaattaattggcaaacatgccatccctaacctcgttaagaatctccccgggggccagcagaattcaagttggaacttctctgaagataccgtgatcagtatactcaacacaattaacgaagttattgctgagaaccttgaggcggccaagaaactccgtgaaacacagggaattgagaaactagtgttgatcaacaagagcgggaaccgatcagaaaaggaagtgcgtgcagcggccctggttctgcagactatctggggatataaggaactgagaaaacctctcgagaaagaaggctggaagaagtcagattttcaggtgaacttaaataacgcaagtagatcccagagctctcactcttacgatgacagtactcttcctctgatcgataggaaccaaaaatccgacaataattactccacccctaatgagaggggggatcataaccggacactggacagaagtggggatctcggagacatggaaccgctgaaaggaaccacacctctgatgcaggatgaggggcaggaaagtctagaggaggagctggacgttttggttctcgacgatgagggtgggcaagtgtcctaccctagcatgcagaaaatctag

SEQ ID NO: 181867 - DNA, 2802 bp, Artificial Sequence
  Description of Artificial Sequence: Synthetic coding sequence
atggacgacagcgaggtggagagcaccgccagcatcctggccagcgtgaaggaacaggaggcacagttcgagaagctgaccagagcactggaagaagagagaagacatgttagcgcacagctcgagcgtgtgagagtcagtccccaggatgctaatccactgatggcaaacgggaccttgactcggaggcaccaaaatggacgattcgttggcgacgccgacctggagagacagaagttttccgacttaaaattaaacgggcctcaagatcactcccatctgctctactctactatcccccgaatgcaggaacctggccaaatcgtcgagacctacacagaggaggatcctgagggcgccatgtctgtagtgtcagtggagacatctgacgatggcacgactaggcgcaccgaaaccacagtgaagaaggtggtgaagactgttacaacccggacagtacaaccggtggcaatgggcccagatggactccctgtagacgcctcaagcgtctccaacaattatatccagactctggggagagatttcaggaaaaatggcaacggtggaccgggcccttacgtcggccaagccggcacagccacgctgccacggaacttccactaccccccagacggttactcaaggcactatgaggatggctatcctgggggtagcgacaactatgggagcctgtctcgcgtgacacgaatcgaagagaggtaccggccctccatggaggggtatcgcgcccccagccgacaggatgtctatggcccccaaccacaggtgagagtaggcggatcctctgttgatctgcacaggtttcaccccgagccatatggcctcgaagacgaccagcggtccatggggtatgacgatctggattatggcatgatgagcgattatgggacggcaaggcgcacgggtactccctcagatcctaggaggaggctgaggagctacgaggatatgatcggcgaagaggtcccctcagaccagtattactgggcccccctggcacagcatgagcgaggctcgctcgcgagtctcgacagtctgcgaaaagggggcccacccccacccaactggcgccagccagagcttccagaagtgatcgccatgctgggctttagactggatgccgtcaagagtaacgcagcagcctacctgcagcatctgtgttatcggaatgataaagtcaagacggacgttcggaaactgaaagggattccggtactcgtggggctgcttgatcaccctaagaaggaggtgcacctaggtgcatgcggggcgctgaagaatatatcctttggtcgggaccaggataataaaatcgctatcaaaaactgtgacggggttccggccctggtgaggctgctgagaaaggcgcgggacatggacctaacagaggtgattacaggcaccctgtggaacctttcaagccacgacagcatcaagatggagattgttgatcatgccctgcatgcactcacagacgaggtaatcatcccacatagcggatgggaacgtgaacctaatgaggactgcaaaccacgtcacattgagtgggagtcagttttgaccaatacagctggttgtctccggaatgtgtccagcgagaggtcagaggccagacgcaaactacgtgagtgtgatgggctcgtggatgcactgatcttcatcgtccaggccgaaattgggcagaaagattccgacagcaagctcgttgagaactgtgtgtgcctgttaagaaacttgagctaccaggtgcacagggaaatcccccaggctgagcgttatcaggaggccgcacccaatgttgctaacaataccggtccacacgcagccagctgtttcggggcaaaaaaaggaaagggtaagaagcccatcgaggacccggcaaatgatacagtggatttccccaaaagaacttctcccgcccgcgggtacgagctcttattccagccagaagttgtcaggatctatattagcttgcttaaggaatcgaagacccccgccattttggaagcctcggcaggggccatccaaaatctgtgcgcgggaaggtggacttatggccgatatatacgctccgcattgagacaggaaaaagccctgtcagctatagccgacctgcttactaacgaacacgaaagggtcgtgaaggccgcttcaggagctctccggaatctggccgtggacgccaggaataaagaactcattggtaaacacgccattccaaatctggtgaaaaatctgcctgggggtcagcaaaactcaagttggaacttctcggaggatactgtcatctctatacttaataccatcaatgaggtgattgccgagaacctagaagccgccaagaaactgcgagagactcagggaatcgagaagctggtgttaataaacaagagcggcaataggagcgagaaggaggtaagggctgccgctcttgtcctgcagacaatatgggggtataaagagctgcgaaagcctctcgagaaggaggggtggaagaagtctgactttcaagtcaacttaaataatgcgagtaggtctcaaagttcacatagttatgatgattctacgttaccattaatcgaccgcaaccagaagagtgacaagaagccggatcgagaagaaattcagatgtcaaacatggggtccaatacaaaatcactagacaacaattatagcacacctaacgaaagaggtgaccacaacaggaccttagatcggagcggggacctcggcgatatggaacctctgaagggaaccactcctttgatgcaaaagatctag

SEQ ID NO: 181868 - DNA, 2817 bp, Artificial Sequence
  Description of Artificial Sequence: Synthetic coding sequence
atggacgacagcgaggtggagagcaccgccagcatcctggccagcgttaaggaacaagaagcccagtttgaaaagctgacacgcgccttagaggaggaacgtcgtcacgtaagcgcgcaactcgaacgtgtcagggtgtctcctcaggatgcaaatccactcatggccaatggaactctaactcgccgccatcagaatgggagattcgtgggtgacgctgatttagaaagacagaaattttccgacttaaagctaaatggcccccaggatcatagccatctgctgtattcaacaatccctcgaatgcaggaacctggccagattgtcgagacatatacagaggaggaccctgaaggggcgatgtccgttgtgtctgtggagacatctgacgatgggaccactagacggacagaaaccaccgtgaaaaaagttgttaaaactgtgactacccggaccgtccagcctgtcgcaatgggccccgacggactccctgtagacgcttcttccgtttcaaacaattacatccaaaccctcggacgggacttccgaaagaatggcaacggaggtccagggccgtatgtgggtcaggcggggaccgctacattacctagaaactttcattatccgccggacggctactctcgtcattacgaagacggataccctggcggatcagataactatggttctctctcgcgggtgacaaggatagaagagagatatagacccagcatggaggggtatcgggctccatctcgccaggatgtttatggccctcagccccaggtgagggtgggtggttcaagcgttgacttacatcgcttccaccccgagccctatgggctggaagatgaccagcgctccatgggatacgacgacctggactacggcatgatgtcagattatggaacggccagacggacaggtacaccttctgaccctcggcgtaggctgagatcctacgaggatatgatcggggaagaggtcccctcggaccagtattactgggccccccttgcgcagcacgagagagggtcattggccagcctcgactctttgcggaagggaggcccgcctccccccaattggcgccagccagagctgccagaggttatcgcgatgcttggctttcggctggacgcagtcaagagcaatgctgcagcctacctgcaacacctgtgctacaggaacgataaagtgaaaaccgacgtgagaaaactgaaggggatcccagtgctcgttgggttgctcgaccaccccaaaaaggaggtacaccttggtgcctgcggggcccttaagaatatcagctttggacgagaccaggacaataagatcgctatcaagaactgtgacggggtgcccgctctcgtgaggctactcaggaaggctcgcgacatggatctaacagaggtgattactgggacgctgtggaatctgtcaagccacgattccatcaaaatggagattgtggaccatgccttgcatgccctgacggatgaagttattatccctcatagtgggtgggagagggagcctaacgaagattgtaagccaagacacattgaatgggagtcggtgctgacgaacaccgcgggctgtttgcggaatgtcagtagcgaacggtcggaagcccggcgaaagctccgtgagtgtgacggcctggtggacgctctgatcttcattgttcaagccgagattgggcaaaaagactcagattcaaaactggtggagaattgcgtctgcctgcttcgcaacttgagttatcaggtgcacagggaaatcccccaggctgagcggtatcaagaggctgcgcctaacgttgccaacaatacgggacctcatgccgcaagttgttttggagctaaaaaaggcaaggatgaatggttcagcagaggaaagaagcccattgaagaccccgccaatgacacagtggacttccccaagaggactagccccgcaaggggctatgaactgttattccagcccgaagttgtgcgaatttacatctccttactcaaggaaagtaagacacctgccatcctggaggcgtctgccggagctattcagaacctgtgcgcaggacgctggacatacggtagatacattcgctctgcgcttagacaggaaaaagccctttccgccattgcagacctcctgacaaacgagcatgaaagagtggtcaaagctgcctccggggcactgcggaatctcgctgtagatgctcgaaacaaggagctgattggaaagcacgcaatccctaatctggttaaaaacttgccaggagggcagcagaatagcagctggaatttctctgaagataccgttatctcgatactgaacaccattaatgaggtgatagctgagaatctggaggctgcaaaaaaactcagagagacccaaggtattgagaagttggtgctgatcaacaagtcggggaatcggtctgagaaggaggtcagagccgcagcccttgtgctgcagaccatctggggctataaagaactgcggaagcccctcgaaaaagaggggtggaaaaaatccgattttcaagtgaatctgaataatgctagccgctctcagtcgtctcacagttatgatgatagcacactgcccctcatagatcggaaccaaaaatctgataagaaacccgacagagaagagatccagatgtcaaacatgggctcaaacaccaagtctttggataacaactactctactcccaacgaacgcggagatcacaaccggacactggaccggagcggagatctcggcgacatggaacccttaaaggggacgacaccactaatgaagatctag

SEQ ID NO: 181869 - DNA, 2907 bp, Artificial Sequence
  Description of Artificial Sequence: Synthetic coding sequence
atggacgacagcgaggtggagagcaccgccagcatcctggccagcgtgaaggagcaggaagctcagtttgaaaagctcacccgcgctctggaggaggagaggcggcacgtgagcgcccagttggagcgcgtccgagtgtccccgcaggacgctaacccccttatggccaacggcacgctgacacgtaggcatcagaatggacgattcgtcggtgatgctgacctggaaagacagaagttttctgatctcaaactaaatgggcctcaagaccattcccacctgctctattctacaattcctaggatgcaggagccgggccaaatcgtcgagacatataccgaggaagacccagagggggctatgtctgtcgtctctgtggaaacgtccgacgacggtacaacccgcaggacagaaacaaccgtgaagaaggtggtaaagactgtgactacccgtaccgttcagccagtggcaatgggtcctgacggccttcccgtcgatgcctcgtccgttagtaacaattatattcagacgttgggacgggactttcgcaaaaacggcaatggcggccccggaccctatgtagggcaggcaggcacagccacgcttccgcgaaatttccattatccccccgacggatatagtcggcactatgaggatggatatccgggagggtcagacaactacggaagtctgtctcgggtaacaaggatcgaggaacggtatagaccctccatggaaggttacagagctccttcccgccaagacgtttatggcccccaaccgcaggttcgtgtcgggggctcttcagtggacctgcatcgttttcatcctgaaccctacggccttgaggacgatcagagatctatgggatacgatgatctggactacgggatgatgtccgactacggcaccgcccgccgcaccgggacgccctcagacccacggcgccggctccgatcttacgaagatatgattggtgaagaggttccaagtgaccagtattactgggccccactcgcccaacatgagcggggtagcctggcgagtctcgactctcttcgcaaaggaggaccccctcccccaaattggcgccaacccgaactgccagaagtgattgctatgctcggtttccggctggacgccgtgaagagtaacgcagcggcgtacctccagcatctgtgctacaggaatgacaaggtgaaaacagacgtgcgcaaactgaagggcatccccgtcttggtgggactcctggatcaccctaagaaagaggtgcatctcggtgcctgcggagcgcttaaaaacatttcctttggaagggatcaggacaataagatagctattaagaattgtgacggcgtgcccgccctggtacgcctgctaagaaaggcccgagacatggacctcacagaagtgataaccgggacattatggaacctttctagccacgacagcatcaagatggaaatcgtagaccacgcactgcatgctcttaccgatgaggtaattatcccccactccgggtgggaacgcgagcccaatgaggattgtaaaccccgtcacatcgaatgggagagcgtgcttacgaatacagcaggttgcctccgcaacgtttcaagcgagcggtctgaagcccgacgaaaattaagggagtgtgacggtctggtcgatgctctaatattcatcgtgcaggctgaaattgggcagaaggattcggattccaagctggtagagaattgtgtttgtcttctgaggaatctgagttatcaagtccatcgggaaattccccaggccgaacgataccaagaggccgctccaaatgtagcgaataataccggcccacacgccgcttcatgcttcggggctaaaaagggaaaggatgaatggttctctcggggcaagaagccaatcgaggacccagctaatgacacagtggactttccaaagaggacatcaccagctcgtgggtatgaacttctgttccaacctgaggttgtgcgaatttacataagcctgctgaaggagtcaaagactcccgccatcctggaagcctctgcgggggccattcagaacctttgcgccggacggtggacatatggtcgctatatccgttctgccctgcgccaggagaaggccctgagcgctattgcagacttgctaaccaacgagcatgaacgggtggtcaaggcagcatctggggcactgcgcaaccttgcagtggacgcgagaaacaaggaacttatcggtaaacacgcaattcccaatctagtgaagaacctcccaggggggcagcagaattcttcctggaatttctctgaggatactgtgatttccattctgaacaccatcaacgaagtgattgcagagaatttggaggcagccaagaaattaagagagacacaagggatagagaaattagtcctgattaataaatcgggcaataggtccgagaaagaagtgagggccgcagctctggtcctccagaccatctgggggtataaggagctgcgaaagccactcgaaaaagaaggatggaaaaagagcgattttcaggttaatcttaataatgcaagcaggtcgcagtcatcccatagctacgatgactccactctgcctttaatcgaccggaaccagaaaagcgacaagaagccagatagagaggagattcaaatgagtaatatgggaagcaatactaagagcctggataataactactctacacccaacgagaggggtgaccacaaccgtaccctcgacaggagcggcgatttgggggatatggagcctctaaagggaaccacgccgctcatgcaggacgaaggacaagagagtcttgaggaagaactggatgtgttggtgttggacgatgagggcgggcaggttagctatccctctatgcagaagatctag

SEQ ID NO: 181870 - DNA, 2604 bp, Artificial Sequence
  Description of Artificial Sequence: Synthetic coding sequence
atgcaggagcccggccagatcgtggagacctacaccgaggaggacccagagggggcaatgtcggtggtttctgttgagacgtcagacgatgggactacgcggagaactgaaaccactgtcaagaaggtcgtaaagaccgtcaccacccgaactgtgcagcctgtagcgatgggtccagacggcctgccggtcgacgccagttccgtctctaataattacatccagacactcggcagagatttcaggaaaaatgggaacggtggacctggaccatatgtggggcaggcgggaaccgccaccctgccaagaaatttccactatccacccgatgggtattctagacactatgaagatggatatccaggtggatccgataattacggctctctgtcaagagtgacgcgtatcgaggagcgttaccgtccctcaatggaaggctatagagcacctagtcgacaggacgtatatgggccacagccacaggttcgggttggaggatcctcagtggacctgcaccggttccacccggaaccatatgggctggaagacgatcaaaggagcatgggctacgatgatctagactacggaatgatgtccgactatggaacagcaagaagaacaggcactccctctgatccacgccggaggttgagatcatacgaggacatgattggggaggaggtgcccagtgaccagtattattgggccccactcgcacaacacgaacgagggtccttagcttccctcgattcactccggaaggggggccccccccctcctaattggcggcagccagaattgcccgaagtgattgccatgctagggtttcgcctggacgcagttaaatccaatgctgccgcctatctccaacatctctgctacagaaacgataaggtgaaaacagatgtgagaaagttaaagggaattcctgtgctggtgggtttgctggatcatccgaaaaaggaagtccacctgggtgcctgtggcgccctgaaaaatatctctttcggacgcgaccaggacaataagattgcaattaagaactgcgacggggtgccagctctggtgagactgctaaggaaggccagagatatggatctcaccgaggtgataaccggaacactgtggaatctgtcctcccacgacagtattaagatggagatagtcgatcacgcactgcacgcgcttactgacgaggtaataataccacacagcggatgggagcgcgagcccaatgaggattgcaaaccgagacatatagagtgggaaagcgtcctgacgaataccgcaggctgccttagaaatgtgagttccgagcggagcgaggcgcgccggaaattacgggagtgcgatgggctggtggatgccctaattttcatcgtgcaggccgagatcggacaaaaagacagtgacagtaagctagtcgagaactgcgtgtgtctgctgcggaacctgtcttaccaagtacaccgcgagatccctcaggcagagagataccaggaggcggcacctaacgtggctaataacactggcccccacgccgcctcttgctttggggctaagaaaggcaaggacgaatggttcagcagaggcaagaaacctattgaggacccggccaacgatacggttgattttccgaagcgaacgtcacctgctcgcggttatgagctgttattccagccagaagttgtgcggatctacatctctctcctcaaagagagcaaaacgccagctatcttagaggcaagcgcaggcgctatccaaaacctgtgcgcggggcggtggacgtacgggaggtatataaggagcgcgctgaggcaagagaaagctttgtctgcgatcgcagatttgttgacgaacgagcatgaaagggtagtgaaggctgcatcaggggcactgcgcaacttagctgtggacgctcgcaataaggaattgattggcaagcacgccataccaaatctggtcaagaacctgcctggaggccagcagaactctagctggaacttcagtgaagacacggtgatcagcatcctcaataccattaacgaggttatagccgagaatctcgaggctgccaaaaagctgagagaaactcaggggatcgagaaattggtgctcatcaacaaatctggtaatagaagtgagaaagaagtgcgcgccgccgccctggtcctacagactatatggggctacaaagagctgagaaagccactggaaaaagaaggctggaagaaatctgatttccaggtgaatctgaacaacgcctctcgaagccagtcaagtcacagctacgacgattctacactgccccttatcgatcgcaaccagaaaagtgataagaaaccagatagggaggaaatacagatgtccaacatgggatctaacaccaagagcctagataacaactacagtacccctaacgaaagaggggatcacaatagaaccctcgacaggagcggtgacctcggggacatggagccgttgaagggaacaacacccttgatgcaagacgagggacaggaatctctcgaggaggaactcgacgtactcgtgcttgatgacgaaggcggccaggtgtcatacccttcaatgcagaaaatctag

SEQ ID NO: 181871 - DNA, 2499 bp, Artificial Sequence
  Description of Artificial Sequence: Synthetic coding sequence
atgcaggagcccggccagatcgtggagacctacaccgaggaggacccggagggggctatgtctgtggtctctgttgagacaagtgatgatgggactacgcgaaggactgagacaacagtcaaaaaggtggtaaaaactgtgaccacacgaaccgtacaacccgttgcgatgggacccgatggactgcccgtagacgccagttcagtgtctaataactatatacagacactcggacgcgacttccgcaagaatgggaacggtggccctgggccctatgtaggacaggctggaactgccacactgcccagaaatttccactatcctccagacgggtactcaagacactacgaggacgggtaccctggagggtctgacaactacggcagcctcagccgggtgactaggattgaggaacgataccggccctccatggaggggtaccgtgccccctccaggcaggatgtctacggtccacagcctcaggtccgggtagggggctcttccgtggatcttcatcgctttcatcctgagccatacggtctcgaggatgaccagagatccatgggctacgatgacttggattatgggatgatgtctgattatggtaccgcccggcgcaccggcacaccgagtgaccccaggagaaggctccggtcctacgaggacatgatcggggaagaggtgccttccgaccaatactattgggcccctctggcccagcacgagagaggctccttggcgagcttagactctctccggaagggaggacccccaccccctaattggagacagcccgagttacctgaggtgatcgccatgctgggctttagactggacgccgtgaagtcaaacgcagccgcttatttgcagcacctgtgttatagaaacgataaagtaaagaccgatgtgcgaaagctgaaaggcattcctgtgctggtcgggctgctggaccacccaaagaaagaggtgcaccttggggcatgtggcgcactcaaaaatatatcatttgggcgagatcaggacaacaagatagccataaagaactgtgatggcgtaccggccttggttcggttgctcaggaaagcccgagacatggacctgaccgaagtgattacaggtacactttggaatctctcctcgcacgacagcattaagatggaaatcgtggatcacgcactgcatgctctcactgatgaggtgatcataccccattctggatgggaaagggagccaaatgaagactgtaagccgcgacatatcgagtgggagtctgtgctcactaacaccgcgggttgtctccgtaatgtcagcagtgaacgcagcgaagcccggcgcaaattacgggaatgtgatggactggtcgatgccctgatttttatagtgcaggcagaaatcggacagaaagattcagattccaagctggtggaaaattgcgtgtgcctccttagaaacctgagttatcaggttcacagagagatcccccaagcagaacggtatcaggaggccgccccgaacgtggcaaataacacaggaccccacgcagcttcgtgtttcggtgctaagaaaggtaaggggaaaaagccgatcgaggaccccgccaacgatacagtggatttcccaaaaaggacaagtcctgcaagaggttatgagctactcttccagccggaggtggtcagaatttacatatctcttttgaaggagtcaaagacacccgctattctcgaggcttctgctggagccattcaaaacctttgtgcaggccggtggacatacgggaggtatatccgatctgccttgaggcaggaaaaagctctttccgctattgcggacctccttaccaacgaacacgagcgcgtggtgaaagccgcatccggcgccctcaggaatcttgccgtggacgccagaaacaaagagctgatcggaaagcacgcgatacccaatctcgtgaagaaccttcccggaggtcaacagaattcaagttggaatttttccgaggatacagtgatcagcattttgaacacgatcaacgaagtcatcgctgaaaacctggaggccgcaaaaaaactgagagaaacacaagggatcgagaaactggtcctgataaacaaatccgggaatagatcagagaaggaagtacgagccgctgcacttgtcctccaaactatttggggctacaaagaactaagaaagcctctcgagaaagaaggttggaagaagtctgacttccaggtcaatcttaacaatgcatcgcgatctcagagcagtcacagttatgatgacagcactctgccgctgatcgataggaaccagaaatcagacaagaagcccgacagggaggagattcagatgtcaaatatgggctccaatacaaaaagtctggataataattattcaacccctaatgaaaggggggaccacaataggacccttgatagaagcggggatctaggcgacatggagccgttaaagggaacaacgcccctcatgcaaaaaatttag

SEQ ID NO: 181872 - DNA, 2802 bp, Artificial Sequence
  Description of Artificial Sequence: Synthetic coding sequence
atggacgacagcgaggtggagagcaccgccagcatcctggccagcgtcaaggagcaggaggcccaatttgagaagcttacccgcgccctggaggaagaacggcgccacgtgtccgctcagcttgaaagagtgagagtttcacctcaggacgctaatcccctgatggctaatgggacattgacaaggagacaccagaacgggcggttcgtcggagatgccgacttggagcgacaaaagttttcggacctgaaactgaacgggccacaagatcactctcatttgttgtacagcaccatcccgcggatgcaggagcctggccagattgtggagacttacacggaggaagatccggagggtgccatgtctgtggtctcagttgaaacttccgacgacgggaccacgagaagaaccgagacgacagtcaagaaagtggtcaagaccgttaccaccaggacagtccaacctgtggccatgggacccgatggcctgccagttgatgctagtagtgtgtccaataattacatacagactctggggagagacttcagaaagaacggtaatggggggcctggtccgtacgtaggccaggcaggcaccgcgactctgcccaggaattttcactaccccccagacggatactcccggcactatgaagatggataccccggtggctccgacaattacgggagtctgtctcgagtcaccaggattgaggagaggtacaggcctagcatggaggggtacagggctccgagtcgacaggacgtatacggtccacagccccaagtcagggttgggggttcatccgtggatttacaccgattccatcccgagccttacggcctggaagacgaccagcgatccatgggctacgatgatttggactatggaatgatgtccgattacggcaccgcccgaagaaccggaacgccaagcgacccacgacggagactgagatcctacgaggatatgattggcgaggaggtgccctctgatcagtattattgggctcccctggcccagcacgagaggggatcgctagcctcactcgactccctgcggaagggaggaccaccgcccccaaattggcgccagcctgagttgccggaagttatcgcaatgctggggttcagactggatgccgtcaagtcaaacgccgccgcttatttacagcatctgtgttacaggaacgataaagtgaaaactgacgtccgtaaattgaaaggaatcccggtacttgtaggccttctggaccaccccaaaaaagaggttcacctcggcgcttgcggcgccctgaaaaatatatcttttggaagagatcaagacaataagatagctattaagaactgcgacggcgtgccagccctcgtgcgtctgctgcggaaggcccgtgatatggacctcacagaagttattactggtaccctctggaacctgagctcccatgactccatcaagatggagattgtcgaccatgccctgcatgcacttactgacgaagtaattataccacactccggatgggaaagagaacctaacgaggattgcaagcctcggcacatcgagtgggagtccgtgttgacaaatacggctggatgtctgcgaaatgttagtagcgagcgttcagaggctagacggaagctccgagaatgtgatggcctcgtcgatgcactcatcttcattgtccaggcagagattggccagaaggattctgactccaagctcgtcgaaaactgtgtgtgtttactccggaatctttcgtaccaggtccatagggagattcctcaggccgagcggtaccaagaagcggccccaaacgtggcaaacaataccggtccccacgctgccagttgcttcggcgccaagaagggaaaggggaagaaacctatcgaggatccggccaacgatactgtggacttccctaagcggacctctcccgcccgtgggtatgagcttctgttccagcctgaagttgttcggatttacatctccctcctaaaggagtcaaaaacccccgctattttggaagcgagtgccggcgccatccaaaatttgtgtgcgggacgatggacttacgggaggtacatcaggtccgctctccggcaggaaaaagctttgagcgccattgctgatctcctcaccaacgaacatgagcgagtcgtcaaggctgcaagcggggccctcaggaacctggctgtggacgctagaaataaggagctgatcggaaaacacgctattcccaatctggtgaagaaccttccgggtggccaacagaacagcagttggaacttttcagaggatacagtcatctctatcctaaatactatcaacgaagtgatcgccgagaatctagaagcagccaagaagctgagagagacacaagggatcgaaaagctagtgctgatcaacaaatcaggaaacaggagtgagaaggaggtgagggctgccgcgctggtgttacagaccatttggggttataaggagttgaggaagcccctcgaaaaggaaggatggaaaaaatcagattttcaggttaatctcaataacgcctcacgttcccagagcagccattcctatgacgactccacacttcctcttatcgatcgaaaccagaagtcagacaagaagcccgacagggaggaaatacagatgagtaatatggggtctaatacaaagtctttggacaataattatagcactcctaacgaaagaggtgaccacaacaggaccctcgacagatccggggatctcggagatatggaacctctgaagggcacaaccccactgatgcagaaaatctag

SEQ ID NO: 181873 - DNA, 15 bp, Artificial Sequence
  Description of Artificial Sequence: Synthetic coding sequence
atggacgacagctag

SEQ ID NO: 181874 - DNA, 2802 bp, Artificial Sequence
  Description of Artificial Sequence: Synthetic coding sequence
atggacgacagcgaggtggagagcaccgccagcatcctggccagcgtaaaagagcaagaggcccagtttgagaagctgacgcgggcactcgaggaagaacgaaggcacgtgagcgcccagctcgagcgcgtcagggtgtccccgcaggacgctaatcccctcatggcgaacggaactctcactcgcagacaccagaatggacggtttgtgggggacgccgacctcgaacgccagaaattcagcgacctcaaactcaacggtccccaagaccattcccacctgctctacagcaccatcccgcgtatgcaggagcccggccagatcgttgaaacatataccgaggaagacccagagggggccatgtctgttgtgtccgtagagacttccgacgacgggacaactagaagaaccgaaaccactgtcaaaaaggtcgtgaaaaccgtgactactcgtaccgtgcagcccgtcgctatggggccagatggccttccggtggatgcgtcctccgtttctaacaactatatacagaccctcgggcgcgacttccgaaagaacggtaatgggggaccagggccctacgtgggccaagccggcaccgccacattgccaaggaatttccactatcccccggatgggtattcccgacactatgaggacggctacccaggcggaagcgataattacggttctttgagcagggtgaccagaatcgaagaaagataccgcccatccatggaggggtaccgagcgccaagtcgacaggatgtctatggtccacagcctcaggtcagagtcggaggatcaagcgtggacctgcacaggttccatcctgaaccctacgggcttgaggacgaccaaagaagcatgggctatgacgacctggattacggaatgatgagcgattatgggaccgcccgccgcaccggaactccctcagatccaaggagaagactccggtcatatgaggatatgattggcgaagaggtgcctagcgatcagtactactgggccccattggctcagcatgaaaggggttccctggcttcacttgacagcttacgaaaaggtggccctcctccgcctaactggcgccagccagaattacctgaggtcatcgcaatgttgggttttcgactggatgcggttaagagcaacgcagcagcctaccttcaacacctctgctataggaacgacaaagtgaaaacagacgtgcggaaactcaagggtatccccgtgctggtagggctcctggaccatccaaagaaggaagttcatttgggcgcttgtggagcactaaagaacatcagctttggaagagatcaagataacaaaattgcaattaagaattgtgacggtgtccccgctctggttcgcctgctacgtaaagcaagggacatggatctgacagaggtgattaccgggacactgtggaacttatccagtcacgacagcattaagatggaaatcgtcgatcatgctctgcatgccctgacagatgaggtgataattcctcattctggttgggaacgggagccaaatgaggattgcaagccaagacacatcgaatgggaatcagtgcttaccaatactgccggttgcttgcggaacgtctccagtgaaaggagtgaggctcggcggaagctgcgcgagtgcgatggccttgttgatgctctgatttttatcgtgcaggcagaaattgggcagaaagactcagattcaaagctcgtcgagaattgtgtttgcctgctgcggaacctgagttaccaggtgcatcgggagatcccacaggcagaacggtatcaggaagcggcccccaatgtcgccaataacacgggcccacacgcagcctcctgcttcggtgccaagaaaggaaaggggaaaaaacccattgaggatcctgccaatgatacagttgatttccccaaaaggacctcccccgcaaggggttacgaactcctgttccagccagaagtggtcagaatctatatttccctcctgaaggagtccaagacccccgccatcctggaggccagtgcaggagcgatccaaaatttgtgcgcaggtcgttggacgtatgggcgttacatccgcagcgccctcagacaagagaaggctctgagtgctatcgcagatcttttaaccaatgagcatgagcgagtagtaaaggccgcttctggtgctctgcgtaacctagcagtggacgcccgaaacaaagagctgataggtaaacatgctatccctaatttagtaaagaatctgcccgggggccaacagaattcatcctggaacttttcagaagatacagttattagtattttgaataccatcaacgaagtgatcgccgaaaacctcgaggctgcaaagaaactaagggaaactcagggaatcgagaaattggtgctgattaacaagtccggaaacagaagtgagaaagaagtcagagcagctgccctcgtgctgcagaccatctggggctacaaagaactgagaaagccacttgagaaagagggatggaaaaagtccgacttccaggtgaatttgaacaacgcatcccggagccagtcctcacatagttatgatgatagcaccctacctctaatcgaccgcaaccagaaatctgataaaaaacccgaccgtgaagaaatccagatgtccaacatgggatccaatactaaaagcctcgataataattattcgactccaaatgagagaggggatcacaaccgtactctggatcgttctggcgacctgggagatatggaacccttgaaggggacaacacccctgatgcagaaaatttag

SEQ ID NO: 181875 - DNA, 1851 bp, Artificial Sequence
  Description of Artificial Sequence: Synthetic coding sequence
atgatcggcgaggaggtgcccagcgaccagtactactgggcccccttggcccagcacgagagaggaagtctggctagcctggattcgttgcggaaaggagggcctcctcctcctaattggcgacaaccagaactaccagaagtaatagcaatgctcggcttcaggcttgatgctgtgaaatccaatgccgctgcttatttgcaacatctgtgctacaggaacgacaaggtaaagaccgacgtgcggaaactcaaagggattcctgtcctggtaggactacttgatcacccgaaaaaggaggttcacttgggcgcctgtggagcactcaaaaatataagcttcggacgggaccaggataataaaatcgcgattaaaaattgtgacggcgtaccagctctggtcagattgcttcggaaagcccgagacatggatctaactgaggttatcactgggacattgtggaatctgtctagtcatgacagcataaagatggaaatcgtggatcacgccctacacgctcttactgatgaagtaattatccctcattccggctgggagagggagcctaacgaggactgtaagcctaggcatatcgaatgggaaagcgtattgaccaacactgctggttgtctaagaaatgtttcttctgagagaagcgaagctcgccgtaagctgcgagagtgtgatggcctcgtagatgcccttatattcatcgtccaggccgaaattgggcaaaaggattctgattctaaactcgtcgaaaattgcgtatgtcttctgcgcaacctctcttaccaggtgcatcgtgaaattccccaggccgaaaggtatcaagaggcagcacctaacgtggctaataacactggtcctcacgcggcttcctgcttcggggcaaagaaggggaaggatgaatggttttcacgaggcaagaagcctattgaggacccagccaacgataccgtggactttccaaagaggacatcacctgctcgggggtacgagttgttgttccagccagaagtcgtcaggatatacattagtctcttgaaggagagtaagactcctgccattctggaagcctccgccggtgccatccaaaatctctgcgccggtcggtggacatatggccgatatatcagaagcgctctgcgtcaggagaaagcactcagcgcaatagcagatctcctgacgaatgaacatgaacgcgtggttaaagccgcttcaggtgccttgagaaacttagccgtggatgccagaaacaaagaactaatcggtaaacacgctatacccaacctggtgaagaacctgcccgggggccagcagaactcttcctggaacttctcagaggataccgtgatctcaattttaaatacaatcaatgaggtgatcgcagaaaacttagaggccgccaaaaaactccgcgagacgcagggtatcgaaaagcttgtcctgatcaacaagtctggaaatcggtcagaaaaggaagtccgcgcagccgcattagtgttgcagaccatttggggttacaaggaactccgaaaaccactggagaaagagggctggaaaaagtccgatttccaggtgaacctcaacaatgccagtcgatcccaaagtagccattcttacgatgactccacgctgccactcatcgacaggaaccagaagtctgacaagaagcccgaccgcgaggagatacaaatgtctaatatgggctccaacaccaagagtctggacaacaactattcaacccctaacgagcgtggagaccataaccgaaccctcgacaggtcaggtgacctgggagacatggaacctctgaagggtaccacgcctcttatgcagaaaatttag

SEQ ID NO: 181876 - DNA, 2727 bp, Artificial Sequence
  Description of Artificial Sequence: Synthetic coding sequence
atggccaacggcaccctgacccggcggcaccagaacggccggttcgtgggggacgctgatctcgagcggcagaaattctctgatctgaaacttaacggccctcaggatcacagccacttgctgtacagcactattccccggatgcaggaaccgggccagatcgtggagacttacacagaggaggaccccgagggagccatgtccgttgtttcagtcgaaactagtgatgatggaactaccagaagaacagagaccacagtgaagaaggtggtcaagacagtaaccacacggaccgtgcagccagtggctatggggcctgacgggctgccagtcgacgcgtcatctgtatccaataactacatccaaaccctgggcagagactttcggaaaaatggaaacggcggcccaggaccttatgtcgggcaggcgggcaccgctacactgccaagaaacttccattatccccccgatggctactccagacactacgaggacggatatccaggaggatcagacaattacgggagcctctctagagtgacccgcatcgaggagagatacaggccaagcatggaggggtaccgtgctccaagtcgccaggacgtatacggaccgcagccccaggtgcgagtgggtggatcgtcggtagatctgcatcgctttcaccccgagccttatggccttgaagacgaccagcgctctatggggtatgatgatttggactatggaatgatgtcggattacggtaccgcgagacgcacaggcaccccaagtgatccacgaaggcggttacgctcatatgaagacatgattggcgaggaggttccgtctgaccagtattactgggccccgctggcacagcacgaacggggcagtctcgcttccctggactctctgcgcaaggggggccccccccctccaaattggaggcagcctgagcttcccgaagtcattgcaatgttgggctttcgcctggatgctgtaaaaagcaatgcggcagcatacttgcagcacttgtgctaccgcaatgataaagtgaaaacggacgttcgtaagctcaagggcattccagtgctggtgggacttctcgatcaccctaaaaaggaggtccacctcggggcctgcggcgccttaaagaatatttcctttggtcgtgaccaggataacaagatcgccatcaaaaattgtgatggcgtacccgctcttgttcggctacttcggaaagcgagagatatggacctgacagaagtgataacaggtacactgtggaatctctcatctcacgattcaatcaagatggagattgtggatcatgccctccacgccttgactgacgaagtgatcattcctcatagcggctgggagagggaaccaaacgaggattgtaaaccccgccatatcgaatgggagagcgtgttgaccaacactgcaggttgcctgcgcaacgtctcctctgaacggtcagaagcccggagaaaactccgagagtgtgatggattagtggacgctttaatatttatcgttcaggccgaaatcggtcagaaagactcagattccaaactagtggaaaattgcgtgtgtctgctgaggaatttaagttatcaggtgcacagggaaattccacaggcggagcgatatcaggaggctgctcctaatgtcgccaataacactggcccccacgcagcaagctgttttggcgccaagaaggggaaaggtaagaagccaatcgaggatcccgcaaatgacaccgtcgactttccaaaacgcaccagcccagcaagaggctatgagctattgttccaacccgaagtggtacgtatttatattagtctcctgaaggagtctaaaactcctgctattctggaagcaagtgctggggcgatacagaatctgtgcgcaggacgatggacctacggccggtacattcggtctgccctgagacaggagaaagccctgagcgccattgcagacctgttaactaatgaacatgagcgcgtggttaaggctgcaagcggagcccttaggaatttggcagttgatgcacggaacaaagagctcattggaaagcacgcgatacctaatctggttaagaatctgcccggcggtcagcagaacagttcttggaatttttccgaggacaccgtaatctctatcctgaacactataaatgaggtgattgccgaaaaccttgaggctgctaaaaagctgagagagacacagggcattgaaaagctagtgctcattaataaatcgggaaatagatcagaaaaggaagtgcgggctgcagctctcgttctacagaccatttgggggtataaggaactgcggaagcctctcgagaaggagggatggaagaaatccgactttcaggtgaatctcaacaacgcatcaagaagccagtcttctcactcctacgatgactcgaccctgccacttattgatcggaatcagaaatccgacaaaaaacccgacagagaggagatccaaatgtctaacatgggctccaacactaagtcactggataacaattactcgacccctaacgagagaggggaccacaatcgaactctcgaccgttcaggagatctgggggacatggagcctctgaaggggacaacgccattgatgcaggatgaaggacaagagagcctggaagaggaactcgacgtccttgtgctggatgatgaagggggtcaggtgtcctaccccagtatgcagaagatatag

SEQ ID NO: 181877 - DNA, 1833 bp, Artificial Sequence
  Description of Artificial Sequence: Synthetic coding sequence
atgatcggcgaggaggtgcccagcgaccagtactactgggccccccttgcccagcatgaacgagggtcactggcatcactggattctctgagaaagggaggacctcctccccctaactggcggcaaccagaattgcctgaagtgatcgccatgctcggctttagactcgacgcggtgaaatccaatgctgccgcatatcttcagcatctatgttacagaaacgataaggttaagacagacgtgcggaagctgaagggcatccctgtcctcgtcgggttgctggaccaccccaaaaaggaggtgcatctcggagcctgcggtgctctcaagaacatctctttcggccgcgaccaggataataaaatcgcgattaagaactgcgacggagtccctgccttagttcggctcctgcgcaaagcccgcgacatggacttaacggaggttattactgggaccctctggaatctttcgtctcatgacagtattaagatggaaatcgtggatcacgccctgcatgcccttactgatgaagttattataccccatagcggctgggaacgagagcctaatgaggattgtaaacctagacacattgaatgggaatcagtgctgaccaatactgcagggtgccttcgtaacgtgtcctccgagaggtctgaagcccgaagaaagttacgcgaatgcgacggcctcgtggatgcactcatcttcattgtgcaggctgagattggacaaaaagacagcgactccaagctggtggagaactgcgtgtgcctattgagaaatctttcctatcaggtccatagggaaattccccaagccgaacgctaccaggaagccgcccctaacgtcgccaataataccgggcctcatgctgcaagctgctttggcgctaagaagggcaaaggtaaaaagccgatcgaggaccccgctaacgataccgtcgactttccaaaacgcacatccccagcccgcggctatgagctcctcttccaacccgaggtcgtaagaatctatatctctttgctcaaggaatctaaaactcccgctattctggaagccagtgccggagccatccagaatctgtgcgcagggcgctggacgtatggacgttacattaggagcgctctgagacaggaaaaggctctcagtgcaatcgcagacctgctgacaaatgaacacgagagggtagtaaaggcagcttccggggccttacgaaatctcgctgtcgacgccagaaataaggagctcatcggaaaacatgctataccaaatctcgtgaagaacttacccgggggccagcaaaacagcagctggaacttctcagaggacacagtaatatctattttgaacacaataaacgaggtgattgccgagaatctggaggccgcgaaaaaactgcgggagacgcagggtatcgagaaactggtcttaattaacaagagcggtaataggtctgagaaggaggtccgggccgcggccctggtcttacagactatctgggggtataaagaattgagaaagcctctggaaaaggagggatggaagaagtccgactttcaggttaatctcaacaatgcatcacgttcccaaagttcacactcttacgacgactccactttacctctgatagacaggaatcagaagtccgataagaagccagatcgcgaagagatccagatgagcaatatgggatcgaatacaaagagtctagataataactactctacgcccaacgagaggggcgatcacaaccgcaccttggaccggtcaggggacctgggggacatggagcccttaaaaggtaccacacccctcatgcaaaagatctag

SEQ ID NO: 181878 - DNA, 1938 bp, Artificial Sequence
  Description of Artificial Sequence: Synthetic coding sequence
atgatcggcgaggaggtgcccagcgaccagtactactgggcccccttagcgcagcatgagagaggttcactggcatccttagattcactgaggaaaggaggtccccccccccctaattggagacagccagagcttcccgaggtgatcgctatgcttggctttaggttggatgcagtgaagtccaacgctgctgcctatcttcagcacctctgctataggaatgataaggtgaaaaccgacgttaggaaactgaagggaatcccagtcctggtcgggctgctggaccatcccaagaaagaggtgcacttaggcgcttgtggggcactcaagaacatctccttcggcagggaccaggacaataagatagccatcaaaaactgcgacggggtgccagccctcgttcgattactccgtaaggcccgagacatggacctcacagaagtgatcacaggcaccttatggaacctgtcttctcacgactcaatcaaaatggagatcgtggaccatgccctgcatgccctcacagacgaggtaatcatacctcacagtgggtgggagagagagcctaacgaggactgtaagcccaggcatatcgaatgggagtccgtacttacaaataccgccgggtgcttgagaaatgtgtcaagcgaacggtcagaagccaggcgaaaactccgagagtgtgatggcctagtcgatgccctgatttttatagtgcaggccgaaatcgggcagaaggattcggatagcaagctggtggaaaactgcgtgtgcctgttgcgtaacctgtcatatcaagtacatcgtgaaattccacaagccgagcgttatcaagaagcagcacccaatgtggcaaataacactggcccccacgctgcctcttgtttcggtgccaagaaagggaaggatgagtggttcagtcggggaaagaaacctattgaagacccagccaacgacacagtagactttcccaaacggaccagtcctgcacggggatacgaacttctctttcagcccgaagtcgttagaatctacatctccttgttgaaagaaagcaaaacacctgcaattctggaagcgtcagcaggggccatacaaaatctgtgtgccggcaggtggacatatgggaggtacattaggtcagccctcaggcaggaaaaggcactgtccgccatcgccgatctgctcacaaatgagcatgaaagagtcgtgaaggctgctagcggtgcactccgcaacctggctgttgatgctaggaataaggagctgattgggaagcacgcaatcccaaatctggtgaagaatctgcctggcggacagcagaactctagttggaactttagcgaggacaccgtgatttctatactcaacactattaatgaggtgattgccgagaatcttgaggccgctaagaagctgcgggagacccagggcatcgagaagttggttctgattaataagagtggaaatcgaagtgaaaaggaagttcgtgccgctgctctggtcctacagacaatatggggatacaaggagctgagaaagccattggaaaaggagggctggaagaaatctgattttcaggttaatctgaacaacgctagccggagccagagttcacacagctatgatgattccaccttgccactgatcgatagaaatcagaaatcagacaaaaagcctgatcgcgaagagatccaaatgtcaaacatgggatctaacactaaaagcctagataacaactactcaacacccaatgagaggggcgaccacaaccgcaccctcgaccgatccggagacttaggagacatggagccactgaaggggactacaccactaatgcaggacgaaggacaggagagcctagaggaggaactggacgtgctagttctcgatgacgaaggcggccaagtttcctacccatcgatgcagaagatatag

SEQ ID NO: 181879 - DNA, 2517 bp, Artificial Sequence
  Description of Artificial Sequence: Synthetic coding sequence
atgcaggagcccggccagatcgtggagacctacaccgaggaggaccctgaaggggctatgtcagtcgtatcggtggaaacctcagatgacggaacgaccaggaggacggagacaaccgtgaagaaagtagtgaagactgtcaccacacgcactgtgcagccggtcgctatggggcctgatggcctcccagtggatgccagtagtgtatcaaacaactatattcagacgctgggccgggacttcaggaagaacggcaacggtggacctggaccctatgtgggtcaggctgggacagccacattacccagaaatttccattaccctccagacgggtacagccgacattatgaagacgggtacccaggtgggtccgacaattacggaagcctctcacgcgtcacccgcatagaggaacgctatagaccttctatggagggctatagagctccgtctcgtcaggatgtctatggtccacagccacaagtgagggtaggtgggtcatccgtcgatctacatagattccatcctgagccttacggattggaggacgaccagaggtctatgggctatgatgacctcgactacggtatgatgtccgactacggtaccgccaggagaaccgggacaccgtctgatccaagacggcgtctgaggtcttatgaggacatgatcggcgaggaggtgccatcagatcagtattattgggcacctctggcccagcacgaaaggggtagtttggcttccttggactcactgcgaaagggaggccccccccctcctaattggcgacaaccagagctgcctgaggtgatagcaatgctggggttcagattagacgctgttaagtccaatgccgcggcttacctgcagcatctgtgttatcgcaacgataaagtgaagaccgacgtccgcaagttgaaggggatccccgtgctggtgggtctcctcgatcaccctaaaaaggaagtgcacctgggggcttgtggcgcacttaaaaatatctcctttgggcgggaccaggacaataagatcgcaattaagaactgcgatggagttcccgctcttgtgcgcctcttacgaaaggctcgagacatggaccttactgaagtgatcaccggaactctctggaacctgtcttcccatgactccatcaagatggaaatagtcgaccacgccctccatgcacttacagacgaggtaattataccacatagcggttgggaacgcgaaccaaatgaagactgcaaacctaggcatattgaatgggaaagcgttcttactaatactgcaggttgtctgcgtaatgtttcaagcgagaggagtgaggcaaggcggaagctgagggagtgcgatggattggtcgacgcccttattttcatcgtacaggctgaaatcggccagaaggattcagactccaaactagtcgagaactgtgtgtgccttctcaggaacctcagttatcaggtccacagagagattccacaggcggagcggtatcaggaagctgcacccaatgtcgccaacaataccggtccgcatgccgcctcatgcttcggagccaagaagggcaaagacgaatggttctcccggggcaagaagccgatcgaagaccctgctaatgacactgttgactttcccaaaaggacttcccccgctcgaggatatgagctgctgttccagcccgaggttgtgcggatatacatcagtctgctgaaagaaagcaaaaccccagccattctggaggcctctgcaggcgccattcaaaacctctgcgcgggccgttggacctacggtcgctatattagaagcgccctgagacaggaaaaggccctgagcgctatcgccgatctgctcaccaacgagcacgagagggtcgttaaggcagcttctggtgcccttagaaacctggccgtggatgcccggaataaggaattgatagggaaacatgctatccctaatttggtgaagaatctgcctgggggccaacaaaatagcagctggaacttcagcgaagatactgtgatctcgattctcaatactattaacgaggtcattgctgaaaacctcgaggctgccaagaagctgcgggagacacaagggatagagaaacttgttctcatcaacaagagcggcaatcgtagtgagaaggaagttcgagccgccgctctggttctgcagacaatctggggttacaaagagctccggaaaccactcgagaaagagggttggaaaaaaagcgactttcaagttaacctcaacaacgctagccgctcgcaatcatctcacagttatgatgactcaactcttcccttgatcgatcgcaaccagaagtccgataaaaagcccgaccgcgaggaaatacagatgtcaaacatgggttctaacactaagtccttggacaacaactatagtacaccaaacgagcgcggtgatcataatcgcacactggatcggtctggcgacctgggcgatatggagccactgaaaggtactactcctcttatgcagaaaatctag

SEQ ID NO: 181880 - DNA, 2640 bp, Artificial Sequence
  Description of Artificial Sequence: Synthetic coding sequence
atggccaacggcaccctgacccggcggcaccagaacggccggttcgtcggcgacgcggacctcgagcgccagaaatttagtgacctaaagttgaatggccctcaagaccatagtcatctgctttattcaacaattccaaggatgcaggagccaggccagattgtagagacatacactgaggaggacccagagggcgccatgtccgtcgtcagcgtggagacctcagatgatggcacaactcgccggaccgaaactacagttaagaaggtggtcaaaacagtgactacccgaaccgtccagcctgttgcaatgggacctgatgggctgcccgtggatgcttcgtccgtcagcaacaattacattcaaaccttggggcgcgactttagaaagaacggaaacgggggacccggtccctacgtgggtcaggcagggacagcaactcttccgcggaattttcattacccccccgacggttacagcagacactacgaggacggataccctggcggctccgataattacggctcattatccagggtgaccagaattgaggagcggtatcgccctagtatggagggataccgggccccatctcgtcaggacgtctacggcccccagccacaggttcgcgtcgggggctcctctgtcgatctccaccgcttccatcccgagccttatggactggaggatgaccagcggtcaatgggctacgacgacttggactacggcatgatgtccgattacggcacagctcggcgcaccggcacaccatcagaccctcggcggcggttacggtcttatgaagatatgataggtgaggaagtgccgagcgaccagtactattgggcacctcttgctcagcatgaacggggctctttggcaagtctggactcactgaggaagggaggccctccccctcccaattggcgccagcccgagcttcccgaagtgatagccatgttgggatttaggttggatgcagtgaagagtaatgctgccgcatatctccaacacctctgttataggaatgataaagttaaaactgacgtgagaaaattgaaagggattcctgtgttagtcggactgctggaccacccaaagaaagaggtccacttgggcgcctgtggcgcacttaagaatatctcttttgggagggatcaggacaacaagattgccatcaaaaactgtgatggcgtgcccgccttggtgcgcctgctccggaaggcgcgagacatggatctgacagaggtgattactgggacgctctggaacctaagctcgcatgatagcataaagatggagatagtggaccatgccctccacgccctaactgacgaggttatcattcctcatagcgggtgggaaagggaacccaacgaagactgtaagccaaggcatatcgagtgggaaagcgtgttgacaaatactgctggttgtttgcggaatgtgagctcagagcggtctgaggccaggcgcaaactgagagaatgtgacgggctcgtggacgcactcatatttatagtccaggccgagatcggtcagaaggactccgacagcaaattagtggagaattgcgtgtgtctactccgcaacttgtcttaccaggtgcatcgggagatccctcaagctgagaggtatcaggaggcagctcctaatgtggccaacaatactggcccacatgcagcctcatgctttggggcgaaaaaggggaagggcaaaaagccaattgaggatcctgccaatgacaccgtggactttccaaaacgcacctcccccgcacgaggatacgagctgctgtttcagccagaggttgtgcggatatatatcagtttgttaaaggaaagcaaaacaccagccatactggaggcgagcgcgggggcgatccaaaacctctgtgcaggtaggtggacctatggaagatatattaggagtgctctgaggcaagagaaggctttgagcgccatagctgacctgctcactaacgagcacgagagggtggtgaaggcagccagtggtgccctcaggaacctcgccgtggacgcacggaataaggaattaatcggcaaacatgctatccctaatttggtgaaaaaccttcctgggggtcaacagaacagttcctggaacttttccgaagacacggtgatttctattctcaataccattaatgaggtcatcgcagaaaacctggaggccgccaaaaagttaagggagacccagggtattgaaaagctggtactgatcaacaagtccgggaacagatctgagaaagaagtgcgcgccgcagctctcgtactgcaaaccatttgggggtataaagagctgcggaagcccctggagaaagagggctggaagaagtcagactttcaagtaaacctgaacaacgcaagccgatcacaaagttcccattcttacgacgatagcacgctgcctctgatagacaggaaccagaagtctgacaagaagcccgacagagaagaaatccagatgtcaaacatggggagcaatacgaagtcactcgacaataactactccaccccaaacgaacggggcgaccacaatcgcacacttgatagaagtggggacctaggtgacatggaacccctcaaaggaacgaccccccttatgcaaaagatatag

SEQ ID NO: 181881 - DNA, 2640 bp, Artificial Sequence
  Description of Artificial Sequence: Synthetic coding sequence
atggccaacggcaccctgacccggcggcaccagaacggccggttcgtaggcgacgctgacctggagaggcagaaattttctgacctgaagctgaacggccctcaggaccattcccatttgctgtacagcactattccacgcatgcaagagcctggacagatcgtggagacatatacagaagaggatcccgagggagctatgagtgtagtctccgttgaaacttcagacgacggcacgactagaagaaccgagaccacggtcaagaaagtggtgaaaacggtgactacccgcaccgttcagcctgtggctatgggaccagacggcctgccagtggatgctagcagtgttagcaataattacatccagactctgggtcgggactttaggaaaaacggaaacgggggacccggcccttacgtcggccaagccgggacagccactctgcctaggaatttccactacccccctgatggctatagccggcattacgaggacggctaccccggggggagcgacaattatgggtccctgtcccgggtaaccaggatcgaggagagatacagaccctccatggaagggtatagggccccttcccggcaggacgtgtacgggcctcagccacaagtgagggtgggagggagctcggtggatctgcatcgttttcacccggagccctacgggttggaagatgaccagcgctcaatgggatatgatgacttggactatggtatgatgagcgactacgggaccgctcggcggactgggaccccatcggacccccgacgcagacttcgtagctacgaggatatgatcggcgaggaggttcctagcgatcagtattattgggccccacttgcacagcacgagcgcggtagcctggcatccctggactccttacgcaagggcggaccgcctccccctaactggcggcagcccgagttgccagaagtcatcgctatgctggggttccgccttgatgccgtgaagtcaaatgctgctgcctatctgcagcacctatgttatcggaatgataaggttaagacagacgtcaggaaactaaagggcattcccgtcttagtaggactccttgatcatcctaagaaggaggtccatcttggcgcatgcggggctttaaagaatatttccttcggccgggatcaggataataagattgccatcaagaattgcgacggcgtgcccgccctcgttcgcctgctgaggaaggcccgcgacatggatctgaccgaagtgattaccggcacgctgtggaatttgtcgtcgcatgattctatcaaaatggaaattgtcgaccacgctctgcatgcactgaccgacgaggtgataatcccacatagcgggtgggagcgggagcccaatgaggactgtaagccccggcatatcgaatgggagtccgtgttgacaaacaccgccgggtgtttgaggaatgtgtcgagtgaaaggtccgaggcaaggcggaaattaagagaatgcgacggactagttgacgctctgatatttatcgtgcaagcggaaattggacagaaagactcagacagcaagttggtggaaaactgcgtttgtcttctgagaaatctcagctaccaggttcaccgagagattcctcaagctgaacggtatcaggaggctgcgccaaatgtggccaataacaccgggccgcatgcagccagctgcttcggagccaaaaaaggaaaaggcaagaagcccatcgaagatcccgctaatgataccgtagattttccgaaaagaacctcaccagctagaggctacgaactgcttttccagcctgaagtcgtgaggatttatataagtcttctgaaagaatctaaaacccctgcgattttagaggcgtccgccggcgccattcaaaatctgtgcgccggaaggtggacatacggccggtacataagaagcgcccttaggcaggaaaaagcattaagcgccatcgctgacctgttgactaatgagcatgaacgtgtcgttaaagcagcttctggggcactgcggaatctggctgtcgacgcacgaaacaaggaattgatcggcaagcatgctattccaaacctggtgaagaatttgccaggcggccaacaaaattcatcttggaacttttccgaggacaccgtcatttcaatactcaacaccattaacgaggtaattgcagagaacctggaagcagctaagaaattacgagaaactcaggggattgagaaactggtcctcattaataaatcgggtaaccggtccgagaaggaagttcgagcagcggcactcgttctgcagaccatttgggggtacaaggagctgagaaaaccccttgaaaaggaagggtggaaaaaaagcgactttcaagtcaatctgaacaatgcaagccgctcacagagctcgcattcctatgacgatagtactttgcctctgatcgatagaaatcagaaatccgataagaaacccgaccgggaggagattcaaatgtctaatatgggcagcaacactaaaagcctggataataactacagtacccctaacgagcggggtgaccataaccgaacattggataggagcggcgacttgggagacatggaacctctgaaaggcaccacacccttgatgcagaaaatctag

SEQ ID NO: 181882 - DNA, 2499 bp, Artificial Sequence
  Description of Artificial Sequence: Synthetic coding sequence
atgcaggagcccggccagatcgtggagacctacaccgaggaggaccctgaaggcgcaatgtcagtggtctctgtggaaacaagtgacgatggtacaactagaaggacagagacaactgtcaaaaaagtagtaaaaaccgtgactacccggaccgtgcagcccgtcgccatgggacctgatgggctacccgtcgatgcatccagcgtatccaacaattatattcagacgctgggacgggattttagaaaaaatggtaacggcggtccaggaccctatgtagggcaggcgggtaccgccacccttccgaggaattttcactaccccccggacgggtatagccgtcattacgaggacggataccccggcggcagcgataattacggttcactgtcccgcgtgacccggattgaggaaaggtaccgccctagcatggagggctaccgtgcaccttcgcgtcaagatgtctatggcccccaaccccaggtccgcgtcggaggttcatctgtggacctgcatagattccaccccgaaccgtacggacttgaagatgatcagcgctccatgggctacgacgacctggactatgggatgatgtctgactacggtactgcccgacgcacaggcaccccatcagacccaaggcggcgtctgaggtcatacgaggacatgattggggaggaggtcccatctgaccagtattactgggcacctctggcccagcacgaacgtggctctctcgcgtccctggactcgctgcggaagggcgggccacccccgcccaactggaggcagccagaactccccgaagtgattgccatgctggggttccgactggacgccgtgaagtctaatgccgccgcatatttgcaacacctctgctaccgcaatgacaaggtgaagaccgacgtccgtaaattaaagggaataccggttctggtcggcttactcgatcacccgaaaaaggaggtgcatttaggggcatgtggagctctcaagaacatcagcttcggacgtgaccaagataacaagatcgccatcaaaaattgtgacggtgtgccagccttagtcagacttctcaggaaggcaagggacatggacttaaccgaggtcatcaccggcactctttggaacctatcttctcacgatagcattaaaatggagatcgttgatcatgctctgcacgccctgaccgacgaagtcattattccccatagcggctgggagcgggaacccaatgaagactgcaagccccgccacatcgaatgggagtccgtgctgacaaatacggccggatgtctgagaaacgtttcttccgaacgaagtgaggcccgacggaagctcagagagtgtgatgggctcgtggacgcattaattttcatagtgcaggccgaaatcggccagaaggacagcgattctaaacttgtggaaaattgcgtgtgcctgctgagaaatcttagctaccaggtgcatcgggagattccgcaggccgagagatatcaggaagcagcccctaacgtcgccaataataccggcccccacgccgcaagttgtttcggagctaagaagggaaagggtaagaaacccatcgaagacccggctaatgatacagtggacttccctaagcgcacttccccagcgcgtggctatgaactactattccagcccgaagtggtaagaatctatatctccctgttaaaggagtcaaagactccagcaattctggaagcttccgccggagccatacaaaatctgtgtgcagggcggtggacctacggccgatacattcggagcgccctcaggcaggaaaaggcacttagcgcaatcgccgaccttctgacaaatgagcacgagagagtcgtaaaggcggcatccggcgctctcaggaaccttgccgtggacgcgaggaataaggagctaattggcaaacatgccattcccaaccttgtgaaaaatttgccaggcggtcagcagaattcctcctggaatttctccgaagataccgtgatttctattctcaatacgattaacgaggtgatcgctgaaaatctggaggctgctaaaaagctgcgagaaactcagggtattgagaaacttgtactgataaacaagtctggcaaccggagtgaaaaagaggttagggccgccgccctggtgctgcaaactatttggggatataaggagctgaggaagcccctggagaaggaaggctggaaaaaatccgacttccaggtgaaccttaacaatgcctctcggagtcagagctcacattcttacgacgacagtacactgccccttatcgaccgaaaccagaagtctgataaaaagccagatcgtgaagaaatccagatgtctaacatgggctcaaataccaagagtcttgacaataattacagcactccgaacgagcgcggtgaccacaacagaaccctcgaccgatcaggagatcttggggatatggaacccctgaaggggacaaccccccttatgcagaagatttag

SEQ ID NO: 181883 - DNA, 390 bp, Artificial Sequence
  Description of Artificial Sequence: Synthetic coding sequence
atggccaacggcaccctgacccggcggcaccagaacggccggttcgtgggtgacgctgatctggagcggcagaagttttccgacctgaagctgaacggcccacaggaccactcccacttgctatatagtacaattccgagaatgcaggaacccggacagatcgtggaaacgtataccgaggaggaccccgagggcgccatgagcgtggtctctgttgagacaagtgatgatggcaccacgaggagaaccgaaacgacagtaaagaaagtagttaagacagtcaccactcgcaccgtgcagcccgtggcaatggggccggacggtctgcccgtagacgccagctctgttagtaacaattacatccaaactctggggagggatttccgatag

SEQ ID NO: 181884 - DNA, 2586 bp, Artificial Sequence
  Description of Artificial Sequence: Synthetic coding sequence
atgcaggagcccggccagatcgtggagacctacaccgaggaggaccctgaaggtgccatgagcgtagtatcagtggagacgagcgacgacggcacaacacggaggacggagacaaccgtgaaaaaggtggtgaagacggtgacaacaaggacggtgcaaccagtagcaatgggaccagacggacttcccgtggacgcttccagcgtatctaataactacatacaaaccctcggaagggattttagaaaaaacggaaacggaggtcctggaccgtatgtcggacaagccgggaccgccacactccccagaaatttccactacccacccgacggctactcacggcactacgaggatggctacccaggcgggtccgataattatgggtcactcagcagggtgactcggatcgaagagcggtatagacccagtatggaaggctaccgcgccccctcgcgccaggacgtttacggaccccagcctcaagtccgagtcggagggagctccgtagacttacatcgcttccaccccgagccttatggtctggaggacgaccagcggagcatggggtatgacgacctggattacgggatgatgagcgactacggcacagccaggagaacagggaccccaagcgaccctaggagaagactgcgttcttatgaggatatgatcggggaagaagtcccctcggatcagtactattgggctcccttagcgcagcacgagcgcgggtccctcgcctcactcgactccctgcgaaagggggggcctccccctcctaactggcgccaacccgagctaccagaagtgatcgccatgttaggattccggctcgacgccgtcaagtccaatgcggcagcctacctgcagcacctgtgttatcgtaatgacaaagttaagaccgacgttcggaaactgaagggcataccggttttagtaggactgttggaccacccaaaaaaagaggtccacctgggagcctgcggagcccttaagaatatctcatttggcagggaccaggacaacaaaatcgcaataaaaaattgtgatggtgtgccagcacttgtcagactgctgaggaaggcgcgagatatggacctcaccgaggtgatcactggtacactgtggaacctgagttcccacgactccattaagatggaaatagtagatcatgctctccacgcactgactgatgaagtcatcattccacattcaggatgggagagagagcctaacgaggattgcaagcctcgtcacatagagtgggaaagcgtactgacaaataccgctgggtgtctcagaaacgtctctagcgaaagatccgaagcccggaggaagctgcgcgaatgtgacggactggttgacgcactaatctttatagttcaggccgagattgggcagaaggacagcgacagtaaactggttgagaactgcgtgtgtctgctgcgcaaccttagctatcaggtgcaccgggaaatcccccaggccgaacggtatcaggaagccgctccgaacgttgccaacaatactggcccgcacgctgcatcctgctttggggcgaaaaagggtaagggtaaaaagccgatcgaggacccggccaacgacactgtggattttcctaaacggacctctccagctcgtgggtacgaacttttgtttcagcccgaggtggttcgaatttacatatcattactcaaggagtctaagacgcctgcaatcctcgaggcctccgcaggcgccatccaaaacctgtgtgctggcaggtggacctatggcaggtatattagaagcgcgctgcgtcaggagaaagctttgagcgctatcgctgaccttcttaccaacgaacacgaacgcgtggtaaaggcagccagcggtgctcttcggaacctggctgttgacgcccgaaataaggaactcattggcaagcacgctattcctaacctagtgaagaacctgcctggtgggcagcagaactcatcatggaacttttcggaggacacggtgatatctattttgaacacaattaacgaggtgattgccgagaacctggaagcagcaaagaaacttagggagacacagggcattgagaaactcgtcctgataaacaagagcgggaaccggtctgaaaaggaggtccgggccgccgctttggtattgcaaactatatggggctataaggagctgcggaagcccctcgaaaaagaaggttggaagaaaagcgattttcaagtgaacctgaacaatgcttctagatcccagtcttctcattcttatgatgattcaaccctccccctgattgaccgaaaccaaaaaagcgacaaaaaacccgatcgtgaagaaattcagatgagtaacatggggtccaatacaaagtctctggataataattattcaactcctaacgagagaggtgatcataacaggaccctggatcgctcaggagacctgggagatatggaaccacttaaaggcacaactccactcatgcaggacgaaggccaggaatcactggaggaagagctcgacgtgctggttctggacgatgaaggaggccaggtgtcttacccttcgatgcagaagatatag

SEQ ID NO: 181885 - DNA, 2658 bp, Artificial Sequence
  Description of Artificial Sequence: Synthetic coding sequence
atggccaacggcaccctgacccggcggcaccagaacggccggttcgtaggggatgccgatttggagagacagaaattcagcgacttgaaactgaatggacctcaagaccactcacaccttctgtattcaactatacccaggatgcaagagccaggccagatcgtggaaacatacacagaggaggatccagaaggggctatgagcgtagtcagtgtggagacttctgacgatggcactacccgacgcacggagacaaccgtcaaaaaggttgtgaaaaccgtcacgacacgaactgtgcaaccagttgccatgggaccagatgggttaccagtggacgcctctagcgttagtaacaattatatacagactcttggacgtgacttccggaagaacgggaacggtggacctgggccgtacgtaggccaagccggaaccgcaactttgccaaggaacttccattatccaccagacggatactctcgccactacgaggacggctacccaggaggctccgacaactatggtagcttgagccgagtaacccggatcgaggagcgataccggccttccatggagggctatagagccccatccagacaggatgtgtacggtcctcagccccaggtgagagtcggcggaagctctgtcgacctgcacagattccatccagaaccatatggcctcgaggatgatcaacgcagtatggggtacgatgaccttgactacggtatgatgagtgactacgggaccgcaaggaggactgggactccgtctgaccctaggcgccgcctccggtcatacgaagatatgattggagaggaagttccttcagatcagtattattgggctccactggctcaacatgagcgcgggagcctagcatcactagacagtctacgcaaagggggtcctccccctcctaactggcggcagcccgagttgcccgaagttatagcgatgctggggttcaggctggacgcagtaaagtcaaacgctgctgcgtacctgcagcacctgtgttaccgcaacgacaaggtgaagaccgacgtgcggaaactgaaaggcatcccagttctggtggggctgttggatcatcccaaaaaggaagtccatttgggggcctgcggagctctgaagaatatttcatttggtcgcgaccaggacaacaaaatagccatcaagaattgtgacggagtacccgctctggtgcgacttctgcggaaagccagagacatggatctgactgaggtaattacaggtacgctgtggaatttgtcttctcacgacagcataaagatggaaattgtggaccatgcgctccatgccctgacagatgaggtgataattccacacagcgggtgggaacgcgagcccaatgaagactgtaagcctagacacatagagtgggagagcgttttgacaaacacagctggctgcctgagaaatgtgtcctccgagagatctgaggctcggagaaagctgagggaatgcgatgggttggtcgacgccttgattttcatcgtacaggccgagataggccagaaggattccgattctaaactcgtggagaactgcgtgtgcctcctaaggaatctgtcttaccaagtccacagggaaatccctcaggcagaacgatatcaggaagcggctccaaacgtggccaataataccggtcctcacgcagcaagctgttttggagccaaaaagggaaaggacgagtggttctcacgtgggaagaagccaattgaggaccccgcaaacgatacagtcgactttcctaaacggacgtccccggcccgcggttatgaactgctatttcagcctgaggtggtcagaatttatatctccctgttaaaggagtcaaaaaccccagcaatactggaagccagcgcgggcgcaattcaaaatctctgtgccggccggtggacttatggccgatatatccggtctgcactgaggcaggagaaagctctctctgcaatcgcagatctcctaacaaacgagcacgagcgggttgtcaaggccgcatcaggggccttgcggaacctcgccgtggacgctagaaataaggagctgatcggtaagcatgccatccctaacctggtcaaaaacctccccggaggccaacagaacagttcttggaatttctccgaggacaccgttatctctatcctgaacaccataaacgaggtgattgcagagaacctcgaagcagcaaagaaactgagggagacccaagggatcgagaagctagtactgatcaacaagagtggcaaccggtccgagaaggaggtcagggcagcagcccttgttctgcaaaccatttggggatataaagagctgaggaagcccctagaaaaggaaggctggaagaagagcgatttccaggtgaatctgaataatgctagccggagtcagtcctcccactcctatgatgactccactctgcctcttatcgacaggaatcagaagtcagataagaaaccagatagggaggaaatccagatgtctaatatggggtccaacacaaaatccctggacaataactatagcacccctaacgagcgaggggaccataacagaactttggaccggtctggtgatctgggcgacatggagcccctcaaaggcaccactcccttgatgcaaaagatctag

SEQ ID NO: 181886 - DNA, 1920 bp, Artificial Sequence
  Description of Artificial Sequence: Synthetic coding sequence
atgatcggcgaggaggtgcccagcgaccagtactactgggcccccttagctcagcacgagcggggatctctggcctctctcgactccctgcgaaaaggcgggccaccacctcccaattggcgacaacccgagctgccggaggtgatcgccatgcttggcttcaggctggatgccgtcaagtccaatgccgcggcatatctgcagcatctttgctataggaatgataaggtcaaaacggatgtgcgcaaactcaaagggatcccggtgctggtcggacttttggatcatccgaagaaggaggtccacctcggcgcttgcggcgccctgaaaaacatctcatttggtagagaccaggataacaaaattgcaatcaagaactgtgatggcgtgcccgcactcgtcaggctgctcagaaaggcccgagacatggaccttacggaggtcattaccggtaccctgtggaacctcagctcacacgattccataaaaatggaaattgtcgaccacgccctgcacgctttgacagacgaagtcatcatccctcacagcggctgggagcgagaacccaatgaagattgcaagccaaggcacatcgaatgggagtccgtgctcaccaacacagccggttgtctgcggaacgtaagttccgagaggagcgaagccaggcgaaagcttcgtgaatgtgatggccttgttgatgccctcatattcatagtacaggccgagatcggtcaaaaggacagcgactctaaactggtcgagaactgcgtctgtctgctccggaacctgagctatcaggtgcatcgggaaatcccacaggcagaaaggtaccaagaagccgcacctaatgtggcaaataataccggtccacacgccgctagttgttttggggctaagaagggcaaagggaagaaaccaatcgaagaccctgcgaacgatactgtcgatttccccaaacgaacgagtcccgctagaggatatgagctgctgttccagcctgaggtagttcggatttatatctcactactgaaggagtctaaaacccccgccatcttggaggctagcgctggcgccatccagaacctgtgtgctggacgctggacatacggccggtatatccgcagcgctcttagacaagagaaggctttgtccgccatcgccgaccttctcactaatgagcatgaaagagtggtcaaggcagcctccggcgcactgaggaacctggctgtggatgccagaaataaggagcttatcggcaaacacgccattccgaacctggtgaagaacctgcccggcggccagcagaactctagctggaacttcagcgaagacaccgttatttctatccttaacacaattaacgaggtaatagccgagaaccttgaagcagccaagaagctgcgtgaaacccagggaatcgagaaactagtgttgatcaacaaatctggaaatagatctgagaaagaagtccgcgccgctgccctggtgcttcagaccatctggggctataaggagcttaggaagccactggagaaggaagggtggaaaaagtccgactttcaggttaatcttaataacgcttctcgctcccagagctcacatagctacgatgactctaccttacctttgattgatcggaatcagaagagtgataaaaaacccgatcgcgaagagatccagatgtccaatatgggaagcaataccaagtctttggataacaactactccacccctaacgaacggggcgaccacaataggactttggaccgcagtggcgacctcggagatatggaacccctcaaagggacaacacccctcatgcaagatgagggacaagaaagcctggaagaagaactcgacgtcctggtgctggatgacgaaggcgggcaggtttcctatccctcaatgcagaaaatatag

SEQ ID NO: 181887 - DNA, 2499 bp, Artificial Sequence
  Description of Artificial Sequence: Synthetic coding sequence
atgcaggagcccggccagatcgtggagacctacaccgaggaggacccggaaggtgccatgtccgtggtgtctgtggagaccagcgatgacggtacaacccgaaggactgaaaccacagtcaagaaagtggttaaaacagttacgaccaggacggtgcagcctgttgccatgggccctgatgggctgcctgtggacgcttccagcgtgagcaacaattacattcagaccctaggcagagattttcgcaagaacggaaacggtggcccaggcccctatgtcggccaggctgggacggcaacgttgccgaggaatttccactatcctccagacgggtacagcagacattatgaggacgggtatcctggagggtccgataactacggaagcttgagccgcgtgactcgcatcgaagagcggtaccggccttccatggaaggataccgcgctccatcaagacaggatgtgtatggaccacagcctcaggtgcgcgtgggcggaagttccgttgaccttcatagatttcacccagagccttatggcctggaggacgatcagcggtccatggggtatgatgacctggattacggcatgatgagcgattatggtaccgccagacggacgggaacaccatcggacccaaggaggcggctgagaagttacgaggatatgatcggtgaggaagttccaagtgaccagtattattgggcacctctcgcgcagcatgaacgaggatccctagcaagcctcgatagtctgaggaagggcggtccccctccccctaattggagacaaccggaacttcctgaagtgattgcgatgttgggatttcgactcgacgccgtcaagtctaacgcagcagcctatctgcagcatctttgttataggaacgataaggttaaaaccgacgttcgcaagcttaaaggcatccccgtgctggtggggctgctggatcatccaaagaaggaagttcatctgggggcttgtggtgcccttaaaaatataagcttcggacgcgatcaagacaacaaaatagctataaagaattgcgacggagtgcccgctctagtgcggctgctgcggaaggcccgggatatggacctgacagaagtgattacgggcactctgtggaacctcagctcccatgattccataaagatggagatcgtagaccacgctttgcacgcccttactgatgaagtgatcatccctcattcaggatgggagcgcgaacccaacgaagattgtaagccaaggcacatagaatgggaatctgtgctgacaaataccgcagggtgtctccggaatgtatcctccgaacgcagtgaagcgcgccgcaaactccgcgagtgtgatgggctggtggatgcgcttatctttatcgttcaggccgagatcgggcaaaaagactcggactcgaaattagtggaaaattgcgtctgcctcctgcgtaacctatcataccaggtgcaccgcgagattccacaggccgagcgatatcaggaagcagcgccaaacgtagcaaataataccggtccacatgccgccagctgcttcggggcaaaaaaggggaaaggtaagaaacccattgaggacccagctaatgacaccgtggatttccccaagcggacttctcccgcacgtggatacgaactactcttccagcctgaagtggtgcgaatctatattagtctcttgaaagagagtaaaacgcccgctattttggaggcatcggccggcgccatacaaaatctgtgcgcaggaagatggacttacggccgctacattaggtccgctttgcgacaagaaaaagcactttccgcaattgcagatcttctcaccaacgagcacgagcgtgtcgttaaagctgcctccggagccctccggaacctggcagtggatgcgcgtaacaaggagttaatcggcaaacacgcaatccctaatctcgtgaagaatctgccagggggccagcagaacagttcctggaacttctctgaggacaccgtgatctctatcctcaatactatcaacgaggtaattgccgaaaacctggaagccgcaaagaagctgagggagacgcagggcatcgaaaagctggtattaataaataaatccggtaaccggtccgagaaggaagtgcgcgccgccgccctcgtgcttcagactatttggggatacaaggaactgcgaaagccgcttgaaaaagaaggctggaagaaatccgacttccaggtgaacctcaacaatgccagtagaagtcagtcatctcatagctatgatgactccactctgcctctcattgataggaatcagaaaagtgataagaagccagatagggaagaaattcagatgtccaatatgggttccaacaccaagtccctcgacaataattactccactcctaacgagcgcggtgaccataacaggacactggacagatcaggtgacttgggcgacatggagcccctcaaaggaaccacccctcttatgcagaagatctag

SEQ ID NO: 181888 - DNA, 2499 bp, Artificial Sequence
  Description of Artificial Sequence: Synthetic coding sequence
atgcaggagcccggccagatcgtggagacctacaccgaggaggacccagagggcgccatgtctgtagtgtctgttgagacctctgacgatgggaccactcgaaggaccgaaacaaccgtgaaaaaagtcgtaaagacagtgaccacgaggacagtgcagcctgtagccatggggccggatgggctgcctgttgatgctagctctgttagcaataactacatccagacgctgggtcgagactttaggaaaaatggtaatggggggcccggcccttatgtcggccaagcgggtaccgctacccttccgcgcaatttccactatccacctgacgggtacagcaggcattatgaagatgggtatcctggaggaagtgacaattatggttcgctgagtagagtgacaaggatagaggagcgctacagaccttccatggagggctatcgggcgccgagtcgccaagatgtttacggaccccagccccaggtacgtgtgggcggctcctcagtggacctgcacagattccaccccgaaccctacggcctggaggacgatcaacggtctatgggatatgatgacttggattatggcatgatgagtgactatggtaccgctcgacgcactggaaccccctccgatccacgccgcagactacgaagttatgaagatatgattggggaggaagtaccttctgaccaatactattgggcccccctggctcagcatgagagaggcagtcttgcatccctcgatagtcttagaaagggaggacccccacctcccaattggcgtcaaccggaattaccagaggtcatcgcaatgttggggtttaggttagatgcagtcaaatcaaacgccgccgcctatcttcagcacctgtgctatcggaacgacaaagtgaaaaccgatgtcagaaaactcaaaggcatacctgttctggtgggcctgttagaccacccaaagaaggaagttcatctaggcgcctgtggagccctgaagaatatcagcttcggcagggaccaagacaataaaatagccatcaaaaactgcgatggcgtgcctgctctggtgcggttgttgcgcaaagcaagagatatggacctgaccgaggtaatcactgggacattgtggaatttgagcagtcatgactctatcaaaatggagatagtggaccacgcactgcacgctcttactgacgaagttatcatccctcattcgggttgggaacgggaacctaatgaggattgtaaaccacgacacattgagtgggaatcagtcctgactaataccgcagggtgtctgcgcaacgtgtcttcagaacggagcgaagccaggaggaagctgcgggagtgtgacgggttagtggacgcattaatcttcatcgtccaagccgagatcggccagaaagattccgacagtaaactggtcgagaactgtgtttgtcttctcagaaacctcagctatcaggtccatagggagatccctcaagccgagagataccaggaagccgcccctaacgtcgcaaataacactggaccgcacgctgccagctgcttcggagccaaaaagggcaagggcaagaagcctatagaagaccccgccaatgacacagttgatttccctaagcgcacaagtcccgcccggggctacgagctcctgtttcagcccgaggttgtccggatatacatatcattattgaaggagagcaagacacctgctatcctcgaagccagcgctggagctatccagaacctctgtgcaggaagatggacctacggccgttacatcagatctgcgcttaggcaggagaaagccctatctgcgattgccgacttgttaaccaacgaacatgagagagtggttaaggccgcctctggagcactgcgcaacctggccgtcgacgcgcgaaataaggagcttataggcaaacacgctattcctaatctggtgaaaaacctgcctggcggacagcagaacagcagttggaacttttccgaggacacggttatcagcatactgaatacaatcaacgaggtaatcgcagagaacctggaagcggccaaaaagctgcgtgaaacccaagggatagaaaagctggtactgattaataagtcagggaatcgatcggaaaaggaagtgagggcggccgccctggtgctgcaaactatctggggatacaaagagctgcgaaaacctctcgagaaagagggatggaagaagtctgactttcaggtcaatcttaacaatgcaagccgtagccagagcagccactcttacgacgatagcacactgcctctgatagacagaaaccagaaatccgataaaaaacccgaccgtgaagaaatccaaatgtccaatatgggcagtaacaccaaatccctggacaataactacagcacaccaaacgaacggggcgaccacaacaggacacttgaccgaagcggcgatctgggggacatggagcctctcaaagggactactcccttaatgcagaagatttag

SEQ ID NO: 181889 - DNA, 2640 bp, Artificial Sequence
  Description of Artificial Sequence: Synthetic coding sequence
atggccaacggcaccctgacccggcggcaccagaacggccggttcgtcggggacgcggatctggaacgacagaagttctccgacctcaaactgaacggcccccaggaccactcccacctcctgtattctactattccccgcatgcaggaaccggggcagattgtggagacttatactgaagaggatccggaaggggctatgagcgtggtctccgttgagacttctgacgacggcacaactcgaaggaccgagacgacagtaaaaaaggtggtgaaaacagtgacaacgcgcacggtgcaaccagtggccatgggtcctgacgggctgcctgtggacgcaagcagtgtgagtaataactacatccagaccctggggcgggatttcaggaaaaatggaaacggcggacctgggccatatgtgggccaggctgggaccgcaacacttccaagaaacttccactacccacctgatggttactctaggcattatgaggatggataccctgggggttcggacaactatggaagtctgtcgcgagtgactcgaatagaagagcggtacaggccgtctatggaggggtacagggctccatctcgccaggatgtttatggccctcagccccaggtacgtgtcggcggttcctccgtcgacctgcatagatttcatccagaaccttacgggctggaagatgaccagaggtccatggggtacgacgatctggactacggaatgatgtcagactacggaacagctcgaagaactggcacaccttccgatccacggagaagactaaggtcatacgaagatatgattggggaggaggtaccgtctgatcaatattattgggcaccgctggctcaacacgagcggggatccctggcctccctggacagccttcggaaggggggcccgcccccaccaaactggcgccaacccgagttgccagaggttatcgcaatgctgggattccgcttggacgctgtcaagtccaacgccgccgcttacttacaacatctgtgttatcgcaatgataaggtgaaaaccgatgtcagaaagctgaagggtatacctgtgctggtggggcttttggatcaccctaaaaaagaagtgcaccttggcgcgtgtggcgctctgaaaaatatcagcttcggcagggatcaggataataaaatcgcgattaagaattgcgatggtgtgccagctctcgtgcgcctgctcagaaaggctagggacatggatcttaccgaggtcataacgggaactttatggaacctctcctcccacgatagtatcaagatggagatcgtcgatcacgccttgcatgctctaaccgacgaagtgatcattccccactctgggtgggaacgggagccaaacgaggattgcaagccaagacacattgaatgggagtccgtacttaccaacaccgccggctgtcttcggaatgtgtcgtcagagcggagtgaggccaggcgaaaacttcgcgagtgtgacgggttggttgacgcgctgattttcatcgtgcaagcggagatcgggcagaaggactctgactctaaattagtcgaaaattgtgtgtgtctcctccgcaaccttagctaccaagtacaccgtgagatacctcaggccgaaaggtatcaggaggcggcccccaatgtcgctaacaataccggcccccatgcagcgtcatgctttggagcaaaaaagggaaaaggcaagaagcctattgaggatccagccaatgacaccgttgatttcccaaaacgcacgagtccagcccgaggctacgagctcctgttccagccagaggttgtcaggatttatatcagcttgctcaaagaaagtaaaacaccggctatcttagaagcgtccgctggcgccatccagaacctctgtgcaggcaggtggacttacggccggtacatcaggagtgccttacggcaggagaaggccctaagtgcgattgcggacctgctcaccaatgagcacgagcgtgtcgtgaaagccgcctccggcgccttgagaaatctggctgtggacgcgcgaaacaaggaactgattgggaagcacgcgatacccaatctcgtgaagaacttacctgggggccaacagaactcatcctggaacttcagtgaagataccgtaatcagcatcctgaacacaatcaatgaggtgatcgctgagaacttggaggcggcaaaaaagttgagagagacccagggcattgagaagctggtcctaatcaataaatctggtaataggagcgagaaggaggtccgcgccgcagccctcgtgttacagacaatctggggctataaagagctgcgaaagccactggagaaagaggggtggaagaagagcgacttccaggtgaacctgaacaatgctagcaggtcacagagcagccactcgtatgatgattctaccctgcctttgattgaccgcaaccaaaagtccgataagaaacccgatagggaagaaatccagatgagcaacatggggagtaacacaaagtctctcgataataattactctacgcctaacgagaggggcgaccacaaccggacacttgatcggagtggcgatctgggcgatatggagcccctgaaaggcacaactcccctgatgcaaaagatctag

SEQ ID NO: 181890 - DNA, 2523 bp, Artificial Sequence
  Description of Artificial Sequence: Synthetic coding sequence
atgcaggagcccggccagatcgtggagacctacaccgaggaggacccagagggtgccatgagtgtggtgtcagtagagacctctgacgatggtaccaccagaaggaccgagaccacagttaagaaggtggtgaagacagtcacaacaagaaccgttcagcctgtcgcaatgggtccagacggacttccagtggacgcatcaagtgtgtcaaataattacattcagacattaggcagagattttcgaaagaacggcaatggcggacccggcccctacgtgggccaggctggaactgccaccttgcctaggaattttcactacccccctgacgggtacagtcggcactatgaggatggttatcccgggggttcagataattacggatctctcagtagagtgactagaatcgaggagcgctaccgtccttctatggaaggataccgggccccttcgcgtcaagacgtttatggaccacagccgcaggtacgggtgggggggagttcagttgatctgcaccgttttcatcctgagccgtacgggctcgaggacgaccagaggtccatgggatacgacgatctggactatggtatgatgtccgactacggcacagcccgcaggaccggcacacccagtgatccacgacggcgcctgaggtcctacgaagatatgataggtgaggaggtgccttctgaccagtattactgggcacctctggctcaacacgagagggggtccctagctagtttggactcgttgaggaaagggggtcctcccccaccaaactggagacagcccgaactgcctgaggtcatcgcgatgcttggctttcgattggacgccgttaaatctaatgcagcagcctatctgcagcacctgtgctaccggaatgataaggtcaagacagacgttcggaagctgaagggaatcccagtattggtcggtctcctcgatcaccctaagaaggaggtgcacctgggtgcatgcggcgccctgaagaacatctccttcggcagggatcaagataataagatcgccatcaagaattgtgacggggtccccgccctcgtgcgcctgctgaggaaagcccgtgatatggacctcacagaggtcattacaggcacactgtggaatctgagttcccacgacagcatcaagatggagatcgtggatcatgctctgcacgccttgaccgacgaagtgataattccacattccggctgggaacgagagccgaacgaggactgcaagcccaggcatatagaatgggaatccgttctgacgaatacagcgggatgtctgcggaatgtcagcagtgagagaagcgaagccaggaggaagcttcgtgagtgcgacggcttagtcgatgcactgatatttattgttcaagctgagataggccagaaggatagtgattccaaactcgtggagaattgtgtttgtctgctgcgtaacctgtcatatcaggtgcacagagaaatccctcaagccgaacggtaccaggaagctgctccgaatgtggcaaacaacacaggtccacacgccgcctcttgcttcggcgccaagaaaggtaagggcaagaagcctatcgaggatcctgctaacgacacagtcgacttccccaagaggactagtccagctagagggtatgaactgctgtttcagccagaagtggtgcggatttatatttccctcctgaaagagtccaagacgccggctatcctggaggcctctgccggagccatacagaatttgtgtgccggacggtggacctatggtcgctacatccggagcgcacttagacaggagaaggctctgtccgctatcgcagacttgctgactaatgaacacgagagagtcgtcaaggccgcatcgggggcccttagaaacctggccgtggacgctaggaataaagagctcatcggcaagcacgctattccaaatctagtgaaaaatctccccggcggacagcagaacagctcttggaatttcagtgaagacacagtcatatcgattttaaacaccattaatgaggtcattgccgaaaacctggaagccgccaagaagctgcgggagacgcagggcattgaaaaattggttctcattaataaatccggcaacagaagtgaaaaagaggtgagggccgctgctctagtgctgcaaaccatatgggggtacaaagaactgcgtaagccgttagagaaagaaggatggaaaaagtcggatttccaggtcaacctaaacaacgcatcgcgctctcagtcaagccacagctatgacgatagcacgctcccattgattgatcggaatcagaaaagcgataataactactctaccccaaatgagagaggagaccataacaggacactggatagaagcggcgacctaggcgatatggaacctttaaaaggcacaacacccctgatgcaggatgaagggcaggagtccctggaagaagagctagatgtcttagtactggatgatgaggggggtcaggtgtcataccccagcatgcagaaaatctag

SEQ ID NO: 181891 - DNA, 2745 bp, Artificial Sequence
  Description of Artificial Sequence: Synthetic coding sequence
atggccaacggcaccctgacccggcggcaccagaacggccggttcgtcggggatgcggacctggaacgccagaagttttcagaccttaagctgaatgggcctcaggaccattcccatttactgtactcaacgatccctagaatgcaggagcccggacaaatcgtcgaaacctataccgaggaggatcccgagggagctatgagcgtcgtcagcgtggaaacctccgatgacggaacaactaggcgcacggagaccacagtgaagaaagtggtgaagaccgtgacgactcgcacagtccagccagtcgctatgggacctgacggcttacccgttgatgcgtcctcagtgtccaataactatatccaaacccttggccgcgatttccgcaagaacggcaacggcggaccggggccttacgtggggcaggcaggaaccgccacactgcctcgcaattttcactatccgccagatggctactctcgccattacgaagacggctaccctggcggtagcgataactatggatccctgtccagggtgaccaggattgaggaaaggtacaggcctagcatggaaggctaccgggctccgagccgccaggacgtatacggcccgcagcctcaggttagggttgggggatcatcagttgatctgcatcggtttcaccccgagccctacggcctggaggacgatcaacgttccatgggttatgacgatttagactatggcatgatgagcgactatggaaccgctcgtcgaactggtacaccttctgatcccaggcgaagactgcgctcttacgaagacatgataggagaggaggttccatcagatcaatattactgggcacctctggcacagcatgagcggggttccttggccagtctggactctctgcgaaagggtggtccccctccaccaaactggagacagcccgaacttccagaagtcatagccatgcttgggtttcggcttgatgccgtgaaaagcaatgcagctgcatacctccaacatttatgctatcggaacgataaggttaaaacagacgtccgtaagctcaagggaatccccgtgctggtgggcctgctggaccaccctaagaaagaggttcatctcggagcctgcggcgctttgaagaacatcagtttcggtagggaccaggataataagatcgccattaaaaattgcgatggcgtgcccgctcttgtcaggctgctgagaaaagccagagacatggacttgaccgaagtcattacgggtactctgtggaatttgtccagccatgactctataaaaatggagatcgtcgaccatgccctgcatgcattgactgacgaggtaatcatcccccatagcgggtgggaaagagagcccaacgaagattgcaaacctaggcacatcgaatgggagtcagtcctaactaacacagctggatgtttaagaaacgtttccagtgagcgctcagaagcgcgtcgcaagctgagggagtgcgatggacttgttgatgccctcatcttcatcgtgcaggcagagataggccagaaggacagtgattctaagctcgtggaaaattgcgtttgtcttctccgtaatctttcctatcaggtgcaccgagaaattccccaggctgagcggtaccaagaagctgctcctaatgtggccaataatactggccctcacgctgcctcttgcttcggcgccaagaagggcaaggacgagtggttctcccgggggaagaagcccattgaagatcccgcaaacgataccgtcgattttccaaaacgcacaagtccagcacgcggttacgagcttctcttccagcccgaagtggtgcgaatctatatctcactgctcaaagagagcaaaacgcccgctattctcgaagcaagcgcaggggcaatccagaatctgtgcgcggggcggtggacctacgggcggtatatccgatccgctttgcgtcaagagaaggccttgagcgctattgctgatctattgactaacgagcacgaacgggtagtcaaggccgcctcaggcgccctccgcaacctcgctgtggacgcccggaataaagagctcataggcaagcacgccatccccaacctcgtaaaaaatctgcctggtggacaacagaacagctcctggaacttttccgaagacacagttatcagtatcctaaacaccattaatgaagtaatagctgaaaatctggaggccgccaagaaactgcgggagacccagggtatcgaaaaactcgtcctaatcaacaagtcaggcaaccgcagtgagaaagaggtgagggctgccgctctggtgttgcagacgatctggggatataaggagctgagaaagccattggaaaaagaaggatggaaaaagtcagatttccaggtcaaccttaataacgctagtcggtctcagagcagccacagctatgacgattccacgttgcccctgattgacaggaaccagaaatcagacaagaagcccgatcgggaagaaattcagatgtccaacatgggcagtaatacgaaatccctggacaacaactactctacccctaacgagagaggagaccataaccgaaccttggataggtcgggggatcttggcgatatggagcctttgaaaggcactactcctctgatgcaagacgagggccaggaaagcttggaagaggaactggatgtgcttgtcctggacgacgagggcgggcaggtgtcttatcctagtatgcagaagatctag

SEQ ID NO: 181892 - DNA, 381 bp, Artificial Sequence
  Description of Artificial Sequence: Synthetic coding sequence
atgatcggcgaggaggtgcccagcgaccagtactactgggcccccttggcccaacacgagagaggcagtctcgcctcccttgattctcttcggaaagggggaccgcccccccccaactggaggcagcccgagctccctgaagtgatcgctatgctggggtttcgactggatgccgtaaagtcaaatgccgcagcttacctccagcacctgtgctatcggaatgataaggtgaaaaccgatgttagaaaactcaaaggaatcccagtactcgtggggctgctggatcatccgaaaaaggaggtccatttgggcgcctgcggagcattgaagaatatctcattcgggcgggaccaagataacaagatagccataaagaattag

SEQ ID NO: 181893 - DNA, 2640 bp, Artificial Sequence
  Description of Artificial Sequence: Synthetic coding sequence
atggccaacggcaccctgacccggcggcaccagaacggccggttcgtcggggacgctgaccttgaaagacagaagttctctgacctgaagctgaatgggcctcaggatcatagccacctgctgtactccacaatcccccgcatgcaggaaccggggcagatcgtggaaacctacaccgaggaggaccccgaaggcgcaatgagcgtggtcagtgtcgaaactagcgacgatgggaccaccaggaggactgagacaacagtgaagaaggtcgtcaagaccgtgacaactcgcaccgtgcaaccagtggccatggggcctgatggtctccccgttgatgcaagttccgtctctaataactacattcagactctggggagagactttcggaagaacggaaatgggggccctggaccgtatgtagggcaggcagggacagccacactgccccgcaacttccattaccctccagacggttattctcggcattacgaagacggatatcccggcggcagcgataactatggtagcttatctcgcgtaaccagaatcgaagaacggtacaggccttcaatggaaggttacagagccccctctcgtcaggacgtgtacggcccccagcctcaggttcgggtgggcggaagctccgtcgacctccatcggtttcacccggagccctacgggcttgaggacgatcagcggagtatgggttatgacgacctggactacgggatgatgagtgactacggaaccgctaggagaactgggaccccatcagacccacgccgacggttgcgctcatacgaggacatgattggggaggaggtccctagtgatcaatattactgggctcctcttgctcagcatgagcgtgggtcccttgccagccttgattccctacgaaaggggggccctcctccccccaactggcggcaaccagagctgcccgaggtgatcgcgatgctgggctttcgcctggacgctgtaaagtccaacgctgccgcgtacttacagcacctatgttaccgcaacgacaaggtaaaaaccgacgttaggaaactcaagggtattccggtgttagtgggtctactcgaccatcctaagaaggaggtccacctgggtgcttgcggcgcactcaagaacatctcctttgggcgggaccaggataataaaattgcaataaagaactgtgatggcgtgccggctctggtgcggctcctgagaaaggccagggatatggacctcaccgaagtgataaccggcaccttatggaacttgagcagccacgattctattaaaatggagatcgtggatcacgccctgcacgccctgaccgacgaagtaattattccgcacagtgggtgggaaagagagccaaatgaagactgcaagccacgtcatatcgaatgggagagcgttctgactaatacggctggatgtctgagaaacgtctctagtgagaggtccgaagcgaggcggaaactgcgcgagtgcgacggccttgtggacgcccttattttcatcgtccaggccgaaattggccagaaggactcagactcaaagctggtcgaaaactgtgtatgtttacttcgcaatctgtcatatcaagtacacagagaaataccccaagcggagcggtatcaagaagccgccccaaatgtggccaacaacactggcccacatgccgctagctgttttggggcgaagaaaggaaagggcaagaagcctatcgaagatcctgcaaatgataccgtagacttccctaagagaactagcccagccaggggatatgaactgctgtttcagcccgaggtggtaagaatctatataagtttgcttaaagagtccaaaaccccagcaattctggaggccagcgcaggtgctatccagaacttgtgtgctggcaggtggacatacggccgttacattcggtccgccttgaggcaggagaaagcactgtcggctatagccgatctgcttaccaacgagcacgaacgggtcgtcaaggcagcttccggtgcacttaggaacctcgcggtggacgctaggaacaaggaactgatcggaaagcatgctattcctaatctggttaagaatttgccgggagggcagcaaaactcttcttggaatttctccgaggatacagtgatctccatattaaacaccattaacgaggtgatcgccgaaaatttggaggctgcgaagaagttgcgcgaaacccagggaatagaaaagctggttctgatcaacaagtctggaaatagatctgaaaaagaggtaagggcagcggcattagtcctccagaccatctgggggtacaaggagctgcgcaaaccactcgaaaaagagggctggaagaaatctgactttcaggtaaacctgaacaacgcatctcgcagtcaaagctctcatagttacgacgattcgacactgcctttgatcgaccgtaatcaaaagagcgacaaaaaaccagatcgggaggagatccagatgagcaatatgggatcaaatacaaaatctctcgacaacaactacagcacccccaatgagagaggagatcacaatagaacactagacagatccggagaccttggcgacatggagcctctgaagggcacaacccccttaatgcaaaaaatatag

SEQ ID NO: 181894 - DNA, 3678 bp, Artificial Sequence
  Description of Artificial Sequence: Synthetic coding sequence
atgttcgcccggaagccccccggcgccgcccccctgggcgccatgccagtcccggaccagccttcatccgccagcgaaaagactagctcactgtcgccagggctgaacacctccaacggcgacggttcagagaccgagaccacgagtgccatccttgcaagcgttaaggaacaggaacttcagtttgagaggctgactcgagagctggaagcagaacggcagatcgttgcaagtcagctcgaacgatgcaagctgggatccgaaaccggctctatgtcaagcatgtcgtcagcggaggagcagtttcaatggcaatctcaggacggccaaaaagatatagaagatgagttaacgaccgggttagaactggtggatagttgcatcaggtcgctgcaagagagcggtattctggaccctcaggattactctacaggggaacgtccatctctgctcagccagagcgccctccagctaaatagcaagcccgagggctctttccagtacccagccagttatcacagtaaccaaacactcgcgcttggcgagacgacacccagccagcttccggctagaggaacacaggcaagagcaaccggccagagcttcagtcagggcactactagccgggccggtcacttggctggccccgagcccgccccaccaccaccgcctcccccgagggaaccatttgcaccttcactgggcagcgcctttcacctgcccgatgcacctcccgccgccgctgctgcagcgctgtactattcctctagcacactgcctgcgccacctcgcgggggaagtccgctggctgccccacaggggggttcccccacaaaactccagcgtggcgggagtgctccagagggggcgacttacgctgcaccaagggggagcagccctaagcagtcaccatcccggctcgccaagtcttatagtaccagttctcccattaacatcgtggtgtcctccgccggactgtctcccatccgcgttacgagtccaccgaccgtgcaatctacaatctcgtcaagccccatacaccagctctcctccacaatcggtacttatgctacactgtcccctactaagaggctggttcacgcttccgaacagtacagcaagcatagccaggagttgtacgccaccgccactcttcaacgtccaggcagcctggccgctggatcccgggctagctattcctcccagcatgggcatctggggcctgagctgagagctctgcaatccccagaacaccatatcgacccgatctatgaggacagggtgtatcagaagcctcccatgcgctctctgtctcagtcacagggtgatcccctacctcccgcccacacagggacttatcgcacaagtactgctcccagctccccaggtgtggacagcgtaccccttcagcggacggggtcacaacatgggccacaaaatgccgcagccgcaacatttcagagagctagctacgctgccgggccagcctccaactacgccgatccctatcgtcagctccagtactgcccaagtgttgagagcccgtattccaagtcgggcccagcactgccccccgaaggaaccttggcgaggagcccgtctattgacagcattcagaaagatcctagagaattcggatggagggaccccgagctgccagaagtgatccagatgctgcagcaccagttcccatccgtgcagagcaacgccgcagcatacctccaacacctgtgttttggcgacaataagatcaaagctgaaattagaaggcagggaggtattcaactgctggtggacctccttgatcatcgcatgaccgaagttcataggtcagcatgtggagcgctgaggaacctcgtctatggtaaggccaatgacgataacaaaatagcactcaaaaactgtggagggatcccagcactagtgagactgctgaggaagaccacagacctggagatccgtgaactggtgactggtgtcctgtggaatctgtcctcatgcgatgcccttaaaatgcctatcatccaggacgccttggctgtcctgactaatgcagtcatcattccgcactccggttgggaaaatagccccctgcaggatgatcgaaagatacagcttcacagctcgcaggttctccgaaatgccaccgggtgccttcggaacgtgagcagcgcaggtgaagaggctcgcagaaggatgagagaatgtgacgggcttaccgacgctctgttgtatgttattcagtcagccttaggctcttctgaaatcgattccaagacagttgaaaactgtgtctgtattctgcggaacctgtcatacagattggccgcagagaccagtcagggacagcacatgggaacagatgagcttgacggcctgctgtgtggggaagctaatggcaaagacgccgagtccagcgggtgctggggcaaaaaaaagaaaaagaaaaagtctcaagatcagtgggatggtgtcggtccacttccagactgcgccgagcccccaaagggtatacagatgttatggcatcctagtattgttaagccttacctgactttattgtccgaatgcagtaatccagataccctggaaggagcagccggcgccctgcagaatctcgccgcagggagttggaaatggtccgtgtacatccgagcggccgtgaggaaggagaaggggctgcctatcctcgtggaactactgaggattgataatgaccgagtcgtgtgcgctgtggctacagctctacggaatatggcactggacgtacggaacaaagaattgattgggaaatatgctatgcgggatctggtgcaccggctcccaggaggcaataactctaacaacaccgcctccaaggcaatgtctgacgacacagtgactgcggtttgttgtactctgcacgaggtgattaccaaaaatatggagaacgcaaaagccctacgggacgccggaggtatcgaaaaactggttggcatttccaaaagtaaaggcgacaagcattccccaaaagtcgtgaaggccgcgtcccaagtgctcaattcaatgtggcagtacagagatctcaggagtttgtataagaaagatggctggagccagtatcatttcgtggcctcctcctcgacaatcgaacgtgatagacaaaggccctacagctcttctcggaccccctccatttccccagtacgagtgtccccgaataatagaagcgcttcggcacctgctagcccacgggaaatgatcagcctcaaggagagaaagaccgactacgaatgcacaggcagcaatgctacctaccacggcgctaagggggagcacaccagccgcaaggacgccatgacagcacagaacaccggcatcagtactctatacagaaacagttacggcgcccctgccgaagatattaagcacaatcaagtttcagcacagcccgtgccacaggaaccgtcacgtaaggattatgagacctaccaaccattccagaatagtacaaggaactacgacgaaagtttttttgaggatcaggtgcaccaccgacctcctgctagcgagtacaccatgcatttagggctcaagagtaccggtaactacgtcgatttctatagcgcagcgcggccttactccgagctaaactatgagacttcccattaccctgccagcccagactcctgggtgtag

SEQ ID NO: 181895 - DNA, 3504 bp, Artificial Sequence
  Description of Artificial Sequence: Synthetic coding sequence
atgttcgcccggaagccccccggcgccgcccccctgggcgccatgcccgtacccgatcagcccagctccgcctcagagaagaccagttcattatcaccagggctgaatactagtaatggagacggaagcgaaacggaaaccacaagtgctatcctggcgtcagtcaaggaacaggagttgcagttcgaacgcctgacccgggagttagaagccgaaaggcagatcgtcgcttcacaattggagaggtgcaagctcggtagtgagacaggttccatgtcctccatgtcatcagccgaagagcagtttcagtggcagtctcaggatggccagaaggacatcgaagacgagctaaccacaggtctagagctagtcgattcatgcatcaggtccctgcaggaatcgggcattctggatccgcaggactattcaaccggcgagcgccctagcttactctcgcaatcagctctgcagctcaattcgaaaccggagggctcctttcagtatcccgcaagctaccactcaaaccagaccctggcattgggggagaccactccctctcagcttcccgcccgcggaacacaggcccgggctacagggcaatctttttctcaaggtacaacatcccgggctggtcacctagccggccctgagcccgccccgccaccaccaccgccccctcgggagcccttcgctccatccctgggtagcgcgttccacctgcctgacgcacctcctgccgccgccgccgcagcactctattactctagttccacactccctgctccacctcgaggggggtcaccgcttgctgctccacagggaggcagcccgactaaactgcagcggggaggcagtgctccggagggggccacctatgctgccccgcggggcagtagcccaaaacaatcaccctcacgactcgccaagtcttactcaacttcctcccctatcaacattgtcgtgtccagtgcaggtctgtctcctatcagggtgacatcaccgcctactgtgcaaagtacgattagcagcagccctatccaccagttgagttcaaccattggtacgtatgcaacactctcacccacaaagcgtctggttcacgcaagtgaacagtattctaaacacagccaggagctgtacgctactgcaacacttcaaagacccggctcccttgcagccgggtcaagagcatcatactcctcccagcacggccatttaggtcccgaactgcgcgcccttcagagccccgagcaccacattgacccgatctacgaagaccgagtttaccagaaacctcctatgcgatctctgagccagagtcaaggggaccccctacctccggcacatactggtacttacaggacatctactgctccatccagccccggggtagacagcgtcccgttgcagcgtactgggtcccagcacgggccccagaatgccgccgcagctacctttcagcgggcctcatatgcggccgggcccgcttccaactacgccgacccttaccggcagcttcagtactgtccatcagtggagtcgccatattcaaagtccgggccggccctgcctcccgagggtaccctggctcgctcacccagtatagattccatacagaaagacccccgcgaattcggatggagagaccccgagttacccgaggtgatccagatgctacagcaccagtttccttctgtgcaatcaaatgcagccgcctacctgcagcacctgtgtttcggtgacaacaagatcaaagctgaaatacggcggcaaggcggaattcagttacttgtggacctcctcgatcacaggatgaccgaagtacataggtctgcatgcggcgccctgagaaacctagtatatggcaaggccaatgatgacaataagattgccctgaaaaactgcggtggcatccctgcactggtccggttattgcgaaagactactgatctggaaatccgggaattggtgaccggagtgttgtggaacctcagcagttgtgacgcacttaaaatgcccatcatccaggacgcccttgctgtgttaaccaacgccgtaattatacctcattctgggtgggaaaactcccccctccaggatgaccgcaaaatacagttgcatagctcacaggtgctgcgaaacgcgactggatgcttgagaaacgtgtcgtctgccggtgaagaagcgcggcgcagaatgcgcgagtgcgatggacttaccgatgccctgctttatgttattcaatctgccctcgggagtagcgagatagactccaaaaccgtggagaactgcgtgtgcatcttgcgaaacctgtcatacagacttgctgcggaaacttctcaagggcagcacatgggaacagatgaactggatgggctcctctgcggtgaagccaacgggaaagacgctgaaagctcgggctgctggggaaagaagaaaaagaagaaaaaaagccaggaccagtggtctgtgtacatcagagcagccgtgaggaaagagaaggggttaccaattttggtggagctgctgcggatcgataatgacagggtggtgtgtgccgttgcgactgcactgcggaatatggcgctcgacgtaaggaataaagagttgatcggtaaatatgcaatgagagatcttgttcacaggctacccggtgggaataattccaataacactgctagcaaggcgatgtccgacgatacagttactgcagtgtgctgtaccctgcacgaagtgataaccaagaatatggaaaacgccaaagcactccgagacgctggaggcattgaaaagctggttggcatctcaaagtcgaagggcgacaaacatagtcccaaggtggtcaaagcggcaagtcaggtactgaactctatgtggcaatacagagacctgagatccctgtataaaaaggatggctggagtcaatatcatttcgtagccagctcctcaaccattgagagagatagacaaaggccctacagcagttcacgcacaccttccatcagcccagttcgtgtgtcgcccaataaccgcagcgcctccgcacctgcttcacccagggagatgatttcgttaaaagagaggaagaccgattacgagtgcaccgggtccaatgcaacctaccacggcgccaagggcgagcacacgtccagaaaggatgcaatgactgcccagaatactggtattagcaccctctatcgcaattcatatggcgccccagctgaagacattaagcacaaccaggtgagcgcgcagcctgtcccccaggagccatcgcgaaaggactatgaaacgtaccagccatttcaaaattcaacgagaaattatgatgagtcctttttcgaagatcaggttcaccacaggcctcctgccagcgaatacaccatgcacctgggcctgaaaagcacagggaactatgtggacttttacagcgccgcacgcccttattccgagcttaattatgagacttcacactaccctgcgtcccccgatagttgggtgtag

SEQ ID NO: 181896 - DNA, 2379 bp, Artificial Sequence
  Description of Artificial Sequence: Synthetic coding sequence
atgcggagcctgagccagagccagggcgaccccctgccccccgcccacacaggcacctatagaacttcaacagccccgagctctcccggcgtcgactcggtgccactccaacgtacagggtcccagcacggtcctcagaatgccgcagcggccacattccagagggcaagctacgccgctggacctgccagtaactacgcggacccatatagacagttgcagtactgtccatctgtggagagtccctatagtaaaagtgggcccgcattgccgcctgaaggaaccctggcacgcagtcctagcatcgattccatccagaaggaccccagagaattcgggtggagagatcccgagctgccggaggtgatccagatgcttcagcatcaatttccaagcgtgcagtccaatgcggcagcatatcttcaacacctttgttttggcgacaacaaaatcaaagcagagatccggaggcaggggggaatccagctgctggtggatctgttggaccatcggatgacagaagtgcataggtctgcgtgcggcgcactcagaaaccttgtttatggaaaggccaacgacgataacaagattgctctgaagaactgcggaggcattcccgccctcgttagactgctccggaagactactgaccttgagatcagagagttagtaacaggggtcctatggaatctcagctcgtgtgacgccctaaagatgcccattatccaggacgctctagctgtcctaacaaacgccgtgattatccctcacagcggctgggaaaactcacccttgcaagatgatcggaaaatacaactgcactcatcccaggttctccggaacgctaccggatgcttgcgaaacgtgtcctctgccggagaggaggcccgcagaaggatgcgtgaatgcgatggcctaaccgatgccttactgtatgtcatacagagcgctctggggtcctccgagatcgacagtaaaactgttgagaactgtgtttgcatcctcaggaacctttcttaccggctggcagctgagaccagccaggggcagcacatgggcaccgatgaacttgatggcctgttgtgcggggaagccaatggcaaggatgcggaatccagcggttgctggggcaaaaaaaaaaaaaagaagaaatcacaagatcagtgggatggggtggggcccctgcccgattgcgccgagccccccaaaggcatccaaatgctctggcatccctcaattgtgaaaccctacctcactctgctcagtgagtgctccaatcctgatacgctggagggggcagccggagctctgcagaatctggccgctggttcgtggaagtggtctgtttatatccgcgcagctgtgagaaaagagaaggggctgccaatcttggttgagctcctgcgtatcgacaacgatcgcgtggtttgtgccgttgccaccgctctccgcaacatggccttggatgtacgcaacaaggaattgattggcaagtatgctatgcgcgacctggtgcaccgccttcctggcggcaacaactcaaacaacaccgcgtctaaggccatgtcggacgacactgtcaccgcggtctgttgcaccttacatgaggtgatcacaaagaatatggaaaatgctaaggctttgcgagacgctggagggatcgagaaacttgtgggtatatccaaatcaaaaggagacaaacatagcccgaaggttgtgaaggccgcctctcaggtcctgaactcaatgtggcaatatagggatctaaggtctctctataagaaagacgggtggtcgcagtaccacttcgttgcttcttcctcaaccattgagagagatcgtcagagaccctattcatcgtcacgtaccccctctatctctccagtacgagtatcacctaacaacagaagtgctagcgcacccgcctccccgcgagagatgatctcgttgaaagagcggaaaaccgactatgaatgcaccgggtccaacgccacatatcatggggcaaaaggagagcacacatcaagaaaggacgcaatgaccgctcagaacacaggcattagtacgctttatcgcaacagctatggtgcccccgccgaggacatcaaacataatcaggtgtccgcacagcctgtgccacaggagcccagccgaaaggattatgaaacataccaaccattccagaattccacaaggaattatgacgagtctttctttgaagaccaggtgcatcaccgtcctcccgcgagcgaatacaccatgcatctgggcctcaaatctactggcaactatgtggacttttactcagccgccagaccatattcagaactgaattacgagacttcccattatcccgcctcgccagattcatgggtctag

SEQ ID NO: 181897 - DNA, 2667 bp, Artificial Sequence
  Description of Artificial Sequence: Synthetic coding sequence
atgagcagcatgagcagcgccgaggagcagttccagtggcagagccaagacggacagaaagacattgaagacgaactcacaacggggctggaacttgtcgattcctgcattaggtctctgcaggaatccggaattctggacccacaggattatagcactggagaaactggaagccgggcttcatacagttctcaacatggacatctaggtcccgagctgcgggcacttcagagccctgagcatcacatcgatccaatttacgaggaccgggtctatcagaaacccccgatgcgcagcctgagccagagccagggggatcccctgcccccagctcatacaggaacatatcgaacttctactgccccatcatcccctggagtggacagtgtcccattgcagcgaacaggttcacaacacgggcctcagaacgccgccgccgccacatttcaaagagcctcatatgcagccggccctgcctcgaactatgctgatccctaccggcaattgcagtactgtccatccgtggaatctccttattccaagagtggacctgcgctaccccctgaaggtaccttagcacgcagtccttctatcgactcaattcagaaagatccccgcgagttcggatggcgcgaccctgagctgcccgaggtgatacagatgttgcagcaccagtttcccagcgtgcaatccaacgccgcggcctatctgcagcacctgtgcttcggagacaataagatcaaagcagaaatacgacgtcagggaggaattcagttgttagtggacctgcttgatcaccgcatgactgaagtgcaccgcagcgcctgtggggctctgaggaaccttgtttatggcaaggcaaatgacgacaataagatagctctgaaaaactgtggaggcatccccgccctggtgcggctcctgaggaaaactacagacctggaaatcagggagctggttactggcgtgctttggaacctgagttcctgcgatgcactaaagatgccaattatccaagatgctctcgccgtactgaccaacgctgtgatcatccctcattctggatgggaaaattccccccttcaggatgatagaaaaattcagctgcactcttctcaggttctaagaaacgcaaccgggtgcctgcgcaacgtatcaagcgccggagaggaggcgaggcgaagaatgagggaatgcgacggactaaccgacgcactgctgtacgtgatacagagtgcacttgggtcatcagagatcgatagtaaaaccgtggaaaattgtgtatgcattctaaggaatctgagctataggctcgcggccgaaacctcgcaaggccagcatatgggcacggatgagctcgatggattgctttgcggcgaagctaatggcaaagacgctgaaagcagcgggtgctggggtaagaagaagaaaaaaaagaagagtcaggatcagtgggatggggtcgggcccctgcccgactgcgccgaaccacctaagggaattcagatgctttggcacccatctattgtcaaaccgtatctcacacttctgtcagagtgctcaaacccagacaccttggagggagccgccggggcactgcagaacctcgcagctggcagttggaagtggtcggtgtacattcgagccgccgtccgcaaggaaaaaggcttaccaattctcgttgagttgctgcgtatagataatgatagggttgtgtgcgcagttgccacagcactgcgcaatatggcactcgacgtcagaaacaaagaactgatcgggaaatacgccatgagggatctggttcacagacttccaggcggaaacaattctaacaacacagcatctaaagcaatgagtgatgacacagtaacggcagtttgctgcactctgcacgaagtgattactaagaacatggaaaacgcaaaagctcttagagatgcgggtgggatcgaaaagttggtgggaatttcgaaatctaaaggagacaagcattcccctaaggtcgtgaaggcagcctctcaagtgctcaacagcatgtggcagtaccgcgatctgcgcagcctgtacaaaaaagacggttggtctcagtatcactttgtcgcaagtagcagcaccatcgaaagggatcgacagagaccatacagcagttcaaggactccctcgattagccccgtgagggtttcacccaacaatcgctcagcctccgcccccgcctccccaagggaaatgatcagcttgaaggaaagaaaaaccgactacgagtgtacaggctctaacgctacttatcatggagctaagggggagcataccagccgtaaggatgctatgacggcccagaataccggcatcagtacgctgtaccggaatagctacggagctcctgcagaagacattaagcacaaccaggtgtcagcacagcctgtccctcaagagcctagtaggaaggattacgaaacttaccagccatttcagaattcgaccaggaattatgacgagagcttttttgaagatcaggtccatcatcgtccaccagcctccgagtacactatgcatctgggtttgaagagcaccggcaactacgtcgacttttatagcgcagcccggccgtatagtgagctgaactacgaaacttcccactatccggcttcacccgattcctgggtgtag

SEQ ID NO: 181898 - DNA, 546 bp, Artificial Sequence
  Description of Artificial Sequence: Synthetic coding sequence
atgagcagcatgagcagcgccgaggagcagttccagtggcagagccaagatggccagaaagacatagaagacgaacttacaacaggacttgaacttgtagactcttgcattagatccctgcaggaaagcggcatccttgatccacaggactatagtaccggcgagcggccctctctactttcccaatctgccctgcagctgaatagcaaacccgaagggagcttccagtatccagcctcttaccactccaaccagaccctggccctcggcgagacgacaccctctcagttgcccgcccgaggcacacaagcgcgggccaccggtcagtcatttagccaggggacaactagccgcgcaggccaccttgccggacccgagccagctcccccgccccctcctcccccacgcgagccattcgctccttcgctggggtctgcctttcacttgcctgatgcaccacccgcagcagcagctgccgcattgtactactcatcaagtaccctccccgctccacctcgaggcgggagcccacttgctgcaccctag

SEQ ID NO: 181899 - DNA, 963 bp, Artificial Sequence
  Description of Artificial Sequence: Synthetic coding sequence
atgaccgtgtggtgcgccgtggccaccgccctgcggaacatggccctggatgtaagaaacaaggagttgatcggtaagtacgcaatgagggatctcgtgcataggctgcctgggggaaacaattctaacaataccgcatctaaggcaatgagcgatgatacagtgacggctgtgtgttgtacacttcatgaagtgatcacaaaaaatatggagaacgcgaaggcactcagagatgcaggaggcattgaaaaactggtaggaatcagcaagtctaagggggataaacacagtcccaaggttgtaaaggcggcaagccaggtgctgaatagcatgtggcagtaccgggatttacggagcctctataaaaaagatggttggtcccagtaccacttcgtggctagtagttctacgatcgaacgagaccgacaaagaccttacagctcatcacggactcctagcatctcacccgtgcgggtgagcccaaacaatcgttctgcctcagctcctgcatcccctagagagatgatcagcctgaaagaaaggaagacagattatgagtgtaccgggtcgaacgccacctaccacggggctaaaggtgaacacacatcaagaaaggatgctatgaccgcgcaaaacacaggtataagtacattgtaccgaaactcctatggggcccctgcagaagacataaagcataatcaggtaagtgcccaaccagttccacaagaaccttctcgaaaagattacgagacttatcagccattccagaacagcacccgaaattatgacgaaagcttctttgaagatcaggtacaccacagaccccctgcttccgagtatacgatgcacttgggcctgaagtccaccggaaactatgtagatttttactccgctgcgaggccttattcagagctgaactacgagacatcgcactatccagcaagccctgattcttgggtgtag

SEQ ID NO: 181900 - DNA, 246 bp, Artificial Sequence
  Description of Artificial Sequence: Synthetic coding sequence
atgaaccgggagggcgcccccggcaagagccccgaggagatgtacatccagcaaaaagtgcgcgtgctactcatgctgagaaagatgggctctaatctcacagccagtgaggaggaatttctgcgtacttacgccggtgttgtcaacagccaactttcccaacttccaccacactccattgaccagggtgctgaggacgtagtcatggccttcagcagaagcgagaccgaagatagacggcagtag

SEQ ID NO: 181901 - DNA, 246 bp, Artificial Sequence
  Description of Artificial Sequence: Synthetic coding sequence
atgaaccgggagggcgcccccggcaagagccccgaggagatgtacattcaacagaaggtaagggtgttacttatgctcaggaagatggggtcaaacttaaccgcatccgaagaggagtttctacggacatacgccggtgtggtgaatagccagctgtcacaattgcctccacatagtatcgatcagggtgccgaggatgtggtcatggctttcagtcggtcagagaccgaagatcgccgacagtag

SEQ ID NO: 181902 - DNA, 246 bp, Artificial Sequence
  Description of Artificial Sequence: Synthetic coding sequence
atgaaccgggagggcgcccccggcaagagccccgaggagatgtacatccaacagaaggtgagagtcctcctaatgctgagaaagatggggagcaacctgaccgcatccgaggaagagttcctgcgcacctatgctggcgtggtgaactcccagcttagccagctgcctcctcactcaatagaccagggggctgaggacgtggtgatggctttctctcgctccgaaacggaggaccgtcgacagtag

SEQ ID NO: 181903 - DNA, 246 bp, Artificial Sequence
  Description of Artificial Sequence: Synthetic coding sequence
atgaaccgggagggcgcccccggcaagagccccgaggagatgtacatccagcaaaaggtgagggtactgcttatgctgcgaaaaatgggtagtaatctcactgcttccgaggaagagttcctcagaacatacgccggtgtggttaactcccagctaagtcagctccccccgcattctattgatcaaggcgccgaggacgtcgtcatggctttcagcagatctgaaaccgaggatagacgccagtag

SEQ ID NO: 181904 - DNA, 246 bp, Artificial Sequence
  Description of Artificial Sequence: Synthetic coding sequence
atgaaccgggagggcgcccccggcaagagccccgaggagatgtacattcaacagaaagtgagggtactcttaatgctaagaaagatgggctccaacctcaccgcttccgaggaggagttcctgaggacctacgccggcgtcgtgaactctcagttatcacagcttcctccgcattcgatcgaccagggagctgaagatgtggttatggccttttctcgtagcgagaccgaagatagacgccagtag

SEQ ID NO: 181905 - DNA, 1692 bp, Artificial Sequence
  Description of Artificial Sequence: Synthetic coding sequence
atggacgtgggcgagctgctgagctaccagcccaaccggggcaccaaacgacctcgcgacgacgaggaggaggagcagaagatgcggagaaaacaaacaggcacgcgggaacgggggcgatacagagaggaagagatgacagttgtagaggaagcagacgatgacaaaaagaggctccttcagataattgatcgggatggtgaggaggaagaggaggaggaggaacccctcgatgagtctagcgtgaagaagatgatcttgaccttcgagaagaggtcctacaagaaccaggaactgcggattaagtttcctgacaatccagagaagtttatggagagtgagctggacttgaacgacattatccaggaaatgcacgtggtggccacaatgcctgacctatatcacctgctggtggagctgaatgccgttcaaagcctcctggggctactaggacatgataacaccgatgtgtccattgccgtagtggacttgttgcaagagctgacagacatcgatacactccatgagtccgaagaaggtgccgaggtgctcatcgacgcactggtagatggccaggtggttgctctcctggtgcagaacttagaacgactcgacgagtctgtcaaagaagaagcagatggagtgcataataccttggcaattgttgagaatatggccgaatttcggcctgagatgtgtacagagggcgcacaacaaggactactgcaatggcttcttaagagactcaaggccaaaatgccctttgacgccaacaagttgtactgttccgaagtgctcgcaatcttactacaggataatgatgagaatcgagaactcctgggggaattagacggcatagacgtgctcctccagcagctcagcgtcttcaagcggcataacccaagtaccgccgaggagcaggaaatgatggagaacctatttgactctctatgcagttgcctcatgctgagctctaacagagaacggttcctgaagggagaggggttacagctcatgaacctaatgttgagagagaaaaaaatcagtagatcctcagctttgaaggtactcgaccacgcgatgatcggccccgagggaaccgataactgccataaattcgtcgacattcttggcttgcgaaccattttcccactctttatgaaatcaccaaggaaaatcaaaaaggtcggcaccacagaaaaggagcatgaagagcacgtttgcagcatcttggcatctctccttaggaatctgcggggacaacagcgaaccaggctgttgaacaagttcaccgaaaacgactctgagaaggtcgataggttgatggaactgcacttcaaatatctaggagctatgcaagtggctgacaagaaaatcgaaggcgagaagcacgatatggtcagacgtggcgagattatcgacaatgatactgaggaagagttctatctgcggcgcctcgacgccgggctgttcgttttacagcacatctgctacatcatggccgagatttgcaacgcgaatgttccgcagattaggcagcgagttcaccagatcctgaacatgcggggttcttccattaagatcgtccggcacatcattaaagaatacgcagagaacattggagacgggagatcacccgagtttagagagaacgagcagaagaggattttgggcctactggaaaatttttag

SEQ ID NO: 181906 - DNA, 1611 bp, Artificial Sequence
  Description of Artificial Sequence: Synthetic coding sequence
atgcggcggaagcagaccggcacccgggagcggggccggtaccgggaggaagagatgaccgtggtggaggaagccgacgacgacaaaaagaggcttttgcaaattatcgacagagacggagaagaggaagaagaagaggaagagcccctggacgagagcagtgttaaaaaaatgatcttgaccttcgaaaagcggagctacaaaaatcaggaactgagaatcaagttccccgataacccagaaaagttcatggagtcagaactggatttgaatgatatcatccaagagatgcacgtggttgccacaatgcccgacttgtatcatctattggtggaattaaatgctgtccaaagtctgttgggcttactgggacacgacaacactgatgttagcattgcggttgtcgacctgctgcaggagttaacagatatcgacacactccatgagtccgaagagggggcggaggtgttgattgatgcgctggtggacggacaggtggtggctctgctcgttcagaacctggagcggcttgatgaatcagtgaaggaagaagctgacggggtgcataatacccttgcaatcgtggagaatatggcagagtttcgacccgagatgtgtaccgagggcgctcagcagggcctgctgcagtggctgctgaaaaggttgaaagcaaagatgccgttcgatgcaaataagctctattgctctgaggtcctggccattttgctgcaggataacgatgagaatcgtgaacttttaggtgagctggatggtattgacgtgttgcttcagcagttgtctgtttttaaaaggcataaccccagtactgctgaagagcaagaaatgatggaaaatctgttcgactccttgtgttcttgcctgatgctatctagcaacagggagcgctttctgaaaggagaggggctgcaactgatgaaccttatgttgcgggagaaaaagatttctcggtcatccgcactaaaggtcctcgaccacgcgatgatcgggcctgagggtaccgacaattgccacaagtttgtggacatcctaggactgaggacgatcttcccactcttcatgaaaagtccaaggaaaatcaagaaggtgggcactacagagaaggagcacgaagagcacgtctgttcaattttggctagcttactgagaaatctaagaggacagcaacggacacgtctgctgaacaagtttactgaaaacgattcagagaaagttgacaggctcatggaacttcactttaagtatctcggcgccatgcaggtcgcggataagaaaatcgagggtgaaaagcacgatatggtgaggaggggagaaattattgacaacgacacagaagaagagttctatctgagaagactggacgctgggttgtttgtgctacagcacatctgctacattatggccgaaatctgcaatgcgaatgtgccacaaatacggcaaagagtccatcagatcctgaacatgcgaggatcatctatcaaaatcgtgaggcacatcataaaggaatacgctgagaatattggtgacggacggtctcccgagttccgggaaaatgagcagaagcgcatccttgggctgctggaaaacttctag

SEQ ID NO: 181907 - DNA, 501 bp, Artificial Sequence
  Description of Artificial Sequence: Synthetic coding sequence
atgcggcggaagcagaccggcacccgggagcggggccggtaccgggaggaagaaatgaccgtggttgaggaagctgatgatgacaagaaaaggttgcttcaaatcatcgaccgagatggggaggaagaggaagaggaggaagagccgctggacgaaagcagcgttaaaaaaatgatcctgacatttgagaaacgctcctataagaatcaggaactccggatcaagttcccagacaaccccgaaaaattcatggaatccgagctggatctgaacgatataattcaggaaatgcatgtggtcgccaccatgcctgatctctatcaccttctggtagagctgaatgccgtccaaagcctacttggtctgctgggccatgacaatactgacgtgagcattgccgtggtagacctgctgcaggaactcacagacattgatacactgcacgagtctgaagaaggagctgaagtgctgattgacgcactcgtggatgggcaggtgtag

SEQ ID NO: 181908 - DNA, 1443 bp, Artificial Sequence
  Description of Artificial Sequence: Synthetic coding sequence
atgatccgggccgcccccccccccctgttcctgctgctgctgctgttgctgctcctggtgagctgggccagtaggggcgaggcagcccctgaccaggatgagatacagcgcctcccaggtctggccaaacagccctcctttcgacagtacagcggctatttgaaaggaagcgggagtaagcatttgcattattggttcgttgaaagtcagaaggacccagagaactcacccgtcgtcctgtggctaaacggcggccctggctgttcttcccttgacggcctcctcacggaacacggcccatttctcgttcagcctgatggggtcacccttgaatataacccatactcctggaatctcattgcaaatgtgctgtacttagagtcgccagccggggtgggattttcatacagtgatgacaagttctatgcgactaatgacactgaggtggcgcagagcaattttgaagcattgcaggatttctttcggctgtttcccgagtacaaaaataataagctgtttttaacaggagagtcttatgcaggcatctacatcccgacgctcgccgtgctcgtgatgcaggacccttccatgaatttgcagggactggccgtgggaaatggtctaagttcctacgagcagaatgataactccctggtctactttgcctactaccatgggcttctcgggaacagactgtggtcgagcctgcaaactcattgttgttcgcagaacaaatgcaatttctatgacaacaaggatctggaatgcgttacgaacttgcaagaagtggcaaggatcgtgggaaactcaggactcaatatctacaacctgtacgccccctgtgccggtggcgtcccctctcatttccgctacgagaaagatacagtggtcgttcaggacctaggcaatatctttaccaggctgcccttgaagagaatgtggcaccaggccctcttgcggtcaggcgacaaggtgcgcatggaccccccatgcactaataccacagccgcttccacctatctcaacaatccctatgttagaaaagcactgaatattccagagcagttgccccagtgggacatgtgcaatttcctcgtgaaccttcaatatcgccgcctgtacagatcaatgaactcacagtatttgaagctgctttcttcacagaaatatcagattctgctgtataatggcgatgttgatatggcctgtaatttcatgggcgacgagtggttcgtggactctcttaaccagaagatggaggtccaacgacgaccttggctggttaagtatggagactctggagagcagatcgcaggtttcgtgaaggagttcagccatatagcttttcttactatcaaaggggctggacacatggttccaacagataagccactggctgctttcacaatgtttagccgattcttgaataagcagccatactag

SEQ ID NO: 181909 - DNA, 1446 bp, Artificial Sequence
  Description of Artificial Sequence: Synthetic coding sequence
atgaccagcagcccccgggccccccccggcgagcagggccggggcggagcagaaatgatacgggccgctcccccgcctctatttttgctactactgctgttgcttctcctggtctcatgggctagcaggggagaggccgctcctgatcaggacgagatacagcggctgccaggccttgcaaagcaacctagttttaggcagtacagcggctacctgaaggggtctggaagcaagcatctgcattattggtttgttgagagccaaaaggatccagaaaacagcccagtggtgctgtggcttaatggcggccctggttgcagtagtctggatggacttcttacggaacacgggccctttctgattgccaacgtgctgtacctggagtccccagctggcgtcgggtttagttacagcgacgacaagttctatgccacaaatgacacagaggtagcccagtcaaatttcgaagccctgcaggactttttccgactatttccagaatataaaaataataaacttttcctgactggtgagtcgtacgctgggatctatatccctactctggcagttctggtgatgcaggacccatccatgaaccttcagggcttggcggtgggaaacggactgtcctcctatgaacagaatgataattcacttgtatacttcgcttactaccacggtttactcggcaataggttgtggagctccttacagacacactgctgctcccaaaataaatgcaacttctatgacaataaggacctagagtgcgtgaccaaccttcaagaggtcgccagaatcgtgggaaattcaggcttgaatatatataacctttatgcgccatgcgcggggggcgtgcctagtcattttagatacgaaaaagacaccgtggtagtccaggatctgggaaatatctttacccgcttacctcttaagcggatgtggcatcaggccctgctccgatccggcgataaggtccggatggatcctccatgcacaaatacaacagctgcaagcacatatctcaacaatccatatgtccgtaaagcgctgaatattccagaacagctgcctcagtgggatatgtgtaactttcttgtcaacctccaatatcgtcgtttgtatagatccatgaactcacagtacctcaagctcctgtccagtcagaaatatcaaattctgctttacaacggcgatgtggatatggcctgtaacttcatgggagatgagtggtttgtggattcactgaaccagaaaatggaagtccagagaaggccatggctggtaaagtacggggattcgggggagcagattgccggattcgtcaaggagttctcacatattgcattcctcacaataaaaggcgccgggcacatggtaccaaccgacaaacctttggcagcgttcaccatgttttcaaggttccttaacaagcagccctactag

SEQ ID NO: 181910 - DNA, 870 bp, Artificial Sequence
  Description of Artificial Sequence: Synthetic coding sequence
atgatccgggccgcccccccccccctgttcctgctgctgctgctgctcctgcttttggttagttgggcctctaggggcgaggccgccccggatcaagatgagatccagcggttacctgggctcgctaagcagccaagcttccgccagtacagtggctatttaaagggctccggcagcaaacacctgcactactggttcgtggagtcgcaaaaggatccagaaaactctcccgtggttctctggctgaacggaggcccaggatgctcatccttagacggactcctgacagaacatggaccatttctggtacaaccggacggcgttactctcgagtataatccatactcttggaatctcatcgccaatgtactgtacctcgaaagccccgctggcgttgggtttagctattccgacgacaagttctacgctaccaacgacactgaggttgctcagagcaatttcgaggctctgcaagacttttttagacttttccctgaatataaaaacaacaagctgttcctcacaggcgagtcatatgcgggtatttacattccaaccttggccgtgttagttatgcaggatccctccatgaacctgcaagggctcgctgtggggaatggtctgtctagttatgagcagaacgataactccctggtgtacttcgcctattatcatggactgctgggaaacaggctctggtcatctcttcaaactcattgttgcagtcaaaacaagtgcaacttctacgacaataaagacctggaatgtgtcacgaatttgcaggaggtggcacgcattgtggggaactcaggtttgaacatctacaatctctatgccccttgtgccgggggggtgccatcacatttttag

SEQ ID NO: 181911 - DNA, 1497 bp, Artificial Sequence
  Description of Artificial Sequence: Synthetic coding sequence
atgaccagcagcccccgggccccccccggcgagcagggccggggcggcgctgaaatgattcgggcagcccctccgccgctttttctcttgctgctactgctgcttctgctggtctcgtgggccagcagaggggaggccgccccagatcaggatgagatccagaggctgcccggtcttgctaagcagcccagcttcaggcaatatagcgggtacctgaaaggaagcggatccaaacacctgcattactggttcgtggaatcccagaaagatccggagaactcccccgtggtactctggcttaacggcgggccaggttgctcctccctggacggcctgctaaccgagcatggtccgtttctggtgcaacccgacggagtgacactcgagtataatccttattcctggaatctgatcgccaacgtgctgtacctagaaagcccagctggagtggggtttagttacagtgacgataagttctacgccacaaatgatactgaggtggcccagagcaattttgaggcattgcaagacttttttcggttattcccagagtataagaacaataaactgttcctcacgggtgagagttacgctgggatatacattccaaccctcgccgtgctggttatgcaggaccccagcatgaatctgcagggtctggctgtcgggaacggactgtcatcttatgaacagaacgacaactccttggtgtatttcgcttactaccatggtctgcttggaaataggttgtggagttctttgcagacccattgttgcagtcaaaataaatgtaacttttatgataataaagatctagagtgcgtgacaaatttgcaggaagtggctcgaatcgtaggcaactctggcctcaacatatacaatctgtacgccccatgtgctgggggcgttccttctcactttcgatatgaaaaagataccgtcgtcgtccaggatttgggtaacattttcacgaggctgccactgaaacggatgtggcatcaggccctactccggtctggcgataaggttcgcatggaccccccttgcactaacactacagccgcatctacttacttaaacaatccttatgttcgcaaagcactgaatatcccggaacagctaccccagtgggacatgtgcaacttcctggtgaacttacagtacaggagactctatcgcagcatgaattctcaatacctcaaattgttatcatctcagaagtaccagatacttttgtataatggagatgtggacatggcctgcaatttcatgggcgacgagtggtttgtggattccctgaatcagaagatggaggtgcagcggcgtccttggctcgtgaaatacggcgacagtggggaacagattgcaggctttgtgaaagaattttcgcacatcgctttcctgacaattaagggcgccggtcatatggtgccaaccgataagcccctcgcagcttttaccatgtttagcaggttcctcaataaacaaccttattag

SEQ ID NO: 181912 - DNA, 1038 bp, Artificial Sequence
  Description of Artificial Sequence: Synthetic coding sequence
atgatccgggccgcccccccccccctgttcctgctgctgctgctgcttcttttgctggtgtcttgggcaagcaggggcgaggctgccccggatcaggatgagattcagcgcctcccgggtctagcaaagcagccctccttccggcagtattctgggtatcttaaggggagtgggtcgaaacatctccattattggttcgtggaaagtcagaaggatccagagaactcccccgtggtcttgtggttgaacggcgggcctggctgcagcagccttgacggcctgttgaccgagcatggcccctttctaatcgccaacgttctctacttagaatccccagcgggcgtagggttttcctactcagatgataaattctacgccactaacgataccgaggttgcgcagtccaattttgaagcactgcaagatttctttaggttatttcccgaatacaagaataacaagctttttctgaccggcgagtcatacgcaggaatttatatccccactctggctgtgcttgtgatgcaggatccctctatgaatctacaggggctggccgtgggtaatggactcagcagctacgaacagaacgacaacagcctcgtgtatttcgcatactaccacggtcttctgggcaatcgactgtggtcgtctttgcagacacattgctgcagtcagaataagtgtaatttttacgataataaggatctggaatgtgtcaccaacctccaggaagtagcccggatcgttgggaatagtggtcttaatatctacaatctgtacgcgccctgcgcaggcggagtgccctctcattttcgctacgaaaaagataccgtggttgttcaagatctgggaaacattttcactagactgccgctaaagcggatgtggcatcaggcactgctgagatctggggacaaggttcggatggacccaccatgcactaacaccactgcagccagcacttacctcaacaatccatatgtcagaaaagcgctaaacattcccgaacagctcccacaatgggacatgtgctag

SEQ ID NO: 181913 - DNA, 1149 bp, Artificial Sequence
  Description of Artificial Sequence: Synthetic coding sequence
atgatgttccccggcctgctggccccccccgccggctaccccagccttctgcgaccgactccaaccctgacattaccccaatcgctccagtctgccttctcgggccacagctcatttttggtggaggacctgatcagaatcagccgaccccccgcttaccttcctaggtcagtcccaacggcaagcatgtcgccccctcgtcaaggcgcgcccacagccttaaccgatacaggtgcttctgacctgggcagccccggacccggctctcgacgaggcggatcccctcctacagccttttctccagcatctgagaccaccttcctgaaattcggggtgaacgccatcctgagcagtggccctaggacagagacgagccctgccctcctacagtccgtgcctccgaaaacgtttgcttttccctactttgaaggttcctttcagccattcatccgcagctcttactttcctgctagttcttccgttgtgccaattcccggcacgttttcttggcccctggccgcccgcgggaagcctcgcaggggtatgctgcgacgggcggtgttttcagacgtgcaacgcaaggcccttgagaagatgttccagaaacaaaaatatatcagcaagccagacaggaagaaattggctgccaagctaggattaaaggactctcaggatactgcaaggaggaccgagcccgcccccgatagtacccctagaccaagggcctctccaggtgcccccgatctgacctctgccagcccctttttttcgcccgcaggaacattccaggtaaagatctggtttcagaataggagaatgaagtggaggaactcaaaggagagggaattgcttagttctggtggatgcagggaacagacgttacccactaagcttaatccacatcctgacctcagtgacgtggggcagaagggcccagggaatgaagaggaggaagagggacctggatctccttcacacagactggcgtatcacgcttcctccgatccacagcacctcagagatccccgtctgccaggtcccctaccaccatcccccgcccacagctcatcgcctggaaagccgtccgatttctcagactctgaggaagaggaggagggggaagagcaggaagagatcaccgtatcttag

SEQ ID NO: 181914 - DNA, 1341 bp, Artificial Sequence
  Description of Artificial Sequence: Synthetic coding sequence
atgggcgccggccccagctgcgacacccccgccaactgcacctaccttgatctcctggggacctgggtgtttcaagtaggatcatccggaagccagagggatgtcaactgttcagtgatgggcccacaggagaagaaagttgtggtgtatcttcagaaactcgatacggcatatgatgacctaggtaatagcgggcatttcacgattatttataatcagggctttgaaatcgttttgaatgattataaatggttcgccttctttaagtataaagaggagggcagcaaggtcaccacatattgcaacgagacgatgactgggtgggtgcacgatgtgcttggccgcaattgggcatgttttacgggtaaaaaagttggtacggcttcagaaaacgtgtatgtcaacatagcccacctgaagaattcccaggaaaagtatagtaatcggctctacaagtatgaccataattttgtgaaagccattaatgcaatccagaaatcttggaccgcaaccacctacatggagtacgaaaccttgaccctgggcgatatgattagaagatcaggcggccactccagaaagatccctcggcccaaacccgctccgctgacagccgaaattcagcaaaagatcctacatctgccaactagttgggactggagaaatgtgcacgggatcaattttgtgtcgcctgtccgcaatcaggctagttgtggctcctgctatagtttcgccagcatggggatgctggaggctcgcatcaggattctcactaacaacagccagacccctattttaagcccacaagaagtcgtctcttgctcccagtacgcgcagggttgcgagggtggtttcccctatctgatcgcgggcaaatatgctcaggatttcgggctggttgaggaagcttgtttcccatacacgggcacagacagcccgtgtaagatgaaagaagattgttttcgatattattcttctgagtaccattatgtcggtggattctatggaggttgcaatgaagctctaatgaagcttgagttagtgcaccacggtccgatggccgtggccttcgaggtttatgacgacttcctgcactataagaagggcatttatcaccacactggactacgagatccttttaatcccttcgaattgacaaaccatgcagttttgctggtggggtacggaacagatagcgcctctggaatggattactggatcgtaaaaaactcttggggaactggatggggtgaaaatggatacttcaggattaggagggggacagacgagtgtgctattgagtcaatagccgttgcggccactccaatcccaaagctgtag

SEQ ID NO: 181915 - DNA, 414 bp, Artificial Sequence
  Description of Artificial Sequence: Synthetic coding sequence
atgggcgccggccccagcctgctgctggccgccctgctgctgctgctctccggagacggggccgtgagatgtgatacccctgctaattgcacttaccttgatctcctcggtacatgggtgtttcaagtgggttcctccgggtcacagcgggacgtaaattgttcggtgatgggcccgcaagaaaagaaagtcgtggtgtatctccaaaagctagacaccgcatacgatgacctaggaaacagcggacacttcactatcatatacaaccagggattcgaaattgttctgaacgattacaagtggtttgctttcttcaaagacgtgacagatttcatcagccacctttttatgcaactgggcaccgtcggcatttatgacctgccacacctgcgtaataaactggtgatcaaatag

SEQ ID NO: 181916 - DNA, 426 bp, Artificial Sequence
  Description of Artificial Sequence: Synthetic coding sequence
atgggcgccggccccagcctgctgctggccgccctgctgctgctgctgtccggagacggagcagttcgctgtgatacgccagccaactgcacatacctagatctgcttgggacctgggtgtttcaggttggctccagcgggtcgcagagggacgtgaactgcagcgtcatgggcccgcaggagaaaaaggttgtggtctatttgcagaaattggacacggcttacgatgatctggggaattccggacacttcacaataatttataaccagggattcgaaatcgtgcttaatgattacaagtggttcgcattttttaaagatgtcactgactttatttcacacttatttatgcagcttggcacggtcgggatttacgacctccctcatctgcgcaacaaacttgccatgaatcgcagatggggatag

SEQ ID NO: 181917 - DNA, 1191 bp, Artificial Sequence
  Description of Artificial Sequence: Synthetic coding sequence
atgaagaccctgctgctgctgctgctggtgctgctggagctgggcgaggctcagggatcccttcatagagttcctcttcggaggcacccatccctgaagaaaaagttgcgcgctcggagccagttgtcagagttttggaagagccacaatttggacatgatacaattcacggagagctgctccatggatcagtcagccaaagagccactgatcaactacttggacatggagtatttcggcactataagtataggttccccccctcagaacttcaccgttatcttcgatactggatcatccaacctatgggtgccgtccgtatactgcacttcccccgcatgtaagacacactcgagatttcaacccagccagagctctacctatagccagccagggcagagctttagcatccaatatggaaccggaagtcttagcggtattattggagctgaccaggtgtcagtagagggactgacggtggtcggccagcagtttggggagtcggtaactgagcccggacaaaccttcgtagatgctgagtttgacggaatccttggtcttggttacccttcgctggccgtgggcggcgtaaccccagtttttgacaacatgatggcacagaacttggtcgatcttccaatgttctctgtctacatgagcagtaatcccgagggtggggccggctctgaactgatattcggcggctacgaccactcccatttctctgggagcttgaactgggtgcctgtgaccaagcaggcttactggcagatcgcactggacaatatacaagtgggtggcactgtgatgttttgttcagaggggtgtcaggccatagtggacacggggacgtcactcattaccgggcccagtgacaagattaaacaattgcaaaacgctattggagccgcacccgtggacggagaatatgcagtggagtgtgccaatctaaatgttatgcctgatgtgacctttaccataaacggagtaccctacacattgtcgcccacagcctacacattgcttgattttgtcgatggtatgcagttctgttcatccgggtttcagggcctggatatccaccctccagcagggccattatggattctgggcgacgtcttcattcgccagttttactctgtttttgatcggggaaataatagagtgggactcgcacccgctgtgccctag

SEQ ID NO: 181918 - DNA, 1092 bp, Artificial Sequence
  Description of Artificial Sequence: Synthetic coding sequence
atgaagaccctgctgctgctgctgctggtgctgctggagctgggcgaggctcagggaagcttacaccgcgtccctcttcgccggcacccctccctgaaaaaaaagctgcgagcaaggtctcagctctctgagttttggaagtcccataatctggatatgattcaatttacagaatcctgttcaatggatcagagtgccaaggaaccgctgattaattacctggacatggagtatttcggaacaatctccattggatctcctccgcagaacttcactgttatcttcgataccgggagcagcaacctttgggtcccttccgtttattgcacctctccagcgtgtaaaacacactcccgattccaaccatcccagagcagcacctatagtcagcccggccagagctttagcattcaatacggcacgggctcattgtctgggatcattggtgctgaccaagtcagcgtcgagggattaacggtggtgggtcaacaattcggcgagagcgtgactgagccgggccagacttttgtcgacgctgagttcgatggtatcctagggcttggctatcctagcctcgctgtgggcggtgtgacacctgtgttcgacaatatgatggctcagaaccttgtggacctgcccatgttcagtgtctacatgagttcaaacccggagggcggagctggatccgagctgatctttgggggatatgatcacagtcatttctcagggtcgctgaattgggtgcccgtgacgaagcaggcttattggcagattgcattagataacatgctgtggtctgttcccacattgacttcttgccgcatgtcaccctcacctcttacagagtcaccaattccatccgcccagctgcctactccctactggacctcatggatggagtgcagctccgcggccgtggcctttaaggatctgacatccactctgcaattaggcccctccgggagttgggggatgtcaagctttgacagtttcactcaatccctaacagtcggtataaccgtctgggattggccccagcagtcccctaaggagggaccttgcgtctgtgcctgtttgtctgacagaccctag

SEQ ID NO: 181919 - DNA, 1206 bp, Artificial Sequence
  Description of Artificial Sequence: Synthetic coding sequence
atgaagaccctgctgctgctgctgctggtgctgctggagctgggcgaggcccagggatctttgcaccgggttcctctgcgtaggcacccaagcttgaagaaaaagctgcgggcccgctcacagctttctgagttctggaaatctcataatctcgatatgatacaatttactgaaagctgcagcatggatcagagcgccaaggaacccctgattaattatctcgacatggagtacttcggaaccatatccattgggtctccaccccagaactttactgttatcttcgacaccggctctagtaacctgtgggtaccaagtgtgtattgcaccagccctgcctgcaaaactcacagtagatttcaaccgtcccagagcagcacctactcccagccagggcaaagcttttccatccaatatggaactggctcattatctggaataattggcgcagaccaagtgagcgccttctcctatcaggtggagggcctgacagttgtggggcagcagtttggtgaaagcgtcactgagccagggcagactttcgtggatgctgagttcgacggcattcttggcctgggctacccatcactggcggtcggcggagtgacccctgtgttcgacaacatgatggcacagaatctggtcgaccttccaatgttcagtgtgtacatgagtagtaatcccgagggcggggccggctctgagctgatttttggcggttacgaccatagccactttagcggctcactgaactgggtaccagtcaccaaacaggcatactggcaaattgcactggacaacattcaggtcggtggaacagttatgttctgttcagaagggtgccaggccatcgtggacactggaacatcacttatcacaggaccaagcgataaaattaagcagcttcagaacgctattggcgccgcgcctgttgacggggagtatgccgtcgagtgcgcgaatttgaacgtgatgcctgatgtgacgttcacaatcaacggggtgccttacactctctctccaaccgcatataccctgctggactttgtcgatgggatgcagttctgctctagcggattccaaggattagacattcatcctcctgccgggcctctgtggatcctgggagacgtatttatccgccagttctacagcgtgttcgaccgcggaaataacagggtaggcttggcaccagctgtcccatag

SEQ ID NO: 181920 - DNA, 867 bp, Artificial Sequence
  Description of Artificial Sequence: Synthetic coding sequence
atggagtacttcggcaccatcagcatcggcagccccccccagaactttaccgttatcttcgacaccggatcttccaacctgtgggtaccaagcgtgtactgcacatcccccgcctgtaagactcattcgagattccagcctagtcagtcttcaacatactctcaacctgggcagtcattctcaattcagtacggaacagggagtctgtccggaataatcggggccgatcaggtgtccgtcgagggcctgaccgtggtgggacagcagtttggggaatccgtgactgagccaggacagacttttgtggatgctgagtttgacggcatcctgggtctgggttatccttccttggctgtcggtggcgtgacccctgtgttcgacaatatgatggctcagaacttagtcgacctgcccatgttttctgtttacatgtccagcaatcctgaaggcggggctgggagtgaattgatttttgggggctacgatcactctcacttttccggatcactgaactgggtacctgttacgaagcaggcttattggcaaatcgccttagataacatgctttggtccgtgcctactctcacatcttgccgaatgagtccatccccgctgactgagagcccaataccgagcgctcagcttcccaccccttattggacctcttggatggagtgcagttcagctgctgtagcttttaaagacttaacgagcactctccagctggggcctagtggcagttggggcatgtcttcattcgatagctttacccaatctctaaccgtcggtatcaccgtgtgggactggcctcagcaaagtccgaaggagggcccctgcgtctgtgcctgcctgagcgacagaccatag

SEQ ID NO: 181921 - DNA, 1455 bp, Artificial Sequence
  Description of Artificial Sequence: Synthetic coding sequence
atggccccctggctgcagctgctgagcctgctgggcctgctgcccggggcagtggctgcccccgctcagcccagggctgcatcatttcaggcgtgggggccgccaagccctgaactgttggctcctactcgattcgccctggaaatgttcaatagaggccgcgccgcagggacccgcgctgtgctcggcctggttcgaggaagagtaagacgggcaggtcagggatctctttatagccttgaggccacactcgaggaacccccttgcaatgatcccatggtgtgtcggctgccggtgtcaaagaagactcttctctgttcctttcaggtgctcgatgaattaggacggcatgtgctcttgaggaaagactgtggcccagtggataccaaggtccccggcgctggcgaacccaaatcagccttcactcagggttccgccatgatttcttcactctctcagaatcacccagataaccggaacgagactttcagcagtgtgatttcactgttgaacgaagatcctctgtcccaagacttgccggtcaaaatggccagtatattcaagaacttcgttattacatacaatcggacgtatgagtccaaagaggaggcccgctggagactctctgttttcgttaacaatatggtcagagcccagaagattcaagccctggacagaggcactgcacagtatggggtgacaaagttctctgaccttacagaggaagagttccggacgatctatcttaatacactgctgaggaaagagcctggtaacaagatgaagcaggccaagagcgttggtgatctggcccctccagaatgggactggcggagtaagggagccgtgactaaggtgaaggaccaagggatgtgcggatcttgctgggccttttcagtgaccggcaatgtggaaggccaatggttcctgaaccaaggaaccctgctcagcttatccgagcaggagttgctggactgcgataaaatggacaaggcttgtatgggcggacttcctagcaacgcctattcggcaatcaagaacctgggcggcttggagactgaggatgattattcttaccaggggcatatgcagtcctgcaatttcagcgccgaaaaagctaaagtatacatcaacgattccgtggagttaagtcaaaatgagcagaaactcgccgcctggctggcaaagaggggccccattagcgtggccattaatgcctttggtatgcagttctaccggcacggaatttccagacccttgaggcccctctgcagcccatggctcatcgaccatgctgtgctgcttgtgggttatggcaacaggagcgatgtgccattctgggctatcaagaactcatgggggaccgactggggggaaaagggttactattacctgcacagagggagcggagcatgtggagtcaatacgatggcatcatctgctgtcgtggattag

SEQ ID NO: 181922 - DNA, 675 bp, Artificial Sequence
  Description of Artificial Sequence: Synthetic coding sequence
atggccgccgccgtgccccagcgggcctggaccgtggagcagctgagatccgagcaattacccaagaaggatatcataaagttcctgcaggagcatggatccgacagtttcctggcagagcacaaactgctcgggaatataaagaacgtggcgaagactgccaataaggaccatctggtaaccgcttataaccacctcttcgagaccaagagatttaagggtaccgagagcattagtaaggtgagtgagcaggtgaagaatgtcaagttaaatgaggacaagccgaaagaaacgaaatccgaggagaccctggatgagggcccgcccaagtacactaagtccgtgttgaagaagggcgataaaacaaacttccccaagaagggagatgtggtgcattgctggtatacaggcacgctccaggacggcacagtattcgacaccaacatccaaaccagcgccaagaaaaagaagaacgctaaacccctgtccttcaaggtgggagtgggaaaggttatccggggctgggacgaagctttgctgacgatgtccaaaggcgaaaaggcccgattagaaatcgaaccggagtgggcatatgggaaaaaagggcagcctgatgccaaaattcctccgaacgccaagctcacatttgaggtggaattggtggacatcgattag

SEQ ID NO: 181923 - DNA, 801 bp, Artificial Sequence
  Description of Artificial Sequence: Synthetic coding sequence
atgagcagcgtgttcggcaagccccgggccggcagcggcccccagtctgcccctttggaggtcaacttggccattttagggcgcaggggagccgggaaaagtgctctcactgtcaagtttctcacgaagagattcatcagcgagtacgaccccaacctcgaagatacgtacagcagtgaggagactgtcgatcaccaaccagtccacctccgggtcatggatacagcagatctggacactcctcgaaactgtgaaagatacttaaattgggcccatgcttttctcgttgtatattctgtcgacagccgacagtccttcgactccagctcttcttacttggagctacttgccctgcacgccaaagagacacagaggagtattccagctctcctcctgggcaataagctggacatggcccagtacaggcaggtgacaaaagcggagggggtcgctttggctggtagatttggttgtctcttctttgaagtatctgcctgtttagatttcgagcacgtccagcatgtgttccatgaggctgtacgggaggcccgcagagagctggagaagagcccccttacccgacctttgtttataagcgaggagagggctctgccacatcaggcaccactcacagcaaggcatggactggcctcctgcaccttcaatacgcttagcaccataaatttgaaggaaatgcccactgtggcacaggctaaactcgtcaccgtaaaatccagcagagcacagtccaaaaggaaagcccccaccctgacgcttctcaaagggtttaagatcttctag

SEQ ID NO: 181924 - DNA, 972 bp, Artificial Sequence
  Description of Artificial Sequence: Synthetic coding sequence
atgtgggccaccctgcccctgctgtgcgccgccgagctgtgcgtgaatagtctagaaaaatttcattttaagtcatggatgtcaaaacaccgaaagacatattcaaccgaggaataccaccatcgcctgcaaactttcgcttctaattggcgcaaaatcaacgcccacaataatggcaatcatacgttcaaaatggcccttaatcagttttcagacatgagcttcgccgagattaagcacaagtacctgtggtccgaaccgcagaactgtagcgcaacaaagtctaactatttaaggggaaccggaccttacccgcctagcgtcgactggcggaagaagggaaactttgttagccctgtcaagaatcagggagcttgtgggagctgctggaccttttcgacaactggcgctcttgagtctgctatagcaattgcaaccggcaagatgctttccttggcggagcaacaactcgtagactgcgcacaggatttcaacaatcatggctgccagggaggcctgccctcccaagcgtttgaatatatcctgtacaacaagggtataatgggcgaggacacgtacccttaccaagggaaagacggctactgtaagtttcagccggggaaagccattgggttcgtgaaggatgtggctaacataacgatctacgatgaagaggcgatggtcgaagctgttgccctgtacaaccccgtgtcctttgcttttgaggtgactcaggacttcatgatgtatcgcaccggaatctattcctcaacaagctgccacaaaacacctgacaaggttaaccacgcggtcctggcagtcggatatggtgagaaaaacgggattccatattggatcgtgaaaaacagctgggggccccaatggggtatgaatggctactttctgattgaacgcggaaagaacatgtgcggattggctgcctgcgccagctatccgatcccacttgtgtag

SEQ ID NO: 181925 - DNA, 621 bp, Artificial Sequence
  Description of Artificial Sequence: Synthetic coding sequence
atgtgggccaccctgcccctgctgtgcgccggcgcctggctgctgggggttccagtatgtggggctgcagaactgtgtgttaactcattggaaaagtttcacttcaagagttggatgtctaagcatcgcaagacctacagcactgaggagtatcaccaccggctacagaccttcgcctccaactggcggaaaatcaatgcccataacaacggaaaccacacatttaagatggcactgaatcagttctcggacatgagttttgccgagatcaagcacaaatatctctggtcagagccacagaactgttcagctaccaagtcgaactacctgcgcgggaccggaccctacccaccctcagtggactggaggaaaaaagggaatttcgtgtctccggtgaagaaccaagtatgcttagccattagtattctctcactgcagaatggccataccccacgccaatatacacggaaaaacaattccaaaggtcctcagaaccaccacaaacacatcccagcgtctgtttcctcccggcatctgagccccggcagaccctcactccctcagctcagagaaatctgcgagggcaaacgcctcggagaggcctcggtcaatttgggatag

SEQ ID NO: 181926 - DNA, 990 bp, Artificial Sequence
  Description of Artificial Sequence: Synthetic coding sequence
atgtggggcctgaaggtgctgctgctgcccgtggtgagcttcgccttgtaccccgaagaaattttggacacgcactgggagctgtggaaaaagacccacaggaaacaatataataacaaggtggatgagatctcaaggcgacttatatgggagaagaacctgaagtacatctccatacataatctcgaagcctcactaggggtgcacacttacgagctagctatgaatcatctcggggacatgacctctgaggaggtggtgcaaaagatgaccggcctcaaggttccacttagtcacagccggtctaacgatactctgtacatacctgagtgggagggtagggcacccgattcggtcgactatcgtaagaagggttacgtgacacctgttaaaaaccaaggccaatgtggatcctgttgggcttttagtagtgtgggtgcactcgagggccagcttaaaaaaaagactggaaaactgctgaacttgtctccacagaacctggtggattgcgtgtcagaaaatgatggctgcggcggtggatacatgacaaatgcattccagtatgtccagaagaaccgaggcattgattccgaggacgcgtacccttatgtcggccaggaagaatcttgtatgtataacccaacaggcaaagccgctaagtgccgcgggtatcgcgagatcccagagggcaatgagaaggcccttaaacgtgcagtagctagagtcggtcccgtttctgtcgcgatcgatgcaagcttgacttcgttccagttctacagcaaaggagtgtactatgacgaaagctgtaattcggacaatctgaatcacgccgtcctggccgttgggtacggcattcaaaagggaaataaacactggatcatcaagaattcatggggggagaactgggggaataagggctatatattaatggcgcggaacaagaacaacgcatgcggaattgccaaccttgccagctttccaaaaatgtag

SEQ ID NO: 181927 - DNA, 777 bp, Artificial Sequence
  Description of Artificial Sequence: Synthetic coding sequence
atgcacaaggagaacgaggagatctacaacgtgagcgagaaccggaaacactgccctatatttccatgtcccctgctgactaggagtggaaaagtacctgagttcaggcatgaacgcgaggaacgccttgaggaaatgatcaggcgacagaatctcgacgggaacttgtcatttgttatgtgggggctaaaagtcctgctgcttccggttgtgtcttttgcactctacccagaggaaatcctggacacgcactgggagctgtggaaaaagacgcataggaagcaatacaataacaaagtagatgaaatatcccgcaggttgatatgggagaaaaacctcaagtatatatctattcacaatttggaagccagcctcggcgtacacacctatgagctcgcgatgaaccacctgggagacatgacatccgaggaggtagttcagaagatgactggcctgaaggtccctctgtcccacagtcgctcaaacgatactctgtatattcctgagtgggagggtcgtgcccctgattcagttgattaccggaaaaagggctacgttactccagtgaaaaatcaaggtcaatgcggatcttgttgggcctttagttccgtgggagctcttgaaggtcagcttaagaagaagactggcaagctgttaaacctgtcgcctcagaatttggtagattgcgtctccgagaatgacggttgtggaggggggtacatgaccaatgccttccagtatgtgcagaaaaatcgaggaattgacagtgaggactag

SEQ ID NO: 181928 - DNA, 1005 bp, Artificial Sequence
  Description of Artificial Sequence: Synthetic coding sequence
atgaacctgagcctggtgctggccgccttctgcctgggcatcgcctcagcagtgccgaaattcgaccagaacctagatactaagtggtatcagtggaaagctacacatcgacgcctctatggggcaaatgaggaagggtggagaagagccgtctgggaaaaaaacatgaagatgatcgaactgcacaatggagaatattcccaaggaaagcatggcttcaccatggcaatgaacgcctttggagacatgaccaatgaagagttccgccagatgatgggctgtttcagaaaccagaaatttcgcaaaggcaaagtattccgggagccacttttccttgacctgccaaagtctgtggactggcggaagaagggatacgtgaccccagtaaaaaatcagaaacaatgcggttcatgctgggcatttagcgctactggcgcactggaaggccaaatgttcaggaagaccggcaagctggtgtccctttctgaacagaacctggtggattgtagtagaccccaggggaatcagggttgcaatggcgggttcatggccagagcattccaatatgtgaaggaaaacggtgggctggactccgaagaaagttacccctatgttgccgtggacgagatctgtaagtaccgtcccgaaaactctgtggcaaatgacaccggattcactgtggttgccccagggaaagagaaagcactgatgaaagcggtggccaccgtaggccccatttcagtggcgatggacgccggacattcatcatttcagttctataagtccgggatctacttcgaaccagactgctcatctaaaaacttagatcacggcgtattggtcgtgggatatggtttcgagggcgccaactcaaacaacagtaagtattggctggtaaagaatagctggggtcccgaatggggttccaatggatatgttaagatagccaaggataagaacaatcactgtgggatcgctacagcagcttcctaccctaatgtgtag

SEQ ID NO: 181929 - DNA, 1005 bp, Artificial Sequence
  Description of Artificial Sequence: Synthetic coding sequence
atgaacctgagcctggtgctggccgccttctgcctgggcatcgcctcagcggtgcctaagtttgaccaaaacctggatactaagtggtatcagtggaaagcaacccataggagactatacggagctaacgaagagggatggcgtagggcggtctgggaaaagaacatgaagatgattgagctacacaacggcgagtactcacagggtaaacatggatttaccatggcgatgaatgcctttggagacatgaccaacgaggagtttaggcagatgatgggatgctttcggaatcagaaatttagaaaaggtaaggtctttagggaacctctgttcctggatctgcctaaaagcgtggactggcgaaagaagggctacgtaaccccggtgaaaaaccagaagcaatgcggctcatgctgggctttcagtgctactggagctctggaaggccagatgtttaggaaaactggtaagctcgtgtctctgtcggagcagaacctggtcgactgctcccgccctcagggcaatcagggatgcaacggaggcttcatggcgagggccttccaatatgttaaagagaatggtggactggattcggaagaatcctatccttatgtggcagtagatgagatttgtaagtacaggccagaaaattctgtggctaatgataccggtttcaccgtcgttgccccagggaaagagaaggcccttatgaaggccgtcgctaccgtcggcccaatctccgtagcgatggatgctgggcacagttcttttcaattctataagagtggcatatacttcgaacctgattgcagctccaagaatcttgaccacggcgtgttggtagtaggttatggcttcgagggggctaactctaacaatagcaagtactggctggtaaagaattcctggggacctgaatggggcagcaatggttatgtgaagattgcaaaagacaaaaataatcattgtggcatcgcaaccgccgcaagttaccctaacgtctag

SEQ ID NO: 181930 - DNA, 996 bp, Artificial Sequence
  Description of Artificial Sequence: Synthetic coding sequence
atgaagcggctggtgtgcgtgctgctggtgtgcagcagcgccgtggcacagctccacaaggatccaaccctggatcaccattggcacctgtggaagaagacatatggaaagcaatataaggagaagaatgaagaggcggtgagaagattaatctgggaaaagaacttgaagtttgtgatgctgcataatttagagcattccatggggatgcattcttacgacctgggtatgaaccacctgggtgacatgacgtccgaagaggttatgtccctgatgagctcacttcgggtcccaagccagtggcagcgaaacataacgtacaaatctaaccctaataggatcttgcccgatagtgttgattggagagaaaaaggctgcgtcacggaagtaaagtatcaaggttcttgtggtgcctgctgggcctttagcgcagtgggggcattggaggcccaactgaagttaaagaccgggaagctggtgagcctttccgcccaaaacctcgtggactgcagcactgaaaagtacgggaataaggggtgtaatggcgggttcatgacaactgctttccaatatatcatcgataataaagggattgactccgatgcttcatatccgtacaaggcgatggaccagaaatgccagtatgattctaaataccgcgctgccacatgcagcaaatacactgagcttccgtatgggcgggaagacgttttaaaagaggcggtcgcaaacaaaggccccgtatccgttggggtggacgctagacacccatcatttttcctgtatcgcagcggcgtctactatgagccctcttgtacgcagaatgtgaaccacggcgttctggtggtcggctatggagatcttaatggcaaggaatattggctggtgaagaactcttggggccataattttggcgaggagggctacatcaggatggctaggaataaaggcaatcactgtggaattgctagtttcccgtcttaccccgagatttag

SEQ ID NO: 181931 - DNA, 846 bp, Artificial Sequence
  Description of Artificial Sequence: Synthetic coding sequence
atgaagcggctggtgtgcgtgctgctggtgtgcagcagcgccgtggcccagctgcacaaggaccctacattggaccatcattggcacttgtggaagaagacctatggcaagcagtataaagagaaaaacgaagaagccgtaagaagacttatctgggaaaagaacctgaagtttgtgatgcttcataacttggaacatagcatgggcatgcattcatatgacctcgggatgaatcatttaggagacatgggctcctgcggggcctgctgggcattctctgccgtgggggctctcgaggcccagttaaagcttaagactgggaagctcgtcagcctgtcagcacagaatctggttgactgcagcacagaaaagtatggaaataagggctgcaatggaggcttcatgacaactgcattccaatacattatagataataaaggcattgactccgatgcctcatatccttacaaggccatggatcaaaagtgccaatacgatagtaaatacagagccgctacatgttccaaatataccgagctgccatacgggcgggaagatgtgctcaaggaagccgtggcaaataagggacctgtttcagtgggagtggacgcaaggcacccttccttcttcttgtatcgctcgggagtctattacgaacctagctgcacacagaacgtgaaccatggggtccttgttgtaggttacggagacctcaacggaaaggaatactggctggtgaagaattcctgggggcacaactttggggaggaagggtacatacgcatggctcggaataagggcaaccactgtggcattgccagtttcccgtcatacccggaaatctag

SEQ ID NO: 181932 - DNA, 1131 bp, Artificial Sequence
  Description of Artificial Sequence: Synthetic coding sequence
atggccctgaccgcccaccccagctgcctgctggccctgctggtggctggcttggctcagggcattaggggtcctcttcgcgcccaggacctagggccacagcctctggagctaaaggaggctttcaagcttttccaaatacagtttaatcgctcctacttgtcaccagaggaacatgcccacagactcgacattttcgcccataatctagcccaagctcagagacttcaggaagaggacctcggtacagccgagtttggggtcacacccttcagcgacttgactgaagaagagttcggccagctctatggctaccggcgagcggccgggggagtaccttcaatgggcagagaaataaggtcagaggaacctgaggaatccgtacctttctcatgtgactggagaaaggtggcttctgcgatttctcctattaaagaccaaaagaattgcaactgctgttgggctatggcagccgccggaaacatcgaaaccttgtggcgcatcagcttttgggatttcgttgatgtttcagtacaagagctgctggattgtggaaggtgcggagatggatgtcacggtggctttgtttgggacgccttcatcactgtgctgaacaactccggtcttgcctctgaaaaggactatccctttcaaggcaaagttagagcccaccggtgtcatccaaagaagtaccagaaagttgcgtggattcaggactttattatgctgcaaaacaacgagcacagaattgctcagtacctggcaacatacggacctattaccgtaaccatcaacatgaagcctctgcagttatacagaaagggcgtgatcaaagctactcccacgacctgtgacccacagctggtcgatcactctgttctcctggttgggttcggatcagtaaagtcggaagaaggtatatgggcggagactgtctcatcccagtcacaaccccagccgccccacccgaccccttattggatacttaaaaacagttggggggcacagtggggcgagaagggctactttagactccaccggggatctaacacctgcggaatcaccaaatttccgttgaccgctcgggtgcaaaaaccagacatgaagccaagagtttcttgtcctccctag

SEQ ID NO: 181933 - DNA, 2679 bp, Artificial Sequence
  Description of Artificial Sequence: Synthetic coding sequence
atgaccgaccccttctgcgtgggcggccggcggctgcccggcagcagtaagtccggacccggaaaagatggatctaggaaggaggtccgtctgcctatgcttcacgatccccctaaaatgggtatgcccgtggtcaggggcggccagaccgttcctggccaggctccgctgtgcttcgacccaggtagccctgcctccgataagaccgaagggaaaaagaagggaagacccaaggcggagaatcaggccctgcgtgacattcccctgtccttaatgaacgactggaaggatgaattcaaggcacacagccgagtgaaatgtccgaatagcggctgttggcttgagttcccctccatttacggactcaagtatcattatcagcggtgtcagggcggagctatctctgacaggctggcctttccctgcccattttgtgaggccgcatttacctcaaaaacccagctagaaaaacaccgcatttggaatcatatggaccgcccactgcccgcctctaagcccgggccaatctcccgacccgtgactatttccagaccggtgggcgtgagcaagccaattggggtctccaagcctgtcaccatcggaaaaccagttggggtgagcaagcccattggcatcagcaagccagtcagcgtcggtagaccgatgccagttaccaaggccataccagtaactcggccagtgcctgttacaaagcctgtcactgttagcagacctatgccagtcaccaaagctatgccagtgacgaagccgatcactgtgactaagtcagtgcctgtgacaaagcccgtgccggttacaaaaccgataaccgtgactaagcttgtgaccgtcacaaagcccgtgccagtgactaagccggtcaccgtctccagaccgattgtggtaagtaagcccgtgaccgtctctcggcctattgccatctccagacacacaccgccgtgtaaaatggtcttactgacacggtctgagaataaagccccgcgcgctacaggaagaaattctgggaaaaagcgagccgccgacagcctagatacatgtcctatacctcccaagcaggccagaccagagaacggggaatacggaccttccagcatgggccagagctccgccttccaactgtccgctgatacctcttccggctcgctgtcccccggatcccggccttccggcggaatggaggctttgaaagcagctggccctgcatctccacccgaggaggatcctgaacgcacgaaacacaggagaaagcagaaaacacccaagaagtttaccggggagcagcctagtatttctggcacgttcggactcaagggcctcgtgaaggcggaggataaggcacgcgtgcatcgcagcaagaaacaagaagggcccgggcccgaggatgctcgaaagaaagttccagcagccccaattactgtgagcaaggaggcccccgcacctgttgcccatcctgcccccggcggcccagaggagcagtggcagcgcgctatacatgagcgaggcgaagcggtgtgccccacttgtaacgtggttacccggaagacactggtggggctgaagaagcacatggaggtgtgtcagaaactgcaggacgcactcaaatgtcagcactgccggaaacaatttaaatccaaagccgggcttaattatcacaccatggccgaacatagcgctaagcccagtgacgcggaagcctcggaaggaggggaacaggaagagagggagaggcttagaaaagtcctgaagcagatgggcaggctccgatgtccccaggaaggctgcggagctgccttttccagcctgatgggctatcagtaccatcagaggcgatgtggaaagccgccatgtgaagtggattcgccatcttttccgtgcacccattgtggaaaaacctacaggtctaaggccggccacgattatcatgtgcggagcgaacatactgcgcctcctccggaggagccaaccgataagtcccccgaagcagaggatccccttggcgtagaaagaaccccctctggccgcgtgcggcgaacatccgctcaggttgccgtgttccacctgcaggaaattgctgaggacgagctcgctcgtgactggactaagcggcgcatgaaagacgatctggttccagagaccgcaagactcaactacactcgtcctggtttgccgaccctaaatcctcaactcctggaagcgtggaagaatgaagtcaaggaaaagggacacgtgaattgtccaaatgattgctgtgaagccatctactcgagcgtgtccggactgaaagcacatctcgcgagctgcagcaaaggtgcacacttggctggtaagtaccgctgtctcctctgtcctaaggaattcagctccgaaagcggtgtgaagtatcatatcttgaaaacacatgccgaaaactggtttcgaacgagtgccgatcccccaccaaagcaccgcagccaggactcgctagtcccaaagaaggagaagaaaaaaaatctcgccgggggcaagaaacgcgggcgcaagccgaaagagagaactcccgaagaacctgtggccaagctgcccccacgcagagatgattggcctccggggtgcagagataaaggcgctcgtggcagcaccggccggaaggtcggtgttagcaaggccccggaaaaatag

SEQ ID NO: 181934 - DNA, 2343 bp, Artificial Sequence
  Description of Artificial Sequence: Synthetic coding sequence
atggaccagaacagcgtgcccgagaaggcccagaacgaggccgacaccaacaatgccgatcggtttttcaggagtcatagttccccccctcatcaccgccctggacactcgagagcgctccatcactacgaactccatcaccacggagtcccacaccagcggggagagtcacatcacccccccgaattccaggacttccacgatcaagctctgtctagtcacgttcaccagtcgcaccaccattcagaagccaggaaccacggcagggcccacggcccaaccggattcggcctggccccatcccaaggtgccgttccttcccatcgctcctatggcgaagattatcatgatgagctgcagcgtgacggccggagacatcatgacgggtctcaatatgggggtttccatcagcaaagtgacagccattatcaccggggctcccatcacggacggccccagtatctcggggagaatctgtcacattattcttctggtgtcccacatcacggcgaggccagccaccatggggggagttatctgccccacggaccaaacccatacagtgagtcgtttcaccacagcgaggcttctcatctgtccggcctgcagcacgatgaaagccaacatcaccaggttccgcaccgcgggtggcctcaccaccaccaggtgcatcaccacggcagaagccgtcaccatgaagctcaccagcacgggaagagcccgcaccacggcgaaactattagccctcactcttccgtggggagttaccaacgcggtatctctgactaccattccgaatatcaccagggtgatcatcaccctagcgaatatcatcacggggatcatccccaccacactcagcaccactaccaccaaacgcatagacaccgggactaccaccagcatcaggaccaccacggggcatatcacagtagctatctgcacggcgattacgtgcagtcaacttcacaactgagtattcctcacacctctcggtccctgatccacgacgcaccaggccccgcagcctcaagaaccggggtctttccgtatcacgtggcacatccaagggggtcggcccattcaatgacaaggtcttcatcgacgatccgaagccgagtcacgcagatgtcaaagaaggtccatacccaggatataagcactaaacactccgaagactggggaaaggaagaaggtcagttccagaagagaaaaacaggacgactgcagaggacccgcaagaaggggcacagcaccaacctgttccaatggctctgggagaagctcacattcctaatccaaggctttagggaaatgatccgaaatctaacccagagtctggctttcgaaactttcattttctttgttgtctgcttgaataccgttatgctagtggctcagacttttgctgaggttgagatcaggggcgaatggtacttcatggctctggatagcatttttttctgcatctacgtggtagaagcactcctgaagataattgccctgggcctgtcttactttttcgatttttggaacaaccttgactttttcattatggccatggcagtcttagacttcctgctgatgcagactcattccttcgctatctatcaccagtccctcttcaggatcctgaaggtgtttaagtcactgcgggccctgcgggctatccgcgtacttagacgcctcagcttcctgacttctgtacaggaagtcacagggacactggggcagagtctgcctagcatcgccgccattcttatcctgatgttcacttgcctttttctgttttccgcagtgcttagggccttgttcaggaaatcggatcccaagcgattccaaaacatatttacaaccatcttcactctcttcactctgctcaccctggatgattggagcttgatctatatggactccagggcacagggagcatggtatatcatacccatcctggttatatatattattatccagtatttcatcttcctgaatttggtgatcactgtactcgtcgactcctttcaaaccgcactgttcaaggggctggaaaaggctaagcaggaacgagccgcccgcatccaggaaaaacttctggaggattcactcaccgaattaagggctgcagagcctaaggaagtagcttccgaaggtaccatgctcaagaggctgatcgagaagaagttcggaaccatgacagaaaagcagcaggagctactattccactacctgcagctggtggcttcagtggaacaggagcaacagaagttccgctctcaggcggctgtgattgacgaaattgtggacaccacttttgaagccggagaggaagattttaggaattag

SEQ ID NO: 181935 - DNA, 1197 bp, Artificial Sequence
  Description of Artificial Sequence: Synthetic coding sequence
atgagccagcaccggcaccagcggcacagccgggtgatcagcagctcaccagtggacactacttcggtgggattttgtcccacctttaaaaagtttaaacgcaatgacgatgaatgtcgcgccttcgttaagcgcgtgatcatgtccaggttctttaaaatcattatgatttccacagttaccagtaacgcattctttatggcactgtggacttcatacgacataaggtatcgtctgttccgactgctggagtttagcgagatcttcttcgtcagcatctgcacttcagagctgagtatgaaggtgtatgtggacccgatcaattactggaagaacggctataacctgttggacgtgatcattattatcgttatgtttctgccctatgccctgagacagctcatggggaagcagtttacatacctgtacattgcggacgggatgcagtcgctccggattctgaagctgattggctactcccaggggatccgcaccttgattacagccgtgggacagacagtttacactgtggcctccgtgctcctgcttttgtttctcctgatgtacatcttcgctattctagggttttgcctcttcggcagccccgacaatggagaccacgataactgggggaatctggccgcagccttcttcactttgttctctttggccacagtcgatggttggacagacctccaaaagcagttggacaaccgagagttcgcacttagcagagcctttaccattatcttcattctgctcgcaagtttcatttttctgaacatgtttgtgggggttatgattatgcacacggaagacagtatacgtaaattcgaaagggagctgatgctggagcagcaagaaatgttgatgggcgagaagcaggtgattctccagcgtcagcaggaagaaatcagtagactgatgcacatacagaagaacgctgactgtacctcatttagcgaactggtggagaactttaagaagaccctatctcacaccgaccccatggttctcgacgacttcgggacaagtcttccgttcattgatatatactttagcaccctggattatcaggatacaactgttcataaactacaggaactgtactacgaaatcgtgcacgttctgtcgctgatgttagaggacctccctcaggaaaagccccaatccctggagaaggtggacgaaaaatag

SEQ ID NO: 181936 - DNA, 1419 bp, Artificial Sequence
  Description of Artificial Sequence: Synthetic coding sequence
atgcgggacaacgagaaggcctggtggcagcagtggaccagccacaccgggctcgaaggctggggaggtacccaggaagatcggatgggcttcggaggggcagttgcagcacttcgtggccggccttcccccctccaaagtaccatccatgaatcgtacggtaggcctgaggaacaggtgcttatcaatcgacaggagatcaccaataaagccgacgcttgggacatgcaggagttcatcacacacatgtatattaagcagttgcttaggcacccggcattccagctccttctggcattgctgctcgtgattaatgctataacaattgcccttcggacgaacagctacctcgaccaaaaacattatgaattgttcagcactattgacgacatcgtgctgacaattcttctctgcgaagtgctgctaggctggctcaatgggttctggatcttctggaaggatggatggaacatcttgaatttcattatcgtgttcatcctccttttgcggttctttatcaatgaaataaatatccccagcattaattatacgctgagagctctgcgattagtgcatgtgtgtatggccgtcgagcccctcgcacgtattatacgggtgatcctacagtctgtgcccgacatggccaacattatggtgttgattctgttttttatgctcgtgttttccgtcttcggagtgaccctgtttggcgcatttgtcccgaagcacttccagaatatccaagtggccctctacacgctcttcatctgcattacacaagatggatgggtcgacatctattcggattttcagacagaaaaaagggaatacgctatggagatcggtggcgctatatacttcacaatttttataacaattggagcgttcatcgggattaacttgttcgtcattgttgtaaccacaaatttagaacaaatgatgaaggcgggggaacagggtcagcagcagcggatcacattttctgaaactggcgccgaggaggaggaggaaaatgaccagcttcccctcgtccactgcgtggttgctcggagtgagaaatctggcttactccaggaaccattggcgggcgggccgctctcaaacctgagcgagaacacatgcgataatttttgcctggtgctagaggccatccaggagaaccttcgtcaatacaaagaaattcgagatgagttgaacatgattgtggaggaggtgcgtgcgatcaggtttaaccaggagcaggagtccgaagtgcttaaccggaggagcagcacttccgggagtttggagaccacgagcagtaaggacatcaggcagatgtcacagcaacaagatctgctcagtgcactggtgagcatggaaaaagtccacgactcgtcctctcagattctgttgaaaaaacacaagtccagccactag

SEQ ID NO: 181937 - DNA, 3351 bp, Artificial Sequence
  Description of Artificial Sequence: Synthetic coding sequence
atggagagccccctgatctacgtgagcgtgctgctgctgaacatcttcgagtttagtagcggcattgtttacaacaaggatgatacggagaaaaggttcgcttgctccaacaaggggtttcctcaagagaacgagatcatcaagctttacctttttctagagaaccttaaaatccagtgtttcttccaaacagaaaacgaaattgcatcgaaggctatgctgagcgtgttcacttccggtggcctcgccccctccctcggcatcatgaattccacctacaacgggatctttcacttcaacttgacccttttcagcgatcgcattctatggctggttgatattccacgtgagaacatcactcagagcaccgatatcgccgccgtggaggaatggctggtcaggatcacactgcaccacggtctgaacatatacgcgacagaggggaccctgctggacgtcattcgagaacccatcctacagtggacaccgggggacgttatcccggagagcgaaataagcaagctgtatccccatgtggtggaccttaaagtgacaaagtgtccctgtgccaacgacgtagctctcctcggcttcatagtcgacaccatcgtggacggtgtgtacattggtataacatttgggggattctggcatgactacgatacgacgtggttcaatatgacgcagacaatttacagccaacttcaggaggaatacgaggatctgagcctcgtagacatggtgcttacgaaccactttctggtgatccttactagcctcggcctcttcgtatccgaggatctccgttacccttctagacatagtcttagcttcagtcgggccgacttctgcgggtttgaaagagttgattacgtgaaaggtaagctgtggtacaatgaacggtgctttgcaaacagggagcacttcgaagtggactatgtgacagtgaccttcgagcggaatcggacgttatccgaaagtagctcttgcttttattcacaggagccatttctcgagtgggtcccctgcctcccacatatctttaaagggataaagatttttccaacagtgctcactttcctagttgatcaggaaagaggcacgggggtatacctcttctataacaaggtacggaaaactgccattgctagcgtcagtaccctgagaaataacgaacccaacagccagagtaagtttcccattttccgattccccagttccttcagttcaccagtaggcatggtgttccacccgcgatcacatttcctttatgcgtacgggaaccagatctggctatcagtcgacggtggtaacacttttcagcttattgcaaatttccatgatgatatcattaaaaagacattccactcattctatactagcgccattaccttcgtaagccagaggggcaaagtttacagcaccaaggctgggatggggcggtattctgccgttggctcggtcaccgaacggatcttcactctttactatgatcatctgggatttctacataagctcactctggggcgcttcgaagccagcggaccaccgactgcatttggtaacagtagaaacttgtttggacagccaccagacatgggcttcgagacagccttggccccgcagcatacttctctagacgaaataatattcttcgcttacgtgcctgaaaacgagccacaggagacaatttacagcaagaagtttggcaatatccattacggaaaggtcattcatagcgggaaaactggacgcgcatatatcaggaaggttctccagcacacaacaccgaaaggttttctttcctctgtgattgctgagatgaaagaaccctttgggcttgaggaagtgaatgagagttcgtgcttatctagcagcctactgattaataaagctggcaacgtttacaaactgactttagactcccaggtggtgcaagctctgttcgaggatacagatattgagaaaacagttgtcttgccaggatatagtagctttctgatcacttctattcttgataacaagaatgcactggccattgcgaccatgcctgagtcggctcctaataacatgacgttcttgaagtccacctggttcctctacaattttggccagcggaacgggagaacttggaagatttattctaaaccatgcaattactggttccaacacgacgactctccgtccctcaatattgtgaagtacatcgatctcggcaactcttatgtcctgaaagcaaaggttatcagaaacgctaaaggctttagaatgttagagatcccactgctcaccgtgttcgttggaaaccccaacctccttgaggtgaccgcagaggtcaccttcgatgatacagacagttacgtgatcaccatttccgccgcatcaaaggtgctgcatcaaggcagtacctcacttgctttcatcatgtggtcggccagtaccgagtgtttcgtgacaactatggtgcctaccctgaagtcgtcctgtagttacctcaggagcatgcatcacataccatccaagtttataccgtttgaggattggattagcggagtacacaaagatagccagggtttcaacctcattaagaccctgcccattaactatagacctcccagcaatatgggcattgccatccctctgaccgacaatttctatcacgcggacccttccaaaccgatccctcgaaacatgtttcacatgagcaaaaagactggcaaatttaagcagtgcgcaaacgtatccacaagggaggaatgtaattgcactaaggaccagaaatttagtcatgccgtagccttttcggactgccgggagaaagtgccacgttttaagtttccgattacccagtatcctgtatccctagaaattataaatgaagatggcagagtcccgctgcaatccccttatctagttaccgtgaccgaagtgaatatgcgccataattggaaattgaagcatacagtccctgaaaacatcaaacggatgaagcagctggtggagccgatcctgggggccgccgtgtacaaccctagcggactcaatcttagtatcaagggaagtgagcttttccacttcagggtgaccgttatcagcggtgtaactttctgtaacttgatagaggagttccagatttatgtggatgaagcccccctacctttccctggacatactctaattgcagtggcaacggcggtggtcctgggcggcctcatttttattgcttttatgttccaactgcaaggcatccatccctggcggacgttccagcggtggattagacgcaaccaggaaaagtttagctccattagtctcagcgagctgatccataggtctaagtctgaagagtag

SEQ ID NO: 181938 - DNA, 225 bp, Artificial Sequence
  Description of Artificial Sequence: Synthetic coding sequence
atggagagccccctgatctacgtgagcgtgctgctgctgaacatcttcgaattctcaagcggaattgtctataacaaagacgacaccgaaaagcgatttgcttgctccaataaagggtttcctcaggagaatgaaattatcaaattatacttatttttggaaaaccttaaaatccaatgttttttccagacagaaaatgagattgcgagtaaggcgatgctctag

SEQ ID NO: 181939 - DNA, 303 bp, Artificial Sequence
  Description of Artificial Sequence: Synthetic coding sequence
atggagagccccctgatctacgtgagcgtgctgctgctgaacatctttgagttcagctccggcatcgtatataacaaagatgataccgagaaacgctttgcttgctctaacaaaggtttcccccaggagaatgaaatcattaagctgtacctttttctggaaaatctgaaaatacagtgcttttttcagaccgaaaacgaaatcgcctctaaagctatgcttagtgtttttacttctggaggtctagccccatctttgggaattatgaactccacctataatggaatcttccacttcaattag

SEQ ID NO: 181940 - DNA, 225 bp, Artificial Sequence
  Description of Artificial Sequence: Synthetic coding sequence
atggagagccccctgatctacgtgagcgtgctgctgctgaacatcttcgaatttagctcagggatcgtctataataaagacgatactgaaaaaaggttcgcttgcagtaataagggatttcctcaagaaaacgaaattattaaactctacctcttcctagagaacctgaagatccagtgctttttccagaccgagaacgagattgcaagcaaagcaatgttgtag

SEQ ID NO: 181941 - DNA, 795 bp, Artificial Sequence
  Description of Artificial Sequence: Synthetic coding sequence
atgcacaaccccgacggcagcgccagccccaccgccgaccccggcagcgaactgcagaccctcgggcaggccgcccgccggccacccccaccgcgagcaggacacgatgctccccgcagaaccagaccttcagcgcgaaagccgttatcctgtttttctcgaagacctatgccaaccagggagcctcctaagacaagaggttctagaggacacttgcacacacaccccccgggacccggtcctcctctgcagggactcgcaccaaggggtttgaagacatccgcccccaggcccccttgccaaccgcagcctgggccacacaaagctaaaaccaaaaaaatcgtatttgaagacgaactgttgagccaagctctgctgggggcaaagaaacccataggcgcaatcccaaagggacacaagcctaggccgcatcctgtcccggattacgaactgaagtaccctcccgttagtagtgagagagagcgttcccggtacgtggctgtgtttcaggaccagtacggcgagttcttagaactgcagcatgaagtcggctgtgcccaagcaaagcttagacagttggaggctttgcttagctcactgcctccacctcaaagtcagaaggaggcccaggtggccgcgagggtttggcgcgaattcgagatgaagagaatggacccagggtttctggataagcaagcgagatgtcattacctgaaaggcaaacttcgacaccttaagacacaaatacagaagttcgacgaccagggtgatagcgaagggtctgtgtacttttag

SEQ ID NO: 181942 - DNA, 3480 bp, Artificial Sequence
  Description of Artificial Sequence: Synthetic coding sequence
atgtgcggccccgccatgttccccgccggccccccctggccccgggtgagagtcgtccaggtactatgggccctgttggccgtcttactcgccagctggcggctctgggccattaaagactttcaggagtgtacatggcaggtggtactgaatgaattcaaaagggttggtgaaagtggcgtgtccgactctttctttgagcaggagcccgttgacaccgtgagtagcctgtttcacatgcttgtggatagtcccatcgacccatccgaaaagtacctggggttcccgtattatctgaagattaactactcatgtgaggagaagccgtcagaggacctggtgaggatgggacacctcaccggactcaagcctctcgtgctggtcacttttcagtcccctgttaatttctatcggtggaagatcgagcagttacaaattcagatggaggctgcacccttccgctctaaagagccctgtatggccgaggaagtatgttccatgagttggtacacaccgatgccgatcaagaaaggttccgtggttatgagagtcgatatttcctctaatggactgggtacattcattccagacaagcggttccaaatgaatatcaacgggttcttgaagcgggacagggataataacatccagtttaccgtgggcgaagaactgttcaacctaatgcctcaatactttgttggagtgtctagtaggcctctgtggcatactgttgaccagagtcccgtccttatcctgggtgggatccccaacgaaaaatacgttctgatgacagacaccagctttaaagacttcagcctggtcgagctgagtatcgactcttgttgggttggatccttttactgtccccactctggcttcactgcgacaatctacgacaccatagcgacagagtctaccctgttcatcaggcagaatcagctggtatattatttcactgggacctacaccacactgtacgagaggaaccggggttctggcagctggattagagttctagctagcgaatgcataaaaaagctatgtccggtttactttcattctaatgggtccgagtacatcatggccctaactacagggaagcacgagggatatgtccactttggcaccatccgtgacgggcaagtgagtttcgagatgctacctaggcagtggagtgtatgcgaacaaatcggcgttacgacctgcagtatcatctggtcagaatacatcgccggcgagtataccctgttgctactggtcgaatcagggtatggcaatgcttctaagagattccaggtggtgagctataatacggcttcggatgacctggaattactgtaccatataccagagttcattcccgaggcccgtggcctggagttcctgatgatcctcgggacagaatcttatacttccaccgctatggcccctaagggaatcttttgtaacccatacaataacttgatttttatctggggaaacttcttgctgcagagcagcaacaaggagaacttcatctacctggctgactttccaaaagagctgagtatcaagtatatggccagaagtttccgcggtgccgtcgccattgtgacggagacagaagagatttggtatctgctggaaggctcctatagggtgtatcagctctttccaagtaaggggtggcaagtgcacataagcctgaaactgatgcagcagtcttccctgtatgcgtctaacgagacgatgctgaccctcttttatgaggatagcaaattgtaccagctcgtctatttgatgaataatcagaaggggcagctggtgaaaaggctggtgccagttgagcaacttctcatgtaccagcagcatacttctcactacgatctggagagaaaaggcggatatctgatgttgagcttcatagatttctgtccattttccgtcatgcggcttagatccctaccttcacctcagaggtataccaggcaggagagatatcgggcaagacccccccgtgtattagagcgaagtggattccacaacgaaaactcattggccatttaccaggggctggtatactatctcctgtggctccattccgtgtatgacaagccatatgctgaccctgttcatgatccaacttggcgctggtgggcgaataataagcaggatcaggattactactttttcctggcaagcaattggcgatcagcagggggggtttctattgaaatggattcttacgagaaaatctataacctcgaaagtgcatatgaattacccgagcgaatctttctcgacaaagggacagaatattcttttgccatattccttagcgctcagggccattcctttaggactcagtcagagttggggactgctttccaacttcattcccaggtagacgtcggtgtggtgctcgctgatcccggctgtatagaagcatccgttaaacaggaggtcctcataaatagaaactccgtgctctttagtatcactttaaaagataagaagttatgttacgaccagggcatttcaggtcaccacctgatggagacatctatgacagtaaacgtagtgggatcaagtggcctctgtttccaagagacacacctgggtccacacatgcagggcaacttgatggtgcccgtattcatcggttgccctcctggtaaacggctggccttcgacatcacttacacactggagtatagccgactgaaaaacaaacattatttcgactgtgttaatgtgaatcctgagatgccatgctttctgtttcgagacattttttacccattttttctgatccaggatcttgttactggcgactccgggtccttccaaggttcttacgtgttgctggttgtggggggaggacctactctagacagtttgaaggattacagcgaagatgagatatacagattcaactcacctttagataagaccaattctctgatttggactacacgaactacacgaactactaaggactcagccttccacatcatgagccatgaaagccctggaatagaatggctgtgtctggagaatgccccatgttatgataatgtgcctcagggcatttttgccccagaattttttttcaaggttctcgtgtctaatcgaggcgtggacaccagtacatattgcaactaccagctcacattcctcctgcacatacatggcttaccactatcgcctaagagagcccttttcataatcatggttagcgcctccgtgtttgtcgggctggtgatcttctatattgccttctgtttgctttggcctctggtggtgaagggttgcactatgatcagatggaaaataaacaacctaatagccagtgagtcatattacacgtatgcctctatttccggtatctcgtcaatgccttctctgagacactcccgtatggggtctatgttctcttcacggatgacggaggatagggccgaacctaaggaggcagtggaaagacagctgatgacatag

SEQ ID NO: 181943 - DNA, 3480 bp, Artificial Sequence
  Description of Artificial Sequence: Synthetic coding sequence
atgtgcggccccgccatgttccccgccggccccccctggccccgggtcagggtcgtccaggtgctttgggcgcttctcgcggtcttattggcctcttggcggttgtgggctatcaaggactttcaggagtgcacctggcaagtcgtgcttaatgagttcaagcgcgtcggggagtccggcgtaagcgacagctttttcgagcaagaaccggtcgataccgtttcttcgcttttccatatgctggtggactctccaatcgaccctagtgaaaagtatctgggattcccttattatctgaagattaactatagttgtgaagaaaaaccgtctgaggatctggtccggatgggtcacttaaccggactgaaaccactcgttctggtcactttccaatccccagtgaatttctatcgttggaagatcgagcagctccagattcagatggaggctgcgccgttccgctctaaggaaccttgtatggccgaggaagtttgttctatgtcttggtatacacctatgcccataaagaaggggagcgtagtcatgcgagtcgatatctcgagcaatgggctgggaacattcatcccggacaagcggttccagatgaacattaacgggtttcttaagcgcgatcgggataataacatacaatttacagtcggtgaggaattatttaaccttatgcctcaatatttcgtaggggtgtcttcacggcccctatggcacaccgtagatcaatcaccagtgctaattcttggtggtatccccaacgagaagtatgtgctgatgacggacacctccttcaaggactttagcctggttgaattatccattgattcttgctgggttgggtcattttactgcccccattcaggtttcacagcgacaatctacgacacgatcgcgacggagagtactctgttcattagacagaaccaactcgtgtattattttacaggcacctataccactttgtacgaacgcaacagggggtccggaagttggatacgcgtgctcgccagtgaatgcataaagaagttgtgtcccgtatatttccattccaacgggtccgagtacatcatggcccttaccacaggaaagcacgaaggttacgttcactttggcactattagagacggccaggtgtctttcgagatgcttccgcgccagtggagtgtctgtgagcagattggcgtgactacatgttctattatttggtccgagtatattgcaggcgagtacaccctgcttctcctcgtggagtcaggttatggtaacgcctcaaaacgcttccaggtggtttcctataatacagcaagtgatgaccttgaactgctttatcatattccagagtttataccggaagctagggggctggagtttctcatgatcctgggaacagagtcctacacctctactgccatggctcccaagggcatcttctgtaacccttataataacctaattttcatctggggcaacttcctcctccagagctcaaataaagagaatttcatttaccttgctgacttccccaaagaactttcaatcaagtacatggcaagatcctttcggggcgccgtggccatagtgacagagacggaggagatctggtacctactggaaggaagttaccgcgtgtatcaactctttccctctaaagggtggcaagtgcacatttccctgaagcttatgcagcaatcatccctgtacgctagcaatgaaacgatgttaacactcttctacgaagatagtaaactgtaccaactggtttatttgatgaataatcagaagggccagctggttaagagactagtccctgtggagcagctcctgatgtatcaacaacacacttcacattacgatctggagcggaagggggggtatttaatgctgagtttcattgacttctgtccattttcagtgatgaggctcagaagtctcccttctccccaacgatatacacgtcaagaacgttatcgggcgcgcccacccagagtgctggaacggtctggtttccacaatgaaaatagcctagccatttatcaggggttggtgtactaccttctttggcttcactccgtgtacgataagccttacgccgatccagttcatgatccaacgtggagatggtgggccaataacaaacaagatcaggattattactttttcctcgccagcaattggcgcagtgcaggtggggtttctattgagatggactcttacgaaaagatctataacctggagtccgcttatgagctcccggagcgcatatttctagacaaggggacggagtattcatttgccatctttctcagtgcacagggacacagttttagaacgcaatccgagctgggtacggcttttcagctgcattcgcaagttgacgtgggcgtagtgttagcagatcctggatgcatcgaggcatcggttaagcaggaggtcctgattaaccggaactcagtcctattctccattacccttaaggacaaaaagctgtgttacgaccaagggatttcagggcaccatctgatggagacctccatgactgtgaacgtagtcgggtccagcggcctctgctttcaggagacacatttaggcccacatatgcaggggaacctgatggtccctgtgttcattggctgccccccaggaaaacgcctggcctttgatataacttacaccttggaatacagtagacttaagaacaaacactatttcgactgcgtgaacgttaacccagaaatgccctgctttctgttccgcgatattttttatccattttttctcatccaggatctggtgaccggggatagcggctctttccaaggctcctatgtattgctcgtagtggggggaggacccactctggatagcctcaaggactatagtgaagacgagatttaccgatttaatagtcccctggataagacgaacagtctgatttggaccactcgtaccactcgaacaaccaaggatagcgcatttcacatcatgagccacgagtcacctggcatcgagtggctttgtctggaaaacgccccctgctatgacaacgtgccacagggaatttttgcccccgagttctttttcaaagtgcttgtgagcaaccggggtgtagatacaagcacttactgcaattaccagttgacctttctgctgcatattcatggtctgccactaagccctaaacgggctctgttcattataatggtgtctgccagtgtctttgtggggctcgtgatattctatatagccttttgtttgctgtggccccttgtggttaagggctgtaccatgataagatggaagattaataacctcattgcttccgagagctactatacatacgcctccattagcggcatcagcagcatgccttcactacgccatagccgaatgggatccatgttttcctctagaatgacagaagatagagccgagcctaaagaagcagtcgagcgccagctgatgacctag

SEQ ID NO: 181944 - DNA, 1983 bp, Artificial Sequence
  Description of Artificial Sequence: Synthetic coding sequence
atggacgtgctggtgagcgagtgcagcgcccggctgctgcagcaggaagaagagatcaaaagcttgaccgctgagattgacagactgaagaattgtggctgtctcggggcttcccccaatcttgagcagctccaggaagaaaacctgaagctgaaatacagactcaatattctacggaagtcactgcaagcggagaggaataaaccgactaaaaacatgattaacatcatctcaaggttgcaagaagtgttcggacacgcgataaaagccgcctacccggatctggaaaacccaccgttgctggtgactccctcccagcaagccaagtttggcgactatcaatgtaactcagcgatggggatttctcagatgcttaaaacgaaagaacaaaaagtcaaccctagagagattgctgaaaatatcaccaaacaccttcctgataacgaatgtatcgagaaggttgaaatcgctgggccgggcttcattaatgttcacctccggaaggactttgtgagtgagcagctgaccagcttgctggtgaacggagtgcagctccccgccctcggggaaaacaagaaggtcatcgtggatttcagcagccccaacatcgctaaagagatgcacgttggccacctgaggtccaccatcatcggggagagcatctccaggctcttcgaattcgcgggctatgacgtcttgaggctaaaccacgttggggactggggaacccagttcggaatgttgatagcccatctccaggacaaattcccagattatttaactgtgagtcctccgatcggggacctccaagtgttttacaaagaatctaagaagcgcttcgacacagaggaggagttcaagaagagagcctaccagtgtgtggtgctgttgcagggcaaaaaccccgatatcactaaagcctggaagctgatctgcgacgtgtccagacaggagctcaacaagatatatgacgccctcgacgtctctctgatcgaaaggggagagagcttttaccaggataggatgaacgacattgttaaggagttcgaggatcgcggcttcgtgcaggtggatgatggaaggaagattgtctttgtccccggctgttcaatcccgcttacaattgtgaagagcgatggagggtatacctacgacacctcagatctggccgccattaaacaaaggctgttcgaagagaaggctgacatgatcatttatgtggttgacaatggccagtccgtccatttccagactattttcgcagccgctcaaatgatcggctggtatgatcctaaagtgacgcgcgtcttccatgctggattcggggtcgtgttgggcgaagacaaaaaaaagtttaaaacccgttccggagagactgtacgacttatggatctgctgggagagggcctcaaaagatccatggataaactgaaagaaaaagagcgtgacaaagttttgaccgctgaagaacttaacgctgcacagacatccgtggcttacggatgcattaaatacgctgatctgtcgcacaataggctaaatgactatatcttttccttcgacaagatgctcgacgatagaggcaacactgctgcttacctcctctatgcctttacccggatccgttctattgcacggctggcaaatatcgacgaagaaatgctgcaaaaagcagcccgagagaccaagatcctcctcgatcacgagaaagagtggaagctgggaaggtgcattctccgattccctgagatcctccagaagattctcgacgatcttttcctgcatacactgtgcgactacatttacgaactcgccacagcctttacagaattctatgactcctgctactgcgtggagaaggatcgtcagacagggaagatattgaaggtcaatatgtggaggatgctgctgtgcgaggccgtggcggctgtcatggctaagggctttgatatcctgggcattaaaccggtccagaggatgtag

SEQ ID NO: 181945 - DNA, 465 bp, Artificial Sequence
  Description of Artificial Sequence: Synthetic coding sequence
atgtgctggacccggatccggcccggcacccccagcagccccggcgcacaaaggcccactccgtacgaatggatgagaaggagcgtggctgccggcggcggaggtggttctggtaaaaccagaactaaagacaagtacagagtggtttacacggaccaccagcgcttggagctggaaaaagaattccactatagcaggtacataaccataaggcgtaaatctgaactggctgccaatctaggactgaccgagcgtcaggtaaagatctggtttcagaataggcgcgctaaggagcgaaaggtcaacaagaaaaagcagcagcaacaacagccgcctcagcccccaatggcacatgacatcacagccacccccgccggcccaagcctcggtggcctgtgcccttctaatacatcacttctcgccacgtccagccctatgccagtaaaagaggagttcctcccctag

SEQ ID NO: 181946 - DNA, 183 bp, Artificial Sequence
  Description of Artificial Sequence: Synthetic coding sequence
atgcggggcggcccccggggccaccacgtgtgcggcctgtgcgccggccagggttttgccagagtgccacgccctagccaggccagccaaccgcgaccaggccctgcatctctgtgtccatcaaatactagcttgctcgctacatcttcacccatgcccgttaaggaagaattcctgccatag

SEQ ID NO: 181947 - DNA, 942 bp, Artificial Sequence
  Description of Artificial Sequence: Synthetic coding sequence
atgtacgtgagctacctgctggacaaggacgtgagcatgtacccctcgtccgtgagacactcaggagggctgaatctagcaccccagaattttgtgtcgcccccccagtatcccgattacggtggatatcacgtggccgcagccgctgcagcagccgcaaatctggattctgcacaaagtccggggccatcttggcctgccgcttacggggccccacttcgagaggactggaatggatacgctcctgggggcgccgccgcagctgccaatgcggttgctcatggattgaatggtgggtctccagccgcagcaatgggatacagcagcccagctgattaccacccccatcatcaccctcaccaccatccccatcaccctgccgccgctcccagttgtgcctctggtctgctccagaccctcaacccgggcccaccagggccagcagcaaccgcggctgccgagcaattatcccccggcgggcaaagaaggaatctttgcgaatggatgcgcaagcccgcacagcaaagcctcgggtctcaggtcaaaacacgcaccaaggataagtacagggtcgtgtatacagaccaccagcggctggaactggagaaggagttccattactccaggtacattactattcgcaggaaggccgaattggccgccactttaggcctgtcagagcgccaagtcaaaatctggttccaaaaccggcgcgctaaagaaaggaagatcaataagaagaaactgcagcagcagcagcagcagcagccccctcaaccgcccccacccccccctcagcctcctcaaccgcagcctggaccactcagatcagtgcccgaacccctgtcccccgtcagctccttgcaggcatcggtccccggctcggtccctggagtgctggggcctacgggcggtgtgctgaatccaactgtgactcagtag

SEQ ID NO: 181948 - DNA, 855 bp, Artificial Sequence
  Description of Artificial Sequence: Synthetic coding sequence
atgtacggcagctgcctgctggagaaggaggccggcatgtaccccggcacgctgatgtcacccggcggcgacggcactgccgggactgggggaacaggtggggggggcagccctatgcccgctagcaacttcgccgctgcccctgcattcagccattatatgggctaccctcacatgcccagcatggatccccattggccatccttgggagtctggggttcaccttactcccccccccgggaagactggagtgtgtatcccggacctagtagcacaatgggcaccgtccccgtgaatgatgtaacgtcaagccctgccgcattctgcagcaccgactactcaaacctcgggcctgtgggcgggggaacaagcggttcaagccttcccggacaggctggcgggtcgctagtgcctaccgacgcgggtgctgccaaagcatcctcacccagtaggtcgcgacactcaccctacgcttggatgaggaagacagtccaggtgaccggaaagacccgcactaaagagaagtatcgagtggtgtatacagatcaccagcggctggagttagagaaggagttccattgcaatcgctacatcacaatccaacggaagagcgagttagcagtcaatctgggactttctgagcgacaggtcaagatttggttccaaaatagaagggcaaaggagagaaagatgatcaagaaaaaaatcagccagttcgagaattccggaggaagcgtccagagtgacagtgatagcatctcacccggcgagctgccgaacacattttttaccactccctccgctgtgaggggcttccaacctatagagatccagcaagtcattgtgtcggagtag

SEQ ID NO: 181949 - DNA, 456 bp, Artificial Sequence
  Description of Artificial Sequence: Synthetic coding sequence
atgatggccgaggagcacaccgacctggaggcccagatcgtgaaggatatccattgcaaggagattgacttggtaaatagagatcctaaaaacatcaacgaggatattgtgaaagtcgacttcgaggatgtcatcgctgaacctgtgggaacttattcgtttgacggggtgtggaaagtgtcctatacgacatttaccgtgtccaaatattggtgctaccgtctcctctcaacactactgggagttcccctcgccctcctgtgggggttcctttttgcatgcatcagcttttgccacatctgggccgtggtaccatgcatcaagtcctatcttattgagattcagtgtatttcccacatttattcactgtgtatccgcaccttttgcaatcccctgtttgctgccctcggtcaagtgtgttcaagtatcaaggtcgtccttcggaaagaggtgtag

SEQ ID NO: 181950 - DNA, 456 bp, Artificial Sequence
  Description of Artificial Sequence: Synthetic coding sequence
atgatggccgaggagcacaccgacctggaggcccagatcgtgaaggatatccactgtaaggagatcgacctcgtgaaccgtgacccaaaaaacataaacgaggatatcgttaaagtggactttgaggatgtcatcgccgagcctgtcggcacctatagcttcgacggtgtctggaaggtgtcttacactacattcactgtcagcaagtattggtgctatagactcctctcaaccctcctcggggtgcctttggctcttctctggggctttcttttcgcatgcatcagtttctgccatatctgggctgtggtgccatgcatcaaatcgtacctcatcgaaatccagtgtatcagtcatatatactccttgtgcatcaggactttctgtaatcctctatttgctgccttgggtcaggtatgtagtagcattaaggtcgtactgcggaaggaagtttag

SEQ ID NO: 181951 - DNA, 813 bp, Artificial Sequence
  Description of Artificial Sequence: Synthetic coding sequence
atggccgaccacatgatggccatgaaccacggccggttccccgacgggacaaatgggcttcatcaccatccagcgcaccggatgggcatgggtcagtttccctcgccgcaccaccaccagcaacagcagcctcagcatgctttcaacgcactgatgggcgagcatattcattatggcgctggtaacatgaacgcgacatcaggtataagacatgcaatgggacctggcacagttaacggcgggcaccctccttccgctctggcccccgctgcacgctttaataattcccagtttatgggacccccagtagcctcccaggggggcagtctccctgcctctatgcaactgcagaaactcaataaccagtacttcaaccaccatccctatcctcataatcattacatgcctgatctgcacccagctgcaggtcaccagatgaacggtaccaatcaacactttcgcgactgtaatcctaaacacagtggagggagcagcacccccggcggatccggcgggagcagcacacctggaggtagcggttcaagctcaggcgggggagccgggtctagcaatagcggaggcggaagtggaagcgggaatatgcccgcgtccgtcgcccacgtgcccgctgcaatgctccctcctaatgtcatcgacaccgacttcatagatgaagaggtccttatgagcctagtgattgagatgggactggatcgaataaaggaacttcccgagctgtggttgggacagaatgaattcgactttatgaccgacttcgtatgtaaacagcaaccctcgagagtctcttgctag

SEQ ID NO: 181952 - DNA, 645 bp, Artificial Sequence
  Description of Artificial Sequence: Synthetic coding sequence
atggccgaccacatgatggccatgaaccacggccggttccccgacggaactaatggcttgcatcaccacccagcgcacaggatggggatgggccagttcccaagcccgcatcatcaccagcagcaacaaccccagcatgccttcaacgccctcatgggggagcatattcactatggagcaggcaacatgaacgcgaccagcgggattagacacgcaatggggccaggcaccgtcaacggcggacacccgccatcagctctggccccagcagcccggtttaacaacagccaattcatgggtccacccgtggcatcccaaggtgggtctttaccagcctctatgcagctgcaaaaactcaacaaccagtacttcaatcaccacccctacccacacaatcactacatgcccgatcttcatccggcagcgggtcatcagatgaatggcactaaccaacatttcagggattgtaatcctccaaacgtgattgatacagactttattgacgaggaggttctgatgagcctggtcatcgaaatgggcctggatcggattaaagagctgcctgaactgtggctaggacaaaatgaattcgactttatgactgattttgtttgcaaacagcaaccatcaagagtgtcatgttag

SEQ ID NO: 181953 - DNA, 813 bp, Artificial Sequence
  Description of Artificial Sequence: Synthetic coding sequence
atggccgaccacatgatggccatgaaccacggccggttccccgacggtactaacgggttacatcaccacccggcccaccggatgggtatggggcagttccccagcccacaccatcatcaacagcagcagcctcagcacgctttcaacgctctcatgggagaacacattcactatggtgctggaaacatgaacgccaccagtggtatcagacatgctatgggccccggtaccgtcaatggaggccatcccccatccgctctggccccagcggccaggttcaacaatagccagtttatggggcctccggttgctagccagggcggctccctgcccgcttctatgcagctgcagaaattgaacaaccagtactttaaccaccacccgtaccctcacaaccattatatgcccgacctccatcccgctgctggccatcagatgaacggcaccaatcagcacttcagggactgcaacccgaagcactctggcggatcctcaacccccggcggctccggcgggagcagcaccccaggcgggtctggaagctcgtccggggggggagccggatcctcgaacagcggcggtggatcgggtagcggaaacatgcctgctagcgtggcccacgtgccagctgctatgttaccccctaatgtaatcgacacagacttcatcgatgaggaggtccttatgtctctcgtcattgaaatgggtttggatagaattaaagaactacccgagctctggctaggccagaacgagtttgatttcatgaccgattttgtgtgcaagcagcagccatctagggtctcatgctag

SEQ ID NO: 181954 - DNA, 813 bp, Artificial Sequence
  Description of Artificial Sequence: Synthetic coding sequence
atggccgaccacatgatggccatgaaccacggccggttccccgacgggacgaatgggctgcaccatcacccagcccaccgaatgggaatgggtcagtttccctcacctcaccaccatcagcagcagcagccacagcatgccttcaacgccctgatgggagagcatattcactacggagccggaaacatgaacgcaacaagtgggattagacacgccatgggccccgggactgtgaacggaggccatccccctagcgcactggctccagctgcccggtttaacaactcccaattcatgggcccacccgtagcctcacaaggagggagtctgccggcatccatgcagttgcagaaactcaataaccaatactttaatcaccatccctatccacataaccattatatgcccgacttgcaccccgcagccggacatcagatgaacggtaccaatcagcacttccgggactgcaaccctaagcatagcggaggctcatctaccccaggtgggtcaggaggctccagcacccccggtggcagcggatcatctagcggcggcggcgccggttcttctaactcaggcggcggtagtggctccggcaatatgcccgccagcgtggctcacgtgcccgctgccatgctgccccccaatgtaattgacaccgactttatagacgaagaggtactcatgagcctggtaatagaaatgggtctggatcgcataaaggagctgcctgagctctggcttgggcaaaatgaattcgactttatgacagacttcgtttgcaaacagcagccgtctagagtctcttgctag

SEQ ID NO: 181955 - DNA, 1797 bp, Artificial Sequence
  Description of Artificial Sequence: Synthetic coding sequence
atggagaacagcagcgccgccagcgccagcagcgaggccggcagctctcgatctcaggagattgaagagctggagagattcatagactcttatgttctggagtaccaggtacagggcctcctcgcagacaaaaccgagggggatggagagagtgaaagaacccagtcacatatttcacagtggaccgccgattgttcagagccactggatagtagttgctcatttagccgcgggcgggccccacctcagcagaatggcagcaaggacaatagtctcgatatgcttgggacagatatctgggcagccaacacattcgactcattcagtggggccacgtgggacctgcagcccgaaaagcttgattttacgcaatttcatcgaaaggtccggcacaccccgaagcaaccattacctcacatagaccgagagggatgtgggaagggcaaactggaggacggcgatgggatcaatctcaatgatatcgaaaaggtccttccagcctggcaggggtatcaccccatgccacatgaagtggagattgcccacactaaaaagttattccggagacgtcgcaatgacagacggcggcagcagcgacctccgggcggaaataagccccaacaacacggtgatcaccaaccagggtctgctaaacataatcgagaccaccaaaaatcataccaaggtgggtcagcccctcacccctcaggcagaccgactcaccacggatattcccagaatcgaaggtggcaccacggtaacatgaagcacccccctggtgacaagggcgaagccggtgcccaccggaacgccaaagagaccatgaccattgagaacccaaagcttgaagacacggctggagataccggccactcttccctcgaggctcctaggtcccccgatacgctggctccagtagcttccgaacggctgccaccacagcaatcgggtggccccgaggttgaaactaaaaggaaagattctattctccctgagcggattggggagcgccccaaaatcacattactgcagtcatctaaggataggcttcgccgacgcctcaaagaaaaggatgaagtggccgtggagactactactccccagcagaacaagatggataagcttattgagatattaaactctatgaggaataactcatctgacgtggatacgaagctgactacgttcatggaagaggcacagaattccaccaacagtgaggaaatgctgggcgagattgtgcgcacaatttaccagaaagccgtcagtgaccggtccttcgcctttacagccgccaaactgtgcgacaagatggctctgttcatggtagagggaaccaagtttcggtccttattactcaatatgttgcaaaaagactttaccgttagagaggagctgcaacagcaggacgtagagagatggctgggattcatcacttttctgtgcgaggtcttcggcaccatgcgttcttcgaccggagagccgttccgcgtgttggtttgccccatctatacttgtttgagggaactgctacagtctcaagatgtgaaagaagatgcagtgctatgctgctccatggagcttcagtctaccgggcggctgcttgaagagcagctgccggaaatgatgaccgaactgctggcctccgctagagacaaaatgttgtgcccctcggaaagcatgttgaccagatccctgctattagaagtgatagaactgcacgccaattcatggaacccacttacccctcccatcactcagtactataacagaaccattcagaagttaactgcctag

SEQ ID NO: 181956 - DNA, 1803 bp, Artificial Sequence
  Description of Artificial Sequence: Synthetic coding sequence
atggagaacagcagcgccgccagcgccagcagcgaggccggcagctcccgttctcaggagattgaagaacttgagcgtttcatcgactcgtatgtccttgagtatcaagtacagggactgcttgctgacaagactgagggggacggtgaaagcgaaagaacccagagccacatcagccagtggacggctgattgttcggagcctctggactcctcctgctccttctcacgcggccgcgcaccccctcaacagaatggcagtaaagataattcactggatatgctcggaactgatatctgggcagccaatacattcgatagcttcagtggcgccacctgggaccttcagcctgagaaactggattttacccagttccacagaaaggttcgtcacactcctaaacaaccgctgcctcacatcgacagagaaggctgtgggaagggtaaactggaggatggagacgggatcaatctgaacgacatcgaaaaggtgctgcccgcttggcaagggtatcacccaatgccgcatgaggtggaaattgctcatactaagaagctcttcagaaggagacgaaacgacaggcggcggcagcagcgccctccaggtgggaacaaacctcagcaacatggtgatcaccagccaggatccgcaaagcataatcgggaccatcaaaaatcttatcagggcggctcagctccccacccgtccggccgtccgacccaccatggatatagccagaacagaagatggcaccatggtaatatgaaacaccctccaggggacaagggagaggccggagcacatcggaacgccaaggaaacaatgacgattgagaatcctaaactggaggacaccgcgggggacactggacatagtagtctcgaggcacccagatctcccgacacacttgcacctgtggcatcagagcggctccctccacagcaatcagggggtcccgaggtcgaaactaagagaaaagactctatcctgccagaacgaataggggagcgtcctaaaattactctgcttcagtcctccaaagatagacttcggcgccgcttgaaagagaaggtgcctgacgaggtagcagtcgagactaccactccccaacaaaataagatggataagctcattgagatcctcaatagcatgcgcaacaatagtagtgacgtcgataccaaactaacaacattcatggaggaagcccagaattccaccaacagcgaggaaatgctcggtgagatcgtccgaactatttatcagaaagccgtctccgacaggagttttgcctttaccgccgccaaattatgtgataagatggctctcttcatggtggagggaactaagtttcgctccttactcctgaacatgttgcagaaggatttcaccgtccgcgaggagctgcagcagcaagacgtcgaacggtggctcggcttcattaccttcctgtgtgaggtatttggcacaatgagatcgtctacgggggagccgttccgagtactggtgtgtcctatatatacgtgcttgcgcgagcttctgcagtcccaggacgtgaaagaggacgccgtcttatgctgctctatggaactccagtctacaggccgcctgctggaagagcaactcccagagatgatgacagagctgctggctagtgcaagggataaaatgttgtgtcccagtgagtcaatgttaacacgatcactactgctcgaggtcatcgaactgcatgcaaacagctggaatccactgaccccgcctattacccagtactataataggaccatccaaaaactgacagcctag

SEQ ID NO: 181957 - DNA, 1947 bp, Artificial Sequence
  Description of Artificial Sequence: Synthetic coding sequence
atgggccggctgccctgcggccccctgcccggccagtggaccgccgattgctcagaaccgctcgactccagttgttccttcagtcgtggccgggcccctccacagcagaatggtagtaaggataattcattagatatgctgggcactgacatctgggccgctaacacctttgacagtttttctggtgcaacctgggatctccaacctgagaaactagattttactcagttccatcgtaaggtcaggcatacccccaagcagccactgcctcatattgacagggaaggctgcggaaaaggcaaattggaagatggcgatggtatcaatctgaacgacattgagaaggttttgccagcttggcagggttaccatcctatgcctcatgaggtcgaaatagctcacactaaaaagctgttccgcagaagaaggaatgacagacggagacagcagaggccaccgggcggaaacaaaccccagcagcacggagatcatcagcccggctctgccaaacacaaccgagaccatcaaaaaagctatcagggcggatctgccccccacccttccggtcggcctactcaccacggctatagtcagaaccgtcgatggcatcatggcaatatgaaacacccccctggtgacaagggggaagcaggcgcccatcgcaatgcaaaggagacaatgacaattgaaaatcctaaactcgaggatactgcgggcgacactgggcactcttcacttgaggcacctagatcgcccgacactctcgctcccgtcgcgtctgaaaggttacctccccagcagtctggtggtccagaggtggagacgaagagaaaggacagcattttacctgaacggattggcgaaaggcccaagatcaccctgttacaatcaagcaaagacaggctccgcagaaggttgaaggaaaaggatgaagtggctgtggagacaaccacaccacagcagaataagatggacaagctgatcgaaatcctaaattcaatgaggaacaactcatctgacgtggataccaaactcacaacctttatggaagaagcccagaacagcaccaattctgaggagatgctaggtgagatcgttcgcacgatctaccagaaggccgtctctgaccgaagcttcgcatttaccgctgcaaagttatgtgataaaatggcattattcatggttgaggggacaaaatttcgatcactactcctgaatatgcttcagaaggattttaccgtccgagaggagctccaacagcaggatgtcgagagatggctgggcttcatcacattcctgtgtgaggtgttcggcactatgcgatcttcaaccggcgagccttttagggtgctggtttgtcccatctatacttgcctgcgcgaacttctacagtcccaggacgtcaaggaggatgctgtcctctgctgcagcatggagctgcaatcaaccggaaggctgctcgaggaacagttgcctgagatgatgaccgagttgctggcctctgcccgagacaaaatgctttgtccgtccgagtcaatgcttactaggtccctcctgctcgaggtcatagaactgcacgccaactcttggaatcagggcgcttggcaggccgctcatggccaattggggccctggtgtacggggccagatgggcaagcgggaggtcagggatggccctggcgggagaaagaaatggggagaagagcgggccgggtgggcggccagtcaggcgcacgcgcatgcaagctgacgccgatcagggaagcttgtttcttttttttggttgctctggcgctcccctttttgacccccgcttcaccactccccatccgtcctatcccccacggggccctgtgcgaaggctcccaccggtgtgattctagtgaaacgctggccgctagccatgctggggccccactgggaagtgaacgcacaagcgaaggctag

SEQ ID NO: 181958 - DNA, 1077 bp, Artificial Sequence
  Description of Artificial Sequence: Synthetic coding sequence
atggagagcgccgacttctacgaggccgagccccggccccccatgtctagccatctgcagtccccgcctcacgcaccgagctccgcggccttcggatttcccagaggcgctggccccgcccaacctcctgctccacctgccgccccagagcctctgggtggcatttgtgagcatgagaccagtatcgacatttcagcttacatagatccagccgctttcaatgatgaattcctggccgatctgttccagcacagcagacagcaggagaaagcaaaagcagctgtaggccctactgggggtggcgggggcggggacttcgattatcccggtgctcctgccggaccaggcggagcagttatgcctggaggcgcacacggtcctccgccagggtatgggtgtgcggccgctgggtaccttgacggccggcttgagcctctatacgaaagagtgggagcacccgctttacggccattggtaattaagcaggaaccacgggaagaggatgaagccaaacaactggctctggctggcctgttcccatatcaaccacctcccccaccgccaccctcacatcctcacccacacccacctccggctcacctggcggccccacaccttcaatttcaaattgctcattgcggacagactaccatgcacctccaacctgggcaccccaccccacctccaacaccagttcccagtccccaccccgcacctgctttaggggcagccggcttacccggacccggctctgccctcaagggactgggtgcagcccatcccgatctgagagctagcggcggcagcggtgccggcaaagcaaaaaagtcggtggataagaactcgaatgagtatcgcgtgcgcagagagcgaaataatatcgctgttcgtaaaagtcgggacaaagccaaacagcgcaatgtggaaactcagcaaaaggtgcttgaactcacctcagataatgaccggctgagaaagagagtagaacagttgagcagagaattggataccctccggggcatcttcagacagctccccgaatctagcctggtgaaggccatgggaaattgtgcctag

SEQ ID NO: 181959 - DNA, 810 bp, Artificial Sequence
  Description of Artificial Sequence: Synthetic coding sequence
atgagcgccgccctgttcagcctggacggccccgcccggggcgccccttggcccgcggagcctgcccctttctacgaacccggacgcgccgggaaaccagggagaggagcagaacctggagcattaggagagcccggcgcagccgctcccgccatgtacgatgatgagtccgcaattgacttttcagcatacatcgacagcatggccgccgttccaactctggagctctgccacgatgagctgttcgccgacctttttaattccaatcacaaggccggcggcgctgggcccttagagctgctgcctggcgggcccgcacgaccgctgggacctggaccagccgcacccagactgttgaaacgggaacccgattggggagatggcgacgcgcccggaagtcttctgccagcccaggtggctgcctgcgcccaaaccgttgtgagccttgccgccgctggccaacctacacctcctacctcaccagaaccacccaggtcttcacctcggcagacacctgcaccagggcccgctcgagagaaatcagcaggtaagagaggaccagataggggctccccagagtatcgacagcggcgagagaggaacaacattgccgttcggaaatcccgcgacaaggcaaaacgccggaaccaggagatgcaacagaagctggtggagctttccgccgagaacgagaagttgcaccaacgcgtggagcagcttacccgtgatttggcgggcctccggcagtttttcaagcagttaccatccccccctttcctgccggccgcggggaccgccgactgtcgctag

SEQ ID NO: 181960 - DNA, 402 bp, Artificial Sequence
  Description of Artificial Sequence: Synthetic coding sequence
atgagcgccgccctgttcagcctggacggccccgcccggggcgccccctggccagctgaacccgctcccttctacgagcccggccgggccggtaagccgggaaggggagccgagcccggcgcccttggagagcctggcgcagcggctccagccatgtatgatgacgagtctgctattgatttctccgcgtacattgatagcatggcagcggtccctacacttgagttgtgccacgacgagctcttcgccgacctctttaactccaatcataaggctcgggctccatgggcccgtgcactgccactgccagcgtgctctagtgcttcccctaccggcgccaccgcgacaaggcctgcccggtgttgtccacgccggtggccccgtgcacatcggccctggtag

SEQ ID NO: 181961 - DNA, 1092 bp, Artificial Sequence
  Description of Artificial Sequence: Synthetic coding sequence
atggccagcggcgacttctgcagccccggcgagggcatggagatcttgcagcaggtctgcagcaaacagctgccaccttgcaacctgtctaaagaggacttactccagaacccctactttagtaagctgctgctgaacctctctcagcacgtggacgagtcaggtctgtctctgacactggctaaggagcaggctcaggcgtggaaagaggttcgtctgcacaagactacctggttgcgatccgaaattctgcatagagtaatccaggagctcctggtggattattatgtgaaaatacaggatacgaatgtaacctccgaagacaaaaaattccacgagactctggagcaaaggctcctggtgaccgaactcatgcgtcttttgggcccctctcaggagcgggaaattcctccgctactcggactggagaaggcagatctcctggagctgatgcccctctccgaggatttcgtttggatgagggcccggctgcagcaagaagtggaggaacagcttaagaaaaagtgcttcactctgctctgctattacgaccccaactctgacgccgattctgaaactgtgaaagcggctaaggtctggaagctggcggaagtactggtcggcgaacagcagcagtgccaagatgccaagagccagcagaaagaacagatgctactgcttgagaaaaaaagtgccgcttattcacaggtgctgctccggtgcctgaccctcctgcagagattgctccaagaacaccgcctgaagacccagtccgagctggacagaattaatgctcagtatctggaagtgaaatgcggcgcaatgatactgaaactgcgtatggaagagctgaagatcctcagcgacacctatacagttgaaaaagtggaggttcaccggctgatccgagatcgcctggagggtgcaattcacttacaggagcaggacatggagaactcacggcaggtgcttaactcttacgaggtgctcggagaggagttcgacaggttagtgaaagaatataccgtgcttaaacaggccactgagaataagcgctgggccctgcaggaatttagcaaagtgtatcggtag

SEQ ID NO: 181962 - DNA, 1359 bp, Artificial Sequence
  Description of Artificial Sequence: Synthetic coding sequence
atgggcagcagccagagcgtggagatccccggcggcggcaccgagggttaccacgtacttagagtacaggaaaactctcccggccatcgagccggacttgagcctttcttcgattttatcgtctccatcaacgggagccggctgaacaaggataatgatacactcaaggaccttctgaaagccaatgttgaaaagccggtcaagatgctgatctattcttctaaaaccttggagctgcgagagacatcagtgacaccaagcaacctttggggcggccagggcttactcggcgtgtccatcagattctgttcattcgatggggctaacgaaaacgtgtggcatgtgctggaggtggaatccaattctcctgccgctctcgctgggctacgaccccattcagattatattattggggctgataccgtaatgaacgagagcgaggacctgttcagcctgattgagacccatgaggctaaaccgcttaaactttacgtgtacaacacagataccgacaattgtagagaggtcatcattactcccaactccgcttgggggggagagggctctctcggatgtggcatcgggtacggctacctccaccggattccaactcggcccttcgaggagggcaaaaagatttctctacccggccagatggccggaaccccaatcactcccctcaaagacggttttactgaggtgcagctttctagcgtaaacccgccctccctatctcccccagggactacaggcatcgagcagtccctgacaggcctgtctatatcttctactcctccagcagtcagctctgtgcttagtaccggcgttccaacagttcctctgctgcccccccaggttaatcagagcctgacatctgtccctcctatgaaccccgccactacgctgcccggcttgatgcccctcccagctgggctacccaacctcccaaatttgaacttaaatttgcctgctccccacataatgccaggggtcggcctgccggagctcgttaacccagggctaccccctcttccttcaatgccacctcggaacctcccaggaatcgcaccgctaccactgccaagtgaattcctgccttctttcccactcgtccccgaaagctccagcgcagctagcagcggcgagctcctttcttccttacctcctaccagtaatgctcctagcgatcctgccacaactactgctaaggccgatgcggcatcatcgttaactgtcgatgtgactcctccaactgctaaagccccgaccaccgtcgaggatagagttggggacagcacaccagtctctgaaaaaccagtctcagcagccgttgacgctaacgccagcgagagcccctag

SEQ ID NO: 181963 - DNA, 2997 bp, Artificial Sequence
  Description of Artificial Sequence: Synthetic coding sequence
atggccgccgtgaaggagcccctggagttccacgccaagcggccctggaggccagaggaggccgtagaggaccctgatgaggaagacgaagacaacacttcggaggccgagaatgggttctccctggaagaggttctgagactgggcggtaccaaacaagattatctgatgctggcaactctggatgagaatgaggaggttattgatggtggaaagaaaggcgccattgatgacctgcagcagggcgaactggaagcattcattcagaatctgaatttggccaagtataccaaagcaagcctggttgaagaagatgagcctgcggaaaaagagaatagctccaagaaggaggtcaagatcccaaagataaataataagaacaccgccgagagccagcggaccagcgtgaacaaggtgaagaataaaaaccggcccgagccacacagtgacgagaacggcagcactactccaaaggtgaagaaggacaagcagaacatcttcgaattcttcgaaagacaaaccctcttgctgaggcctggcggcaagtggtacgacttggaatactcgaacgaatatagcttaaaaccccagccccaggacgtggtgtccaagtataaaactctggcacagaagttgtatcagcacgagatcaatctgtttaagagcaaaacgaactctcagaagggagcatcctctacctggatgaaggctattgtcagctcgggcaccttgggcgaccgaatggccgccatgatattgctaatacaagatgatgccgtacatacacttcagtttgtcgaaaccctcgtcaaccttgtcaaaaagaaaggatccaaacagcagtgtctcatggccctcgacacgtttaaggagctcctgattacggatctcctacccgacaatagaaagctgcggatttttagccagagaccatttgataaactggagcagctgtcttccggaaataaagatagccgggaccgccgtctaattctgtggtatttcgaacaccagctgaagcatctcgtggccgagttcgtgcaggtcctcgaaactctcagtcacgatacactggtgaccacgaaaaccagagccctgaccgtggctcacgagttgctgtgcaacaaaccagaggaagaaaaagccctgctggtgcaagtggtcaacaaactaggggatccacagaaccgcatagctacaaaggcatcacacctgttagaaacactcctgtgcaaacatcccaacatgaaaggagtggtaagcggagaagtggagaggctgctcttccgatcaaacatcagctcaaaagcccagtactatgccatttgcttcctaaaccagatggccctttctcacgaagagtcagagctcgcaaacaagctcattactgtctacttctgcttctttaggacttgcgtcaagaaaaaggatgttgagagcaaaatgctctccgccctccttacgggagtcaatagggcctatccatacagtcagacaggagacgataaagtgcgggagcagatcgataccttatttaaagtgttgcatatcgttaacttcaacacatctgttcaagctctgatgcttctctttcaggtgatgaacagtcaacagactatttccgacagatattatacagccctctataggaaaatgctggacccaggtctgatgacctgcagcaaacaagccatgttcctaaacctcgtatataagagtttgaaggccgacatagttctgcgacgcgtgaaagccttcgtaaagaggctgcttcaggttacctgccaacagatgccacccttcatttgcggagcgctgtatctcgtttccgagatattgaaagcgaaacccggtttgagatcccaattggatgatcacccagagagcgatgatgaagagaatttcatagacgctaacgatgacgaggacatggagaagttcaccgacgctgacaaagaaactgagatcgtcaagaagctagagacagaggagacagtgcccgagactgatgtggaaacaaagaagcctgaagtggccagttgggtgcactttgataacttgaaggggggtaaacagctaaataagtacgatccattctcacgtaacccacttttctgcggagcagagaatacctctctttgggaactcaagaagctgtccgtacacttccacccaagtgttgctctcttcgctaagacaattctgcaggggaactacatccagtactctggcgaccccctgcaggatttcactctcatgaggtttctggaccggtttgtgtaccggaaccctaaacctcacaagggcaaagagaacacagattctgtggtaatgcagcctaagcggaagcatttcatcaaagatattcgacacctgcctgtgaacagcaaggagttcctggctaaagaggaatcacagattcctgtcgatgaagtgttcttccacaggtactataagaaggtggccgtcaaggaaaaacagaagagagatgctgacgaggaatcaatagaggacgtggatgacgaggagtttgaggagctcattgacaccttcgaagatgacaactgtttttcaagcgggaaggatgacatggactttgctggcaacgtgaaaaagaggacaaaaggggccaaagacaatacgttggatgaggattcagaaggaagcgatgatgagctcggcaacttggatgacgacgaggtctccctcgggtccatggacgacgaggagttcgcagaggttgatgaggacggcggcaccttcatggatgtcttagacgacgagagtgaaagcgttcccgagctggaggtccacagcaaggtctccactaagaagtcgaagaggaagggaacggatgactttgattttgctggcagcttccaaggcccacggaaaaaaaagcggaatctcaatgactcttccctgttcgtgagtgctgaagagtttgggcacctgttggatgaaaatatgggatcaaaattcgataatatagcatag

SEQ ID NO: 181964 - DNA, 1992 bp, Artificial Sequence
  Description of Artificial Sequence: Synthetic coding sequence
atggccgccaccgagatcagcgtgctgagcgagcagttcaccaagattaaagagctcgagctgatgccagaaaagggactgaaagaagaggaaaaggacggtgtttgtcgcgagaaggatcatcgtagcccatcagagctcgaagccgagagaacttcaggcgcatttcaggactcagtgctggaagaagaagtcgagttggtgttggctcctagcgaggagagtgagaagtacatccttaccctgcaaacagtccattttactagcgaggcagtcgagcttcaggacatgtcacttctaagcatccagcagcaggagggggtgcaagtcgttgtccagcaacccgggcctggactgctttggctggaagaaggaccacgtcagtctctgcaacaatgtgtggcaatttccatccaacaggaactgtatagcccccaggaaatggaagtgctccaattccatgccctagaggagaatgtgatggttgccagcgaagattctaagctagccgtgagcctagccgagacgacaggattaatcaaacttgaggaagagcaggaaaagaatcagctcctggccgagagaactaaagaacaactgttctttgtagagactatgtcaggagacgagaggtcagatgagatcgtcctcacagtctcgaacagtaacgttgaggaacaggaggaccaacccacagccggccaagcagacgccgagaaggcgaagagcaccaagaatcagcgcaaaaccaaaggtgcaaagggtactttccattgtgacgtgtgtatgtttacgtccagtcgaatgagttcatttaacaggcacatgaagactcacacatccgagaagccacacctttgccatctgtgtcttaaaactttccgcacagtgacattactgcgaaatcatgtgaatacccacacggggacccgcccttacaaatgtaacgattgtaatatggcatttgtgacctctggagagctggtccggcataggcggtacaagcatacccacgaaaagcctttcaagtgctctatgtgcaagtacgcaagcgtagaggcatcaaaactcaaacgacatgtaaggtcgcacacaggcgagcgcccattccagtgttgtcaatgcagctacgccagcagggacacatacaaacttaagcgtcatatgagaacccacagcggagaaaagccctatgagtgccacatctgccatacccggtttacacagtcagggacgatgaaaatccacattcttcagaagcacggcgagaatgtacccaaataccagtgtccccactgtgctacaataatcgcccgcaagtccgacctgagggtccatatgagaaatctgcatgcatacagcgcggcggaacttaagtgcaggtactgctctgccgtcttccacgaacgttatgccctaattcaacatcaaaagactcataagaatgaaaaacgatttaagtgcaaacactgctcctacgcatgcaaacaggagaggcatatgacagcgcacatccgtactcatactggcgaaaagccgttcacctgcctgagttgcaacaaatgtttcaggcaaaaacagttgctcaacgctcactttcggaaataccacgacgctaattttatccccaccgtttacaaatgctctaaatgtggcaagggcttttcgcgctggattaatttgcatcgacactcagagaaatgtggtagcggagaagctaagtctgccgcaagcggcaagggcaggcgcacccgcaagagaaagcaaaccatactaaaagaggccacaaagggtcagaaagaggctgcaaagggctggaaggaggccgctaatggagatgaagccgccgcggaagaagccagcacaaccaagggcgagcaattccctggggaaatgttccccgtggcatgcagggagaccacagcaagagtcaaagaggaggtggatgaaggggtcacttgtgaaatgctgttaaataccatggataaatag

SEQ ID NO: 181965 - DNA, 1992 bp, Artificial Sequence
  Description of Artificial Sequence: Synthetic coding sequence
atggccgccaccgagatcagcgtgctgagcgagcagttcaccaagatcaaggaactggaactgatgcctgagaaaggcctgaaggaagaggagaaggacggtgtatgtagagaaaaagaccacaggtctcctagcgagctcgaggcagagcgcactagcggagcgtttcaggacagcgtcttggaagaggaagtggagttagtgctggcgccctcagaggaatctgagaaatatatcctcacccttcagactgttcactttaccagtgaggcagtcgagcttcaggatatgagtcttctgtcgatccagcagcaggaaggggtgcaggtcgtggtccagcaacctggccctggcttgttgtggctggaggaaggcccccgacagtccttgcagcagtgcgttgccattagcattcaacaggagttgtactccccacaggagatggaggtgctgcagtttcacgctcttgaggagaacgtgatggtggcaagcgaagattccaaactggcagtgtcactcgcagaaacaactggtctcatcaaactcgaggaggagcaggaaaagaatcaacttctcgccgagaggacaaaagagcaattattctttgtcgaaacaatgtccggcgacgagcgatcagacgagatagtcctgacggtttcgaactctaacgtcgaagagcaggaggatcagccaacagcaggacaggccgatgcagaaaaggccaagtccacaaagaatcagcgaaagactaaaggcgcaaagggcacgtttcactgcgacgtctgcatgtttacctcgagccgaatgtctagcttcaatcgtcatatgaagactcatacgtctgaaaaacctcacctatgtcatctgtgtctcaagacattccgcaccgtcactctcctgaggaatcatgtaaacacccacacggggacccggccatataaatgcaatgattgtaacatggccttcgtgacttctggggagctcgttaggcatcggcggtataagcacacacatgaaaaaccctttaaatgttctatgtgtaagtatgcatccgttgaagcatccaaacttaaaaggcacgttaggtctcacacaggcgagagaccctttcagtgttgccagtgtagctatgcttccagggatacctataagttaaaacggcacatgcggacacattcaggcgaaaaaccatatgaatgtcatatttgccatacacggttcacacagtccggaacgatgaaaatccatatcctgcagaaacacggagagaacgtgcctaaatatcaatgtccccactgtgccacaattatcgcccgtaagtccgacctgcgagtccacatgcgtaatctacacgcgtattctgccgccgaactcaagtgccgatattgctcagcagtctttcacgaacgttatgcactgatacagcaccagaaaacccacaaaaatgagaaacgatttaaatgcaaacactgttcgtacgcctgcaaacaggagaggcacatgacagctcacattcgaacacataccggggaaaagcctttcacttgtctatcgtgcaacaaatgcttccggcagaagcagctcttaaacgctcattttcggaaataccacgacgccaacttcattccaactgtgtacaaatgcagcaaatgcggtaagggattcagtcgctggatcaatctgcaccgacatagtgagaagtgcggctctggggaggcaaagtcagccgcctctggaaaaggtcgtagaaccaggaaaaggaagcagactatcctgaaggaggcaacaaaggggcagaaagaagctgcaaaaggatggaaggaagccgcaaacggcgacgaggctgctgctgaggaggcctcaactactaaaggcgagcaatttcctggtgagatgttcccagtggcttgtagagagacgaccgccagagttaaagaagaggtggatgagggggtgacctgcgagatgctcctgaataccatggacaagtag

SEQ ID NO: 181966 - DNA, 1284 bp, Artificial Sequence
  Description of Artificial Sequence: Synthetic coding sequence
atggccgccaccgagatcagcgtgctgagcgagcagttcaccaagattaaagaactggaactcatgcccgaaaaagggttgaaagaagaggaaaaggatggcgtttgtcgcgagaaagatcaccgaagtccatccgagctcgaagctgaacgtacctcaggtgccttccaggactcagtactcgaagaggaggtggagctcgtgctggctccgagcgaagaatccgaaaagtacatcctcacattacagactgtgcactttacatccgaggctgtggaattgcaggatatgtctttactcagcattcaacaacaggagggagtccaagttgtggttcagcagccagggccagggttgttatggctcgaggaagggcctaggcagtcattgcagcagtgtgtagccatttcaattcagcaagagctgtattccccacaggagatggaggttctgcagtttcacgcccttgaagagaatgtgatggttgcaagcgaagattctaagctggcggtctccttggcggaaactacaggccttattaagctggaggaggagcaggagaagaaccaacttctcgccgaacgaaccaaagaacagctgttctttgtggaaacgatgtcgggcgacgagagaagcgacgaaattgttctgacagtgtctaacagcaacgtggaagagcaggaggaccagcctacagccggtcaagccgacgccgagaaggctaagtctacgaaaaaccagaggaagacgaagggcgcaaagggtaccttccattgcgatgtatgcatgtttacttcctcccgcatgtctagcttcaatagacacatgaaaacgcatacctccgagaagccacacctgtgccacctctgccttaagacgttcagaactgttacccttctccggaatcacgtgaatacgcacactggtacaaggccgtacaaatgtaatgattgtaacatggcatttgtcacttcaggggaactggtccggcatcgaagatacaaacacacacatgagaaaccattcaaatgcagtatgtgcaaatacgcatctgtagaagctagcaaactcaagagacacgttcggagccataccggcgaacgtccttttcagtgttgtcagtgctcctacgcttctcgtgacacttacaagctcaaacgtcatatgcggacacattctgaggccacgagcaagcgttccctccaggagatccctcggtgtaaattccatcccgattgcctccaaatgctgcaggtttggcagcggctgttcccacttgactag

SEQ ID NO: 181967 - DNA, 1722 bp, Artificial Sequence
  Description of Artificial Sequence: Synthetic coding sequence
atggccgccaccgagatcagcgtgctgagcgagcagttcaccaagattaaggagctggaactgatgcctgaaaaggggctgaaggaggaagaaaaggacggtgtttgtagggagaaagatcaccgttcccccagtgagctcgaagcggagagaacctctggagctttccaggacagtgtcctggaagaagaagtcgaactggtgctcgctccgtctgaggaatcagaaaagtacatcctcacactgcagactgtccactttacttctgaggctgtggaactgcaggacatgagtctcctttctatccagcagcaggaaggggtacaggtcgtggttcaacagcccggccctggacttttatggctagaagagggcccccgtcaatctctgcagcagtgtgtggcaataagcatacaacaggagctctacagtcctcaggaaatggaggtattgcagtttcacgcgctcgaggagaacgtgatggttgcctcagaggactctaagctggctgtgagcttggccgaaactacagggctgattaagctcgaggaggagcaggaaaagaatcagttactcgcagagcggacgaaggaacaactgtttttcgttgaaaccatgtctggagatgaaagaagcgacgagattgttttgaccgttagtaatagcaatgtggaagaacaggaggaccagcctacagctggtcaggcggatgccgaaaaagctaagtcaaccaaaaatcagagaaagaccaaaggtgcgaagggaacattccactgcgacgtgtgtatgtttaccagttcgcgaatgtcttcttttaaccgccacatgaagacacatacctctgagaaacctcacctctgccatctgtgtctcaagacctttagaaccgtgactctcttgagaaaccacgtgaacacacacacaggaacacggccttataagtgcaacgattgcaatatggcctttgtgacgagtggagaacttgtgcgccacagaaggtacaagcacacacatgagaagccatttaagtgttccatgtgcaagtacgcatctgtggaggcctcaaagctaaaacggcacgtgcgatcccacactggtgagaggccattccagtgctgtcagtgttcgtacgcctcccgggatacctataaactgaagcgacatatgcgcacgcactctggagaaaaaccctacgagtgtcacatctgtcatactaggttcactcagagcgggaccatgaaaattcacatcctccagaagcacggcgagaacgttccgaagtaccagtgcccgcattgtgcaaccatcatcgctcggaaaagtgatctacgagtgcatatgagaaatctgcacgcttactcagctgcggaactgaagtgtcggtactgcagcgctgtcttccatgagcggtacgcgttgatccagcaccaaaagacccacaaaaatgaaaagcggttcaagtgcaagcattgcagttacgcttgtaaacaggagagacacatgaccgcacatattagaacacacactggggagaagccgttcacttgcctgagctgcaataagtgttttcgacagaaacaactgctcaacgcacactttaggaagtaccacgatgccaacttcataccgaccgtttataagtgctctaagtgcggcaaaggattttctagatggattacctctaagtggtccggcctgaagccacagacatttattacctag

SEQ ID NO: 181968 - DNA, 2103 bp, Artificial Sequence
  Description of Artificial Sequence: Synthetic coding sequence
atggccgccaccgagatcagcgtgctgagcgagcagttcaccaagatcaaagagttagagctcatgcccgagaagggattaaaggaagaagaaaaagatggtgtgtgtagggaaaaagaccacagatcccccagtgagttggaagctgagagaacatctggcgccttccaagattcagtgctggaggaggaggtagagctcgttctcgccccctccgaggagagtgagaagtacatcctcactcttcagaccgtacacttcacctccgaggccgttgagctgcaggacatgtccctgctgagcattcagcagcaagagggcgtccaggtggtcgtccagcagccaggcccaggtctgctttggttagaagaaggaccacgccagagtctgcaacagtgtgtcgcgatctctatccagcaagaactctatagccctcaggagatggaagtcctgcagtttcatgcgctggaggagaatgtgatggtggctagtgaagactcaaagctggctgtaagtttagccgaaacaactggcttaatcaagctggaggaggaacaggaaaaaaaccagctgttggccgagcgtactaaagagcagctgttttttgtggaaactatgtctggagatgagcgatcggacgagatcgtcctgactgtgtctaactctaatgtcgaagaacaggaggatcagcccactgcagggcaagccgatgctgaaaaagctaaatctaccaaaaaccagagaaagacaaagggagccaaaggaacgtttcactgcgacgtctgcatgtttacgagctcccgcatgtcctcttttaacaggcacatgaaaacacacacttccgagaaaccgcacctgtgtcatttatgtttaaagaccttccgcaccgtgacactgttgcggaaccatgttaatacccacacaggcactagaccttacaagtgtaacgactgtaacatggcctttgtcacgtcaggcgaactcgtgcgccaccgccgctacaagcatactcatgagaaaccgtttaagtgtagcatgtgcaaatatgcctcggtggaggcttcaaaattgaaaaggcacgttcggtcccataccggggaacgtccatttcagtgctgccagtgttcttatgcaagccgcgatacatacaagctcaaacgccatatgagaacccactccggtgaaaaaccatacgagtgccatatatgccacaccagattcacccagagcggaacgatgaaaatccacatcttgcagaagcacggggagaacgtgccaaagtatcagtgccctcattgcgccaccatcatcgcaagaaaatctgacttgcgagtgcatatgagaaatctacacgcctattctgccgcggaactgaagtgcagatactgcagcgccgtctttcacgagcggtatgccctgatccagcatcaaaagacgcacaagaacgagaagcggtttaagtgcaagcattgcagttacgcatgtaagcaggagagacacatgaccgctcatataagaactcatacaggagagaaacctttcacctgtctatcatgcaataagtgtttccgccaaaagcaactgctgaacgcacactttagaaaataccacgatgcaaattttattccaactgtctacaagtgctccaaatgcggcaaaggcttcagccgatggataaatctccaccgacattctgaaaagtgtggatctggggaggctaaaagtgctgcaagtggaaaggggcgcaggactcgaaaacggaaacagactatccttaaggaggctaccaagggacaaaaggaagctgcgaaaggctggaaggaagcagccaatggagacgaggctgcggccgaagaagcctcaaccaccaagggtgagcagttcccgggggagatgtttcctgtagcatgtcgggagaccacagctagggtgaaggaggaagtcgacgagggcgtgacatgtgaaatgctgttgaacaccatggataattcggccgggtgtactggacgtatgatgctggtgtccgcctggctacttggtagaccgcaggagacctataatcaaggtaggaggaggcggggatcacggcgggtgacatggtag

SEQ ID NO: 181969 - DNA, 1356 bp, Artificial Sequence
  Description of Artificial Sequence: Synthetic coding sequence
atggccgccaccgagatcagcgtgctgagcgagcagttcaccaagattaaggaactggagctgatgcccgaaaaaggccttaaggaagaggaaaaggatggcgtatgccgcgagaaagaccatcgaagtccgtctgagctagaggctgaacggacaagtggagcgtttcaagattccgtactggaagaagaggtggagttagttctcgccccttccgaagagagtgagaagtatatcctgaccctgcagactgttcattttactagcgaggcggtagagctccaagatatgtctcttctctccattcagcagcaagaaggtgttcaagtagtagtccagcaacctggacccggactgctctggctggaggaggggcctcgccagtctttgcagcagtgtgttgcaatcagcattcagcaggagctgtattcccctcaagagatggaggttctacagtttcacgccttagaggaaaatgtaatggtcgccagtgaggactccaagctggcggtctctcttgcagaaactaccggcttgattaaactcgaagaggaacaggagaagaatcagctgctggcggaaaggaccaaggaacagctttttttcgtagaaactatgagtggggatgagcgaagcgatgaaatcgtgttaacggtgtcaaactccaacgtggaagaacaggaggaccaacccacagcggggcaggcggacgcagagaaagctaaatccacgaaaaatcagaggaagaccaagggcgccaaggggacatttcattgtgacgtgtgcatgtttacatcaagcagaatgagttccttcaacaggcacatgaaaactcacacgagcgagaaaccacacctgtgccatctgtgtctcaagaccttccgaaccgttacactcctccggaaccacgtgaatacacacactggcactagaccttacaagtgtaacgactgcaacatggcatttgttacctctggcgagcttgtccgccaccgacggtataaacacactcacgagaagcccttcaagtgtagtatgtgcaagtatgcatccgtggaggctagcaagctaaaacgtcatgtgagatcccacactggagagcggcccttccagtgttgtcagtgtagctatgcgagcagagatacatacaaattgaagcgacacatgcgtacacactcgggcgaaaagccttatgagtgtcacatctgccacaccagatttacccagagcggcactatgaaaatacatatcctgcagaaacacggggaaaacgtccccaagtatcagtgtccccattgcgcaacaattattgcacggaaatcagatttacgctttctcggcctgcccttcccgtag

SEQ ID NO: 181970 - DNA, 1842 bp, Artificial Sequence
  Description of Artificial Sequence: Synthetic coding sequence
atggccgccaccgagatcagcgtgctgagcgagcagttcaccaagatcaaggaattagaacttatgccagaaaaaggcctaaaggaggaggagaaagatggcgtctgtcgggaaaaagaccaccgcagtccgtccgagctggaggccgaacgcacttccggtgccttccaggacagtgtgctagaggaggaagtcgaacttgtgctggctccaagcgaggaatcggagaagtatatactcaccctgcaaacagtgcactttaccagcgaggccgtcgaacttcaggacatgtccctactgtccattcagcaacaggagggagtccaagtagtcgttcagcagccagggcctggtctgctttggctggaagaaggccctcggcagagcctgcagcaatgcgttgctatttccattcagcaggaattgtactctccgcaagaaatggaggtgctgcaattccatgccttggaagaaaatgtaatggtcgcatccgaggacagcaaactggctgtgtctctcgccgaaactacaggcctgattaagctggaagaagagcaggaaaagaatcagttattggcagagcggaccaaagaacaattgttcttcgtagagaccatgtcaggcgatgagagaagcgatgaaatcgttctgaccgtctcaaactccaatgtagaagagcaggaagaccaacccactgccggccaggcagatgctgagaaggcgaaatctaccaaaaatcagcggaaaacaaaaggcgccaagggaaccttccactgtgatgtgtgtatgtttacgtcaagccggatgtctagcttcaataggcatatgaagacccacactagcgagaagcctcacctgtgccacctttgcctgaaaactttcagaaccgtgaccctgctcaggaatcacgtaaacacgcacacaggcaccaggccttacaagtgcaacgactgtaacatggcgtttgtaacatctggcgagttagttcggcaccggcgctacaaacatacccatgagaagccatttaaatgctccatgtgtaagtatgctagcgtcgaagcaagtaagctcaagagacacgtgagaagccacacaggcgaaagaccattccaatgttgtcagtgttcttacgctagtcgggacacatataagctgaagagacacatgaggactcactcaggagtacacatgagaaacctgcacgcctactccgctgcagagcttaaatgccgttattgtagcgctgttttccacgagcgctacgccttaattcaacatcagaagacccacaagaacgagaagcggttcaaatgcaagcactgctcctacgcatgcaagcaggagaggcatatgacagctcatatccgaacgcacaccggagaaaagccgttcacttgcctctcctgcaataagtgtttccggcagaaacagttgttgaacgctcatttccggaagtatcacgacgcgaacttcattccaaccgtctacaagtgctcgaaatgtggcaaagggttttctcggtggatcaacctgcatcgtcatagcgaaaagtgcggctccggagaggccaagtcagcagccagtggcaaaggccgacggacaaggaaaagaaaacaaactatcctgaaggaggctactaaaggccagaaagaagccgccaaaggctggaaggaggccgccaatggcgacgaagccgccgcagaagaggcctccaccacaaagggggaacagtttccaggcgagatgtttcccgttgcttgtagggaaacaaccgcacgggtgaaggaagaagtggatgagggggtgacctgtgagatgcttctcaataccatggataaatag

SEQ ID NO: 181971 - DNA, 1452 bp, Artificial Sequence
  Description of Artificial Sequence: Synthetic coding sequence
atggccgccaccgagatcagcgtgctgagcgagcagttcaccaagattaaggaactcgagctgatgcccgaaaagggtttgaaagaggaggaaaaggacggagtgtgccgggagaaggaccacagaagcccctccgagctcgaggcagaaaggacttccggagcatttcaggactctgtgcttgaggaagaggtggagttggtgctggctccctccgaggaatccgaaaaatatattttgaccttgcaaactgtacatttcactagcgaagcagtggagttacaggacatgagtctgttgagtattcaacagcaggagggcgtgcaagtggtggtccagcagccaggacctgggctgttatggttggaggaagggcctcggcagtcattacagcagtgcgtagccatcagcatccagcaagagctttactctcctcaggaaatggaggtgttacagttccacgcactcgaagaaaacgtaatggtggccagcgaggattctaaactggcggtcagtttggcagagactacaggccttatcaaattggaggaggagcaagaaaagaaccagctgctggctgagagaacgaaagaacaactgttctttgtcgagaccatgagcggcgacgaaaggtccgacgagatcgtgctgacggtctcaaactcaaacgtggaagagcaggaggaccagcccacagcaggacaagctgatgcagagaaggctaagtcgaccaaaaaccagcgtaaaacaaagggcgctaaaggcacattccattgcgatgtctgcatgttcacctcctctaggatgtccagtttcaatcggcacatgaaaactcatacaagtgagaagcctcatctgtgccacctgtgccttaaaacttttcggacagtaacacttctcaggaatcacgtcaacacacatacgggaacccgtccatacaagtgtaacgactgcaatatggccttcgtcacgagcggagaactggtgcgacatcggagatacaagcacacgcatgaaaagccatttaagtgttcaatgtgtaaatatgcatcagtggaagagagacatatgactgcgcatattaggactcacactggagaaaaaccctttacatgtctgtcgtgcaacaaatgcttcaggcagaagcagctcctgaatgcccattttaggaaatatcacgatgccaacttcattcctactgtctacaaatgttcgaaatgtggaaaggggttctcccgatggattctctgggtgggaaattcagaggtggccgagctgggcgggcctggcagtggtccattgctgcggctgcagagcggctgcccacccggactgcatcaccctaaggctggccttggcccagaggaccctctgcctggtcagctgagacacacaactgcgggtacaggtctgagctccctactgcaaggtccactgtgccgggctgcatag

SEQ ID NO: 181972 - DNA, 1998 bp, Artificial Sequence
  Description of Artificial Sequence: Synthetic coding sequence
atggccgccaccgagatcagcgtgctgagcgagcagttcaccaagatcaaggagctggagctcatgccggagaagggtttgaaggaagaggaaaaggacggcgtttgccgtgagaaagatcatcgttcacccagcgagctggaggccgaacggacaagcggggcctttcaggatagcgtgctggaggaagaggtggagctggtgctcgcaccatcggaggagtccgagaagtacatcttgaccctgcagaccgttcactttacctcggaagccgtggagctccaggacatgagcctccttagtatccagcagcaagagggtgtgcaggtggttgttcagcaacctggtccaggcttgctttggctagaagagggtcctcgtcaaagcctgcagcagtgtgtcgccatctccatccagcaggagttgtactccccacaggagatggaggtgctgcagttccatgccctcgaggagaatgtgatggtggccagcgaggactccaagctggccgtcagtttggcagagacaactggtctcatcaagcttgaggaggagcaggagaaaaatcagctcctggctgaacgtaccaaagagcagctgttctttgtggagactatgagtggggacgagcggagcgacgaaattgtgcttactgtgagcaacagcaacgtcgaagagcaggaggaccaacccaccgcggggcaggccgacgccgaaaaggccaaatccaccaagaatcagcgcaaaactaaaggtgctaaagggacatttcattgcgacgtatgtatgttcacctcaagtcggatgtctagctttaatagacatatgaaaacgcacacctccgagaagccccacctatgccatctgtgcctcaagacctttaggaccgtgacattgttgcggaaccatgtcaatactcatactggtaccaggccttataaatgcaacgactgtaacatggcttttgtgacttccggtgaactggtgcgtcaccgtcggtataagcacacccatgaaaaaccctttaaatgctctatgtgtaagtatgcttccgttgaggcaagcaaactgaaaagacacgtccgttctcacacaggcgaaagacccttccagtgctgccagtgctcttacgcctctcgcgacacctacaaactcaaacgccatatgagaacacattctggcgaaaagccctatgaatgccacatttgtcacacgcggtttacacaaagcgggacaatgaagattcatatcctgcagaaacacggggaaaatgttcctaaataccagtgcccacactgcgctacaatcatcgccagaaagtctgaccttcgcgtccacatgcggaatctgcatgcatactctgccgctgagctcaaatgccgctactgtagcgccgtgtttcacgaacgttatgccctcattcagcaccagaaaacccataagaacgagaagcgatttaaatgcaaacattgctcctatgcttgcaaacaggagagacacatgacagcccacatcagaacccacacaggggagaaaccctttacttgcctgagctgcaacaaatgtttcaggcagaaacaactcttgaatgctcatttcaggaaatatcacgatgccaactttattcccactgtgtataaatgttctaagtgcggcaaaggcttcagcagatggattaatcttcatcgccactctgagaagtgcgggtccggggaagccaagtccgcagcttcagggaaaggacgccgaacccgaaaaaggaaacagaccatcctcaaggaagctaccaaggggcagaaagaggcagccaaaggatggaaggaagctgccaacggggatggggtgattagtgcccacaggaatctttgtctcctgggaagctccgacagccacgcctctgtgtcaggcgccggcataacagatgcaaggcaccatgcgtggctgattgtcttgctgtttcttgttgaaatggggttttaccacgtgtcccactcttag

SEQ ID NO: 181973 - DNA, 1212 bp, Artificial Sequence
  Description of Artificial Sequence: Synthetic coding sequence
atgttcaccagcagccggatgagcagcttcaaccggcacatgaagacccatacttcagagaaaccacacctgtgtcacctttgtttgaagactttccggaccgttactctgttgcggaatcacgtgaacactcacacaggcacacggccatataagtgcaatgactgtaatatggcttttgtgaccagcggagagcttgtccgacatcgtaggtataagcatacgcacgagaagccatttaagtgtagtatgtgcaagtatgcttctgtggaagcctcgaagctcaaacggcacgtacggtctcatactggggagagaccatttcagtgttgccagtgctcctatgcctcaagagatacttataagctgaagcggcatatgaggacgcattctggagaaaaaccatatgagtgtcacatttgtcatacccgtttcactcagtccgggaccatgaagatccacatcctgcagaaacacggtgagaatgtacctaaataccaatgccctcactgtgccacgataatcgctcgcaaatcagacctgagagttcacatgagaaatctgcatgcctatagtgcggccgaattgaagtgccggtactgttccgccgtgttccacgaacggtatgcattaatccaacatcagaagacccataaaaacgagaaacgattcaaatgcaaacattgctcttatgcctgcaaacaggagagacatatgactgcacacattcgtactcacacaggagagaagccctttacctgcctctcttgcaataaatgctttcggcaaaagcaactcctgaatgctcattttagaaaatatcacgatgccaacttcatcccaacagtctacaaatgctccaaatgcgggaaagggttctctaggtggattaatctccatagacactctgaaaaatgcgggtctggagaagccaaatcagccgccagcgggaaggggcggcggaccaggaagagaaaacagacaatcctcaaagaagcaaccaaaggacaaaaggaggccgccaagggctggaaggaagccgccaacggtgatggcgtgatcagtgctcatcggaacctgtgtctgctgggctcatcagacagccatgctagcgtctccggagcgggcataacggacgcccgccaccatgcgtggctgatcgtgctgctgttccttgtggagatggggttctaccacgtcagccattcatag

SEQ ID NO: 181974 - DNA, 1269 bp, Artificial Sequence
  Description of Artificial Sequence: Synthetic coding sequence
atgagcggcgacgagcggagcgacgagatcgtgctgaccgtgagcaactcgaatgttgaagagcaggaggatcagccgacggctggacaagcagatgccgaaaaggccaaaagcacaaagaatcaacggaagaccaagggtgcaaaagggacctttcactgcgacgtgtgtatgttcacttccagtaggatgtctagctttaatagacacatgaagacgcatacgtcagaaaagccccacctctgtcacctgtgcctcaagacgtttcggacggtaacactgttgagaaaccacgtgaatacccacactggcacacggccttacaaatgtaacgactgcaacatggcctttgtgacaagtggcgagctagtacgccacagaaggtataaacacactcacgagaagccctttaaatgcagcatgtgtaagtatgcaagcgttgaggcttctaagctaaaacgccacgtccggtcccataccggggaacggccttttcaatgctgtcagtgctcgtatgcttcaagggacacttacaagctgaagagacacatgagaacgcacagcggcgagaagccctacgagtgccatatctgtcatacccggtttacacaaagtggaacgatgaagatccatattcttcagaagcacggggaaaatgtccccaagtaccagtgccctcattgcgctacaataattgccagaaagagtgatttgagagtgcatatgcggaatctgcatgcctatagcgctgcagagctgaagtgcagatactgtagcgccgtgtttcatgagcggtatgcgctcatccagcaccaaaagacccataaaaacgaaaagcgatttaagtgtaaacactgctcttacgcttgcaaacaggagagacatatgacagcacatatacggacccacacaggcgagaaaccttttacttgtctgtcatgcaataagtgcttccgccaaaagcaactgcttaacgctcactttcggaaatatcacgatgccaacttcattccaactgtgtataagtgttccaaatgcggcaagggcttctctagatggatcctgtgggtaggcaactccgaagttgcagagctggggggtcccgggtcgggacccctgttgcggctgcagtccggctgccctccaggtctccatcacccaaaagcagggctcgggccggaggacccccttcccggtcagctcagacatactacagcaggaaccggcctgtctagtctgctgcagggccccctgtgtcgcgccgcatag

SEQ ID NO: 181975 - DNA, 1296 bp, Artificial Sequence
  Description of Artificial Sequence: Synthetic coding sequence
atgttccacagcccccggcggctgtgcagcgccctgctgcagcgggacgcacctggcttgcgccgactgccagcccctggcctccgccgcccattgtctccaccagccgcagtccccaggcccgcttccccgcggctgttagccgccgcctctgctgcctcaggagcagccagaagttgctctcgcacagtctgcagtatggggaccggtacttccaggctctactccgcattggcaaaaactttgaactcatccgcagcctcccaacatcctgagtatctagttagcccagatccagaacatttggagccaattgatcccaaagagctgctggaagagtgcagggctgttctccatactagaccaccaaggtttcagagggacttcgtggacctgagaacagactgtccaagtactcacccccccattagggtgatgcagtggaatatactggcccaggcccttggcgagggtaaagataactttgtgcagtgtcccgtggaggctcttaagtgggaggagcgcaagtgtctcatcctggaggaaattctggcatatcaaccagatattctctgcttgcaagaggtggaccactactttgacaccttccagcccctgttgtcacgcctgggctatcagggcacattttttccgaagccatggtctccctgcttggatgtcgagcataacaacggaccagacggatgtgcgctgttcttcctccagaaccggtttaagctcgtcaattcggccaatatcagactgacggcaatgactctgaagaccaatcaggtggccatcgctcagacacttgagtgcaaggagtctggacgccagttctgcatcgcagtgacacacctgaaggctcgcaccggctgggaaagattccggagcgcacaaggctgtgacctccttcagaacctgcagaacatcactcagggcgctaaaattcccctgattgtgtgcggagacttcaatgcggagccaactgaggaggtgtataagcacttcgcatcaagctccttaaacctcaatagcgcctacaagctccttagcgctgacggacagagcgagccaccctataccacatggaagatccggacatcgggggaatgccggcacactctcgactatatctggtacagcaagcacgccctgaatgtgcgatctgctctcgatctgcttacggaggaacagatcggccctaaccgtcttccgagctttaactacccctcagaccacctttctctggtgtgcgatttttcctttacagaggagtccgacggactgagctag

SEQ ID NO: 181976 - DNA, 2133 bp, Artificial Sequence
  Description of Artificial Sequence: Synthetic coding sequence
atgagccggagccccgacgccaaggaggaccccgtggagtgccccctgtgcatggagcccttggagattgacgatatcaacttcttcccatgcacctgtggctaccagatttgccgtttctgttggcaccggattaggacggacgagaacgggttatgtccggcttgcagaaagccatacccagaggatccggccgtgtataaacctctatcccaggaggaattgcagcgtatcaagaacgaaaagaagcagaaacaaaacgagcggaaacagaagatttctgagaacagaaaacatctcgctagcgtcagggtggtgcagaaaaatctggtgttcgtcgtgggtctgagccagcggctggccgaccccgaggtgctgaagaggccggagtattttgggaagtttgggaagattcacaaagtggtaataaataatagcacctcctacgcagggagccagggcccctcagcaagcgcctatgtgacttacattcgttccgaagacgcactgagagctattcaatgtgtgaacaacgtcgtggtcgacggccgaaccctgaaggctagtcttggaacaacaaaatattgcagctattttcttaagaacatgcagtgccccaaacccgattgcatgtacttgcatgagctcggcgacgaggcggcatcgttcaccaaagaggaaatgcaggccgggaaacatcaggagtatgagcagaaactgctccaggaactctataaattgaaccctaactttctacagttgagcaccggttccgtggacaagaataagaacaaggtaactccactgcagagccctatcgacaaaccttccgatagcctgagtattggaaacggggacaattctcagcagatttctaacagcgacacaccatctcccccaccagggttgagcaagagcaacccagtgattcccatttcttcgtctaatcactcggctaggagtcctttcgaaggcgcagtgactgagagtcagagcctgttttcagataactttcgtcaccctaatccaatccctagcggcctgcctccttttccatcgagcccccagaccagttcagattggcccacagcacccgaacctcaatcactgtttaccagcgagacaatacctgtatcaagctccaccgactggcaggcagcctttggtttcgggtccagcaagcagcccgaggatgaccttggattcgatccattcgacgtgactagaaaagcccttgcggacttgatagaaaaggagctgagcgtgcaagatcagccctctctgtctccgacaagtctacagaattctagctctcacacaacaacagctaaaggccccggttcagggttcctgcaccctgctgccgctacaaacgcgaactctctgaacagtactttcagtgtcctgccccagagattcccccagttccaacaacatagggctgtttacaactccttttctttccctggccaggcagccagatacccctggatggcattcccaagaaacagcatcatgcacctgaatcatactgcaaacccaacctcgaactctaactttttggatttaaatctcccaccgcaacataacacaggcctcgggggcattccagtggctgacaatagctcctccgtagagagtcttaatatgaaggagtggcaggacggacttagagccctcctgcccaatataaatattaatttcggaggactgcctaactcaagctcccccagcaacgctaatcactccgcaccgaccagtaacactgcgaccaccgatagtcttagctgggacagtccggggtcatggaccgaccccgctatcattacgggcatccccgccagcagcggcaatagcctggactctctgcaggacgacaaccctccccattggctgaaaagtctgcaggctctgacagaaatggatggcccctcagccgctccctcacagacccaccattccgcaccctttagcacccagataccacttcatagggcttcatggaacccctacccccccccctcgaatccatcttcattccatagtcctcctccaggtttccagacagcctttcgaccgcccagtaagacccccacagacttactgcagtcgtctaccctggatcggcactag

SEQ ID NO: 181977 - DNA, 3684 bp, Artificial Sequence
  Description of Artificial Sequence: Synthetic coding sequence
atgacccagaaggtggaggagctgaaggagaccgtgaaggaggagttcatgccctgggttagccagtacctcgtcatgaagcgcgtgtccattgagcctaactttcattccctatactccaactttttggacacccttaagaatcctgaattcaacaaaatggtgctgaacgaaacctatcggaatatcaaagatctggacgtcaagagcctgctcctcgaggcatacgtgaagggacagcaagaactcctgtatgtcgtacccttcgtggccaaagtgctggagtcttcaattcgatctgtagttttccggccacctaacccatggacaatggccataatgaacgtcctggcggagctgcaccaggaacatgatctgaagctgaacttgaaattcgagattgaggtgttgtgtaagaaccttgccctcgacatcaacgagttaaagccgggcaatctactgaaggataaagacagactgaaaaatttggatgaacaactgtccgcccctaagaaggacgttaagcagccagaggaactgccccctatcaccaccaccacgacttctactactcccgcgacgaacacaacctgcaccgccaccgtgccacctcaaccacaatatagttatcatgatatcaacgtttatagtctggcaggtctggcacctcatataaccctgaacccaaccatccctttattccaggcgcaccctcagctcaagcaatgtgtccggcaggctatcgaacgagctgtgcaggagcttgtgcaccctgtcgtcgatcgatctattaaaatcgcaatgacaacctgtgaacagatcgtgagaaaggattttgcgctggacagcgaggagtcccggatgagaatcgcggcacatcacatgatgcgaaacctgactgcgggcatggccatgatcacttgtagagaacctctgcttatgtccatctcaactaacttgaaaaactcctttgctagcgcactgcgaaccgctagccctcagcagagagagatgatggaccaggcagcagcgcaactggctcaagacaattgcgaactagcctgttgttttatccagaagaccgcggtagagaaggctggacccgagatggataaacggttagcaacagagttcgaactccggaagcacgcgaggcaggaaggcagacggtattgtgaccccgtcgtgctgacctaccaagccgagcggatgccagagcagattcggctgaaagtggggggggtcgatcccaagcagctcgcagtgtatgaagaatttgctcgtaacgtgcccggctttctgccgacaaacgatctgagccaacccacagggtttctcgctcagccaatgaagcaggcgtgggccactgacgatgtggcacagatctatgataaatgtatcaccgagctggaacagcacctgcacgccataccacctaccctagctatgaacccacaagcgcaagcactgcgttccctgctggaggtcgttgtcctgagtcggaattcacgggatgcgatagcagctctgggactgctccaaaaggccgtagagggacttctggatgccactagcggagcagacgccgacttactcctgaggtatagagagtgccacctgctcgttcttaaggccctgcaggatgggcgcgcctatggaagtccttggtgcaacaaacaaatcacacggtgcctcattgaatgcagagatgaatataagtacaacgtggaggcagtggagttattgataaggaaccacctggtaaatatgcagcagtatgatctacacctagcacagtccatggaaaacgggctgaactacatggccgtcgcttttgctatgcagctagtgaaaatcctgcttgttgacgaacgatctgtcgcccatgtcactgaagcggatctctttcatacaatcgaaacactgatgcgcattaatgcacacagtcgcggcaatgctcccgagggcttgcctcagctgatggaagtcgtcaggagcaactacgaagccatgatagaccgcgcccatggcggtccgaactttatgatgcactctggcatcagtcaggcctctgagtacgacgatcctcctggactgagggaaaaggccgaatatctcctcagggagtgggtcaatctctaccattccgccgccgcaggccgtgatagcactaaggcattttccgccttcgtaggacagatgcaccagcagggaattctgaaaactgatgaccttattacccggttttttcgcctttgcacagaaatgtgtgtcgaaatttcttatcgtgcgcaggcagagcagcagcacaaccctgccgcgaaccccaccatgatccgggctaaatgttatcataacttggatgccttcgtacggctgatcgcccttctggtcaaacattctggagaggccaccaatactgttaccaagatcaaccttttaaacaaggtgctgggtatcgtggtgggcgtgctgttgcaagatcatgacgtgcggcaaagcgagttccagcagctcccataccaccggatcttcattatgctgctgcttgaactgaacgcgcctgaacatgtgctggagacaattaattttcagactttgacggccttttgcaacaccttccacattctccgacctacgaaggcaccaggattcgtctatgcctggctggagctgatttcccatcgcatttttatcgcaaggatgctcgctcacacacctcagcagaaaggatggcctatgtatgctcagcttctaattgacttgttcaaatatcttgcccccttcctccgcaatgtcgaacttactaaacctatgcagatcctatataagggaacccttagggttttgctcgtcttgttacacgatttccctgaattcctctgtgactaccactacggcttctgcgatgttattccgcctaattgcattcagctgagaaatctcattctcagtgcattccctcgcaacatgaggctgcctgatccattcacacctaacctgaaagtcgacatgctttctgaaatcaatattgcaccccgcatcctaactaacttcacaggagtgatgcccccccagtttaagaaggacctggactcttatctgaaaacacggtccccggtcacatttttatcagacctccgaagcaacttgcaggtttcaaacgaacctggcaacaggtataacctccaacttatcaacgcactcgtgctgtacgttggtactcaagccatcgcccacatccataacaaaggatccaccccttccatgtcaacaattacccattccgcacacatggatatttttcagaatctggcagtggatttggatacggaagggcgataccttttcttgaacgccatcgccaaccagctgcgctatccgaatagtcacacccactacttttcttgcaccatgctctacctgtttgcggaggccaatacagaagccattcaggagcagatcacacgggtcctgctggagcggctgatcgtcaaccgacctcacccctgggggctcctgattacgttcatcgagcttatcaagaatcctgcgttcaaattctggaaccacgaatttgtacattgtgctccggaaatcgagaagttgtttcagagcgtggcccagtgctgtatgggccagaaacaagcccagcaggtgatggaaggaactggcgcatcttag

SEQ ID NO: 181978 - DNA, 7131 bp, Artificial Sequence
  Description of Artificial Sequence: Synthetic coding sequence
atgaacctggacagcctgagcctggccctgagccagatcagctacttggtcgacaacttaacgaagaaaaattatcgcgcaagccagcaagaaatacagcacatcgtgaaccggcacggcccagaggcggacaggcatctgctgcgctgtcttttctcacatgtggacttttccggggatggtaaatcctcaggtaaggatttccatcagacccagttcctgatccaggaatgtgccctcctgattacaaaaccaaattttatttcaaccctctcttacgccatcgataaccctctgcattaccaaaagtctctgaagcctgctccccaccttttcgctcagctatccaaggtcctgaaactgtctaaagtccaggaagtgatattcggcctcgcactgcttaatagttcatcctccgacttgcgagggttcgccgctcagttcatcaaacagaagctgcctgacctcctgaggagttatatcgatgccgacgtgtcaggtaatcaggaaggcgggttccaagatattgctatcgaggtgctccacctcttgctgtcacatctcttgttcggacagaagggcgccttcggggtgggtcaggaacagatcgacgccttcctaaagacgctgaggcgcgactttccccaggagaggtgtcccgttgtcctggcaccgctcctgtatcccgaaaagcgcgatatcctcatggatagaattttgccagacagcggcggggtcgccaagaccatgatggagtcttctcttgcagattttatgcaagaagtcggctatggcttttgtgcttctatcgaggagtgtaggaatatcatcgtccagtttggcgtgcgcgaggtgaccgcagcccaggtggcaagggtgctgggcatgatggcacgaacgcattcgggactgacagatggaataccactgcaatccataagcgcacctggctccgggatctggtctgatggcaaggataaatcagatggggctcaggcccatacatggaatgtcgaggtgctcattgacgttctgaaagaactgaatccttccctgaactttaaagaagtcacatacgagttagaccatccgggtttccagattcgagatagcaagggactgcacaatgtggtgtatggcatccagcgggggctgggtatggaggtctttccagtggacttgatttacaggccatggaagcacgcggagggtcagctcagctttatacaacattcactgataaatccggagatcttctgcttcgctgattatccttgtcataccgtggccacagatatcttgaaggcacctcccgaagatgacaatcgtgagatcgctacttggaaatcgctggatctgattgaatccctgctgcgtctggccgaagttggccaatacgagcaagtcaagcagctcttttctttcccaataaagcattgtcccgacatgctcgtgcttgcactcttacaaattaacacaagttggcacactctccgacacgagctcatctccaccctaatgcccatctttctcggtaatcacccaaattcagctatcatattgcattacgcctggcacgggcagggacagtctccttctattcgccaattaatcatgcatgccatggccgagtggtacatgcggggcgaacagtacgaccaggccaagctgtcacgtatactcgacgtcgcgcaggacttgaaagccttgtcgatgttgctgaatgggactccatttgcgttcgttattgatctggctgcacttgcctcacggagagaatacctgaaactggacaaatggttgactgataagatccgagaacatggcgagcctttcatacaagcttgtatgacttttctaaagagaagatgtcccagcatcttgggcggcctcgcccccgagaaggaccagccaaaatctgcccagcttcccccagaaaccctggccaccatgcttgcgtgtttgcaggcttgcgctgggagcgtgtctcaagagctgagtgagacaatactgaccatggtagctaattgttctaatgtcatgaacaaagcaagacagcccccgccgggtgtaatgccaaaggggcggcccccttccgccagcagtttggatgccatttctcctgtacagatagacccacttgcaggcatgactagcctatcgatcggcggctcagcggcccctcatacccagagtatgcagggatttcccccaaatctcggcagtgctttttctactccacagagtccagccaaggcgttccctccactttcaaccccaaatcagaccaccgctttttctggaattgggggcctctcatctcagctacctgtcgggggcctgggtacaggatccctcactgggattggcaccggggccctcggcttgcctgcagtgaataacgatccattcgtgcagcgaaaattggggactagtgggctcaaccagcctactttccagcaaagcaaaatgaaaccatcagacctgagccaggtttggcctgaggcaaatcagcacttctccaaagagatcgatgacgaggctaattcttactttcagagaatatataatcatcctccgcacccaacaatgtcagtggatgaggtgctggaaatgctgcaacggtttaaggactccaccatcaaacgggaacgggaagtgttcaattgtatgttgagaaacctattcgaagaataccgtttcttcccacagtaccccgacaaggaactccatatcactgcctgcctgtttgggggtatcattgagaaagggcttgtgacctatatggccctaggcctggctctgcggtacgttttggaggccttaagaaaacccttcgggtcaaagatgtattacttcggcatcgccgcgttagatcggttcaagaaccgacttaaggactacccacagtactgtcagcacttggcgagcatatcacactttatgcagtttcctcaccatcttcaggagtatatagaatatggtcaacaatccagggatccaccagtaaaaatgcagggctcaatcacgacacccggttctatagctcttgcacaagcgcaagcacaagcccaggtcccggccaaagctcctctggccggtcaggtaagtaccatggtgaccacctcaactactactaccgtggcgaagacagtaactgtaaccagaccaacgggggtctcttttaagaaagacgtgcctccgtcaatcaacactactaatatcgacaccttgttagtagcgactgaccagactgagcgcatcgtcgagccacccgaaaatattcaggaaaagatagcctttatctttaataacctttcgcagagcaacatgacccagaaagttgaagagttgaaggagacagttaaagaggaatttatgccctgggtgtctcaatacctggtcatgaagcgcgtgtccatcgaacctaacttccattctctgtatagcaattttttagacacccttaagaaccccgaatttaacaaaatggtcctcaatgaaacctacaggaacatcaaggtcctgctgacctccgataaggccgccgccaacttctctgatcgatcactgttgaagaatctgggacattggctgggtatgatcacgctggctaaaaacaagcctattctgcacacggatttggatgtcaagagcttgctgctggaagcctacgttaagggccagcaggagctattgtacgtcgtaccgtttgttgctaaggtcctggagagttccatccggtccgtggtgttccgaccacctaacccttggactatggccataatgaatgtgctggctgagcttcatcaggaacacgatctcaagttgaacctgaaattcgaaattgaggtcctgtgcaaaaacctcgctctggacataaatgagctgaaacctggtaacctgttaaaagacaaggacagactgaagaatctggacgaacagctctccgcacccaaaaaggatgttaaacagcccgaggaattaccccctatcactactactactacaagtaccacccccgcaacaaacacaacctgtacagcaaccgttccgcctcagccgcagtacagctatcacgacataaacgtgtattcgttagccgggctggccccccacatcacgctgaatccaacaatccctctctttcaggcgcacccccagctgaaacagtgtgtaaggcaagctattgaaagagctgtgcaggagctcgtacacccggtggttgatagatccattaaaatcgccatgaccacttgtgagcagatcgtgcgtaaggatttcgccctggactccgaagagtcaaggatgcgcattgccgctcatcacatgatgcgaaacctgaccgccggaatggcaatgattacctgccgcgagcccctgctcatgtctatcagtaccaatttgaaaaattctttcgctagtgccctgagaaccgccagtccccagcagagagagatgatggaccaggcggcagcccagttagcgcaagataactgcgaattggcatgctgtttcattcagaaaacagccgtggagaaagctggcccggaaatggacaagcggttagcgaccgagtttgaactgcgtaagcacgccagacaggagggccgccgttattgcgaccccgtggtactgacataccaggcggagaggatgcccgaacagatccgcctgaaagtaggcggcgtcgatcccaaacagctcgctgtgtacgaagaattcgccaggaacgtgccgggctttttgcctacgaatgatttatcccaaccaactggcttcttagcacagccgatgaagcaggcctgggctacagacgatgttgcccaaatttatgataagtgtataaccgagctggagcagcacctgcatgcgattcccccaacacttgccatgaaccctcaggcccaggcgttgcgcagtctgttggaggtcgttgttctgagccggaacagccgtgatgccatagcagctctcgggctcctgcagaaagctgtagaaggccttctggatgctacctcgggagctgatgccgacctattactaaggtacagagagtgtcacttgctggtgctgaaggccttgcaggacggacgggcttacggaagcccctggtgcaacaaacagataacccggtgtctgatagagtgtcgcgacgaatataagtataatgttgaagccgtggagttactgatcagaaatcacctcgtgaacatgcagcaatacgacctgcatctcgcgcaaagtatggaaaatggactaaattacatggccgtggcattcgctatgcagctcgtcaagatcctgcttgtggacgaaagatctgttgctcatgtcacagaggcagatctgttccacactatagaaacccttatgcggattaatgcacatagcagaggcaatgcccctgagggactcccgcagttgatggaggtggtgagatctaactatgaggcaatgattgatagagcacacggtgggcccaactttatgatgcactcagggatcagtcaagcaagtgagtatgatgaccccccaggcctcagggaaaaggctgagtacctgctcagggaatgggtcaatctctaccacagcgcagcggccgggagagatagtaccaaagccttttccgcttttgttgggcagatgcaccagcaaggcattctcaagaccgatgacttaattacacgtttctttaggctctgcacggagatgtgtgtagagatctcctacagagctcaggccgagcagcagcacaatccggctgccaatcctacgatgatacgcgcaaaatgttaccataaccttgacgcattcgttagactcatcgctcttttggtcaagcacagtggagaagctacaaatacagtcacaaaaatcaatttgctgaacaaagtgttgggaatcgttgtgggggtcctcctacaggatcacgatgttcggcaaagcgaatttcagcaactgccttaccatcgaattttcataatgcttttattagaactaaacgcccctgaacacgtgttggaaaccattaatttccagaccttgactgccttttgcaacacttttcatattctgcgaccaaccaaagcaccagggttcgtgtatgcatggctcgagcttatctcgcacaggatcttcattgcacgcatgttagcgcatactccccagcagaaggggtggccgatgtatgcccagcttttaatcgatttgttcaaatacctcgccccttttctcagaaacgttgaattgactaagcctatgcagattttgtataaggggacactccgcgttttgctggtacttctgcacgatttcccagaattcctttgcgactaccattacggattttgcgatgtgataccgccaaactgtatacaactcaggaacctcattctttcagcctttccacgcaatatgcgactacccgatccatttacccccaaccttaaagtcgacatgctctccgaaattaacatcgcccctaggattcttaccaacttcacaggtgtgatgccaccgcagttcaagaaggatctcgattcctacttgaagacaagatctcctgttacattcctatcggacctgcgatccaatctccaggtgtctaatgaacctggaaaccgctacaatctccagctgataaatgccttggtcctatacgtgggtacacaggcgatcgctcatatccacaataaaggaagtacaccctccatgtctaccatcacgcactcagcccacatggatatttttcagaatttggccgtggacttggatacggaaggaagatatttgtttctcaacgcaattgcaaatcagctgcgctaccctaattcccatactcattacttctcatgtactatgctataccttttcgcggaagccaacaccgaggctatccaggaacaaatcactagggtgctcctagagagattaattgtaaataggccccacccttggggattgctcattacattcattgagcttataaagaacccagcttttaaattctggaatcacgagttcgtgcattgtgcccctgagatcgagaagctgtttcagtccgttgctcagtgttgcatggggcagaagcaagcccagcaggtgatggaagggaccggggcctcatag

SEQ ID NO: 181979 - DNA, 6453 bp, Artificial Sequence
  Description of Artificial Sequence: Synthetic coding sequence
atgaacctggacagcctgagcctggccctgagccagatcagctacctggtggacaacttaactaagaaaaactacagggcaagtcagcaggagatccagcatattgttaatagacacgggcctgaggccgatcgacacctgctgaggtgcctgtttagccatgtggacttttcgggtgacggaaaatcttctggtaaggactttcaccagacgcagttcctcattcaggagtgtgctttactgatcacaaagcccaattttatcagcactctgtcttatgccatagataatcctctccactaccaaaagtccctcaaacctgctccccacttatttgcacagctgtccaaagtcctcaagttaagtaaagtgcaggaagtcatctttgggctcgcactcctgaactcatcttccagcgatcttaggggctttgctgcccaatttatcaaacagaagctgccggatctgctgcgttcttacatcgatgctgatgtgagcggcaaccaagaggggggctttcaagatattgcaattgaggtattacaccttttattgagccacttgctcttcggccaaaagggagctttcggggtggggcaggaacagatagatgccttcttgaaaactctgcggcgtgactttcctcaggagcgatgtccggtagtgcttgcgccattgctctacccagagaagcgagacattttgatggacaggatactaccggacagcggcggcgttgccaaaacgatgatggagtcgtccctcgcggacttcatgcaagaggtgggatacggtttctgcgcatcaatcgaagagtgtcgtaatataatcgtccagtttggtgtcagagaagttacggccgctcaggtggcccgagttttaggaatgatggcccgcacccattcaggcctaacagacggcataccgctccagtcgatttcagcgcccggaagcggcatttggtcggacggcaaagataagtcagacggcgcccaagcgcatacctggaacgtggaggtgctaatcgacgtgcttaaggagcttaacccaagcctgaactttaaagaggtaacttatgagctcgaccacccaggttttcagatcagggactcgaagggactgcacaatgtggtatatggaatccaaaggggactgggaatggaggtgttccccgtggatctgatttaccggccttggaaacacgctgagggccagctaagttttattcaacactccctgataaatccagagatcttttgttttgcagactatccctgccatacagtggccacggacatcctgaaagcccccccggaggacgataaccgagaaattgcgacgtggaagtcactcgacctgatcgagtccctattgagattagctgaggtgggccagtacgaacaggtgaaacaactgttttcctttccaatcaaacactgtcccgacatgctcgtgctggctttattgcagattaacacctcatggcacactctgagacacgagctgatttccacactgatgcccatttttctgggcaaccacccaaactccgccattatcctccactacgcatggcacggtcagggacagtccccttccatcaggcagctgatcatgcatgccatggctgagtggtacatgcggggcgagcagtacgaccaggccaagttgtccagaatactggatgtcgcgcaagacctgaaggcactgtccatgctgctcaacgggacaccgtttgcctttgtcattgacctggccgcgctcgcatcgaggcgagagtacttgaaactggacaagtggttgacagacaagatcagagagcacggtgaaccctttatccaggcatgcatgaccttcttgaagcgacgctgtccatccattctaggtgggcttgctcctgaaaaggatcagccaaaatctgcccagctgcctcctgaaaccctggccacaatgctggcctgcctccaggcctgcgctggcagcgtatcacaggagttgtcggaaacaatcctcacgatggtggctaattgctctaatgtcatgaataaggcccggcagcccccaccgggagtcatgcccaaagggcgccctcccagcgccagcagcctagatgctataagccccgtgcagatcgacccactggctgggatgacctccttgtctatcggtggcagtgcagcacctcacacccagagtatgcagggatttccacccaacttgggcagtgccttttcaaccccgcaatctcctgcaaaggcctttcccccactgtccacacccaatcagaccacagccttctcaggaattggaggattgagcagtcagttacccgtcggtggtttaggcaccggttctttgaccggcattggcacaggtgcattggggttgccagctgtcaataacgacccatttgtccaaagaaaacttggaacttccgggttaaaccagcccaccttccagcagactgacctttctcaggtatggccggaagcgaatcagcacttttctaaagagattgacgatgaagccaatagctacttccagagaatatataatcacccaccacacccgactatgtcagtagacgaagtcttggagatgctgcagcggttcaaagatagcactattaaaagagagcgcgaggttttcaattgcatgctgcgaaatttgttcgaggagtaccgcttttttccacaatatccagataaggagctccatataactgcctgcttgtttggcggaatcatcgaaaagggactcgtgacctacatggctctgggtctagctcttcgatacgttctcgaagcactgcgaaaacccttcggatccaagatgtactattttggtatcgcggcccttgaccgcttcaagaacagactaaaagattatccacagtactgtcaacatcttgcatccatatctcactttatgcaatttccacaccacctacaggaatacatcgaatatggacagcagtcgagggacccccccgtaaagatgcagggatccatcacaactcccgggagcattgccctggcccaggcacaggcacaagctcaggtgcctgcaaaggctccgctggccggccaggtgtccacaatggtaacaaccagcaccacaacaacggtagcgaaaactgttaccgtaacccgccctaccggagtgtctttcaaaaaagacgtgcccccctccatcaacaccacaaatattgacactctgctggtggccaccgatcaaactgagcgcattgttgaacctccagaaaatattcaagaaaaaatcgccttcatttttaataatctctcacagagcaatatgacacaaaaggtggaggagctgaaggaaacagtgaaagaagagttcatgccgtgggtttcccagtacctggtaatgaagcgtgtgtccatcgagcccaatttccatagcctttattcgaatttcctcgacacccttaaaaatcctgaatttaataagatggtccttaatgagacatacaggaacataaaggtgctcctcacgagcgacaaagccgccgcaaatttctcagatcgcagcttgctaaagaacctggggcactggctgggcatgataacactcgccaagaataagcctattttgcacactgatctcgacgtcaaatccctactgctggaggcctatgtcaagggtcagcaggaacttctgtacgttgtgccattcgtagcaaaggtcctagagagttcgatccgctcagtcgtgtttcggccacccaatccttggacaatggccatcatgaatgttctggcggaactccaccaggagcatgatctcaagctaaatctgaagtttgagattgaggtcctgtgcaaaaatcttgctcttgacattaatgagttgaagcccggcaatctgttgaaggataaggaccgccttaagaacctggacgagcagctgagcgccccaaagaaagatgtgaagcagccagaggagttgcctcctatcacgactacaaccacatccacaacaccggccacaaatactacttgcacggctacagtgcccccacagccacaatattcataccatgatatcaatgtgtacagtctagccggcttggctccccacatcaccctcaatccgactattcctctcttccaggcccaccctcaacttaagcagtgtgtgcggcaggcgattgagagagctgtacaggagctggtgcatccagtagtggaccgaagcattaaaatcgcaatgaccacttgcgaacagatcgtccgaaaggacttcgcgctggattcagaagaatctagaatgcgcattgctgcacatcatatgatgaggaaccttaccgccggcatggccatgattacttgcagagaacctctgctcatgagcatttcaacaaacctgaaaaacagctttgctagtgctttgaggaccgcctcaccacagcaacgggaaatgatggaccaggcggccgcccaactggcccaggataactgcgaacttgcctgttgcttcattcaaaagacagccgtcgagaaagccggcccggaaatggacaagcggctagctaccgagtttgagttaaggaaacatgccagacaagagggccggcggtactgcgatccagtggtgctaacataccaggctgagaggatgcctgaacagatacgtctgaaggtggggggagtggaccccaaacagctggcagtttatgaggagtttgcacgtaatgtgccagggttcctccctacaaacgacctgagccagccaactggatttctggctcaaccgatgaagcaggcttgggccaccgacgatgtcgcccagatttacgacaaatgtatcaccgaattggagcaacacctgcacgcaattccacctactcttgccatgaaccctcaggcccaagcactgaggtcactgctcgaggttgtggtcctgagcaggaactcccgcgacgctatcgcggctctgggactgctgcaaaaggccgtcgaagggcttctggatgccaccagtggggcggacgctgacctgctgcttcgctatagagaatgtcatttgctggtcctgaaggccctgcaggatggacgcgcctatggtagcccgtggtgcaacaagcagattacaaggtgtctgattgaatgtagggacgagtacaaatacaacgtagaagcggtcgaactccttattcgtaaccacctggtgaatatgcagcagtacgatcttcatctggctcaatccatggaaaatgggctcaactacatggctgtggctttcgctatgcagctcgtcaaaatactcctggtggatgagcggtccgtggcccacgtcaccgaggccgacctgtttcacactatcgagacgctgatgcggattaatgcccactcccgagggaatgcacccgagggactgcctcagcttatggaggtcgttaggtctaattacgaagccatgatagatagagcccacggggggccaaatttcatgatgcatagcggcatttcacaggctagtgagtatgacgatccacccggtcttcgggagaaggccgaatatttactgcgcgagtgggtaaacttgtatcattccgccgcagctgggcgcgatagtaccaaggcttttagtgctttcgtcggccagatgcatcagcaaggcatactgaagactgatgatctgatcacaagatttttccgtctctgcacagaaatgtgcgtggagatctcatacagagctcaggccgagcagcagcataatcccgctgccaatccaactatgattcgagctaagtgctatcataacctcgatgcattcgtgcggcttatcgcgttgctggtgaagcacagtggcgaggccactaacaccgtcacaaagatcaatctgttgaacaaagtgctcgggattgtggttggcgttctgcttcaagaccatgatgtccggcagtctgaattccagcaactgccctaccatagaatctttatcatgctactgttggagctcaatgcacccgagcacgtcctagagacgattaacttccagaccctgaccgccttctgcaacactttccacatcctccggcctacaaaggcccctggttttgtttatgcctggctggagctaataagtcataggatttttattgcgcgcatgctggcgcataccccccaacagaagggctggccaatgtatgctcagcttctgattgatctgttcaagtaccttgctccattcctgcggaacgtcgaacttaccaaaccaatgcagatactgtataagggcactctgagagtgctcttggtcttattgcatgactttccagaatttttgtgtgattaccattacggcttttgcgatgtaatcccacctaattgtattcagttgagaaacctgatcctgtcagcctttccgaggaatatgcgcctgcctgacccttttaccccgaacctgaaggagattatgctgtag

SEQ ID NO: 181980 - DNA, 3213 bp, Artificial Sequence
  Description of Artificial Sequence: Synthetic coding sequence
atgctgctgaacggcacccccttcgccttcgtgatcgacctggccgccctggcctctcgtagggagtacttgaaactggataagtggctgactgataagattcgcgagcacggtgaaccctttatacaagcttgcatgacctttctgaagcggaggtgccctagtatcctgggagggcttgcacccgagaaagaccagcccaagtctgctcagctcccccccgagacattagctaccatgctcgcttgcctgcaggcctgtgccgggtccgtgagtcaggagttaagcgagaccattttgaccatggttgctaactgctcaaatgtgatgaataaggcccggcagcctcccccaggagtgatgcccaaaggccgcccccctagtgccagctccctcgacgctatttcacctgtccagatagaccccctggctggcatgacttccctgtctataggaggaagcgccgccccacacacgcagtccatgcaagggtttccgccaaatctcggctccgcattcagcacgccccagtcccccgctaaagccttcccgcctctgagtacccccaatcaaacaaccgcattcagtggtatagggggattaagctcccagctgcctgtaggcggactgggcacagggagcctcaccggaatcggcaccggcgctctagggttgcctgcagtgaacaacgatccatttgtacaacgcaagttgggcacttctggcttaaaccagccaacctttcagcaaagcaaaatgaagccctctgatctgtcacaggtttggcccgaagcgaaccagcatttctcgaaggagatcgatgatgaagccaattcttacttccagaggatctataaccacccaccacatcccaccatgagtgtcgatgaggttctagaaatgttgcaaagatttaaagacagcactatcaagcgtgagcgggaggtgtttaactgtatgttgagaaatctcttcgaggagtatagatttttcccacaatacccagataaagagctgcatattactgcctgtctatttggcggcattattgaaaagggcttggtaacatacatggccctgggtctcgctctcagatatgttctggaagcattgagaaagcccttcggttctaagatgtactacttcggtatcgcggctctggaccggtttaaaaacaggttgaaggactaccctcagtattgccagcacctcgcatcgatctcacatttcatgcagttccctcaccacttgcaggaatacatcgagtacggccagcaatctcgcgacccacccgtcaagatgcaggggtccatcaccactccaggcagtattgctctagcacaggcacaagcacaggctcaggtgcccgcaaaggccccgttggccggtcaggtaagcaccatggttacaactagtactaccacaacagtcgccaagaccgtcacagtgactaggccgaccggcgtgagcttcaaaaaagatgtccccccatctatcaatacaactaatattgacactctcttagttgcaacggaccagacagagaggatcgtcgagccacctgaaaacatccaggagaaaattgcgttcatcttcaacaacctatcacagagcaatatgacccagaaggtggaggaactgaaggaaaccgttaaggaagaatttatgccctgggtgtcacagtacttagtgatgaagcgggtttccattgaacctaattttcatagtctgtactcgaatttcctggacacccttaagaatctcataacgcgctttttcagactgtgcaccgagatgtgtgtagagatttcttaccgagcgcaggccgagcagcagcataaccccgcggccaacccgaccatgatccgcgccaagtgttatcacaacctggatgctttcgtaaggctgattgcgctgctggtgaagcactccggcgaagccacgaatactgtgacaaagattaacttgctcaacaaagtgctcggcatagtcgtaggggtattgctgcaggatcatgatgtgaggcagagcgaatttcagcagctgccttatcatcggatattcataatgcttcttctggagcttaatgcaccggagcacgtcctggaaaccatcaactttcagacgctcactgctttctgtaacacattccacattctacgacctaccaaggcacccggcttcgtgtacgcctggttggagcttatatcccaccggatcttcatcgcacggatgctggcgcacaccccgcagcagaagggctggcccatgtatgcacagctgttaatcgatctgttcaagtacctggctcccttcctacggaacgttgaactgacaaagccaatgcagatcctgtacaagggaactttgcgggtcctcctggtcttattacatgacttccccgagtttctttgcgattaccactatggcttttgcgacgtgataccaccaaattgtatccagcttaggaacctgatactcagcgccttccctcggaatatgcgtctgcccgacccctttacgccgaacctcaaagtcgatatgctgtctgagatcaacattgcccctcgaatactgactaacttcaccggcgtgatgccccctcaattcaaaaaggaccttgattcctacttgaagacccgttcacctgtcacctttctgtcagacctccgatccaatcttcaggtcagcaacgagccaggcaatcgttacaacctgcagttaatcaacgccctggtgctgtatgtgggaacgcaggctattgctcacatccacaataaggggagcactcccagcatgtctacgattacacattccgctcacatggacattttccagaacctggccgtggatctcgacaccgagggccgctacctatttctgaatgcgatcgcaaatcaattgcgttaccctaactctcacacacattacttctcttgcacaatgctctacctcttcgcggaagcgaacacagaagctatccaggagcagattactagggtgctgttggaaagattaattgtgaacagaccacatccttggggtcttttaatcacttttatcgaactgatcaaaaatccggcctttaagttctggaaccatgaattcgttcattgtgcccccgagattgagaaactgttccaatctgttgctcagtgctgcatgggccagaaacaggcccagcaggtgatggagggtaccggggcctcctag

SEQ ID NO: 181981 - DNA, 4656 bp, Artificial Sequence
  Description of Artificial Sequence: Synthetic coding sequence
atgaacctggacagcctgagcctggccctgagccagatcagctacctggtggacaatctgacaaagaaaaactaccgggcaagtcaacaggaaatccagcacatcgtgaatcggcacggaccagaggcagatcgtcatctgctgaggtgcctattttctcatgtggacttctctggtgacggtaagtcatcaggtaaggactttcaccagacccagtttctgattcaggagtgcgcattgctgattacgaaacctaactttatttccacgctgtcatacgcaatcgataatcccctccactaccaaaagtcgctgaagcctgccccacatctctttgctcagctgtctaaagttctcaaattgagcaaggttcaggaggtgatattcggcctagccctcttgaatagtagtagttccgaccttaggggcttcgccgcccagtttattaagcagaagcttcccgacctgttacggagttatattgatgccgatgtatctggtaatcaggagggaggttttcaggacatcgcaattgaggtcctgcacctgctgctctctcacctgctgttcggccagaaaggtgccttcggcgtgggccaggagcagatcgacgccttcctgaaaacactacgtcgcgatttcccacaggaaaggtgccccgttgttctggcgcctttattgtaccccgagaaacgcgacatcctaatggaccgcattctcccagatagtgggggggttgccaagaccatgatggagtcttcgctcgcggactttatgcaggaagtgggatatggcttttgtgccagtattgaggaatgtaggaatatcatcgtacaatttggcgttcgagaagtgaccgcagcccaggttgccagggtacttgggatgatggctcgcacccatagtggccttaccgatggtatccctcttcagagtatctcggcccctggaagcgggatctggagcgacggaaaggataagagcgacggggcacaggctcatacctggaatgtagaggtgctcatcgacgtgctgaaagagctgaacccttcgcttaacttcaaggaggtgacatacgaactcgatcaccctggttttcagataagagattcaaaaggactccacaacgtggtgtatggtatccaaagaggactgggcatggaagtgttccccgtcgatctgatctacagaccctggaaacatgccgaggggcagctgtcattcattcagcattccctgatcaatccagagattttctgctttgccgactatccatgccacaccgtcgctaccgatatactgaaggccccgccggaagacgataacagagaaattgccacctggaaatctcttgacctcatcgaaagcctgttacgtctcgccgaagtaggacagtacgagcaggttaaacagctgttttcgtttcccatcaagcactgtcccgacatgctggtccttgcgctcctccagattaataccagctggcatacacttaggcacgagctcatttcaacactgatgccaatctttctggggaatcacccgaatagcgctataatattgcactacgcatggcacggacagggacagtctcctagcattcgccagctgattatgcatgcaatggctgagtggtacatgaggggcgaacagtacgaccaggctaagcttagtagaatcttggatgtggcacaggacctgaaggcccttagcatgctcctcaacggcacaccctttgcattcgttatcgacctagcagccctcgcctcccgaagggagtatctgaagttggacaagtggcttacagacaaaatccgagagcacggcgaaccgtttatacaggcttgcatgacctttctgaaaaggaggtgccctagcattctgggggggctcgccccggagaaggaccagccaaaatcagcccagctgccacccgagaccctggcaactatgctggcatgtctgcaagcctgtgctggtagcgtttctcaggagttaagcgagacaatcttgactatggtggctaactgcagcaacgtgatgaacaaagccaggcagcctccacctggtgtgatgcccaaaggccggccgccctctgcatccagcctagacgccatcagccccgtccaaattgatccgcttgccggcatgaccagcctgtctatcggcggctccgctgccccacatactcagtctatgcaggggtttccccctaatctcgggtcagccttcagcacaccacagagccccgccaaagcatttcccccacttagtacccctaaccaaaccactgcttttagcggaatcggcggcctgtcttctcaacttccagtgggcggcctgggcaccggatccctgaccgggattggaacgggggcactgggtctgcccgcagtcaataatgacccctttgtccagagaaaactaggtacctccggtcttaatcagcctaccttccagcagtccaaaatgaaaccgtcagatttatcacaggtttggcctgaggcgaaccagcatttctctaaagagattgacgacgaggcaaattcttattttcagagaatctataaccaccctccccaccccactatgtccgtggatgaagtacttgagatgctccagcgattcaaagattcaaccatcaagcgggagagggaagttttcaactgcatgctgcgcaacctcttcgaggaataccgcttcttcccacaataccctgataaggaactccatattactgcttgtcttttcggaggaataatcgaaaaagggcttgttacctacatggctttgggactggctctgcgttacgttctggaagctcttaggaaaccatttggcagcaaaatgtactatttcggcatcgccgcactggacagattcaagaacaggctcaaggattatccgcagtactgccaacacctggccagcatctctcacttcatgcagttcccacatcaccttcaggagtacatcgaatacggccaacagtcccgggatcctcccgtgaaaatgcagggcagtatcacgacaccagggtcaatcgcactcgcacaagcacaagcccaggcccaagtgcctgccaaggccccgctcgcaggacaggtgtccaccatggtgaccaccagtaccacaactactgttgcaaaaacagtgaccgtgacccgcccaaccggagtgtcattcaagaaagatgtcccacccagcatcaatacgactaacattgacactctgttggtggcgaccgatcagaccgagcggattgtggagccaccagagaacatacaggagaagatcgcatttatctttaataatctgtctcagagtaacatgactcaaaaagtagaggaacttaaggaaacggtgaaagaggaattcatgccttgggtgtctcaatatctggttatgaaacgcgtctccatcgagcctaactttcatagtctttactctaattttctggacactctgaaaaacccagaattcaataagatggtcttgaacgaaacctacaggaacattaaggttctgctgaccagcgataaggccgctgccaacttcagcgatcgaagcctgctgaaaaatttggggcactggctcggaatgatcactttggccaagaacaagccaatcctccacacagacctggatgtcaaaagcctgttgctcgaggcgtatgtgaaaggacagcaggagctgttgtacgtggtgccttttgtggcgaaagtcttagagagctccatacgcagtgtggtgtttcgtccacctaatccctggacaatggcaatcatgaatgttctggcggagctgcaccaggaacacgacctcaaactgaatcttaagtttgagattgaagtgctgtgtaaaaatctggccctagacatcaacgagctgaagccaggcaaccttctcaaggacaaagatcggctgaaaaacctagatgagcagctttcagctccaaaaaaagacgttaaacaaccagaagagctgccaccaattactaccaccactacatccacaacaccagccactaacacgacatgtactgccaccgtccctccccagcctcaatacagctatcacgatattaacgtgtattccctggccgggctcgccccacacatcacccttaaccctactatcccgctgtttcaggctcatccccaacttaaacagtgcgtgcggcaggccattgaacgcgcggtccaggaactcgtacaccctgtggtggaccgaagcataaagatagcgatgacaacctgtgagcaaatcgtgcggaaagatttcgcactggattccgaagagagccgtatgagaatcgccgcccaccacatgatgcgaaacctgaccgctggcatggctatgatcacatgtcgggaaccactacttatgagtatctccacgaaccttaagaatagtttcgcctcagccttgagggtctcttggctcttcccctggtatagatacaagacctactactgcctctctgtaatcatcttcttctttgtctatatttggcattgggccttgcccctgattctgaacaatcatcacatctgcctgatgtctagcataatccttgattgcaatagcgtccgacagagcatcatgtctgtctgttttttcttcttcctcctgtactctcagcatgacgtgtag

SEQ ID NO: 181982 - DNA, 951 bp, Artificial Sequence
  Description of Artificial Sequence: Synthetic coding sequence
atgctgctgctggagctgaacgcccccgagcacgtgctggagaccatcaactttcagacacttactgccttttgcaataccttccacatcctgaggcccactaaagccccaggcttcgtgtacgcctggctggagcttatcagccatcggatcttcatcgcaagaatgctagcacatactccgcaacagaaaggatggccaatgtatgcccagctgttgatagatttattcaaatatctggcacctttcctccgaaacgtcgaactgacaaaacccatgcagattctgtataaagggactctgcgtgttttgctggtgttactgcacgactttccagaattcctgtgcgactaccattacggcttttgcgatgtgattccacctaactgtattcagttaaggaatctcattctctccgctttccctagaaacatgcggcttcctgatccttttacccctaacttgaaagtggacatgctctccgagatcaacatcgccccccggattctcaccaactttacaggcgttatgccacctcagttcaagaaggacctcgactcctacctcaagaccagatcccctgtcactttcctgagcgatctgcgtagtaaccttcaagtctccaacgaacccggcaaccgctataacctccaattaatcaacgctctggtgctgtatgtgggaacccaagccatcgcccatatccacaataagggatctaccccaagtatgtccaccatcacgcacagtgcacacatggatatttttcagaacctggcagtcgacctggacaccgaaggcaggtatttgttcctgaatgctatcgccaatcagtccgggacccaaattgcaaccctcaccaccagcgtagcgccatgctgtacattcctacaaaggccaatccgaaaaccatcgaagaacaggagccaagagtttagttggaacggatag

SEQ ID NO: 181983 - DNA, 2778 bp, Artificial Sequence
  Description of Artificial Sequence: Synthetic coding sequence
atggaccggagcggcttcggcgagatcagcagccccgtgatccgggaagcagaggtaacacggaccgcaaggaagcagagtgcgcagaagcgggtcttacttcaggctagtcaggatgaaaattttggcaataccacccctagaaaccaggtgatccctcgtacacccagttccttccgtcagccctttacacctacaagcagatccctgctgaggcaacccgacatctcttgtatcctcggaaccgggggcaagtctccacgcctgacccagagcagtggcttttttggcaatctgagtatggtgaccaatctcgatgactcaaattgggccgcagccttttcaagccagaggtctggtctgttcaccaatactgaaccccacagcatcaccgaggacgttaccataagcgccgtgatgctgcgagaggacgatccaggagaggcggcatctatgagcatgttcagtgacttcctgcaaagttttctcaagcactcttcttctactgtttttgacctggtcgaagagtacgaaaatatctgtgggagtcaagtgaacatcctcagcaaaatcgtgtcccgagctacccccggactccagaagttctcgaaaactgccagtatgctgtggctgctccagcaagaaatggtgacctggaggttactggcttcattataccgggacaggatccaatctgccctagaggaggaaagcgtgttcgccgtgacagctgtcaatgcatccgaaaaaaccgtagtggaggcactcttccaacgagacagcctggtacgccagtcccagctagtggtggactggctcgagagcatagccaaagacgaaatcggtgagtttagcgacaatattgagttttatgcaaagagcgtgtactgggagaacactctgcacaccttaaagcagcgccagcttacaagctacgtggggtccgtcagacctctcgtgactgaactggaccccgacgcacctatcaggcaaaaaatgcctctggacgatttggaccgcgaggatgaggttaggttgctcaaatacctttttacgttaataagggctgggatgaccgaggaagcccagagattgtgtaagcggtgcggccaggcatggagagccgctacattggagggatggaagctataccatgaccccaacgtaaatgggggcacagagctggagcctgttgagggcaatccgtatcggcgcatctggaagatttcctgctggcgcatggcagaggatgaactttttaaccggtacgaaagggcaatctacgccgcgctctccggcaatttgaaacagctcttgcccgtatgtgacacctgggaagacacagtgtgggcatacttccgagtcatggtagacagcttggttgagcaggaaatccagacaagtgtggctaccctggacgagactgaagagctgccgagagaatacctgggcgccaattggacacttgagaaagtgtttgaagagctgcaggctacagacaagaaaagagtcctcgaagagaatcaagaacactatcacattgtgcagaaattcctcatcctgggcgatatcgatgggctcatggacgaattttctaaatggttatctaagagcagaaacaacctgccaggacatctcttaagattcatgactcaccttattcttttctttaggacccttggactccagacaaaagaggaggtgtcaatagaggtgttgaaaacctatatccagcttctaatccgcgagaaacacaccaatctgattgccttttatacctgccacttacctcaggacctggcagtcgcccagtacgcattatttttggagtcagtgacagaattcgaacagaggcatcactgcctcgagcttgccaaggaggctgacctggatgtggccactatcactaaaacagtggtggagaacatccggaagaaagacaacggcgagttctcacatcacgatctcgcacccgcgctcgatacaggcacaacagaagaagatcggcttaaaatcgacgtgattgactggttagtcttcgaccccgcccaacgtgctgaagccctcaagcagggcaacgccatcatgcgcaagttcctggccagcaagaagcacgaagccgccaaagaagtgttcgtcaaaattccccaggactccatcgcagaaatctataaccagtgcgaagaacaaggaatggagagtcctctgccagcagaggatgacaacgctatccgggaacacctgtgcatcagggcttaccttgaggcacatgagactttcaacgagtggttcaagcatatgaatagtgtgccacagaaacccgctctgataccacagcctacatttaccgagaaagttgctcatgagcataaggaaaaaaaatacgaaatggacttcgggatttggaaggggcacttggacgccttgaccgctgacgtgaaagaaaaaatgtataatgtgttactctttgtggacggagggtggatggtggatgtccgcgaggacgctaaagaggatcacgagaggacccaccagatggtcctgttgagaaaactctgtcttcccatgctgtgcttcctgctgcacactatcttgcatagtaccggtcagtaccaagagtgcttacagctagccgacatggtatcctccgagcggcacaagctctacctggttttttcaaaggaagagttgcgtaaactcctgcagaagctgcgcgaaagctccttaatgcttctcgaccaaggccttgaccccctgggatacgaaattcagttgtag

SEQ ID NO: 181984 - DNA, 1623 bp, Artificial Sequence
  Description of Artificial Sequence: Synthetic coding sequence
atggtgcggaccgacggccacaccctgagcgagaagcggaactaccaggtcaccaactctatgttcggcgcgagcagaaaaaaattcgtagaaggagtcgattctgattatcatgacgagaatatgtattactcccagtccagtatgttcccacatcgcagtgaaaaagatatgctcgccagcccttccaccagtggacagctttcccagttcggcgcatcattatatgggcagcagtctgccctcggactgcccatgcgcggcatgtctaataatacaccccaactaaacagatccctgagtcaagggactcagctgcccagtcacgtgacacccacaaccggggtcccaacaatgtctctgcataccccacccagtccaagtcgcggaatcctacccatgaatcctcgcaatatgatgaaccatagtcaagtgggacaaggaattggcatcccatccagaacgaatagcatgtcttcgagcggcctcggctctcccaatagaagtagcccgagcatcatctgtatgcccaagcagcaaccgtcccgccagccttttaccgtcaattcaatgtcaggcttcgggatgaatcggaatcaagcgttcggcatgaataatagcttatcaagcaatattttcaatggcaccgatggctctgagaacgtgacagggttggacctcagtgatttcccagccttggcagataggaaccgcagggagggcagtggtaatcccacccctctcataaaccccctggctggtagagctccttacgtggggatggtaaccaaacctgccaacgagcagagtcaggattttagtattcataacgaagacttcccagccctccctgggagcagttataaggatcctacttcctccaacgacgacagcaagtccaatctcaacacgtccgggaagactacatcctcaactgatgggccgaaatttcccggagacaaatcaagtaccacgcagaacaacaaccaacaaaagaagggcatccaggttctccctgacgggagagtcacgaacattcctcagggtatggtcacagaccagttcgggatgatcggacttctgacgttcatacgagctgccgaaaccgacccgggcatggtgcacctggcgctcggctccgacctgaccactctaggcctgaatttgaactccccggaaaacctctatcctaagttcgcaagcccttgggcttcctcaccatgtcgcccccaggatatcgactttcatgttccttccgagtacctcacgaacatccatatcagagataaactcgctgcaattaaactcggtcgctacggtgaagatctattattctacctgtactacatgaatggaggcgacgtgctacagctcctggctgcggtggaactctttaaccgagattggaggtaccacaaagaggaacgagtgtggatcaccagggctccaggcatggaacctaccatgaagaccaacacctatgagaggggaacttattacttcttcgattgtctcaattggcggaaggtggcaaaagaattccacttggaatatgataagctcgaggagagaccacacctccctagtacattcaattataacccagcgcaacaagcattctag

SEQ ID NO: 181985 - DNA, 78 bp, Artificial Sequence
  Description of Artificial Sequence: Synthetic coding sequence
atggtgcggaccgacggccacaccctgagcgagaagcggaactaccaggttacaaatagtatgttcggagctagctag

SEQ ID NO: 181986 - DNA, 552 bp, Artificial Sequence
  Description of Artificial Sequence: Synthetic coding sequence
atggtgcggaccgacggccacaccctgagcgagaagcggaactaccaagtcacaaattccatgtttggcgctagtcgcaagaagtttgttgaaggtgtggattccgattatcatgacgagaatatgtattactcccagagctctatgtttccccacagaagtgagaaagacatgctcgctagcccatccactagcgggcaactgtcacaatttggcgcctcactctacggtcagcagagtgctcttggtctccccatgagagggatgagcaacaatactcctcagctgaatcggtcactgtcacaaggcacccaactaccatctcacgtgactcccactactggggttcctactatgtccctccatacgccgcccagtccttccagagggattttacccatgaaccctagaaatatgatgaaccacagccaggtcggacaaggcattggtatcccaagtagaactaactccatgtcatcatccgggttaggttctcctaatcgttctagtcctagcataatttgtatgccaaagcagcagccgtcgaggtag

SEQ ID NO: 181987 - DNA, 1623 bp, Artificial Sequence
  Description of Artificial Sequence: Synthetic coding sequence
atggtgcggaccgacggccacaccctgagcgagaagcggaactaccaggtgaccaactccatgttcggggcatcccggaaaaagtttgtggagggtgtggatagtgattatcatgatgagaacatgtattactcccaaagctcaatgtttccacatcgaagcgagaaggacatgctggcctcaccatctacctccggacaacttagtcagtttggcgcgtcactttatggccagcagagcgcgcttggccttccgatgcggggtatgagcaataacaccccacagctaaacagaagcctgtctcaaggtacacagttgccttcacatgttactccaacaactggagtgcctactatgtcgctccacactcctccctcaccctctagaggaatcctgccgatgaatcccaggaatatgatgaatcattctcaggtgggccaaggcatcggaatcccttcccgaacaaactcgatgtcctcctctggactgggttcccccaatcgttccagccccagcatcatctgcatgcccaagcagcagccaagtcgacaacccttcacggtcaattctatgtctggcttcggcatgaaccgcaatcaggccttcgggatgaacaattctttaagctccaatatattcaatgggactgatggctccgagaacgtgacaggtctggacctgtccgacttcccggcactggccgacaggaaccgccgggaaggaagcggcaatcctacacctctgataaacccactggccggcagagccccatacgtgggaatggtaaccaaacccgccaatgaacaatctcaggacttctcaatccacaatgaagactttccagcattgccgggatcatcgtataaagatccaacctcatcaaacgacgacagcaagagcaatctaaacactagcgggaagaccacctccagcacagacggacccaaattccccggcgataagtcttcaacaactcaaaacaacaaccaacagaagaaaggcattcaggtcttgccagacggacgggtgactaatatccctcagggcatggtgaccgaccagtttggcatgatagggctccttacattcatacgagcagctgagacagatccgggaatggttcacctcgccctgggctctgatctgacaacactcgggcttaacctcaattcccccgaaaacctgtaccctaagtttgccagcccctgggcctcctcaccttgtcgacctcaggatatcgacttccatgtgccctcggaatacctgactaatatccacatcagggacaaacttgctgccatcaaactcgggagatatggcgaggacctgctgttttacctgtattacatgaacggcggggatgtacttcagctactcgctgccgtcgaactcttcaatagagactggaggtaccacaaagaagagcgagtgtggattactcgggccccaggaatggagcctacaatgaagactaatacttatgagcgcggtacctattatttcttcgactgcctgaattggaggaaggtagcaaaggagttccatttggaatacgataagctcgaagaacggccccatttaccgagtaccttcaattataatccagctcagcaagccttctag

SEQ ID NO: 181988 - DNA, 576 bp, Artificial Sequence
  Description of Artificial Sequence: Synthetic coding sequence
atggtgaccgaccagttcggcatgatcggcctgctgaccttcatcagggcagcggagacagaccctggaatggtccaccttgctctgggctctgatctaaccacactgggactgaatctaaactctcctgagaatctgtatcccaagtttgctagtccttgggcatctagtccatgccgccctcaagatattgacttccatgtgccttccgaatacttaactaatatccacatacgcgataagttagctgctattaaacttggaaggtatggcgaggatctcctgttctacttatactatatgaatggcggagacgtgttgcaactactggcagccgtcgagcttttcaacagagactggcggtatcacaaggaggagagagtttggatcacaagagccccaggcatggaacctacgatgaagacaaatacctacgaaaggggcacttactacttcttcgattgcctaaactggcggaaagtggccaaggagtttcacctcgaatatgataaactggaggagcgaccacacctgccgtcgacatttaattacaaccccgcccagcaggcattttag

SEQ ID NO: 181989 - DNA, 966 bp, Artificial Sequence
  Description of Artificial Sequence: Synthetic coding sequence
atggtgcggaccgacggccacaccctgagcgagaagcggaactaccaagtaaccaactccatgtttggcgcctctcgtaaaaagtttgtggagggggtggacagcgattaccatgacgagaatatgtattacagccaatcctcaatgtttccgcatcgcagtgagaaagacatgctggcgtccccatctacgtccggacagctgagtcaattcggcgccagcctgtacggtcagcagagcgcattgggtctgccgatgcgaggcatgagtaataacacaccacaactcaatcggtccctgtctcagggaacacagctgccttcccatgttacgccaaccacgggagtgccaaccatgtccctccatactccgcccagtccgtctcgagggatcctgcccatgaaccctaggaacatgatgaatcactcgcaggttggccagggcatagggatcccgtcacggactaactccatgagcagttcgggactgggtagcccaaaccggagtagtccatctatcatctgtatgcctaagcaacaacctagcaggcagccattcactgtgaattcaatgagcggtttcggcatgaatcgaaatcaggcattcggcatgaacaacagtctgtcttccaatatcttcaacggcaccgacgggagcgagaatgtcacaggtttggatctctccgactttccggcattggccgatagaaaccgacgggaggggtcggggaacccaacccccctgattaaccctctggcaggccgcgctccttatgtgggcatggttacgaaaccggctaatgaacaatctcaggacttctcgatacacaatgaggacttccctgcgttgccaggttcctcctacaaagatcctacttcttcaaacgacgatagcaagtccaatctcaatactagtggaaaaacaacctcttcgacagacggtcccaagtttccaggtgataaatag

SEQ ID NO: 181990 - DNA, 978 bp, Artificial Sequence
  Description of Artificial Sequence: Synthetic coding sequence
atgagcaccgcccgggagcagcccatcttcagcacccgggcccacgtattccaaatcgacccagctaccaagcgcaattggattccagccggcaaacatgccctgactgtgagctacttctatgacgctactaggaatgtctaccgtattatttcaatcggtggggctaaggccatcattaactccaccgtcacacccaacatgacctttacgaaaacttctcaaaagttcgggcaatgggccgatagccgtgcaaacaccgtgtatggattaggcttcgcctccgaacaacacttgacacaggttccacctagtcctctcgtgtcggccaatggtcctggtgaggaaaagctgttccgctcccagagcgcagatgctccagggcccaccgaaagagagcggttgaaaaagatgctgtccgaaggctcagttggtgaagtgcagtgggaagccgagttttttgctctgcaggactctaacaacaagctcgccggggccttaagggaagccaacgccgctgccgcccagtggaggcaacagcttgaagctcagcgcgcagaggccgagcggctgcgccagcgcgtagcagaactcgaggcgcaggccgctagcgaggtgacgcctaccggagaaaaagaaggccttggtcagggccagagcttggagcaactagaagctctggtgcagactaaggaccaggaaatccagacgttgaagagccaaaccggtggccctcgagaagcccttgaggccgccgagagagaggaaacccagcagaaagtgcaggatctggagacccgcaacgctgaactggagcaccagctaagagctatggagcggtcccttgaagaggccagggccgaacgcgaaagagcccgagcggaggtcggacgcgctgcccagctgctggacgtttctcttttcgaactgagcgagctcagggaagggctggcaaggctggccgaggcagcaccatag

SEQ ID NO: 181991 - DNA, 1716 bp, Artificial Sequence
  Description of Artificial Sequence: Synthetic coding sequence
atgctggagaccatcctgcggatgctggacaacgacagcatcctggtggacgctatccgaaagatcaaggacgatgtcgaatactacgtcgattcatctcaggaccctgactttgaggagaatgagttcctgtacgatgatctagacctcgaggatatccctcaggctttagtcgcaacaagcccaccaagccactcccatatggaggatgaaatttttaatcagagttccagcactccgacatctaccacatcctctagtccaattcccccatcacccgccaactgtaccaccgaaaattctgaagacgacaagaaacgaggacggagtaccgattctgaggttagccagtctcctgcaaagaatggctccaagcctgtgcattcgaaccagcacccccagtctccagccgtgcctcccacctacccttctggtcctccacccgctgccagcgcgctgtctaccacgcccggaaacaatggagtgcctgcccccgccgcccctccatccgccctcgggcctaaggccagccccgcgccatcccacaattcaggaacaccggcaccctacgcccaggcagtggccccacccgccccttcaggaccttccactacgcagcctcgaccgccttctgtccagccatccgggggaggaggcggcggttccggtggcggaggatcttcctcgagctccaatagtagcgccggcggcggggccggtaagcagaacggcgctaccagctactcctcagtggtagctgactcccctgctgaagtcgccctgtcatccagtgggggtaataacgccagttcacaggccctgggtccgccgtccgggccccataacccgccaccctcgactagcaaagagccttcagctgcagcccctactggagcagggggggtggcacctggttctggaaacaacagtggcgggccctcattgctggtgcctctgcctgtgaaccctccatcatctccgaccccctccttttcagacgctaaggctgccggagcgttgttgaacgggccgcctcagttttctacggcccccgaaatcaaagctcctgagcccctgtcaagcctgaaatctatggcagagagagcggccatttcttccggaattgaggacccagtgccaacactgcatctgacagaacgtgatatcatactgtcttccactagtgctccccccgcatctgctcaacctcctctgcagctgagtgaggttaacatccctctctctctgggggtgtgtcccttggggcctgttccactgacaaaggaacagctatatcagcaggcaatggaagaagccgcctggcatcacatgcctcaccctagcgactctgaaagaattcgccagtacctcccccggaatccctgccccaccccaccttatcatcatcagatgccacctccccattctgacactgtggagttctatcagcgcctatccaccgagaccctgtttttcatcttttactatctcgagccacgggacgtgcgaacagcatgggtggattccgaggctggcccccttcggcacacctcagccccgctgcctgtcgcacactggctgacaagaggcccatctccagccctgctgcagcagccacaatcccggccgaccccactgtgcagtagcgctcactctcaggcttctttggagactacaggtgaattgagcagccccctgccaacacctctgctgtag

SEQ ID NO: 181992 - DNA, 2262 bp, Artificial Sequence
  Description of Artificial Sequence: Synthetic coding sequence
atggccgacaagcggaagctgcagggcgagatcgaccggtgcctgaagaaggtgagtgaaggagtagagcagtttgaagacatctggcagaagctccataatgctgccaatgcaaatcaaaaagaaaagtatgaggccgacctcaaaaaggaaatcaaaaaactgcagcgcctgagggatcagatcaagacgtgggtggccagtaacgagatcaaagacaagcggcaactaatcgacaataggaagctcattgagactcagatggagcgctttaaggtcgtggagcgcgagacgaaaacgaaggcatatagtaaagagggtctaggcctggctcagaaagtcgaccccgcccagaaggagaaggaggaagtcggccagtggctgacaaatacaattgacacacttaatatgcaggtggatcaattcgagtctgaagtcgaatccctcagcgttcaaactaggaagaaaaaaggagacaaggacaagcaggacaggatcgagggtctcaaaagacatattgagaaacacaggtatcatgttcgaatgcttgagactatcctgcggatgctcgacaatgatagtatattggtagatgcgatcaggaagattaaagatgacgttgagtattacgtggatagtagtcaggatcccgatttcgaggagaacgagttcctctacgacgaccttgatctggaggatatcccacaggcactcgtcgctacatctcctccttcccatagccatatggaagacgaaatttttaaccagagttcctcaactccaactagcacaaccagctcctcaccaattccaccgtcccctgccaattgcaccaccgaaaacagtgaggatgacaagaaacggggcaggtccaccgactcggaagtctcccagagtccagcaaagaatggatcgaagcccgttcattctaaccagcacccccaatcgcccgccgtcccacctacttaccctagtggaccccctcctgccgcgtccgccctcagcactacaccgggaaataatggggtgcccgctccagccgccccaccatctgcattgggccctaaggcgagccctgctccttctcacaactcaggaacgcctgccccttacgctcaagcagtcgccccaccagccccatcaggcccaagcacaacacagcctcgtcccccatccgtccaaccctcaggcggaggcggcggcggcagtggtgggggtgggtcctcgagctctagcaacagttccgcaggcggcggagcagggaaacagaatggtgctacgtcctactctagcgtcgtcgctgactccccagcagaagtggccctgtcctcatcgggcgggaacaacgcatcaagtcaagcactggggccccctagcggcccacacaaccctcccccctccacatctaaggagccaagcgctgctgcaccaaccggggccgggggcgtggcacctgggagtggcaataatagcggtggcccctccctgttggtgcctttgcccgtcaaccccccatcctcaccgacaccctcctttagtgatgctaaagctgccggggccctcttaaacggtcccccgcaattttctactgcccccgaaattaaggcgccagagcccctgtccagtctgaagtcgatggcagagcgcgccgcaatttcgagtggcatcgaagaccccgtacctacgctgcacctcaccgagagggatatcatattgtccagcacttccgcacctcccgctagcgctcagccacctcttcagctctccgaggtgaatattccattaagcctcggcgtgtgtcctttgggaccggtgcccctgacaaaggagcagctgtaccagcaggctatggaggaagctgcctggcatcacatgccccacccctcggattcagagcggatcagacagtatctgccaagaaatccctgtccgacccccccttaccaccaccagatgccgccgccccacagtgacaccgttgagttctaccagagacttagtaccgaaacgctcttttttatcttttattatctggagggcaccaaagcccagtacctcgctgctaaggcactaaagaaacagtcctggaggttccataccaaatacatgatgtggttccagagacacgaggaacccaagaccatcactgatgagtttgagcagggaacatacatttacttcgactatgagaaatggggccagcgcaagaaggagggatttactttcgaataccggtacctcgaggatcgggacctgcagtag

SEQ ID NO: 181993 - DNA, 867 bp, Artificial Sequence
  Description of Artificial Sequence: Synthetic coding sequence
tgaaaggagcccagcgccgccgcccccaccggcgccggcggcgtggcccctggaagcggcaacaacagcggggggccgtcactcctcgtacccctgcctgttaacccaccgtcaagtcctactccctcgttctcagatgccaaagccgctggagctctccttaacggccctccacagtttagtactgctcctgagataaaagcacctgagcccctctcttctcttaaatccatggcagagagggccgcaattagttccggcatcgaagatcctgtgcctactctgcatctgaccgaacgagacataatcctctcaagtactagcgctccgcccgcctcagcccagcctccgttacaactgtcggaagtgaatattcctctgtctttgggagtgtgtcccctaggcccggtccctcttacaaaggagcagctgtatcagcaggcaatggaagaggccgcgtggcatcatatgccccatccgtcagactctgaacgaattcgacagtacctccccagaaatccttgtccaacccctccttatcaccaccagatgcccccaccccatagcgacacagtcgagttttatcagaggctcagtaccgagacactgtttttcattttctattacctggaggggactaaggcccaatacctggccgccaaggcccttaagaagcagagttggaggtttcacaccaaatacatgatgtggtttcagcgtcacgaagagcccaagacgatcacagacgaatttgagcagctggcccagagtctatcgctgacgaagtatagctctctctggctgtccgcgcagcctggtactccaccatcacatccccccttaggccagctgttgggcttactgtag

SEQ ID NO: 181994 - DNA, 2304 bp, Artificial Sequence
  Description of Artificial Sequence: Synthetic coding sequence
atgagccggagccccgacgccaaggaggaccccgtggagtgccccctgtgcatggaaccccttgaaattgacgacatcaactttttcccttgcacatgcggctaccagatttgtaggttctgttggcaccggattagaactgacgaaaacggtctgtgccctgcatgccgaaagccctaccccgaagatccagctgtatataagcccctgagccaggaagaacttcagaggatcaaaaatgagaagaaacaaaagcagaatgaacggaagcaaaagatcagcgaaaatagaaaacacttggcctctgttagagtagtacagaagaatttggtgttcgtggttggactgtcacaaaggctcgccgacccagaggtgctgaagaggcccgaatacttcgggaagtttggaaagattcataaagtggtgattaacaattctacttcctacgcaggatcccaggggccatccgcctccgcctatgtaacttacatccgatcagaagatgcgcttcgggccattcagtgcgtcaacaatgtggttgtggacggccggacactgaaggctagtctgggcactacgaagtactgctcttattttctcaaaaacatgcagtgccccaaacccgattgcatgtaccttcatgagctgggggatgaggctgcctcatttaccaaagaggaaatgcaggctggaaagcaccaggagtatgagcaaaaactgctgcaggaactttacaaattgaatcccaatttcctccagttgtcaactggtagcgtcgacaaaaataagaataaggttacacctctccagaggtacgacacccctattgataaaccatcagattccctgagtataggcaacggagacaattcacagcagataagcaattcagatacgccatcaccacctccaggactgtccaagtcaaacccggtgatccctatcagctcctccaatcacagcgcccggagcccctttgaaggggctgtcactgagtcccaatcattgttttcggataactttcgacatcctaatcctatccccagtggcttgcctccctttccaagttccccgcagacctcctctgattggcccacagctcccgaacctcagtcactcttcacctctgaaacaattcctgtctcctcaagcacagattggcaagccgctttcggatttgggtcctcgaagcagccagaagacgacctgggctttgacccgttcgacgtcactcgaaaagccctggccgatttgattgaaaaagagctaagtgttcaggatcaacccagcctttcacctacatctctccagaattcctcctcgcataccacgactgctaaagggcctggttctggttttctacatcctgccgcggctacaaatgccaatagtttaaattctacctttagtgttttgccccaaaggttccctcaatttcagcagcatcgggctgtttacaattccttctcttttccagggcaggcagcccgctatccctggatggcctttccccgcaactctataatgcaccttaaccataccgccaaccctacctccaacagtaactttctagacctgaacctgcctccccagcataatactgggctgggaggcatcccggttgcagataactcaagcagcgtcgaatccctgaatatgaaggaatggcaagacggactcagagcattactccctaacataaacattaattttggcggcctgcctaactccagtagcccctcgaatgcaaatcattccgcacctacgtctaacaccgctactacagactctctttcttgggatagtcctgggagctggactgaccctgccataattacaggtatccccgcctctagcggaaattccctcgacagcttgcaggacgacaatccacctcattggctcaagtctctccaggccctgactgagatggacggaccatcggccgctccctcccagacacaccactctgcaccattcagcactcagattcctctgcacagagcctcctggaacccttacccccctcccagtaacccctcctcattccatagcccaccaccagggatttattatcgtgtgcaacactggacagcgatccgccagcgaggcgcaactattcgaaagtgccgcatttgcccaacactttttagcccatctcagcccaccacacattcgtcattgctcatctcatacgtccttaaaaatccagtgcctgaccagtttttcttttcattgactccagacgcaatgaggtcacagggtcattaccatctcttcataaattgcaaaaatttttgttag

SEQ ID NO: 181995 - DNA, 1728 bp, Artificial Sequence
  Description of Artificial Sequence: Synthetic coding sequence
atgagccggagccccgacgccaaggaggaccccgtggagtgccccctgtgcatggaaccattagagatcgacgatataaatttcttcccatgcacatgcggttatcagatttgtcggttttgctggcaccgcattcgtaccgatgagaacggactttgtccagcatgcagaaagccttatccagaggacccagctgtatacaaaccactgtcacaggaggaactccagagaatcaagaacgagaaaaagcaaaaacagaatgaacgcaaacagaagattagcgagaacaggaagcacttggcatctgttcgcgttgtgcagaagaatttggtattcgtggtggggctttcacaacgattagccgatcccgaggtactcaagcgtccagaatacttcggcaaattcggaaagattcacaaggtcgtgattaataatagcactagctatgctggctcacagggcccttcggcttccgcttatgtcacatacattcgctctgaagatgcattgagggcaattcagtgcgtcaacaacgtagtggtggatggccggaccctgaaggcaagcctgggcaccacaaagtattgctcatatttcttgaaaaatatgcaatgcccaaagcccgactgcatgtatctgcacgaattgggcgatgaagctgccagttttaccaaggaggagatgcaagccggcaagcatcaggaatatgaacagaaactgctacaggagctgtataaactgaacccaaactttctgcagcttagcacgggcagtgtggataagaacaaaaacaaggtcacaccactgcagcgctatgataccccaattgacaaaccgtcagacagcctgtccatagggaatggcgataacagccagcagatttctaacagcgacacaccttccccaccccccggtctgtccaaatctaatccagtgatccctataagttcaagcaaccacagtgctaggtcaccattcgagggcgccgtgacggaaagccagtcactgttctctgataatttccggcaccctaatcccatcccgtcaggcctgcctcccttcccttcctccccacagaccagctcggattggcccactgcgccagagccgcaatctctgtttaccagcgagaccatcccagtcagctcttcaacagattggcaagccgcatttggtttcggctcctctaaacagcccgaggacgatctggggtttgacccatttgacgttacccgcaaggccctcgcagatctgattgaaaaggagctatccgtacaggaccaaccttccctctcccctacatccttgcagaatagttcttctcacacgaccacagcaaagggccccggctcagggtttctgcacccggcagccgcgaccaatgctaactcgctaaacagtacctttagcgtgcttcctcagcgctttcctcagtttcagcagcatcgggccgtttataacagttttagcttccctggacaggctgcccgctacccttggatggcttttcctcgcaactccatcatgcaccttaaccacactgctaatcccacaagcaattctaactttctggacttaaatttgccgcctcagcacaatactgggctgggcgggatcccggtggctggagaggaggaagtgaaggttagcacaatgccactcagcaccagtagtcatagtttacaacagggacagcaacccacaagcctgcatactactgtagcctag

SEQ ID NO: 181996 - DNA, 1302 bp, Artificial Sequence
  Description of Artificial Sequence: Synthetic coding sequence
atgagccggagccccgacgccaaggaggaccccgtggagtgccccctgtgtatggaacccctggaaatcgacgacattaacttttttccttgcacatgtggttatcagatctgcagattttgctggcacaggatccggactgacgagaatggcttatgtcccgcttgccggaagccgtatcccgaagatcccgcagtttacaaacctctgagccaggaagagctgcagcgcatcaagaatgagaaaaagcagaaacaaaatgagcgtaaacagaaaattagcgagaatcggaagcacctggcatccgtgcgggtggtgcaaaagaatctggtgtttgtggtgggactatcacaaagactggcagacccagaggtattaaagcgcccagaatactttggaaaatttggaaaaatacataaggtggttattaacaattcgacaagctacgcgggctcacagggcccatcagcctcagcatacgtgacatacatccgctctgaggatgccctccgggcaatccagtgcgtgaacaatgtggtcgtcgacggcagaactctgaaggccagtctgggaaccaccaagtattgtagttacttcttgaagaacatgcaatgtcccaagccagattgcatgtacctgcatgagttaggcgacgaagcggcttcctttacaaaggaggaaatgcaagctggtaagcatcaggaatatgagcaaaagctactacaggaactctacaagcttaatccgaactttttacagctgtccacagggtccgtggataagaacaagaacaaggtgacaccactgcagcgctacgacacaccgatcgataagccgagcgacagcctgagtatcgggaatggcgacaatagtcaacaaatcagcaactccgacacgccctccccaccccccggtctgtccaaatctaaccctgtaatcccgatcagttcgtctaatcacagcgcccgctctccatttgagggtgctgtgacagagagccagtccctatttagtgataatttccggcatcccaatcccatccccagcggtttgccaccgtttccctctagccctcagacttcaagtgattggcctacggcgccagagccccagagtctttttacatctgaaacaatccctgtctcttcctcaacagactggcaggcagcctttggctttgggtcttccaagcagccagaggacgatctgggcttcgacccatttgacgtcacacgtaaagctctggcggacctgacggagccaatcgaaagaaagcggctggcagtgctcaaacgcaggtag

SEQ ID NO: 181997 - DNA, 1920 bp, Artificial Sequence
  Description of Artificial Sequence: Synthetic coding sequence
atgagccggagccccgacgccaaggaggaccccgtggagtgccccctttgcatggaacccctggagatcgacgacatcaatttttttccttgtacctgtggctatcagatttgcagattctgttggcacagaataaggaccgatgagaacggattatgccccgcatgcagaaagccctatcccgaggatcccgcagtttacaagcccctcagccaggaggaacttcaaaggattaagaatgaaaagaagcaaaagcagaacgaacgtaagcagaaaatctcagagaataggaagcacttagctagcgtgcgggtggtgcagaagaatttggtctttgtggtggggttatcacaacggctggccgacccggaagtcctgaagagacccgaatatttcgggaaatttggaaagatccataaagtggttatcaacaactccacctcatatgccggctcccaaggaccaagcgctagtgcttacgtcacctatattaggtctgaagacgccctgagagccattcaatgtgtgaacaacgttgtggtagacggcagaacactgaaagcatctctcggcactacgaagtactgtagttatttcttgaaaaatatgcaatgccctaaacccgattgcatgtacctgcacgaattgggcgatgaggcagctagcttcactaaggaggagatgcaggccggcaagcaccaagaatatgagcagaaactgttgcaggagctgtataagctgaaccctaactttttgcaactgagcactggaagcgttgataaaaacaaaaataaagtgacaccactgcaatcccctatagacaaacctagtgatagtttgtcaattggcaatggagacaacagccaacagatcagcaattcagatacaccatcccccccaccaggcttatccaagtccaaccctgtcatacctatatcttcttccaaccatagcgcccggtccccattcgagggagcggttacagagtctcagtccttgtttagtgacaatttcaggcacccgaatccaattcccagcggcttacctcccttcccttcaagcccccagacgagttctgattggcctaccgcgcctgaaccccagtccctgtttacctccgagactatcccagtgagctccagtactgattggcaggccgccttcggttttggcagctccaaacagcctgaagatgacttgggattcgaccccttcgatgtcacccgtaaggccctggcagacctcattgagaaggagctgagtgtacaggatcagcccagtctctctcctacatccctacagaattcttcctcccataccaccacagcgaagggtcctggttccggcttcttgcatcctgccgccgccaccaatgccaacagcctcaattccacctttagtgtgctgccccagcggttccctcagttccagcagcatagggccgtctacaacagtttcagtttccctggccaggctgcacgatacccctggatggcgttccctcgcaactcgatcatgcatttgaatcacacagcaaatcccaccagcaattctaattttctggatcttaacctgccgccacagcataatacaggattgggcggtataccagtggctggcatcccagcatccagcggcaacagcctggactccctgcaggatgataatccaccccactggcttaagagtctgcaggccctgaccgagatggatggtccgtcggccgcaccctcccagacacatcacagcgctcccttcagcacccagattccgctccaccgtgcctcctggaatccatatcctcccccctcgaatccaagctcatttcactcaccccccccaggcttccagacagccttccgcccgccttccaaaacacccaccgatctattgcagtcctcaaccctggatagacactag

SEQ ID NO: 181998 - DNA, 1302 bp, Artificial Sequence
  Description of Artificial Sequence: Synthetic coding sequence
atgagccggagccccgacgccaaggaggaccccgtggagtgccccctctgcatggagcccttggagattgatgacataaactttttcccatgcacctgtggataccagatctgcaggttttgttggcatcgaatccgaactgacgagaatggtctgtgtccagcttgcaggaaaccatatcctgaggatcctgctgtctacaaaccactgtcacaggaggagctccagcgtattaaaaacgagaaaaaacagaaacagaatgagcgcaaacagaagatctctgaaaataggaaacacctggccagtgtcagagtggtgcagaaaaatctggtgtttgtcgtgggcctcagtcagagactcgctgaccccgaggtgctgaagcgtcctgaatacttcggaaagtttggcaagatccataaggtagtgatcaacaactccacaagctatgccggctcgcagggcccctccgcgtccgcctatgttacttatatccggtcggaagatgcactcagggctatccagtgtgtcaacaatgtggtggtagacggccgcactctgaaggcctcactgggcacaaccaagtactgttcttattttctgaaaaacatgcaatgccctaaacctgattgcatgtacctgcacgaactgggggatgaggccgccagcttcacaaaagaggagatgcaggctggcaaacatcaggagtacgagcagaagttgctgcaggagttatataagctgaaccccaattttttgcaactgagcactggaagtgtagataaaaataagaacaaggtcactcccttacagcggtacgacactcccatcgacaaaccctccgattcactttccatcggaaacggagataactcacaacagatttctaactcggacacccccagtccacctccaggtctctctaagtcaaacccggtgattcctatcagtagtagcaatcactccgcccgctctccctttgagggcgccgtgaccgagtcgcagagtttgttttccgacaacttccgacaccccaatccaataccatctggacttcctccttttcctagctcaccacagacatcctctgattggcctaccgcccctgaaccacagtcactgtttacctccgaaacaatacctgtgtcaagctcaacagactggcaggccgcctttgggttcggctcgagcaaacagccggaggatgacctcgggttcgacccctttgacgtgacccgcaaggccctggcggatctgactgaacctatcgagagaaagcgactggctgtgctcaagaggaggtag

SEQ ID NO: 181999 - DNA, 1929 bp, Artificial Sequence
  Description of Artificial Sequence: Synthetic coding sequence
atgagccggagccccgacgccaaggaggaccccgtggagtgccccttgtgcatggagccactcgagattgatgacatcaacttctttccctgcacatgtgggtaccagatttgtaggttttgttggcaccgtattcgaactgacgaaaacggcctgtgtccggcttgccggaaaccctaccccgaagatcctgccgtgtacaaacccttgtctcaagaagaactgcagagaatcaagaacgagaagaaacagaagcagaacgagaggaagcagaaaatcagcgagaatcgcaagcatctggccagcgtccgtgtcgtacagaagaatctggtgttcgtagtcggtctgagtcagaggctcgccgaccccgaagtgctgaagcgtcccgaatattttggcaaattcggtaagatccacaaggtcgtgataaataactccacatcctacgccggatcccagggaccctccgcctcggcttacgttacttacatacgaagtgaagatgccctgagggccatccaatgcgttaataatgttgtggttgacgggagaactttaaaagcgtccctcgggactacaaaatattgcagttacttcctgaaaaacatgcaatgtccaaagccagattgcatgtacttgcatgagcttggcgacgaggctgcttcatttaccaaagaggaaatgcaagctggcaagcaccaggagtatgagcagaagttgctgcaggagctctacaagttgaaccccaatttcttacagctaagcacaggttccgttgacaagaacaagaacaaggtcactccactgcaaagatatgatacacccatagataaaccaagcgatagtctctcaataggaaatggcgacaactcacagcaaatatcgaattcagataccccctccccacctccgggtttaagtaagtccaaccccgttatcccaatctcctcctctaaccacagtgcccggtcccctttcgaaggtgctgtgacagagtctcagtccctgtttagtgataattttcggcatcccaaccccatcccgagcggactcccacccttcccctcaagtccacagacatcaagcgattggccgactgcccctgagccacagtccttattcacctccgaaacaatccctgttagttcctcaaccgattggcaggctgcttttggctttggcagcagcaaacaacccgaggacgacctgggctttgacccatttgacgttacccgtaaggctttggcggacttgatcgaaaaagagctgtccgtccaggaccagccttctctgagccccacaagtctgcagaattcttcctcacatactaccacagcaaagggccccggctctgggttcctacacccagcagccgcaacaaacgctaattcacttaacagtacgttttccgtcctgcctcagcgttttccccagttccagcagcaccgtgcagtttacaattcattttccttccctggacaggctgccaggtacccgtggatggcattcccaaggaactccatcatgcacctgaatcacaccgctaaccccacaagtaactctaactttcttgatctgaacctacctccacaacataacacaggcctcggcggcatcccagtcgctggcattcccgcctcaagcggcaatagtcttgactcacttcaggacgacaatccaccccactggttaaagtcgctgcaagccctgactgagatggacggccccagcgccgctccatctcaaacccaccattccgcccccttttccacacagatcccgctgcatcgcgcaagttggaacccatatccccctccaagcaatcccagctcctttcactcccctcctcccggcttccagacagccttcagacctccatctaagacaccaacagatctgctccagtcatctaccttagatcgccactag

SEQ ID NO: 182000 - DNA, 1719 bp, Artificial Sequence
  Description of Artificial Sequence: Synthetic coding sequence
atgagccggagccccgacgccaaggaggaccccgtggagtgccccctgtgcatggagccactggaaatcgacgacattaatttttttccatgcacgtgcggatatcagatatgccgcttttgctggcaccggattcgcaccgacgagaatgggctgtgccctgcttgccgcaaaccttacccagaggatcccgcagtttataaacccctgagtcaggaggagctccaacgcataaaaaacgagaagaagcaaaagcagaacgagcgaaaacagaagatctctgagaaccgcaagcatttagccagcgtgcgcgtggtccagaaaaacttggtgtttgtcgtggggctgagccaacggctcgccgaccccgaagtcctgaagagaccagagtatttcggaaagttcggtaagatacacaaggttgtgattaacaactctaccagctatgcgggtagtcagggtcctagcgccagtgcctatgttacatatattaggtccgaagacgcacttcgagctattcagtgtgtgaataatgtagtggtggatggccgcaccttaaaggcctcgctaggaaccacaaagtattgttcttactttttgaagaacatgcagtgtccgaagcctgattgtatgtacctgcacgagctaggggatgaagctgcaagctttacgaaggaggaaatgcaggccgggaagcaccaagaatatgaacagaaattgctgcaagaactgtacaaattgaatccgaatttccttcagctctccactgggtccgtggacaaaaacaagaataaggtcaccccgttacagagccccatcgacaagccttcagactcactctctattggcaacggtgataactcccaacagatcagcaacagtgacactcctagtccacctcccggcctgtccaaatcgaaccccgtaattccaatcagctcgagcaatcatagtgctagatctccatttgagggtgcagtcacggaatcccagtcattattcagcgataatttccggcatcccaaccctatcccatctggcttgcctccgtttccctcgtcgcctcagacaagcagcgattggcctacagcccccgagcctcagtccctttttacttctgagactattcctgtctcttccagcaccgactggcaggcggcctttgggtttggctcctctaaacaaccagaagacgatcttggatttgacccatttgacgtgactaggaaggccctagccgacctgattgaaaaggagttgagtgtgcaagaccagccaagcctgtcgcctacatccctgcagaacagttcctcccatacgacaactgctaagggacccggctcgggcttcctccatccagctgccgctactaacgcgaattccctgaactccacgttctctgtactacctcagagatttccacaatttcagcagcaccgcgccgtgtacaattctttttcatttcctgggcaggccgcccggtatccctggatggcatttccaaggaattcgatcatgcacttgaatcataccgccaatcccacctctaattccaactttctcgacctgaatctgcctcctcagcataacacaggccttggcggaattccggtcgccggggaagaagaggtcaaagtttctaccatgcccctttcaacatcctcacactccttgcagcaggggcaacagcctacatccctgcatactaccgttgcgtag

SEQ ID NO: 182001 - DNA, 2142 bp, Artificial Sequence
  Description of Artificial Sequence: Synthetic coding sequence
atgagccggagccccgacgccaaggaggaccccgtggagtgccccctgtgtatggaacctctggaaatcgatgacattaacttcttcccgtgcacatgtggctatcaaatctgtagattctgctggcatcgtataaggactgatgagaatggcttgtgtccagcatgtcgcaaaccataccccgaagatcctgccgtatacaagcctctgagccaggaggaactccagcggattaagaacgagaaaaaacagaaacaaaacgaaagaaaacagaagatttcagagaaccggaaacatctggctagtgtccgcgtcgtgcagaagaaccttgtgtttgtggtcggcttgtcccagagactggcggaccctgaagtgctgaagagacccgagtactttggaaaatttggcaagatccacaaagtggtaatcaacaattccacctcctacgccggctctcagggacctagtgcctcagcatatgtcacatatattaggtccgaggacgccctccgagcaatccagtgcgtcaataatgtggtggtcgatggccggacactgaaagcgagcctgggtacaacaaagtattgttcatattttctaaagaacatgcagtgtccaaagcctgattgtatgtacctgcacgagctgggcgatgaggcagcttctttcaccaaagaggagatgcaggctggaaaacaccaggaatacgagcagaaactccttcaggaattgtataagctaaacccgaattttctgcagttgagcacgggctcggtggataagaacaagaataaggtgactcctttgcagaggtatgacacaccaatcgacaagccatcagactcactgtctattggaaatggggacaactcacagcagatcagcaattctgacaccccaagccctccacccggactgtcaaaaagcaaccccgttattcccatatcctcttccaatcattctgcaaggtcacctttcgagggcgcagttaccgagagtcaaagccttttctccgacaatttccgccatccgaaccctattccttctggcctccctcccttcccctcttcccctcagacctcttccgactggcctacagcgccagagcctcaatctctgtttacatccgagaccattcccgtgtcgtcatccaccgactggcaggcagcattcggatttgggtcctcaaagcagccagaagatgacttaggcttcgatccattcgacgtaacgagaaaagctctcgcggatctgatcgaaaaggagctctcggtgcaagaccagccctccctgtcacccacctccctgcagaactcatcttctcacaccaccacagcgaaagggccaggaagcggtttcctgcacccagcggctgccacaaatgctaactctctgaattcaactttttcagtgcttcctcagcgcttccctcaatttcagcagcaccgggccgtctataatagtttctccttcccaggccaggccgcccggtacccctggatggcatttcccagaaattctatcatgcacctgaaccacaccgcaaatcccacttccaatagcaactttctcgacttgaacctgccgccgcaacataacactggcctgggcggcatccccgtggcagataactcttcaagcgtggagagcctcaatatgaaagaatggcaggatggccttcgggcattacttcccaatattaacataaatttcggtggcctgcccaacagctcctcccctagtaacgctaatcacagcgctcctactagcaacacagcaaccacagactcgctgtcttgggactctccgggcagttggacggaccctgcaattatcacagggatacctgcatcaagtgggaactcactggactctcttcaggatgacaacccgccccactggttgaagtccctgcaggccttgactgaaatggacgggccctccgccgcaccaagccagactcaccattcagctcctttctctacgcaaattcccctgcacagagcctcttggaatccttatcccccaccatctaacccatcttcctttcattctccgcctccagggttccagactgctttcaggccgccttccaaaacccccacagacctcctacagagcagcactctggaccgccactag

SEQ ID NO: 182002 - DNA, 1674 bp, Artificial Sequence
  Description of Artificial Sequence: Synthetic coding sequence
atgcccaaggagaagtacgagccccccgacccccggcggatgtacaccataatgtcgagcgaggaggccgccaatggaaagaaaagccattgggccgagctggagatcagtggtaaagtgaggagcctaagcgccagcctctggagtctaactcacctcacagctctgcatctgtccgataattccttatccagaatcccatctgatattgcgaaacttcataacttggtctaccttgacctgagtagcaacaagatccgatctctaccggccgaactgggaaacatggtgagcctgcgcgagctacacctgaataacaacctgctccgcgtcctcccctttgagctcgggaagctgtttcagcttcagaccctggggttaaaagggaacccacttacgcaggatatcttgaatctgtaccaagagccggacggaactagacgccttctgaattaccttctcgataacctgtccggtacagcgaaaagaatcactacagaacagccacctcccaggtcctggattatgctgcaagagcccgataggactagacctactgcactcttcagcgtcatgtgttataatgtcttgtgcgataaatacgcaactcggcagttgtacggctattgtccaagctgggcattgaactgggactacagaaagaaggcaattattcaggagattctgtcttgcaatgcagacatcgtcagtcttcaggaagtggagactgaacagtattacagcttttttctcgtggaactaaaagagcgtgggtataacggtttcttctctccaaagtccagagctaggaccatgtctgaacaggagaggaaacacgtggatggctgcgctatattttttaaaaccgagaagtttactctggtgcagaagcatacagtcgagtttaatcagctggctatggcaaactcagaaggtagtgaggccatgctgaatcgagtgatgacgaaggataatatcggcgtggctgtgcttttagagctcaggaaggagagcatcgaaatgccttccggaaagccccacctcggcactgaaaaacagttgattctagtcgctaatgcacatatgcactgggatccagaatactccgacgtgaaactcgttcagacaatgatgtttttatcagaggtgaaaaatatcattgataaggcatccagaaatctcaagagcagcgttctgggcgagttcgggaccatccccctagtgttatgcgctgatctcaactccttacctgattctggagtcgtggaatacctgagtactggtggtgttgagaccaatcacaaggatttcaaggagctgaggtataacgagtcgttgaccaattttagctgtcatggcaaaaatggcaccactaacggcagaattactcacggcttcaagctacagtcggcctacgagagtggcttgatgccttacacaaactacacatttgattttaagggtattatcgactacatcttttattccaaaccacaattaaataccctcgggatcctaggccccctggatcatcattggctggtggagaacaacatctccgggtgccctcaccccctgataccaagtgatcatttcagcctcttcgcccagctggagctcctgcttccattcttaccccaagttaacggcattcacttacccggtcgacggtag

SEQ ID NO: 182003 - DNA, 1674 bp, Artificial Sequence
  Description of Artificial Sequence: Synthetic coding sequence
atgcccaaggagaagtacgagccccccgacccccggcggatgtacacgattatgagctctgaagaggccgccaacggtaagaagagccactgggccgaactggagatcagcggcaaggtgagatccttatccgctagtctctggtcacttacccatctgaccgccctgcacctgtccgataattctctgtcccggataccaagcgacattgcaaagctgcacaaccttgtgtatctcgacctgtcttctaacaaaatcaggagcctccccgctgagctgggcaatatggtgagcctgcgggagctgcacctgaacaataacctgttgcgcgtcctccctttcgaactgggcaagctctttcagctgcaaactctcggcttaaaaggcaatcctctgacccaggatatcttgaatctctatcaagaacctgacggcacccgcaggctcttgaactaccttctggataacctgtctggcacagccaaacggataactacagagcaaccaccccctcgtagttggatcatgttacaggagccggaccggacgcggccaacagcactcttttcagttatgtgttacaacgtgctgtgtgataaatacgccacgaggcagctctacggctactgccctagctgggctttgaattgggactaccggaaaaaggccatcatccaggaaatcctaagctgcaatgcggatattgtgtctctacaggaagtggagaccgagcagtattacagcttctttctggtcgaattaaaggagcgaggctacaacgggtttttcagtccaaagtcacgcgcacgcacgatgagtgagcaagaacgaaagcatgttgacggatgcgccattttctttaagaccgaaaagtttacactggtccagaaacacaccgtcgagttcaaccagctcgctatggctaacagtgaaggttcagaggccatgctaaatagggtcatgacaaaggacaatattggcgtcgcagtgctgttggaactccgtaaagagagtattgagatgccctccggcaagccccatttagggactgaaaagcagcttatccttgtggcaaatgcacatatgcactgggatcctgaatactcagacgtgaagctggttcagacaatgatgtttctgagcgaagttaaaaatatcatcgacaaggcaagcagaaacctgaagtcgagcgtccttggcgaattcggcactatccctctggtgctgtgtgctgatctcaacagtcttcccgacagcggggtggtcgagtatcttagcactgggggagttgaaaccaaccacaaggattttaaagagctgagatataatgagagcctgaccaactttagctgccacgggaagaacggtacaacaaacggcagaattactcacgggttcaaactccagtctgcttatgagtctggcttaatgccttataccaattatacgttcgattttaaaggcataatcgattatatcttttactcaaagccacagctcaacaccctggggattttgggccccctggatcatcattggctggtggagaacaatatttctgggtgtccccaccctcttattccgagtgatcacttctccttgttcgcacaactcgaactccttctgccttttctgccccaggtcaacgggatccatctgcccggccgacggtag

SEQ ID NO: 182004 - DNA, 858 bp, Artificial Sequence
  Description of Artificial Sequence: Synthetic coding sequence
atgcccgccgccaccgtggaccacagccagcggatctgcgaggtgtgggcctgtaatttggatgaagagatgaaaaagatccgacaggtgattcggaaatataattatgtggcaatggatacagaattccctggcgtggttgcacgccctattggcgaattccgctcgaatgccgactatcagtatcaactcctgcgctgcaacgtggacctgctgaaaatcattcagctgggtctaactttcatgaacgagcagggtgagtatccacccgggactagcacttggcagttcaattttaagtttaacttgacagaagacatgtatgcccaggattcaattgaactgctcacgacgtctggcatacagttcaagaagcatgaggaggaaggcattgaaactcagtatttcgccgagctgttgatgacgtctggcgttgtgctatgcgaaggagtgaagtggctgagcttccatagcgggtacgacttcgggtatttgataaagattctgacaaactcaaacctgcccgaggaagagctcgatttcttcgagatattgcgattgttctttccagtcatctacgacgtgaagtacctaatgaaatcttgtaagaatctgaaggggggtctgcaagaggttgccgaacagctggagctggaacgcattggccctcagcatcaggccggatctgacagtttgctaactgggatggcattcttcaaaatgcgggagatgtttttcgaagaccacatcgacgacgccaagtattgcgggcatctctatggtcttggatcaggcagctcctatgttcagaatggcacaggaaatgcgtacgaggaggaggcaaacaaacagtcctag

SEQ ID NO: 182005 - DNA, 126 bp, Artificial Sequence
  Description of Artificial Sequence: Synthetic coding sequence
atgcccgccgccaccgtggaccacagccagcggatctgcgaggtgtgggcttgcaacctggacgaagaaatgaaaaaaattcggcaggtgatacgcaaatataactatgttgccatggatacctag

SEQ ID NO: 182006 - DNA, 735 bp, Artificial Sequence
  Description of Artificial Sequence: Synthetic coding sequence
atgcccgccgccaccgtggaccacagccagcggatctgcgaggtgtgggcctgcaatctcgacgaggaaatgaaaaaaatccgtcaagtcatcagaaagtataattatgtcgcaatggatactgagtttccgggagttgtggctcgtccaatcggcgagttccgctccaacgcagactaccaatatcagttgctgagatgtaatgtggacctgcttaaaatcatacaactgggattgactttcatgaacgagcagggcgaatatccaccgggcaccagcacttggcagtttaactttaaattcaacctcaccgaggacatgtatgctcaggatagtatcgaacttttgaccactagcgggatccagttcaagaagcacgaagaagagggcattgaaactcagtattttgcagaattactcatgacatcgggggttgttctgtgtgaaggagtaaagtggttgagctttcatagcgggtacgatttcggatacttgatcaaaatcctcaccaattctaacctaccagaggaagaactcgatttcttcgagattctgcgattgttctttcccgtgatctatgacgtgaagtatctgatgaagtcctgcaaaaatctgaaaggtggcttgcaagaagtggcagagcagctggagctggaacggatcgggccccagcaccaggctggaagtgatagccttctcaccggcatggccttctttaagatgcgagaagtgtag

SEQ ID NO: 182007 - DNA, 444 bp, Artificial Sequence
  Description of Artificial Sequence: Synthetic coding sequence
atgcccgccgccaccgtggaccacagccagcggatctgcgaggtgtgggcctgcaatcttgacgaggagatgaagaagattcgacaagtgatacgtaagtataattacgttgcaatggataccgaatttcctggggtggtggcacggcccatcggtgaatttcgctccaatgccgactatcaataccagttgctgcggtgcaatgtagatttattgaagattatccagcttggactgactttcatgaacgaacagggcgagtatccgcccgggacttcaacatggcaattcaattttaagttcaatttgacagaggatatgtacgctcaagattcaattgagttactgaccaccagcggcatccagtttaagaagcatgaagaggagggcattgaaactcaatatttcgctgagctgttgatgactagtggtgtggtcctctag

SEQ ID NO: 182008 - DNA, 879 bp, Artificial Sequence
  Description of Artificial Sequence: Synthetic coding sequence
atgcccgccgccctggtggagaacagccaggtgatctgcgaggtgtgggcctctaacctggaggaagaaatgcgcaaaatcagggagattgtgctgtcctactcctacattgcgatggatacggaatttcctggagttgtagtgcggcctataggagagttccgctcaagcatcgattatcagtatcaacttctcagatgtaatgtagacctgttaaagatcattcaattgggactcacattcactaatgagaaaggcgaatacccctctgggattaacacatggcaattcaacttcaagttcaacctgaccgaagacatgtactcacaggattccatcgacttgctggctaactccggtctgcaattccagaagcacgaggaagaaggaattgatacccttcactttgccgagttactgatgacctcaggggttgtcctgtgtgacaacgtcaagtggctaagcttccacagtgggtatgactttggttatatggtgaagttgctgacggacagcagactgcccgaagaggagcacgagttctttcatatcctgaatctgtttttcccatccatttatgacgtgaagtacctcatgaagtcctgcaaaaatttaaagggcggactccaggaggtagccgaccaactggacctacagcgaatcgggcgtcagcatcaggcaggtagtgattctctattgactggtatggctttttttcggatgaaggaactgttctttgaggattccatcgacgatgcaaagtactgtgggaggttatacggactcgggactggagtggcccagaaacaaaacgaagacgtggactctgcccaggaaaaaatgtcaatcctggccatcataaacaacatgcagcagtag

SEQ ID NO: 182009 - DNA, 879 bp, Artificial Sequence
  Description of Artificial Sequence: Synthetic coding sequence
atgcccgccgccctggtggagaacagccaggtgatctgcgaggtgtgggcttcaaacctggaggaagaaatgagaaaaatcagagagatcgtgctgtcttacagctatatagctatggacaccgaatttccgggcgtggtcgttagaccgattggggagtttcgctcctccatcgactatcagtaccaactgctgaggtgcaatgtggatttattgaagataatccagctcggtctcacgtttacaaacgaaaagggcgaatatccatctggaatcaatacttggcaattcaatttcaaattcaacctgacggaggatatgtattcccaggactcaatcgacctgctggccaattccggactacagttccagaagcacgaggaagaaggaatcgacactttacacttcgccgaattgcttatgacatccggggtggtcctgtgcgataacgtcaaatggttgtctttccactccgggtacgactttggatacatggtcaaactgctgaccgacagtaggctgcccgaagaggagcacgaatttttccacatactcaatttgttcttcccatctatatatgacgtcaagtacctcatgaaaagctgcaagaatttaaaaggcggcctgcaagaggtggccgaccagctggacttgcagaggataggacggcagcatcaggcaggatccgatagcctgctcaccggaatggctttcttcaggatgaaagaactgtttttcgaagacagcatcgacgacgccaagtactgcggtcggctttatggcctcggtaccggagtcgcgcagaagcaaaatgaggatgtcgacagcgcccaggagaagatgtctatcttggctatcatcaacaacatgcagcagtag

SEQ ID NO: 182010 - DNA, 357 bp, Artificial Sequence
  Description of Artificial Sequence: Synthetic coding sequence
atgcccgccgccctggtggagaacagccaggtgatctgcgaggtgtgggcctcgaatctggaggaggagatgaggaagatcagagaaatcgtgctgtcgtactcctacatcgctatggatacagaatttcccggagttgtagtgagaccgattggcgaatttcgtagcagcattgattatcagtaccagttgctgaggtgtaacgtcgacctgctgaaaattatacagttgggcctcaccttcactaacgagaaaggcgagtatccatcgggaattaacacttggcagtttaacttcaagttcaacctgacggaagacatgtactcccaggacagtatcgatctgctagccaattag

SEQ ID NO: 182011 - DNA, 879 bp, Artificial Sequence
  Description of Artificial Sequence: Synthetic coding sequence
atgcccgccgccctggtggagaacagccaggtgatctgcgaggtgtgggctagtaatttagaggaggagatgcgcaagataagggagatcgtcttatcctatagttacattgcaatggatacagagtttcccggggtggtcgtccgacccatcggggagtttaggagtagcattgattaccagtatcagctgttacgctgtaatgtcgacttgcttaagataatccagctcggcctgacatttacgaatgagaagggtgaatacccatctgggattaatacttggcagttcaatttcaagttcaacctcacagaagatatgtacagtcaggattccattgatttattggcaaattcaggcttacagttccagaaacacgaggaagagggaatcgacaccctacacttcgccgagctcctgatgacaagcggagtggtgctgtgcgacaacgtgaagtggctctcctttcacagcgggtacgacttcggctacatggtaaagctcctcactgatagcaggctgccagaggaagagcacgagttttttcatattctcaatcttttctttcctagcatctacgatgttaaatacttaatgaaatcttgcaagaatctcaagggagggttgcaagaggtagcggatcagctcgacctccagcggattgggcgacagcatcaagccggtagcgacagtcttctgaccggtatggctttcttccgcatgaaagaactcttttttgaagactctattgacgatgccaaatattgtgggcgtctgtacgggttaggaactggagtagctcagaaacaaaacgaggacgtggattcagcccaggaaaagatgtccatactcgctataattaataatatgcagcagtag

SEQ ID NO: 182012 - DNA, 168 bp, Artificial Sequence
  Description of Artificial Sequence: Synthetic coding sequence
atgcccgccgccctggtggagaacagccaggtgatctgcgaggtgtgggcctcaaacctcgaagaagaaatgcggaaaattcgggagattgtgctgtcctatagttacattgctatggacacggaattccccggtgtggtggtgcgacctatcggcgaatttcgctag

SEQ ID NO: 182013 - DNA, 678 bp, Artificial Sequence
  Description of Artificial Sequence: Synthetic coding sequence
atgcccgccgccctggtggagaacagccaggtgatctgcgaggtgtgggcatccaatcttgaggaagagatgaggaagatccgggagattgtcctgtcttacagttatattgcaatggacacagagtttcccggagtggtcgtgcggcccatcggggagttcagaagcagcattgactatcagtatcagcttcttcgatgcaatgtggacctgctgaagatcattcagttggggctgacgttcactaatgagaaaggagagtacccctccggcatcaatacctggcagtttaactttaaattcaacttgacaggatacgatttcggctacatggtgaagctgctgactgatagtcgactgccggaggaagagcatgaattcttccatattctcaatctcttcttcccctccatttatgacgtgaagtatctcatgaaatcctgtaagaacttgaaaggcggcctgcaggaggtcgcagatcagctggacctccaacggattggaagacagcatcaggctgggagcgactcgctcctgactgggatggctttcttcagaatgaaagagttattttttgaagacagtatcgacgatgcaaagtactgcggccgcctttatggcctgggcaccggcgtcgctcagaaacagaacgaggacgtagactctgcccaagagtag

SEQ ID NO: 182014 - DNA, 360 bp, Artificial Sequence
  Description of Artificial Sequence: Synthetic coding sequence
atgcccgccgccctggtggagaacagccaggtgatctgcgaggtgtgggcatccaacctggaggaagagatgcgaaagataagagagattgtgctctcttatagttatattgctatggacaccgagttcccaggtgtcgtagtccgtcctatcggagaatttcgcagctccattgactaccagtaccaactgctgcggtgtaacgtcgatctgcttaagattattcagctgggactgacatttacgaatgagaagggagaatacccttctgggatcaatacttggcagtttaactttaagttcaacttaactgaggacatgtactcacaggactctattgacctactcgctaattcctag

SEQ ID NO: 182015 - DNA, 717 bp, Artificial Sequence
  Description of Artificial Sequence: Synthetic coding sequence
atgcccgccgccctggtggagaacagccaggtgatctgcgaggtgtgggccagtaacctggaggaggagatgcgtaaaatcagggaaatcgttctgagctactcatacatcgccatggacactgagttcccgggagtggtggtgcgcccaatcggggaattccggtcttcaattgattaccaataccagctattaagatgcaacgtggacctcctgaagatcatacaactggggttgacattcacaaacgagaagggtgagtatccctctggtataaatacctggcagtttaactttaagtttaatttgactgggtatgattttggatatatggtaaagctattaaccgatagtagactgcctgaggaagaacatgaattcttccacattcttaacctgttttttccatccatttacgatgtgaaatacttgatgaaaagttgtaagaacctcaagggaggtctgcaggaggtggcggaccagcttgatctgcagcgcatcgggcggcaacatcaagccgggtctgactcgctgcttaccggaatggcgtttttccgtatgaaggagctctttttcgaggactcaatcgatgacgctaaatattgcggaaggctgtatggcctggggactggcgtcgcccagaagcagaatgaagacgtagacagcgcccaggaaaagatgagtatcctggccatcatcaacaatatgcaacagtag

SEQ ID NO: 182016 - DNA, 168 bp, Artificial Sequence
  Description of Artificial Sequence: Synthetic coding sequence
atgcccgccgccctggtggagaacagccaggtgatctgcgaggtgtgggcctcaaatctcgaggaggagatgagaaagatacgcgagattgtgctgagctacagctatattgccatggataccgagttccccggtgttgttgtgcggccgattggggaattccgttag

SEQ ID NO: 182017 - DNA, 258 bp, Artificial Sequence
  Description of Artificial Sequence: Synthetic coding sequence
atgtacagccaggacagcatcgacctgctggccaacagcggcctgcagttccagaagcacgaggaagagggaatcgacacactgcatttcgcagagcttctgatgaccagcggcgtagtactgtgtgacaacgtgaagtggctctcttttcacagcggttacgacttcggctatatggtcaagctactaactgattcacggctgcccgaagaagaacatgaattctttcatatccttaatctgtttttcccttcgtag

SEQ ID NO: 182018 - DNA, 402 bp, Artificial Sequence
  Description of Artificial Sequence: Synthetic coding sequence
atgcccgccgccctggtggagaacagccaggtgatctgcgaggtgtgggcaagcaacttggaagaggagatgcgcaagatcagagagatcgtattgagctattcctacattgcaatggatacagaattccctggcgtggtagtgaggcccataggagagttccgcagttccattgattatcagtatcagttgctgcgttgcaatgttgacctcttgaagatcatccagcttgggttgactttcaccaacgaaaagggtgagtacccgtccggaatcaatacatggcaatttaattttaagtttaatctcacagaggacatgtacagccaggattctatcgatctcttggctaattctgggctgcagtttcagaaacacgaggaagagggaatcgatacctag

SEQ ID NO: 182019 - DNA, 561 bp, Artificial Sequence
  Description of Artificial Sequence: Synthetic coding sequence
atgtacagccaggacagcatcgacctgctggccaacagcggcctgcagtttcagaagcacgaagaggaagggatcgatactcttcactttgccgaacttttgatgacatcaggagtcgtcttatgtgataacgtcaagtggctgagctttcactccggttatgacttcggatatatggttaagctgctcactgactctagactccctgaggaggaacatgaattcttccacattctcaatttgtttttcccctctatttatgatgtgaaatacctcatgaagagctgtaagaacctcaagggcggcctgcaggaggtggctgaccagttggatctgcagcggattggccgtcaacatcaggcaggatccgattccttgctcacggggatggcttttttccgcatgaaggaattgttttttgaggattcgattgatgacgccaaatattgcggccgcctgtatggtctcgggacaggcgtggcccaaaagcaaaacgaagacgtggactctgcccaggagaaaatgagcatcctggctataattaataatatgcagcagtag

SEQ ID NO: 182020 - DNA, 561 bp, Artificial Sequence
  Description of Artificial Sequence: Synthetic coding sequence
atgtacagccaggacagcatcgacctgctggccaacagcggcctgcaattccagaaacatgaagaggaggggatcgacacgctacactttgcagaacttctcatgacatccggcgtggttctgtgtgataacgtgaaatggctgtcttttcattctggatatgattttggttatatggtcaagctcctcacggacagcaggttacccgaagaagagcacgaattttttcacatcctgaatctgttctttccctctatttacgatgtaaaatacctgatgaagtcttgcaagaaccttaaaggaggcctccaggaagttgcagaccagctagacttacagcggattggaaggcagcatcaggccggctccgactctttactgacgggaatggccttcttcaggatgaaagagctgtttttcgaggatagcatcgatgacgccaaatactgtggacggctctacgggctcggaactggtgtggcccagaagcagaatgaagacgtggactcagcccaagagaagatgagtatattagccatcataaacaacatgcagcagtag

SEQ ID NO: 182021 - DNA, 561 bp, Artificial Sequence
  Description of Artificial Sequence: Synthetic coding sequence
atgtacagccaggacagcatcgacctgctggccaacagcggcctgcagtttcagaagcacgaagaggaagggatcgacactcttcatttcgctgagttgcttatgacatccggtgtggtcttatgtgacaacgttaagtggctgagctttcactccggctacgactttgggtatatggtcaagctactgactgactcccgcctgcctgaagaagagcatgagttttttcatattcttaacctgttttttccgagcatatatgatgttaagtatctcatgaagtcatgtaagaacctgaagggagggctgcaagaagttgccgaccaactggacttgcagcggataggaaggcaacaccaggccggcagcgatagcttactaaccggcatggctttcttccggatgaaagagctttttttcgaagacagtattgatgatgccaaatattgtggaaggttgtatggcctcggtactggggtggcgcaaaagcagaacgaagacgtggacagcgcccaagagaagatgtccattctcgcaattattaataatatgcagcagtag

SEQ ID NO: 182022 - DNA, 366 bp, Artificial Sequence
  Description of Artificial Sequence: Synthetic coding sequence
atgcccgccgccctggtggagaacagccaggtgatctgcgaggtgtgggcttctaacttggaagaagagatgagaaagatcagggagattgtgctcagctacagctacattgccatggatacagaattccctggcgtcgtggtcaggcctattggagagttccgttcttcaatagattatcagtatcagcttcttcggtgcaatgtcgatttactgaagattattcaactcggcctcacctttaccaatgaaaaaggcgaatatccatcaggaattaacacttggcagttcaatttcaaattcaatctcaccggatacgacttcggctacatggtaaaactgctgaccgactcgagacttccctag

SEQ ID NO: 182023 - DNA, 561 bp, Artificial Sequence
  Description of Artificial Sequence: Synthetic coding sequence
atgtacagccaggacagcatcgacctgctggccaacagcggcctgcagttccagaagcacgaggaggaggggatagataccctgcacttcgctgaactgctgatgacatccggggtggtactgtgtgacaacgtgaaatggctctcattccattctggctatgatttcggatacatggttaaactgctgacagactctaggctccctgaggaggaacatgagttcttccacattctaaatctgtttttccccagcatctatgatgtaaagtatctgatgaagtcatgcaagaatctgaaagggggcctgcaggaagttgctgatcagctggatttgcaacgaataggccgtcagcatcaagctgggtccgacagcctcttgacgggcatggcattcttccggatgaaagaattatttttcgaagatagcattgatgatgcaaaatactgtgggaggctgtacggcctgggcactggcgtggcgcagaaacagaacgaggacgtagactcagctcaagagaagatgtctatcctagctatcatcaataacatgcagcagtag

SEQ ID NO: 182024 - DNA, 387 bp, Artificial Sequence
  Description of Artificial Sequence: Synthetic coding sequence
atggtgaagctgctgaccgacagccggctgcccgaggaggagcacgaattttttcacatactaaacctgttcttccccagcatttacgacgtgaagtacctaatgaagtcctgcaagaacttgaaagggggcctgcaggaagtggccgaccagctcgatctacagcggatcggccggcagcatcaggccggaagcgatagcctgctcactggaatggcgttcttcaggatgaaggagcttttcttcgaagattctattgacgacgccaagtactgtggtaggctgtacggactcgggaccggcgttgcacagaagcagaacgaagacgtggatagcgcccaagagaagatgtccatcctggcaataatcaataatatgcaacaatag

SEQ ID NO: 182025 - DNA, 810 bp, Artificial Sequence
  Description of Artificial Sequence: Synthetic coding sequence
atgcggaagatccgggagatcgtgctgagctacagctacatcgccatggacaccgagtttcctggcgtcgtggtacgacccatcggcgaattccggtccagcatagactaccaatatcagctcctgcggtgcaacgttgatcttctgaagatcattcagctgggtctcactttcaccaacgagaaaggagagtatccctcaggcatcaacacctggcaatttaatttcaaattcaacctcacagaagacatgtactcccaggactccatagacctcctggccaattccggattgcagttccagaagcatgaggaagaggggattgatacactgcactttgctgaacttctgatgacatctggggtcgtactgtgtgataacgttaagtggctgtctttccacagcggctacgacttcgggtacatggtcaagttgctaactgactctagactccccgaagaagagcatgagttcttccacatcctgaatttgttcttcccctcaatttatgatgtgaaatacctgatgaagagctgtaagaacttgaaggggggactgcaagaagtggcagatcagctggatctccagagaattggtaggcagcatcaggccgggtccgatagtcttctgactggcatggctttctttaggatgaaggagctcttcttcgaggattccatcgacgacgcgaagtactgcggacgactgtacggcctgggaactggagtggcacagaaacaaaatgaggacgtggacagcgcacaggagaaaatgagcatcctcgccataattaacaacatgcagcagtag

SEQ ID NO: 182026 - DNA, 4338 bp, Artificial Sequence
  Description of Artificial Sequence: Synthetic coding sequence
atgcagggcccccccctgctgaccgccgcccacctgctgtgcgtgtgtactgcagcactggcagtggctcccggcccaaggttcctggttacagctcctggaatcattaggcctggagggaatgttacaatcggcgttgaattacttgaacactgcccaagtcaggttaccgtgaaggcagaattgcttaagacagcatccaatttaacagtgagcgtactggaagccgagggcgttttcgaaaaaggatccttcaagacacttacactaccctcacttccacttaacagcgcagacgagatttatgagctgagagtgaccgggaggacgcaagatgagattcttttcagcaacagtaccagactgtctttcgaaactaagagaatctctgtctttattcagactgacaaggccctttacaaaccgaaacaggaagtaaagtttcgcatcgttacactgttttccgatttcaagccttataagacgtcgctcaatattttaattaaggaccccaagtcgaatctgatccaacaatggctaagccagcagtccgatctgggcgttatttccaagacatttcagttgtcaagccatcccattctcggagactggtctatccaggtccaggtgaatgatcagacgtactatcagtctttccaggtctcggaatatgttctgcctaaatttgaggtcacactgcagacccctctctactgttctatgaactccaaacatttaaatggcacgatcactgcgaaatatacttacgggaaacccgtgaaaggagatgtcactctgaccttcttgcccctcagtttttgggggaagaagaagaatattacaaagaccttcaagataaatggctcagccaacttttccttcaatgatgaagagatgaaaaacgtcatggactcctcgaacggtctgagcgaataccttgatctgtctagtcctggcccagtggaaatcctgactaccgtcaccgagtccgtcactgggatttccaggaatgtctctaccaacgtctttttcaaacagcacgattacatcatcgagttttttgattacactaccgtcctcaaacccagtttgaattttactgctacggtgaaggtgacacgagccgatggcaaccaacttacactggaagaacggaggaacaacgttgtgattactgtgacacagcgcaattatactgagtattggtctggaagcaactcaggcaaccaaaaaatggaagcagtacagaagatcaactacaccgtgccacagagcggcacctttaagatagaatttcctatcctggaagatagttccgagctgcagctcaaagcctattttttgggttcgaaatccagtatggctgtccactcccttttcaagtcaccgagtaaaacatacatccagcttaaaaccagagatgagaatatcaaggtcggcagcccttttgagctggtggtcagtggaaacaaacggttaaaagagcttagctatatggttgtgtctcgggggcagttagtcgccgtgggtaagcagaactccactatgttctcactgaccccagagaactcatggacaccaaaagcatgtgtgattgtctattacatcgaggatgacggcgagattatctctgatgtactgaaaatccccgttcaactggtgtttaaaaataaaattaaactgtattggtccaaagtgaaggccgagccttctgagaaagtgtccttacgcataagcgtgacgcagcctgattcaatagtggggattgtagcagtggacaaatcggtgaacctgatgaatgcatccaacgacataaccatggagaacgtggttcatgaacttgaactgtataacacgggctactacctgggaatgttcatgaactctttcgccgttttccaggagtgcgggctgtgggttctgacagacgccaatttgacaaaggattatatcgatggcgtttacgataatgctgagtatgccgagcggttcatggaggagaacgaaggacacatagtggacattcacgatttcagcctgggatctagcccacatgtcagaaagcatttcccagagacatggatttggctcgataccaacatggggtatcggatttatcaagaattcgaagtgaccgtgcccgacagtatcacttcttgggtcgcaacaggcttcgtgatttccgaggatctggggctcggcctgactacaacccccgtggaactgcaggcttttcagcctttctttatttttttgaacctgccatatagcgtgatcaggggcgaggagtttgccctggagatcaccatcttcaattacttaaaagacgctactgaagtaaaagtgattatcgagaaatccgacaagttcgacattctcatgacaagcaacgagatcaacgcgaccgggcaccagcagactttactggtgccctccgaagacggggcaactgtcctcttccctattcgacctactcatttaggtgaaattcccattacagttaccgctctttcacccacagcatccgatgccgtaacccagatgattctggtgaaagctgaaggcattgagaaatcttacagtcagtccattctgctcgatctgacagacaaccggctgcagtctacattgaaaacactgtcctttagttttcccccaaacacagtcacaggctcagagcgagtgcagatcacagcgatcggagatgtgcttggcccttctattaacggcctggcgagtctgatccgaatgccgtacggctgcggcgaacagaacatgattaatttcgcgccaaatatttatattcttgactatctcaccaaaaagaagcaactgacagacaatctgaaggagaaagccctctccttcatgcggcagggttatcagcgggagcttctgtaccagcgcgaagatggctcttttagcgcatttggaaattatgacccgagcggaagcacatggctgtccgcgtttgttctgcgatgcttcctggaagccgatccctatatcgacatcgaccagaatgtgttgcatagaacatacacttggttgaaagggcaccagaaaagcaacggggagttctgggacccgggtcgggtaatccactccgagttgcagggagggaacaaatccccagtgactctgactgcatatatagttacgtcccttcttgggtacaggaagtaccaacctaatatagatgtgcaggaatccattcattttctggagtcagagttttcaagaggcattagcgacaactatacgctggctttgataacttacgcactgtcctctgtgggctccccaaaagcaaaggaggccttgaatatgcttacctggagagccgagcaggagggcggcatgcagttctgggtaagtagtgaatctaagctgtctgactcatggcaaccgcggtccctggatatcgaagtggcggcatacgccttactgtcacatttcttacagtttcagactagtgaaggtatcccaattatgcggtggctctctcgtcagcgcaacagtcttggcgggtttgctagcacccaggacaccaccgtggcactcaaagccctgtctgaatttgcggcgctgatgaacacagagcggactaatatacaggtgacggtgacggggccctcttcaccaagtcctgtgaaatttctgatcgacacacataatcgactccttctgcagaccgcagaactcgcagtggtgcagccaaccgccgtgaacatctcagctaatggcttcggctttgccatatgtcagctgaatgtcgtctacaacgtaaaggccagcggtagctcacgtagaaggaggtcgatccaaaatcaggaggcctttgacctagacgtcgctgtgaaagagaataaggacgaccttaatcacgtggatctgaatgtgtgtacttccttctcgggtcccggccggagtggtatggcgctaatggaagttaacctcctgtcagggttcatggtgcccagtgaagccattagtctctccgaaacagtgaaaaaagtggagtacgaccacgggaagctgaacctgtatctagacagtgtaaacgagacccaattttgcgtaaacatccctgccgtcagaaatttcaaagtatctaatactcaggatgcttccgtttccatcgtagactattatgagcccagaagacaagcagtccgttcttataactccgaggtgaaactcagcagttgcgacctttgtagcgatgttcagggatgccgaccttgtgaggacggtgcgtccggaagccaccaccatagctccgtcatcttcatcttctgtttcaagttactatattttatggagttatggctgtag

SEQ ID NO: 182027 - DNA, 4107 bp, Artificial Sequence
  Description of Artificial Sequence: Synthetic coding sequence
atgcagggcccccccctgctgaccgccgcccacctgctgtgcgtgtgtacagctgcactggccgtggcgccaggaccaaggtttcttgttaccgcgcctgggattattcgacctggcggtaacgtgacaatcggagtcgagctgctggagcattgtccatcccaggtcactgtcaaagccgagctgctgaaaactgccagcaatctgacggtgagtgtcctcgaggccgagggtgtgtttgaaaaaggcagttttaaaaccctcacactcccttctgatcccaaaagcaatctcattcagcagtggctgagccagcagagcgacctgggtgtcatttcaaagacattccaactatcctctcatccaatattaggcgattggagtatccaggttcaagtcaacgatcagacgtattaccagagtttccaggtgtcagagtacgtcttacccaagtttgaagtgaccctgcaaacacctttatactgctctatgaactccaagcacctgaacgggactatcactgctaagtacacctacggcaagcccgttaagggagatgttacactcacattccttccgctctccttttggggaaaaaaaaagaacatcacaaagacattcaagatcaacggatctgcgaacttctccttcaatgatgaggagatgaagaatgttatggattcatcaaacgggctgtccgaataccttgatctgtcgtccccgggccctgtcgaaatactgacaacagtcaccgaatccgtcacaggcatcagcagaaatgttagcaccaatgtcttcttcaagcaacacgactatatcatcgagttcttcgattataccacagtgcttaaacccagtctgaactttaccgccaccgtaaaggtgaccagagcggacggcaaccagcttactctggaagaacgcagaaacaacgtagtgataactgtgacacaacggaattataccgagtactggagcggaagcaactctggcaatcagaagatggaagcagtgcaaaaaataaattatacagtgccacaatcgggcacctttaagatagagttcccaatcctggaggactcttccgaattgcaacttaaagcgtacttcctgggatcaaagtcttcaatggccgtacattctttgtttaagtcaccctcaaaaacttacatacagttaaagactagagacgagaacatcaaagtggggagcccattcgaactggttgtctctggtaataagcgcctaaaggaattaagctacatggtcgtcagcagaggccagctcgttgctgtcggcaagcagaactccaccatgttctctctgacccctgagaattcttggacgcctaaggcgtgtgtaatcgtgtattatatcgaagacgatggagaaattatctcagacgtgcttaaaatcccagtgcagctggtgtttaagaataaaataaaactttattggtctaaagttaaggccgagcctagcgaaaaagtgagcttgcgcatcagtgtcacccagcctgatagtatagtgggcattgtagccgttgacaaaagcgtgaaccttatgaacgcatccaacgacattaccatggagaacgtcgtgcacgaactggagttgtataatacgggatactacctgggcatgttcatgaattccttcgctgtctttcaggagtgtggcttgtgggtgctgaccgatgcgaatctgactaaagattatattgacggggtctatgacaatgcagagtatgcagaacggtttatggaagagaatgaaggccacattgtggatatacacgacttttcactagggtcttccccacacgttagaaaacactttcctgaaacatggatctggctggacactaatatggggtaccgcatctatcaggagtttgaagtgaccgtgcccgattccatcacctcatgggttgccaccggcttcgtaatctctgaagatctggggttagggctaactacaacacccgtggagctgcaggccttccaaccatttttcatttttcttaacctgccctacagcgttatcaggggtgaggaattcgccctcgagatcactatttttaattatctcaaagacgctacagaagtcaaggtgattatagagaaatcagacaaatttgacatactaatgacctccaacgagataaacgctaccggccaccagcaaaccctacttgtgccatccgaggacggcgccaccgtgcttttccccatcaggcccacacatttgggggaaatccctatcaccgtgaccgcactcagtcctacagcgtccgatgccgtgacccagatgatattagtcaaggctgaaggtattgaaaagtcttactctcagtcaatacttctggacctgactgataacagactccaatcaactctgaagacattgtcattctcgttcccccccaatacagtcactgggagcgagagggtgcaaattaccgctatcggggacgttttaggaccaagcattaacgggctggcaagtcttatacgcatgccttatggatgcggcgagcagaacatgatcaactttgctccgaatatctacatcttggactatctgacgaagaagaagcagcttacagataatctcaaagagaaggccttgagttttatgcgccaaggctatcagcgagaactcctgtaccagcgcgaggatggtagcttttcagccttcggaaattacgacccaagcggaagtacctggctgagtgcttttgttctcagatgcttcctagaagctgacccctacattgacattgatcagaacgtcttacacaggacatacacttggctgaagggccaccaaaagtcaaacggagaattttgggatccgggtcgggtgatacattctgagttgcagggggggaacaagagcccagtcaccctgacggcctatattgtaacgtctctccttggttatagaaagtaccaaccaaacattgacgtgcaggagtccatacatttcttagagtccgaatttagcaggggaatttccgacaattatacgttagcactgatcacttacgccctgtcatctgtgggatctccaaaggcgaaggaggccctgaacatgctcacatggagagcggaacaagaagggggaatgcagttctgggtttcttctgagagcaaattgtccgacagctggcagccgcgtagtcttgacattgaagtagcagcgtacgcccttctatcccatttcttgcaatttcagaccagtgaaggcatcccaatcatgagatggttatctaggcagaggaattcgctcggtggattcgcctctactcaggataccacagtggcgctcaaagctctgtctgagttcgcagccctcatgaataccgagcgaactaatattcaagtcacggtcaccggcccatccagcccaagtccagtgaaatttctcatcgacacacacaatcggctcttactccagacggccgagctcgccgtcgtgcaaccaaccgccgtgaacatctcggcgaacgggttcggctttgcaatctgccaattgaatgtggtttataatgtaaaagcatccggctcatcccgccgcaggaggtcaatacaaaaccaagaggcatttgatctggacgtcgctgtgaaggaaaataaagatgatctgaaccacgtggacctcaacgtgtgcacatcattcagtggtcctggtcggagcgggatggcactgatggaggtcaatcttctgtccggcttcatggtgccctcagaagctatcagtctgagcgaaactgtaaagaaggtagagtacgatcatggcaagctcaacctgtacttggacagtgtgaatgagactcagttctgcgtgaacataccagctgtgcggaattttaaagtgtcaaacacacaggatgcctcagtcagcatagttgattactacgaacccagacggcaggccgtgcgaagttacaactctgaggtaaagttgagctcatgtgacctgtgctccgatgtgcagggttgcaggccttgcgaggacggtgcatccggcagccatcatcacagctccgtgatcttcatcttctgttttaagttgttgtactttatggaactgtggctgtag

SEQ ID NO: 182028 - DNA, 4287 bp, Artificial Sequence
  Description of Artificial Sequence: Synthetic coding sequence
atgcagggcccccccctgctgaccgccgcccacctgctgtgcgtgtgcaccgctgccttagccgtggcacctggccccagattcctcgtcaccgcccctggcattatcaggccgggtggcaacgtgaccataggagttgagctgctggagcattgtccttcccaggttacggtaaaggcagaactgctgaagaccgcctcaaacctgaccgtgtccgtcctggaggctgaaggggtttttgagaagggctctttcaaaaccctgactctgcctagcctgcccctaaactctgccgacgaaatctatgaacttagggtcaccggtcgtactcaggacgaaatcttgttttcaaatagcactcgcctgagcttcgaaacgaagaggattagtgttttcattcaaacagataaagccttgtacaagccaaagcaagaggtgaagtttcgaattgtgacacttttttcagacttcaagccatataagacttctctgaacatcttgattaaagatcccaaaagcaacttaatccagcagtggttgagtcagcaatctgaccttggcgtgatttctaaaacattccagctctcgagtcacccgatcttgggcgattggtccatacaggtgcaggtgaatgatcagacctattatcaaagctttcaggtgtcggaatacgtcctgcctaagttcgaagttaccctgcagactccattgtattgttccatgaatagcaaacacctcaatggtactatcactgctaagtatacttatggaaaaccagtgaaaggagacgttacgctgactttcctgccattaagcttttgggggaagaaaaaaaacatcaccaagacctttaagatcaatggatccgccaactttagttttaacgacgaggagatgaaaaatgtgatggactcatcaaacggcctttcagaataccttgacctgtcctctcccgggcccgtagaaatcctgacaactgtgaccgagtccgtcactgggataagcagaaatgtctcaaccaatgtgttcttcaaacagcacgactacatcatcgaattcttcgactacaccacagtcctcaagccttctttgaactttaccgctacggtgaaggtgacccgggctgatggcaatcagcttaccctcgaggagaggagaaacaacgtagtgatcaccgttacacaacgcaactacacagagtattggagcggttccaattccggtaatcaaaagatggaagcggtgcagaagattaactacactgttcctcagtccggcacttttaagatcgaattccctattctcgaggactcctctgaactgcagctgaaggcctactttctgggatcaaagtcgtctatggctgtacacagtctgtttaagagtccaagcaagacatatatccagcttaagacacgggacgagaacattaaggtcggctccccttttgagctggttgtttccggaaataagcgtcttaaggaattatcctacatggtggtctctaggggacaactcgttgctgtgggtaagcagaatagcactatgtttagcctcactccggagaattcttggacgcccaaagcctgcgtcatcgtgtactacatagaagatgacggagagattatttcggacgtcctgaaaattccggtgcagcttgtttttaagaacaagattaagctttactggtccaaggtgaaggcagagccaagcgagaaggtttccctccgtatttctgtgacgcagcctgattccattgtgggaattgtcgccgttgataagtcggtgaacctcatgaatgcaagcaacgatattacaatggagaacgttgttcatgagctggaactctataacaccggctactacctggggatgtttatgaatagcttcgccgtcttccaggaatgtgggttgtgggtgctgactgatgctaacctgacgaaggactacattgatggagtttacgataatgccgaatatgctgagaggttcatggaggagaacgagggacacatcgtggacatccatgatttttcactggggagcagtccgcacgtgcgaaagcacttccccgagacctggatatggctcgacaccaatatgggatataggatttaccaggagtttgaggtgacggtccccgactctatcaccagctgggtggccaccgggttcgtgatttccgaggaccttggtcttggacttaccaccacgccggtcgagttgcaggcctttcagcctttcttcattttcctcaacctgccttatagcgtgattagaggggaagaattcgcactagagattacaatcttcaattatctcaaagatgctacggaggtgaaagtcattattgaaaagtctgacaagttcgatattctcatgacaagcaacgagatcaatgcaaccggccatcagcaaacgctgctcgtcccatctgaagacggcgcgaccgtactgttccctattcgacctactcatctgggggaaattcctatcactgtcaccgcactgtcacccaccgcctctgacgccgtgactcaaatgatcttagtgaaggccgagggcattgagaagtcctactcccaaagcatcctcctagacttgaccgacaatcgattgcagagcaccctgaaaacactaagtttttccttcccacctaacaccgtgaccgggtctgagcgtgtccagattactgctatcggagacgtgctggggcccagtatcaatgggctggcatccctgatacggatgccttacggatgtggcgaacagaatatgattaattttgctccaaacatttatatccttgattatcttacaaagaagaagcagctgacggataacttgaaggagaaagcactgtctttcatgcggcaagggtatcagcgggaacttctctaccagcgggaagatggaagtttctccgcatttggaaattatgacccctctggatcgacctggctttccgccttcgtcctaagatgctttcttgaggcggacccgtacatagacatcgaccagaacgtgctgcacaggacatacacatggctgaaggggcaccagaagtccaatggggagttctgggatccaggcagggtgatccacagtgaactgcagggaggcaacaaatcacctgtcacgctgaccgcctatatcgtcacaagtctactaggctatcggaaatatcagcctaacatcgatgtgcaggagtccattcacttcctggagagcgagttcagtcgggggattagcgacaattatactctagctctgataacttacgcgctatcatcggtgggtagcccaaaagctaaagaagccctgaacatgttgacctggagagctgaacaggaagggggcatgcaattttgggtgagctccgagtcaaagctaagcgactcctggcagcctcggtcgttggacatcgaagtggccgcgtatgccctgctgagccattttctgcagtttcagaccagtgaaggcatcccaatcatgcgatggttatcacgacagagaaacagtttgggaggcttcgcatcaactcaagataccactgttgctctaaaagcactgtctgagtttgctgctctgatgaataccgagaggacaaatatccaggttactgtgaccggacccagctcaccatcacctcttgccgtggttcagcccaccgccgtcaacattagcgcaaatggctttggctttgccatatgccagctaaacgttgtttacaacgtgaaggcttctggttcaagcagacgcaggaggtcaattcaaaaccaggaggcctttgaccttgatgtagcagtcaaggagaacaaagatgatttgaatcacgtcgacttaaacgtgtgtacaagctttagtggtcctgggagaagcggaatggccctgatggaggttaatttactgtcggggttcatggtgccttcagaggctattagtctgtccgagacagtcaaaaaggtggaatacgatcacggtaaacttaatctgtatttggactccgtaaacgaaacacagttttgtgttaacatccccgctgttcgaaatttcaaggtttccaacacccaagacgcttctgtctccatcgtagactattacgagccgagacggcaggccgtgcggtcttacaacagcgaggttaaattgagtagctgtgacctctgcagtgacgtgcagggttgtcggccgtgtgaggatggcgcgtctgggtcccatcaccattcgtccgttatcttcattttttgcttcaagctgctgtatttcatggagttgtggctctag

SEQ ID NO: 182029 - DNA, 762 bp, Artificial Sequence
  Description of Artificial Sequence: Synthetic coding sequence
atgggcgagttcaacgagaagaagaccacctgcggcaccgtgtgcctcaagtatttactcttcacctacaactgttgcttctggctcgcaggtctagctgttatggctgtgggaatctggacacttgctctcaaatcagattacatctccctactcgcctccgggacttaccttgcgactgcttatatcctggttgtggcagggacggtggttatggtcactggcgtgttgggatgttgcgcaacattcaaagaaagacgcaatttgctgagactttatttcatcttattgctcatcattttcctgcttgagattatcgcaggtattttggcctatgcctactatcagcagttaaacacagaactgaaggagaacctcaaagatactatgactaagagatatcatcagccagggcacgaggctgtcacttccgccgtggatcaactgcagcaggaattccactgctgcggctctaacaacagtcaggattggcgcgacagtgaatggatccggtcacaggaggccggtgggcgtgtcgtcccagatagctgttgtaaaacggttgtcgccctgtgtggtcagcgagaccatgcatctaatatttacaaagtggaaggtggctgcatcacgaagcttgaaacctttatccaggagcatctgagggttataggcgccgtcggaattggaatagcttgtgtgcaggtgttcgggatgatctttacttgttgtctgtacagatcgctaaagcttgagcattactag

SEQ ID NO: 182030 - DNA, 762 bp, Artificial Sequence
  Description of Artificial Sequence: Synthetic coding sequence
atgggcgagttcaacgagaagaagaccacctgcggcaccgtgtgcctaaagtatctactattcacttacaattgctgcttttggctggctgggctggctgttatggccgtggggatttggacattagcacttaaatctgactacatcagtctgctagcatccggcacctatttggcgaccgcctacattcttgtggtcgccggtactgtcgtgatggtcacaggggtgcttggctgttgcgctaccttcaaggaacgccgcaatctattgaggctgtactttattctgctcctcatcatctttttgttagagattattgccgggatccttgcttacgcctattaccaacagctgaacaccgaacttaaagaaaatcttaaagacactatgactaagcgctatcaccaacctggccacgaggcagtcaccagtgctgtcgaccagctgcagcaagaatttcattgctgtggaagtaataacagccaggactggagagacagcgagtggatacgctcccaggaggcagggggtagggttgtcccagatagctgctgtaaaaccgttgtggcgctgtgcggtcagagagaccatgcttccaatatatataaggtcgaaggcggctgtataacaaaacttgagacttttatccaagagcatctgcgcgtaattggcgccgtgggaattggtatcgcttgcgtgcaggtttttggcatgatttttacttgctgcctttataggagcctgaaactggagcactactag

SEQ ID NO: 182031 - DNA, 762 bp, Artificial Sequence
  Description of Artificial Sequence: Synthetic coding sequence
atgggcgagttcaacgagaagaagaccacctgcggcaccgtgtgcctgaaataccttcttttcacatacaactgctgtttttggctggccggcctggccgtgatggctgtcggcatctggacactcgcgcttaaatcggattatatttccctattggcctccgggacttacctggctacggcatacatcctggtagtagccggaacggtggtaatggtgacaggagtcctcggttgctgcgccactttcaaggagcggcgtaacctgctgaggttatacttcattctgcttctcatcatcttcctgttggaaatcatagcaggtatccttgcgtacgcttattaccaacaactgaataccgagctaaaagagaatcttaaggataccatgaccaaaaggtatcatcagcccggccatgaagcagttacaagtgccgtggaccaattgcagcaggaatttcattgctgtgggtctaacaactcacaggactggcgcgatagcgagtggatccggagccaggaggctgggggcagggtagtcccagatagctgctgcaaaactgtggtcgctctgtgtggtcaaagagaccacgcctccaatatctataaagtagaggggggatgcatcacaaagctggagacctttattcaagaacatctgagggtgattggcgccgtgggaatcggaattgcttgtgttcaggtctttggaatgatatttacgtgctgcctgtacaggagccttaagctcgaacattactag

SEQ ID NO: 182032 - DNA, 543 bp, Artificial Sequence
  Description of Artificial Sequence: Synthetic coding sequence
atgggcgagttcaacgagaagaagaccacctgcggcaccgtgtgccttaagtacctgctcttcacatacaactgctgcttctggcttgcgggacttgctgtgatggccgtcgggatctggacattggcactgaagagtgattacatatccctcctcgcctcagggacatatctggctaccgcgtatattctggtcgtggcggggaccgtggtcatggtaactggtgttctaggatgctgcgcgacattcaaggagcgtcgcaacttgctcagactgtattttatactcttgctgatcatcttcttgcttgagatcatcgccggcatcctagcatacgcctactaccagcagctcaacactgaactcaaagagaacctgaaggacaccatgaccaaacggtatcaccagcctgggcacgaagccgtgaccagcgccgtcgaccagcttcaacaagagttccactgttgcgggtccaacaactcgcaggactggagagattcggagtggatccgatcacaggaggccgggggcagagtcgtgtag

SEQ ID NO: 182033 - DNA, 240 bp, Artificial Sequence
  Description of Artificial Sequence: Synthetic coding sequence
atgggcgagttcaacgagaagaagaccacctgcggcaccgtgtgcctgaagtacctgctttttacatacaattgttgtttctggctggcaggactcgcggtgatggcagtgggcatatggacccttgccttaaaaagtgattatatctcccttttggctagcggcacatatctggctaccgcctatattctggtggttgctggcactgtggttatggtaactggtgtgctgggctgttag

SEQ ID NO: 182034 - DNA, 279 bp, Artificial Sequence
  Description of Artificial Sequence: Synthetic coding sequence
atgggcgagttcaacgagaagaagaccacctgcggcaccgtgtgcctcaaatacctcttgttcacatataactgttgcttttggctggccggactagctgtgatggccgttgggatctggaccctggcactgaagtctgattatatcagcctactcgcctccggaacatatcttgccactgcatacatcctggtagtagccggaacggtggtcatggttactggagtcctgggatgttgcgcaacctttaaagagcgaaggaaccttctcaggctgtag

SEQ ID NO: 182035 - DNA, 198 bp, Artificial Sequence
  Description of Artificial Sequence: Synthetic coding sequence
atgggcgagttcaacgagaagaagaccacctgcggcaccgtgtgcctcaagtatcttctgtttacctataattgctgcttctggctagcaggactggccgtgatggctgtggggatatggacgctggccctgaagagtgactacatcagcctcttggctagcggaacatatctggctacggcctatatcctggtttag

SEQ ID NO: 182036 - DNA, 531 bp, Artificial Sequence
  Description of Artificial Sequence: Synthetic coding sequence
atgggcgagttcaacgagaagaagaccacctgcggcaccgtgtgcttgaagtacctgttgttcacatacaattgctgcttttggctggccggcctggcagtcatggccgtgggtatctggacactcgcactcaagtcggactacatctcgctgctggcgtctggtacttacctggccaccgcctatatcctagtggtggctggtaccgtggttatggtcactggcgtactcggctgttgtgccactttcaaggaacggagaaaccttcttcgattgtactttatcctgctactaatcatattcctgctagagattattgccggaatcctggcttacgcgtattaccaacagttaaacaccgagcttaaggagaacctgaaggacaccatgactaaacgttaccaccaacccggtcatgaagccgtgaccagtgctgtggaccaactgcagcaggagttccattgctgcggttccaataacagccaggactggcgggacagcgagtggattcggtcccaagaggcagggtag

SEQ ID NO: 182037 - DNA, 543 bp, Artificial Sequence
  Description of Artificial Sequence: Synthetic coding sequence
atgggcgagttcaacgagaagaagaccacctgcggcaccgtgtgcctcaagtatctgctattcacatacaattgctgcttttggctggctggtctggctgtgatggcagtagggatttggacccttgcccttaaaagcgactacatttctctgctagcgtctggcacttatcttgccacagcatacatcctggtcgtagcaggcacagtggttatggttacgggagtgcttgggtgctgcgcaaccttcaaggagagaagaaatctgctgagactgtacttcatcctgctgctcataatcttccttctggaaattatcgctggcattcttgcctatgcatactaccagcagctcaataccgaactgaaggagaacctgaaagatacaatgaccaaaaggtatcaccagcccggccacgaggcagtgacctctgccgttgatcagctgcaacaagaattccactgctgtggatccaacaattctcaggactggcgggactccgaatggatcaggtcacaggaagccggggggcgagtggtgtag

SEQ ID NO: 182038 - DNA, 273 bp, Artificial Sequence
  Description of Artificial Sequence: Synthetic coding sequence
atgggcgagttcaacgagaagaagaccacctgcggcaccgtgtgcctcaagtacctgttgttcacgtacaattgctgcttttggttggcaggcttagctgtgatggccgtgggtatttggaccctggcgttgaaaagcgactacatcagtttgctcgcttcgggtacctacctcgccacagcctatatcttagttgttgccggcacagtggtgatggtgaccggggtactcggttgctgtgcaacattcaaggagcgaagaaatttgctttag

SEQ ID NO: 182039 - DNA, 513 bp, Artificial Sequence
  Description of Artificial Sequence: Synthetic coding sequence
atgggcgagttcaacgagaagaagaccacctgcggcaccgtgtgcttgaagtatctgttatttacctacaattgctgcttttggctggccggtcttgctgtcatggccgtgggcatttggactctggccctcaaaagtgattatatttctctcttggccagcgggacatatctcgccacagcctacatccttgttgtcgcggggaccgtggtgatggtgaccggtgtattgggctgctgtgctaccttcaaggaaagaagaaacctcttacgcctatattttattttactgttgattatcttcctgttagagatcattgccgggatcttggcctatgcctattaccaacagctgaatacagagctgaaagagaatctcaaggacaccatgacaaaacgttatcaccagcccggccatgaggccgtgacctcagccgttgaccaactgcagcaggaattccactgctgcggtagtaacaactcacaagactggagagactctgaatggatttag

SEQ ID NO: 182040 - DNA, 762 bp, Artificial Sequence
  Description of Artificial Sequence: Synthetic coding sequence
atgggcgagttcaacgagaagaagaccacctgcggcaccgtgtgcctaaagtaccttctgtttacttacaattgctgcttctggttggccgggctggcagtaatggcggtggggatctggacactcgcacttaaatccgactacattagccttcttgcctccggaacatacctggccaccgcgtacattctcgtcgtagctggtacagttgttatggtaactggtgtgctgggttgctgcgcgaccttcaaggagcgtaggaacctcctacggctgtacttcattttgctactcatcatttttctcctcgagatcattgcaggaatcctggcatatgcttactaccaacaactgaacactgaactaaaagagaatctgaaggatacgatgacgaagcggtatcaccagccagggcatgaagctgtcaccagtgctgttgaccaactgcaacaggagttccactgttgcggcagtaacaattcacaggattggcgggatagcgagtggatccggtcccaagaagccggtgggcgggtcgtgccagactcttgttgcaagaccgtagtagcactgtgtgggcagagagaccatgcaagcaatatttataaggtagaggggggatgtatcacaaaactggagactttcatacaagaacacctgcgggttataggcgccgtgggtatcgggatcgcctgtgtgcaggtgttcggtatgatcttcacatgttgtctgtacagaagtcttaaactcgagcattattag

SEQ ID NO: 182041 - DNA, 3471 bp, Artificial Sequence
  Description of Artificial Sequence: Synthetic coding sequence
atgagcaagctgcggatggtgctgctggaggacagcggcagcgccgacttccgccgtcattttgtgaacctttccccatttaccattacggtcgtgcttctcttgtctgcttgcttcgtgacatcgagtctgggaggcacggataaagaactccgattggtggatggggagaataagtgtagtggtcgagtggaggtcaaggtgcaagaagaatgggggacggtgtgtaataatggctggtccatggaagcggtttccgtaatttgcaatcagctcggatgtccaacagccattaaagccccaggatgggcgaattccagcgctgggagcgggaggatctggatggatcatgtgtcttgtaggggtaacgagtcggctctgtgggactgtaaacatgacggatggggtaaacatagcaactgcacacatcaacaggatgcaggagttacttgctcggacgggtcaaacttggagatgaggctgacccgcggcggaaacatgtgctccggcagaatcgagattaaatttcagggcaggtggggtacagtatgtgacgacaacttcaatattgaccacgcttctgtcatctgtcggcagctcgaatgcgggtcagctgtgtctttctctggcagcagcaactttggcgagggttcagggcccatctggttcgacgatctaatctgtaatggcaatgaaagcgccttgtggaattgcaaacaccagggatggggtaaacataattgtgaccacgctgaggatgcgggtgttatctgttctaagggtgctgacctgtcattacggttggttgatggcgtaactgaatgttcagggagactcgaggtgcgcttccagggcgagtgggggaccatctgtgacgatggatgggactcttacgatgctgccgtggcctgtaagcagctgggttgcccgactgctgtgacagctataggtagagttaatgcaagcaaaggattcgggcatatctggctggattcggtgtcatgtcaagggcatgagccggcaatttggcagtgcaagcaccatgagtggggaaagcattactgcaaccacaacgaggacgctggcgtgacctgctctgacggctcagacctcgagctgcgtttgcgtggaggtggcagcaggtgtgcaggcacagtggaggtggaaattcaacgccttttgggaaaggtttgtgatagaggatggggcctgaaggaggctgatgtagtgtgtcgtcagctcggatgcggatccgccctgaaaacctcctaccaggtgtactctaagatccaggcaaccaacacatggctgttccttagttcttgtaatggtaacgagacaagcttgtgggattgtaaaaactggcagtggggcggcctcacttgcgatcattatgaggaagcgaaaatcacttgttccgcgcatcgcgagcctaggctggtgggcggcgacatcccttgttcaggcagggtcgaggtaaagcatggagacacctggggcagtatatgtgatagcgactttagcctggaagctgccagcgtcctgtgccgggaactccaatgcggcactgtagttagcatccttggaggcgcacatttcggcgagggtaatgggcaaatatgggccgaggaatttcagtgcgaaggccacgaatcgcatttgtctctctgccctgtggctcctcgaccagagggaacgtgcagtcattcgcgtgatgtgggcgtcgtttgctctagatacaccgagattcggcttgtgaatggaaagacgccctgcgaggggcgcgtcgaactcaaaaccttgggagcctggggaagtctgtgcaattcccactgggatatcgaagatgctcatgtcttgtgtcagcaactgaaatgcggcgtcgcactttcgacccctggaggcgcccgttttgggaagggtaatgggcaaatatggaggcacatgttccattgtacaggaactgagcaacacatgggcgattgtcctgttaccgctctcggggcgagcctgtgcccaagtgagcaggtggcatcagtgatatgctctggaaaccagtctcagactctctcttcatgcaattcgagcagcctgggtcctactcgcccaaccatccctgaggagtctgccgtggcctgtatagagagtggacaactgagactcgtcaatggcgggggcagatgtgccggacgagtggaaatctaccacgaaggttcctggggaaccatctgtgatgactcctgggatcttagcgacgcccatgtggtgtgcaggcaactcggatgtggggaggctatcaacgcaactgggtcagcccatttcggcgagggcaccggaccaatttggttggacgaaatgaagtgtaacgggaaggagagtaggatctggcagtgtcacagtcacggatgggggcaacaaaactgtcgtcacaaggaggatgcaggtgtgatttgttccgagttcatgtcactaaggctgacgtcggaggcctccagagaagcctgtgctggacggctggaggtgttttacaacggcgcttgggggaccgtgggaaagtcgtctatgtcggagacaactgtgggagtggtgtgcagacagcttggctgtgctgataaaggcaaaattaatcctgcctcactagacaaggccatgagcatccctatgtgggttgacaatgtacagtgccctaagggaccagataccctctggcaatgtccatccagcccctgggaaaagcgcctggccagcccatcagaggagacatggatcacttgtgacaacaagatccgtctgcaggagggacctacaagctgctctggccgggtggaaatctggcatggtggctcttgggggacagtgtgtgacgatagttgggatctggacgatgcccaggtggtttgccagcaactgggctgtggacccgccctgaaggcctttaaagaggccgaattcggacaaggcaccggaccaatctggctgaatgaggtgaaatgcaaaggaaacgagtccagtctgtgggattgccccgcccgtcggtggggacactccgagtgtggccataaggaggacgccgccgttaattgcactgatatcagcgtccaaaagacaccacagaaagctacaactggtaggtcaagccgccagtcctcttttattgctgttggcatcctgggcgttgtcctattggccatctttgttgctcttttctttctgaccaagaaaagacgtcaacgccagcgtttggccgtcagtagccgtggggagaacttggttcaccagatccagtaccgggagatgaattcatgcctgaatgcggacgatctcgatctgatgaactcaagtgagaatagtcatgagtccgctgatttcagcgcagctgagcttatttccgtctccaagttcttgcctatctccgggatggagaaagaagcaatcttatcacataccgagaaggagaacgggaacctctag

SEQ ID NO: 182042 - DNA, 3465 bp, Artificial Sequence
  Description of Artificial Sequence: Synthetic coding sequence
atgagcaagctgcggatggtgctgctggaggacagcggcagcgccgatttcaggagacacttcgtgaatcttagccccttcacgattacagtggttctattgctatctgcctgtttcgtcacatcatctctgggtggcacagacaaagaattacgtctcgtcgacggcgaaaacaagtgcagcgggagggtggaagttaaggtgcaggaagaatggggcaccgtttgtaataatggatggtcaatggaagcagtgagtgttatatgtaaccagctgggatgccccaccgcaataaaagcaccaggatgggcgaactcctcagcagggagcgggagaatctggatggaccacgtgagctgtcgtggaaacgagtccgcactatgggactgcaagcacgatggctggggaaagcactcaaactgtacccatcagcaggacgccggcgtgacctgtagcgacgggtctaatttggagatgcgcctgacccgaggggggaatatgtgcagcggcagaattgaaattaagttccagggcaggtggggaactgtgtgcgacgataacttcaatatcgatcatgccagcgtaatatgtcgccagttggagtgtggctccgcggtttctttctccggctcctctaacttcggggaggggtctggcccaatttggttcgatgatttaatctgtaacggcaatgaatctgccttatggaactgcaagcaccagggctgggggaagcacaactgtgaccatgccgaagatgccggggtgatctgcagcaagggtgccgatctgtcactgcggttggtggatggtgtgacggaatgttccgggcggctcgaggtccgatttcagggggagtggggcaccatctgcgacgatggatgggactcatatgatgcagcggtggcctgcaagcagctgggttgcccaactgccgttactgcaattgggagagtgaatgccagtaagggctttgggcatatctggttggacagcgtgagctgccaaggccatgagcctgccatttggcagtgtaaacaccatgagtggggaaagcattactgtaaccataacgaggatgccggggtgacttgctccgatggaagtgatctcgaactcagactgaggggcggcgggagccgctgcgccgggacggtagaggtggaaatccaaagactgcttggaaaagtgtgtgatcgggggtggggactgaaggaggctgatgtggtttgccgtcaattaggctgtggctccgccctgaagacttcctaccaggtgtactcaaagatccaggctactaacacttggctcttcctgagcagctgcaatggcaatgagacctcgctttgggattgcaaaaactggcagtggggcggcctaacttgcgatcattatgaagaggcaaagattacatgttcggctcacagggaaccacgcctggtcggaggtgacattccctgtagcgggcgagtcgaggtgaaacacggggacacatggggatcaatttgtgacagcgacttctccctggaggcagctagcgtgctctgtcgagagctgcagtgtggaaccgtggtgagtatcctggggggcgcgcattttggagaggggaatggacagatatgggctgaggaattccagtgtgagggtcatgaatcccacctctccttgtgccctgtggccccaaggcccgaaggtacatgctcccactcgagagatgtgggagtggtttgctcgagcaagacgcagaagacctctctcattggctcacatacagttaagggaaccgggctgggtagccatagctgcctgttcctgaagccatgtctgctgcctggctacacagagattaggctggtgaacggtaagacaccctgcgaaggccgggttgagttgaaaactctgggcgcatggggaagtttatgcaactcccactgggatatcgaggacgcccatgttctgtgtcaacagctgaagtgcggcgttgctttgagcaccccgggcggagctaggttcggcaaggggaatggtcagatatggcgacacatgtttcattgtacaggaacagagcagcacatgggcgattgccctgtgactgcccttggagccagtctatgccctagcgaacaagtggctagcgtgatctgtagcgggaatcaatcacagacactgagctcttgcaattcatcctcactcggaccgacgagacctactatccccgaagaatctgccgttgcctgtatcgagagcggccagctgcggcttgtcaatggaggtggtcggtgcgcgggccgggtggagatctatcacgagggtagttggggaactatttgcgacgacagctgggatctgtctgacgcgcacgtagtctgtagacagttaggctgcggtgaggccatcaatgccaccggtagtgcccacttcggtgagggaaccgggcctatctggttggatgagatgaaatgtaatggcaaagaatcccgcatatggcagtgtcattcccatggttggggccaacaaaattgcaggcacaaggaggacgctggtgtgatctgttcggaattcatgagcctaaggttgacatcggaagccagccgagaggcatgcgctggacggctggaagtattttataacggcgcctggggaaccgtggggaaaagttctatgagcgagaccacagtgggggtagtttgcaggcagctcggatgcgccgacaagggaaagattaacccagccagcttggacaaggccatgagtattcctatgtgggtagataacgtacagtgtccaaagggaccggataccctatggcaatgcccgagctctccatgggagaagaggcttgcctcccccagcgaggagacgtggataacctgtgacaataagattcgcctgcaggaaggaccaacttcgtgtagcggtcgggtggaaatctggcatggaggttcatgggggaccgtgtgcgacgacagctgggacttagatgacgcgcaggtcgtctgtcagcaattgggttgcggcccagcactgaaagcttttaaggaggccgagttcggtcagggcaccgggcccatctggctgaacgaggtgaaatgcaaaggcaacgagtcttccctgtgggattgccccgcccgtcgctggggacactctgagtgcggtcacaaagaagacgcggccgtgaactgtaccgatatcagcgtccagaagacaccccagaaagctacaacaggacggtcatcgcgccagtcgagcttcatcgccgtggggattttgggagtcgttcttttagctatcttcgtcgccctcttctttctaaccaaaaaacggagacagcgccagcggctggccgtgtcctcacgcggcgaaaatctggtgcaccagatccagtacagggaaatgaattcatgcctaaacgctgatgaccttgaccttatgaacagctccggtggacactctgagcctcattag

SEQ ID NO: 182043 - DNA, 3366 bp, Artificial Sequence
  Description of Artificial Sequence: Synthetic coding sequence
atgagcaagctgcggatggtgctgctggaggacagcggcagcgccgatttccggaggcattttgtaaatcttagtcccttcacaataacggtggttctgctacttagtgcctgtttcgtcacatcttcactgggaggaactgataaggagttacgtttggtggatggagaaaataagtgctccggacgggtggaggtgaaggtgcaggaggagtggggaaccgtgtgcaacaatggttggagtatggaagccgtgtcagtgatctgcaatcagctgggctgcccaaccgctatcaaagctccaggctgggccaattcatctgctggtagtggccgcatttggatggaccacgtctcatgtagaggcaacgagtcagccctttgggactgcaaacacgatggttggggaaagcattctaattgcactcaccagcaagacgctggggtgacatgtagtgatggttccaatttggagatgaggctcacccgaggcggcaatatgtgtagcggtcgaattgaaattaagtttcaagggcgctggggaacagtttgcgatgacaattttaacatcgatcatgcaagtgtgatctgtcgccagctcgagtgtggcagtgctgtttccttttcgggatccagcaactttggagaaggaagtggaccgatttggttcgatgaccttatctgcaacggaaacgagagtgctctatggaactgtaagcaccagggttggggaaagcataattgtgaccacgcggaggatgctggcgttatctgctcaaaaggcgccgacttgtccttgcggctggtggacggcgttaccgagtgctccggccgactcgaagtgcggttccagggtgagtgggggacaatctgcgacgatggttgggattcctacgatgcagcagtggcctgtaaacagttgggatgccccaccgcggtgacagccatcgggagagtgaatgctagcaaaggcttcgggcacatctggttagactccgtgtcttgccagggacacgagcccgccatctggcagtgtaagcaccacgagtgggggaaacactactgcaatcacaacgaagacgccggggtgacttgttcagatggttccgatctcgaactccggctcagaggcggcgggagccggtgtgccgggactgtggaagttgaaattcaaaggctgctgggcaaagtttgcgaccggggttggggtctgaaagaggccgatgtagtttgtagacagttaggatgcggaagcgccctgaagacatcctatcaggtgtactctaaaatccaagcgactaatacgtggctcttcctgagttcttgtaacggcaacgaaactagtttatgggactgcaaaaactggcaatggggaggtctgacttgtgaccactacgaggaggccaagattacttgcagtgcccatcgtgagcctcgactggtgggaggtgatataccctgttccggtcgggtggaagtcaagcacggcgatacctggggctccatctgcgatagcgatttctcattagaggcagcctccgtcttgtgtagggaacttcagtgtgggaccgtggtgagcattctgggcggggctcacttcggcgaaggtaatggccaaatctgggccgaggagttccaatgcgagggacatgaatcgcatctgtctttatgtcctgtggctccaaggccagaagggacctgctcacactccagagacgtcggcgttgtgtgttcacggtacacggaaattagactggtcaacggcaagactccatgcgagggccgcgtggaattgaaaactcttggtgcatggggcagtctgtgtaatagtcattgggatattgaggatgctcatgtgctttgccagcagttaaaatgtggggtcgcgctttcaactccaggaggcgcccggtttggcaaaggcaacggccagatttggagacacatgttccactgcactggcactgagcagcatatgggcgattgtcccgttactgcccttggggctagtttgtgtccttccgagcaggttgctagtgtgatctgtagcggcaaccagagtcagacgctcagctcgtgtaacagctcatcactcgggccgacgagaccaacaatcccagaggaatccgccgttgcctgtatagagtctgggcagctccggcttgtgaacgggggcggcaggtgtgccgggagggtggaaatttatcacgagggttcttggggaacaatctgtgatgacagctgggatttatcagacgctcacgtcgtctgtagacagcttggatgcggcgaagccataaacgccaccggatctgctcacttcggagaggggactggcccaatttggctggacgaaatgaagtgtaatggcaaggaaagtcgaatttggcagtgccattctcacggttgggggcagcagaactgccgccacaaggaagacgctggtgtgatatgttccgaatttatgtcactccgtctgactagcgaggcatcaagagaggcctgtgctgggaggctggaggtgttctacaatggcgcctgggggaccgtgggtaagtcatctatgagtgaaacaacagtgggagttgtttgccggcaactgggatgtgctgataaaggtaagatcaacccagcatccttggataaagccatgagcatccccatgtgggtcgataatgtccagtgtccgaaaggccccgacacactttggcagtgtcccagctccccctgggagaagcggctggcttctccgagtgaagaaacttggattacttgtgacaacaaaattcgcctccaggaaggaccaacaagttgtagcggacgagtggagatctggcacggcggaagctggggcacagtgtgcgacgactcttgggatctggacgatgcccaggttgtctgccagcaattgggttgcgggcctgctttgaaagcattcaaagaagccgaatttggccaagggactggccctatttggctgaacgaggtgaagtgcaaaggcaacgaatccagcctctgggactgcccagctcgtcgctgggggcatagcgagtgtggtcacaaagaagacgccgcagtgaattgcactgacattagcgttcagaagacaccccaaaaagcgaccacggggcgctcttcccgccagtcctcattcatcgctgtcgggatattaggtgtcgttttactggctattttcgtggctctcttctttctgacgaaaaagcgtaggcagcgccagaggctcgcagtgagcagccggggcgagaacctcgtccaccaaatccagtaccgggagatgaattcctgccttaacgcagatgatctagacctcatgaacagctccggaggacattccgaacctcactag

SEQ ID NO: 182044 - DNA, 555 bp, Artificial Sequence
  Description of Artificial Sequence: Synthetic coding sequence
atgagccggctgagccggagcctgctgtgggccgccacctgcctgggcgttctgtgtgtgctcagtgcagataagaacaccacccagcaccccaacgtcactacattggcccccatctcaaacgttacatcggcccccgttacctcactacctctggtaaccacacccgctcctgagacgtgcgaggggcggaactcttgcgtgagctgcttcaatgtcagtgtggtgaacaccacgtgcttttggattgaatgtaaggatgaaagctactgtagccataactccactgtaagtgattgccaggtgggcaatacaaccgatttttgcagtgccaaaccaaccgtgcagcccagcccaagtaccacaagcaaaaccgtcaccacgtccggcacaaccaacaatacggttacccctactagccagccagtcagaaagtccacattcgacgcggcctccttcatcggtggaattgtccttgtcctcggtgtgcaggctgtgatattcttcctgtacaaattttgtaaatcaaaggaacgcaactaccatacactgtag

SEQ ID NO: 182045 - DNA, 594 bp, Artificial Sequence
  Description of Artificial Sequence: Synthetic coding sequence
atgagccggctgagccggagcctgctgtgggccgccacctgcctgggcgtcctttgtgtgctcagtgcagacaagaacacaacccaacatcctaacgtgaccaccctggcccccatctctaatgtcacgtcggcccctgtcactagtttgccgctggtcacaacacccgctcccgagacttgcgagggcagaaactcctgcgtctcctgcttcaacgtcagcgtagtcaacaccacctgcttctggatcgaatgcaaggacgaatcctattgctcacataactccactgtgtccgattgccaggtcggtaacacgactgacttctgctcagtgagcactgcaaccccagtccctacagccaattccacagctaagcctaccgttcagccatccccaagcaccacaagcaagaccgtgaccacatccggtaccactaataacacggtgacacccacctcacagcctgtgcgaaaatccacattcgacgcagcttcattcataggcggaattgtactcgttctcggcgtgcaagcagtgattttctttctgtataagttttgcaagtccaaagagcggaactatcacactctgtag

SEQ ID NO: 182046 - DNA, 537 bp, Artificial Sequence
  Description of Artificial Sequence: Synthetic coding sequence
atgagccggctgagccggagcctgctgtgggccgccacctgcctgggagtcctgtgcgtgctatcggcggataagaacacgacccagcacccaaacgttactaccctggctcccatctctaatgtgaccagcgcccctgtgacttcattacccttagttaccacacccgcccccgagacctgtgaaggcagaaattcctgtgtgtcttgtttcaacgtgtcggtggtcaacactacgtgtttctggattgaatgcaaggatgaatcttattgttcccataatagtacagtttccgattgccaagttgggaacacaacggacttctgctcggtgagcacggccaccccagtgccaacagctaattcaacagggacaactaacaacaccgtgacaccaacttcccagcccgtgagaaaatctacgtttgacgcagcctcttttataggcggcatcgtcctagtgctaggtgtacaggccgtgatctttttcctctacaagttctgcaagtccaaggagcgtaactaccatacactctag

SEQ ID NO: 182047 - DNA, 498 bp, Artificial Sequence
  Description of Artificial Sequence: Synthetic coding sequence
atgagccggctgagccggagcctgctgtgggccgccacctgcctgggcgttctctgtgtgctcagcgccgacaaaaacacaacacaacatcctaacgtaacaacactggcccccatctcgaacgttacatccgcccccgttacctccctgcctctagtgaccaccccagcccctgaaacatgtgaaggcaggaactcttgtgtttcttgcttcaacgtgtccgtcgtgaacaccacctgtttctggatcgaatgcaaggacgaaagctactgttcacacaactccaccgtgtcagactgccaggtcggcaacaccactgatttttgctccggcacaacaaataatacagtaacacctacaagccagcccgtgaggaagagcacctttgatgcggcatcattcattggcgggattgttctggtgctcggcgtgcaggctgtgatatttttcctgtacaagttctgcaagtccaaggaacggaactaccacacactgtag

SEQ ID NO: 182048 - DNA, 570 bp, Artificial Sequence
  Description of Artificial Sequence: Synthetic coding sequence
atgagccggctgagccggagcctgctgtgggccgccacctgcctgggcgtgctctgtgtgttatccgctgacaaaaatactacacagcaccccaatgttaccacattagctcccatctccaatgtgactagcgctcccgtgacttccttgcccctagtgaccacgccagctccagagacgtgtgaaggacgcaattcatgtgtcagctgcttcaatgtctccgtggtgaacaccacctgcttctggatcgagtgtaaggatgaatcgtactgttcccacaacagcaccgtctccgactgccaggtgggaaacaccacggatttttgcagcgtcagtactgccacacctgtccctacagccaatagtaccgcgaagccaactgttcagcccagcccttccaccacctctaagaccgtgaccacttccgggaccacaaacaataccgtcacccccacgtcccagcctgtgcgcaagtctactttcgacgcagcaagcttcattggcggcatcgtactcgtcctggagatcagatgtcacacacggaactatataccggatctgaaaaagtag

SEQ ID NO: 182049 - DNA, 474 bp, Artificial Sequence
  Description of Artificial Sequence: Synthetic coding sequence
atgagccggctgagccggagcctgctgtgggccgccacctgcctgggggtcctgtgcgtactctctgccgacaagaatactacgcaacacccaaatgtgactactctggctcctatcagtaacgtcacttccgcccctgtcaccagtctgccattggtcaccacaccagcgccagagacttgtgagggtcggaattcttgtgtatcctgttttaacgtgtctgtcgttaacaccacatgcttctggatcgaatgcaaggacgagtcctactgttcccacaactcaactgtgagcgactgtcaggtaggaaacaccacagatttctgcagcgtgagtactgcaacccccgtgcccaccgctaatagtaccgccaaacctaccgtgcagccttctccttcaactacttctaagacagtgacgacaagcgaaattcgatgccataccaggaattacatcccagatttaaagaaatag

SEQ ID NO: 182050 - DNA, 747 bp, Artificial Sequence
  Description of Artificial Sequence: Synthetic coding sequence
atgagcgccgtgctgctgctggccctgctgggcttcatcctgcccctgccaggcgtgcaggcactgttgtgccagtttggcaccgtgcagcacgtatggaaggtgagcgatctcccacggcaatggacacctaaaaatacatcttgtgactccgggctgggatgccaggataccctgatgctgattgagtccggccctcaagtgagtctcgttctctccaaaggttgcaccgaggccaaggaccaggagccacgggttacagagcacagaatgggtcccggactcagcttgatcagctacacatttgtttgtcgtcaagaggatttctgcaacaatctggttaacagcctgccgttgtgggcaccccaaccccccgctgaccccggctccctgcggtgcccggtatgtttgtctatggaaggatgtttagagggaaccaccgaggagatctgccctaaaggaactacacactgctacgatggacttctgcgcttgcgcggtggcgggattttctcaaatttgcgtgttcagggttgtatgcctcagcccgtctgcaatctcctgaacgggactcaggagattggacctgtgggtatgaccgagaattgtgacatgaaggatttcctgcagctcaaacccgttgggctgttagaagagcacaacgtaggtgaaaaggagcgcggtcagggacagcaccaatgtgtgcaactcgactggcaaaagcgggctgcaaccggcattttctag

SEQ ID NO: 182051 - DNA, 438 bp, Artificial Sequence
  Description of Artificial Sequence: Synthetic coding sequence
atgagcgccgtgctgctgctggccctgctgggcttcatcctgcccctgcctggtgtgcaggctctcctctgtcagttcggcactgtgcagcatgtttggaaggtttcggatcttcctagacaatggacacctaagaatacaagctgtgattccggcctgggatgtcaggatacacttatgctgattgagagcggaccgcaggtgagcttggtgctttccaagggctgtactgaggccaaagatcaggagccacgtgttaccgaacatcgcatggggccaggcctctccctcatctcttacacattcgtctgtcgccaggaggacttctgtaataacctggtgaactcactcccactttgggcccctcaaccacccgctgacccaatgatgggcgctgctgaagggccattcggaaaagccgaacaggtcgactcatag

SEQ ID NO: 182052 - DNA, 438 bp, Artificial Sequence
  Description of Artificial Sequence: Synthetic coding sequence
atgagcgccgtgctgctgctggccctgctgggcttcatcctgcccctgcccggggtgcaagccctgctgtgtcagttcggaactgtgcagcacgtgtggaaagtcagcgatttgcctcggcaatggacccccaagaacacttcttgtgattctgggctcgggtgtcaagatactcttatgctgatcgagtcaggacctcaagtttcacttgtcctgtctaaagggtgtacggaggcgaaagaccaggaaccacgagttacagaacacagaatggggccagggctctctttgatttcctacacattcgtgtgcagacaggaggacttttgcaacaatctggtgaactcactgccactgtgggccccgcagccccctgctgacccgatgatgggggccgccgaaggaccctttggcaaggcagaacaggttgacagctag

SEQ ID NO: 182053 - DNA, 1671 bp, Artificial Sequence
  Description of Artificial Sequence: Synthetic coding sequence
atgccccccccccggctgctgttcttcctgctgttcctgacccccatggaggtccgcccagaggaaccgctggtggtaaaagtcgaagaaggagataacgctgtcctccagtgcctgaagggaacatctgatggacctacccagcagctgacttggagtagagagagtccgctgaagccatttttaaagttatccctcggcctgcccgggctcgggatccacatgaggccactggccatttggctgtttatcttcaacgtcagccagcagatgggcggcttttacctgtgccagccagggcccccctccgaaaaggcatggcagcccggatggacagtgaacgttgaggggagcggagagctgtttcgctggaacgtctccgatctgggcgggctcggctgcggcctcaagaatcggagtagcgaggggccctcatcaccttccggcaagctgatgagtccaaaactttacgtgtgggctaaggatcggccagagatttgggaaggagaacccccctgcctccccccacgcgacagcttaaaccaaagtctctcacaggacctaaccatggccccagggtccactctgtggctctcctgcggggtccctccagactctgtatcccgaggtcccctcagctggactcacgttcatcctaaagggccaaagagcctccttagtctagaactgaaggacgatcgacccgcgagggacatgtgggttatggagaccggcctgttgctgccccgggccacagctcaggacgctggaaagtattattgccatagggggaacctgaccatgagtttccatctggagataaccgccagaccagtcttgtggcactggctcttaaggaccggggggtggaaggtttcagctgtgacactcgcctacctcatattctgcttgtgctctttggtgggcattctccaccttcaaagggccctagtgctgaggaggaagcggaaacgcatgacagacccaacccgacggttcttcaaggtgaccccccctccaggatctggacctcagaaccagtacggcaacgtgttatcattacccacaccaactagtggactgggaagggcccagcgctgggcagcgggactgggggggactgcaccatcttacgggaacccttcttccgacgtccaggctgatggggcacttgggagtcgatctccaccaggcgtgggcccagaggaagaggagggggaaggatacgaagagcctgatagcgaggaagacagcgagttctatgaaaatgactctaatctgggtcaggatcaactctctcaggacggctccgggtacgagaatcctgaagacgaacctttaggacccgaggacgaggactccttcagcaacgcagaaagttacgagaacgaagatgaggagctgacccagccggtggcaaggaccatggactttctgtctccacacggtagtgcctgggatcctagtcgggaggctactagcctgggaagtcagtcttacgaagatatgcgagggatcttgtatgctgccccgcaactccgctctataagaggtcagcccggccccaaccacgaggaggacgcagacagttacgagaatatggataatcccgacgggccagacccggcgtggggtgggggcggaaggatggggacgtggtcaactagatag

SEQ ID NO: 182054 - DNA, 1092 bp, Artificial Sequence
  Description of Artificial Sequence: Synthetic coding sequence
atggaggtgcggcccgaggagcccctggtggtgaaggtggaggagggggacaatgccgtcctacagtgccttaagggcactagcgacgggccaacgcagcagttgacttggagccgagagagtccattgaaaccatttctgaaactcagcctcgggctcccaggattgggcatacacatgcggccgctcggcaaatattactgccacagggggaacctcaccatgtcctttcacctggagattacagccaggccagtgctctggcactggctccttcggaccggaggctggaaagtgagcgctgttactctggcttacctgattttctgcctatgctcacttgttggcattctgcatctgcagagagcgctggtccttcgacggaaaaggaagaggatgacagaccctacccgccggttttttaaggtgacaccaccaccgggttccggaccccagaaccagtacggcaatgtgctgtcgctgcctactccaacctcaggattaggccgcgcgcagcgctgggcagctggcctgggagggacagcgcccagctacggtaacccatcaagcgatgtacaggcagatggagccctgggcagccggagcccccctggtgttggacccgaagaagaagagggtgaaggctacgaagaacctgattcagaagaggactccgaattttacgaaaacgactccaatctgggccaggaccagctctcacaggatggctcaggctatgagaaccccgaggatgagccgttgggtcccgaggacgaagattcattcagtaacgccgagagctacgaaaatgaagacgaagagttgacccagcccgtggctcggactatggacttcctgtcccctcacggctctgcatgggaccccagcagggaggctaccagcctgggatcacagtcttatgaggacatgcgcgggattctttacgccgccccacagttgaggagcatccgagggcagcctggtcccaaccatgaggaggatgctgacagctacgagaatatggacaaccccgatgggcctgatcccgcatggggaggggggggaaggatgggcacctggtcaacaaggtag

SEQ ID NO: 182055 - DNA, 1218 bp, Artificial Sequence
  Description of Artificial Sequence: Synthetic coding sequence
atgagccccaagctgtacgtgtgggccaaggaccggcccgagatctgggagggggaaccaccatgtcttccccctagagatagtctgaatcaatcattaagccaggatctgacaatggctcccggctctacactttggttatcatgtggcgtgcctcccgattctgtgtctcgtggacctctctcttggactcacgtacaccccaaaggaccaaaatctctactctctctcgagctgaaggacgatcgtccagcgagggatatgtgggttatggaaaccggactgctgctccccagggctactgcacaagacgctgggaagtattactgccatagaggaaacctcaccatgtccttccatttggaaataaccgcccgaccggtactctggcattggctgctaaggaccggtgggtggaaagtatcagctgtcacccttgcttatctgatcttttgcctctgttcgctcgtgggcatcctccatcttcagagggctctggtgctaaggcgcaaacgcaaaaggatgactgatccaaccaggaggttctttaaggtcactccaccacctgggtctggcccgcagaaccagtacgggaatgtgctcagcctccctacccccaccagtggactgggcagggcccagaggtgggctgccggattgggaggcacagctcctagctacggaaatccgtcttctgacgtgcaagctgacggtgcgctgggcagtagatccccccctggagttggacccgaagaggaggagggtgagggctatgaagagccggacagtgaagaagatagtgagttctacgaaaacgactccaacttgggccaggaccaactgagccaagacggatcagggtatgagaacccggaagatgagcctctgggacctgaggacgaggactctttctccaacgccgagtcttatgagaacgaggatgaggagttgacacagcctgtggcgcgcactatggatttcctgagccctcacggatctgcatgggacccttccagggaagccacaagcctgggcagccagtcctatgaggacatgcgcggcatcctctacgcagcaccccagctgcgcagtattcgggggcagcctggccccaatcatgaagaagacgcagactcttacgagaacatggataaccctgacggaccagacccagcttggggtggagggggaaggatgggcacgtggagtacacgctag

SEQ ID NO: 182056 - DNA, 1674 bp, Artificial Sequence
  Description of Artificial Sequence: Synthetic coding sequence
atgccccccccccggctgctgttcttcctgctgttcctgacccccatggaagtccggcctgaggagcccctggtggtgaaggtggaagagggtgacaacgcggtgctgcaatgcctgaaagggaccagcgatggacccacccagcagctgacatggagcagggagagtcctctgaaacccttccttaaactcagtctgggcttgccaggcctcggcatacatatgaggcctcttgcgatatggctattcatctttaacgtgagccagcagatggggggattctatctgtgccaaccggggccaccatcagagaaggcatggcagcctggctggaccgtcaatgttgaagggtcaggcgagctatttcgatggaacgtgtctgacctgggcgggctcggctgcggactcaagaacaggtccagcgaaggccctagcagcccatccggaaagctgatgtcccccaagctgtatgtgtgggccaaagataggccagaaatttgggagggcgagccaccatgcctcccgccacgcgactctctcaatcagtcactatcgcaggatctcaccatggcacccgggtccaccctctggctctcgtgcggagtccctcctgattctgtttctaggggtcccctctcatggacccacgtgcatccgaagggccctaagtcactgttatcccttgagttgaaggacgacaggcccgcccgcgacatgtgggtgatggaaacaggtctgctgctgccacgggcaacggcccaggatgcaggaaagtattactgtcatcggggcaacctcaccatgtccttccacttagagatcacggcacgtcctgttctgtggcactggctgctgcgcacaggcgggtggaaagtgagtgccgtgaccttagcttatctgatcttttgcctctgcagcctcgtgggaatattacatctgcagagagccctggtgttgcgaaggaaacggaagcgcatgacagatcccacgcgccgcttctttaaggttacaccaccgcccggatcaggcccgcagaatcaatatggcaacgtgctttccttgccgacacccacttctggcctgggcagagcccaacggtgggccgcagggctgggtgggactgctccgagctacggtaatccatcaagcgacgtgcaggctgatggggctcttggaagtagatcccctcctggtgtgggtcccgaagaggaagagggtgagggatatgaggagcccgacagcgaggaggactccgagttttatgagaacgatagcaacttagggcaggatcagctgtctcaggatggctcaggctatgaaaaccccgaggacgaacccctcgggcctgaagacgaggattccttctcgaatgctgagtcatacgagaatgaggacgaagaattaacccaaccagtagctcggactatggatttcttgagtccccatggctccgcatgggatccctcaagagaggccaccagtctcgccggctctcagtcttacgaggatatgagagggattctctacgctgcccctcaattgcgctccattcgtggccagcctggtccaaatcatgaggaggacgctgactcctacgaaaatatggataaccccgacggtcccgaccccgcttggggtgggggcggtaggatgggcacatggagtacgaggtag

SEQ ID NO: 182057 - DNA, 984 bp, Artificial Sequence
  Description of Artificial Sequence: Synthetic coding sequence
atgctgttcctgctgctgcccctgctggccgtgctgcccggcgacgggaacgccgacgggcttaaggaacccctgtcatttcacgttacctggattgcttctttctacaatcatagctggaagcagaacctcgtatcagggtggctgtctgacctgcagacacatacctgggactcaaattcttctacgattgtgtttttgtgtccttggagtagaggtaattttagtaacgaggagtggaaagaactcgagaccctgtttcgcattcggaccataagaagctttgaaggtatcagaagatatgcgcacgaactacagttcgagtacccattcgaaatccaggtgacaggtggctgtgagttacattccggaaaagtgtccggaagctttctgcagctggcataccagggctccgatttcgttagttttcaaaataattcttggctcccataccccgtcgccggcaacatggccaagcacttctgtaaggtgctgaaccagaatcagcatgagaatgatattacgcacaatctcctgagtgatacatgcccacggtttattctgggactcctcgacgccgggaaagcacatttgcagcgccaagtgaagccagaagcgtggttgtcgcacggtccgagcccagggcccggtcacctgcagctggtttgccacgtctcgggtttctatcccaaacccgtgtgggtcatgtggatgaggggcgaacaggaacaacagggcacccagaggggcgatatcctcccctccgcagatggcacgtggtatctgcgcgccaccctggaggtagcagcaggtgaggctgctgacctgtcatgccgagtcaaacactccagcctggaaggccaagacatcgtcctttactgggagcatcattcgagtgtgggtttcattattctcgctgtgattgtgcctctgctgttgctgatcggactggctctgtggttccgaaagaggtgtttttgctag

SEQ ID NO: 182058 - DNA, 1002 bp, Artificial Sequence
  Description of Artificial Sequence: Synthetic coding sequence
atgctgctgctgcccttccagctgctggccgtgctgttccccggcggcaacagtgagcacgcgtttcaaggacctacctcttttcatgttatccaaacctctagctttactaacagtacctgggcccagacacagggctccggctggttagatgatcttcagatccacggctgggactccgattcagggacagccatctttcttaagccttggtctaagggcaatttttcagataaagaggttgcagaactggaggaaatcttcagagtgtacattttcggcttcgcacgtgaagtgcaggacttcgctggggacttccaaatgaagtatccgtttgaaattcagggaatcgccggatgcgaattgcatagcggaggagccatcgtgtccttcctgagaggagccttaggcggactggattttttatcggtgaagaacgcatcgtgcgtcccctcaccggaaggcggtagccgggcccagaaattctgtgccctcattatacagtaccaaggaataatggagaccgtaagaatactactgtacgagacctgtccacgctacttgctcggggtgctcaacgccggaaaggccgacctgcagagacaggtgaagcccgaagcttggctgtcatccggcccatctcctgggcctggaagattacagctcgtttgtcacgtatccggattctacccaaagcccgtgtgggtgatgtggatgcgtggcgagcaggagcaacaggggacccagctcggagacattctccctaacgcgaactggacctggtatcttagagcaacccttgacgtggctgatggagaggcagccggcttatcttgtcgtgtgaaacattcttcattggagggtcaggatattatcctttactggcggaaccctacaagcattggatctatcgtgctggccattatcgtgccctctcttctcttgctgctttgtctagccctctggtatatgcgccggcggtcttaccagaacatcccttag

SEQ ID NO: 182059 - DNA, 741 bp, Artificial Sequence
  Description of Artificial Sequence: Synthetic coding sequence
tgaagcagcttcaccaacagcacctgggcccagacccagggcagcggctggctcgacgatttacagattcacggatgggattcagactctgggacggcaatcttcctcaaaccatggagtaagggcaatttctctgataaagaagtagccgaacttgaggagatctttcgggtttatatctttggttttgcacgggaagtccaggactttgccggagatttccagatgaagtatccttttgagatccagggaatcgcgggatgtgaattacactctggtggagcaattgtatctttcctacggggggctcttggcggcctggacttcttaagcgtcaagaacgcatcttgtgtcccgtctcctgagggagggtcacgcgcccagaaattctgtgctctgattatccagtaccagggtatcatggaaacagtgaggattctcctgtacgagacctgccctcgttatttattaggtgtgctgaacgctgggaaagcagaccttcagaggcaggtgaagcccgaagcatggctgtcttcaggtccctcccctggcccggggcgtctccagctggtgtgccacgtcagtggattttatcccaagcccgtgtgggtgatgtggatgcggggcaacccaaccagcattggaagcattgtgcttgcgataattgtgccatcgcttctgcttctactgtgcctggctctgtggtatatgaggcgcagatcctatcagaatatcccttag

SEQ ID NO: 182060 - DNA, 1041 bp, Artificial Sequence
  Description of Artificial Sequence: Synthetic coding sequence
atgctgttcctgcagttcctgctgctggccctgctgctgcccggcggggacaatgcagacgccagtcaggaacacgtgtccttccatgtgatacaaatcttcagcttcgtcaaccagtcttgggcacgcggccaaggttccggctggcttgacgaacttcaaacgcacggatgggatagtgagtctggcaccattatttttctgcataactggagcaaagggaatttcagcaacgaggagctgtcagatctggagttgctgttcaggttttacttattcggacttactagagaaattcaagaccacgccagtcaggactactccaaataccccttcgaagttcaagttaaagctggatgcgaactgcactcaggcaagagccctgaaggctttttccaggtggccttcaatggcctcgatctgctgtcctttcagaacactacctgggtgccttcccctggttgcggctctctggcccagtctgtgtgccacttactgaatcatcagtacgagggggtgaccgaaactgtttacaatctgattcgctcgacgtgccccagatttctcctcggtttactcgacgccgggaagatgtacgtccaccgacaggttaggcccgaggcttggctgtccagccgccccagcctgggaagtggccagctgttacttgtgtgtcacgctagtggattttatcctaagcctgtctgggtcacttggatgcgaaacgagcaggagcagttgggcacaaaacacggcgatatcctccctaatgcagacggtacctggtatctgcaggtgatacttgaggtggcatctgaggaacccgcgggactctcatgtagagtgcgccactcctctctgggagggcaggacattattctatactgggcccacatcagaacttcttgtgaaactctccctcccgatagcccaattgtccttcgcacacagcagccacgttctttggtgcagtactctgatgctattccttcaacgctgcacctgaactgttttagtttttgtattatcaacatctgctag

SEQ ID NO: 182061 - DNA, 1002 bp, Artificial Sequence
  Description of Artificial Sequence: Synthetic coding sequence
atgctgttcctgcagttcctgctgctggccctgctgctgcccggcggagacaacgcggacgcctcccaggaacatgtgagcttccacgttattcaaatattcagttttgttaaccagtcctgggctcgcggccagggaagtgggtggttggatgagctgcagactcatggctgggatagtgagtccggaacaattattttcctccataactggagcaaaggcaacttctcaaacgaggagctgtcagacctggaattgctcttcagattctacctgtttggccttacgcgggagattcaggatcacgcatcccaggattacagcaagtatcctttcgaagtccaggtgaaagccggttgtgaactgcacagcggtaagtcaccggaggggttcttccaagtggctttcaacgggttggaccttttaagcttccagaacacaacatgggtacccagccccgggtgtggtagcttggctcaatcggtttgtcaccttctcaaccatcaatatgaaggggtgaccgaaaccgtgtacaatctgatcagatcaacctgtccccgcttcctgttggggttgctggatgcagggaagatgtatgtgcacaggcaagtgcgcccagaggcatggttgtcctccaggccgagcctaggatccggacagctgctgttggtttgccacgcctccggtttttaccccaagcctgtatgggtgacctggatgaggaacgagcaagagcagctcggaaccaagcacggagatattctcccgaatgccgacggcacctggtacctgcaggttatcctcgaagttgccagcgaggagcctgcggggctcagctgcagagtacggcattcatcactgggaggacaggacattatcctatactggggtcaccatttttccatgaattggatagcactggttgtcatcgtacccttagtgattctcatcgttttagtactctggttcaagaaacattgttcctaccaggatattctttag

SEQ ID NO: 182062 - DNA, 846 bp, Artificial Sequence
  Description of Artificial Sequence: Synthetic coding sequence
tgattcctgcacaactggagcaagggcaacttcagcaacgaggagctctccgatctggagctcttgtttagattttacctgtttggtctgaccagagagatccaggaccatgcgagccaggattactccaagtaccccttcgaggttcaggtgaaggccgggtgcgaacttcactccggaaaaagcccagaggggtttttccaggttgcttttaatgggctcgacctgctgagtttccagaacacaacctgggtgcccagtccaggctgcgggtcccttgcccagtcagtctgccatctgctaaatcaccagtatgagggagtgacagaaaccgtgtacaaccttatacgctcaacttgcccccgatttttgctgggccttctcgatgcaggtaaaatgtacgtgcaccggcaagtgcgcccggaggcctggctaagttctcgaccttctctgggcagcggtcaactactgcttgtgtgtcatgcatcgggattctacccaaagcctgtgtgggtcacctggatgagaaacgagcaggaacagcttggcaccaaacacggagacatcctgcctaacgccgacggtacctggtatctacaggtgatcctggaggtcgcaagtgaagagcctgcgggcctctcctgccgcgtcaggcactccagtctgggaggacaagacatcatcctgtactgggcccacattagaacttcatgtgaaacccttcccccggatagtcccatcgtgctgcgaactcagcaaccgcgtagcttggtgcaatacagcgatgcaataccctccaccctgcatctgaattgcttttcattttgcatcataaatatctgctag

SEQ ID NO: 182063 - DNA, 411 bp, Artificial Sequence
  Description of Artificial Sequence: Synthetic coding sequence
atgtacgtgcaccggcaggtgcggcccgaggcctggctgagcagcagacctagcctggggagtggccagctcctgctggtgtgccacgcttcaggcttttaccctaagccagtctgggtgacgtggatgagaaatgagcaggaacagctaggaacgaagcacggcgacatcctgccaaacgctgacggcacatggtacttacaggtgattctggaagtggcatccgaggaaccagctggcttaagttgcagagtgagacactcctctctaggaggccaggatatcatattgtattggggccaccatttttcaatgaactggattgcccttgtggtaattgtgccattagtgattctgatcgtgctggtcctgtggtttaaaaaacattgtagctatcaggacatattgtag

SEQ ID NO: 182064 - DNA, 1008 bp, Artificial Sequence
  Description of Artificial Sequence: Synthetic coding sequence
atgggctgcctgctgttcctgctgctgtgggccctgctgcaggcctggggatcagccgaggttccgcaacgcctctttcccctgagatgtctgcagattagcagctttgctaactcatcctggactagaactgacggcctcgcatggcttggagagctccagactcacagctggagtaacgacagcgatactgttaggtccctaaaaccctggtctcagggcacattctctgatcagcagtgggagacccttcagcatattttcagagtgtacaggtcttccttcaccagagacgtaaaagagtttgctaagatgcttaggctgtcctatccactggagctgcaggtctccgcaggttgcgaggtccaccctggaaatgcaagtaataatttctttcacgttgcgtttcaggggaaggacatcctatctttccagggtacaagttgggagcctacccaagaggccccgctttgggtaaatctggccatccaggtgctcaatcaggacaaatggacaagggagaccgttcagtggctgttaaatggtacctgtccacagtttgtgagtggtctgctcgaaagtggcaaatcagaattgaaaaagcaggtgaagcccaaagcctggctaagcagaggaccaagcccgggtccagggcgcctgctactcgtgtgtcacgtttctggattctacccaaaacctgtgtgggtcaagtggatgcgcggggagcaagagcagcagggcacccagcccggcgatatcctgccaaatgccgacgaaacctggtatcttagagccaccctagacgtggtcgcaggcgaggccgctggcctgtcatgcagagtcaaacattctagtctggagggacaggatatcgtgctgtactggggcgggagctacaccagcatgggactgatcgccctcgccgtgctggcctgcctactcttcctgctcatcgtgggatttacttcacggttcaagcgccagacgtcctaccaaggagtgctgtag

SEQ ID NO: 182065 - DNA, 435 bp, Artificial Sequence
  Description of Artificial Sequence: Synthetic coding sequence
atgctgctgctgttcctgctgttcgagggcctgtgctgccccggcgagaacaccgcggtcaaaccagaggcatggctgtcctgtggcccatcaccaggtcctggcagactgcagttggtctgtcatgtgtcgggattctatccaaaacccgtttgggtcatgtggatgcggggagggtactccatcttccttattctcatctgtctgaccgttatcgtgacattagtgattttggtggttgtcgacagccgtctgaaaaagcagtcttccaataagaatatcctgagcccacatacaccaagtcctgtgttcttgatgggagcaaacacacaggacacgaagaactcccggcaccagttttgcctcgcgcaggtatcatggatcaaaaaccgggtactgaaaaagtggaagactcgcctgaatcagctgtggtag

SEQ ID NO: 182066 - DNA, 696 bp, Artificial Sequence
  Description of Artificial Sequence: Synthetic coding sequence
atgctgctgctgttcctgctgttcgagggcctgtgctgccccggcgaaaacactgctgctccccaagctctgcaatcataccatctcgctgctgaggaacagctgagttttaggatgctgcagacgagtagctttgccaatcactcatgggcccactcagaagggagtggatggcttggcgacctacaaacccacggatgggacaccgtcctcggaaccataaggttcctgaagccttggtcccacggtaacttttctaagcaggaattaaaaaatctgcagagccttttccaactttactttcattcgttcatccagattgtccaagctagcgcaggccagttccaactcgaacttaagcctgaagcctggctctcttgtggaccaagtcccggccccggcaggcttcagctggtctgccacgtgtcaggcttttaccctaagcctgtttgggtgatgtggatgcggggtggttactctatcttcctgattctaatatgcttaactgtgattgtaaccctggtgatcttggtcgtggtcgatagtagactgaaaaaacagagcccggtatttttaatgggcgctaatacgcaagacaccaaaaatagccggcaccagttttgcctggcccaggttagctggatcaaaaacagagttctaaagaaatggaaaactcgcctcaaccagctatggtag

SEQ ID NO: 182067 - DNA, 861 bp, Artificial Sequence
  Description of Artificial Sequence: Synthetic coding sequence
atgctgctgctgttcctgctgttcgagggcctgtgctgccccggcgaaaatacagcagcccctcaggccctacagtcttatcacttggctgccgaggagcagctgtcatttagaatgctgcagactagcagttttgccaatcatagttgggctcattctgaaggatcaggctggctcggagacctgcagacgcacggctgggatactgtcctcgggactattcggttcctcaagccttggtcacatggcaatttcagcaaacaggaactgaagaacctgcagagccttttccaactgtactttcatagcttcatccaaatcgtccaggcctccgctgggcagtttcaactcgagctgaaaccggaggcctggctttcatgcggaccgagccccggtcctgggcgactgcagctcgtgtgtcatgtgtctggattttaccccaagcccgtttgggtgatgtggatgagaggtgagcaggaacagagggggacccagcgtggcgacgtgctgcctaatgctgacgaaacctggtacctgagagccaccttggacgtcgccgcgggggaggccgccgggctctcatgtcgggtaaaacacagtagcctgggcggtcacgacttaattattcactggggcgggtactctatcttccttatcctaatctgtctgactgtgattgttacactcgtgatactggttgttgtggactctcggctcaaaaaacagagtcccgtgtttctcatgggtgctaatacccaggacaccaaaaatagtaggcatcagttctgccttgcgcaggtttcttggatcaaaaaccgggtcctgaagaaatggaagaccaggctgaaccaattgtggtag

SEQ ID NO: 182068 - DNA, 399 bp, Artificial Sequence
  Description of Artificial Sequence: Synthetic coding sequence
atgctgctgctgttcctgctgttcgagggcctgtgctgccccggcgagaatactgctgtcaagccagaggcatggttgtcatgtggtccatcaccagggccaggcaggctgcaactggtttgtcacgtgtccggattttatccaaaacctgtgtgggtaatgtggatgcgaggagggtatagtatttttctgatcttaatttgcttgacggtgatagtcacactggtgatcctggtagtggtcgatagccgactcaagaaacagagtccggtatttctgatgggggcgaatacgcaggacaccaaaaactctagacaccagttttgtctggcacaggtatcatggattaagaacagggttctgaagaagtggaagactcgcctcaatcaactatggtag

SEQ ID NO: 182069 - DNA, 1131 bp, Artificial Sequence
  Description of Artificial Sequence: Synthetic coding sequence
atgctgctgctgttcctgctgttcgagggcctgtgctgccccggcgaaaacaccgcggctcctcaggcactgcagtcttaccacctggcagccgaagagcagttgtcgttccggatgcttcagacatcttcattcgcgaatcactcatgggcccacagcgaaggctcaggctggcttggagatttgcagacccatgggtgggacaccgtgcttgggacgatcagattcctcaaaccatggagccacggaaacttttctaaacaggaactgaaaaacttgcagtccctgtttcagttatattttcacagcttcatacaaatagtgcaggcatccgctgggcagttccagcttgagtaccctttcgaaattcagatattggccggatgcaggatgaatgcccctcagattttcttgaacatggcctaccaggggagcgactttctttcctttcagggtatttcttgggaaccctcccccggagctggcatccgggcgcaaaatatctgtaaggtattgaaccgctacctggacatcaaggagatcctgcaaagtcttctgggccatacgtgcccaagatttctggctggtctgatggaagcaggcgaatctgagttgaaaaggaaggtgaagccagaggcttggctgagttgcggccctagtcccgggcccggaagattgcagttagtctgtcacgtctccggcttctacccaaaaccagtgtgggtgatgtggatgcggggagagcaggagcagaggggcacccagcgcggtgatgttttgcctaatgccgatgagacgtggtaccttagggccaccctggatgtcgcagctggggaggccgcaggcttatcatgtcgggtgaaacacagctcgctaggcgggcacgatttaatcatccattggggcggatacagcatatttctgattttaatctgtctgactgtgatcgtgacactggtcattctggtggtcgtggattcgcgcctgaagaagcagtccccggtgttcctgatgggggcgaacacacaggacacaaagaacagccgtcaccagttttgcctggcacaggtttcctggatcaaaaaccgagtattaaagaagtggaaaacaagattaaaccagttgtggtag

SEQ ID NO: 182070 - DNA, 873 bp, Artificial Sequence
  Description of Artificial Sequence: Synthetic coding sequence
atgctgctgctgttcctgctgttcgagggcctgtgctgccccggcgagaacaccgccgctccccaggccctccagtcatatcatttggccgctgaggagcagctctcttttaggatgctgcagaccagttcttttgcgaatcattcatgggcccactctgaagggtcaggatggctgggagatcttcagacccacggctgggataccgtgctcgggaccatccgattccttaagccgtggtcccacggtaatttttcaaagcaagaactgaagaacctgcaaagtctgttccaattgtattttcactcattcattcaaatagtgcaggccagtgccgggcaatttcaactggagtacccttttgagattcagatcctggctggctgcaggatgaatgctcctcagatcttcctcaatatggcgtatcagggaagcgacttcctgtcgtttcagggaatttcctgggaaccctcgcctggcgccgggatacgggcccagaatatctgtaaggtcctgaacagatatctcgatattaaggagatacttcagtccctgctcggacacacttgccctcggtttcttgccggacttatggaggcaggggaatccgagttgaagcgaaaggtcaagcccgaggcctggttgagctgcggccccagccccggacccgggaggcttcagctggtttgtcacgtgtcggggttctaccctaagcctgtatgggtgatgtggatgaggggggaacaggagcagcggggcacccagcggggggacgtccttcccaatgccgacgaaacctggtggatttttcacctctcacatcctgatctattcgactgcgactcctatcctggccacattggctgttcatag

SEQ ID NO: 182071 - DNA, 183 bp, Artificial Sequence
  Description of Artificial Sequence: Synthetic coding sequence
tgagtgagcggcttctaccccaagcccgtgtgggtgatgtggatgagaggggaacaggagcagcggggaacccagcgcggcgacgtactgcctaacgccgatgaaacctggtggatcttccaccttagtcatccagacttgttcgactgtgattcttacccggggcatataggatgctcctag

SEQ ID NO: 182072 - DNA, 966 bp, Artificial Sequence
  Description of Artificial Sequence: Synthetic coding sequence
atgctgctgctgttcctgctgttcgagggcctgtgctgccccggcgaaaacaccgccgctcctcaggctctgcaaagctaccatctggcagcagaggagcagttaagctttcggatgcttcagacttcgagcttcgctaatcactcctgggcccacagtgaagggtccggatggttgggagatcttcagacgcacggatgggatacggtgttaggcacaattaggttcctgaaaccctggtctcacggaaacttcagtaaacaagagttaaaaaacctgcaaagcttgttccaattatacttccacagcttcatccagattgtacaagcaagcgctggacaattccagcttgagtatccgtttgagatccagatactggccggttgcaggatgaatgcccctcagatttttcttaacatggcttaccaagggtctgattttttgagtttccagggcatctcctgggagcccagccctggcgccggaatcagagcccagaacatatgtaaggtgctgaatcggtacctagatattaaggaaatactgcaatcccttctggggcatacttgcccaagatttcttgccggtctgatggaggccggggaaagcgagctgaagcgcaaggtgaaacctgaagcgtggttgtcctgcggcccttcacccggtcctgggagactccagctagtgtgtcacgtcagtgggttctacccgaaacccgtatgggtcatgtggatgcgaggcgggtactccatctttctgatcctcatctgcctgacagtgattgttaccctagtgatcctggtcgtcgttgattcacgactcaaaaaacagagcccagtttttttgatgggagccaacactcaggacacaaagaattctcggcaccagttctgtttggctcaggtttcttggatcaaaaacagagttctgaaaaaatggaagaccagacttaatcagctgtggtag

SEQ ID NO: 182073 - DNA, 306 bp, Artificial Sequence
  Description of Artificial Sequence: Synthetic coding sequence
atgctgctgctgttcctgctgttcgagggcctgtgctgccccggcgaaaacacggccgttaagccagaagcatggttgtcttgcgggccatccccgggccctggacgactgcagttggtgtgtcatgtgtcaggattctaccctaaaccagtgtgggtgatgtggatgcgcggcgagcaggagcagagggggactcagcgaggagacgtgttgccaaacgccgacgaaacctggtggatatttcatttgtctcacccagatctcttcgattgcgactcataccccggtcatattggctgtagctag

SEQ ID NO: 182074 - DNA, 897 bp, Artificial Sequence
  Description of Artificial Sequence: Synthetic coding sequence
atgctgctgctgttcctgctgttcgagggcctgtgctgccccggcgagaacactgcggctccacaggccctgcagagttaccatctggcagcggaggagcaattgtcttttaggatgctgcaaacgtctagctttgcaaaccactcgtgggctcattcggaagggtcaggatggctgggtgacctgcaaactcacggctgggataccgtcctgggaaccatccggtttctgaaaccttggagccatgggaatttctctaagcaggagctgaaaaaccttcagtccctctttcagctgtatttccactcctttatccagatcgtccaggctagcgccggacagtttcagttggaactaaaaccggaggcctggctgtcctgtggtcccagccctggccctgggcgtcttcaattggtctgccatgtgagcggcttctacccgaagccagtgtgggttatgtggatgcgaggagagcaggagcagagaggtacacaaagaggagacgtcttaccgaacgctgatgaaacctggtatctcagggccacgcttgatgttgctgctggcgaggctgctggactgtcttgccgcgtgaagcacagctctctcgggggccatgacttgataatccactggggagggtacagtatctttctgatcttaatatgtctcacagttatcgtcactctcgtcattctcgttgttgtcgacagccgcttaaagaaacagtcctcaaacaagaacattttatcaccgcacacacccagtcccgttttcttgatgggagcgaacactcaagacacaaaaaattcacgacatcagttttgtttggctcaagtgagctggataaagaacagagtactgaagaaatggaagactcggctgaaccagctgtggtag

SEQ ID NO: 182075 - DNA, 564 bp, Artificial Sequence
  Description of Artificial Sequence: Synthetic coding sequence
atgctgctgctgttcctgctgttcgagggcctgtgctgccccggcgagaatactgcggtaaaaccagaggcatggttatcctgcggacccagccccggacccggaaggctgcaactcgtctgccacgtgagtggcttttaccccaagcctgtgtgggtgatgtggatgcgcggtgaacaggagcagagaggaacccagagaggcgacgtcctgcccaatgccgacgagacatggtacctgcgcgcaaccctggatgttgctgctggcgaggccgccgggctgtcatgtcgggtcaaacactcttcattaggaggtcacgacttgataatccattggggggggtactctattttccttattctaatctgtcttactgtaatagtgacgttggtgatcctcgtggtcgtggattctaggctgaagaagcaatctccagttttccttatgggcgccaatacccaggacacaaaaaacagcagacaccaattctgtctcgcacaggtcagctggattaagaaccgggtcctcaagaagtggaaaacccggctgaaccagctttggtag

SEQ ID NO: 182076 - DNA, 1167 bp, Artificial Sequence
  Description of Artificial Sequence: Synthetic coding sequence
atgctgctgctgttcctgctgttcgagggcctgtgctgccccggcgaaaacaccgctgctccccaggccttgcaaagttaccacttagcagcagaggagcagttgagcttccgcatgctgcagacaagcagctttgccaaccactcgtgggctcattcggaaggaagcggatggctgggcgacctgcaaacacacggctgggataccgtcctgggcaccatccgcttcctgaaaccgtggtcgcacggtaatttttctaaacaggaactcaaaaatttacaaagtttgtttcagctgtatttccactcctttattcagatcgtccaggcatctgctggccagtttcagctcgagtacccttttgaaatacaaatccttgccgggtgccgaatgaatgccccccagatctttctgaacatggcgtaccagggatctgacttcctgtctttccaggggatatcatgggaaccctctccaggggcaggcataagggctcaaaacatctgcaaggtcctgaatagatacctggatatcaaggaaatcctgcagtccttgctgggccacacctgtcctcggttccttgccggattgatggaggcgggagaaagcgagctcaaacgcaaagtgaaacctgaggcgtggctaagctgtggcccttcaccaggtcccggccggttgcaacttgtttgtcacgtgagcggattttaccccaaaccagtttgggtcatgtggatgaggggggagcaggaacaacgcggtacccagaggggtgacgtgcttcctaatgctgacgaaacatggtacctgagagctaccctcgacgtggctgctggggaagctgcaggactgtcgtgcagggtcaagcattcttctctgggaggccacgatctgattatacactggggcgggtactctatctttctaattttgatctgtctgaccgtgatagtcacgctggtgatcctggtcgtggttgattctcgactcaagaagcagagcagtaacaagaacattctttctccgcacaccccctccccagttttcttgatgggcgccaacacacaggacacgaaaaattcccgacatcagttttgtctcgctcaagtatcttggattaaaaaccgtgtcctcaagaagtggaagactcgcttaaatcaactatggtag

SEQ ID NO: 182077 - DNA, 1023 bp, Artificial Sequence
  Description of Artificial Sequence: Synthetic coding sequence
atgatcaagagccgggtgaagcggtaccggcggcggcggggcagccagagggcccctcaggccttgcagtcatatcacctggcagctgaggagcagctgtcctttagaatgctgcaaacttctagcttcgccaaccatagctgggcacactcggagggttctggctggctcggagacctccagacccacggctgggatacggtgctcggcacaatccggttcctgaaaccttggtcacatggcaatttttccaaacaagagctgaaaaacctgcagagcctgttccagctatattttcactcatttattcagattgtgcaagcttctgctggccagttccaactggagtacccgtttgaaattcaaatcctggcaggatgccggatgaacgcccctcagattttcctgaacatggcctatcagggctctgattttctcagtttccaaggcatttcctgggagccttcccccggtgctgggatccgtgcgcagaatatttgtaaagtcctcaaccgataccttgatattaaagaaatactgcagagcctgcttggtcacacatgccctagatttctcgctggactgatggaggcaggagaaagtgaattgaagaggaaggttaagcccgaagcatggttgtcatgtggaccaagtcccgggcctggtcggctgcagctggtttgccacgttagcggcttttaccccaagccggtctgggttatgtggatgcgaggagaacaagagcagaggggaacccaacgcggagacgtgttgccgaacgctgatgagacttggtacctcagagcaacattggatgtggccgccggagaagctgcagggctcagctgtcgtgtgaaacattcatcactgggcgggcatgatctgataatccactggggtgaaaagcagctgagactgtgttgggagattatgaagatagcactagggctcctgtcagtggggcttagaaaatgggttggcatgctcggaacaaggcgcgtaaagctcggccaatccaaatag

SEQ ID NO: 182078 - DNA, 870 bp, Artificial Sequence
  Description of Artificial Sequence: Synthetic coding sequence
atgctgctgctgttcctgctgttcgagggcctgtgctgccccggcgagaataccgcagatcccttcgagattcagatcctggccgggtgcagaatgaatgcaccccagatctttctgaatatggcctatcagggctctgattttctcagctttcaggggatcagctgggaaccttcccccggagcaggcatccgcgcccaaaatatctgcaaagtgctcaaccgctacctggatattaaggagatcctccagagcctgctcggtcatacgtgccctcggttccttgcaggccttatggaagccggcgagagcgaactcaaacggaaggtgaaacccgaggcttggctgagctgcggtccttcacctggcccaggccggctgcagcttgtttgccatgtgagcggattctacccaaagccagtttgggtgatgtggatgaggggcgagcaggagcagcgaggtacacagcggggcgatgttctcccgaacgctgatgaaacatggtacctacgggcaactctcgacgtggctgccggcgaggctgccggactttcttgcagagtgaaacactcttctttgggcggtcacgacctgatcattcactggggcggatattccattttcctgatcctgatttgccttacagtgattgtgacccttgtcatactggtcgtagttgacagccgcctgaagaagcagagctccaacaaaaatattctgtccccccacacgccatctccagtattcttaatgggagcaaacactcaggatacgaagaactccaggcaccagttttgtctggcacaagtgtcttggattaaaaacagggttctcaaaaaatggaagacgaggcttaatcagctgtggtag

SEQ ID NO: 182079 - DNA, 600 bp, Artificial Sequence
  Description of Artificial Sequence: Synthetic coding sequence
atgctgctgctgttcctgctgttcgagggcctgtgctgccccggcgagaatacggcagtcaagccagaggcatggctctcgtgtggtcctagccccggacccgggagactccagctggtatgccacgtgtcaggattctaccctaaacccgtatgggtcatgtggatgcgtggcgaacaggagcagcgcggtacccagcggggcgacgtcttgccgaatgccgatgaaacgtggtatctgcgggccacactggatgtggccgctggggaggctgctggtctcagttgccgtgtgaagcattcatccctcggcggccacgacctgataatccattggggaggctactcaatcttcttaattctcatttgtctgactgtcattgttacacttgtgattcttgttgtcgtggattccaggcttaagaaacaatccagtaataagaacatcctgtctccccatactccttcccccgtattcctcatgggagccaatacccaggatacgaagaacagcaggcaccaattctgcttagcgcaggtgtcctggattaagaatagagttctaaaaaagtggaagacccgccttaaccaactctggtag

SEQ ID NO: 182080 - DNA, 1047 bp, Artificial Sequence
  Description of Artificial Sequence: Synthetic coding sequence
atgctgtgcccctggcggaccgccaacctgggcctgctgctgatcctcacaatttttctcgtggcagaagctgagggcgcagcacagcctaataattcactgatgttacagactagcaaagagaatcacgctctggcctcatcatctctgtgtatggacgagaaacaaataactcagaactatagcaaggtcctggctgaagtgaacacttcttggcccgttaagatggcaactaatgctgtgctttgctgcccccccatagccctgcggaacctcattataataacatgggagataatcctgcgtggtcagccatcctgtaccaaggcttataagaaggagaccaacgagactaaggagactaactgtaccgatgagcgaattacatgggtgtccagaccagatcagaactcggacttgcagatccgaactgtcgccattactcacgatgggtattacagatgcatcatggtcacccccgacggcaacttccatcggggctaccacttgcaagttctggttacccctgaggtgaccctcttccagaatagaaaccggactgctgtttgcaaggcagtggccggtaaacccgctgcacacatcagctggattcccgaaggcgactgtgccactaagcaagagtattggtctaatggtaccgtgaccgtgaaatctacctgtcattgggaagtgcataacgtttctaccgtgacttgccacgtctcccatcttaccggaaacaaaagcctttatatagagctcctacccgtgcctggggcgaaaaaaagtgccaaactgtacattccttacatcatactgaccataattatcctgactatcgtggggttcatttggctcctcaaagtcaacggttgcagaaaatataaattaaacaagacagagagcactcctgttgtggaagaggacgagatgcagccatacgctagttacacggagaagaataatccgctttacgacacgacaaataaggtgaaagcatctgaggcactccagtccgaagtcgataccgatctgcacacactatag

SEQ ID NO: 182081 - DNA, 567 bp, Artificial Sequence
  Description of Artificial Sequence: Synthetic coding sequence
atgctgtgcccctggcggaccgccaacctgggcctgctgctgatccttacgatctttcttgtggcggaagccgaaggggcggcacagcccaacaactctttaatgttacagacctctaaagagaatcacgcgttagctagcagctccctgtgcatggacgagaagcagattactcagaattacagtaaggttttagcagaagtgaacacctcatggcccgtcaaaatggctaccaacgcagtcctttgctgccccccgattgcgctgcgcaacctgattataatcacttgggaaattatcttgcggggccagcccagctgtacaaaagcctataaaaaggaaacaaacgagacgaaggaaacaaattgcaccgacgagaggatcacttgggttagcaggcctgaccagaactccgacctgcagatccgtacggtggcaatcacgcacgatgggtactatcgctgtattatggtgacgcccgacgggaatttccaccggggataccatctccaagttctggggaaagagcaccacatcttgcgctattttacctccccagacctctag

SEQ ID NO: 182082 - DNA, 978 bp, Artificial Sequence
  Description of Artificial Sequence: Synthetic coding sequence
atgctgtgcccctggcggaccgccaacctgggcctgctgctgatcctaaccattttcttagtggcagcttccagctctctttgtatggatgaaaagcaaattacccagaattactcaaaggtgcttgcagaagtcaacacaagctggccagtgaagatggctacgaatgccgttctctgctgcccccctattgccctccggaatctgatcataattacgtgggaaatcattctcagaggtcagccatcttgtaccaaggcatataaaaaagaaactaacgaaaccaaagaaaccaactgtactgatgagagaattacatgggttagccgaccggaccagaatagtgatctccagatcaggactgtcgctattacacatgatggctattatcgctgcattatggttacgcccgacggaaatttccacagggggtaccatctgcaggttctagtcacccctgaggtcacactttttcagaacaggaacagaacagccgtctgtaaagccgtagccggcaaaccagctgcccatataagctggattccagagggcgattgtgccaccaagcaggagtactggtctaatggcactgttacagtgaagtctacctgccattgggaagtgcataacgtgagtaccgtgacatgtcatgtctcacatcttacaggtaataaatcgctgtacattgagctgttacccgttccaggcgcaaaaaagagcgccaagctttatatcccatatatcatcttaaccattattatcctcacgatcgtaggattcatctggctgttgaaagtgaatggctgcagaaaatacaagctgaacaagactgaatctactccggtagtcgaggaagatgaaatgcagccctatgcctcttataccgagaaaaacaatccactctacgacactaccaataaagtgaaggccagcgaagccctccagtctgaagtggatactgaccttcatacattatag

SEQ ID NO: 182083 - DNA, 498 bp, Artificial Sequence
  Description of Artificial Sequence: Synthetic coding sequence
atgctgtgcccctggcggaccgccaacctgggcctgctgctgatcctgactatatttctggtggccgccagctcaagcctttgcatggacgagaaacaaattactcagaattatagtaaggtgctggcagaggttaacacctcctggccggtgaagatggcgaccaatgccgtcctgtgttgccccccaatcgccttaaggaatctcataatcattacctgggaaatcatccttaggggccagccctcctgcacaaaggcttacaaaaaagagaccaatgaaacgaaagaaacgaactgcaccgacgaaaggattacttgggtttccagaccggatcagaattcggatcttcagatccgcaccgtagccattacacatgacgggtattacaggtgtatcatggtgacccctgatggcaactttcatcgcggatatcatttgcaagtgctggggaaagagcaccatattctgaggtattttactagccctgacctctag

SEQ ID NO: 182084 - DNA, 987 bp, Artificial Sequence
  Description of Artificial Sequence: Synthetic coding sequence
atgaccgtggagaaggaggcccccgacgcccacttcaccgtggacaagcagaatatctcactgtggccacgtgaacccccccccaagtctgggccaagtttggtcccgggaaagacacccacagttcgtgcagccctgatctgtctcactctcgtattagtagctagcgttctgttgcaagccgttttgtatcctaggtttatgggtactataagtgatgttaagaccaatgttcaacttctgaagggcagggtagataacatctcgaccttggattctgaaatcaagaagaactcggatgggatggaggctgccggggtccagatccagatggttaacgagtccctgggctacgtacgatctcaatttctgaagctcaagacctccgtggagaaggccaatgcacagatacagatcttgactaggtcatgggaggaagtgagtaccctcaatgcccagatccccgagctgaaaagcgacctggagaaagcttccgcactgaatactaagatcagggctttacaggggtccctggagaatatgagcaagctcctgaagaggcaaaacgacatcctgcaagtggtttctcaggggtggaaatattttaaaggaaatttttattatttttcgttgatccccaaaacctggtatagcgcagagcaattttgcgtgtccaggaactctcatctcacatccgtcaccagtgagagcgagcaggagttcctgtacaaaactgccggaggcttgatctactggatcggcttgacgaaggctggaatggaaggagactggagttgggttgatgatacaccattcaataaggttcagtctgttcgtttttggatccccggggaacccaataatgctggtaacaacgagcactgtggaaacatcaaggcacctagcctgcaggcctggaacgacgctccgtgcgacaagactttccttttcatttgtaaaagaccctatgtcccgtccgaaccttag

SEQ ID NO: 182085 - DNA, 4497 bp, Artificial Sequence
  Description of Artificial Sequence: Synthetic coding sequence
atggacggcgccagcgccgagcaggacggcctgcaggaggaccggtcccattcgggacctagttccctgcccgaagctcccttgaaacctccgggaccgcttgtccccccagatcagcaggataaagtacaatgcgccgaagttaatcgggcctccacagagggcgagtcccccgacggcccgggccagggaggcctttgccaaaatggacctacccctcctttccccgaccctccatcatccttggatcccaccacatctcctgtagggcccgacgcgagcccaggcgttgccggcttccacgataacttgcggaaatcacaaggtacttcggccgagggttcagtccgcaaggaggcactgcagtctcttagactaagtctgccaatgcaggagacacagctctgtagcaccgactctccactgcctctagaaaaggaagaacaggtgagactgcaagctagaaagtggctagaggaacagttgaagcagtatcgagtgaagaggcagcaagagcgatcctcacagcctgcaacgaaaacccggcttttctctacgcttgacccagagctgatgttgaaccccgagaaccttcctcgcgccagtactcttgcaatgaccaaggagtatagtttcctgcgcacatcagttcctagggggcccaaggtcggtagcctcggtcttcctgctcatccccgcgaaaagaagacgtccaaaagctcaaagatcaggagcctcgccgactacagaacagaggacagcaatgcaggcaactcaggcggtaatgtgcccgctcctgacagcaccaagggatcgttgaagcaaaatagatctagtgccgctagtgtggtaagtgagatttcactcagtccggacacggacgaccgcctggaaaacacatctctggcaggtgactccgtgtcagaagttgatgggaatgatagtgactcttcctcatactcctccgcctccacgcgaggaacgtacgggatcctctcaaaaaccgtggggacacaggataccccgtacatggtcaatgggcaggaaattccagcagatactttaggccagtttccctctataaaagatgtgctgcaagcggccgccgcggagcaccaggatcagggtcaggaggttaacggagaagtgagaagccgaagggacagcatctgcagtagcgtctcactggagtcttctgccgccgaaacccaggaggagatgctacaggtgctgaaggaaaagatgcggcttgaaggccagcttgaagccttgtctctcgaagcatctcaggcgttaaaggaaaaagccgagctacaggcccagctcgctgccctgtctacgaagctgcaggcccaggtcgaatgctcacatagctcccaacagcgccaagattccttatcaagtgaggttgacaccctcaagcagtcttgctgggaccttgagagagcaatgaccgatctgcaaaatatgttagaggctaaaaatgcaagcttagcctcctccaacaacgatcttcaagtggccgaagaacagtaccagcgcctgatggcaaaggtggaagatatgcaaagatccatgttgagtaaggataacacagtgcatgacctccgccagcagatgacggcattacagagccaattacaacaggtacagttggaaaggactactctaacgagcaagctaaaggcttcacaggcggaaatcagtagcctacagtctgtgcgccaatggtaccagcaacagctcgccctagcgcaggaagcaagggtgaggctgcagggggagatggcgcacatccaggtgggccagatgactcaggccggcctacttgaacacctcaaactggaaaacgtgagccttagtcagcagcttaccgagactcagcacaggtctatgaaggaaaaaggaagaatcgctgcccagcttcaaggcatagaagccgacatgcttgaccaagaggccgcgtttatgcagatccaggaggccaagaccatggtggaagaggacctgcagcgccgattggaggagtttgagggtgagcgagagcgactacagcgaatggctgatagcgctgcaagtctagagcagcagctggaacaagtgaaacttactctactgcagagagatcaacaactagaagcgcttcagcaagagcaccttgatcttatgaaacagctcacactcacacaagaggccctccaatctagggagcagagtctggacgctctccaaacacattacgatgaactgcaggccaggctcggcgaactgcagggtgaagcggctagtcgcgaggatacaatctgcctgcttcagaacgaaaaaattattctagaggcggcgctacaagctgccaagagtgggaaggaggagctggacaggggcgccaggcggctggaagaaggaaccgaagaaacatctgagaccctcgaaaaactccgggaggagctggccattaaatctggccaggtggaacacctgcagcaggagaccgccgccctcaagaagcagatgcagaagatcaaagaacagttcctgcagcagaaggtcatggtcgaggcttatagaagggacgccacttcgaaagatcaactgatcagcgaactgaaagccactcgcaaaagactggattctgaactgaaagagctccgacaagaattgatgcaagtacacggtgagaagcgtacggccgaagctgagctttcacgcctgcacagggaggtggctcaggtgcgccagcacatggctgatttagagggtcatttgcaatcagcccagaaggagagagatgagatggaaacccacctgcagagtctgcagtttgacaaggaacagatggttgcagtaaccgaggcaaacgaggctctcaaaaagcaaatcgaggagctgcaacaagaggctcgcaaggctatcaccgagcagaaacaaaagatgagaagactggggagcgatctgacatctgcgcagaaagagatgaaaactaaacacaaagcttacgagaatgcagtcggcatcctctcaagacgcctccaagaggcgcttgcagccaaagaggccgcagatgcagagttgggacagctccgggcccaggggggttctagtgactcctcacttgctctgcatgagcgcatccaggctctggaggctgaactccaagccgtgtcacattcgaaaactttgttggagaaggagctccaggaggttatagccctgacttcccaggagctcgaggagagccgagagaaggtactcgagctagaggacgaattacaggagtcaaggggttttcgcaaaaaaatcaagcggctcgaggagtccaacaagaaacttgcacttgagctggaacatgaaaaggggaagctcacaggactgggtcagtccaacgctgctctccgtgaacacaatagtatactggaaacagcattagccaaacgcgaggccgatttggttcaactgaatttgcaggttcaggccgtgttgcagcggaaagaagaggaagatagacaaatgaaacacctggtacaagccctccaagcctcactggagaaggaaaaggaaaaggtgaattctttgaaagagcaagtcgctgcagccaaagtggaggcaggccacaatcggcgccactttaaggctgcctccctggagctttctgaagtaaaaaaggaactccaggcaaaggagcacctcgttcagaaactccaggccgaggccgacgatctgcagattagagaaggtaagcacagccaggagattgcacagttccaagccgagctggctgaagcgcgcgctcaacttcagctgcttcagaaacagctggatgagcagctgtctaaacaaccggtcgggaatcaagaaatggagaatctgaagtgggaggtggatcagaaagagagagagatacaaagtctaaagcagcaacttgaccttactgaacagcaaggccgcaaagagttggagggtctgcagcaactcctccagaacgtcaaatccgaattagagatggctcaggaggacctcagcatgacccaaaaagacaagttcatgttgcaggccaaggttagtgagctgaagaacaacatgaaaacactgctacagcaaaaccagcagttgaagctagatcttaggagaggagccgctaaaacaaggaaagagcctaaaggcgaggccagttcatctaatcccgcgacccccattaaaatccctgactgcccagtgccagcctcgctcctcgaggagctgttacggcctcctccagctgtgtccaaggaacccctgaaaaatctcaatagctgtctgcagcagctcaagcaggagatggactccctccagagacagatggaagagcacgctctcaccgtgcacgagagccttagctcatggacacccctcgagcccgctaccgcgagtcccgtcccaccaggtggtcacgctggccccaggggggatccccagaggcactcccagagcagggccagtaaagaaggccctggcgaatag

SEQ ID NO: 182086 - DNA, 807 bp, Artificial Sequence
  Description of Artificial Sequence: Synthetic coding sequence
atgagcgacagcaaggagccccggctgcagcagctgggcctgctggtgtcaaaggtgccctcatcaatttcacaggaacagtcacgccaagacgctatttatcagaacttgacacaattaaaagcggccgtcggggaactctccgagaaatccaagctgcaggaaatctatcaagagttgacccagctcaaggccgctgtgggcgaattgccagaaaagtcaaaacttcaggagatttaccaggaactgacacgtttgaaggccgcagtgggagagttaccagaaaagtctaaacaacaggaaatataccaagagttgactcagctgaaagctgccgtggaaagactttgtcatccgtgtccttgggagtggacttttttccagggcaactgctatttcatgagcaactcccagcggaactggcatgatagcatcactgcctgcaaggaggttggagcccagctagtggtgattaagtctgccgaggagcagaactttttacagcttcagtcctctcgttctaatcgctttacctggatgggactgtccgatttaaaccaggaagggacttggcaatgggtcgacgggagcccactgctcccaagtttcaaacagtactggaaccgaggcgagcctaataatgtcggtgaggaagactgtgccgagttttccggcaatggatggaatgatgacaaatgcaaccttgccaagttctggatatgcaagaagagcgcagcatcatgctcccgcgacgaggagcagtttctttcccctgcccccgctaccccgaacccaccgcctgcatag

SEQ ID NO: 182087 - DNA, 1143 bp, Artificial Sequence
  Description of Artificial Sequence: Synthetic coding sequence
atgagcgacagcaaggagccccggctgcagcagctgggcctgctggaggaagaacagcttagagggttaggatttagacaaacacgcgggtacaaaagcctggcggtttcgaaagtgccttcctccatctcccaggagcaatcgaggcaggatgcaatctatcagaacttgacgcagctgaaagccgccgtgggggagctctcagaaaaatccaagcttcaggagatctatcaggaacttactcagctgaaggcagctgtcggcgagctgcccgagaagtccaaacttcaggagatataccaggaactcacgcgcctcaaagccgccgtcggcgaattacccgaaaagagcaaactgcaggaaatataccaggagttgacatggctcaaggctgcagttggggagcttcccgaaaaatccaaaatgcaagagatctaccaggaattgacgcggcttaaagcagccgtcggtgaactgcctgagaaatctaagcaacaggaaatttaccaagaactgacgaggcttaaggctgcagtgggcgaactacccgaaaaaagtaaacagcaagagatttaccaggaactgacgaggctgaaagctgcagtgggcgagctgcccgagaagagcaagcagcaagagatttaccaggagctaacccagctgaaggccgctgtggagcgactttgccatccgtgcccttgggaatggacctttttccagggaaattgttactttatgtctaatagccagagaaattggcacgattcgataacagcctgtaaagaagtcggtgcgcaacttgtcgtcattaagtctgctgaagagcagaacttcctgcagctgcagagctctaggagtaataggttcacctggatggggctcagcgatttgaatcaagaaggcacatggcaatgggtcgatggcagccccctgctgccaagctttaaacagtactggaatcggggggaaccaaacaacgtcggggaggaggattgcgcggaattctctggcaatggttggaatgatgacaagtgcaacctcgctaagttttggatctgcaagaagtctgcagcaagctgctctagagatgaagaacaatttctgtcgccagccccagccacccccaatccgcctcccgcatag

SEQ ID NO: 182088 - DNA, 1215 bp, Artificial Sequence
  Description of Artificial Sequence: Synthetic coding sequence
atgagcgacagcaaggagccccggctgcagcagctgggcctgctggaggaagaacaactcagaggactggggtttcgccagacaaggggatacaagtctctcgctggctgtttggggcatggaccattagtgcttcagttactgtccttcactctcctcgcaggcttgctggtccaggttagtaaggtgccttcaagtattagccaagagcaaagccgccaggacgccatttaccagaatctgacccagttgaaggcagctgtgggagagctatctgagaagtccaagctgcaggaaatctatcaggagttgacccagctcaaggctgcagttggggaactcccggagaagagtaaactgcaagagatatatcaggaattgacccgcctcaaagcagccgtgggcgaattacctgagaaatcaaagcttcaagagatttatcaagaacttacttggctcaaagccgccgttggggagctaccagagaagtcaaaaatgcaagaaatataccaggaactgacgagactaaaggctgcagttggagagctgcctgaaaaaagcaagcagcaggagatatatcaagagctgacacgcctgaaagccgccgttggagagctcccagaaaaatccaagcagcaggagatctaccaggagctcacacgcctgaaagccgcagtaggagagttgcccgagaaatcaaagcaacaagagatctaccaggaattaacgcagctgaaggcagccgttgaacgactgtgccatccgtgtccctgggagtggactttctttcaggggaactgttacttcatgtccaactcgcagcgcaattggcacgatagcattacagcctgtaaggaggtaggtgcacagctggtggtgattaagtcagccgaagaacaaaatttcctacagctccagtctagccgcagcaaccgatttacatggatgggcctgtccgacctcaatcaggaagggacttggcagtgggtggatggctctcccctcttaccctcttttaagcaatactggaataggggggagccgaataacgtgggagaggaggattgcgctgagttttccgggaacggctggaatgatgacaagtgtaatctggcaaaattttggatttgcaagaaaagcgccgcctcatgctctcgcgacgaagagcagttcctcagcccagcaccggcaaccccaaacccccccccagcatag

SEQ ID NO: 182089 - DNA, 1197 bp, Artificial Sequence
  Description of Artificial Sequence: Synthetic coding sequence
atgagcgacagcaaggagccccggctgcagcagctgggcctgctggaagaggaacagctcagaggcttggggtttcggcaaacgcgtggatacaaaagcctggcggggtgtctgggacatggccccctggttctgcaactgctgagctttacactccttgcaggactccttgttcaggtcagcaaggtcccaagctccatttcccaggaacagagcagacaggatgcaatatatcagaatcttacacagttgaaggcagctgtaggtgagttgagtgagaagagcaagctgcaggaaatttatcaggagctaactcagttgaaggcagccgtaggtgaactccctgaaaaatcgaagctgcaagagatctaccaggaactgacccggcttaaggctgccgtgggcgaattgcccgagaaatctaagctgcaggaaatttatcaagagctcacatggctcaaagccgctgtgggagaactcccagaaaagagcaagatgcaagagatataccaggagctcacacggttgaaggcagccgttggagagcttcctgagaagtccaagcaacaggaaatctaccaagagcttaccaggcttaaggccgccgtgggcgaactccccgagaaatccaaacagcaggaaatctaccaggaacttaccaggctgaaagccgctgttggagagcttccggaaaagagcaaacagcaggagatttaccaggaacttacccagctaaaggctgctgttgaaaggttatgtcacccatgtccttgggagtggacatttttccaggggaactgttattttatgtctaactcacaaaggaattggcacgactcgattacagcatgcaaagaagtcggggcccaattggtagtgattaaatccgccgaggagcagtcctccaggtctaatcggttcacctggatgggacttagcgacctgaaccaggagggcacatggcaatgggtggatggatcaccattactgccaagttttaagcagtattggaataggggtgaacccaacaacgtgggggaggaagattgcgccgagttttctggtaatggctggaatgacgataaatgcaatttagccaagttttggatctgcaaaaaaagcgctgcatcttgctctcgagatgaagaacagttcctctccccagcaccggccactcccaatcctccccccgcttag

SEQ ID NO: 182090 - DNA, 507 bp, Artificial Sequence
  Description of Artificial Sequence: Synthetic coding sequence
atgagcgacagcaaggagccccggctgcagcagctgggcctgctggaagaggaacaactgagggggcttggctttaggcagacacgcggctataagagtctagcagggtgcctgggtcacggacccctggttctgcaactgctgtcatttaccctcctggccggactgctggtgcaggtctcaaaggttcctagctcgattagccaggagcaatcacgtagcaataggtttacttggatgggactaagcgatctcaatcaggagggcacttggcagtgggtcgacggttcccccttgctgccttcattcaaacagtactggaaccggggcgaaccaaacaacgtcggggaagaggactgcgccgaatttagcggtaatgggtggaatgacgacaagtgtaaccttgctaaattttggatctgcaagaagtcagccgcgtcatgctcgcgagatgaggagcagtttctaagcccagcccctgccacccccaacccacctcccgcctag

SEQ ID NO: 182091 - DNA, 939 bp, Artificial Sequence
  Description of Artificial Sequence: Synthetic coding sequence
atgagcgacagcaaggagccccggctgcagcagctgggcctgctggaggaagaacagcttaggggcctgggttttagacagacaaggggatataaatccctggcaggatgcctcggtcacggacctttagtgctccagctcctcagcttcacgcttctagccggtctcctagtgcaggtttccaaggttccttcatctatcagccaggagcaaagccgacaagacgccatctatcagaatctgacccagcttaaggcggccgtgggcgagctaagcgaaaaatccaagctgcaggaaatttaccaggagttgacccagctgaaggcagctgtgggagagcttccagagaagtcgaaactgcaagaaatatatcaggaactgacccgcttgaaagctgccgttggagagcttcctgagaaaagcaaactccaggagatatatcaggaattgacatggctcaaggctgccgtcgaacggctgtgccatccctgcccatgggagtggacctttttccagggcaattgttattttatgtcgaactcacaaaggaattggcacgatagcattacagcctgcaaggaggtgggtgcacagctggtagtaatcaaaagcgccgaggagcagaatttcctacagctccagagctcccgctcgaaccgcttcacttggatgggcctgagcgaccttaatcaagaaggcacctggcagtgggtggatggaagtcctctcctaccaagctttaaacaatattggaatcgtggcgagcccaataatgtgggcgaggaggattgtgctgagttctcaggcaacggctggaacgacgacaagtgcaacttggccaaattctggatatgcaaaaaatctgcagccagctgttcccgagatgaagagcagtttctatctcccgctccagcaacccctaaccctcccccagcctag

SEQ ID NO: 182092 - DNA, 105 bp, Artificial Sequence
  Description of Artificial Sequence: Synthetic coding sequence
atgagcgacagcaaggagccccggctgcagcagctgggcctgctggaagaggagcagctgcgaggactcgggtttaggcagacccgccgtaatcagaaatgctag

SEQ ID NO: 182093 - DNA, 855 bp, Artificial Sequence
  Description of Artificial Sequence: Synthetic coding sequence
atgagcgacagcaaggagccccggctgcagcagctgggcctgctgggatgtctggggcacggcccgttggtccttcagctgctgtcctttactcttctggcaggcctgctggtgcaagtcctcggaccagtttcgaaagtgcccagctctatatcacaggagcagtcccgtcaggatgctatctaccagaaccttacgcagcttaaggccgccgtaggggagctgagcgagaaatcgaagttgcaggaaatttatcaggagctcacccaactaaaggcggccgtcggagagctccccgaaaaaagtaaacttcaagagatttaccaagagctcacccggctgaaggctgccgtcggcgagcttcccgaaaagagtaaactgcaagagatctatcaagaactcacctggctgaaggccgcggtcggcgagctgcccgagaagagtaaaatgcaagagatctatcaggagctcacccgcctgaaggccgccgtaggtgagctgccagagaagtccaaacaacaggagatttaccaggagctgacaaggctgaaagctgctgttggagaactgcctgaaaagtccaagcagcaggagatttaccaggagttgacgaggctcaaggctgcggtgggagagctccccgagaagtctaaacagcaggagatctaccaggaattaactcagttgaaagctgctgtggagcgtctctgtcatccttgtccatgggagtggacgttttttcaggggaattgctacttcatgagtaacagccaacgcaactggcatgattctatcaccgcttgcaaggaggtgggggctcagttagttgtcatcaagtctgcagaagagcaatag

SEQ ID NO: 182094 - DNA, 939 bp, Artificial Sequence
  Description of Artificial Sequence: Synthetic coding sequence
atgagcgacagcaaggagccccggctgcagcagctgggcctgctggaagaggagcagttgagagggttgggcttcaggcaaacccggggatataaatctctcgctggctgcctaggacacgggccactggtcctgcagctgctcagtttcacacttttagctggcctgctggtgcaggtcagcaaagtgccctcaagtatctcccaggaacagtctcgccaggacgctatatatcagaaccttacacagctaaaggcggccgtgggggaattatccgaaaaatccaagctccaggaaatctaccaggagctgacccagcttaaggcagccgtgggcgagctccctgagaaatccaagctgcaggagatataccaggagctaacccggctgaaagccgccgtcggggagcttcccgagaagtcgaagctacaagaaatataccaggagctgacctggttaaaagctgccgtggagagactgtgccacccctgtccatgggaatggaccttttttcagggaaattgctattttatgagcaattcacagcggaactggcacgactccatcaccgcatgcaaagaagtcggcgcccaactggtggtaatcaagtctgcagaagagcagaattttctgcagctccagtcttctcgcagcaaccgcttcacttggatggggctgagtgatttaaaccaggaaggtacttggcaatgggttgatggatccccactgttgccttctttcaagcagtactggaaccggggcgaacctaataacgtgggtgaggaagattgcgctgagttctcagggaacggctggaacgacgataagtgcaatctcgccaagttctggatctgcaagaagtccgccgcttcgtgctctagagacgaggaacagtttctatctcctgccccagcgacaccaaacccaccacctgcttag

SEQ ID NO: 182095 - DNA, 1011 bp, Artificial Sequence
  Description of Artificial Sequence: Synthetic coding sequence
atggactaccccaccctgctgctggccctgctgcacgtgtaccgggcactgtgcgaagaggtgctctggcacacatctgtccctttcgcagaaaacatgtctcttgagtgtgtgtatcctagcatgggaatactcacgcaagtcgagtggttcaagatcggcacccagcaggactcgatagccatcttcagccccacccacggtatggtgattcggaaaccgtatgccgagagggtatatttccttaactccaccatggccagcaacaacatgaccctgtttttcaggaatgcttcggaagacgatgttgggtattacagttgcagcctgtacacatacccacagggcacttggcagaaggttatacaggtcgtccagagcgattcgtttgaagctgccgtgccaagtaattcccatatagtttccgaacccggcaagaacgttacactgacgtgccagccacaaatgacctggcccgttcaggcagtgaggtgggagaagatccagccgagacagatagacttgctgacatattgcaacctggtgcacgggcgaaacttcacctcgaagtttccaagacagatcgtcagcaactgctctcacgggcggtggtccgtgatcgtgatccccgatgtgaccgtgtcagacagtggtctctacaggtgctacctgcaggccagcgccggcgagaatgagacattcgtgatgcgactgaccgtcgcagagggcaagaccgacaatcagtataccctcttcgtcgccggaggaaccgtccttctcctgctctttgtcatctcaattactaccataattgtgatatttctcaacaggcggaggcggagggagagacgagacctctttacagaaagctgggatacgcaaaaggcacctaataactaccgaagtccaatatccacaagtcagcctacaaatcaatccatggatgatacaagggaggacatttacgttaattatccaacattttctagaagacccaagacacgcgtttag

SEQ ID NO: 182096 - DNA, 822 bp, Artificial Sequence
  Description of Artificial Sequence: Synthetic coding sequence
atgctgggccaggtggtgaccctgatcctgctgctgctgctgaaggtgtatcaaggtaagggatgccagggatccgcggatcacgttgtgtccatctcgggcgttcccctccagttgcagccgaactcaatccagaccaaggttgactccatcgcttggaaaaagctgctgccatctcaaaatggtttccaccacatcctgaaatgggaaaacggatcgctgccctctaacacttccaatgaccgcttcagcttcattgtgaaaaatctctctctgctgatcaaggccgcgcagcaacaggattctggattgtattgcctagaagtcacatcgattagtggaaaagtacaaaccgccacttttcaggtattcgtgttcgagtttcgtttttggccctttctcgtgatcatagtcatcctctcagccttatttctcggcactctcgcctgcttctgcgtctggcggagaaagcgcaaagaaaaacaatccgagacctcgcccaaggagttcctgaccatttacgaagacgtcaaagacctcaaaactaggaggaatcacgagcaggagcagactttcccaggagggggatcgacaatatatagtatgattcaaagtcagagctccgctcccacctctcaagaacctgcttatacattatacagccttatccagccctccagaaagtccggttcccgaaagcgcaaccacagtccttctttcaattctacaatttatgaggtgatagggaagtcccagcctaaggctcagaatcccgccagactctcccgaaaagaattggagaatttcgacgtgtactcttag

SEQ ID NO: 182097 - DNA, 990 bp, Artificial Sequence
  Description of Artificial Sequence: Synthetic coding sequence
atgctgggccaggtggtgaccctgatcctgctgctgctgctgaaggtttaccaagggaagggatgccagggcagcgccgatcatgtggtttccatcagcggagtgccattacaactccagcccaacagtattcaaacaaaggttgattccattgcgtggaaaaagctactgccctcacaaaacggatttcatcatattctcaagtgggagaatgggagcctgccctccaatacatctaacgacagattctcttttatcgtgaagaacctatccctgttgataaaggcggcccaacagcaggattctggactgtattgtttggaggtaaccagcatttcgggaaaggtgcagaccgcgacgtttcaagtgttcgtgtttgataaagtcgaaaaacccagattgcaaggacaggggaagattctggataggggcaggtgccaggtcgccctgagctgtcttgtgtcaagggacggcaacgtgtcgtacgcttggtacaggggcagcaaactcatccaaactgcgggaaaccttacctacctggatgaggaggttgatattaacggcacacacacgtacacttgtaacgtctcgaatcccgtgagctgggagagccatactctcaatctcacccaggactgccaaaatgctcatcaggagttcaggttctggccattcctggtgatcattgtgatccttagtgccctatttctcggcacattggcgtgtttttgtgtgtggcggaggaaacggaaggagaaacagtctgaaacatcacccaaagagttcctgactatctatgaggacgtgaaggacctcaaaactagaaggaaccatgagcaagagcagacttttcctggaggaggatctactatttattccatgatccagtctcaatcatccgccccgactagccaggagcctgcctacaccctgtattcgctgattcagccttctcgcaaaggtgataggttttacagtttctccggatag

SEQ ID NO: 182098 - DNA, 1113 bp, Artificial Sequence
  Description of Artificial Sequence: Synthetic coding sequence
atgctgggccaggtggtgaccctgatcctgctgctgctgctgaaggtgtatcaaggaaagggttgtcagggatccgcggatcacgtggtaagtatcagtggtgtgcccttacagctgcagcctaactcaattcagacaaaagtcgattcgattgcatggaaaaagctcttgccaagccagaatggttttcaccacatactgaagtgggagaacggaagtctgccatctaacacctcaaacgacagattcagtttcattgttaaaaaccttagcttgctcattaaagcagctcagcaacaggattccggtctgtactgcctagaggtgacctccatcagcgggaaggtccagacagccacattccaggtttttgtgtttgaatcccttctgcccgacaaggtggaaaagccccgactccaaggccagggcaaaatactggaccgagggcgttgccaggttgccctgtcatgtcttgtgagcagagacggcaatgtgagctacgcctggtatagaggctctaagttgatccagactgccggaaacttgacctatttggacgaggaagtagatattaatgggacacatacctacacgtgcaatgtgagcaaccccgtcagttgggagagtcacaccctgaacttgacacaggactgtcagaacgcccaccaggagtttagattctggccttttctcgtgatcatcgtgatactgtctgcattattcctaggcactctcgcctgtttttgtgtatggcgacgaaaacgaaaggagaaacagtcagagacatcaccaaaagagttcttgactatctatgaggacgtgaaggacctcaagacccggcgcaatcatgagcaagagcagacttttcccgggggaggaagtactatttacagcatgatacagagtcaaagttccgccccaacctcccaggagccggcatacacattgtactcactcattcagccaagtcgcaagtccggatcccgcaagcggaatcacagcccgtctttcaacagcaccatatatgaagtaatcggcaaatcccagccaaaagcacagaatccagcccggctgagccggaaagagctggagaacttcgatgtgtactcctag

SEQ ID NO: 182099 - DNA, 1098 bp, Artificial Sequence
  Description of Artificial Sequence: Synthetic coding sequence
atgctgggccaggtggtgaccctgatcctgctgctgctgctgaaggtttaccagggcaaaggatgccagggctctgcagaccacgtggtctccatctctggcgtgcccctgcaattgcagcccaacagtatacagactaaggtcgacagcatcgcatggaaaaagctgctgccatcgcagaatggcttccaccatattttgaaatgggagaatgggtcgctcccttccaacactagcaacgataggttcagcttcatcgtaaagaatctctcgctgttgatcaaagccgcacagcagcaggattcgggactctactgccttgaggtgacgtctatctccgggaaggtgcagactgctacatttcaagtgtttgttttcgacaaagtggagaagccccgcctccaaggacagggtaagattttagatcggggtcgatgccaggtggccctctcttgcttggtgagccgggacggaaacgtgagctatgcctggtacagaggaagcaaactgatccaaaccgccgggaacctgacatatttggatgaagaggtcgacatcaacgggacccatacttatacatgtaacgtttcaaatcccgtgtcctgggagtcgcatacactcaacctgacacaagattgccagaacgcccaccaggagtttagattttggccatttttggtcataatcgtgatactctccgcactgtttctcggcacactcgcgtgcttttgtgtttggagaagaaagcggaaggaaaaacaaagcgaaacctcaccgaaagaatttctcacaatctacgaagatgttaaggatctaaaaactcgccggaatcacgaacaggagcagacatttccaggcgggggcagcactatctatagcatgatccaatcccaaagctcggctccaacgtcacaggaaccagcatacacattgtactccttgattcagccatcaaggaagagtggcagtagaaaaagaaaccattccccatccttcaattcgaccatttatgaggtgatcggaaaatcacagccaaaggcccagaacccagcccggctctccagaaaggagttagaaaatttcgacgtgtatagttag

SEQ ID NO: 182100 - DNA, 495 bp, Artificial Sequence
  Description of Artificial Sequence: Synthetic coding sequence
atgaagtggaaggccctgttcaccgccgccatcctgcaggcccagctacccatcactgaagctcagtccttcggactcctagacccgaaactatgctacttgcttgatggcatcctgtttatttacggagtgatcttgaccgctctgtttctgagagttaaattctccagatcggccgacgccccagcctatcagcagggccagaaccaactatacaacgaactcaacctagggaggagagaagaatatgatgttcttgacaaacgccggggtcgggatccagagatgggcggtaagccacagcggcgaaaaaacccacaggaagggctctacaacgagctccagaaagataagatggcagaagcctattccgagattggaatgaaaggggagaggcgccgggggaaggggcacgacggcttgtaccagggactatctacagccactaaagacacgtatgacgcactgcacatgcaggcgctgccgcccagatag

SEQ ID NO: 182101 - DNA, 492 bp, Artificial Sequence
  Description of Artificial Sequence: Synthetic coding sequence
atgaagtggaaggccctgttcaccgccgccatcctgcaggcccagctgccaatcacagaagcccagagtttcggtctactggaccctaagttatgctatctgctcgacggcatcttgtttatatacggcgtgatcctgaccgcactgttccttcgggtgaagtttagtcggagcgctgatgcccctgcatatcagcaggggcagaatcagttgtataacgaactcaatctgggccgcagagaggagtacgatgtgctggacaaacggcgaggccgggatcccgagatggggggcaagccccggcggaaaaacccccaggaagggctgtataatgagctccaaaaggacaagatggcggaagcttactccgagatcggcatgaaaggcgaaaggaggcgagggaagggacacgatggcctgtaccagggcctcagcactgccaccaaggatacctatgacgctcttcacatgcaggctctacccccaagatag

SEQ ID NO: 182102 - DNA, 2274 bp, Artificial Sequence
  Description of Artificial Sequence: Synthetic coding sequence
atgctgctgcggctgctgctggcctgggccgccgccggccccaccttgggccaggacccttgggccgcagagcctcgagcggcatgcggaccgagtagttgctatgccttgtttcctagacggcggacttttttggaagcctggagagcctgcagggaactgggaggggaccttgccacgcctaggactcccgaggaggcccaaagggtggacagcctcgtgggtgctggaccggcctcacgccttctgtggatcggactgcagcgacaagccaggcagtgtcaattgcagcggccacttagaggttttacctggaccaccggggatcaggatactgcattcaccaattgggcgcagccggccagtgggggaccatgccccgcgcaaagatgtgtggccttggaggcgagcggagaacatcggtggttagagggttcttgtaccttagcagtggatgggtatctttgccagtttggctttgagggtgcctgtcctgccctgcaggacgaggctggtcaagctggccccgcggtatacaccaccccctttcatctggtcagtacagagttcgaatggctcccatttggctccgtggccgctgtccagtgccaagcaggaaggggggcctcgctcctgtgcgtgaaacaacctgaggggggggtcggctggtccagagccggtccgttatgtctaggcaccggctgcagcccagataacggtggctgcgaacacgaatgtgtcgaggaggtcgatggtcacgtgtcttgccggtgtaccgaggggttcagattggccgccgatggaaggtcttgcgaagatccctgtgctcaagccccctgtgagcagcagtgcgagccggggggcccacagggctatagctgtcattgtcgcctcgggtttcgaccagccgaagacgacccccatcggtgcgtcgataccgacgagtgtcaaatcgcgggagtctgccagcagatgtgcgttaattacgttgggggctttgaatgttattgttctgaagggcacgagttagaagctgacgggattagctgttctccagcaggagcaatgggggcacaagcaagtcaagacctcggggacgagctgctggacgacggagaggacgaggaagacgaggacgaagcttggaaagcattcaacggtggctggactgaaatgccgggcatcctatggatggagcctactcagcctcccgacttcgccctcgcttatcggcccagtttccctgaggaccgtgaacctcagatcccatatccagagcccacatggcccccacccttatctgcgccaagagtgccataccacagttccgtactgagcgtcacccgccccgtagtagtttccgccactcaccctaccctgcccagcgcgcatcaacctcccgtgattccagctacgcaccccgcactgagtcgggatcaccaaatccctgtaatagccgccaactacccagatctccctagtgcttaccagcctggcattctctctgtgagccacagtgcccagccccccgcccaccagccacccatgatttcaactaaatacccagaactgtttcctgcccaccaaagccctatgttccccgatacgcgcgtcgctgggacacagaccacaacacatctgcctggcataccgcccaatcatgcgccactggttactaccttgggcgcacagcttcctccccaggcgcctgacgcactcgtgttacggacacaagcaacacagctgccaatcattcctaccgctcagccctctctcaccaccacctcccggagcccagtctcacctgcccaccagatcagcgttcccgccgcgactcaacccgctgccctgccgacactcctcccttcccagagcccaactaatcagacatcccctatctctcccacacatccacattccaaagctccacagatcccccgggaagatggacccagtcccaagttggccctgtggcttccaagccccgcaccgacagcagctcctacagctctgggcgaggccgggctggccgaacattctcaacgagacgatagatggttgctggttgcacttctcgtcccaacatgcgtctttctggtcgtgctgttggccctgggcatagtctactgtactcgctgcggtccccatgctcctaacaagagaataactgattgttaccgctgggtgatccacgcgggatctaagtctccgaccgagcccatgccaccaaggggatccctgacaggagtacagacatgccggactagtgtgtag

SEQ ID NO: 182103 - DNA, 951 bp, Artificial Sequence
  Description of Artificial Sequence: Synthetic coding sequence
atgctgcggcggcggggcagccccggcatgggcgtgcacgtgggcgctgccctaggtgcgctgtggttctgcctcaccggggccctggaagttcaggtacccgaagaccctgtcgtggcccttgtgggtacagacgcgaccttgtgctgcagcttctcccctgaaccaggcttcagcctggcccagttgaatctgatatggcagctcactgacaccaagcagctagtgcacagcttcgccgaaggccaggatcaaggtagcgcttacgccaaccggaccgcattgttcccagatttattagcgcagggcaatgcaagcctgaggctgcagcgagtgcgggtagccgatgagggtagctttacctgctttgtatctattcgggactttggctcagctgctgttagcctccaggtggcagcgccgtatagtaaaccatctatgactcttgaacccaataaagatttgcgccctggtgacaccgtcactatcacatgctctagctaccgaggctacccagaagcagaggtgttctggcaggacgggcagggtgtgccgctaacggggaacgttaccacatcgcagatggcaaatgagcaggggttgtttgatgtgcacagtgtgctgagggttgtgctgggcgcaaacggtacatacagctgtctcgtcagaaatccagtgctgcaacaagatgcccacggctcagtcaccattacaggtcaacccatgactttcccaccggaagccctctgggtcaccgtgggcttgtcggtgtgtctgattgcactgctagtcgcccttgcctttgtctgttggaggaagatcaagcagagctgtgaagaagaaaatgccggtgccgaggaccaggacggagaaggagagggcagcaagaccgcattgcagccactgaagcactcagactcaaaggaagatgatggccaagaaatcgcctag

SEQ ID NO: 182104 - DNA, 1605 bp, Artificial Sequence
  Description of Artificial Sequence: Synthetic coding sequence
atgctgcggcggcggggcagccccggcatgggcgtgcacgtgggcgcagcactgggcgcgttatggttttgtctgacaggcgcccttgaggttcaggttcctgaagaccctgtcgtggctcttgtggggacagatgccaccctctgctgcagtttttcccctgagcccgggttctcgctggcccagcttaacctgatctggcagttgacagacaccaaacagctcgtgcactcattcgcggagggacaggaccaaggatccgcctacgctaatcggactgctctgttccctgatctcctggcccagggtaacgccagtctcaggcttcagcgagtgcgagtggccgacgagggctctttcacctgcttcgtttctattcgcgattttggtagtgctgcagtaagtctgcaagtggccgctccgtactccaaacccagcatgacactcgaaccaaacaaagatctccggcccggcgacacggtgactattacttgctcttcttatcagggctaccccgaggcagaagtcttctggcaggatggtcaaggcgtgccactcacggggaacgtcactacaagccaaatggccaatgagcagggcctgttcgacgtccactcgatcctacgagtcgttctgggggccaacggtacttattcctgtttggtccgtaatcccgtcctgcagcaggacgcacacagctcggtgactatcacgcctcagaggtctcctactggggctgtggaagtgcaagtccccgaggatcctgtggtagctttggtcggaacggacgctaccttgcgttgctctttctcaccagagccaggcttttctctcgctcaactcaatctgatctggcagctcacagataccaaacagctcgtccacagcttcacagagggaagagatcagggaagtgcttatgctaaccggaccgccttgtttccggacttgcttgcccaggggaatgctagcctgcgcctccagcgagtgcgtgttgccgatgaagggtcttttacatgctttgttagtattcgcgactttggctctgccgcggtaagcctgcaggtcgcggccccttactcgaagccatcgatgactcttgagcctaacaaggatctgagacctggcgacacggttacaatcacctgcagttcctatcgagggtatcctgaggcagaggttttttggcaggacggacagggcgtgcctctgaccggcaacgttaccacctcccaaatggctaacgaacagggcctcttcgacgttcactccgtactgagagtcgttctgggggccaacggaacatattcctgcctggtcaggaatcccgtgttacagcaggatgcccatgggtcagtcacgattaccgggcagcccatgacttttcccccagaggccctttgggttaccgtgggtctttctgtgtgcctcattgccctcctcgttgcgctggctttcgtgtgctggcgcaagataaagcagtcatgcgaggaggaaaacgccggcgccgaggaccaggatggcgaaggtgagggatcaaaaaccgccctgcagccgctaaagcactccgactcgaaggaggatgacgggcaggaaatagcctag

SEQ ID NO: 182105 - DNA, 1482 bp, Artificial Sequence
  Description of Artificial Sequence: Synthetic coding sequence
atgctgcggcggcggggcagccccggcatgggcgtgcacgtgggcgccgccctgggcgcgctgtggttctgtttgaccggcgctctggaggtgcaggtgccggaggatcccgtcgttgcactggtgggaactgacgccaccttatgttgttctttcagccctgagcccggtttttccctggctcagttaaatttgatttggcagctgacagatacgaagcagctggtgcatagcttcgctgaggggcaggatcaggggagtgcttacgcaaatcggacagccctctttccagacctcctcgcccaaggaaacgcttctttgcgccttcagcgcgtgcgagtcgctgatgaggggtccttcacttgcttcgtcagtattcgcgacttcgggtcagccgccgtctcactccaggtcgcagccccctatagcaagccgtccatgactttggagcctaataaagatcttcgtccaggtgataccgtgacaatcacttgctctagctaccaggggtatcctgaagcggaagtgttttggcaagatggacagggggtgccgctcactggaaacgtgaccacctcgcagatggccaacgaacaaggactgtttgatgtccattccatcttgcgcgtcgttcttggggctaacggaacctattcatgcctcgtgagaaaccctgtgctgcaacaagacgcacatagctccgtgacaatcacccctcaaaggtcccctactggcgctgtcgaggtgcaagtacccgaggaccccgtcgtcgccctggttggaacagatgccaccctcagatgttctttctcaccagagcccggattctccctggcccagcttaacctgatctggcagctaaccgacactaagcagctggtccatagtttcaccgaaggcagggaccaagggagcgcctacgctaacagaactgccttgttccccgacctgttggctcaagggaatgcgtccctgcgcttgcagcgggttagggtagctgacgaaggtagcttcacctgtttcgtttctatacgggacttcggatctgcagccgtttcgctccaggttgctgccccatattcgaaaccgtctatgaccttggagcccaataaagatttacgtccaggggatacagtcacaatcacctgttcctcttatagagggtaccccgaggcggaggtcttttggcaagacggccaaggggtccccctgaccgggaatgtgactacatcacagatggcaaatgagcaggggctgttcgatgtccactctgttttaagagtggtcctgggagccaacggcacatactcatgtctggtgaggaaccccgtgctgcagcaggatgcacacggatcagtcacgattacaggacagcccatgaccttcccccccggtcctgcatcttccgcagtcccgctgtccccagcacatcctcctcatggctcaatgtgttggtcccattggttttcaagaggactgtag

SEQ ID NO: 182106 - DNA, 423 bp, Artificial Sequence
  Description of Artificial Sequence: Synthetic coding sequence
atgctgcggcggcggggcagccccggcatgggcgtgcacgtgggcgctgccttgggtgccttatggttttgtttaaccggggccttggaggtgcaggttccagaggatccggtcgttgcccttgtgggaaccgatgctactctctgttgttctttctcacctgaaccagggtttagcctggcacaattaaatttgatctggcagctgacagatacgaaacagcttgtccacagctttgccgaaggtcaggatcagggatccgcttatgccaatcgaacagctctcttcccagatctgcatagagccgcgtatgacatccccccccggggcccagtgggcgatcgtggagctgtctgcctgagccactgcaccgccggggggccgggatttcgggtcctcgaaaaggaccagaccgagctgtag

SEQ ID NO: 182107 - DNA, 411 bp, Artificial Sequence
  Description of Artificial Sequence: Synthetic coding sequence
atgctgcggcggcggggcagccccggcatgggcgtgcacgtgggcgctgcactgggagccctgtggttttgtctgaccggtgcactagaagtgcaggtgccagaggatcccgtagtcgctctggtcgggactgacgccaccttatgctgctcattttcacctgagccggggttttcacttgctcagttaaacttgatatggcagctgacagacacaaaacagctggtgcactcattcgcagaaggccaggaccaggggagcgcttacgccaatagaactgcactgttcccagacctgctggcacagggcaacgcatcactgcgcctccagcgtgtgagagtcgccgacgaaggctccttcacctgttttgtgtcgattcgtgattttgggagtgcagcggttagcctctag

SEQ ID NO: 182108 - DNA, 402 bp, Artificial Sequence
  Description of Artificial Sequence: Synthetic coding sequence
atgctgcggcggcggggcagccccggcatgggcgtgcacgtgggcgccgccctaggggctctgtggttctgccttaccggcgcgctggaggtgcaagtgccagaagatcctgttgtagccctggtgggaaccgatgctacactgtgctgcagtttctccccagagcctggcttcagcctcgcgcagctgaatctcatctggcagctcacggataccaagcagcttgtgcactcatttgctgagggccaagatcaaggcagcgcttatgctaaccggactgccctgttcccagacttattggcgcaaggcaacgctagtctccggctgcagcgcgtacgggtcgctgatgagggatccttcacttgcttcgttagcatccgtgacttcgggtctgcagcatag

SEQ ID NO: 182109 - DNA, 1602 bp, Artificial Sequence
  Description of Artificial Sequence: Synthetic coding sequence
atgctgcggcggcggggcagccccggcatgggcgtgcacgtgggcgccgcactgggggccttgtggttttgtctaaccggtgcccttgaggtgcaggtccctgaggatcctgtcgttgctctggtgggcacagacgctaccctttgttgttctttctcccccgagcccggtttctctctcgcccagctcaatcttatttggcagctcaccgacacaaagcagttagtacatagcttcgccgagggacaggatcagggctccgcgtacgccaaccgcacggccctgttccccgacctgctcgcacaagggaatgcttcgcttaggctgcagcgagtaagggtcgctgacgaaggatctttcacatgctttgtgtcgatcagagacttcggatctgccgcagtgagtctgcaggtggcggccccctacagtaaaccctcgatgacgctggagcccaacaaagacctccggcccggagatacagtgaccatcacgtgcagctcatatcaggggtatccagaggcggaggtgttctggcaagacggccagggcgtcccattaacagggaatgtgactacttctcagatggccaacgaacaggggctgttcgatgtccattctattttgcgcgttgtgttgggagcaaacggaacgtacagttgccttgtgcgcaaccccgttctgcaacaggatgcccattcaagcgtcaccatcaccccccagaggagccccaccggcgcagttgaggtccaggtcccagaagacccagtggtcgctcttgtgggtactgacgcgaccctgcgttgttcattctcccccgaacccggattctcactcgcccagctgaacctgatttggcagctgactgacacaaagcagttggtccactcttttacagagggacgagatcagggctccgcctatgcgaacaggacagcgctgtttccagatcttttagcccagggtaacgcatcgctgcggttacaaagggttcgtgtagcagacgaggggagctttacatgcttcgtatcaattcgagactttgggagcgcagcagtgtctctgcaagtcgccgcgccatattctaagccctctatgacactggagcccaataaagacctgagacccggcgacacagtgactataacatgtagcagctaccgcggataccctgaagcggaagtattttggcaggacgggcagggagtgcctctgaccggcaatgtgactacaagccagatggccaatgaacagggattgtttgacgttcactccgtcctccgcgtggtgctcggtgccaacggtacctacagctgcttggtgcggaaccctgtgctacagcaggatgctcatggttcagttaccatcaccggtcagcccatgacattccctcccgaagccctatgggtgacagttggcttgtcagtctgcctcattgcccttctcgttgctttggctttcgtatgctggagaaagatcaagcagtcttgtgaggaggaaaatgccggggctgaagaccaggacggcgagggcgaaggcagcaagacggcactgcagcccttgaagcattccgattctaaagaaggcaaggacacctgggcctag

SEQ ID NO: 182110 - DNA, 498 bp, Artificial Sequence
  Description of Artificial Sequence: Synthetic coding sequence
atgctgcggcggcggggcagccccggcatgggcgtgcacgtgggcgcggcgctgggggcattatggttctgcctgacaggggctcttgaggtccaggtgcctgaagacccggtggtggcactggttgggactgacgccaccctctgctgctccttctctcctgagccaggtttttctctggctcagctgaacctgatttggcaattgactgataccaagcaactggtgcactcttttgctgaaggacaggatcagggctctgcttatgctaatagaactgcattattccccgatctgctggctcagggcaatgcctcacttcggctacagagagtcagggtagctgacgaaggaagcttcacatgtttcgtgagcatccgtgacttcgggtccgccgccgtaagtctgcaggtggccgcaccttacagcaaaccatcaatgacattagaaccaaataaagatctccgtcctggcgataccgtgacaataacttgctag

SEQ ID NO: 182111 - DNA, 156 bp, Artificial Sequence
  Description of Artificial Sequence: Synthetic coding sequence
atgctgcggcggcggggcagccccggcatgggcgtgcacgtgggcgccgcccttggggcactatggttctgcctaaccggagccctggaggtgcaggtgcctgaggatcctgtggtggcgcttgtgggtactgatgcaaccctgtgttgcagctag

SEQ ID NO: 182112 - DNA, 663 bp, Artificial Sequence
  Description of Artificial Sequence: Synthetic coding sequence
atgctgcggctgctgctggccctgaacctgttccccagcatccaggtgactggcaacaaaattcttgttaagcagagccctatgctggtggcctatgacaatgcggtgaatttgtcctgtaaatattcatacaatttgttttctagggaattccgcgcttccctacacaaggggctggacagcgcggtggaggtctgcgtcgtgtacgggaactattcccagcagttgcaggtctactcgaagaccgggttcaactgcgacggaaaactggggaacgagtctgtgaccttttatctccagaatctttacgtgaaccagacagacatctatttttgcaaaattgaggttatgtatcccccaccatatctggataacgaaaagtctaatggcacaatcatacacgtaaagggaaaacatctgtgtcctagccccttgttccccggaccttcaaagcccttctgggtgctggtcgtcgtgggcggagtgttggcctgttactccctgctggttacagtggcatttattatcttctgggtccgctctaagcgctcccgcttactccattccgattatatgaacatgacaccacggaggcccggtcctactcggaagcattaccagccatacgccccaccccgggatttcgcggcctaccgctcatag

SEQ ID NO: 182113 - DNA, 306 bp, Artificial Sequence
  Description of Artificial Sequence: Synthetic coding sequence
atgctgcggctgctgctggccctgaacctgttccccagcatccaggtgaccggaaaacatttatgtccctcccccttgtttccgggaccatccaaacctttctgggttttagttgtggtagggggggtgctggcatgttacagcctgcttgtcaccgtggcttttatcatcttctgggtgcggtcgaagcggtcgagactcttgcacagcgattacatgaatatgactcctagaagaccggggcccacgcgcaagcattatcaaccctacgctccgcctagagatttcgcggcctaccgcagttag

SEQ ID NO: 182114 - DNA, 411 bp, Artificial Sequence
  Description of Artificial Sequence: Synthetic coding sequence
atgctgcggctgctgctggccctgaacctgttccccagcatccaggtgacaggaaacaaaatcttagtcaaacagagccctatgttggttgcttacgataatgctgtgaacctcagctacaacgaaaagtctaatgggaccatcattcacgttaagggcaagcacctctgccctagcccgctgtttcctggcccctcaaagccgttctgggtgctggtcgtcgttggaggcgtccttgcttgttactctcttctggtgactgtagcgttcattatcttttgggttcgatctaaacgctcccgcctgctgcactccgattatatgaacatgacacctagacggccaggccccacaagaaagcattaccagccctacgcccccccccgggacttcgccgcctacagatcctag

SEQ ID NO: 182115 - DNA, 705 bp, Artificial Sequence
  Description of Artificial Sequence: Synthetic coding sequence
atgccctgcggcctgagcgccctgatcatgtgccccaagggcatggtggccgtcgtggtggctgtggacgacggtgacagtcaggcattagccggaaacaaaattctcgtgaagcagtcaccgatgttggttgcctacgataatgccgtgaatctttcttgcaaatacagctacaatctctttagcagggagttcagagcctccctgcacaaggggctagactcagcagtagaggtgtgcgtggtgtatggcaattattcccagcaactccaagtctattctaaaactggctttaactgtgacgggaagctcggcaacgaatcagtcaccttttaccttcagaacttgtacgtgaaccagacagacatttacttttgcaaaattgaagtgatgtatccgccgccttacctggataatgagaaatctaatgggacaattatccatgtgaaaggtaaacacctgtgcccatcacctctgttcccagggccatcgaaacctttttgggtgctcgtcgttgtcgggggtgtgcttgcttgctattctttattggtcaccgtcgctttcatcatcttctgggttcggtccaaaagatcacggctgctgcattcagattacatgaacatgacacccagaaggcctggacctactaggaagcactatcagccatatgccccacctcgcgattttgctgcttataggagttag

SEQ ID NO: 182116 - DNA, 1920 bp, Artificial Sequence
  Description of Artificial Sequence: Synthetic coding sequence
atggtggactacatcgtggagtacgactacgacgccgtgcacgacgacgaactgaccattcgtgttggggagatcattcgcaacgtgaaaaaactgcaagaggagggctggctggagggtgagttaaacggtcgtagagggatgttcccagataattttgtcaaggagatcaagagggaaactgaattcaaagacgactcgctgccaattaaacgggagaggcacggcaacgtagctagcctcgtacagcgaatttccacctacgggctcccggccggtggcatacagccccatcctcagacgaagaatatcaaaaaaaaaactaagaagcggcagtgcaaggtgttattcgagtatattccccaaaatgaggatgaactggagctcaaggtgggggacattatcgatatcaatgaggaagtcgaggagggctggtggtcaggtacattgaacaacaaactgggcctctttccctcaaactttgtgaaggaactagaagtgaccgacgacggcgaaacacatgaagctcaggatgattctgaaaccgtgttggccgggccaacatctccgattccaagcctgggcaacgtgagcgaaaccgccagcggctcagtgacacagccaaagaagatccgtgggatcgggtttggtgatatttttaaggagggctctgtgaaactgaggacccggacttcctcatcagagactgaagagaagaagccagaaaagcccctcattctccaaagtctcggcccaaagactcagagtgtagagattactaaaacggatacggaaggaaagatcaaggcaaaagaatattgtaggacactttttgcatatgagggcacaaacgaagatgaactcactttcaaagaaggggagatcattcacttaatttccaaggagacaggcgaagcaggctggtggcggggcgagctgaacggtaaagaaggggtctttcccgacaactttgctgtccaaattaatgagctggataaagacttccccaaacccaagaagccaccccccccagcgaaagctccagctccaaaacccgagctgattgccgctgagaagaagtacttctcactgaagcctgaagagaaggatgaaaagagtaccctggagcagaaacccagcaagcccgcagcccctcaggtaccacctaagaagcccacaccccccaccaaagcaagtaatctcctgcggtccagcggcacagtgtacccaaagaggcccgagaagcccgtgccaccaccacctccgatagctaaaattaatggtgaggtttcttcaatttcttccaaatttgagaccgaacctgtgagcaagctgaagcttgattcagagcagctgccactgaggcccaagtccgtggacttcgacagtcttacggtgaggacatcaaaagaaacagacgtcgttaactttgatgacatcgccagctcagaaaaccttcttcacctgaccgctaaccggcctaagatgccagggcggcgcttgcccgggaggttcaatggcggtcatagccctacccactcacctgaaaaaatcctgaagctccccaaagaagaggactctgctaatctgaaaccgtcggaactcaagaaagatacttgctactctcccaagccctccgtgtacttaagcacccctagcagcgcaagtaaggccaacaccacagcctttctgacacctctggagatcaaggccaaggtggaaaccgacgatgtgaagaagaacagcctggatgaactccgggcacagattatagagctcctgtgcattgtcgaggcgctgaaaaaagatcacggcaaagagcttgagaaactgaggaaggacctggaagaagaaaagacaatgcgatccaatctagagatggagatcgaaaagctaaagaaagctgtgctgagttcatag

SEQ ID NO: 182117 - DNA, 717 bp, Artificial Sequence
  Description of Artificial Sequence: Synthetic coding sequence
atgtgccggcggtgcaagcccgagctgcggcagaacttccagagcgcatcaggtatctgcatttgccactggctccagatccgcagaacaaggagccgcgaaggaagagccatgtggttgccacccgcacttcttttgctgtcattaagcggctgcttctctattcaaggccccgaaagtgtacgggctccggaacaaggtagtctgactgtccaatgccattacaagcaaggctgggaaacctacatcaaatggtggtgccgtggtgtacggtgggacacttgcaagattctcatcgaaactcggggttctgaacagggagagaagtctgatagggtcagcatcaaagataaccaaaaagatagaaccttcaccgtcaccatggaaggcctacggagggatgacgctgatgtctactggtgtggaatagagcgtagggggccagacctggggactcaggtaaaggtcattgtcgatcccgagggagccgcgagcaccaccgcatcgtcccctactaattcgaatatggcagtcttcattggatcccataagaggaatcactacatgcttttggtatttgtcaaagtgcccatcttactgatcctggttactgccatattgtggctgaaggggtcacagcgcgtgccggaagaacccggtgagcagcctatttacatgaatttcagcgagccgctaacgaaggacatggctacttag

SEQ ID NO: 182118 - DNA, 606 bp, Artificial Sequence
  Description of Artificial Sequence: Synthetic coding sequence
atgtggctgccccccgccctgctgctgctgagcctgagcggctgcttctccatccagggaccagaatctgtgcgggcacctgaacaaggaagcctaactgttcagtgccattacaagcaggggtgggagacatatattaagtggtggtgccgcggagtcaggtgggatacatgtaagatccttatagagactaggggctctgagcagggtgagaagagtgatcgtgtttctatcaaagataaccaaaaggatcggaccttcaccgtcacaatggaaggcctcagacgtgacgacgctgacgtttattggtgtggaatagaacgcaggggacctgatcttggcactcaagtgaaggtaatagttgatccggaaggagccgcatcgacaacagcctccagtccaactaattcaaatatggccgtgtttataggctcccacaaacggaaccattatatgctcctagtgtttgtgaaggtgcccatccttctgatccttgtgaccgctattctctggctaaagggaagccagcgcgtgcccgaagaacctggagaacagcctatctatatgaatttcagcgaaccactgacgaaggacatggctacatag

SEQ ID NO: 182119 - DNA, 735 bp, Artificial Sequence
  Description of Artificial Sequence: Synthetic coding sequence
atgcccctgctgaccctgtacctgctgctgttctggctgagcggctactcaatagtaacccaaattaccgggcccacaaccgtgaatgggctggagcgcggatcactgactgttcagtgcgtctatcggtctggttgggaaacctatctgaagtggtggtgccgcggagcgatctggagagactgcaagatattggtaaaaacctccggcagcgagcaagaagtgaagagagaccgggtctctataaaagacaaccagaaaaatcggactttcaccgtaactatggaagatttgatgaagaccgatgcggatacctattggtgtggcattgagaaaactggcaatgacctcggcgtgaccgtacaggttaccatagatcccgccccggtgacacaggaagaaacttcctctagtcccactctcaccgggcatcatctggacaacaggtcggaggggtcacaagctgccaattatcgcccagcggcccaccaagcgcaggctcctgaggcgcagtgtccaccagccccacacctacaccatatcgctgccgcattcggaggacgattgaccctggggttagaggatgacgaagtgcctgcggagtctagtcgcgatgtgccgcgtgctggaaccgcggctcctggagggaggcctctcctgtgccggcctgaccctgctgctggacgaaatctcccagccaagggttatcacgaggcattcctgtgccctgggtag

SEQ ID NO: 182120 - DNA, 873 bp, Artificial Sequence
  Description of Artificial Sequence: Synthetic coding sequence
atgcccctgctgaccctgtacctgctgctgttctggctgagcggctactcaattgttacccagatcactggaccaacaacggtcaacggactcgaacggggctccctgacggtccagtgcgtgtatcgatcgggctgggagacctacctgaaatggtggtgtcgtggagctatatggagggattgcaaaatcttggtcaagactagcggcagcgaacaggaggtgaaaagagaccgggtcagtattaaggacaatcagaagaaccggacctttaccgttactatggaagacttgatgaagaccgacgccgacacctattggtgtgggatcgaaaagaccggcaatgaccttggggtgactgtgcaagtgaccatagatcccgccccggttacgcaggaagaaacaagcagttcgcctacactaaccggacaccacctggataacagacacaaactgttgaagctgtctgtactgctcccccttattttcacgatcctgctgctgttgctggtcgccgcttctctgctagcctggcgcatgatgaaataccagcaaaaggctgccggcatgtcgcctgagcaggtgctccagccactggagggtgatctgtgttatgccgacttgaccctccagctggcaggcacaagtccccaaaaggcgactacaaaactgtcctctgcacaggtcgatcaggtggaagtagagtatgtcaccatggcctcattgcccaaagaagacatttcctacgcttctctgacgctcggcgctgaggaccaggaacctacatattgtaacatgggtcacctttcctcacacctcccgggccgagggccagaagagcctactgaatactcaactatcagtcggccatag

SEQ ID NO: 182121 - DNA, 585 bp, Artificial Sequence
  Description of Artificial Sequence: Synthetic coding sequence
atgtggctgccccagctggacctgatgcgggtgatcagcgccaagagtcagggctattcaatagtgacacagataacgggaccaacaaccgttaacgggctggaacgtggctccttaaccgtgcaatgcgtgtaccgctctggctgggagacatacctcaaatggtggtgccggggcgcaatatggagggattgcaaaatcctggtgaaaaccagcggatccgagcaggaggtgaagcgggatcgagtgagcatcaaggacaaccaaaagaatagaacctttaccgtcacgatggaggacctaatgaagacagacgctgatacctactggtgcgggatcgagaagaccggaaacgacctgggagtgacggtgcaggtgaccattgatccagcaccagtcacgcaggaggaaacgtcaagcagccccacccttacgggtcaccacctggataactcctcacgcgacgttccacgcgcaggaacagccgcccccggggggaggcccctgctgtgtagaccagaccctgccgccggccgaaacctcccagcaaaggggtaccatgaagcttttttatgccctgggtag

SEQ ID NO: 182122 - DNA, 720 bp, Artificial Sequence
  Description of Artificial Sequence: Synthetic coding sequence
atgtggctgccccagctggacctgatgcgggtgatcagcgccaagtctcagggctattcgatagtgacacagattaccggccctactacagtgaacggtctggaacggggatccctgaccgtacagtgtgtgtaccgatctggctgggagacctatctgaagtggtggtgcaggggagccatatggagggactgcaagattctcgttaaaacatccggctccgagcaagaggtcaaaagggaccgcgtgagtattaaagataatcaaaagaaccgcaccttcactgtgacaatggaagacctcatgaagacggacgctgacacctactggtgcggtattgaaaaaaccgggaatgatctcggggtcacggtgcaagtcaccatcgaccctgcaagcactccagcccccacgacacctaccagcacaactttcacggcccccgttacgcaggaagagacctcaagcagtcctacgctgacagggcaccatcttgacaatcgtcataagctcctgaagctgtcagttctgctccctctgattttcacaatccttctgttgctgctggtggcagcctccctgctggcgtggaggatgatgaaataccaacagaagggaacagccgcaccaggcgggcgacctctgctctgccgaccagatccagcagcagggaggaacttgccagccaaaggatatcatgaggcctttctgtgccctggttag

SEQ ID NO: 182123 - DNA, 699 bp, Artificial Sequence
  Description of Artificial Sequence: Synthetic coding sequence
atgctgcgggccgccctgcccgccctgctgctgcccctgctgggcctggcggccgccgctgtcgccgattgtccgtcttccacatggatccagtttcaggatagttgctatatttttctgcaagaggcaatcaaggtcgaatccattgaggatgtccgcaatcaatgcactgaccatggcgcagatatgatctcgatacacaacgaggaagaaaacgctttcattctggatactcttaagaaacagtggaagggcccagacgacatcctcttgggaatgttttatgatacggacgacgcttctttcaagtggttcgataatagcaacatgactttcgacaaatggacagatcaggatgatgatgaagaccttgtggacacctgtgcttttctgcatattaagaccggggaatggaagaaaggaaattgcgaggtaagctcggtggagggcacattatgtaagaccgctattccgtacaagcgcaaataccttagcgataatcacattctcatctccgccctcgtcatcgcttccactgttattttaaccgtgcttggagccataatctggtttctgtacaaaaagcatagcgattccaggttcactacagtattttctactgccccgcagagcccatataacgaggactgcgtgctggtcgtgggcgaagaaaacgaatatccagtgcagtttgattag

SEQ ID NO: 182124 - DNA, 525 bp, Artificial Sequence
  Description of Artificial Sequence: Synthetic coding sequence
atgctgcgggccgccctgcccgccctgctgctgcccctgctgggcttggcagcagctgccgtggctgactgtcccagctcaacttggatacagtttcaggattcatgttatatttttctgcaagaggctattaaagtggagagtatagaggacgtgcgcaaccagtgcactgaccacggggcggacatgattagcattcataacgaggaagaaaatgcgttcattttggatactcttaaaaagcagtggaaaggacctgatgacatactcctcggaatgttttacgacacggacgtaccatataagcggaaatacctctccgataatcatattctgatctctgccctggttattgctagtacagtcattctgaccgtgctgggagcaatcatttggtttctctataagaagcacagcgattcaagattcaccacagtgttctccacggcccctcagagcccctacaacgaagattgtgttctagtggttggagaagagaatgagtacccggtgcagtttgactag

SEQ ID NO: 182125 - DNA, 849 bp, Artificial Sequence
  Description of Artificial Sequence: Synthetic coding sequence
atgagcggcggctggatggcccaggtgggcgcctggcggaccggcgcgctgggcctcgcccttctccttctgttagggcttggcttaggtctggaagccgcagcttcccccctcagcactccaaccagcgcgcaagctgcagggcctagctccgggagttgcccgcctaccaaattccagtgtcgcactagtggtctgtgcgtgccactgacctggagatgcgacagggacttggactgttcagatggtagcgatgaggaagagtgtaggatcgagccttgcacacagaagggacaatgtccaccacctccagggttaccgtgcccctgtaccggtgtgtctgactgctccggcggaacggataagaaactccgaaattgttcccgattggcttgcttggctggagagctgcgatgcaccttgtccgacgactgtatccccttgacatggcgctgcgacggccatcctgactgtcccgacagctccgacgaactcgggtgtggcacaaacgaaatcctccccgaaggcgacgccaccaccatggggccaccagtcacactggagtccgtgacatcactgcgcaatgccaccaccatgggcccacccgtgacattggagagcgttccctctgtcggcaacgccacatcatctagtgctggggatcagtctgggtcccccactgcctacggcgtcattgccgcggctgccgtgctgagtgccagcctggtgacggctactctgctgctactgtcctggctccgtgctcaggagcgcctgaggcctttaggtctcttggtcgccatgaaggaaagcctgctcctgtcagagcagaaaactagcctaccgtag

SEQ ID NO: 182126 - DNA, 606 bp, Artificial Sequence
  Description of Artificial Sequence: Synthetic coding sequence
aacgagatcctgcccgagggcgacgccaccaccatgggcccccccgtaactctggaaagcgtgacttccctgcgaaatgcgacaacgatggggccaccggtaacactggagagcgttccaagcgtgggaaacgccattcttctctgccggagaccggtttggaagccgaactgtctgtggggttactgctcctgctgtggtgcacagtgcaaacctggccaccgccaccctccaccctttgtcctcgccccctctcccggtgccccaccacccaccggagtaacagggggccacgaaggggttcctgcggccgttagaacagaagatctcgccgccttgcgcacctctacttgccatcaccgacatagcgcactcggcgttgcgggccaggaggagtctagcgacgctgatggatatccgggcacacctgcattacgggacctgtctagcagtggccacgtggagcctcgcacgagagctcctgcagaggtggcattggagattgagggaccttggacgttaccaatggagataaggggagctaggatggggaatttgccacagccggaacttcgtggctggccccaggctgcccctcggggatag

SEQ ID NO: 182127 - DNA, 723 bp, Artificial Sequence
  Description of Artificial Sequence: Synthetic coding sequence
atgagcggcggctggatggcccaggtgggcgcctggcggaccggcgccctcgggctggccctgctgcttctgctaggactgggactcggacttgaggctgcggctagcccattgagcacacccaccagtgcccaagctgctgggattgagccttgtacccaaaaaggtcagtgtcctcctcccccaggacttccctgcccctgtaccggcgtttccgattgctcggggggaacggacaagaagttgaggaattgtagccggctcgcctgtctggccggagagttgcggtgcacactctccgatgattgcattccgctcacatggcgctgtgacggacaccctgattgcccagattctagcgatgagctgggctgcggtacaaatgaaattctccccgagggagacgccaccacgatggggcctccagtgaccctggaaagcgtcacgtccttgcgaaatgcaacgactatgggcccaccggtgacgctagagtctgtgcctagcgttggcaacgcgactagtagtagcgctggagaccagtcaggatcccccaccgcgtatggagtgatcgcagctgccgcagtcctgtctgctagtctcgtaaccgccaccctcctgttgctaagctggttgagggcgcaggagagattaagacccttgggactgctggttgctatgaaagaaagccttctcttgtctgagcagaaaacgtcactcccctag

SEQ ID NO: 182128 - DNA, 1095 bp, Artificial Sequence
  Description of Artificial Sequence: Synthetic coding sequence
atgcccctgctgctgctgctgcccctgctgtgggccggcgccctggccatggatcccaacttttggctgcaagtacaagagagtgtgacagtgcaggaaggcctgtgcgtcctcgttccctgcacattctttcaccccattccttactacgataaaaattcccctgtgcatggttactggttccgagagggcgccataatttccagggattctccggtcgcgactaacaagctggaccaggaagtgcaagaagagacccagggcaggtttcggttactcggagacccctcccggaacaattgctcacttagtatagtcgacgccaggagacgagataatggatcctattttttcagaatggagaggggatccaccaagtattcatataaatcacctcagttgtccgtgcacgtcaccgatctcactcatagacccaaaattctgattcccggtactctggagcctgggcattccaagaatcttacctgctccgtttcctgggcttgtgagcagggcaccccacccattttctcatggctgtcagccgctcccacctccctaggcccaagaacaacacacagctctgtccttatcattaccccacgtccgcaggaccacgggactaatctcacatgccaggttaagtttgccggcgctggagtaaccactgaaaggactatccagttaaatgtcacatacgtacctcaaaatcctacaactggaattttcccaggtgacggctccggaaagcaggagacaagggccggagttgtgcatggagcaataggtggcgcaggtgttaccgctctgctcgccctgtgtctgtgtctgatcttttttatcgtcaaaacacaccgtaggaaggccgctagaactgccgttggcaggaatgatacccaccccaccaccggcagcgcgagcccaaagcaccagaaaaaaagtaagcttcacggacctacagaaacaagctcctgctcaggtgcagcgccaaccgtcgagatggacgaagagttacactacgcatcccttaacttccatggcatgaatccgtctaaggacacaagcactgaatattccgaggttcgcacacagtag

SEQ ID NO: 182129 - DNA, 933 bp, Artificial Sequence
  Description of Artificial Sequence: Synthetic coding sequence
atgcccctgctgctgctgctgcccctgctgtgggccggcgccctggcgatggatcccaatttttggctgcaggtccaagaatcagttaccgttcaggaaggattgtgtgttcttgtcccctgcacatttttccaccctatcccatattacgacaaaaattcgccagttcacgggtactggttccgagagggtgcaattatcagccgagattcaccagttgcgaccaacaagctagaccaggaagtgcaggaggagacacagggcaggtttcgccttctcggagatcccagtcggaataactgttcactatcaatcgtggacgcacgccgcagagataacggctcttacttcttccggatggagcgtgggtcgacaaaatattcctataagtcaccccagctctccgtgcatgttacagacctcacccacagaccaaaaatcctgattcccggcaccttggagcccggacactcaaaaaacctcacatgcagtgtaagttgggcctgcgagcagggaactccaccaatcttttcatggctttctgcggcccccacttcacttggaccccgtaccacccacagtagtgtgcttatcatcacgccacggccacaggaccatggtaccaacctgacttgccaggtcaagtttgcgggcgctggagtgacaactgagcggacaatacagctgaatgtgacgtatgttccacaaaaccctactacgggaattttccctggcgacgggagtgggaaacaggagacccgggccggcgtggtccacggtgccataggtggtgcaggagtcacggcactgctggcattgtgcttgtgtctaatctttttcatcgttaagactcatcgccgcaaagccgctaggaccgccgtcggtcgcaacgacacccatccaacaaccggaagcgctagcccagtacgctag

SEQ ID NO: 182130 - DNA, 714 bp, Artificial Sequence
  Description of Artificial Sequence: Synthetic coding sequence
atgcccctgctgctgctgctgcccctgctgtgggccgacctgacccataggccgaagatcttgatccccggtaccctggaacccggccactctaagaacctcacatgcagtgtgtcctgggcatgtgagcaaggcacccctcccatattttcatggctgtctgccgcgcctacctccctgggcccacgcacaacacactcaagtgtcctcatcatcacgcctcggccacaagaccatgggaccaacctgacctgtcaggtgaaattcgcgggcgcgggcgtaacaacggaaaggacgattcagctcaatgtaacctacgtgccacaaaatcccaccacgggaatcttcccaggcgacgggtctggcaaacaggagaccagagctggcgtcgtgcacggagccatcggaggagcgggggtcaccgcactcctcgccttgtgtctctgcctgatattcttcatcgtgaaaacccaccgccgtaaagccgcaaggactgccgtgggtaggaatgatacccaccccaccactggctcagcctccccaaaacatcaaaagaaatctaagttgcacggacctactgaaacctcctcctgtagcggcgctgctcccacggtggagatggacgaggagctccactatgcatcactgaattttcatggaatgaatccgtccaaggatactagcaccgagtatagcgaggtccgaacccagtag

SEQ ID NO: 182131 - DNA, 639 bp, Artificial Sequence
  Description of Artificial Sequence: Synthetic coding sequence
atgcccctgctgctgctgctgcccctgctgtgggccgacctgacccatcggccaaaaatcctgatccccggaactctggagcccggccattcaaagaatctgacatgctctgtttcttgggcgtgtgagcaggggaccccaccaatcttcagctggttgtctgctgcacctacctcgctggggccccgtacaacccactcatcagtcttgataattacacctcgccctcaggaccacggcaccaacctgacctgtcaggttaagttcgccggcgccggtgtcacaactgagagaaccattcagttaaatgtcacttacgtgccccagaacccgacaacaggcatcttccctggtgacggctcaggcaagcaggagaccagggcaggcgtggttcacggggccattggcggtgcgggtgtaactgccctgctcgccctgtgcctctgcctgatcttcttcatcgttaagactcacaggcgaaaggccgcccgaactgccgtgggaagaaacgacactcatcctacgactgggtctgcatctcctgtctcagatggtgcaagctggcacccagtgtgccccgctgatacgagctcgcagtgcggcccgcctagttgcccaatccagcattttcaaaactag

SEQ ID NO: 182132 - DNA, 1419 bp, Artificial Sequence
  Description of Artificial Sequence: Synthetic coding sequence
atgggctgcgaccggaactgcggcctgatcgccggcgccgtgatcggagctgtcctggcagtgttcggcgggattctgatgccagtcggtgatctgctgattcagaagacaatcaagaaacaggtagtgctggaggagggcaccattgctttcaaaaactgggttaagacaggtacggaagtctataggcagttttggatcttcgatgtgcagaatccacaagaggtcatgatgaacagctccaacatccaagtgaaacaaagaggcccttatacgtacagggtaagattcttggccaaggaaaatgtgacacaggatgccgaagataacaccgtatcatttctccagcctaacggcgccatcttcgagccatcattgagtgttggcaccgaagccgacaactttacagtgctgaatctggctgtcgccgccgctagccacatctatcagaatcagttcgtgcagatgatattgaattcgctgattaataagtcgaagagcagtatgtttcaggtgaggaccctgcgggaactgctgtggggataccgagaccccttcctctccctcgtcccctatcctgtgactacaacagtgggactcttttacccgtataataacactgccgacggggtgtataaggttttcaacgggaaagacaatatcagcaaggttgccattatagatacttataaaggtaaaagaaacctgtcttattgggagagccactgcgatatgataaatgggacagatgctgccagcttccccccttttgttgagaagagccaagttctgcaattcttttcctcagatatctgccggagcatctacgccgtgttcgaatccgacgtgaatctgaaggggattcccgtgtaccgcttcgtcttgccatcaaaggcgttcgcttcgccggtagagaacccggataactactgtttctgtaccgagaagatcatatctaagaactgtaccagctatggagttctggacataagtaagtgcaaggagggtagaccggtttacatctcacttccacacttcctttacgcctcgccagatgtgagtgagcccattgacgggcttaaccctaatgaggaagaacaccgaacctaccttgatatcgaaccaataaccgggttcacactgcagttcgctaaacggctacaggtgaacctattggttaagccttcggaaaagattcaggttctgaaaaatttaaagcgcaattatattgtcccaatcctgtggcttaacgagacaggcactataggggacgaaaaggcaaatatgttccgaagccaggtgacaggcaagatcaatcttctgggtctcattgagatgatcctgctgagtgtgggggtagttatgttcgtagccttcatgatttcttattgcgcatgtcgctccaaaacaataaagtag

SEQ ID NO: 182133 - DNA, 1419 bp, Artificial Sequence
  Description of Artificial Sequence: Synthetic coding sequence
atgggctgcgaccggaactgcggcctgatcgccggcgccgtgatcggcgctgttttagctgtgtttggaggaatcctgatgcccgtgggagacctcctgatccaaaaaacgataaaaaagcaggtcgttctcgaggagggcactatcgcatttaagaactgggttaagacggggactgaagtgtacagacagttctggattttcgacgtgcagaacccgcaggaggtaatgatgaactccagcaacattcaggttaagcagcgaggcccttatacatatagagtgaggttccttgctaaggagaatgttacacaggatgcagaggataatacagtcagctttctccagccaaacggcgctatctttgagcctagtctcagcgtgggcaccgaagctgataacttcaccgtcctcaatttagctgtcgctgccgctagtcatatctatcagaatcaattcgttcaaatgattcttaatagtttaatcaacaagtctaaaagtagcatgtttcaggtacgtacactgcgcgaacttctctggggatatcgggatccattcttaagcctggtgccctatcctgtcacaacgacagtagggctcttttacccttacaacaatactgctgacggtgtgtataaagtgtttaacggcaaggataacatctccaaagttgccatcatcgatacatacaagggaaagagaaatctctcatattgggaaagtcactgcgatatgatcaatggaaccgacgcagcttcattcccaccgttcgttgagaagtcccaggtgcttcagttttttagcagcgacatctgtaggtctatctatgctgtgttcgagtccgacgtcaacttgaaaggaatcccagtgtatcggttcgttcttccctcgaaagcatttgccagccccgtggagaacccagataattactgcttttgcactgagaaaattatctcgaagaactgcacctcctatggtgtcctggacatcagcaaatgtaaggaaggaaggcccgtgtatatcagtcttccccattttctttatgccagtcctgacgtgagcgaacctatcgacgggctgaacccgaacgaggaagaacatagaacctacctggatatcgaaccgatcaccggctttacactgcagtttgcaaaaagacttcaggtcaatttgctggtcaagcccagcgaaaagatccaagtattaaaaaacctgaagcgaaattatatcgtgccaattctctggctcaacgagacagggaccattggggatgagaaggcgaatatgtttcggagccaggttaccggaaagatcaatttgttggggctgatcgaaatgatcttgctgtcagtaggcgtggtaatgttcgtagcctttatgattagctactgcgcttgtcgcagtaagaccattaagtag

SEQ ID NO: 182134 - DNA, 612 bp, Artificial Sequence
  Description of Artificial Sequence: Synthetic coding sequence
atgggctgcgaccggaactgcggcctgatcgccggcgccgtgatcggggctgtactggcagttttcgggggaatcctcatgcctgtgggggacctgctgatccagaaaaccataaagaagcaggtggtgttggaagaaggcaccatagcttttaaaaattgggtgaaaaccggcacggaggtgtataggcagttttggatatttgacgtgcagaacccccaagaggtgatgatgaattccagtaacatccaggtgaagcagcggggcccctatacctatagagtccgatttttggcaaaggaaaatgtcactcaagacgctgaggataacacggtaagctttctgcaaccaaacggagccatctttgagccaagtctgagcgtaggtaccgaagccgacaattttacagtgcttaacttagcagtggccgccgccagtcatatttaccagaaccagtttgttcagatgatcctcaacagtctcattaataagagtaaaagtagcatgttccaggttcgcactctgcgagaactgctttgggggtaccgcgacccctttctgtcgctggtcccataccccgttactactaccgtcggactgttctacccatag

SEQ ID NO: 182135 - DNA, 1392 bp, Artificial Sequence
  Description of Artificial Sequence: Synthetic coding sequence
atgggctgcgaccggaactgcggcctgatcgccggcgccgtgatcggagccgtgttggcagtgtttggtggcatcttgatgccagtcggggatctgctgattcagaagactattaaaaagcaagtcgttctagaagaaggtaccattgcattcaagaattgggtaaagaccggtaccgaagtgtatcgccagttctggatctttgacgtgcaaaaccctcaggaagtcatgatgaactccagcaatattcaggtaaagcagcgcggtccctatacctatagggtgaggtttcttgccaaggagaatgtcacacaagacgccgaagataataccgtctcttttctgcaacctaacggcgcaatcttcgagccatccttatcagtcggaacagaggctgacaactttaccgtgttaaacctggcagtcgcagcggcctcgcacatctatcagaatcagttcgtgcaaatgatcctaaactccttaattaacaagtcaaagtcaagcatgtttcaggtgcggactctgagggagctcttatggggctaccgtgacccctttctgtctctcgtcccatatcctgtcacaacaaccgtggggctcttttacccctataacaacacagccgacggcgtttataaggtgtttaacggaaaagacaacattagtaaagtcgcaatcattgacacttacaagggtaagcggaatctttcttattgggagtctcactgcgacatgattaacggtaccgacgctgctagttttcctcctttcgttgaaaaaagtcaagtcctccagttcttctccagcgatatttgccgttccatctacgcagtctttgagagcgacgtgaacctgaaggggataccagtctatcgattcgtgctccctagcaaggcatttgcatcacctgttgaaaatcctgacaattactgcttttgcactgagaagatcatctctaagaactgcacttcatacggggtcctggacatcagtaagtgcaaggaaggtaggccggtgtacatcagcctcccccacttcctctacgcgtcacctgacgtgagcgagcccattgacggactgaaccctaacgaagaggaacatcggacatacttagacatcgaacccatcacgggattcaccctgcagttcgcaaagagactgcaggtgaacctgcttgtgaaacctagcgaaaaaatccaagtgctcaaaaacctcaaaagaaactacatcgtccctatactgtggctgaatgaaactgggacgattggagatgagaaagcaaatatgtttaggtcgcaggtgacaggtaagattaacctgctaggtttgattgagatgattctcctctccgtgggggtcgtgatgtttgtcgcctttatgatcagttactag

SEQ ID NO: 182136 - DNA, 447 bp, Artificial Sequence
  Description of Artificial Sequence: Synthetic coding sequence
atgggctgcgaccggaactgcggcctgatcgccggcgccgtgatcggcgccgtcctggccgttttcggtggaatattgatgccagtgggggatctgctgattcagaagaccatcaaaaagcaagtcgtcctggaggagggtaccatcgcatttaaaaactgggtaaaaactgggacagaagtctaccggcagttctggatcttcgatgtacagaatcctcaggaggtcatgatgaattcgagcaacatacaggttaaacagcgagggccctacacatatcgggtgcggttcctggccaaagagaatgtgacgcaggatgccgaggataacaccgtctcttttttgcagcctaatggagccatattcgaaccttctttgagcgtgggcaccgaagccgataactttaccgtgctgaaccttgcggtggccgccgcctctcacatctag

SEQ ID NO: 182137 - DNA, 282 bp, Artificial Sequence
  Description of Artificial Sequence: Synthetic coding sequence
atgggctgcgaccggaactgcggcctgatcgccggcgccgtgatcggagccgtcctggccgtgtttggcggcatcctcatgcccgttggggacttgctgattcaaaagactatcaagaaacaggtcgttctagaggagggcactatcgcctttaagaactgggtgaaaaccggcacagaagtgtaccgacagttctggattttcgatgtgcaaaacccacaagaagtgatgatgaatagcagcaacatccaagtgaagcaacgaggcccctacacctattag

SEQ ID NO: 182138 - DNA, 1419 bp, Artificial Sequence
  Description of Artificial Sequence: Synthetic coding sequence
atgggctgcgaccggaactgcggcctgatcgccggcgccgtgatcggcgctgtgctggcagtgttcggaggcatcctgatgcctgtgggcgacctcctgatccagaagacaatcaaaaaacaggtcgtactggaggagggcactatcgcgttcaaaaactgggtgaagaccggcactgaggtgtatcgtcagttttggattttcgacgtccagaatccacaggaagtcatgatgaacagtagcaatatccaggttaaacaacgaggtccctacacctacagggttcgcttcctggctaaggagaatgtgacacaggatgcggaggataacactgtcagcttcttacaacccaacggggctatattcgaaccctccttatccgttggtaccgaggcagataacttcacagtccttaatctcgccgttgccgcagcatctcacatctatcagaatcaatttgttcaaatgattctaaattctctcattaacaaaagtaagagctcgatgtttcaggttcggacgcttcgagaactgttgtgggggtaccgggatccattcctatcgctcgttccttaccctgtgaccaccacagtgggcctattctacccctacaacaacaccgcagatggtgtgtacaaagtgtttaacggcaaggataatatcagcaaggtcgcaattattgacacctataaaggaaagcgcaacctgtcatattgggagtctcactgcgacatgatcaacggaacagatgcagcatcctttcccccatttgtcgaaaagtctcaggtactacagttcttcagcagtgatatttgcagaagtatctatgccgtcttcgaatccgacgtgaatttaaaggggatccctgtataccgctttgtactccctagcaaggcctttgcttctcctgtagagaacccagataattattgtttctgcaccgagaagataatttccaaaaattgtactagctacggggtccttgacataagcaagtgcaaggaaggccgaccggtttacataagcttgccccactttctgtatgcaagtcccgacgtgtccgagcctatcgacggtctgaatccaaatgaggaggaacatcggacctatctcgacatagagcctatcaccggttttaccctgcagttcgctaaacggttacaagtgaacctgctcgtgaaacctagcgaaaagatccaggtgctgaagaatctgaagcgcaattatatcgtacccattctctggttgaacgaaacgggcacaattggcgatgagaaagcaaacatgtttaggagccaggtgactggcaaaatcaacctcctcggacttattgagatgattttactgtctgtgggagtggtgatgtttgtggcctttatgatttcatattgtgcatgcagaagtaaaactatcaaatag

SEQ ID NO: 182139 - DNA, 1302 bp, Artificial Sequence
  Description of Artificial Sequence: Synthetic coding sequence
atgggctgcgaccggaactgcggcctgatcgccggcgccgtgatcggagcggtattagccgtttttgggggcatcttaatgcccgttggggaccttctgattcagaaaacaatcaaaaaacaggtcgttctcgaagaaggaactattgctttcaagaattgggtgaagaccggcaccgaggtctatcgtcagttttggattttcgatgtgcagaatcctcaggaggttatgatgaatagttctaacatccaagttaaacagcgggggccatatacctatagagttcgttttctcgccaaagagaacgtgactcaggacgccgaagacaatacggtctccttccttcaacccaacggggctatcttcgagccatctcttagcgtcggcacagaagctgacaattttacagtgctgaacttggccgtggcagcggctagtcatatctatcagaatcagtttgtgcagatgatcctgaattctcttattaacaagtctaaatcctctatgtttcaagttaggacactccgcgagctcttgtggggctaccgcgaccccttccttagcctggtgccatatccggtgactacaactgtcggcctcttttacccctataacaacacagctgacggagtctataaggtctttaacggaaaagacaacatttcgaaggtggccatcatagacacctataaaggaaagcggtccatatacgccgtgttcgagtctgacgtcaacctgaaggggattccagtgtataggtttgtgctgccctccaaagcgtttgcaagccctgtcgagaaccccgataactactgcttctgtaccgagaaaatcatatccaaaaactgcacctcttatggcgtgctggatatcagcaaatgcaaagagggccggcccgtgtatatcagcttgccccacttcctctacgcctcaccagacgtatcagagccaatagatgggctgaatccgaatgaagaagaacatcggacttatctcgacatcgagcccatcacaggcttcaccctccagttcgctaagagactgcaagttaatctgctcgtgaagccgtctgagaagatccaagtgcttaagaacctgaaaaggaattacatcgtgccaattctgtggcttaatgagacaggaacgattggcgatgaaaaggccaatatgtttcgctctcaagtcaccggcaagatcaaccttctggggctaatcgagatgatcttgctgtctgtcggcgtggtgatgtttgtggcgtttatgatatcctactgcgcctgcaggtccaaaaccatcaaatag

SEQ ID NO: 182140 - DNA, 1419 bp, Artificial Sequence
  Description of Artificial Sequence: Synthetic coding sequence
atgggctgcgaccggaactgcggcctgatcgccggcgccgtgatcggtgctgtgctcgctgtgtttggtggtatcctcatgccggtgggggacttgctgattcagaagacaataaagaagcaggtagtgctcgaagaaggaaccattgccttcaaaaattgggtcaaaactggtaccgaagtttaccggcagttttggatcttcgacgttcagaatcctcaggaggtaatgatgaactcatcaaacatccaagtcaagcagcgggggccctacacttaccgggtgcgctttctcgcaaaggagaatgttacccaggacgcagaagacaataccgttagcttcttgcaaccaaacggcgccatctttgaaccctcgttaagtgttggcaccgaagccgataattttacagtattgaatctagcggtcgccgccgcgtcacacatctatcaaaatcaatttgtccagatgatccttaacagtttaatcaacaaaagcaagtcttctatgttccaagtgagaactcttcgggaactgctatggggataccgggacccgtttctgtcacttgtgccctaccccgtaaccaccacggtggggttattctacccatataacaatacagccgatggagtgtacaaggtgtttaacggcaaagacaacatctcaaaggtggccattattgatacttataaagggaaacgaaacttatcttactgggaaagccactgcgatatgattaacggtacagacgccgcatcatttcccccatttgtcgaaaaaagccaagtgctgcagttcttctcctctgacatctgccggagtatttacgccgtgttcgagtcagacgtgaatctgaagggcatacctgtatatcgcttcgtcctgccgagcaaggcgttcgcttcacccgtcgaaaatcctgacaactattgcttttgtactgagaaaatcatctcgaagaattgcacaagctacggagtacttgacatctctaaatgtaaagagggacggcccgtctatatttcactgccccacttcctgtatgccagtcctgatgtcagcgagcctatagacggacttaacccaaacgaagaggaacatcgtacctacctcgacatcgagccaatcactgggtttactctgcaattcgccaagcgcctgcaggtgaatctgctggtcaagccctccgagaagattcaggtcctgaaaaatctgaaacggaattacattgtgcctattttatggctcaacgagactggtactatcggcgacgaaaaagccaatatgtttcggagtcaggtgaccggaaaaatcaatttactagggctcatagaaatgatcctgctcagcgtcggtgtggtgatgtttgtcgccttcatgatctcatattgtgcctgccgcagcaagaccattaaatag

SEQ ID NO: 182141 - DNA, 282 bp, Artificial Sequence
  Description of Artificial Sequence: Synthetic coding sequence
atgggctgcgaccggaactgcggcctgatcgccggcgccgtgatcggcgctgtgctcgccgtctttggcggaatcctgatgccagttggggacctgctgatccaaaagactattaaaaagcaggtggttctcgaagaagggactatcgcctttaagaattgggtgaagactggtactgaggtgtacagacagttttggattttcgacgtccagaatccccaggaggtgatgatgaactctagtaacattcaggtcaagcagagaggtccttacacctactag

SEQ ID NO: 182142 - DNA, 432 bp, Artificial Sequence
  Description of Artificial Sequence: Synthetic coding sequence
atgggctgcgaccggaactgcggcctgatcgccggcgccgtgatcggggccgtgctggccgttttcggaggaatcctcatgcccgtgggagatctccttatacaaaagaccattaagaaacaggtggtgctcgaagaaggcaccatcgccttcaaaaactgggttaaaactggaaccgaggtttatcgccagttctggatttttgacgtgcagaatccccaagaggttatgatgaactctagcaatatccaggtgaaacagcggggaccatatacatacagagttaggtttctggccaaagaaaatgttactcaggacgccgaggataacacagtgagttttctacaacccaacggggccatcttcgagcctagcctgagcgtcggtacggaggcagataactttacggttctgaacttagccgttgcatag

SEQ ID NO: 182143 - DNA, 1419 bp, Artificial Sequence
  Description of Artificial Sequence: Synthetic coding sequence
atgggctgcgaccggaactgcggcctgatcgccggcgccgtgatcggcgctgttctcgcagtctttggcgggatattgatgccagtaggtgaccttctcatccaaaagaccattaaaaaacaggtcgtacttgaagaggggaccatcgcgtttaagaactgggtaaagaccggcactgaggtataccgacagttctggatcttcgatgtgcagaacccacaggaggtcatgatgaattcatctaatattcaggtcaaacagagaggaccctacacttatcgggtacggtttctcgcgaaggaaaatgtcacccaggacgccgaggataataccgtctcatttcttcagccaaacggggccatttttgagccttctctgtcagtaggcacagaggctgataattttaccgtccttaatcttgccgtggcagccgccagccatatctatcaaaaccagttcgtgcagatgattcttaatagtctgatcaataaaagcaagagctcgatgtttcaggtccggactcttcgtgagctgttatggggctatagagacccctttctctccctcgtaccatatcctgtgactacaactgtgggattattctatccgtataataacacagcagacggtgtgtacaaggtgttcaatgggaaagataacatcagtaaggtagcaataatcgatacctacaaaggaaagcggaacctgtcatactgggagagtcactgcgacatgatcaatggaacggatgcagcttcctttcctccctttgttgaaaaaagccaggtgttgcaattttttagttccgacatctgtaggagcatttacgcagtttttgagagcgacgttaatctgaaaggcattccggtctatcgcttcgtgttgccatcaaaggcattcgcttctcccgtggaaaaccccgacaactactgcttctgcaccgagaaaatcatttccaaaaactgcacaagttacggcgttcttgacatctctaagtgcaaagaggggcggcccgtctacataagcttgcctcactttctgtacgcctcccctgacgtctcagaacccatcgacggcctcaaccctaatgaggaagagcaccgcacttacctcgacatcgagccaatcacagggttcactctgcagttcgctaaaagactgcaggtaaacctgctcgttaagccctccgaaaagatccaggttctgaaaaatctcaaacggaattacatcgtgcctattctctggctcaacgagaccggtaccattggggacgaaaaggctaacatgtttaggagccaggttaccggtaagataaaccttttaggcctgattgagatgattctactgtctgtgggcgtcgtgatgtttgttgcattcatgataagctattgcgcctgtagaagcaaaaccataaagtag

SEQ ID NO: 182144 - DNA, 198 bp, Artificial Sequence
  Description of Artificial Sequence: Synthetic coding sequence
atgggctgcgaccggaactgcggcctgatcgccggcgccgtgatcggagccgtcctggctgtgtttggtgggatcttaatgcccgtgggggacctgcttattcagaaaaccattaagaaacaggtcgtcctggaagaaggaactatagcatttaaaaattgggtcaagactggtactgaggtctaccgtcagttctag

SEQ ID NO: 182145 - DNA, 1191 bp, Artificial Sequence
  Description of Artificial Sequence: Synthetic coding sequence
atgatgaacagcagcaacatccaggtgaagcagcggggcccctacacatatagagtaaggtttctggctaaggaaaatgtcacacaggatgctgaggacaatacggtgtccttcctccagccaaacggcgcaatttttgagcccagtttgtcggtgggcaccgaggctgacaacttcactgttctcaaccttgcagtggcagcagctagccatatttatcaaaatcagttcgtccaaatgatcctgaattcgctgataaacaaatccaaaagctctatgttccaggtcagaacgctgagagaacttttgtggggatatcgcgacccgttcctatccctggtgccttatcctgtaaccacaacagtggggctgttctacccatacaacaataccgccgacggtgtgtacaaagtgttcaacggcaaggacaacataagcaaagtcgccataatcgacacctataaggggaaacgcaatctttcttactgggagagtcattgtgatatgatcaacggtacagacgcagcttcttttcccccctttgtggaaaaatcccaggtactccagttcttctccagcgatatttgccggagcatttatgccgtctttgaaagcgatgtgaacctgaaaggcatcccagtctacagatttgtgcttccatccaaagcctttgcgtctccagtggagaatcccgataactattgtttttgtacagagaaaattatcagtaaaaattgtacatcttatggagttctggatatcagtaagtgcaaagaagggaggcccgtctacatatccctcccgcacttcctgtacgcttctccagacgtttccgagcccatcgatggcttgaaccctaatgaagaggagcacagaacatacctcgacatcgaacccatcaccgggttcactcttcagttcgcaaaacggctgcaggtgaacctgcttgtgaaaccgtccgagaagattcaggtgttaaaaaacttaaaacggaattacattgttccaatcctatggctcaacgaaacgggaacaattggggacgagaaagcaaacatgttcagatcccaggtaaccggtaagataaatctccttggactcatcgagatgatcctactgagtgtaggcgtcgtcatgttcgtggccttcatgatctcttactgcgcatgtcggagcaagacaattaagtag

SEQ ID NO: 182146 - DNA, 1239 bp, Artificial Sequence
  Description of Artificial Sequence: Synthetic coding sequence
atgggctgcgaccggaactgcggcctgatcgccggcgccgtgatcggagccgtccttgctgtttttgggggtattctgatgccagtgggcgatctccttattcagaaaaccattaagaaacaggtggtccttgaggagggcaccatagcatttaaaaactgggtgaaaactggaaccgaggtctatcgtcaattttggatattcgacgtacagaatccacaagaggtgatgatgaactcttctaatatccaggtgaaacagcggggcccctacacgtaccgtgtccgtttcttggccaaggagaatgtgacacaagacgctgaggacaatacagtgtcatttcttcagccaaatggcgcaatcttcgaaccttctctatctgttggaacagaggcggataactttaccgtcctaaacctggccgtggcctataacaacacagctgatggagtgtacaaggttttcaacggaaaggacaacatcagcaaagtggccatcatcgacacctataaagggaagaggaatctatcatactgggagtcgcattgtgatatgatcaacggcaccgacgctgccagtttcccccctttcgtggagaaaagccaggtactccagttcttttcaagtgacatttgtagatcaatttacgccgtattcgaatctgacgttaaccttaaaggcattcccgtttatagatttgtgctgccaagcaaggcattcgcatcacctgtagaaaatccagataattactgcttctgcaccgagaagataattagcaagaactgcacttcttacggggtattagacataagcaagtgtaaggagggaaggccagtgtacatttccctgcctcatttcctctatgcttcaccagacgtatctgagcctatagacggcctcaaccccaatgaagaagagcacaggacttatctggacatcgaaccaataaccggcttcacgcttcagttcgccaagagactacaagtcaacctgttagtgaagccctcagagaagattcaggtcctgaagaacctgaagcgtaattatatcgtgcccatcctttggctcaatgaaaccggtaccataggggatgaaaaggctaatatgtttagatcccaggtcaccggaaagattaatttattggggcttatcgagatgatcctgttatctgttggcgttgttatgttcgtcgccttcatgatctcatactgcgcctgtcggtcgaaaactattaaatag

SEQ ID NO: 182147 - DNA, 867 bp, Artificial Sequence
  Description of Artificial Sequence: Synthetic coding sequence
atgggctgcgaccggaactgcggcctgatcgccggcgccgtgatcggggctgtactggcagtctttggaggtatcctgatgccagtgggggacttactcattcagaaaaccatcaagaagcaggtcgtcctcgaggagggaaccattgcgtttaaaaactgggtcaaaactggcactgaggtctatagacagttctggatcttcgatgttcagaaccctcaggaggtcatgatgaacagtagtaatatccaagtcaagcagagagggccatatacctatagagtgcggtttctcgccaaagagaatgtgacgcaggatgctgaagacaataccgtctcttttctgcaaccaaatggagctatcttcgaacccagccttagtgtgggcaccgaggccgataactttacagtcttgaatcttgccgttgctgcggcatcccatatttaccagaatcagttcgtacagatgatcttaaatagcctaataaacaaaagcaagtcaagtatgttccaggtcagaacgctacgggagctgctttggggttatcgggatcccttcctgtcccttgtgccctacccggttaccacaaccgtagggctcttttacccttataacaacaccgccgacggggtgtacaaagtgttcaacggaaaggacaatataagcaaggttgccatcatcgatacatacaaaggaaagagaaacctctcctactgggaatcacattgcgacatgataaacggcactgacgccgcttcctttcccccttttgtcgagaagagccaggtccttcagtttttttcttccgacatatgcagagagacctgcgtgcacttcacatccagctttagcgtgtgtaaaagctag

SEQ ID NO: 182148 - DNA, 846 bp, Artificial Sequence
  Description of Artificial Sequence: Synthetic coding sequence
atgagcgcccaggagagctgcctgagcctgatcaagtacttcctgtttgttttcaacctttttttctttgtcctcggctcacttattttctgtttcggtatatggattctgatagacaagacatcttttgtgtcttttgtaggattagctttcgtgcccctgcagatttggagtaaagtgttggctatttctgggatcttcaccatgggcatcgcactcttggggtgcgtaggagctctgaaggagctaaggtgcctgctcgggttgtatttcggtatgttgctgctgcttttcgcaacccaaatcacactcgggattctaattagcactcagcgcgcccagctcgagaggtcgctgcgggatgttgtggaaaagacaatccaaaagtatgggacaaacccagaggagacagccgcagaggagtcctgggattatgttcagttccagctgcggtgttgtggatggcactatccacaggattggtttcaggtgctcattctgcgaggcaacggtagtgaggcccacagggttccgtgttcctgttacaatctgtcagcaaccaacgatagtaccatcctggacaaggtgatactaccacagctgtctcgtttgggccacctggccaggtctaggcactccgcagatatctgtgccgtccctgccgagtctcatatttatcgggagggttgcgcacaggggctgcagaagtggttgcacaacaatctgatcagtatagtgggcatctgtctcggcgtgggtctgctggaacttggcttcatgacactcagcattttcctgtgtcggaacctggatcacgtctacaacagactggccagatacaggtag

SEQ ID NO: 182149 - DNA, 471 bp, Artificial Sequence
  Description of Artificial Sequence: Synthetic coding sequence
atgagcgcccaggagagctgcctgagcctgatcaagtacttcctgtttgtctttaacttatttttcttcgtcttagggagccttatattttgcttcgggatatggatcctcatcgacaaaacaagtttcgtctcattcgtcggactggcctttgtaccactgcagatatggtctaaggtgcttgcgatatccgggatctttacaatgggcatagctctacttggctgcgtgggggcattgaaggagctccggtgcctgttaggcctgtacttcggaatgcttctgctcctctttgccacccagatcacccttggcattttgatctcaactcagcgggcacagaaggatacacctacttggactaagggagaccgacacaaacagctccagcgtgaaacccacggcaagaagagggaacaggaaaaggaaatcgatgctctaaaggaagaaacagagacgtacgaaccttag

SEQ ID NO: 182150 - DNA, 642 bp, Artificial Sequence
  Description of Artificial Sequence: Synthetic coding sequence
atgggcatcgccctgctgggctgcgtgggcgccctgaaggagctgaggtgcttgctgggactgtatttcggcatgctcctcctactatttgctacgcagatcaccttaggtatcctgatcagtactcagcgagcccagctggagagatcactgcgggacgtcgtggaaaaaacaatccagaaatacgggacaaatccagaggagactgccgcagaggagtcctgggattatgttcagtttcagctccgctgctgtggctggcattacccacaggactggtttcaagtgctcatcctgagaggaaatgggagtgaggcccaccgcgttccttgctcctgttacaatctgtctgccacaaatgacagcacaattcttgacaaggtgattctgcctcaattgtctcggctcggtcacctcgccaggagccgacacagcgctgacatctgcgcagtgcccgcggaaagtcatatctatcgggagggttgcgcccagggcctacaaaagtggctgcacaacaatctgatctctatcgtgggcatctgcctgggcgtgggcctgctcgagctgggttttatgacactgtccatcttcttgtgccgcaatctcgaccacgtgtataacaggcttgcaaggtaccggtag

SEQ ID NO: 182151 - DNA, 813 bp, Artificial Sequence
  Description of Artificial Sequence: Synthetic coding sequence
atgagcgcccaggagagctgcctgagcctgatcaagtacttcctgtttgtcttcaatctctttttcttcgtgcttggcagcttgatcttttgcttcgggatttggattctgatagataaaacctcctttgtctcctttgttggtttagcattcgtgcctcttcaaatctggtcaaaagttctggccatctccggcatctttactatggggattgctcttttaggatgtgtcggggccctgaaggaacttaggtgtctgttgggattgtacttcggcatgctcctactcctgtttgcgactcagattacgttgggaattctgatctccactcaacgggcacaattagaaaggagtctgagagacgtggttgaaaagaccatccagaagtacggaacaaaccctgaggagaccgccgctgaggaatcttgggactatgtccagttccaattgcgatgttgtggttggcactacccgcaggattggttccaggtgctaatactgcggggaaacgggagtgaagcgcatagagtcccctgttcctgttacaacctgagtgctaccaatgacagtactattctcgataaggtaatactgccccagttgagcagattgggtcacctggcgcgatcccgacacagcgctgatatctgtgcggtcccggcggaatcccatatctatcgcgagggctgcgctcaaggactgcaaaagtggctgcataataacctgatctcaatcgtgggaatttgcctgggggtgggcttgttagaggtgatctggccgcggcctcatccacggtcggctctgaatccgtag

SEQ ID NO: 182152 - DNA, 1095 bp, Artificial Sequence
  Description of Artificial Sequence: Synthetic coding sequence
atgccccacagctaccccgccctgagcgccgagcagaagaaggagctgagtgatattgccctgcgcatcgtcgcccctgggaaaggcatcttagccgctgacgagtctgtaggaagcatggccaagcgactcagccagatcggtgttgaaaataccgaagagaatcggagactgtaccgccaagtgttgtttagtgccgacgatagagttaagaagtgtattgggggtgtgatctttttccatgagaccctgtatcagaaagatgacaatggcgttcctttcgttaggacaatacaagataagggtattgtagttggtataaaggtggacaaaggggtggtaccactggcaggaacggatggggagactacaacacagggcttggatggcctgtccgaacgctgcgcccaatacaagaaagatggagcagatttcgctaagtggcgctgtgttttgaagattagcgagcggacaccttcggccctggccatacttgaaaatgcgaatgttctcgctaggtacgcttcaatttgccaacagaacggaatcgtccctatcgtggagcccgagattctccccgacggagatcatgatctcaagcggtgtcaatatgtgactgaaaaggtcctggccgccgtgtacaaggctctgtccgatcatcacgtgtaccttgagggaacactgctgaagcccaacatggttacccccggacatgcttgtcccatcaaatatactcccgaagagatcgccatggctactgtcacagccttgcggcggacagtgcccccagcggtgcccggggtcacatttctctcgggaggacaatctgaagaagaggcatctttcaatctgaatgctatcaataggtgtcctctgcctagaccttgggccttgacattcagctatggaagggccctccaggccagcgccctgaacgcatggcgcgggcagagggataacgccggcgctgcaactgaagagttcatcaaacgtgcggaagtgaacggtcttgctgcacaaggtaaatacgagggaagcggggaggatggaggcgctgcagcacaaagcctgtatattgctaaccatgcctattag

SEQ ID NO: 182153 - DNA, 483 bp, Artificial Sequence
  Description of Artificial Sequence: Synthetic coding sequence
atggccaactgcgagttcagccccgtgagcggcgacaagccctgctgcagactgtctagaagggcccagctctgcctgggcgtctctatacttgtcctgatactggtcgtggttctggctgtggtagtcccccgctggcggcagcagtggagcggacccggaaccacaaaaaggtttccagagactgtactcgccaggtgtgtgaagtatacagaaatccaccccgagatgagacatgtggattgccagtccgtgtgggacgcctttaagggtgcctttatcagtaaacatccatgcaatatcaccgaggaagactatcaacccctgatgaagctgggcacacagacggttccctgtaataagaatgagaccatcaacctcgcccagacaggtgagagaactgctgccacaaccctgttccagtatagcggcaaaaggttcccagccggactgcagaagctgcctgtcatgtggtctatgtag

SEQ ID NO: 182154 - DNA, 624 bp, Artificial Sequence
  Description of Artificial Sequence: Synthetic coding sequence
atgcagagcggcacccactggcgggtgctgggcctgtgcctgctgtcggtgggcgtctggggccaggacgggaatgaggaaatgggtggcatcactcagaccccttacaaggtgtcaatcagcgggaccaccgttatccttacctgtccacagtacccaggttcggagatcttgtggcagcacaacgataagaacataggcggcgacgaggacgacaagaacatcggctctgacgaagaccatttatccctgaaagagttttcagaacttgagcagtctggatactacgtttgctatccacgcggtagtaagcccgaggatgcaaacttctacctatacttacgtgcccgagtgtgcgaaaattgtatggagatggatgtaatgtccgtcgccacaattgtcatagttgacatttgcataacaggaggcctactcctgttagtgtattattggtcaaagaacaggaaggccaaagccaagcctgtgactcgaggtgccggggccgggggacgacagcggggccaaaataaagagagaccacccccagtcccaaatccagactacgaacccatccgcaaaggccaacgagacctgtactctggactgaatcagagaaggatatag

SEQ ID NO: 182155 - DNA, 606 bp, Artificial Sequence
  Description of Artificial Sequence: Synthetic coding sequence
atgcagagcggcacccactggcgggtgctgggcctgtgcctgctgagcgttggtgtttggggccaggatggcaacgaggagatggcctacaaagtctccatcagtggaacaaccgtaatcctcacatgtccccaataccctggctcagagatcttgtggcagcacaacgataaaaacatcggaggagacgaggacgacaaaaatatcgggtctgatgaggatcacctgagcctgaaggagttctctgaactcgagcagtcaggttactatgtatgctaccctcgtggatctaagcccgaagacgcaaacttctacctgtacctgcgggcccgcgtgtgtgagaactgtatggagatggacgtgatgtccgtggctacgatcgtcatagttgacatatgtatcacaggtggcctcctgctactcgtgtactactggagcaaaaaccggaaagccaaagcaaaacctgtgaccaggggggctggagcaggggggcgacagaggggtcagaacaaagaaagacctccccccgtgccaaaccctgattacgagcccatccgcaagggtcagagggatttatactccggcctgaatcagcgccgaatctag

SEQ ID NO: 182156 - DNA, 237 bp, Artificial Sequence
  Description of Artificial Sequence: Synthetic coding sequence
atgatcggcttcctgaccgaggacaagaagaagtggaacctgggctcaaatgcaaaagatccacgcggtatgtaccagtgcaagggctctcagaataagagcaagcctctgcaggtgtactaccgaacgtctgataagcaaaccctgcttccaaatgaccagctctaccagcctttgaaagacagagaagatgatcagtactcccacttgcagggaaaccaactccgcaggaattag

SEQ ID NO: 182157 - DNA, 549 bp, Artificial Sequence
  Description of Artificial Sequence: Synthetic coding sequence
atggagcagggcaagggcctggccgtgctgatcctggccatcatcctattgcagggaaccctggctcaatctattaaaggcaatcacctcgtgaaggtctatgattatcaagaagatggaagtgtcctgctgacttgtgatgcagaggctaagaacattacctggttcaaggacggcaagatgatcggttttctcacagaggataagaaaaaatggaatctgggcagcaatgctaaagatccgcgaggcatgtaccagtgtaaaggcagccagaacaaatctaaaccactgcaggtgtattaccgtatgtgtcagaattgcatcgaactgaacgccgctacaatcagtggattcttatttgcagaaatcgtatcaatttttgtcctcgccgtaggagtctacttcatcgccggccaggacggggtgaggcagtctagagccagcgacaaacaaacactcttgcctaacgatcagctctatcaacccctcaaggatagggaggacgatcagtactctcatctacaaggcaaccagttgcgaaggaactag

SEQ ID NO: 182158 - DNA, 1200 bp, Artificial Sequence
  Description of Artificial Sequence: Synthetic coding sequence
atggagccccccggccggcgggagtgccccttccccagctggcggttccccgggctgctgctggcggcaatggtattgctgctttactcattttccgatgcgtgcgaggagccaccaacctttgaggctatggaactgataggcaaaccgaagccgtactatgaaattggggaacgcgtagactataaatgtaaaaaggggtatttctatatcccgcctctggctacacacacaatttgtgaccgcaatcatacatggcttcccgttagtgacgacgcgtgttaccgcgaaacgtgcccttatatccgtgaccccctgaatgggcaagctgtccccgcgaacggcacttatgagttcggctaccaaatgcattttatttgtaacgaggggtactacttaatcggagaagagatcctgtactgcgaacttaaggggagtgtggccatttggagtggcaagccgcccatctgcgaaaaagtcctttgcacgcccccccctaagatcaagaatggtaaacataccttttcagaagtggaggtcttcgagtatctggacgccgttacgtattcttgtgaccctgctcctggtcccgaccccttcagcctaattggcgagtcaacaatttactgtggagacaacagtgtctggagccgggccgccccagaatgcaaggtggtgaagtgccggttccccgttgtcgaaaacggtaaacagatttcaggctttgggaagaaattttattacaaggccactgtgatgtttgaatgcgataaaggtttctaccttgatgggtccgacactatcgtgtgcgactccaacagcacctgggatccgcctgtgccaaagtgtctgaaggtgctgcccccaagctcaacgaagccccccgctctcagccactccgtgtccacatcctccaccacaaaaagccccgcctcctcagcttctgggcctagacctacctataaaccaccagtgagcaactacccaggttacccgaaaccagaggagggcatcctggactcactcgacgtgtgggtgatcgcggtgatcgtgattgctatcgttgtcggcgtggccgtcatatgcgtggtgccatatcgttatctgcagagaagaaaaaaaaaaggcaaggctgacggaggtgcggagtacgccacataccagactaaaagcaccacaccagctgaacagcgaggttag

SEQ ID NO: 182159 - DNA, 1050 bp, Artificial Sequence
  Description of Artificial Sequence: Synthetic coding sequence
atggagccccccggccggcgggagtgccccttccccagctggcggtttcctggactcctgttggcagccatggtcctcctgctgtattctttctcagacgcctgtgaggaaccccctaccttcgaggcaatggaactgatcggcaagcccaagccatattacgaaattggggagcgcgtggattataagtgcaagaagggctacttctatattcccccactagccactcataccatctgcgacagaaaccacacttggcttcctgtgtcagacgacgcgtgttatcgcgaaacctgtccatacataagggatcctttaaatggacaggctgtgcctgccaacggtacctacgagttcggttaccagatgcactttatctgtaacgagggctactacctcattggcgaggaaattctctactgcgagctcaaggggtctgtggcaatctggagcggcaagcctcctatatgtgagaaggtgctgtgcacaccccctcctaagataaaaaatggaaaacataccttttctgaagtagaggttttcgagtatctggacgcagtcacgtattcatgcgaccctgcaccaggaccagaccccttctctctgattggggagtctactatctattgtggcgacaatagcgtgtggtctagagctgcgcctgagtgcaaggttgtgaaatgccgttttcctgttgtggaaaacggtaagcagatcagcggatttgggaagaagttttattacaaggccactgtgatgtttgaatgtgacaaagggttttacctcgatggctccgacacaattgtgtgtgattctaatagcacctgggacccacctgtgccaaagtgtctgaaaggaccacgaccaacgtacaagccacccgtgtctaattatcccggttaccccaaacccgaagaaggcattttagacagcctggatgtgtgggtaatagctgtgattgttattgctatcgggaagcagatggttgagttgaacatgccgctgactaggctgaatcaaccactgcagcagagccgggaggcagagtag

SEQ ID NO: 182160 - DNA, 1155 bp, Artificial Sequence
  Description of Artificial Sequence: Synthetic coding sequence
atggagccccccggccggcgggagtgccccttccccagctggcggtttcccggcctgctgctggccgccatggttctgctgctgtactcattcagtgatgcctgcgaagagcctccaactttcgaggccatggaactgatcggcaagcccaaaccttactatgaaattggagagagggtagattataagtgcaagaaaggatacttttacatacctcctctcgctacacacacaatctgcgacagaaaccatacctggctgccagtgagtgatgacgcgtgctatcgtgaaacatgcccatacattcgggatccattaaatggccaggctgttccagccaatggcacgtacgagttcggttatcagatgcacttcatttgtaacgagggctattatctcatcggtgaagagattctctactgcgagctgaagggctccgtggcaatttggagcggaaaacccccaatctgcgaaaaggtcctgtgcacaccgcctcccaaaataaagaatggcaagcacacctttagcgaagttgaagtgtttgaatacttggacgccgtgacctatagctgtgacccagctcctggaccggatccattcagtttgatcggcgagtctactatttactgcggggataactccgtatggagccgggccgcgcccgaatgtaaggtggttaagtgtagattcccggtggtagaaaatggcaaacagatctccggttttgggaagaagttttactacaaggctacagtcatgtttgagtgcgacaagggtttttacctggacgggtcagatacaatagtgtgtgacagcaattctacgtgggacccacctgtacctaagtgtctaaaagtctcaacttccagcactactaaaagtcccgcaagtagtgcatctggccccagaccaacatataaacctcctgtgagtaattacccaggctacccaaagccagaggagggaatacttgacagccttgatgtgtgggtgatcgcagtaatagtgattgccattgtggtcggcgtggccgtcatttgcgtagtcccctataggtacctgcagcggcgaaagaagaagggcaaggcggacggcggtgccgaatatgccacctaccaaaccaagagcacaacacccgctgaacagagaggctag

SEQ ID NO: 182161 - DNA, 1110 bp, Artificial Sequence
  Description of Artificial Sequence: Synthetic coding sequence
atggagccccccggccggcgggagtgccccttccccagctggcggttccctggcctgctcctggccgccatggtacttctcctctattctttttccgatgcgtgcgaggaaccccccacatttgaggccatggaactgatcggcaagcctaaaccttactacgaaatcggagagagagtggactataagtgcaaaaaagggtatttttacattcctccactcgctacccatacaatttgcgacaggaaccacacctggctgcctgtttcagatgatgcctgttatcgcgaaacttgtccctacatccgtgacccgctgaatggccaggccgtcccagcaaatggcacctacgaatttggatatcagatgcactttatctgcaacgaggggtactatcttatcggcgaggaaatcctgtactgcgaactcaaggggtcagtggcaatttggagtggcaagccgcctatatgtgagaaggtgctttgcactccaccacctaaaataaagaatggtaagcataccttctccgaagtggaggtcttcgagtacctagatgcggttacctattcctgtgaccctgccccaggtcccgatccttttagtctgatcggggaatccaccatatattgcggtgataatagcgtgtggtccagggcagcacccgagtgtaaagtggtaaaatgtagatttcccgtcgtcgaaaatggtaagcagatctccggcttcgggaagaaattctattacaaggcaacagtcatgtttgagtgcgacaagggattttatctggacggcagtgatacaattgtgtgcgactccaatagcacctgggatccacccgtgccaaagtgccttaaaggacctcgacccacatacaaaccgcccgtgtcaaattaccctggctacccaaagccagaagaaggaatcctcgactctctggacgtctgggtgattgccgtaatcgtaatagctattgtggtgggcgtggcggtaatatgcgtggtaccctacagatacctacagcgccgcaaaaagaagggcaaggccgatgggggcgccgagtacgctacctatcagacaaagtccaccacccctgccgagcagagaggatag

SEQ ID NO: 182162 - DNA, 1179 bp, Artificial Sequence
  Description of Artificial Sequence: Synthetic coding sequence
atggagccccccggccggcgggagtgccccttccccagctggcggtttcccggactgctgctggcagcaatggtgttactcttgtacagcttttcagatgcgtgtgaagagccccccacctttgaggccatggaactaattgggaaacctaagccatactatgagattggcgaacgcgtggactataaatgcaaaaaaggctatttctacatcccgccgttagccacccacacgatctgcgatcgtaatcacacttggttaccagtctctgatgacgcctgctaccgcgaaacttgcccatacatcagagaccccttgaacgggcaggcggtccccgccaacgggacctacgagtttggctatcaaatgcacttcatatgtaatgagggatactatttaattggggaggagatcctgtactgcgaattgaaggggagcgtcgcgatctggagcggcaaaccgccaatctgtgagaaagttctctgtacccccccgcccaaaataaagaatggcaaacacaccttttcagaggtcgaggtgttcgaatacctcgacgctgtgacctatagctgcgaccccgcccctggccctgatcctttttcactcattggagagtccaccatctattgcggagataactcggtgtggtctagagccgctccggaatgcaaggtcgtcaagtgcagattcccagtggttgagaacggcaagcagatctccgggttcggtaagaagttttactacaaggcaactgtcatgttcgagtgcgataagggcttctaccttgatggatccgatactatagtttgcgattcaaacagcacctgggaccctccagtgccaaagtgtcttaaagtgctccctccctcaagcaccaagcccccagccctctcccacagtgtgtccacctcctcaactacgaagagtccagcatccagcgcctctggccctcgtccaacgtataagcctccagttagcaactaccccggttatcccaagcctgaggagggaatcctcgacagcttagacgtttgggtaattgccgtgatagtcatcgcaattgttgttggagtggccgttatttgcgttgttccttatcggtatctccagcgcaggaaaaagaaggggacatacctgactgacgagacccatcgagaggtcaaattcacaagcctctag

SEQ ID NO: 182163 - DNA, 1068 bp, Artificial Sequence
  Description of Artificial Sequence: Synthetic coding sequence
atggagccccccggccggcgggagtgccccttccccagctggcggtttcccggcctcttgttggccgccatggtcctattactgtattccttctcagacgcttgtgaagaacccccgacatttgaggcaatggaactgatcggaaaacccaagccttactatgagatcggtgaacgtgttgattacaagtgcaaaaagggatacttttacatcccacctctggcaactcataccatttgtgaccgtaaccatacatggctcccagtaagcgatgacgcttgctatagggagacttgcccctacataagagatccactgaatggacaggccgtcccagccaacggaacttacgagttcggataccagatgcacttcatttgcaacgagggatactatctcatcggcgaggagattctgtactgcgaattgaaaggttctgttgccatttggtccgggaagccgcctatctgcgagaaggtcctgtgcacccccccccccaagatcaaaaatggaaagcacacattttctgaagtggaagtgtttgaatatctggacgcagtgacatatagttgtgaccctgcacccggtccagatcccttctctctgattggtgaatctactatttattgtggcgacaacagtgtgtggtctcgcgctgcacccgaatgtaaagtggtgaagtgtaggtttccagtggtggaaaacggaaagcaaatttctgggttcggaaaaaagttctactataaggcgacagttatgttcgagtgcgataaaggattttacttggatggaagtgacactatcgtgtgtgactccaatagcacgtgggatcccccggtgcccaaatgtctgaaaggttaccccaagcccgaggaaggaattctggacagcctggacgtttgggtcatcgccgtcatcgtgatcgctatcgtggtgggtgtggctgtgatctgtgtcgtgccctatcgctacctccagcgcagaaagaaaaaagggaaagccgacggcggcgccgaatatgctacataccagacgaagagtacgacccccgccgagcagagaggttag

SEQ ID NO: 182164 - DNA, 1158 bp, Artificial Sequence
  Description of Artificial Sequence: Synthetic coding sequence
atggagccccccggccggcgggagtgccccttccccagctggcggtttccagggctgctcttggcagcaatggtcctgttactgtactccttctcggacgcctgcgaggaaccgccgacttttgaggctatggagttaattggtaagcccaaaccatactatgagataggagagcgagttgattacaaatgcaaaaagggatatttttacatacctccactcgccacccataccatttgcgacaggaaccatacttggctgccggtttcagatgacgcttgctatcgagaaacttgtccgtacatccgtgatcctctcaatgggcaggccgtgcccgccaacggcacttatgagttcggataccagatgcatttcatctgcaacgaaggctattacctgatcggcgaagaaatcctctactgcgaattgaagggttctgtcgccatatggtcaggaaagcccccaatctgcgagaaagtactatgtacgcccccaccaaaaatcaaaaatggaaagcacaccttcagcgaagttgaagtgtttgagtacctcgacgccgttacctatagctgtgaccccgctcccgggcctgacccctttagtcttatcggagagagcactatctattgcggcgacaatagcgtttggtcccgcgctgcccccgaatgcaaggttgtcaaatgtcgatttcctgtcgtggaaaacggtaaacaaattagcggattcggcaaaaagttctattataaggctactgtgatgtttgagtgtgataaaggcttctacctcgatggatcagacaccattgtgtgcgattccaacagtacatgggatccccccgttcctaaatgccttaaggtgctccccccttccagcaccaaaccccctgccctctctcatagcgtttctacctccagtacaactaagtccccagcttcgagcgctagcggttatcccaaacctgaggaagggatcctggattctcttgacgtgtgggtgattgccgtgatcgttattgctatagtcgtgggagtggccgtcatctgtgttgtgccataccgttacttgcagaggcggaagaaaaaaggcaaagccgacggcggagctgagtatgcgacctatcaaaccaaatctacgactccggctgagcaacgcggctag

SEQ ID NO: 182165 - DNA, 1089 bp, Artificial Sequence
  Description of Artificial Sequence: Synthetic coding sequence
atggagccccccggccggcgggagtgccccttccccagctggcggttcccaggcctgctgttagccgcgatggtcctgcttctatattcctttagcgatgcctgtgaggaacccccaacgttcgaagctatggagttgatcggcaaaccgaaaccttattacgagattggtgagcgcgtggactataaatgtaaaaaaggatatttctacatacctccccttgcaacgcacacgatttgtgaccggaaccacacctggttgcctgtgtcagatgacgcatgttatcgtgaaacttgcccatatatcagagatccactcaatggacaagccgtacctgcaaacggcacctacgagttcggataccagatgcacttcatttgtaacgaaggctattacttgattggcgaagagatcttgtactgcgagttaaagggcagtgtggccatctggagcggaaagcctcctatttgcgagaaggtcttatgcacaccccctccgaaaattaaaaacggcaagcatacgttcagtgaagtcgaagtcttcgaatatctcgatgcagtgacatactcttgtgacccggcgccaggcccagaccccttctcactaatcggagaatcgacaatttactgcggtgataatagcgtgtggagcagagccgctccagaatgtaaggtagtaaagtgtaggtttccagtcgtggagaacggcaagcagatttcaggtttcggcaaaaaattctattacaaagcaactgttatgttcgaatgtgataagggcttctatctggacggtagtgatacgattgtgtgcgactcaaatagcacgtgggaccctcccgtgcctaagtgcctcaaggggcctcggcccacttacaagcctcccgtcagcaattatccagggtatcctaaacccgaggagggcattctggactcactggacgtgtgggtgattgccgtcattgtgatcgcaatcgtggtcggtgtcgctgtcatatgcgtggtgccatacaggtatctgcaaaggagaaaaaagaagggaacataccttaccgacgagacccatcgagaggtcaaatttacaagcctgtag

SEQ ID NO: 182166 - DNA, 1134 bp, Artificial Sequence
  Description of Artificial Sequence: Synthetic coding sequence
atggagccccccggccggcgggagtgccccttccccagctggcggttcccagggctcctgttggctgcaatggtgttactcttgtactccttcagcgacgcatgcgaagaacccccgacctttgaagccatggagctgatcgggaagcctaagccctactacgagattggagaaagagtagactacaagtgcaagaagggatacttttacattccacctttggctacccataccatctgtgacaggaatcacacatggctgcccgtttccgacgacgcatgttacagagaaacttgcccatatatccgggatccacttaacgggcaagccgtcccagccaatggcacctatgagtttggctatcagatgcattttatctgtaacgaaggctactatcttatcggcgaggaaatcttatactgtgaactaaagggcagcgtggctatctggagtggcaagcctccaatatgtgagaaggtgttgtgtactccccctcctaagatcaaaaacgggaagcatacattctccgaagtagaagtctttgagtatcttgatgcagtgacatatagctgtgaccctgctccgggacctgaccctttctccctgatcggcgaaagcactatctactgcggtgacaactccgtctggtccagagccgcgccggaatgtaaagttgttaaatgtagattccctgtggtggagaacgggaaacagatctctggatttggaaagaagttctactataaggctactgtcatgtttgagtgcgacaagggattctacctagatggtagtgacactattgtctgtgacagtaactccacctgggatccaccagttcccaagtgcctcaaagtgagcacctcctcaactaccaaatcccccgcctccagcgcaagcggacctagaccaacatataagccacccgtgagtaactaccccggctatcctaagcccgaagaggggatccttgatagccttgacgtgtgggtcattgctgtaattgttatcgctattgttgttggtgttgcagtgatatgcgtggtgccttacagatacctgcagagaagaaaaaagaaggggacgtaccttactgacgagacgcaccgcgaggtgaagttcacctctctgtag

SEQ ID NO: 182167 - DNA, 1011 bp, Artificial Sequence
  Description of Artificial Sequence: Synthetic coding sequence
atggagccccccggccggcgggagtgccccttccccagctggcggtttcctgggctgctcctggccgcgatggtactgctgttgtattcattcagcggcgaaacatgtccttacatccgagaccctcttaatgggcaagccgtcccagccaacgggacctacgaattcggctaccaaatgcacttcatctgcaacgaggggtattacctaatcggagaagaaatactgtactgtgaacttaaaggtagcgtggccatctggtccggtaagccacccatttgtgaaaaggttttgtgcactccaccacccaaaatcaagaatggaaaacacacattctccgaggtcgaagtgtttgagtacctggacgccgtcacttattcttgcgatcccgcccccgggcctgatcctttctccctcattggcgaatccacaatttactgtggggacaatagcgtctggtcacgagctgccccagaatgcaaggtcgttaagtgtcgatttccagtcgtggaaaatggcaaacaaatatccggcttcggtaaaaaattctattataaagccacggtaatgtttgagtgtgataaaggattctacctcgacggatccgacaccatcgtatgcgactcgaattccacttgggacccacccgttccaaaatgcctcaaagtgctaccaccctcctctaccaagccaccggccttatcacactcggtgtcaactagtagcacgaccaaaagcccagctagcagtgcgagcggtcctcggccaacgtataagcccccagtaagtaattatccaggctatcctaaacccgaggaaggaatcctggattctctcgacgtgtgggtgatcgcagtgatcgtgatcgctatcgtggttggtgttgcggtgatttgcgtggtgccttaccgttatctgcagaggcggaagaaaaaaggtaaggctgacgggggcgccgagtatgcaacctatcagactaagtccacaactcccgcagaacaacggggctag

SEQ ID NO: 182168 - DNA, 1095 bp, Artificial Sequence
  Description of Artificial Sequence: Synthetic coding sequence
atggagccccccggccggcgggagtgccccttccccagctggcggttcccaggcctccttctggcagccatggtactcctgttatattcatttagcgatgcatgcgaggagcctccaacttttgaagccatggagctgattggcaagccaaagccttactatgagattggcgaacgtgttgattataagtgcaagaaagggtacttctacattccacctctggcgacacacactatctgcgaccggaatcatacatggttaccggtgagcgatgacgcttgttaccgcgaaacctgtccatacattcgggatcccttaaacgggcaggcggttccagccaacggtacttatgagttcgggtatcagatgcactttatttgtaacgagggctactatttgatcggagaagaaatactgtactgcgaattgaaggggtctgtggctatctggtccggaaagccccctatttgtgagaaagtgctctgcacaccccctcctaagattaagaacggaaaacacacatttagcgaagtggaagtgtttgagtacctcgacgccgtgacttactcatgcgatccagcccccggcccggacccgttctctctgatcggcgaaagcacaatctattgcggcgacaacagcgtgtggtcacgggcagcacccgagtgcaaggtcgtgaaatgccgtttcccagttgtcgagaacgggaaacaaattagcggtttcggcaaaaaattctactacaaggcaacagtgatgttcgagtgtgacaagggattctatctggatgggtcagacactattgtttgcgattccaatagcacttgggatcctcccgtgcctaagtgcctaaaagtctctacttcctccacaactaaaagtccggctagctcagcatccggccccaggcctacatataaaccgccagtgtcaaattacccaggctatccaaaacctgaagaaggcatccttgactccctggacgtgtgggtgattgcagtcattgttattgctatcggaaaacagatggttgagttaaacatgcctctgaccaggctgaaccaacccttacaacagtcacgggaggcggaatag

SEQ ID NO: 182169 - DNA, 1113 bp, Artificial Sequence
  Description of Artificial Sequence: Synthetic coding sequence
atggagccccccggccggcgggagtgccccttccccagctggcggttccccggtctgctgctggccgctatggtcctcttactttactctttttctgatgcatgtgaagaaccccccacatttgaagctatggagctgatagggaaaccgaagccctactacgagatcggcgagagggtcgactacaaatgtaaaaagggttatttctatatcccgcctctcgcgactcacactatttgtgacaggaaccacacctggctgcctgtgtcagacgatgcttgctatcgtgaaacatgcccatacatcagggaccccttaaacgggcaggccgtgcccgctaacggaacatacgagtttggctatcagatgcattttatttgtaacgaggggtattacctaattggcgaagagatcctatactgtgagttaaaaggttcagtcgctatctggtccggaaagcccccaatttgcgagaaagtgctgtgcacaccacctcctaagattaaaaacgggaagcatacctttagtgaggtggaggtgttcgaatatctggacgctgtaacctactcctgcgatccggcccctgggcctgatcccttctcgttaattggggaaagtaccatatattgcggggacaactctgtgtggagtagagccgctccagagtgcaaggtagttaaatgccggtttccagtggtggaaaatgggaagcaaatctccggctttgggaagaaattctactataaggcaacagtgatgttcgaatgtgataagggtttctatctcgacggctctgacactattgtgtgtgactcgaactcaacatgggacccgccagtcccgaaatgtttaaaggtgtcgacttcatcgacaaccaagtcccctgccagttccgcatccggataccctaagccggaggaagggattcttgactctctggacgtctgggtgattgcagtgatagttattgctatcgtggtgggcgtcgcggtgatctgtgtggtcccttaccggtacctacaacggagaaagaagaaggggaaagccgatggcggggccgagtatgccacgtatcagactaagtcgacaactcctgcagaacagcggggctag

SEQ ID NO: 182170 - DNA, 510 bp, Artificial Sequence
  Description of Artificial Sequence: Synthetic coding sequence
atgtgcagccggggctgggacagctgcctggccctggagctgctgctgctgcctctgtcgctgctagtgacctctatccaggggcacctggtgcatatgacagtagtgtcaggctcaaacgtgactctcaatatttctgaaagcctgcccgagaattacaaacagctaacctggttctacaccttcgatcaaaagatagttgagtgggattcacggaagtccaaatatttcgagtctaagttcaaggggcgcgtgagactcgacccccaatccggagcactgtacatttccaaagtgcagaaagaggacaactccacatacattatgcgggtgctaaaaaaaacgggaaatgagcaggaatggaagatcaagctacaggtgctaggggagtctggagagcctaaatctaagtcaccactccagtggccccagatggaccactgcagggccagctgggaggcctggggaaccctaggagaggaagagcgcaagacctctggccaggtgtag

SEQ ID NO: 182171 - DNA, 732 bp, Artificial Sequence
  Description of Artificial Sequence: Synthetic coding sequence
atgtgcagccggggctgggacagctgcctggccctggagctgctgttgctaccactgagtctgctagtgactagtatccaaggacacctggttcatatgacggtcgtgtcaggtagcaacgtcactctgaatatctccgagagtctgcccgagaactataagcaactaacttggttctatacatttgaccagaagatcgtagaatgggatagccgcaagtctaaatatttcgagtccaaatttaaagggagggtgcggctcgacccacaatctggggccttgtacatttccaaggtgcagaaagaagacaattccacatacatcatgagagttttgaaaaagacgggcaatgaacaggagtggaagatcaaattgcaggtgttggatccggtccctaaacctgttataaagattgaaaagattgaggatatggatgacaattgttacctgaaattatcatgtgttatccccggggaatcagtcaactatacatggtacggcgataagcgcccgttcccgaaagagctgcaaaattctgttctcgaaactaccctcatgcctcacaactatagtcggtgctatacttgtcaggtgtccaatagcgtgtcctctaagaacggcaccgtatgtctgagtcccccgtgtacactagctcgcagttttggtgttgaatggatcgctagctggctcgtggttaccgtgcctaccattctgggactgctgctcacctag

SEQ ID NO: 182172 - DNA, 1044 bp, Artificial Sequence
  Description of Artificial Sequence: Synthetic coding sequence
atggccctgctgttcagcctgatcctggccatctgcacccggcccggctttctagcttcgcctagcggtgttaggctggttgggggcttacaccggtgcgaaggccgggtcgaggtggagcagaagggccaatggggcacggtgtgtgacgacgggtgggacatcaaggacgtggcggtgctatgcagggagctgggctgcggcgccgcctctggtactccctcagggatcctgtacgagcctcccgccgagaaagagcaaaaggtgcttatccagtctgtttcgtgtaccggtaccgaggatacgctggctcagtgtgagcaagaagaagtgtatgactgtagccacgacgaagatgctggtgccagttgtgaaaacccggagagctctttcagtccagtgccagaaggcgtgcggctcgctgacggtcctggccactgcaaaggaagggtcgaggtcaaacaccaaaatcagtggtacacggtctgccagactggatggagcctgagggctgccaaggtcgtctgtaggcagttgggctgtggtcgggctgtactgacacagaagaggtgcaataagcacgcatacggacggaagccaatctggctctcccagatgagctgttccggtcgggaggcgactctgcaggactgtccttccggcccttggggtaaaaacacctgcaaccacgatgaagacacttgggtcgagtgtgaagacccattcgatttacgcctagtaggcggagataatttgtgctctggccggttggaagtgctccacaagggcgtgtgggggtctgtctgtgacgacaactggggagagaaggaggaccaggtggtttgtaagcagctgggatgcggaaagtctctgtccccttcgttccgcgatcggaagtgttacggccctggagttgggagaatctggctggacaatgtgagatgttccggagaggaacagagcttggagcagtgccagcacagattctggggtttccatgattgtacccaccaggaggacgtggcagtgatctgctccggatag

SEQ ID NO: 182173 - DNA, 660 bp, Artificial Sequence
  Description of Artificial Sequence: Synthetic coding sequence
atgggcatgagcagcctgaagctgctgaagtacgtgctgttcttcttcaatctcctcttttggatttgtggctgctgcattttagggttcgggatttaccttcttatacataataatttcggcgtgctgttccacaatctgccttcactgacactgggaaatgtctttgtcatcgtgggctccataatcatggttgtagccttcctcggctgtatgggctctataaaggaaaacaaatgcttgctgatgtccttcttcattctcctgctgatcatcttgcttgccgaggtgacactcgccatccttctttttgtctacgagcaaaagttgaacgagtatgtggcgaaaggcttgaccgactccatccataggtaccacagcgataacagcactaaagccgcttgggactctattcaatctttccttcaatgttgtggcataaacggaacctcggactggacatccggcccccctgctagctgtccctctgatagaaaggtcgaaggctgctacgccaaagcccgcttgtggttccacagtaacttcttgtatattggcattataactatttgcgtgtgtgtcatcgaagtgctgggaatgagtttcgccctgactctgaattgccaaattgacaagacatcccagaccatcggcttatag

SEQ ID NO: 182174 - DNA, 483 bp, Artificial Sequence
  Description of Artificial Sequence: Synthetic coding sequence
atgggcatgagcagcctgaagctgctgaagtacgtgctgttcttctttaatctcctgttctggatttgcggctgctgtattttagggttcggaatctatctgttaattcataataacttcggagtgctcttccacaatctgccaagtctgacactcggcaatgtgtttgtgatcgtgggcagcatcatcatggttgtggcattcctgggctgtatggggtccattaaggagaacaagtgccttctgatgagtttctttattcttctcctgattatcctgctggctgaagtgacgttggctatactgctattcgtctatgagcagaaaggttgttacgctaaggctcgattatggttccattcgaactttctgtatatcggcatcattaccatctgtgtttgtgtgattgaggtgctggggatgtctttcgctcttaccctcaactgtcaaatcgacaagactagccagactatcggcctatag

SEQ ID NO: 182175 - DNA, 1323 bp, Artificial Sequence
  Description of Artificial Sequence: Synthetic coding sequence
atgaccgtggcccggcccagcgtgcccgccgccctgcccctgctgggcgaactgccacgactcttgctgctcgtcctgctgtgccttcccgccgtatggggagattgtggattgccaccagacgtgcccaatgcccagccggccctcgagggcaggactagttttcctgaggataccgttataacctataaatgcgaagagtctttcgtcaagatccccggcgagaaggattccgtgatctgtctgaagggcagccagtggagcgacatcgaggaattttgcaataggtcatgtgaggtgcctacccgactcaattctgcctcgctgaaacagccctacattacccagaattactttccagtcgggactgtggttgaatatgagtgcaggccagggtacaggagagaaccttccctatctccaaaattaacatgtctccaaaatctaaagtggtcgactgccgtagaattttgtaagaaaaaatcatgcccgaacccaggcgagattcgaaatggccagattgacgtgcccggaggtattctctttggagccaccattagctttagttgtaacacaggctataaattattcggctcaacgtccagcttttgcctcataagcggcagctcggtgcagtggtctgatccactgcctgagtgcagggagatttactgcccagcccctccccagatcgacaacggaattatacagggcgagcgcgaccattacgggtaccggcagtccgtcacgtacgcctgcaacaaaggcttcactatgattggtgaacacagtatctactgcaccgtcaataacgacgagggcgagtggagcggccctcctccagagtgccggggtaagtcgctaacatctaaagtgccgcccacggttcagaagccgaccactgtcaatgtacctacgactgaggtctcgccaactagtcagaagacaactacaaagaccaccacccccaatgcgcaggctacccgcagcacgcctgtgagtcggacaactaaacacttccatgagaccacgccaaataaaggctcaggtaccacctctggaaccacacgcttgttatctggtagccgccccgtcactcaggcggggatgcgctggtgcgatcggagtagcctacaaagtcggactccgggatttaagcgctcattccattttagtctgccatcttcttggtactatcgggcacatgtctttcatgtggataggtttgcttgggatgctagtaaccacggactggctgatctcgctaaggaggagttaagaagaaagtatacccaagtgtaccggctgttcctggtatcttag

SEQ ID NO: 182176 - DNA, 1095 bp, Artificial Sequence
  Description of Artificial Sequence: Synthetic coding sequence
atgaccgtggcccggcccagcgtgcccgccgccctgcccctgctgggagagctcccccgcctgttgctactagtgctgctgtgcctgccagctgtgtggggagactgcgggttaccaccggatgtaccaaacgcacagccagcactcgaaggaaggacctcatttccggaggatacggtcatcacatacaagtgcgaggagagtttcgtgaagattcctggagagaaagacagcgtgatttgccttaaggggtcccagtggtctgacatcgaggaattttgtaaccgctcatgtgaggtccctacaaggttgaactctgccagcttaaaacaaccatacattacccaaaactacttccctgtgggcaccgtcgtggaatacgagtgccggccaggctatagacgcgaaccctcattgtctccaaagctgacttgcctgcagaacttgaagtggagcaccgccgtcgagttctgtaagaagaaatcctgccctaatcccggagagattcgtaacggtcagatcgacgtcccaggaggaatcctgtttggtgctaccattagtttttcttgcaacaccggctataagcttttcggtagtaccagcagcttctgtcttatctctggttctagtgtccaatggtctgacccgctccctgaatgtcgtgaaatctactgccccgctcctccccagattgataatgggatcatccagggtgaaagggatcactatggctaccgccagagtgtgacttatgcatgcaacaagggtttcacgatgattggggaacattcaatttattgcacggtgaacaacgatgaaggtgagtggagtgggccaccccccgaatgcagaggcaaatcactgaccagcaaggtgccgccaacggtccagaagccgactaccgtgaatgtcccgaccacggaagtgagtcctacatctcagaaaaccaccactaaaacaacaacaccaaatgcacaggcaacacgcagcactcccgtttcgaggaccactaagcacttccatgaaactacaccgaataagggatctggaaccacgtccggtactaccaggttattgagcgtgctattcatgtag

SEQ ID NO: 182177 - DNA, 1146 bp, Artificial Sequence
  Description of Artificial Sequence: Synthetic coding sequence
atgaccgtggcccggcccagcgtgcccgccgccctgcccctgctgggagagctgccacggctcttgctcctcgtcctcctctgccttccagctgtatggggtgattgcggcctacccccagatgtgcccaatgcccaacccgccctggagggccgtacctcctttcccgaggatacagttatcacctacaagtgtgaggagtcattcgtaaagattcccggggagaaggactctgtaatctgcctcaaaggaagccaatggtccgacattgaggagttttgcaacaggtcatgtgaggtccctaccaggctgaactcggcttctctaaaacaaccttacattacacaaaattacttccccgtcgggaccgttgtggagtacgaatgtcggcccggctaccggagagagccttcactgtcccccaagttgacttgtctccagaatctgaaatggagcacagccgtcgagttttgtaagaaaaagtcctgccctaatcccggggaaatcaggaatggccagatagatgttcctgggggaattctgttcggggcgaccatctcattttcgtgtaacacgggttataagctgttcggctcaacatcctccttctgcctgatttcaggaagcagtgttcagtggagtgaccccttgccagagtgccgcgagatctactgcccagccccgcctcagatagacaacggcatcatccagggcgagagggaccattacgggtaccgccagtccgtgacatacgcttgcaacaaaggcttcacaatgatcggcgaacatagcatatattgcactgtgaataacgatgaaggtgagtggtccgggccaccgccggagtgccgcggcaagtcactcacaagtaaggtgccacctaccgtgcagaaacccactactgtgaacgtcccgacgactgaggtttctcctacgtcgcagaagactaccaccaagacaaccaccccaaatgctcaggctactcgctctaccccagttagccggacgaccaaacactttcacgaaacaacacctaacaaaggatccggcactacctccggcacaacacggctgctctccggacacacatgttttacactgaccggactattaggtacccttgtcaccatgggcttgctgacatag

SEQ ID NO: 182178 - DNA, 1320 bp, Artificial Sequence
  Description of Artificial Sequence: Synthetic coding sequence
atgaccgtggcccggcccagcgtgcccgccgccctgcccctgctgggcgagctccctcgcctgctcctgctggtgcttctgtgcctgcctgcggtgtggggggactgcggactaccgcccgatgtcccaaatgcccagccggccctggaaggaagaacatcatttcccgaagataccgttatcacatataagtgtgaagaaagttttgttaagatcccaggggagaaggactccgtgatttgtcttaagggcagccagtggagtgacattgaggaattctgtaatagaagttgtgaagtgcccacccgcctgaattccgcaagcctcaagcaaccctacatcacacagaattactttcccgttgggacagtggttgaatacgagtgtagaccaggctaccggagggagccgtcactaagccccaagctgacttgcctgcagaacctgaagtggagcacggctgttgagttttgcaagaaaaaatcatgtccaaacccaggcgaaatccgtaatgggcagattgatgtcccagggggcattctcttcggggcaaccatttcattttcatgcaacactggatataagttgtttggctcaacctcatcgttttgtctgatttccggcagtagcgtccaatggtccgaccctctgcccgagtgtcgggaaatatattgccctgctccgccacagatcgataacggaattatacaaggagagcgggaccactatggataccgtcagagcgtgacctatgcatgcaataaagggtttacaatgatcggcgagcacagcatctactgcaccgttaataatgatgagggggagtggagcggtcctccccccgagtgtaggggaaagagcctcacttcgaaggtgccgccaaccgtgcagaagccaaccactgtgaacgtgcctaccacagaggtcagcccgaccagtcaaaagacaacaactaaaacgaccactcccaatgctcaggcaactcgctccacaccagtttccagaacgacaaagcactttcatgaaaccacacctaataaaggttccggcaccacaagcgggaccactcggctcctgtctgagaccgtgttccatcgggttatccaggatggcctggacctgctggcttctcgctccgcgtgcctggggctcccgaagtgttgggactaccggagagagcccccacatttggccagagctcacgtgtttcacgtggacagattcgcttgggacgctagcaatcatggtttagccgacctagccaaagaggaactgcgtcgtaagtacacccaggtgtaccgtctgtttctcgtgagctag

SEQ ID NO: 182179 - DNA, 390 bp, Artificial Sequence
  Description of Artificial Sequence: Synthetic coding sequence
atgaccgtggcccggcccagcgtgcccgccgccctgcccctgctgggcgaactaccgcgcctgttacttttggtgttattatgtctgccggcagtttggggtgactgcggccttccgccggatgtgccaaatgcccagccagctctcgagggccgtacctctttccctgaagataccgtcatcacttacaaatgtgaggagtcctttgtaaagatcccgggggagaaggattctgtcatttgtttgaaggggtcccagtggtccgatatcgaggagttctgtaatcgttcctgcgaggtacccacacggctacaaaaacggactttttctattaccaaaactaacctgccgtcggagtttaagatggtccacagcagcaggattctatag

SEQ ID NO: 182180 - DNA, 1155 bp, Artificial Sequence
  Description of Artificial Sequence: Synthetic coding sequence
atgaccgtggcccggcccagcgtgcccgccgccctgcccctgctgggtgagcttccgcgtctgctgctcttggtcctgttatgtttacctgctgtgtggggggattgcggacttcctccggatgtccctaatgcgcagcccgcgttggagggcagaacctcatttcctgaagacaccgtgatcacttacaaatgcgaggaaagcttcgtcaagattccaggagaaaaggatagtgtgatctgtctgaagggcagtcagtggagcgacatagaggagttttgcaataggtcttgcgaggtgcctacgaggctaaattcagcttcgctgaagcagccctacatcacgcaaaactacttcccggtgggaacagtggtggagtacgaatgtagacctggttatcgtcgagagcccagcttgtcccccaagctcacctgcttacagaatctgaaatggagcacagcggttgaattttgtaagaagaagagctgccctaatccgggcgagatccgcaatggacagattgatgtccctgggggtattctctttggggctacgatctcattttcatgcaacacggggtacaagctgtttgggagtacatccagcttttgcctaatttccgggagtagtgtgcagtggtcggacccactgcccgaatgtcgggaaatttactgtcctgcacccccacaaatcgacaacggcattattcagggcgagcgggaccattacggctaccgacaaagtgttacgtacgcatgcaataagggcttcactatgatcggagagcatagcatctactgtactgtgaataacgatgaaggagagtggtccggtccgccacccgagtgccgcgggaaatctctgacctctaaagtaccacctacggtacaaaaaccaaccactgtcaacgtccccacaacagaagtgagcccgaccagccaaaaaacaacaacaaagacgactacgcccaatgcccaagcaaccaggagcactcccgtcagcagaaccactaagcattttcatgagacaactcccaataaagggtccggcacaacatcagggacaactaggctgttgtccgcactccaggtgaggccattcgaagtctctggatcctctcacatttcaagcaaaaagatgatgtgcattctgtag

SEQ ID NO: 182181 - DNA, 954 bp, Artificial Sequence
  Description of Artificial Sequence: Synthetic coding sequence
atgaccgtggcccggcccagcgtgcccgccgccctgcccctgctgggtgaactccctcgattgctgttactggtgctactctgcctgccggctgtctggggggactgcgggctacccccagatgtaccgaatgcccaaccagcgctagagggcagaacctctttccccgaagataccgttataacctacaaatgcgaggagagtttcgtcaagatcccaggcgaaaaggattcagtaatatgtttgaagggcagtcagtggagtgatatagaagagttctgtaatcaaaagagttgtcctaatcccggcgagatccgcaatggccaaatcgacgtacctggggggattctgttcggagctacaatttccttctcctgtaacacaggttacaagctgttcggcagtactagctctttttgcttgatttccggatctagcgtccagtggtccgatcctctgcctgagtgccgcgagatctattgtccagcgcctcctcagatcgacaacggaatcattcagggcgagagggaccactatggctaccggcagagcgtgacctatgcatgtaacaaagggtttacaatgatcggcgagcattctatttactgtaccgtaaacaacgacgagggcgagtggagtgggcctcctccagagtgtaggggcaagagtctgacctcgaaagtgcctcccacagtgcagaaacccacaacagtgaacgtgcctaccaccgaagtaagcccgaccagccagaagacaacaacaaagacgactacccccaacgctcaagctactcgctctactccggtgtcccgcaccactaagcattttcacgagacaacccctaataaaggctcaggaactaccagtggccagctgactctgttttctgggcatacttgcttcactctgaccggactcctgggcacgctcgtaactatgggcctcctcacatag

SEQ ID NO: 182182 - DNA, 753 bp, Artificial Sequence
  Description of Artificial Sequence: Synthetic coding sequence
atggtggccggcagcgacgccggccgggccctgggcgtgctgagcgttgtctgtctgctgcattgttttggcttcatttcttgcttctctcagcaaatttatggcgtggtgtacgggaatgtgacgttccacgttccctcaaacgtgccactcaaagaggtgctctggaagaagcaaaaagataaagtcgctgaattagaaaactctgaatttagggcctttagtagctttaagaatcgcgtttatctagatacggtgtctgggagcctgaccatctacaacctgacctccagtgatgaggatgagtacgagatggagagccccaacatcacagatactatgaaatttttcctgtatgttttagagtctctgcccagccccactttaacctgcgctttaacaaacggctctatcgaggtgcagtgcatgattcccgaacactacaattctcatcgcgggctgatcatgtattcatgggactgccccatggagcagtgcaaacgtaattccacctccatatatttcaagatggaaaatgatctaccgcagaagatccagtgcaccctgtccaatccactctttaacacgacctcatctataattctcacgacttgtataccgtcttctgggcatagtagacataggtacgccctgattcctattccactggccgtgattaccacctgtattgtgctgtacatgaacggcatcctgaagtgcgatcggaaacccgaccgaaccaacagcaattag

SEQ ID NO: 182183 - DNA, 747 bp, Artificial Sequence
  Description of Artificial Sequence: Synthetic coding sequence
atggtggccggcagcgacgccggccgggccctgggcgtgctgagcgtggtgtgcctgctacactgcttcggtttcatctcctgtttctcacagcagatctacggcgtagtgtacggcaacgtcaccttccacgttccctcaaatgttcctctgaaagaagtgctgtggaagaaacagaaggacaaagtggctgaactcgagaattcagaattccgggccttttctagtttcaagaaccgggtttatctcgataccgtgagcggatcacttacgatatacaatctcaccagttccgacgaggatgaatacgaaatggagtcacccaatattacagacaccatgaaatttttcctgtacgtgctcgaatctctcccttcccctaccctcacctgtgccctgacgaatgggtccatcgaggtgcagtgcatgattccagagcactacaacagccataggggcctgatcatgtatagctgggattgtcccatggagcagtgtaagcgcaactcaacctcaatttatttcaagatggagaacgatttaccacagaagatccagtgtactctatccaaccctctgtttaacactaccagttccatcattcttactacatgcattccatcttccggacattctaggcaccggtacgccttgatccccatcccgctggctgttatcactacctgtatcgttctatacatgaatggcatcctgaagtgtgacagaaagcctgataggactaagtag

SEQ ID NO: 182184 - DNA, 387 bp, Artificial Sequence
  Description of Artificial Sequence: Synthetic coding sequence
atgggcatccagggcggcagcgtgctgttcggcctgctgctggtgctggctgtgttctgccactccggtcacagccttcagtgctataactgccctaaccctacggccgactgcaaaactgccgttaactgcagctcagactttgatgcgtgcctgatcaccaaggcgggtctccaggtatacaacaagtgttggaagttcgagcattgtaattttaacgatgtgaccacccgcctgcgcgagaatgaattaacgtattactgctgcaagaaagatttatgcaatttcaacgagcagctggagaatggtggaacttccctgagtgaaaagacagtgttactgctcgttaccccatttctggctgctgcatggtcccttcatccctag

SEQ ID NO: 182185 - DNA, 387 bp, Artificial Sequence
  Description of Artificial Sequence: Synthetic coding sequence
atgggcatccagggcggcagcgtgctgttcggcctgctgctggtgttggcagttttttgccattcaggacactccctccaatgctataactgtcctaatcctactgcagattgcaaaacagcagttaattgctcctccgacttcgacgcatgcctgatcactaaggctggtctgcaggtgtacaacaaatgttggaaattcgaacactgtaattttaacgatgttactacccggttaagagagaacgaactgacatattactgctgtaagaaggacctgtgcaactttaatgaacagctggagaacggtggcacttctctttcagagaagaccgttttgctgctggtgactcccttcttggccgccgcatggagcctacatccctag

SEQ ID NO: 182186 - DNA, 387 bp, Artificial Sequence
  Description of Artificial Sequence: Synthetic coding sequence
atgggcatccagggcggcagcgtgctgttcggcctgctgctggtgctggccgttttctgccatagtgggcattccctgcaatgctacaactgccctaatcccaccgccgactgcaaaactgctgtgaactgttcgagtgattttgatgcctgtctgattacaaaggccggattgcaggtgtataacaagtgttggaagttcgagcactgtaatttcaacgacgtcacgaccagactgcgggagaacgagcttacttattattgctgtaaaaaagacttatgcaatttcaatgaacagctggaaaacgggggaaccagcctgagcgaaaagactgtgctactgctagtgactccatttctggcagctgcctggtctctgcacccatag

SEQ ID NO: 182187 - DNA, 387 bp, Artificial Sequence
  Description of Artificial Sequence: Synthetic coding sequence
atgggcatccagggcggcagcgtgctgttcggcctgctgctggtgctggccgtgttctgtcatagtggacactctctgcagtgttacaattgtcctaaccccacggccgattgcaagactgccgttaactgttcatctgattttgacgcatgtctgatcactaaagcaggtctgcaggtgtataacaaatgttggaagtttgagcactgcaactttaacgatgttaccactcggctgagagagaacgagctgacctattactgctgtaagaaagatctatgtaattttaacgagcagcttgaaaatggtggcacgtcattaagtgaaaagactgtgctcttgttggtgacaccattcttggcagcagcatggtccctccatccctag

SEQ ID NO: 182188 - DNA, 387 bp, Artificial Sequence
  Description of Artificial Sequence: Synthetic coding sequence
atgggcatccagggcggcagcgtgctgttcggcctgctgctggtgctggcagtgttttgccactccggtcatagtctgcaatgctacaactgccccaacccaaccgcagattgtaagaccgctgtcaactgcagcagcgactttgatgcgtgtcttattaccaaagccggacttcaggtgtacaataagtgttggaagttcgagcactgcaacttcaacgacgtaacaaccaggctgagagaaaacgagttaacttactactgttgtaaaaaggacctctgtaatttcaacgagcaactcgagaatggaggcacaagcctgtctgagaaaactgtgttgcttctagtgacaccatttttggctgcagcttggtccttacacccatag

SEQ ID NO: 182189 - DNA, 387 bp, Artificial Sequence
  Description of Artificial Sequence: Synthetic coding sequence
atgggcatccagggcggcagcgtgctgttcggcctgctgctggtgctggcggtgttctgccatagtggccactctctgcagtgttataactgtcctaaccctaccgcggactgcaaaaccgctgtcaattgcagctccgacttcgacgcctgcttgattactaaggctggtcttcaggtgtataataagtgctggaaattcgaacactgcaatttcaatgatgtgacgacccggctgcgggagaatgagctgacgtattactgttgcaagaaagacctttgcaacttcaatgaacagcttgagaatgggggtacttccctctctgagaagaccgttctgctcctggtcaccccttttctggccgccgcctggtcattacatccctag

SEQ ID NO: 182190 - DNA, 387 bp, Artificial Sequence
  Description of Artificial Sequence: Synthetic coding sequence
atgggcatccagggcggcagcgtgctgttcggcctgctgctggtgctcgctgttttttgccatagcgggcactcactgcagtgttataactgtccaaatcccacagccgattgcaaaaccgcggtgaattgctcaagcgattttgatgcctgcttaataaccaaggccggactgcaggtttacaacaaatgctggaaattcgagcactgtaatttcaatgatgttactacgagattgcgtgaaaacgagcttacatattattgttgcaagaaggacctgtgtaatttcaatgaacagctggagaacgggggaacctctctctctgagaaaacagtcttacttctggtcactccattcctggcagcagcatggagtctgcatccatag

SEQ ID NO: 182191 - DNA, 387 bp, Artificial Sequence
  Description of Artificial Sequence: Synthetic coding sequence
atgggcatccagggcggcagcgtgctgttcggcctgctgctggtgctggctgtgttttgccatagcggccactctctgcagtgttataactgcccaaatccaaccgctgattgtaagaccgccgttaactgtagtagtgactttgacgcatgcttgattacaaaggctggactccaggtgtacaacaaatgctggaagtttgaacactgtaacttcaatgacgtcaccacgcgactgagagagaacgaacttacctactactgctgtaagaaggacctgtgcaatttcaatgagcaattagagaatgggggtacctcactgtctgagaagactgtgttgctcctggttacgccttttctggctgccgcctggagtctccacccctag

SEQ ID NO: 182192 - DNA, 387 bp, Artificial Sequence
  Description of Artificial Sequence: Synthetic coding sequence
atgggcatccagggcggcagcgtgctgttcggcctgctgctggtgctggcagtgttctgtcatagcggtcacagtctgcagtgctataattgccccaaccccacagcggactgcaagacggcggttaattgttcctccgactttgacgcctgtctgattacaaaggccgggctgcaggtctacaataaatgttggaagttcgaacactgcaactttaacgacgtaacgacacgcctgagggaaaacgaactgacatattactgctgtaaaaaagacctgtgtaactttaatgagcagcttgaaaatggtggaacctccttgtcggaaaaaacagttctcctcctggttaccccctttctcgccgctgcatggagtctccatccatag

SEQ ID NO: 182193 - DNA, 2007 bp, Artificial Sequence
  Description of Artificial Sequence: Synthetic coding sequence
atgtggctgttcttcggcatcaccggcctgctgaccgccgccctgtctggacatccctccccagctccaccagaccagctgaacaccagttccgctgaatctgagctttgggagcccggcgagaggctccccgtaaggctcacaaatggttcttcatcctgtagcggcactgtggaggttcgattagaggcatcatgggagccagcttgcggagcattatgggatagtcgagcagccgaggcagtatgtcgggccctggggtgcggtggcgccgaagctgcaagccagctggcacctcccactccagagttgcctcccccaccagccgcaggtaacacgtcggtcgcagcgaacgctaccttggcaggagcaccggccctcctttgttccggcgcagagtggaggctctgtgaagtagtggagcatgcatgtcgatcggacggccgaagggcacgcgtgacctgcgcagagaaccgtgcgctgcggttggtggacggcgggggggcatgcgccggacgggtagaaatgctcgagcacggagaatggggctcagtctgcgatgacacctgggatctcgaggacgctcacgtggtttgccggcagctgggctgtggttgggcggtacaggccctgccaggactccattttactcccgggagaggccccatacaccgagatcaggtgaattgtagtggcgcagaagcgtatttgtgggactgccctggtctgcccggtcagcattattgcggccacaaagaagatgctggggcagtttgtagcgaacatcagtcatggcggctgactggaggtgcagaccgttgtgagggccaggttgaggtgcatttccggggggtgtggaacaccgtctgcgactctgaatggtatcccagtgaggctaaagtgctttgccaatctctcggttgcggtacggctgtcgagcggcccaaaggacttccgcatagcctcagtggccgtatgtactacagttgtaatggagaggagcttaccttatcaaactgctcatggaggttcaataattctaacctgtgctctcagtccttagccgctcgcgtgctctgcagcgcctccaggtcactacataacctctcaactcctgaggtacccgcctcggtccaaacagtaaccatcgagtccagcgtaacagttaagatagagaacaaggaaagtcgcgagctgatgctgctgattccaagcatcgtgctggggattcttctgttgggtagtcttattttcattgctttcattctactgcggattaaagggaaatacgccctgcctgtcatggtgaatcaccaacacctgcccactaccatacccgccggctcaaattcttaccaaccggtccccataactatcccgaaggaagtgtttatgcttcccatccaggtgcaggctcctccacccgaggattccgactctggatctgactctgattacgaacactatgacttctcggctcagccccccgtcgctcttactactttctataacagccaaagacacagggtgacggatgaggaggtgcagcaatcgcgattccagatgcctccacttgaggaaggacttgaagagctacacgcatcacacattcccactgccaaccccggccactgtattacggacccgccgtccctcgggcctcagtaccaccccaggagtaactcagagtcatctacttcatcaggagaggactactgcaattcacccaagtcaaagttgccaccctggaatccccaggtgttctctagtgaacgctcttcttttctggaacaaccgcccaatctggagcttgctggaacgcaacctgccttctctgctgggcctcctgcagacgactcttcctctacgtctagtggcgagtggtatcaaaattttcagcctcctccacagcctccgtcggaggagcaatttggttgtcctggtagtccttcacctcagccggatagtactgacaatgacgattatgatgatatcagtgcagcatag

SEQ ID NO: 182194 - DNA, 1911 bp, Artificial Sequence
  Description of Artificial Sequence: Synthetic coding sequence
atgtggctgttcttcggcatcaccggcctgctgaccgccgccctgtccggtcacccaagccccgccccacctgaccaactcaatacttccagtgcagaaagcgaactgtgggagccaggagaaagactcccagtgagattgacaaatggtagctcttcctgtagtgggacagtggaagtgaggttagaggcaagctgggaacctgcttgtggagctttgtgggatagtcgcgccgcagaagccgtctgtagggccttggggtgcggaggggccgaggcggcttcccagcttgcccctccaactccagagcttcctccgccacctgcggctggaaacaccagcgttgctgctaatgctacactggctggtgcaccagccctgttgtgcagcggcgctgagtggcgcctttgcgaagtggtggagcacgcatgtaggagcgatggtagaagggcgagggttacctgcgcggagaaccgggctctgcgtctcgtcgacggaggaggagcctgtgctggacgcgtggaaatgctggagcatggggaatgggggtctgtctgcgatgatacctgggacctcgaggatgcccacgtggtgtgtcgccaactaggttgcggatgggccgttcaagctctgccaggtctgcatttcactcctggtcggggacctatacatcgcgatcaggtgaattgttcaggggccgaagcctatctgtgggattgtcccggcttacctggacaacactattgcgggcacaaagaagatgcaggcgcagtttgctccgaacaccagtcatggcggctgaccggaggagcggacagatgcgagggtcaagtcgaggtgcacttcagaggggtgtggaacaccgtttgtgatagcgaatggtatccatccgaagccaaggtattatgtcaatccctgggctgtggaaccgccgtagagcgcccaaagggtttgccccactctctttccgggcgaatgtattattcttgtaacggcgaggagctgactctatcgaattgctcttggcgtttcaacaattctaatctatgttcccagtccctggcagctcgcgtgctgtgttccgcatcccgatcactgcacaatctgtcgaccccagaggtgcctgccagtgtccaaaccgtgaccatcgagagcagcgtgaccgtgaaaatcgaaaataaggagtccagggagctgatgttactcataccctccattgtgctgggaatcctactattgggttccctcatctttatcgctttcattctcctgcggataaagggcaagtacgtctttatgctgccaattcaggttcaggcccctcccccagaagactcagactctgggagcgactctgactacgagcattacgacttctccgcccaacccccagttgccctaactacattctacaattcccagcggcatcgtgtgacagacgaggaagttcaacagagccggttccaaatgccacccctcgaggaaggtctggaggaactgcatgcgagccacattccaacagccaatcctggacactgcattaccgaccccccgtcacttgggccgcaatatcacccacggagcaatagcgagagctccacctcatctggcgaggactattgtaatagcccaaaaagcaagttacccccttggaaccctcaggtttttagtagcgagaggagctccttcctcgaacagcctcccaacttagaactggctggcacccagcctgcattctccgcaggaccacccgccgatgactcctcctctacgtccagcggcgagtggtatcagaactttcagccccctccccaacctccaagcgaggagcagttcggatgcccagggtctccgtcaccgcagccggattccactgacaatgatgactacgacgatatctccgctgcttag

SEQ ID NO: 182195 - DNA, 1788 bp, Artificial Sequence
  Description of Artificial Sequence: Synthetic coding sequence
atgtggctgttcttcggcatcaccggcctgctgaccgccgccctgtcgggccaccccagtcctgcaccccccgaccagctgaacacaagtagcgcggaatcggaactgtgggagcccggggagcggttgcctgttaggctgaccaacggctcttcatcttgctctggcacagtcgaagtcagactcgaggcaagttgggaaccagcgtgcggcgccttgtgggattccagggcagccgaagcagtgtgtcgcgccctgggctgtggaggggcggaagccgcaagccagctcgcacctccgacgcccgaattgcctccgccgccagctgctggaaatacctccgtcgccgccaacgccacgctggcgggggctcccgctctgctctgctccggcgccgagtggcgcctgtgcgaagtagttgagcatgcttgcagatcagacgggaggcgagccagagtcacctgcgctgagaaccgcgctctgagactggtggacggcggaggtgcctgtgccgggagggtcgaaatgctcgaacacggagaatggggtagtgtgtgcgacgatacttgggatctcgaggatgctcacgtggtttgccgccagcttgggtgcggatgggccgtgcaggcactccctggcctacactttacccccggacgaggaccgatacatcgtgaccaggtaaactgttcgggagctgaagcttacctctgggattgccccggtctccccggccagcattattgtggtcacaaggaagatgcaggagccgtgtgttctgaacatcaatcctggcgccttaccggcggagccgacagatgcgagggccaggttgaagtccactttagaggtgtgtggaacactgtctgcgattcagaatggtacccgagcgaggccaaagtactgtgtcaaagcctgggatgtgggactgccgtggagagaccgaaagggctaccccactccttatctgggaggatgtactactcatgcaacggggaggagctgacactctcaaactgtagctggcgattcaataactcaaacctttgtagccagtctctcgccgcgcgtgtattgtgcagtgcatcccgttccctgcacaacctgagtacacctgaggtcccagccagcgtgcagaccgtaacaatagagagctctgtgactgtgaagattgaaaacaaagagtccagagagctcatgctccttattccctccatagtcctgggaattctcctgctcgggtccctgattttcattgccttcatcctcctgagaatcaaaggtaagtatgattctcagcggcatagagtgactgatgaggaggtgcagcagtctcggtttcagatgcccccgctggaggaaggcctcgaggaactacacgcctctcatatcccgaccgccaacccaggccattgcatcaccgacccacccagccttggaccccagtaccatcctcgctctaactctgaatcctcaacaagctccggcgaggactattgtaattcacccaagtccaagttgcctccctggaatccccaggtgttttcttccgaaaggagtagctttctggagcagccccctaacctggaacttgctgggactcagcccgctttcagtgctggacccccagcggacgattcgagctcgacttctagcggggaatggtaccagaatttccaaccacccccccaacctccaagcgaagagcagttcggatgtcctgggtctccctctccacagcctgactctacagacaatgacgactacgatgacatctctgctgcatag

SEQ ID NO: 182196 - DNA, 1806 bp, Artificial Sequence
  Description of Artificial Sequence: Synthetic coding sequence
atgtggctgttcttcggcatcaccggcctgctgaccgccgccctgtccgggcaccctagccccgccccccctgatcaacttaatacttcaagcgccgagtccgagctgtgggagcctggagaaagactgcccgtgagactgacgaacggctcctcttcttgctccggcacagtggaagtgcggctggaagcctcctgggaacctgcctgcggtgccctgtgggattcaagggcagctgaggcagtttgcagggcattgggctgcggcggggccgaggccgcctcacagcttgcccctccaactccggagctgcccccaccaccagcagcaggaaatacatctgttgcagcaaatgccacattggctggcgctcccgcgttgctgtgcagtggagccgagtggagactatgtgaagttgtcgagcatgcttgtcggtccgacggcagaagggcaagagtgacatgtgccgaaaatcgagccctacggctggtcgacggcggaggggcctgcgccggacgagtcgaaatgctggagcatggtgagtgggggtccgtgtgcgacgacacatgggacctggaagatgcccacgtggtgtgtcgacagttaggctgcgggtgggcggtccaggccctgcccggccttcatttcaccccggggcgcgggcccatacatcgcgaccaggtcaactgcagcggggcggaggcctacctctgggactgcccaggcttacccggccagcactactgcggacataaagaagacgcaggggcagtatgctctgagcatcaaagctggcgactcaccggcggggctgatagatgtgagggacaggtcgaagtccatttccgtggggtgtggaacacagtatgcgacagcgaatggtacccgtcagaagctaaagtgctctgtcagtcattgggatgtggcaccgccgtggagcgtcctaagggactcccacatagcttaagcggacgcatgtattactcgtgcaatggcgaagaactgaccttgagtaattgctcctggcgtttcaacaacagcaacttgtgctcccagtctctggcggcccgcgtgctttgctcggcctcaagaagtctgcataatcttagtacccctgaggttccagcttccgttcaaactgtgacaattgagtcgtctgtgaccgtgaagatcgaaaataaagagagcagggaacttatgctgctgattccatcgatcgtgctaggcatcctgcttctcggaagcctcatatttattgcgtttatcttgctccgcataaagggaaaatacgtattcatgctgcctatccaggttcaggctccaccacccgaggatagtgactctgggagcgatagtgactatgagcattacgatttttcagctcagcctcccgttgccctgactaccttttataacagccagcgccacagggtcacagatgaggaagttcaacagtcccggttccagatgccgcccctcgaggaggggctcgaagaactgcatgcctctcacatcccaactgcaaatcccggccattgtataacagaccctcccagtcttggccctcagtaccatcctcgttctaatagcgaaagctcaacgtcatcaggggaagactactgtaactcccctaaatccaagctgcctccatggaatccacaagtgttctcgagtgagcgcagcagcttcctggagcaacctcctaatctcgagctggctgggacacaacctgcctttagcggctccccctccccacagccagactccaccgacaatgatgactatgacgatatcagtgctgcttag

SEQ ID NO: 182197 - DNA, 1779 bp, Artificial Sequence
  Description of Artificial Sequence: Synthetic coding sequence
atgtggctgttcttcggcatcaccggcctgctgaccgccgccctgtctgggcatccttccccagcacctcctgaccagctcaacacttccagcgcagaatccgaactgtgggagcccggcgagagactgccagttaggctcaccaacggcagcagctcttgtagcggcactgtcgaggttcgcttggaagcatcttgggaacccgcgtgcggggccctgtgggattcacgagctgccgaggctgtgtgccgcgctctggggtgcggcggagctgaggcagctagccagctagcccctcctacacctgagctaccccccccacctgccgctgggaacacctctgtggcggctaatgccacactggccggggcccctgccctgttatgttctggtgctgagtggaggttatgcgaggtcgtagagcacgcctgccgcagcgatgggcgcagggccagagtgacatgtgccgagaacagggccttgagattagtcgatggcggaggggcctgcgccgggcgggtggaaatgcttgaacatggtgagtggggttctgtgtgcgacgacacatgggacctggaggatgcgcacgtagtttgtcgccagctgggatgtggatgggcagttcaggccctgccaggcttgcactttactccaggccggggaccaattcatagagaccaggtgaactgtagcggagcagaggcctatctgtgggactgtccgggcctaccgggacagcattactgcgggcataaggaggacgcaggagctgtgtgttccgagcatcagagctggagattgaccggcggggctgatcgctgtgaaggacaggttgaagtccatttcaggggagtgtggaacacggtgtgcgactctgaatggtatccttctgaggcaaaggttctgtgtcaatctctcgggtgcgggactgcagtggagcggcccaagggactgcctcactcactttccggtcgcatgtattattcctgcaatggcgaggagctaacgctctcaaactgtagttggaggtttaacaacagtaatctgtgttcccagagccttgccgccagggtgttgtgttctgcttccaggtccttacataatctctctacacctgaagtgcccgcatccgttcagaccgtaacgatcgaaagcagtgttacggtcaaaatcgagaataaggagtcacgcgaactgatgctgctaatcccctcaatcgtcctgggaatcctgctgctgggttccttgatctttatcgcattcattctgctgaggattaagggcaaatacgccctgcctgtgatggtcaatcaccaacacctgccaactactatcccagcgggtagtaatagttatcagccagttccaattacaatccctaaggaggactcgcaacggcatcgagtaaccgacgaggaggttcagcagagtagatttcaaatgcctcccttggaagaggggttagaagagttgcacgcctcccatatcccgaccgcaaacccagggcactgcataaccgacccgccctccctggggccccaataccatccaagaagcaactctgaatctagtacctctagcggggaagattattgcaatagcccaaaatctaagcttcccccatggaacccccaggttttttctagcgaacgatccagtttcctcgagcaacctccaaacttagaactcgcggggacacagccagcgttcagcggatcaccgtccccccagccggacagcacagacaacgacgactatgacgatatttcagctgcctag

SEQ ID NO: 182198 - DNA, 717 bp, Artificial Sequence
  Description of Artificial Sequence: Synthetic coding sequence
atggccgtggagggcggcatgaagtgcgtgaagttcctgctgtacgtgcttctcctagccttttgcgcctgcgccgtcggcttaatagccgtcggcgtgggtgcccaacttgtgctgtctcagactattatccaaggcgccacaccgggcagcctattgcccgttgtgattatcgccgttggagtgtttctgtttctggtcgcatttgtgggctgttgcggagcatgtaaagagaattattgcctcatgataacgttcgccattttcctgagtctcattatgcttgtagaggtcgctgcagcgattgccggttacgtgttcagagataaggttatgtccgagtttaataacaattttcgccaacaaatggaaaactatccaaaaaataaccacactgcatccattctggataggatgcaggcggattttaaatgttgcggtgccgctaactacacagattgggaaaagatcccgagcatgtctaagaaccgcgttcccgattcatgctgtataaacgtgactgttggctgtgggataaattttaacgagaaggctatacacaaggagggttgcgtcgaaaaaattggggggtggctaaggaaaaatgtcctcgtggttgctgccgccgcattgggcatcgctttcgtggaagttcttggcatcgtgttcgcttgttgtctagtgaaatccatcaggagcgggtacgaagttatgtag

SEQ ID NO: 182199 - DNA, 711 bp, Artificial Sequence
  Description of Artificial Sequence: Synthetic coding sequence
atggccgtggagggcggcatgaagtgcgtgaagttcctgctgtacgtgctgctgctggcgttctgcgcctgcgcggtcggacttatcgctgtgggcgtcggtgctcagctcgtgctgagtcagaccattattcagggtgcaaccccaggaagcctgttgccagttgttatcattgcggttggcgtgtttctgttcttagttgcttttgtcggctgttgtggagcctgcaaggaaaactactgtctgatgattacatttgctatttttctttccttgataatgcttgtcgaggtagctgcagcaattgcaggatatgtgttcagggacaaggttatgagtgagttcaacaacaatttccggcagcaaatggagaactatccaaagaacaaccacactgctagtatattagatcgtatgcaggccgatttcaagtgctgtggagcagctaactatacagattgggagaaaatcccatccatgagcaagaatcgcgtccctgactcctgctgtattaacgtgactgttggctgtgggataaattttaatgagaaagctatccataaagaagggtgcgtcgagaaaattggcggctggctaaggaagaacgtgctggttgttgctgccgcagcgctcggcattgccttcgtccttggcatcgttttcgcctgctgtctggtcaaatcaatacgatcagggtatgaagtaatgtag

SEQ ID NO: 182200 - DNA, 402 bp, Artificial Sequence
  Description of Artificial Sequence: Synthetic coding sequence
atggccgtggagggcggcatgaagtgcgtgaagttcctgctgtacgtcttgctgcttgcattttgtgcatgtgctgttgggctcatagccgtgggcgtgggcgcgcaactggtgctgtctcagaccatcattcaaggtgctacacctggttcattactccctgtcgtaataattgcggtaggcgtgttcctctttctggtcgcattcgtcggatgctgtggggcatgtaaagaaaactactgtctaatgataacgtttgctatcttcctttctcttattatgctggtcgaggtggcagccgcgatagccggttacgtgttccgcgacaaggttatgagtgaatttaataataacttccggcagcaaatggaaaattaccccaagaacaaccacactgcatag

SEQ ID NO: 182201 - DNA, 717 bp, Artificial Sequence
  Description of Artificial Sequence: Synthetic coding sequence
atggccgtggagggcggcatgaagtgcgtgaagttcctgctgtacgtactcttgcttgcattctgtgcctgtgcagttggactcatcgccgtcggagtcggtgcccaactggtactctcgcagacaatcatccagggagctacccctgggagtttgctccctgtggtgataattgccgttggggtgttcctgtttctggtcgccttcgtgggctgctgtggcgcgtgcaaggagaattactgtctcatgatcacctttgccatttttctctctcttataatgctggtcgaggtggctgcggctatcgcaggttatgtattcagagacaaagtgatgagcgagtttaacaacaacttccggcagcaaatggaaaactatcccaagaacaaccacaccgcttccatactagacaggatgcaagccgactttaagtgttgtggcgccgcaaattacacagactgggaaaaaattccctcgatgtcaaagaacagggtccctgacagctgctgcatcaacgttaccgtcggatgcggcataaactttaacgaaaaggcgatccataaagagggttgcgtggaaaaaattgggggctggctgcgcaaaaatgtgctcgttgtcgctgccgcggctcttggcatcgctttcgtggaagtgctgggtattgttttcgcctgctgcttggtgaagtctatccgcagcgggtacgaggtcatgtag

SEQ ID NO: 182202 - DNA, 648 bp, Artificial Sequence
  Description of Artificial Sequence: Synthetic coding sequence
atggccgtggagggcggcatgaagtgcgtgaagttcctgctgtacgtgcttttgctggcattctgtgcctgcgcggtgggcctgatcgcggttggcgtgggcgcccagcttgtcttgagccagaccataatccagggtgctacacctggctccctgctaccagtggtgatcatcgcagtcggtgtgttcttatttctggtggccttcgtgggctgctgcggggcctgcaaggagaactattgcctcatgattacgttcgccatttttttgtctctcattatgctggtcgaagtagccgccgccatcgcgggatatgtcttcagagataaggtaatgtccgagttcaacaataacttccggcagcagatggagaactatccaaagaacaatcacaccgcaagcattctggatcggatgcaggccgattttaagtgctgcggtgccgccaactacaccgactgggaaaagatcccctctatgtcaaagaacagggtccccgacagctgctgcatcaatgtcaccgtagggtgtggcatcaactttaacgaaaaggccattcataaagaaggatgcgtggagaaaatcggcggttggttacgtaagaacgtcctagtcgtcgccgccgcagccctgggtattgccttctag

SEQ ID NO: 182203 - DNA, 654 bp, Artificial Sequence
  Description of Artificial Sequence: Synthetic coding sequence
atggccgtggagggcggcatgaagtgcgtgaagttcctgctgtacgtgctgcttcttgctttttgcgcatgcgctgttgggctgatcgccgtgggcgtaggcgcgcagttggtgctgtcccagaccattattcaaggagccacgcccggtagtcttttgcccgtggttatcattgccgtgggcgtcttcctgtttctggtcgctttcgttggatgttgtggagcttgcaaagagaactactgcctgatgattacatttgccatcttcctgtctttgatcatgctagtcgaggtggcagccgcaattgcaggctatgtcttcagggataaggttatgtccgagtttaataacaactttaggcaacagatggagaattaccccaaaaacaaccacactgcatcgattctggatcgaatgcaggccgacttcaaatgctgtggggctgccaattataccgactgggaaaaaattccctctatgagcaagaatcgtgttccagactcatgctgtatcaatgttactgttgggtgcgggatcaattttaatgaaaaggcaatccacaaagaaggatgcgtcgaaaagattggcgggtggctgcggaagaatgtcctagtggtggccgccgctgccttgggaatcgctttcgttgaatag

SEQ ID NO: 182204 - DNA, 717 bp, Artificial Sequence
  Description of Artificial Sequence: Synthetic coding sequence
atggccgtggagggcggcatgaagtgcgtgaagttcctgctgtacgtccttcttttagccttctgtgcctgcgcagtgggtctcatagctgtgggagttggcgcccagctagtactctcccagactatcatccagggggccacccccggcagcctactgcctgtggtcataatcgccgttggcgtgtttctttttctcgtcgcctttgtgggctgctgtggtgcgtgcaaggagaactactgccttatgatcaccttcgctatcttcctatcccttataatgctcgtggaggtggcagccgctatcgctggctacgtctttcgcgacaaggtgatgagcgaatttaataataactttaggcagcagatggaaaattacccgaagaataaccatactgccagtattctggatcgcatgcaggctgattttaagtgctgtggggccgccaattataccgattgggaaaagatcccctccatgtctaaaaatagggtccccgattcttgctgtattaacgtgacagtaggatgcggaatcaactttaatgagaaggctatacataaagaagggtgcgtggagaagatcggcggctggttgcggaaaaacgtgcttgtggtggccgccgctgctctgggaatcgcctttgttgaggtgctgggcatcgtgttcgcatgttgcctggtcaagtccatcagatccggctatgaggtcatgtag

SEQ ID NO: 182205 - DNA, 648 bp, Artificial Sequence
  Description of Artificial Sequence: Synthetic coding sequence
atggccgtggagggcggcatgaagtgcgtgaagttcctgctgtacgttttacttcttgctttttgcggagcaaccccgggcagtctcttgcccgtcgtgattatagccgtcggagtcttcctgttcctggtggcctttgtgggctgttgcggcgcttgtaaagaaaactactgcctcatgatcactttcgctattttcctgtcattaatcatgctcgtcgaagtggcagccgccatcgctggatacgtattccgtgataaggtgatgtccgaattcaacaataactttcggcagcaaatggaaaactaccctaaaaacaatcatacagcttctatccttgaccgcatgcaggcggattttaagtgctgtggagcagctaattatacagactgggaaaaaattccatcaatgagcaaaaatcgagtgcctgattcatgctgcattaatgtaactgttgggtgcggaattaactttaacgaaaaggcaattcacaaagaggggtgcgttgaaaagatcggggggtggctcagaaaaaatgtacttgtggtcgccgcagcagcattaggcattgcattcgtcgaggtgctggggatcgtttttgcctgttgtctggtcaagtcaatcagaagcggttacgaagtaatgtag

SEQ ID NO: 182206 - DNA, 471 bp, Artificial Sequence
  Description of Artificial Sequence: Synthetic coding sequence
atgatcaccttcgccatcttcctgagcctgatcatgctggtggaggtggctgccgctattgccggctacgtgttcagagataaggtgatgtccgagttcaacaataactttaggcagcagatggaaaattatcctaaaaacaaccacacagcctcgatactggaccgcatgcaagctgattttaaatgttgtggggcggctaattataccgattgggaaaaaattccatctatgagtaagaatagagtgccagactcgtgctgcatcaacgtgactgtgggatgcggcatcaattttaacgaaaaggctatccacaaggaaggatgtgtggaaaaaatcggcggatggctccgcaaaaatgtactggttgtcgccgcggcagccctgggcatcgccttcgtagaggtgctcgggattgttttcgcgtgttgcctcgtgaaatcaattcggtccggctacgaggtgatgtag

SEQ ID NO: 182207 - DNA, 471 bp, Artificial Sequence
  Description of Artificial Sequence: Synthetic coding sequence
atgatcaccttcgccatcttcctgagcctgatcatgctggtggaggtagctgcagcaatagctggctacgtgtttagggataaggtaatgagtgagtttaacaataacttcaggcagcaaatggagaattaccctaagaacaaccacaccgcaagcatcctggacaggatgcaggcggactttaaatgttgcggcgccgctaactatacagactgggaaaagatcccaagcatgtctaaaaatagggtcccagacagctgttgcattaatgtaaccgtcggctgcggaataaattttaacgaaaaggccatccacaaagagggatgcgtagagaagatcggagggtggctacgaaagaatgtccttgtggtggctgctgcggcactggggatcgcattcgttgaggtgttagggattgtattcgcatgttgtctcgtgaagagtattagaagcggatacgaagtgatgtag

SEQ ID NO: 182208 - DNA, 1065 bp, Artificial Sequence
  Description of Artificial Sequence: Synthetic coding sequence
atgcggctggccgtgctgttcagcggcgccctgctgggcctgctggctgcccagggtacggggaacgattgtcctcataagaaaagcgctactctcctgccatccttcactgtgacgcccacggtgaccgagagcacaggcaccacaagtcaccggactacgaagtcgcacaagactaccacacaccgtactaccactactggtacaacatcccacggccctaccacagcaacccacaacccaacgacaacttctcacggaaacgtgaccgtgcatcctacctctaacagtactgctactagccaagggccatccaccgcaacccactcccctgccaccacatcccacggaaacgctacagtgcaccccacaagtaacagtactgccacaagccctggcttcacgtctagcgctcaccccgagccccctcctccctccccctcacccagccccacatccaaagagactatcggtgactacacttggactaatggcagtcagccttgcgtgcatctgcaagcacagatacagatacgtgtaatgtatacaacgcagggaggcggcgaggcctggggcattagcgttttaaatccgaacaaaaccaaggtacaggggtcttgcgagggggctcatccgcacctgctgcttagcttcccctacggtcacttgtcctttggattcatgcaggatcttcagcaaaaagtcgtttatttgtcctatatggccgtcgagtataacgtatccttccctcacgccgctcagtggacattttccgcacaaaatgctagtctcagggatcttcaagctcccctgggccagagtttctcctgtagtaacagtagcatcatactgtcacctgcagtgcacctggatttgctatccctgaggctgcaggcggctcaattaccacacactggagtcttcggccagtcattttcctgtccatctgaccgcagcatcctgctgccactcatcatcggcctgatcctgttgggcctgttggcgctggtgctcattgccttttgcattattaggaggcggcctagcgcctatcaagcattgtag

SEQ ID NO: 182209 - DNA, 894 bp, Artificial Sequence
  Description of Artificial Sequence: Synthetic coding sequence
atgcggctggccgtgctgttcagcggcgccctgctgggcctgctggcagagtcaactggaaccacttctcaccggaccactaagtcacacaaaactacaacccatcgcaccacaactacagggacaacatcccatggcccaaccacagccactcacaatcccacaacaacttcccatggaaacgctaccgtgcacccgacgagtaacagtaccgcgacatcccccgggttcacatcttcagcccatcccgagccccctcccccatctccttctcctagccctacttcaaaggagactatcggtgactacacatggacgaatggatcccagccctgcgtgcatctgcaggcccagatacagatacgtgtgatgtacactactcagggcggcggtgaggcctggggcatctcagtcctcaaccccaacaagaccaaggtccagggatcatgtgaaggtgcccatccgcatctccttttgtccttcccctatgggcacctctctttcggatttatgcaggatctacagcagaaggttgtctaccttagttacatggccgtggagtataatgtcagctttcctcacgccgcacaatggaccttcagtgcccagaacgcctctctcagagacttgcaggcaccactgggccagtccttctcatgttcaaactcatctatcatcctgtccccagcagtgcaccttgacctgttgagcttgcgactgcaggcggcgcagctcccgcatactggagtgttcgggcaatcctttagttgccctagcgaccgtagcatactactacctctcattatcggtctgatcctattagggctgttggccttagtcctaatcgcattctgcataattaggcgtcgcccctctgcctaccaggctctatag

SEQ ID NO: 182210 - DNA, 3018 bp, Artificial Sequence
  Description of Artificial Sequence: Synthetic coding sequence
atgatgagcgacgccagcgacatgctggccgccgccctggagcagatggacgggattatcgctgggagtaaagctcttgagtacagcaacggaattttcgattgccagtcaccaacatccccctttatgggcagcctgagagccctccacttggtggaagatctgcgtggactgctggaaatgatggagaccgatgaaaaggagggcttgcgatgtcaaatcccagatagcaccgccgagacgctggtggagtggctacagagccagatgaccaatggccatttgccaggcaatggtgacgtgtatcaggagaggcttgcacgactggagaatgacaaagaaagtttagttctgcaggtcagtgtgctcaccgatcaggtggaggctcagggtgagaaaatcagggatctcgagttctgcctggaggaacacagggagaaggttaatgcaaccgaggagatgctgcagcaggagttactgagccggacatcactggagactcaaaaactggatttgatggctgagatttcaaatctcaagctcaagctgaccgctgtggagaaagataggctagattacgaggacaaatttcgggacacggagggactgattcaggagatcaacgatctccgtctcaaggtatctgaaatggattctgaacgcctccagtacgagaagaagctgaaatcaaccaaagatgagcttgcctcacttaaggagcagctcgaggaaaaagagagtgaagtgaaaagactccaggagaaactcgtctgtaaaatgaagggagagggggttgaaattgtcgatagggacgagaatttcaaaaagaagctgaaggagaagaacatcgaggttcaaaaaatgaaaaaagccgtcgagtcactcatggccgctaacgaggagaaggatcgaaagattgaggacctgcggcagtgtctcaataggtacaagaagatgcaggacactgttgtcctagctcagggcaaaaagggcaaagacggggaatatgaagagctcttaaatagctcatccatcagcagcttgctggacgctcagggattttcagatcttgagaaaagtcctagccccacaccagtaatgggctccccatcatgcgaccccttcaacacgagtgtgcctgaggaatttcacacgaccatcctgcaggtttccattccgtctttgctgcccgctacagtctccatggagaccagtgaaaaatctaagttaacacccaaacctgagacatccttcgaagagaacgacgggaacattatcctgggggccactgtggatacccagctctgcgacaaattgttgacttcctctttgcagaaaagtagctcattgggcaacctaaagaaggaaactagtgatggagagaaggagactatacagaaaacaagtgaagacagagctccggccgaatcacggcctttcgggacgctgccccctagacctcccgggcaggatactagtatggatgacaaccccttcggcaccagaaaggtgcgctcttccttcggccgcggattttttaagataaagtccaataagcggaccgccagcgcccccaacctggaccgtaagcgcagtgcctcggcgcccacgttggccgagacggagaaggagaccgctgagcatctcgatcttgctggtgcctctagcaggcccaaggatagccagcgcaactcccctttccaaatccctccacctagccctgattccaagaaaaagagccgaggcatcatgaagctgtttggaaaactgcgcagaagtcagagtacgacatttaaccccgacgatatgagcgaaccagagttcaaaagaggggggacccgggccacagctggtccacggctgggctggtctcgcgatcttggtcaatccaactctgatctggatatgccgttcgcaaagtggaccaaggagcaggtgtgcaattggctcatggagcaagggctaggtagttatctgaatagcggcaaacactggattgcctccgggcaaacgctgctccaagcttctcagcaggatctcgagaaagagctcggcattaagcacagcttgcaccgaaagaagctccagctcgccttgcaggccctcgggagcgaggaagaaaccaatcacggtaagctggattttaattgggttacgcgctggctcgacgatatcggcctcccgcaatacaaaacccaatttgatgagggccgagtagacggacgtatgctccattatatgactgtcgatgacctcctgagtctgaaggtggtaagcgtgttgcaccacctgtccatcaaacgcgctattcaggtgctcaggattaacaatttcgagcctaactgtctgaggcggcggccctccgacgagaacacaattgccccaagcgaagtgcagaagtggactaatcaccgggtcatggagtggctgcggagcgtcgaccttgcggaatacgccccaaacctgcgggggagcggcgttcacgggggcttaatggtcctggaaccaagatttaatgtggaaaccatggcccagctgctgaatatccctccaaataaaactcttttacggcggcacttagctactcatttcaacctgctgatcggtgccgaggcccagcaccagaagcgggatgctatggagttacctgattatgtgttgctgactgctactgccaaggtgaagccgaaaaaactcgctttttccaacttcggaaatctgagaaaaaagaaacaagaagacggggaggaatacgtgtgcccaatggaactggggcaggcttccggaagtgcaagcaaaaaggggttcaagcccggtcttgacatgcgattgtatgaggaggacgaccttgacagattggagcagatggaggactctgaaggcacggtccggcagatcggcgcattcagcgagggcatcaacaatctgactcacatgttgaaagaggacgacatgttcaaggactttgctgcccgctctcctagtgcctccattacagacgaagacagcaatgtctag

SEQ ID NO: 182211 - DNA, 495 bp, Artificial Sequence
  Description of Artificial Sequence: Synthetic coding sequence
atgagcagcgagaactgcttcgtggccgagaacagcagcctgcacccagaaagcgggcaggaaaacgatgccacgtctccacactttagcactagacacgagggaagttttcaggtgccagtgctttgcgcagtgatgaatgtcgtgtttattacaatactgattatcgcattgattgccctgagtgtcggtcagtacaattgtcccggccaatatactttctctatgccctctgatagccacgtttcatcctgctcagaagattgggtggggtatcagcgcaagtgttattttatttcaacagttaaaagaagttggacctctgctcaaaatgcctgttcggagcacggcgctacactggcggtgatcgattcagagaaagatatgaactttttgaagcgctacgctgggcgggaagagcactgggtcggcctgaagaaagagcccggtcacccctggaagtggagcaacggcaaggaattcaacaattggtag

SEQ ID NO: 182212 - DNA, 723 bp, Artificial Sequence
  Description of Artificial Sequence: Synthetic coding sequence
atggccggccccccccggctgctgctgctgcccctgctgctggccctggcccgcggattaccaggagcactcgcagctcaggaagttcaacaatcacctcactgtaccacagtccccgtaggggccagcgttaacatcacttgttctacgtccggtggcctcagaggaatttatttacggcagcttggacctcaaccccaggatattatttattatgaggacggcgtagtgcctaccacggaccgccgattcagagggcgcattgactttagcggcagccaggataacctaaccattaccatgcataggcttcagctgtccgatacgggaacttacacgtgtcaggccataaccgaagtgaatgtttacgggtccggaaccttggtgctggtcaccgaggagcagtcacagggatggcatcgctgctccgatgcaccgccacgagcctctgctctcccggctccacccactggcagtgcccttcccgacccccagaccgccagtgcgctgccggacccccctgcagcttccgctcttcctgccgctctggctgtcatttcattcctattgggcctgggtctgggcgtagcgtgtgtgctggcacgtacacagattaaaaagctgtgttcttggcgggacaaaaattctgcggcttgcgtggtgtatgaggatatgtctcatagccgttgtaatacactgtcttctcccaaccaatatcagtag

SEQ ID NO: 182213 - DNA, 1080 bp, Artificial Sequence
  Description of Artificial Sequence: Synthetic coding sequence
atggccgaggccatcacctacgccgacctgcggttcgtgaaggccccccttaagaaatctatctccagccggttagggcaggacccgggagccgacgatgacggcgagattacatacgagaatgtacaggtgcccgccgtcctcggagtcccgagttctcttgccagtagtgtgctcggcgacaaggcagccgttaaatccgaacaacccaccgcatcctggcgggctgtcacttcccccgccgtgggacgcatcctgccctgcaggactacgtgtttgaggtacctgttgcttggacttctcctgacctgtctattacttggcgtgactgcgatttgtctgggcgtccgttatttgcaggtttcccagcagctgcaacagaccaacagggtcctggaggtaaccaacagcagtctgcggcagcaactgcggttgaagatcacgcaacttggccagtcagctgaggacctgcagggcagcagaagggagttggctcaaagccaggaagcattgcaggtggagcaacgagcacaccaggcagcagaaggtcagctgcaagcttgtcaggccgaccggcagaagacaaaggagactcttcagagtgaggagcagcaacgcagagctcttgagcagaagctgtccaacatggaaaatagactgaaaccattttttacatgcggctccgccgacacatgttgcccaagcggatggatcatgcaccaaaaaagttgtttttatatctcactcacaagcaagaactggcaggaaagtcagaagcagtgcgaaacgctgagcagtaagctcgcaacttttagcgagatctaccctcagtcccacagctattattttttgaacagccttttaccaaatggaggcagcggcaattcttactggactggactgtcctcaaataaggattggaaacttacagatgatacacagcgtacgcgcacctatgcacagtcatcaaagtgcaataaggtgcataagacgtggtcatggtggacattggaatccgagagctgtcgatcctctctgccctacatttgtgaaatgaccgctttccgattccctgattag

SEQ ID NO: 182214 - DNA, 363 bp, Artificial Sequence
  Description of Artificial Sequence: Synthetic coding sequence
atggccgaggccatcacctacgccgacctgcggttcgtgaaggccccgttgaagaagagtatctcctctcgcctaggccaggacccaggggccgacgatgatggcgagatcacctatgaaaacgtgcaggtgccagctgttttgggcgtccccagtagcctcgcctcttctgtgctgggagacaaagcggccgtgaagtctgaacagcccacagcgagttggagggccgtgacctctcccgctgtggggagaatactcccttgtgagtgtgcatgcgccggccagccaaggggccaagttcttgcaccagtacccgctgccgatggagctggaccgaggggagtgcagttgctgcccgggtag

SEQ ID NO: 182215 - DNA, 360 bp, Artificial Sequence
  Description of Artificial Sequence: Synthetic coding sequence
atggccgaggccatcacctacgccgacctgcggttcgtgaaggccccgctcaagaagagcatttcaagccgacttggacaggacccgggggctgacgatgatggggaaattacctatgagaatgttcaagtacccgctgtgctgggcgtgcctagctctcttgcaagctcagtgctgggtgataaagccgcagtgaagtcggagcagcctaccgccagctggcgcgcggttacgtccccagcagtaggccgcatcctgccttgtaggacgacatgccttcgctacctgttgttgggtctgctcctgacatgcttgctgctgggcgtcactgctatttgcctgggggttaggtgtgaatag

SEQ ID NO: 182216 - DNA, 1080 bp, Artificial Sequence
  Description of Artificial Sequence: Synthetic coding sequence
atggccgaggccatcacctacgccgacctgcggttcgtgaaggccccactcaagaaatccatctcctcacgactcggacaggaccctggcgctgacgatgacggggaaatcacatacgagaacgtgcaggtgccagcagttctaggtgtgcccagctccctggcttctagcgtgttgggcgataaagccgcggtgaagagcgaacagcccactgcctcttggcgggcagtcacgagtcctgcagtggggcgtatcctgccttgtcgcactacctgcctaagatatctgctgttggggttgctccttacttgcctgctgctaggggttacagccatatgcctcggagttaggtaccttcaggtttcgcagcaactgcaacagacgaatcgcgttctcgaagtcaccaactcatccctccggcagcagctgcggctcaagatcacacagttgggccagtccgccgaggacctccagggctcacgaagagaactcgctcaaagccaagaagctctccaggtggaacagcgagcccatcaagccgctgaggggcagctgcaagcctgtcaggctgacagacaaaagacgaaagagaccctgcaaagcgaagagcagcagcggagagccctcgaacagaagctttccaatatggagaaccgcctgaagccttttttcacgtgcggcagtgccgacacatgctgtccctccggatggatcatgcaccagaaaagctgtttctacattagcttgacctcaaagaattggcaggaaagtcaaaagcagtgtgagacacttagcagcaagctggcaactttttccgagatctatcctcagtcgcattcctactatttcctgaactcattgttgcctaatgggggatcaggcaatagctactggaccgggctgtcatccaataaggactggaagctgacagatgatactcagcgaactcgtacctacgctcagtccagcaaatgcaataaagtccataaaacgtggtcttggtggaccctagaatcagagtcatgtaggtcgtcactgccttacatatgtgaaatgacagctttccgcttccctgattag

SEQ ID NO: 182217 - DNA, 1080 bp, Artificial Sequence
  Description of Artificial Sequence: Synthetic coding sequence
atgcagacccggaacccccagagccacggcgagaacggcgccagcccttggtcatggggggatagactgggacctggacccgatcctggggcggacgacgacggagaaattacttacgaaaacgtccaagtccccgccgtgctgggcgtccccagcagccttgcatcttccgtgctgggcgacaaggccgctgtcaagagcgagcagcctacagctagctggagagcggtgactagccccgcagtgggaagaatacttccttgtcgcacaacatgcttacgctacttgctgctgggtttactgttgacttgtctgctgctgggagtcaccgctatatgtctgggagtgaggtacttgcaggtttctcagcaactccagcagaccaaccgcgtgctggaggtgacaaactcatcgctacgacagcagctgcgtctgaaaatcactcagctgggacagagtgctgaggacttgcagggctccagaagggaactggcccagagtcaggaagccctccaggttgaacagcgagcacaccaggctgctgaaggccagttacaggcctgccaggctgacaggcaaaagaccaaagagaccctgcagtctgaagagcagcaacgcagggcgctggagcagaaactgagcaatatggagaaccggctcaagccattctttacatgcggcagtgctgatacttgttgccccagtgggtggatcatgcatcagaagagttgtttttatatctctctcacaagcaaaaattggcaggagtcacagaagcaatgcgagaccctcagttccaaactggctaccttctccgaaatctacccacaatcccactcctactacttcttaaacagtcttctgcctaatggggggagcggaaactcttattggactggcctcagcagtaacaaggattggaaactgactgacgatactcagcgcacccgtacttacgcccaaagctctaaatgtaataaagtccataaaacttggagctggtggacccttgaaagtgagtcctgtcggagtagcctgccgtacatctgcgagatgacggcctttcgtttccccgattag

SEQ ID NO: 182218 - DNA, 891 bp, Artificial Sequence
  Description of Artificial Sequence: Synthetic coding sequence
atgcaccggcggcggagccggagctgccgggaggaccagaagcccgtaatggatgaccagagggatctaatctccaacaacgaacagttacccatgctgggcagaaggcctggggccccagagagcaaatgcagccggggagcgctgtatacagggttctccatcctcgtcacccttctcctggccgggcaggccaccacagcttactttttgtaccaacagcaaggcagacttgacaagctgacagtcacatcacagaacctccagttggagaacctccgcatgaagctgccaaaaccaccaaaacctgtcagcaagatgcgcatggccacacctttactgatgcaggctctcccgatgggagccttgccgcagggacccatgcagaatgcgaccaaatatggaaacatgaccgaggatcacgtcatgcacctcctccagaatgccgaccccctcaaggtgtatccccccctgaaaggcagttttccagaaaaccttcggcatctgaaaaataccatggaaacgattgattggaaggtgtttgaatcatggatgcatcactggctgctgttcgaaatgtctcgccactctcttgaacagaagcccacggatgctcctccaaaagtcctaacgaagtgccaagaggaagtgagccatatccccgcagtccaccccggatcgtttaggcccaaatgcgacgaaaacggcaattatctccccctgcagtgttatggaagcattgggtactgttggtgtgtgttcccaaatggcacggaggttcctaatactagatcaagggggcaccacaattgctccgagagcctggagctcgaggatccctctagtggactcggagttacaaaacaagatctcggccctgttcctatgtag

SEQ ID NO: 182219 - DNA, 699 bp, Artificial Sequence
  Description of Artificial Sequence: Synthetic coding sequence
atgcaccggcggcggagccggagctgccgggaggaccagaagcccgttatggacgaccagcgcgacttgatttccaacaacgagcagcttcctatgttaggcaggcgcccaggagctcccgagtcaaaatgctcacgtggtgccttgtacacagggtttagcatcctcgtgactctactactggcaggacaggccaccaccgcctactttctctatcagcagcagggcaggctggataaactgaccgtcacctctcagaatcttcagcttgagaaccttagaatgaagctgcccaagccacctaagcccgttagtaaaatgagaatggcaaccccacttctaatgcaggccctgcccatgggggccctcccccagggacctatgcaaaatgcaacgaaatacggcaacatgacggaggatcacgtaatgcatcttttacaaaatgcggatcctttaaaagtctacccgcccttaaaagggagtttcccagagaatctgaggcaccttaagaatacaatggaaacgatcgattggaaagtgttcgagagttggatgcaccactggttactgtttgagatgtccaggcactccctggagcagaagcctaccgacgcccctccgaaggaatccctggagctggaagacccttcttcaggtctcggcgtgacaaagcaggatttggggcccgtgcccatgtag

SEQ ID NO: 182220 - DNA, 483 bp, Artificial Sequence
  Description of Artificial Sequence: Synthetic coding sequence
atgcaccggcggcggagccggagctgccgggaggaccagaagcccgtgatggacgaccaaagagacctcatctccaataatgagcagctgcctatgctgggccggcgccctggtgcaccagagtcaaagtgtagtagaggtgcattgtacacaggttttagtattctggttactctgctcttggccggccaagctactacggcatattttttataccagcagcagggcaggctggacaagctgaccgtcacatcacagaacttacagcttgaaaacctcaggatgaaactaccgaaacctccgaagccggttagcaagatgagaatggctaccccccttctcatgcaagcgttgcctatgggagccctccctcaggggcctatgcagaacgcgacaaaatacggaaacatgaccgaggatcacgtcatgcacctcctgcagtcccactggaactggagaacaagactcctcggctgggtgtag

SEQ ID NO: 182221 - DNA, 951 bp, Artificial Sequence
  Description of Artificial Sequence: Synthetic coding sequence
tgacggagctgccgggaggaccagaagcccgtgatggacgaccagcgagacctgatcagcaataatgaacagctgccaatgctgggccggcgccctggggcacccgaatcaaagtgttctcgtggagccctttacacaggcttctctattctcgtcacccttctccttgccggtcaggccactacggcatatttcctctatcagcagcagggcaggcttgataagcttacggtgacatcacagaatttacagctggaaaatctgcgcatgaaactccctaagccgccaaagccagtttctaagatgaggatggccacgccgctccttatgcaggcactccccatgggggctcttccgcagggacccatgcagaatgcaacgaagtacggtaacatgacggaggatcatgtcatgcatttgctgcagaacgcagaccctctcaaagtctacccacccttaaagggctccttccccgagaatcttcgccacctgaagaacaccatggagacaatcgactggaaggtgttcgagagttggatgcatcactggctcctctttgaaatgtctaggcatagtcttgagcagaagcccactgacgctcccccaaaagtactaaccaaatgtcaagaagaggtttcacacatacccgccgtccacccaggctcctttagaccaaaatgcgacgagaacggcaattacctcccactgcagtgctatggtagtataggatactgttggtgtgtgttccccaatggaaccgaagtgcctaatactagatctaggggccaccacaattgtagcgagtctttagagctcgaggatccatcctcaggactgggtgtgacaaaacaggacctggggcctggcaaggggcttgcagaaggtcacctcgtgacaagtagtagcagtccagccgggcctgctccactctgggctggggagggcgtttag

SEQ ID NO: 182222 - DNA, 369 bp, Artificial Sequence
  Description of Artificial Sequence: Synthetic coding sequence
atgcaccggcggcggagccggagctgccgggaggaccagaagcccgtgatggatgatcagcgagacctcatttcgaacaacgagcagctgcccatgcttggacgccgcccaggcgctccggagtccaagtgctcgcgcggtgcactctacacgggatttagcatcctggtgacattattgctcgcgggacaagcgacaaccgcctactttctctaccagcagcagggcaggttggataagttaaccgtgacctctcaaaacctacagttagagaacctgagaatgaagctccctaagccacacgcagaatgccatcaggtctggcagcacgatcggggtccatgtgatgcccctgctcctgaatgttag

SEQ ID NO: 182223 - DNA, 459 bp, Artificial Sequence
  Description of Artificial Sequence: Synthetic coding sequence
atgcaccggcggcggagccggagctgccgggaggaccagaagcccgtgatggacgaccagcgggatctcatctccaataacgaacaactgcccatgttgggccgccgcccaggcgcaccggagtcaaagtgtagtcggggggccctgtacaccggcttttctatcctagtgacactcctgctcgccggccaagccactactgcctacttcctgtaccagcagcaagggaggctggataagctcactgttaccagtcaaaacctgcaacttgaaaacctgcgtatgaagttgcccaaacccccaaagcccgtgagcaagatgaggatggccactccactgctcatgcaggcactcccgatgggggccctcccacagggacccatgcagaatgcgactaagtacggtaacatgacagaggatcatgtgatgcacttgcttcaggaggttgctaagtcatag

SEQ ID NO: 182224 - DNA, 690 bp, Artificial Sequence
  Description of Artificial Sequence: Synthetic coding sequence
atggcccggctggccctgagccccgtgcccagccactggatggtggcgcttctcctccttctgtccgccgaacctgtacccgcggcgcgttccgaggaccgttatcggaatcccaaagggagcgcttgtagtagaatctggcaatctccgcgctttatagcccgaaagagagggtttactgttaaaatgcactgttatatgaatagcgcctccggcaatgtaagctggttgtggaagcaagagatggacgagaatccccagcagctgaaactcgaaaaagggcggatggaagagagccagaatgaatccctggcaaccttaactatacaaggaatcaggttcgaggataatggtatttatttctgtcagcagaagtgcaacaacacatctgaagtctatcaaggctgtggcaccgaattgcgcgtgatggggtttagtacactggcccagctgaagcaaagaaacacccttaaggacggaattatcatgattcagaccctgctcatcatcctgtttattattgtccccatctttctccttctcgataaagacgattccaaggccggcatggaggaggaccatacatacgaaggcctggatattgatcagacagctacttacgaagacatcgtgactctccgaaccggcgaagtgaagtggagtgtgggggagcatccaggtcaggagtag

SEQ ID NO: 182225 - DNA, 378 bp, Artificial Sequence
  Description of Artificial Sequence: Synthetic coding sequence
atggcccggctggccctgagccccgtgcccagccactggatggtggccctgctgctgctgctgagtgccgagccagttccagctgcacgcagtgaggaccgctaccgaaatccaaagggatttagcaccctggcccagctgaagcaacggaatacactgaaagacggtatcatcatgatccaaactcttcttattatactctttatcattgtgccaatcttcctcctcctcgacaaggacgattctaaggcgggcatggaagaggaccatacttatgaaggcctggacatcgatcagacagcaacgtacgaggacatagtgactctccgaacgggtgaggtcaagtggtcggttggagagcatcccgggcaggaatag

SEQ ID NO: 182226 - DNA, 693 bp, Artificial Sequence
  Description of Artificial Sequence: Synthetic coding sequence
atggcccggctggccctgagccccgtgcccagccactggatggtggcgttgttgcttcttctgtccgccgctgaacccgtccctgcagccaggtcagaagatcggtatagaaacccaaagggttcagcttgctcgcgaatctggcagagcccacgcttcatcgctagaaaaagaggcttcacagtgaagatgcactgctacatgaactccgcctccgggaacgtctcctggctatggaaacaggagatggatgagaatccgcagcagctcaaactcgagaagggaaggatggaagaatcccagaacgagtctctcgctaccctgacaattcagggaattcgcttcgaggataatggcatatacttctgccagcagaagtgcaataatacaagcgaagtgtaccagggctgcggaacagagttaagagtgatgggattttcaacgttagcccagcttaaacagcggaataccctaaaggacggcataataatgattcagacactcctgatcatcctcttcatcatcgtgccgatcttccttctactggacaaggatgatagcaaagcgggtatggaggaggaccacacatacgagggactggacatcgatcaaaccgccacttacgaggacatagtgaccctgcgtaccggcgaagtcaaatggagcgttggggaacacccagggcaggagtag

SEQ ID NO: 182227 - DNA, 711 bp, Artificial Sequence
  Description of Artificial Sequence: Synthetic coding sequence
atgggcgtggagggctgcaccaagtgcatcaagtacctgctgttcgtattcaatttcgtattctggctagctggcggggtgattctaggtgtggccctttggctcagacacgatcctcaaaccacaaacctactgtatctagaactgggtgataagcccgctcctaacaccttttatgtaggcatctacattctcattgccgtgggtgcagtgatgatgtttgtgggcttcctcggctgttacggtgccatccaggagtcacagtgtctcttggggaccttcttcacatgcctggtgattctcttcgcatgtgaagtggccgcgggaatttggggtttcgtaaataaagaccagattgcaaaggacgtgaaacagttctacgatcaagcccttcagcaggccgtggtagacgatgatgcaaataacgcaaaggccgttgtgaaaacctttcacgagacactggattgttgtggcagcagtacattgaccgccttgacaacaagcgtccttaaaaacaatctgtgcccctcaggatcgaacatcatttcaaacctgtttaaggaagactgtcatcagaaaattgacgatctcttttccgggaaactgtatctgatcgggatagctgccatagtagtggctgtgattatgatttttgagatgattctcagtatggtgctgtgctgtggcattcgcaatagctctgtgtactag

SEQ ID NO: 182228 - DNA, 618 bp, Artificial Sequence
  Description of Artificial Sequence: Synthetic coding sequence
atgagccggggcctgcagctgctgctgctgagctgcgcctacagcctcgcacccgcgactccagaagtcaaagtcgcttgctcagaagacgtcgatctgccgtgcacggcaccatgggacccacaggttccttataccgtttcttgggtgaaactccttgaaggtggggaagaacgtatggaaaccccccaagaagaccacctgcgaggacagcactatcatcagaaagggcagaatggctcattcgatgcacccaatgaaagaccttatagcctgaagattcgaaacacaacaagttgcaattccgggacatatcggtgtactctgcaggaccctgacggccagagaaatctgtccggcaaagtgattctgcgggtgactgggtgcccagcccagcgcaaagaagagacgtttaagaagtacagagccgaaatcgttctgctcctcgctcttgtgatcttctacctgactctgattatttttacttgcaagttcgcccgacttcaaagcatattcccagacttcagcaaggcaggcatggaacgggccttcctacctgtgaccagccctaataagcaccttggactggtcactccccacaagacggagctggtgtag

SEQ ID NO: 182229 - DNA, 351 bp, Artificial Sequence
  Description of Artificial Sequence: Synthetic coding sequence
atggacccccagtgcaccatgggcctgagcaacatcctgttcgtgatggcttttctgttgagtgaattggaggatcctcagccccctccagaccacatcccatggatcaccgcagtgctgccaacagtcattatatgtgtcatggtgttctgtctgattctgtggaaatggaagaagaaaaaacggccaaggaattcctacaagtgcggaaccaatacaatggaaagggaagagtccgaacaaacaaaaaaaagggagaaaatacatattcctgaacgctccgacgaggcccaaagagtattcaaatcatccaaaacatctagttgcgataaaagcgacacttgcttttag

SEQ ID NO: 182230 - DNA, 990 bp, Artificial Sequence
  Description of Artificial Sequence: Synthetic coding sequence
atggacccccagtgcaccatgggcctgagcaacatcctgttcgtgatggctttcttactcagtggagcggcccccctcaagatccaggcctactttaacgagactgccgacctaccttgccagtttgccaattcccagaatcagtccctctccgagttggtggtgttttggcaggaccaggaaaatctcgtgcttaacgaggtttatctgggtaaagagaagttcgactccgtccatagcaagtacatgggcaggacctctttcgactcagatagctggactcttcgcctacataatttgcaaattaaggacaaggggctctaccaatgtatcattcaccataaaaaacctactggtatgatacgcattcaccagatgaacagcgaactctctgttctggctaatttcagccagccggagatcgtgccaatatcaaatattaccgaaaacgtctacattaacttaacctgcagcagtatccacggataccctgaacctaagaagatgagcgtcctcttacgtaccaagaattctaccatcgaatacgatggagtcatgcaaaaatcacaggataacgtgactgagctttacgacgtgagtatatcactcagtgtctcctttccagatgtgacctcgaatatgaccatattctgcatcttggaaacagacaagacacgcttgctatcgagcccttttagcattgagttggaagatccccagccccctccagaccatatcccctggatcaccgccgttctgcctaccgtaattatttgtgtgatggtattctgcctcatcctctggaagtggaaaaagaagaaaagaccaaggaatagctataagtgtgggaccaacacaatggagagagaagaatcagagcagacgaaaaaaagggaaaagattcacattccagagagatcagatgaggcccaaagagttttcaagtcaagtaaaactagcagctgcgacaagagcgatacctgcttttag

SEQ ID NO: 182231 - DNA, 972 bp, Artificial Sequence
  Description of Artificial Sequence: Synthetic coding sequence
atgggcctgagcaacatcctgttcgtgatggccttcctgctgagcggcgcagcacccttaaagattcaggcctattttaacgagactgccgatctgccctgtcagttcgcaaattcccagaatcaatctctctctgagcttgtggtgttttggcaagaccaggaaaacctggtcctcaatgaagtatatctgggaaaggagaaattcgatagtgtccatagtaaatatatggggaggacttctttcgattctgattcctggactctcagactgcataatttgcaaatcaaagacaaagggctgtaccagtgtatcattcaccataaaaagcccactggaatgattcgcattcaccaaatgaactcggagttgtccgtgttagccaatttctctcagccagagatcgtcccaatcagcaacattaccgaaaacgtctatataaatcttacttgcagttctatccacggctaccccgagccaaaaaaaatgtccgtgctccttcgtacaaaaaacagtactatagagtatgacggtgtgatgcagaagagccaggataacgttactgagctgtacgacgtgagcatctcgctgagtgtatcattccctgacgtcacctcaaatatgacaattttctgcatcctggaaacagataagaccaggctcttgtcctcaccctttagcattgaactggaggatccacagccacctccagaccatataccgtggattaccgcagttttgccaaccgtgattatctgtgtcatggtgttctgcttgattctatggaagtggaagaaaaaaaagcgcccaaggaattcatacaaatgtggcacaaatactatggagcgagaagagagcgagcagaccaagaaacgcgaaaaaatacacatccccgaacggtccgacgaggcacagagggtctttaaatcctctaagacaagctcgtgtgataagtccgatacttgtttctag

SEQ ID NO: 182232 - DNA, 504 bp, Artificial Sequence
  Description of Artificial Sequence: Synthetic coding sequence
atgggcctgagcaacatcctgttcgtgatggccttcctgctgagcggagccgctccactcaagattcaggcctactttaacgagaccgccgatctgccttgccagttcgccaatagtcaaaatcagtcgttaagcgaactggtcgtgttttggcaagatcaagagaatcttgtgttgaatgaggtctatctcggaaaagagaaatttgattccgtccactctaaatacatgggccgcactagttttgatagcgattcttggacgctacggctgcataacctacagatcaaagacaagggactctaccagtgtatcatccatcacaaaaagccgacaggtatgatccggatccatcaaatgaatagcgagctgtccgtgctggctaacttctctcagcccgagatcgtgccgattagtaatatcaccgagaacgtatacatcaatctgacatgcagttcaatccacggctatccagagcctaagaaaatgagtgtccttttgtag

SEQ ID NO: 182233 - DNA, 744 bp, Artificial Sequence
  Description of Artificial Sequence: Synthetic coding sequence
atgggccggaccagcttcgacagcgacagctggaccctgcggctgcacaaccttcagattaaggacaagggactataccagtgtatcattcatcataaaaaacccaccggtatgattcgaatccaccaaatgaatagcgagctgagtgtactggccaactttagccaacccgagattgtaccaatttctaatatcactgagaacgtgtatattaacctcacttgcagcagcattcatgggtaccccgagcccaaaaaaatgagcgtcctattgaggaccaagaacagcaccattgaatatgacggtgtcatgcagaagagtcaagacaatgtgactgaactctatgacgtgagcatttctctgtcagtatccttccccgacgttaccagcaacatgacaatattctgcatcctggagaccgacaagactcgcctgttatctagccctttttccatcgaattggaggatccacaacctcccccagatcacataccctggataacagctgtgttgcccacggtgattatctgtgttatggtcttttgtttgatactgtggaagtggaagaagaagaagcggccaaggaatagttataaatgtggcacaaacacaatggagagggaggaaagcgagcagacaaagaaacgggagaagatccatatccccgaacgctccgatgaggcccagcgggtgttcaaatcaagcaagactagtagctgcgacaaatctgatacatgcttttag

SEQ ID NO: 182234 - DNA, 654 bp, Artificial Sequence
  Description of Artificial Sequence: Synthetic coding sequence
atggacccccagtgcaccatgggcctgagcaacatcctgttcgtgatggccttcctgctctcagccaatttctcacagcctgaaatcgttcctatcagcaatataacggagaatgtctacataaacctgacttgcagctcgattcacggttaccctgagccaaaaaagatgtcagtcctgctacggacaaaaaacagcacgattgagtatgatggcgtgatgcagaagagccaggataatgtaaccgaactgtacgacgtctcgatttcgttatccgtctccttcccagacgtgacttccaatatgacaatcttctgtatcctcgagactgataagacgcggttattgagctcacctttcagcatcgagttggaagatccccagcccccccccgatcacattccctggatcaccgccgtgctgcccacggtgatcatatgcgtgatggtgttttgcctgattttgtggaaatggaagaaaaaaaaacgcccccggaactcttataagtgtggcacaaacacgatggagagggaagagtccgaacagacgaagaagcgcgaaaaaattcacattccggagaggtctgatgaggcgcagagagtgtttaaatcttctaagaccagttcatgtgacaagtccgacacatgtttctag

SEQ ID NO: 182235 - DNA, 732 bp, Artificial Sequence
  Description of Artificial Sequence: Synthetic coding sequence
atgcggccccggctgtggctgctgctggccgcccagctgaccgtgctgcatggcaacagcgtgcttcagcagaccccggcctatatcaaagtgcagaccaataagatggtgatgctgtcatgtgaggccaaaatttctctgtcaaatatgcggatctattggcttaggcagcggcaagcacctagctccgattcacaccatgagtttttggctctttgggactctgcaaaggggacaatccacggcgaggaagtcgagcaggaaaaaatagctgtcttccgtgatgcgtcccggtttatcctgaacttgacttcagtcaaacctgaggactctgggatttacttctgtatgattgttgggagtccggagttaacattcggaaaaggcacccaactgagcgtggtggacttcctgccaaccacagctcagcctacgaagaagagcacactgaaaaaacgagtatgccggcttccacgcccagagacccaaaaggggccattatgctcgcccataacactcggactgctggtagccggtgtattggtgctgctcgtgagtctaggcgtggctatacatttgtgttgtaggaggaggcgcgcccgtctaagattcatgaagcaaccccagggggagggaataagcgggaccttcgtgcctcagtgtctgcacgggtattacagcaataccacaacctcacagaagctgctcaatccctggatactgaagacgtag

SEQ ID NO: 182236 - DNA, 642 bp, Artificial Sequence
  Description of Artificial Sequence: Synthetic coding sequence
atgcggccccggctgtggctgctgctggccgcccagctgaccgtgctccacggcaattccgtgctgcaacagactcctgcatacatcaaagtgcagaccaacaagatggtcatgctgtcatgcgaggccaaaatctctctctcaaatatgagaatttattggctgcggcagcgacaggcaccctcctcggattcgcaccatgaatttctcgcactttgggactccgccaagggcacgatacacggtgaggaagtcgaacaggaaaagatcgctgtcttccgggatgcatcgcgcttcatcttgaacctgacctctgtgaagcctgaggactctggaatttatttctgcatgattgtgggcagccccgagctgacgttcggaaagggtacgcagctctctgtcgttgactttctgcccacaaccgcccagcctaccaagaagtcaactctcaagaagcgtgtttgcagacttccacggcctgaaacccagaaaggaaggcggcggagggctagactgagatttatgaagcaacctcagggagaaggaatctcagggaccttcgtcccacagtgtcttcatgggtactacagtaacactaccacgtcccaaaaactactgaacccctggatcctgaagacctag

SEQ ID NO: 182237 - DNA, 633 bp, Artificial Sequence
  Description of Artificial Sequence: Synthetic coding sequence
atgcggccccggctgtggctgctgctggccgcccagctgaccgtgctccacggaaactcggtcttgcagcaaacacccgcctacattaaagtgcaaaccaacaaaatggtcatgctctcgtgcgaggctaaaatctctctgagcaacatgcgcatttactggctgcgccagcggcaggccccaagttccgatagtcaccacgaatttctagccctctgggattctgcaaaagggactatccacggagaagaagtcgaacaggagaaaattgctgtcttcagagatgcttccagatttattctcaatctgacctcggtgaagccagaagacagtgggatctacttctgcatgatcgtgggatctcccgagttgactttcgggaaagggacccagctgagcgttgtggacttcctgccaactaccgcccagcccactaagaagagtaccctcaaaaaacgcgtttgcagactccctcggccagagactcagaagggcccgctgtgtagccctatcactctgggtctgctagtggctggggtattggtgcttctagtaagcctcggcgtggctattcacctgtgttgtaggaggcgtcgggctaggcttaggtttatgaagcaattctacaaatag

SEQ ID NO: 182238 - DNA, 666 bp, Artificial Sequence
  Description of Artificial Sequence: Synthetic coding sequence
atgcggccccggctgtggctgctgctggccgcccagctgaccgtgttacacggcaattcggttttgcaacaaactccagcgtatattaaggtgcagacaaataaaatggttatgctcagctgtgaagcaaagattagcctgtccaatatgaggatttattggctgcgccagagacaagcaccgtccagtgattcccaccacgaattcctcgcactatgggattcagctaagggtacgattcatggcgaggaggtggagcaagagaagatcgcggttttccgtgacgcttcaagatttatcctcaatctgaccagcgtgaagcccgaggacagcggcatctacttctgcatgatcgtgggctctccggaattgacattcgggaagggtacgcaactcagtgtggtggactttctcccaacaaccgctcagcccacgaagaagtccacactgaagaagagagtctgtcggttaccccggcccgagacacagaaagggccgctgtgtagccccattacacttggtctcctggtggcgggcgtgttggtgctgcttgtgagtttgggagtggcaatacatctctgttgtcggcgtaggcgggctaggctgcggtttatgaaacagttgcggctgcaccctctcgagaaatgctcaagaatggactattag

SEQ ID NO: 182239 - DNA, 597 bp, Artificial Sequence
  Description of Artificial Sequence: Synthetic coding sequence
atgcggccccggctgtggctgctgctggccgcccagctgaccgtgttgcatgggaactcggtgctgcaacagacccccgcatatatcaaagtgcagacaaataaaatggtaatgttatcttgcgaggccaagatctctctgagcaacatgcgcatctactggctacggcaacgccaggccccctcatctgactcgcaccatgagttcctcgcactgtgggactctgctaaaggaactatccacggggaagaggtcgaacaagagaagatcgccgtttttagggatgcttctaggtttatccttaatttaacatctgtgaagcccgaggattcaggtatctacttctgtatgatagtcggatcccctgaactgacattcggtaaaggaacacagctaagtgtagtggacttccttccaaccaccgcccaacccacaaaaaagtctactttgaagaagagggtttgccgcctgccacggccagagactcagaaggggctgaaagggaaggtgtaccaggaacctctaagcccaaacgcctgcatggacaccactgctatcttgcagccacatcgctcttgcctaacccacggtagttag

SEQ ID NO: 182240 - DNA, 93 bp, Artificial Sequence
  Description of Artificial Sequence: Synthetic coding sequence
atgcggccccggctgtggctgctgctggccgcccagctgaccggccgtcgccgacgggcgagactgcgcttcatgaaacaattatataagtag

SEQ ID NO: 182241 - DNA, 624 bp, Artificial Sequence
  Description of Artificial Sequence: Synthetic coding sequence
atgcggccccggctgtggctgctgctggccgcccagctgaccgtgttgcacggcaattccgtccttcagcaaactcctgcctatatcaaggtacagaccaataaaatggtcatgctaagctgcgaggctaaaatcagtctgtcgaacatgcgtatctactggctccgacagagacaagcaccttcatcagacagtcatcacgaattcctggccctctgggacagcgctaaaggtaccatacacggtgaggaagttgaacaggaaaagattgccgtctttcgtgatgcctcacgcttcattctaaatctaacaagtgtgaaaccagaggatagcggtatttatttttgcatgattgtgggaagccccgaactgacattcggtaagggaacacagttatcagtagtagattttcttcctaccactgctcagcctacgaagaagagtactctaaaaaagagagtgtgcaggctgccgcggccggaaacacagaaagggcccttgtgcagccctattacccttggcctcttggtcgccggtgtgctagttcttctggtaagcctgggcgtagctattcacctgtgctgcaggcgtcggcgtgcccgactgcggttcatgaaacagtag

SEQ ID NO: 182242 - DNA, 153 bp, Artificial Sequence
  Description of Artificial Sequence: Synthetic coding sequence
gagcggggccgggagcggcgggtgaagctgcggttcagcgcccggcctcaaggggaagggatcagcggcaccttcgtgccacaatgcctgcacggctattatagtaatacaaccacaagtcaaaagctgctgaatccgtggatcttaaaatag

SEQ ID NO: 182243 - DNA, 687 bp, Artificial Sequence
  Description of Artificial Sequence: Synthetic coding sequence
atgcccgtgaagggcggcaccaagtgcatcaagtacctgctgttcggcttcaactttattttttggctggccggaattgccgtgttggccatagggctgtggttacgtttcgattcacagacgaagtctatcttcgagcaggaaaccaacaacaacaactccagtttttacactggtgtatacattcttattggcgcaggtgcgctcatgatgctggtgggatttcttggatgttgtggcgcagtgcaggaatcccagtgcatgctcggcctgttcttcggcttcctgctggttattttcgcaatcgaaattgcggccgccatctggggctactctcataaggacgaggtgattaaggaggtgcaggaattttacaaggacacgtacaataagctgaagacaaaagacgagcctcagcgtgaaactttaaaagccatccattatgccttgaattgctgtggcctggcagggggagttgaacagtttatttccgacatttgtcctaaaaaggatgttttggagacctttacggtaaagagttgtcccgatgcaatcaaggaggtgttcgataataagttccacataattggagcggtcggaatcggaatcgcggtggtcatgatctttgggatgatctttagtatgattctgtgttgcgctattagacgtaacagggagatggtatag

SEQ ID NO: 182244 - DNA, 480 bp, Artificial Sequence
  Description of Artificial Sequence: Synthetic coding sequence
atgatgctggtgggcttcctgggctgctgcggcgccgtgcaggagtcccagtgcatgttgggcctgttttttggtttcctcctcgtgattttcgcaatagagatagccgctgccatctgggggtactcacacaaagacgaggttattaaagaagtccaggagttctataaagatacttataataagctgaagacaaaggacgagcctcaacgtgagaccctaaaggccatacattacgccctgaactgctgcggcctggccggtggtgtggagcaattcatctctgacatatgtcccaagaaagacgtgctggaaactttcacagtcaaatcctgccccgatgcgattaaggaagtgtttgacaacaagtttcacatcataggcgccgttgggataggcatagccgtggtgatgatctttgggatgattttttcgatgattctctgctgcgccatccgcaggaatcgagaaatggtgtag

SEQ ID NO: 182245 - DNA, 687 bp, Artificial Sequence
  Description of Artificial Sequence: Synthetic coding sequence
atgcccgtgaagggcggcaccaagtgcatcaagtacctgctgttcggcttcaactttatcttttggcttgctggcatcgcagtgttagccattggtctttggctgaggttcgatagtcagaccaagagcatttttgagcaggagaccaataataacaactcttcattttacaccggtgtctacatactcattggcgctggggccctgatgatgctagtggggttcctcggatgctgtggcgcagttcaggagtcccagtgtatgctcggactgttttttggcttccttttggtgattttcgccatcgagatcgctgcagctatctggggttattcccacaaagacgaggtcattaaagaggtccaggagttttataaagatacctacaacaagttgaaaactaaagacgagccccagcgcgaaactctgaaggccatacactatgccttgaattgttgcggactggcaggaggagtggagcagttcatctctgatatttgtccaaagaaggatgtactggagacctttacggtgaagtcttgcccggatgctatcaaggaggttttcgataataagttccatatcataggcgccgtgggtataggcatagctgttgtcatgatttttgggatgattttctccatgattctctgctgcgccatacggaggaaccgagaaatggtgtag

SEQ ID NO: 182246 - DNA, 687 bp, Artificial Sequence
  Description of Artificial Sequence: Synthetic coding sequence
atgcccgtgaagggcggcaccaagtgcatcaagtacctgctgttcgggttcaactttatcttctggctggctggcatcgcagtcttggcaatagggctctggctccgctttgatagtcagaccaagtccatttttgagcaggagacaaacaacaataactcaagcttttacaccggtgtgtacatcctgattggcgcaggggccttaatgatgttagtcgggtttctcggttgttgcggcgccgtgcaggagtcacagtgtatgcttggtctcgctactaagcgaactatgtttcctcccttcctggaggaccacgtatgtttctttagcttgaacccccaattctttggattcttgctagtgattttcgcgattgagatcgccgcagcgatttggggatacagtcacaaggacgaggtgatcaaggaagttcaggagttttataaggacacatacaacaagcttaaaacgaaggacgagccccagagggagaccctgaaggcaatacattacgctctgaactgttgcggcctggctgggggcgtcgaacagtttatctccgacatttgcccaaagaaagacgtcttagagacctttacggtgaagtcctgccccgacgcgatcaaggaggtgtttgacaacaaatttcatatcattggtgccgtgggaattgggattgctgtgtag

SEQ ID NO: 182247 - DNA, 546 bp, Artificial Sequence
  Description of Artificial Sequence: Synthetic coding sequence
atgcccgtgaagggcggcaccaagtgcatcaagtacctgctgttcggtttcaacttcatcttctggctggctggaatcgccgttttggcgataggactgtggctgaggttcgattcccagactaagagtatcttcgaacaggaaactaacaataacaatagttccttctacacgggcgtgtacatactgataggggctggtgccttaatgatgcttgttgggttccttggatgttgcggcgccgtgcaggaatcgcaatgtatgctgggactcttttttggcttcctgcttgtaatctttgccatcgaaattgcagccgcgatctgggggtattcccataaggatgaagtgatcaaggaagtgcaggagttctacaaagatacttataataagttgaagacaaaagacgaacctcagcgagaaactctgaaagctatccattatgctctcaacctttggtttggttggggcagaggcaccgtatacctccggcacctgcctcaagaaggacgcaccagaaacctgcatagagaggtcctgtcttag

SEQ ID NO: 182248 - DNA, 426 bp, Artificial Sequence
  Description of Artificial Sequence: Synthetic coding sequence
atgctgggcctgttcttcggcttcctgctggtgatcttcgccatcgaaatcgccgctgctatatggggatactcacacaaagatgaggtcatcaaggaagtgcaggagttttacaaggatacatataataagctcaaaactaaggacgaaccccagagggagaccctgaaggccattcattatgccctcaattgctgcggtcttgcaggaggtgtcgagcagtttatatcagatatttgtcctaaaaaggacgtgcttgaaacttttactgtgaaatcgtgtcccgacgcgatcaaggaggtgttcgataataagttccacataattggagccgtaggaatcggaatcgccgtagtgatgatttttggaatgatcttcagcatgatcttatgctgcgcgatcaggcggaatcgggaaatggtgtag

SEQ ID NO: 182249 - DNA, 1758 bp, Artificial Sequence
  Description of Artificial Sequence: Synthetic coding sequence
atggagaagaagtggaagtactgcgccgtgtactacatcatccagattcattttgttaagggcgtgtgggagaagactgtgaataccgaagagaatgtgtacgccacattaggctcagacgtcaacttgacctgccagacccagactgtgggcttttttgtgcagatgcaatggtctaaagttaccaacaagatcgatcttatcgctgtgtatcatccacagtacggcttctattgtgcatatggaagaccctgtgagagcctcgtgaccttcaccgaaacaccagaaaacggatcaaagtggacactccatctgagaaatatgtcttgtagtgtgagtggccggtacgaatgcatgctggttttatatcctgaggggattcaaacaaagatatacaacctgttaatccagacacatgtgacagcagacgaatggaatagcaatcacaccattgagatagaaatcaaccagaccttagagatcccttgttttcagaatagcagcagtaagatctcctcagagtttacgtatgcttggtcggtggagaacagtagtaccgattcttgggtgctgttgtctaaaggcattaaggaggacaacggcacacaggagacattaatcagtcagaaccatctgatctctaattcaacacttctgaaggaccgcgtgaaactcggtacagactacaggctccatctaagccctgtacaaatcttcgatgacggcaggaagttcagctgtcacataagagtcggtccgaacaaaatcctgaggtcttcaacgacagtgaaagtgtttgccaaaccggaaataccagtgattgtggagaataattctactgatgtgctggtggagagaagatttacatgtttactgaagaatgtcttccccaaggctaacattacttggttcattgacggcagtttcctccatgatgagaaggagggaatttatataacgaacgaggagcgtaagggcaaggacggtttcttggagcttaagtcagtcttgaccagggtacacagcaataaacctgcgcagagtgacaacctcaccatttggtgcatggctctctccccggtcccaggaaacaaggtatggaacatctctagcgagaagattacattcctgctgggatccgagattagctctacagacccacccctcagtgtcacagagtccaccctggacacacagccatcccccgcctcctcagtgtcgcctgccaggtatccggctactagctcagtcacacttgttgatgtgagcgctcttagaccaaacacaaccccacaacccagcaacagcagtatgactacgcgcgggttcaattacccctggacctcttccggcacagacaccaagaaatcggtgtccagaattccatcagaaacatatagctcatccccctctggcgctggctccactctgcatgacaacgtgttcactagtacagcccgggcgttcagcgaagtgccaacaaccgctaatggctcaaccaagacaaatcacgtgcacataactggaatcgtcgtgaacaagccaaaagatgggatgtcctggcctgtgatagttgcagctctattattctgctgcatgattctgttcggacttggggttcgcaagtggtgtcaataccaaaaagaaatcatggagagacctcctccattcaagcccccccccccgcccatcaagtacacctgcattcaagagccgaacgaatcggacttaccttaccacgagatggagacgctgtag

SEQ ID NO: 182250 - DNA, 1710 bp, Artificial Sequence
  Description of Artificial Sequence: Synthetic coding sequence
atggagaagaagtggaagtactgcgccgtgtactacatcatccagattcattttgttaagggtgtgtgggaaaagaccgtaaacactgaagagaacgtgtatgcgactttggggtcagatgtaaatctgacatgccagactcagactgttggcttcttcgttcagatgcagtggagcaaggtaaccaacaaaatcgacctgatagccgtctaccatcctcaatacggattctactgcgcttatggacgaccttgtgagtcgctggtcacctttacggaaacaccagaaaacggctctaagtggacgctgcatttgaggaacatgtcctgctctgtgagcggccgctatgaatgcatgctggtcctgtaccctgagggcatccagacaaaaatttataatctgctaattcaaacccacgtgaccgccgatgaatggaattctaaccataccatcgaaatagagattaatcaaactttggaaattccctgcttccagaactcctccagcaaaattagctccgaattcacgtacgcttggagtgtagaggacaacggaacgcaagagactcttattagccagaatcacttgatcagcaattctacattgctgaaggacagagtcaagcttggcaccgactacagacttcatttatccccagtgcagatttttgatgatgggcggaagtttagctgccacatcagggtaggaccaaacaagatacttcgcagttccacaaccgtgaaagtattcgccaagccagagattcccgtcatcgtggaaaataactctacagacgtcctcgtcgagcggcggtttacttgcttgctgaagaacgttttccccaaagctaacatcacatggtttatagatgggtctttcctgcatgatgagaaggaagggatctacatcactaatgaggaacggaaagggaaggatggatttctggagctcaagtcggtgttgacgagggtgcactccaataagcccgcccaatcagataacctgaccatctggtgcatggctctgagcccagtgcccggcaataaggtatggaacatttccagcgaaaagatcacatttctactgggcagtgagatttcttcaaccgacccccctctgtcagtgactgagtctacgctggatactcagcccagccccgccagtagcgtgagccctgcaaggtacccagccacgtcttccgttacgctggtggacgtctctgcccttagacctaacacaaccccacagcccagcaatagctcaatgaccacgcgcggatttaactacccctggaccagctcaggcacagataccaaaaagtccgttagccgaatacctagcgagacgtattcttcgtcaccatctggagcaggctccacacttcatgataacgtgttcacctccacggcccgcgcgttttccgaggtgcccacaacggctaacggaagcacaaaaacaaaccatgtacatattactggaattgtggttaacaagcccaaagacgggatgtcctggcccgtgatcgtcgccgcgctgcttttctgttgtatgatcctgttcggactcggcgtccgaaagtggtgccaataccagaaggaaatcatggaacgaccccctcctttcaagccccctccaccacctatcaagtatacatgcattcaggagccaaatgaatcagatctgccatatcacgaaatggagaccctgtag

SEQ ID NO: 182251 - DNA, 2508 bp, Artificial Sequence
  Description of Artificial Sequence: Synthetic coding sequence
atgggcggccgggtgttcctggccttctgcgtgtggctgaccctgccaggtgctgagacacaggattcaagaggttgcgctaggtggtgtccacagaactcttcatgcgtgaacgcgaccgcatgcagatgtaaccccggcttttccagcttcagtgaaatcataacaacacctacggagacttgcgatgatattaatgaatgtgctacacctagcaaagtgagctgcggaaaattcagtgactgttggaacacggagggatcatatgattgcgtgtgcagccccggatacgagcctgtctccggcgcaaaaacgtttaagaacgagtctgaaaacacctgtcaagacgtcgatgagtgccaacagaatccacgtctgtgtaaatcctacgggacatgcgtgaacacgctgggatcgtacacatgccaatgtctaccaggttttaagtttatcccagaggatcccaaggtgtgcaccgacgtgaacgagtgtaccagcgggcagaatccatgccactccagtactcactgtcttaataacgtgggatcctaccagtgtcgctgccgccccggctggcagcccattcccggctcacctaacggtcctaataataccgtgtgtgaagacgtggacgagtgttctagtggacagcatcagtgcgactctagtacagtttgcttcaacaccgtgggtagctattcttgccgctgtcgtccagggtggaaaccgagacatgggataccaaacaaccagaaggacactgtgtgcgaggatatgaccttttctacctggaccccgccccccggcgtgcattctcagacactgtcccgctttttcgataaggtgcaggacctgggaagagactctaagaccagctccgcagaagtgaccatccaaaacgtcatcaaactggttgacgagcttatggaagctcctggagacgtggaagccctggcgccccccgtacgacatcttatcgctacccaattgctcagtaatcttgaagatatcatgagaatcctggcgaaatctctccccaagggcccattcacgtacatctccccatccaacacagagttgacactgatgatccaggagaggggtgataagaatgtgacaatggggcagagttccgcccggatgaaactcaattgggctgttgctgccggggcggaggacccaggcccggcagtagccgggatcctgtcaatccagaatatgaccaccctgctagccaacgctagcctgaacctacactccaaaaaacaggctgagctggaggaaatatacgaaagttccattagaggcgtgcaacttcggcgcttgagcgccgtgaatagtatattcttgagccacaacaacactaaagagttgaacagtccaattttgttcgcattctctcacctggaaagcagtgacggagaggcaggcagagatccacccgctaaggatgtcatgcctggcccgcgccaagagctgctgtgtgcattctggaagagtgatagcgaccgtggcggccactgggcaaccgagggttgtcaggttctgggctctaagaatggatccacaacctgtcagtgttcacatctcagcagcttcgccatcctgatggcccactacgacgtggaggactggaagctgacgctgattaccagagtaggactcgctctatccctgttctgccttcttctctgtatcctcacgtttctgctggtgaggcctatacagggtagtcggacaactatccatctgcatttatgcatatgcctatttgtgggcagtactatctttctggccggaatcgaaaacgagggtggccaggtgggcttaaggtgccgactcgtggccggcttgctgcattattgtttcttggcagctttctgttggatgagtttagaagggctggagctctactttctggtggtgcgcgtgtttcaaggacaggggctttccacccgatggctgtgtctcattggttatggcgtcccactgctgattgtaggggtatcggctgctatttattccaaaggctacgggagaccccgttactgctggctagatttcgaacagggttttctgtggtctttcctgggccctgtgacctttattatcctgtgcaacgcagtcatcttcgttacaaccgtttggaagctcacccagaagttttcagagataaatccagacatgaaaaagttgaagaaagctcgagcgttaaccattacggcaatagcccagttgttcctgctgggctgtacatgggtgttcggcttgtttatctttgatgatcgcagcctggtgctaacctacgttttcactattctgaactgtctacaaggagcattcttatatctcctacattgcttgttgaacaagaaggtgcgggaagaatatagaaagtgggcctgccttgtggctggcggaagcaagtatagtgagtttacaagcaccacttctgggaccgggcataatcagacccgcgctttgagggcttccgaatcgggcatctag

SEQ ID NO: 182252 - DNA, 2361 bp, Artificial Sequence
  Description of Artificial Sequence: Synthetic coding sequence
atgggcggccgggtgttcctggccttctgcgtgtggctgaccctgcctggcgcagagacacaggactccaggggatgtgcccgctggtgtccacagaattcttcatgcgtcaacgctactgcctgcaggtgcaacccaggcttttcctccttctctgagatcattacaaccccaacagagacctgcgacgatattaacgaatgcgctacccctagtaaggtgagctgtggaaaattcagtgactgttggaatacggagggctcgtatgattgtgtgtgttccccagggtacgagccagtcagtggggcgaagacttttaagaacgaaagcgaaaatacctgtcaggacgtcgacgagtgccagcagaaccctcggctctgcaagagctacggaacatgtgtgaacaccctcggctcatacacatgccagtgtttgcccggctttaagttcattccagaggacccgaaagtgtgcacggatgtggacgagtgctcttcgggccagcaccagtgtgatagttcaactgtctgtttcaatacagtcgggtcttattcttgtagatgccgcccagggtggaagccgcgccacggcatacctaacaaccaaaaggacaccgtgtgtgaggatatgacatttagcacgtggacaccaccaccaggggtgcatagtcagaccttgtcaagattcttcgataaagtccaggatctcggcagagattctaaaacatcttctgcggaggtcaccatccagaatgtcataaagttagtggatgagctgatggaggcacccggagacgttgaagccctcgcaccacccgtgcgacacttaatagccacacagctactttcaaacttggaggatataatgcgcatcctggcaaaatccctgcctaagggccccttcacttacatcagccctagcaataccgagctaaccctgatgattcaggagcggggggataagaacgtcacgatggggcagtcttctgcgaggatgaagctgaactgggctgttgctgctggcgcagaggatccagggcccgctgtcgccggaatactgtccatccagaatatgacgacgcttcttgctaacgccagtcttaacttgcactctaagaagcaagcagaactggaagaaatttatgagtcctctatccggggggtccagctgagacgtctatctgccgtaaattcgatctttctgagtcataataataccaaggagcttaattcccctatcctcttcgccttttcccaccttgaatcctccgacggggaggccggacgagatcccccagctaaggacgtaatgcctggaccacgtcaggaactcctgtgcgctttctggaagagcgacagcgatcgtggcggtcactgggctaccgaaggttgtcaagtcctggggagcaagaatggtagtaccacgtgtcaatgttctcacttgagttcctttgcaatccttatggcacattacgacgtggaagactggaagctgactctgatcacgagggtcgggctcgccctcagcctcttttgtctcttgttgtgcatacttaccttcctgttggtccggcctatacaggggtcacgcactacaatacatctccacttgtgtatctgtctctttgtcggcagtacaatttttctggccggcatcgagaatgaagggggccaggtgggcctaaggtgcagacttgttgccggcctattgcactattgtttccttgcagccttttgttggatgtccttggagggactcgagttgtactttctggtcgtgagggtgtttcaaggccaaggtttgtctacacgctggctgtgcctgataggctacggtgtgcctttgctgattgttggcgttagcgccgccatctacagcaaggggtacggtaggcccaggtattgctggctggatttcgagcagggattcctgtggagctttcttgggcctgttacttttatcattctttgcaacgccgtcatctttgtaacaacggtatggaagcttacccagaagttttcagaaatcaaccctgatatgaaaaaactgaaaaaggcgagggccttaactattaccgcaatcgcgcagctcttcctcttgggttgtacgtgggtgttcgggttgtttatctttgatgaccggtcacttgtgctgacctatgtttttaccattctcaattgcctgcagggtgccttcctgtatttattacactgcttgttgaataagaaggttcgagaggaatacaggaaatgggcctgtctagttgccggggggtccaagtactccgagttcacatctacaacgtctggtactgggcataatcagactcgggctttaagagcgagtgaatccggtatatag

SEQ ID NO: 182253 - DNA, 2229 bp, Artificial Sequence
  Description of Artificial Sequence: Synthetic coding sequence
atgggcggccgggtgttcctggccttctgcgtgtggctgaccctgccaggtgctgagacccaagattcacgtggatgcgctcggtggtgtccacaaaatagctcctgtgttaacgccactgcctgcagatgcaacccaggcttctcaagcttcagtgagattattacaaccccaacagagacatgcgatgacatcaacgagtgcgccacccctagtaaggtctcctgtggtaaattcagcgactgttggaacacggaagggtcatatgattgcgtgtgcagtcccggctatgaacctgtgtctggcgcaaaaacattcaagaacgagagtgaaaatacttgccaggatgtggacgagtgctctagcgggcagcaccagtgtgacagctcaacagtgtgtttcaataccgtcggcagctacagctgcaggtgccgccccggatggaaaccaaggcacggcattcctaacaatcagaaggacacagtctgcgaggacatgacttttagcacctggaccccccctccaggagtccactctcagacgctgagcaggtttttcgacaaggtgcaggacctaggccgagattcgaaaacatcgagcgctgaagtcacaatccagaacgttattaagctggtagacgagctcatggaggctcctggcgacgtcgaagctctggcccccccggtgagacatctcattgcgacccagctcctttctaacttagaggacatcatgcgaatcctggccaagtctctacctaaagggcccttcacctatatcagccccagcaataccgagcttaccctcatgattcaggaacggggagacaaaaatgtgacaatgggccagtcttccgccagaatgaagctgaattgggccgttgcagctggggcagaggatcccggcccagccgttgctggtatcctgagcatccagaatatgacgactctcctcgccaatgcctccctcaatctgcattccaagaagcaagcagaactggaagaaatttacgagtcttctatcagaggcgtgcaactacgaagactgagcgccgtaaattccatctttctgtcacacaacaacaccaaggaactaaattcgcctattctttttgccttctctcacttagagagctccgacggggaggctggtagagacccaccagcaaaagacgtgatgccagggccccggcaggaactcttatgcgctttctggaaaagcgacagcgatcgcggtgggcactgggccacagagggctgtcaagtcttagggtcaaaaaatggctctacaacgtgccaatgcagccatttgagctcctttgctatccttatggcacactatgatgtagaggactggaaactcaccctgatcacacgagttggcctggcactcagcctcttctgccttctgctgtgtattctgacattcttactggtgaggcctatccaggggagcagaactaccatacatctgcacctttgcatctgccttttcgtagggtccaccatttttttggccggaatcgagaacgagggaggccaagtcgggttacggtgccggctcgttgccgggttgctgcactattgtttcctcgcagccttttgctggatgagtctcgagggactcgagctatattttctcgtggtgagggtcttccagggacagggcctcagcacccggtggctctgtcttatcggttacggcgtacctctcctcattgtcggagtcagtgctgccatatactcaaagggatatggaagacctaggtactgttggctggactttgaacaggggttcctgtggtctttcctgggtcccgtaacctttatcatcttatgcaatgctgtcattttcgtgacaacagtttggaaactgacacagaaattcagcgagatcaatccagacatgaaaaagttaaagaaagcgcgagcactgactatcactgccatcgcgcaactctttttattgggatgtacatgggtttttggtttgtttatttttgatgaccgaagcctagtcctgacttacgtgtttaccatactcaattgcctgcagggcgcatttttatatctcctccactgtctcttaaataagaaagtcagagaagaatacaggaagtgggcctgtctggtggcaggcggatctaagtactcagagtttacatcgaccacctcaggcacaggtcataaccaaacaagggccctcagagcttccgagtctggcatttag

SEQ ID NO: 182254 - DNA, 2358 bp, Artificial Sequence
  Description of Artificial Sequence: Synthetic coding sequence
ggcggccggatcatgcgggccttctgcgtgtggctgaccctgcccggcgctgagacgcaagacagcagagggtgtgctcgatggtgcccccaaaattcaagttgtgtaaatgccaccgcatgtagatgtaaccccggtttcagcagctttagcgagatcatcacgacaccgaccgagacatgcgacgacattaatgaatgcgccactccctccaaagtctcctgcggtaagttctccgattgctggaatacagaggggagctatgattgtgtgtgctcccccggctacgaaccagtgagcggagccaaaactttcaaaaatgagtcagagaatacttgtcaggatgtagacgaatgccagcaaaatcccaggctgtgcaagagttacggtacatgcgtaaatacgctcggctcttacacttgccagtgtttacccggcttcaagtttatccccgaggaccccaaagtctgtacagacgtcgacgagtgcagctccggacagcaccagtgcgacagttctacagtgtgtttcaacacagtgggttcctactcttgcaggtgcagacccggctggaagcctaggcatggcattccaaataaccagaaggatacagtgtgcgaggatatgacattttctacttggacacccccgccgggagtccactctcagaccctgtctcgctttttcgacaaggtccaagacctaggcagagactccaagacatcttccgctgaggtgaccatccaaaacgtaatcaagctggtggacgaacttatggaggccccaggagatgtcgaagctctcgctcctccagtgagacatctcatagccacacagcttctgagcaatctggaggacattatgcggattctcgcgaaatcactccccaaaggacctttcacctatatatccccgtctaacaccgagctgacgcttatgatccaggaacgcggcgataagaacgtgactatgggccagtcttcagcgcggatgaagctgaactgggccgtcgcagccggagcagaggaccctggacctgctgttgccggtatcctgagcatacagaacatgactaccctgctagcaaatgcctctttgaatctacattccaagaagcaggccgagctagaggagatttacgagtccagtattagaggcgtccagctccgtagattgagtgccgttaacagtatcttcctgtcccacaataacacaaaggaactgaactctcccattctctttgcttttagtcacttagagagttccgacggggaggccggcagggatcctccagccaaagacgtcatgcccggaccccgacaggagctgctttgcgccttttggaaaagtgattcagatcgagggggccactgggccaccgaggggtgccaggttcttgggtccaaaaacggtagtactacttgccagtgcagccacctgagtagtttcgcaatccttatggcgcactatgacgttgaggattggaaactgaccctgatcactagagtcggactggcactgtcactattttgcctacttctgtgtattctgacctttctcttggtgaggcccattcaaggcagccgcacgactattcacctccatctgtgcatatgcctttttgtgggttccacgattttcctggcaggcatcgagaacgaaggagggcaagtgggactgagatgccggctcgttgccgggcttttgcattactgtttccttgctgcgttttgctggatgagcctcgagggactggaattgtatttcctcgtggtccgagtgttccaaggccaaggcttgtccacccgctggttatgtctcattggctacggtgtcccattgctgatcgtcggagtctccgcagccatatactcaaagggctacggtcgaccacggtactgttggctcgatttcgaacagggattcctgtggtccttcctgggacccgtcactttcatcattttgtgcaatgctgtgatctttgtcactaccgtctggaagttgacccaaaagtttagcgaaattaatccagatatgaaaaagctcaagaaagcaagagcacttaccattaccgccattgcccagctgttcttgctgggctgtacctgggttttcgggctctttatcttcgacgaccgtagcctggtgcttacctacgtgtttactatattgaactgtctgcagggtgccttcctgtatctcttgcattgcttgctgaataaaaaggtcagggaggagtatcgcaagtgggcctgcttagtggccggcgggagcaagtactcagaatttacctcaacgacttctggaacaggccataaccaaaccagggccctgagggcctccgagagtggcatctag

SEQ ID NO: 182255 - DNA, 297 bp, Artificial Sequence
  Description of Artificial Sequence: Synthetic coding sequence
atgagcgtgcggctgcacgtgcccagcggcagccggggcagcgagctttccgctttaatccaggcaatcggagcctccaccagtgggaagcccaaatgttttgtgtgtatacttagatccgggctgtccgttgccctctcactgtccgtctattttctcctgctcttttcacggacccgcggaggcggacacggcgaaccgcccgaatgtcagagaagggcctcttgttcagcctacagcttcagagagattgaggattgtaggcagaagcagcctcggcgatggcaacaaggttag

SEQ ID NO: 182256 - DNA, 231 bp, Artificial Sequence
  Description of Artificial Sequence: Synthetic coding sequence
atggcccggggcgccgccctggccctgctgctgttcggcctgctgggcgtgctcgtggctgccccagggtttggtgacctgcgtttgcaggcagcacggggcggacgtcctggcgttgcctgtcatagccacgccctgcggcctggccccaagtttggtatcgcgcggtccctgagacctggatggtggggggaagggaaggagaagttagaaaaaaatttcgaaccctag

SEQ ID NO: 182257 - DNA, 534 bp, Artificial Sequence
  Description of Artificial Sequence: Synthetic coding sequence
atggcccggggcgccgccctggccctgctgctgttcggcctgctgggcgttctggtagccgcccccgatggcggctttgacctatccgacgcactgcccgacaatgagaataaaaagccgaccgcaatcccaaagaagccatccgccggagacgatttcgacttgggagatgcggtagtcgatggagagaacgacgaccctaggccaccgaacccgcctaagccgatgccgaatcctaacccgaatcacccatcttcctccggctcttttagtgatgccgatctggccgatggggtatccggaggcgaggggaaaggagggtcagacggtggaggctcccacaggaaagagggggaggaggccgacgccccaggtgtgattcccgggattgtgggtgccgtggtggtagccgtggcgggtgctatctctagtttcattgcatatcagaaaaagaagctgtgctttaaggagaacggccaactggccggttccctcgggccctgtatcggaattcggcgcgaggccgacggctag

SEQ ID NO: 182258 - DNA, 510 bp, Artificial Sequence
  Description of Artificial Sequence: Synthetic coding sequence
atggcccggggcgccgccctggccctgctgctgttcggcctgctgggagtgctagttgccgcgccagacgggggatttgatctttctgacgcacttcccggggatgactttgatctcggcgatgccgtggtcgacggggagaacgacgatccacggccgccgaatcctcctaagcccatgcccaaccccaatccaaatcacccctctagtagcggatccttctccgacgccgacctcgctgatggagtgtcaggaggtgaaggcaaaggtggttctgacggcggtggtagtcatagaaaggagggggaggaggcagacgcacccggtgtgatccccggcatcgtaggcgccgtcgtggtcgccgtcgcaggcgccatctcttcttttatagcctaccagaaaaagaagttgtgtttcaaagaaaatgcagagcagggcgaggtcgacatggaaagccacaggaacgcaaatgcggaacccgccgtgcaaaggactctcctcgagaagtag

SEQ ID NO: 182259 - DNA, 558 bp, Artificial Sequence
  Description of Artificial Sequence: Synthetic coding sequence
atggcccggggcgccgccctggccctgctgctgttcggcctgctgggagtgctggtggcagcaccagatggagggtttgacctctccgacgcactacctgataatgaaaataagaagcccaccgcaattcctaagaaaccaagcgccggtgacgattttgaccttggcgatgcagtcgtggacggcgagaacgacgatcctcgccccccaaatccccctaagccaatgcccaaccctaatcctaatcatccttcctcaagtggttctttttctgatgctgatcttgcagatggcgtctccgggggcgagggcaaaggcgggtcagacggtggcggctctcacagaaaggaaggcgaagaagctgacgctccaggagtcatccctgggattgtaggtgctgtggttgttgcagtggcaggtgcaatctcctctttcattgcatatcagaaaaagaaactttgctttaaggagaatgctgagcagggcgaggtggatatggaatcccataggaacgccaatgcggaaccagccgttcaacgaactcttcttgagaagtag

SEQ ID NO: 182260 - DNA, 606 bp, Artificial Sequence
  Description of Artificial Sequence: Synthetic coding sequence
cggcggtggggccggcccgccggcacccccggcgccagcagcctgcctggccggaccaggtgtgcccacggaggaccgggtcctgaggaagctccaactttcagccccactctcttccttgaaccctttcagcgggaaaagtctgcctttgtagtgggcgtcgcaaactcctacatgtggggtggactcggtcgagacggcgggttcgatttatccgatgctctgcctgataacgaaaacaagaagcctacggcaattcccaagaaaccgtctgccggcgacgacttcgatctgggtgacgctgtggtggatggcgagaatgacgacccgcgcccccctaatcccccgaagccaatgcctaatcctaaccctaatcatccctctagcagcggctctttttctgatgccgatcttgcagacggcgtctcagggggagaggggaaaggcggatcagacggtggtggcagtcacagaaaggagggcgaagaagccgatgcaccgggcgtaattcctggtatcgtgggggcagtggtggttgctgtcgctggcgctattagttcgtttatcgcctatcagaagaagaagttatgcttcaaagaaaactag

SEQ ID NO: 182261 - DNA, 438 bp, Artificial Sequence
  Description of Artificial Sequence: Synthetic coding sequence
atggtggcctggcggagcgccttcctggtgtgcctggccttcagcttggccaccttagtgcagcgtgggagtggggacttcgatgactttaatttggaagacgccgtgaaggaaaccagcagcgtcaagccagcactcggcatgtatcataaactggacgggctgaagcagcagaattttatcctgtccctgttctggatgctcgaggtgctctaccaaggggtggggtgggccacattcagtctgaaagccctgggcaaaaacctgtcactgacattcccaaccagcggcggaagccggtgttctcttgtttgcggatgcatcactccaatttccgccagcgtggtgacctggtgctctcctttctgcgtgagcctcctcagtctcaccaaaatgttggtgagcggatttaaggcccatttagataatcccggctag

SEQ ID NO: 182262 - DNA, 573 bp, Artificial Sequence
  Description of Artificial Sequence: Synthetic coding sequence
atggtggcctggcggagcgccttcctggtgtgcctggccttcagcctcgcgaccttagtccagaggggttcaggtgatttcgatgactttaatctggaagacgccgtcaaagagacatcttccgtcaagagaaatgactttgacttagccgatgccttggacgatagaaacgacagagatgacggccgccggaagcccatagccggtggtggcggcttttctgataaggacctcgaagacatcgtaggcggcggcgagtataaacccgacaagggaaagggcgacggccgctatggaagtaacgacgatccaggaagcggtatggttgcagaaccaggaacaatcgcaggtgttgcctcagcactggctatggctttaataggtgctgtctcttcttacatttcctatcagcagaaaaagttctgcttttcgattcagcaaggtctgaatgctgattatgttaaaggagaaaacctcgaggccgtggtgtgcgaagagcctcaggtgaaatattcgactctgcatactcagtcagcggaacctccccccccccctgaaccagcgagaatttag

SEQ ID NO: 182263 - DNA, 789 bp, Artificial Sequence
  Description of Artificial Sequence: Synthetic coding sequence
atggtggcctggcggagcgccttcctggtgtgcctggccttcagcctcgccacgctcgtgcagcgcggcagtggggacttcgacgacttcaatttagaagatgcggtcaaggaaacctcaagcgtcaagcagccctgggatcataccacgaccacaacaaccaatcgacccgggacaacacgggccccagcaaaacctcccggaagcggactcgatttagctgatgccttggatgaccaggatgatggaaggagaaaacctggaatagggggaagagaacgttggaatcacgtgactacgactaccaagaggcctgtgaccacccgtgctccagccaacacgctaggcaatgattttgatctggctgatgcactggatgatcgcaacgatagagacgacgggagacggaagccgatcgcgggaggtggggggttcagcgataaggatttggaggatatcgtcggcggtggcgagtacaagcctgataagggaaagggtgacggtagatatggtagcaatgatgacccggggtctggaatggtagctgaacccggaactatcgccggcgtagctagcgcactggcgatggctctcatcggcgctgtttctagctacatctcctaccagcagaagaaattctgtttcagcatacagcaaggactcaatgcagactatgtgaagggggagaatctggaagctgtggtgtgtgaggagcctcaagtgaagtactccactctgcacacccagtcagctgagcctccacctccccccgaacccgctcggatttag

SEQ ID NO: 182264 - DNA, 474 bp, Artificial Sequence
  Description of Artificial Sequence: Synthetic coding sequence
gagaccagcagcgtgaagcagccctgggaccacaccaccaccaccaccacaaatagacccgggacaacaagggctcctgccaagccacccggcagcggcctggatctcgcggacgccctggacgatcaggacgacgggaggcggaagcctggcattggtggcagagaacggtggaaccatgtgactactacgactaaacggccagtgacgacacgggcgcccgccaataccctcggcaacgacttcgacctggcagacgctttagacgatcgcaatgatagggatgatggccgaagaaagcccatagctggtggggggggattttctgataaggatctcgaagacattgtggggggtggagaatataagcccgacaaagggaagggtgatgggcgctatggatcaaatgacgatccaggcagcggcgggtttctcaaccccgaggcgcctgtcggccacgtcaagggtaagtag

SEQ ID NO: 182265 - DNA, 570 bp, Artificial Sequence
  Description of Artificial Sequence: Synthetic coding sequence
atggtggcctggcggagcgccttcctggtgtgcctggccttcagcctagccacgttggttcagcgcggatcaggggatttcgacgacttcaacctggaagacgctgtgaaagagacaagctctgtgaagcagccatgggatcacactaccactactacaactaacaggccagggaccacccgagcaccagcaaaacctccgggatccgggctggacctggctgacgccctggacgatcaggatgacggccggagaaagcccgggattggcgggagaggcgacggtcgctatggctcaaatgacgacccagggtcgggcatggtagccgagcccggaaccatcgccggcgtggccagcgccttggccatggctttaatcggtgccgtgagttcgtacatttcatatcagcagaagaagttctgtttcagtattcagcagggcttgaatgctgattatgttaagggtgaaaacctggaagctgttgtttgtgaggaaccacaagttaaatactcaacactgcacacacagagcgctgaacccccccctcctcccgagcctgctcgaatctag

SEQ ID NO: 182266 - DNA, 819 bp, Artificial Sequence
  Description of Artificial Sequence: Synthetic coding sequence
atggtggcctggcggagcgccttcctggtgtgcctggccttcagcttagctacattggtgcagagagggtccggagacttcgatgactttaatctcgaggacgccgtgaaagagacaagtagtgtaaagcaaccatgggaccatacaactactacaaccaccaatcgccctgggactacacgggcccctgccaagccgcctggaccaactgagggctcaggcctcgatctcgccgatgctctcgacgatcaggacgatggcagacgaaagcccggcataggaggaagggaaagatggaatcatgtcacaaccacaacgaaaagacctgtgactactagggccccagctaatactctggggaacgactttgacttagccgacgcactcgatgaccgcaatgacagggatgacggtcgtcggaagccaatcgcaggcggaggcgggtttagcgacaaagatctggaagatatcgttgggggaggtgagtataagccagacaaaggaaagggcgatggacgatacgggagcaacgacgacccaggcagcgggatggtggcagagcccggcactattgccggtgtcgcctccgcactggcgatggccttaattggcgccgtctcttcctatatatcataccaacagaaaaagttctgtttctcaatccagcatgccgcagcgggacaggaaggtctgaacgccgactatgtgaagggggagaacctggaagctgtggtgtgcgaagagccacaagtgaaatattcaactctgcacacccaatcggcagagcccccgccccctcctgagcccgctcgcatctag

SEQ ID NO: 182267 - DNA, 642 bp, Artificial Sequence
  Description of Artificial Sequence: Synthetic coding sequence
atggtggcctggcggagcgccttcctggtgtgcctggccttcagcctggccactctggtgcagcgggggtccggagactttgatgatttcaatctggaggacgcggttaaagagacatctagcgtgaagcagcggtggaatcatgtgaccacaacaactaagaggccggttacaactagagcacctgccaacactctcgggaacgacttcgatctggcagatgctctggatgacagaaatgaccgtgatgacggacgcaggaagccaatagcgggaggaggcggctttagtgataaggatctagaagatatcgtcggaggcggcgagtacaaacctgataagggcaaaggcgatgggcggtacggctctaacgatgatcccgggtcggggatggtcgcagagcctggaaccatcgcaggggttgccagcgcgctagccatggccctgatcggggcagtttcctcctatatctcgtaccagcagaagaagttttgctttagcatccagcaaggactgaatgcggactacgtcaaaggggagaacctggaagcagtggtctgcgaggaacctcaggtcaaatatagcaccttacatacacaatctgccgagcccccacccccgccggaacccgccaggatctag

SEQ ID NO: 182268 - DNA, 1785 bp, Artificial Sequence
  Description of Artificial Sequence: Synthetic coding sequence
atggccgccgagagcggcgagctgatcggcgcctgcgagttcatgaaggatagactttacttcgccaccctccgcaaccggcccaagtcaaccgttaatacacactatttctccatcgacgaggaactcgtttatgagaatttctacgccgattttggtcctctgaatctggcaatggtctaccgctattgttgcaagctcaataaaaaactcaagtcctatagcctctctcggaagaagatagtgcactatacatgtttcgaccagcgtaaacgagcgaatgccgcttttctgattggcgcctacgcagttatttacctgaaaaagactcctgaggaggcttacagagccctactcagtgggagcaaccccccatacctgcctttccgcgatgcaagctttggaaactgtacttacaatttgaccatattggattgccttcaggggatccggaagggattacagcacggattcttcgatttcgagactttcgatgtggacgagtacgagcattatgagcgggtggagaacggagattttaactggatagtccctggaaagtttcttgccttttcaggcccacaccccaaaagcaaaatcgagaatggataccctttgcatgcgcctgaggcctacttcccctattttaagaaacacaacgtgactgctgtggtccggctcaataaaaagatctatgaagcgaaaagattcacagacgctggttttgaacactatgacctcttttttatcgacggctccacccctagcgacaatatagtccgtcgcttcctcaatatctgtgagaacaccgaaggtgctattgcagtgcattgcaaagcaggtttgggaagaaccggaaccctgattgcctgttacgtaatgaagcattaccgatttacccacgccgaaattattgcttggatacgaatttgcagaccaggatccatcatcggcccacagcaacattttttggaagagaagcaggctagtttatgggtgcagggcgatattttcagatcgaagctgaagaaccgcccttcaagcgaaggatctatcaataagatcctgagtgggttggacgatatgtcgatcggcggcaaccttagcaagacacagaatatggagcgcttcggagaggacaacctggaagacgatgacgttgaaatgaagaatgggattacccagggggataaactgagagcgctgaaaagtcagcgccaaccgaggacatcaccttcctgtgcctttagatccgacgacaccaagggacacccacgtgctgtgtcccaaccttttcgtctgagttccagccttcagggcagcgcagtgaccttaaagacatccaagatggcattgagccccagtgccaccgctaagcggattaacaggacaagcttaagctccggcgcaacagtgagatccttcagcataaattccaggctggcttcaagtctaggaaacctgaacgccgcaaccgacgaccccgagaacaagaagacgagctcaagtagcaaagcgggctttactgcgagccctttcaccaatttattaaatggtagcagtcagcctactaccaggaattaccccgagttgaataacaatcagtataaccggtcctctaattccaacggtggtaacctgaactcacctcctggtccccatagtgctaagacggaggagcacacaactatcctgagaccgtcatatactgggctcagctcttccagtgcccggtttctgagccggtctattcctagcctgcagtcggagtacgttcattattag

SEQ ID NO: 182269 - DNA, 1872 bp, Artificial Sequence
  Description of Artificial Sequence: Synthetic coding sequence
atggccgccgagagcggcgagctgatcggcgcctgcgagttcatgaaagacagactgtattttgcaactctccgaaaccgcccaaaatccaccgtcaatacgcattacttcagcatcgatgaagaactcgtgtacgagaacttttacgcagatttcggccccttaaatttggccatggtgtaccggtactgctgtaaactgaacaagaagctgaaaagctactcattgtcaagaaaaaagatcgtccactacacttgttttgaccagcgaaagagagcaaacgcagcatttcttatcggggcctacgcggtgatctatctgaagaaaacccctgaagaggcctatagagcactcctgtccgggtccaaccccccctatctgcccttcagagatgcctcctttggaaactgtacctacaacctgaccattctggattgtctccaggggatacggaaggggctgcagcacgggttcttcgattttgaaacgtttgacgttgatgaatacgaacattatgagcgagtggaaaacggagacttcaattggatagtgcctgggaaatttcttgccttcagcggtccccatcctaaaagtaaaattgaaaacggatacccattacatgcccctgaggcatacttcccgtacttcaagaaacacaatgtgaccgctgtggtgagactgaataaaaaaatttatgaggcaaagcgtttcaccgatgccgggtttgagcactacgatctgttttttattgacggctccacgcctagtgataacatcgtgcgccgcttcctaaacatctgcgaaaatacagaaggcgcaattgcagttcactgtaaagcagggctcggccggactggaacgttgattgcatgctatgtgatgaaacattacagatttactcatgcggagattattgcctggatccggatatgccgaccaggctccatcattggccctcagcagcacttcttggaggagaagcaggcctcactctgggtgcagggggacatattccgttccaagctgaaaaatcgccctagttccgagggttcgattaacaaaatcctgtcgggcctggacgatatgtcaatcggaggtaacctgtctaagacccaaaacatggagcggtttggagaggacaatctcgaggacgacgatgtcgagatgaagaacggtataacccagggcgacaaactccgcgccctcaagagtcagcgccaaccccggacatctccttcatgtgctttcaggtcagatgatacgaaaggccaccctagggccgtgtcccagcctttccgtctgagctcctccctccagggatccgccgtgactctgaaaacttcaaagatggcactgagtccaagtgcaaccgcaaaaagaatcaatcgcaccagtttatcgagcggcgctaccgtacggtccttctccatcaattctcgactcgcctcaagtctaggtaacctgaacgctgccactgatgatcctgagaacaagaagacaagctcctcatccaaagccgggttcaccgcctctccatttacaaatctgttgaatggctcaagtcagcccacaacgcgaaactaccccgagctcaacaacaatcagtataataggagttcaaacagcaatggcggtaacctgaacagtcccccgggccctcactcagccaagaccgaagaacatacgaccatcctccgccccagctatacgggattatccagctctagtgcccgctttcttagcaggtctatacctgtgtccgctcagacaccacccccaggtccacagaatcccgaatgcaacttttgcgccttgccctctcagccccgactccctcctaaaaagttcaatagcgctaaggaggcgttctag

SEQ ID NO: 182270 - DNA, 1152 bp, Artificial Sequence
  Description of Artificial Sequence: Synthetic coding sequence
atggccgccgagagcggcgagctgatcggcgcctgcgagttcatgaaagatagactatacttcgctaccctgcgcaatcggcccaagtcaacagtcaatacccattacttctcaatcgacgaagaactagtgtacgagaatttctacgccgattttgggccactgaacctcgcaatggtatatcggtattgttgtaagctgaacaagaagctgaagtcctattctctgagccgcaaaaagattgtgcattacacctgttttgaccaacggaagcgggcaaatgccgcttttttgatcggggcctacgccgtcatctacttgaagaaaaccccggaggaggcctacagggccctgctctcagggtcaaatccaccctatctcccattcagagatgcaagctttggcaactgtacatacaacctgaccattttggactgtctgcaaggcattcgcaaagggctgcagcacggtttctttgattttgagacattcgatgttgatgagtatgaacattacgaacgagtcgagaacggtgacttcaactggattgttccaggaaaattcctggctttctctggccctcaccctaaaagcaaaatcgagaatggatacccgctgcacgcgccagaggcttactttccctatttcaaaaagcacaacgtgactgcagtggtgaggctcaacaaaaagatctatgaagcaaagcgcttcacagatgccgggttcgaacactatgacctattcttcattgacggtagcacaccatccgataatatcgtgaggagattcctgaacatctgcgaaaatacagagggagctattgccgttcattgtaaggccggcctgggtcgcaccggtaccctgatcgcttgctatgtcatgaagcactataggtttacccacgccgaaatcatcgcttggattcggatttgtcggcctggctcaattattgggccccagcagcattttctagaagagaaacaagcctctctctgggtacagggcgacattttccggtctaaactcaaaaaccgaccgtcttccgaaggttccataaacaagatattgagtgggctggacgatatgagcatcggcggcaacttatctaagacccaaaacatggagaggtttggcgaggtgtcatttccgtag

SEQ ID NO: 182271 - DNA, 576 bp, Artificial Sequence
  Description of Artificial Sequence: Synthetic coding sequence
atggccgccgagagcggcgagctgatcggcgcctgcgagttcatgaaagaccgtctctacttcgcaactcttcgcaaccgccccaagagtacagtaaatacgcattatttttctatcgacgaggagttggtatacgaaaatttctatgccgatttcggtcctctaaacctagctatggtgtatcgctactgttgcaagctgaacaagaagctaaagtcatattcactgagccggaagaagatcgtgcactacacctgcttcgatcagagaaaacgggcaaacgctgctttcctgatcggcgcctatgcagtcatctacctgaagaaaacccccgaggaagcctatagggcactactgagtggcagtaaccccccttatttgccctttcgcgatgcctcattcggaaactgtacgtacaacctgacaattctggactgcctgcaggggattaggaagggtctacaacatggcttcttcgactttgaaacctttgatgtggatgagtacgaacactatgaagttattttattcacccccctgaagcctacttttttgattagtaagtctattatgtag

SEQ ID NO: 182272 - DNA, 822 bp, Artificial Sequence
  Description of Artificial Sequence: Synthetic coding sequence
atgggcaacttcctgagccgggagaacaaggtgcaggtgatcagcgaaagcgatcggctgtattttgcaacgcttcggaataggccaaaatctacagtcaacacacattacttctccatcgacgaggagcttgtctatgaaaatttctatgccgactttggacctctcaatcttgctatggtctacaggtactgctgtaagctgaataaaaagctgaagagctactccttatccagaaagaagatcgtgcactatacatgcttcgatcagcggaaacgggcgaatgccgcctttttgatcggggcatatgccgtcatctatttgaaaaaaacacccgaagaagcatacagggctcttctgtcaggaagcaacccgccatatctgccctttcgagatgcttcgttcggcaactgtacatataatctaaccattctagactgcctgcaaggtatccgcaagggccttcagcatggcttctttgatttcgagactttcgacgtcgatgagtatgagcactatgaacgggttgaaaacggagatttcaactggattgtgcccggcaaatttctggcattctctggaccacacccaaagtctaaaatcgaaaacggctaccctctgcacgcacctgaagcatacttcccctactttaagaaacataatgtcaccgccgtggtcagactgaacaaaaagatatatgaggctaagaggttcacagacgccggatttgaacattatgatctgtttttcatagacggctctacacctagtgacaatatcgtgaggcgctttctgaatatctgcgagaacactgaagggtag

SEQ ID NO: 182273 - DNA, 1698 bp, Artificial Sequence
  Description of Artificial Sequence: Synthetic coding sequence
atggtgtaccggtactgctgcaagctgaacaagaagctgaagagctacagccttagccgcaaaaaaatcgtacactatacctgctttgatcagcggaagcgggcaaacgccgccttcctgattggagcctatgccgtgatttacctcaaaaagactcccgaagaggcctacagagctctgttgagcggatctaaccctccataccttccattcagggacgcctcctttggcaattgtacttataatctgaccattctcgactgcttgcagggaatacggaagggcctccagcatggattttttgacttcgagacttttgatgtggatgagtatgagcattatgagagagtggagaacggggatttcaactggatcgtgcctggaaagttcttagcattctcagggcctcacccaaaatccaaaatcgaaaacggctatccattgcacgccccagaagcctattttccatacttcaaaaaacacaacgtcacagcagtggttcggttaaataaaaaaatctacgaagccaaacgctttactgacgctggatttgaacattatgacctctttttcatcgacgggagcaccccctcagataacatcgtgcgacgtttcctaaacatctgtgaaaatacagaaggcgcgatcgcagtgcattgcaaggccgggttaggacgaacaggaacactcattgcttgctatgtgatgaagcactatcgcttcactcacgctgaaataatcgcctggattcggatttgcaggcctggaagcatcatcggtccacaacagcacttcctagaggaaaagcaggcgagcctctgggtccaaggcgatattttccggtctaagctgaaaaatcggccaagtagcgagggtagtatcaacaagatcctgagcgggcttgatgatatgtccattggtggtaatctatcaaagacacaaaatatggaaaggttcggagaggacaatctggaggacgatgacgtggagatgaaaaatggtataacccaaggagacaagcttcgggcgctaaagtcgcagcgccaaccaagaaccagcccttcttgcgcattcaggagtgacgatacaaaggggcatccacgggcagtgtctcaacccttccgcctgtcctcttcactgcaaggcagcgcggtgactctgaagaccagcaaaatggccctcagtccaagtgccaccgcaaagaggataaacaggacaagtctgtcttccggcgctacagtgcgctcgttttccattaacagtcgcctggcctcctcactgggcaatctgaatgcggcaacagatgatcctgagaacaagaagacctcctccagctccaaagccggctttaccgctagcccatttactaacctgctcaacggttcctcccagccgaccacccgcaactacccagagttgaacaacaaccagtacaatcggagctccaactctaatggcgggaatctcaatagcccacccggaccgcattcagcaaagaccgaggagcacacaacaatcctcaggccgtcctacaccggcctgtcgtcttccagtgcaaggttcctttccaggtcaatccccgtgtccgcacagacacctcctccaggtccccagaatccagaatgtaatttttgcgctctgccgagtcagccaagactgcctccgaagaagttcaactccgccaaagaggcattttag

SEQ ID NO: 182274 - DNA, 1833 bp, Artificial Sequence
  Description of Artificial Sequence: Synthetic coding sequence
atggccgccgagagcggcgagctgatcggcgcctgcgagttcatgaaggaccggctttatttcgctaccctccgtaaccggcctaagagtactgtgaacactcattatttctctattgatgaggagctcgtctacgagaacttctacgctgacttcgggccgctgaacctggcgatggtttacagatactgttgcaaattgaacaagaagctaaagagctatagcctgtcaagaaagaagatcgttcactatacttgcttcgaccagcgaaagcgcgcaaatgccgcgtttctgatcggagcatacgcagtcatctacctgaaaaaaacaccagaagaggcgtatagggccctcttatcaggatcaaaccccccctatctccccttccgtgacgcaagctttggcaactgtacctacaaccttaccatactggactgcctccagggcatcaggaaaggtctgcaacacgggttctttgacttcgagaccttcgatgtggatgagtacgagcactacgaaagagtggaaaacggagattttaactggattgtacctggtaagttcctagcgttctctggaccgcaccctaagtctaagatcgaaaatggctatccactgcatgcacccgaggcctattttccgtatttcaagaagcacaacgtgaccgccgtcgtgaggctgaacaaaaaaatatacgaggctaaaaggttcactgacgccggcttcgaacactacgatctgttctttatcgatggctcaacgccatcagacaatatagtgcggcgcttcctgaatatttgtgagaacactgaaggtgctatcgccgttcactgcaaggctgggttggggaggaccgggaccctcatcgcctgttatgttatgaagcattaccgcttcacccatgccgaaataatcgcttggatccgcatctgccggcctggttctatcatcggacctcagcaacactttctcgaagaaaagcaggcttccctctgggttcagggagatatatttcggtccaaactgaaaaaccgacctagctccgagggctccattaataaaatcttatcagggcttgatgatatgagcattggcgggaatctgtcaaagacgcagaacatggaacggtttggagaagataacctcgaggatgatgacgtggaaatgaagaatggcattactcagggagacaagctaagagcactgaagagccagagacagccacggaccagcccaagttgcgcctttcgttcagacgatacaaagggacacccacgagccgtaagccagcctttccgcttgtccagcagtttacagggatctgctgtgaccttaaagacttctaagatggccttgagtcccagcgctacggccaagcgcattaatcgcacgagcctgtcctcaggcgccactgtccgcagcttcagtatcaactccagacttgccagctccctgggcaacctgaacgctgccactgacgacccagaaaataaaaagaccagctctagttctaaagctggcttcaccgcctctcccttcactaacctgctcaacgggagctctcagcctaccactaggaattacccggaactgaacaacaatcagtacaatcgatcttcaaactcaaatggaggtaatctgaacagtccccccggacctcatagtgcaaaaaccgaagaacacacaaccatcctcagaccaagctacaccggtctcagcagttctagtgccaggtttctgagccggagtataccatgctcgtgtctacttctcgtgtttaggaagccattcctgggcagcccccttctcagcctccccatatctcacctgtag

SEQ ID NO: 182275 - DNA, 1416 bp, Artificial Sequence
  Description of Artificial Sequence: Synthetic coding sequence
atgaagcggaagagcgagcggcggagcagctgggccgccgcccccccatgttcaaggagatgttctagcacttccccaggcgtgaagaaaattcggtcaagtacccagcaggacccaagacgcagagatccccaggacgatgtgtaccttgatatcacagaccgcttatgcttcgccattctctattcacgcccaaagagtgcgagcaatgtgcattacttctcaatagacaacgagctcgagtatgagaatttctacgctgacttcggccccctaaatctggccatggtgtataggtactgttgtaaaatcaacaagaaattgaaaagtattacaatgctgcgcaagaaaattgtgcactttacgggtagcgatcagagaaagcaggcaaacgcagcctttttggtaggatgttacatggtgatttaccttggtagaacgccagaggaagcctaccggattctaatctttggagagacaagctacatcccgttcagggatgcagcctatgggtcctgcaacttctacatcacccttcttgattgcttccacgctgtgaaaaaggctatgcagtacggattcctcaacttcaattcttttaatctcgacgagtatgagcattacgaaaaagcagaaaacggggatctcaactggattatccccgaccgattcattgcgttttgcggcccgcacagccgtgctagactggagtctgggtatcatcagcattcacccgaaacttatatccaatatttcaaaaatcataacgttacaacaattatccgcttaaataagcgaatgtacgacgcaaagcggtttacagatgcaggctttgaccatcacgatctcttttttgcagacgggtctaccccaacagacgcgattgtcaaggagtttcttgatatttgtgaaaacgcagagggcgcaatcgccgtgcattgcaaagcgggtcttggacggaccggaacgcttatcgcctgttatatcatgaaacactacaggatgacagcggccgaaactatcgcttgggtgagaatttgccgcccaggcagtgtgattggcccgcaacaacagttccttgtgatgaaacaaacaaacctgtggctagaaggcgactactttaggcagaaactgaaaggtcaggaaaatggtcagcatcgcgccgccttctctaaactgctctccggagtggacgacatatctatcaatggtgtcgagaatcaggaccagcaggagcccgaaccctatagcgacgacgacgagatcaatggcgtgactcagggcgacagactgcgggccctgaagtctcgacggcagtccaaaacgaacgcaatccctctcaccgacggctggttgtcgcaagctgtaacctttctggaccgcttgctcatctggctgggcatccataaggactag

SEQ ID NO: 182276 - DNA, 1458 bp, Artificial Sequence
  Description of Artificial Sequence: Synthetic coding sequence
atgaagcggaagagcgagcggcggagcagctgggccgccgcccccccatgttcaagacgctgcagcagcactagtccaggggtgaagaagattcgaagtagtacacagcaggaccctaggaggcgagatccacaggacgatgtttacctcgacatcactgaccgcctctgcttcgctatactttacagtaggcctaaatccgcctccaatgtgcactatttctctatcgacaacgaactggagtacgagaacttctacgcagattttggcccactgaatctcgcaatggtgtacagatactgttgcaaaatcaataaaaaactcaaaagcatcaccatgttgcgaaagaagattgttcattttactggctccgaccagaggaaacaggcaaacgctgcattcctggtgggttgctatatggtaatatatctgggacggacccctgaggaggcttaccgtattctcatctttggcgagacctcttatattccatttcgagatgcagcctacggaagctgcaacttctacattactttgcttgattgcttccatgctgtgaagaaagctatgcaatacggctttctcaacttcaattctttcaatcttgacgagtatgagcactatgagaaagccgagaacggggatctgaattggatcatccctgatcgattcattgcattttgtggtccccactcccgagctcggctggagtctggctaccatcagcactctcccgagacctacattcagtattttaaaaaccacaatgtgacaaccatcataaggctaaacaaacggatgtatgacgccaagcggttcactgacgctggctttgatcaccacgacctatttttcgctgacgggtccacaccaacagatgccatcgtcaaggagtttttggacatatgcgaaaacgccgaaggtgcgatcgcagtacattgcaaggccggcctgggtcgcacagggactctgatcgcctgctacataatgaaacattaccgcatgacagccgctgagactatagcctgggtgaggatatgtcggcccggttcagtcattggtccacagcagcagttcctggtgatgaagcaaaccaacctgtggctcgagggagattacttccgccagaaactgaaaggccaggaaaacgggcagcatagggccgccttctcaaaactactgagtggcgtggatgacatatccattaacggcgtagagaatcaggatcaacaagagccagagccatacagtgacgatgatgagatcaacggagttacccagggggataggctgagggccttgaagtccaggaggcagagcaaaacgaacgcgatacctctgacatgtccgctggccgtgctcacctctgcactgtgctctgtggtgatctggtggatcgtttgcgactatattttgcccatcctcctgttttgccttgatgggttcaggacccagtag

SEQ ID NO: 182277 - DNA, 1380 bp, Artificial Sequence
  Description of Artificial Sequence: Synthetic coding sequence
atgaagcggaagagcgagcggcggagcagctgggccgccgcccccccctgctcccgccgctgctcttccacctcaccgggggtgaagaaaatcaggtcgagcacccagcaggatccccgtcgtcgggatcctcaggatgatgtttatctggatatcaccgatcgcctgtgctttgcaatcctgtattcacgaccgaaatctgctagtaacgtgcactacttctccattgacaatgaactcgagtatgagaacttctacgcagacttcggtccactgaacctagccatggtgtataggtattgctgcaagattaacaaaaagcttaagtccataaccatgctgagaaaaaaaatagtgcacttcactggaagcgaccagcggaaacaagctaatgctgcatttcttgttggttgctacatggtaatatacttgggtcggactcctgaagaggcctaccggatccttatctttggcgaaacgagctacatcccctttcgcgacgccgcgtacggctcatgtaatttttacataaccctgctggattgctttcatgccgtaaagaaggcaatgcagtatgggtttctgaatttcaactcttttaatctggatgagtatgaacattacgagaaggcggagaatggggatttgaactggattattcctgataggttcattgctttctgcgggccgcactcccgggcaagattagaatctggctaccatcaacactcgccagagacctacatccagtactttaaaaatcacaatgtaacaacaatcatcagacttaacaagcgaatgtacgatgccaagaggttcactgacgcggggtttgaccaccacgatctgttcttcgctgatggatcaaccccaacggatgccattgtcaaagaatttttggacatttgtgaaaatgcggaaggcgctattgctgtgcactgtaaagccgggctgggtaggacaggcaccctgatcgcatgttacattatgaagcattatagaatgactgctgcagagaccattgcatgggtgcggatatgcagacctggaagcgttattggtccacagcagcagtttctagtgatgaaacaaacaaacctgtggctcgaaggcgattatttcaggcaaaagctgaaagggcaggagaacggccagcacagagccgcattttcgaaattgctgagtggggtcgatgacatctcaataaatggagtcgagaatcaggaccagcaggagccagagccctactcagacgacgacgagatcaatggcgtcacccagggggaccgattaagggctctgaagagtagacgccaatccaagaccaacgcgatacctctgactctttcaatcagtcgaaccaagaccgtcctccgttag

SEQ ID NO: 182278 - DNA, 1497 bp, Artificial Sequence
  Description of Artificial Sequence: Synthetic coding sequence
atgaagcggaagagcgagcggcggagcagctgggccgccgcccccccttgcagccggcgatgttccagcaccagcccaggcgtgaaaaagatacggagtagtacacaacaggacccccgtcgtcgcgacccccaggacgacgtgtacctggacatcacagacagactgtgtttcgccatattatacagtcgacccaagtctgccagtaacgtccactacttttctattgacaacgagctcgagtatgagaacttttatgccgatttcggtcctctgaacctggcaatggtctaccgctattgctgtaaaatcaacaaaaaattaaagtcaatcaccatgctgagaaaaaaaatagtccatttcacaggaagtgaccagcgtaagcaagctaacgccgctttcttagtgggctgctacatggtcatctaccttgggagaactccagaggaggcctacaggattctcatctttggcgagacgtcttatatacccttccgcgacgctgcttacggatcttgcaatttctacattaccctccttgattgcttccacgcggtcaagaaggccatgcagtacggttttctaaacttcaatagcttcaatctggatgagtatgaacattacgagaaagccgaaaacggggacctcaactggattataccggaccgctttatagcgttttgtggtcctcactctagggcccggctggaatcgggttaccaccagcatagccctgaaacttacattcagtacttcaaaaaccataacgttaccacgattataagactcaacaagcgcatgtatgacgcgaagagatttacggatgctggcttcgatcatcacgacctttttttcgcagacggtagcaccccaactgatgcaattgtaaaagagttcctcgatatatgcgaaaacgccgaaggcgccattgcagtccattgcaaggccgggctcgggagaactggcaccctaatcgcctgttatattatgaaacattatcgtatgaccgccgccgagaccattgcttgggttcgaatttgtagaccaggcagcgtgataggtccccagcaacagttcctggtcatgaaacagaccaacctttggctggaaggtgactattttcgccagaagctgaaaggacaagagaacggacagcacagagccgcctttagcaagctcctctcaggggtagatgacatctccataaatggcgtagagaatcaagaccagcaggaacccgaaccctactctgatgacgatgagattaatggagtcacacaaggggacagactgagggcgctgaagtcccgcaggcagtcaaagacaaacgccattccgctgacagtcatcctgcagtcctctgttcagtcttgtaagacttcagagcctaatatctccgggtctgcgggtatcactaaacgtacgactaggtcagcaagtcgcaagagcagcgtgaaatctctgagtatctctcgcaccaaaaccgtactgaggtag

SEQ ID NO: 182279 - DNA, 1386 bp, Artificial Sequence
  Description of Artificial Sequence: Synthetic coding sequence
atgagccgggagggcgccggcgccgccctggtggccgaggtgatcaaggaccgtttatgctttgcaattctgtacagtcggcccaagtcagctagcaacgtacattatttttccattgacaatgaactcgagtatgaaaatttttatgctgatttcggcccattaaatctggccatggtttaccgttattgttgtaagataaataaaaagctgaagagcattactatgcttaggaaaaagatcgttcattttacagggtcggatcagcgaaagcaggccaatgcagcattcttggtgggctgctatatggtgatctacctaggtcggacaccggaggaagcgtatcgaattttgatattcggcgagacatcctacatcccgttcagagatgccgcttacgggagttgtaatttctacataaccctgctcgactgcttccacgcagtgaaaaaggccatgcagtacgggttcctgaacttcaactcattcaatctggatgagtatgaacactacgagaaagcagaaaatggagacttgaattggatcatccctgatcgatttattgccttttgcggtccccactcccgcgcaagattggagtccggataccaccagcactcacctgagacctacatacagtattttaagaaccataatgtgaccacgattatacgcctcaataagagaatgtatgatgcaaagcggtttacagacgcgggtttcgaccatcacgatctgtttttcgccgacgggagcacaccaacagacgccatcgtcaaggagttcttagatatctgcgagaatgcagagggggcaattgcggtgcattgcaaggcagggctgggacgcacagggacgctgatcgcgtgctatattatgaaacattacagaatgacggccgccgaaaccatagcttgggtgcgcatatgcagacctggatccgtcattgggccccagcagcagttcttggtgatgaagcaaactaatctgtggctcgagggagactatttccggcagaaactaaaaggtcaggaaaacgggcagcatcgggctgcgtttagtaagctcctctcgggggttgacgacatctcgattaatggcgtcgagaaccaggatcagcaggaacctgaaccctattcagacgatgatgagatcaatggagtgacacagggggacaggctccgcgcactgaagagtcgccgccagagtaaaacaaacgcaatcccccttacagtgatcctgcagtcttctgtacaaagctgcaaaaccagtgagcctaacatttccgggtccgccgggatcacgaagaggacgacacgaagcgcaagccgtaagtcaagcgtgaaatctctgagtatctcccgaaccaagacggtgttgcggtag

SEQ ID NO: 182280 - DNA, 1458 bp, Artificial Sequence
  Description of Artificial Sequence: Synthetic coding sequence
atgaagcggaagagcgagcggcggagcagctgggccgccgcccccccatgttcacggcgctgctcctccacttctcctggagtcaagaaaattcgtagctctactcaacaggacccgcgcaggcgggatccccaggacgatgtttacctagacattactgaccgtttgtgttttgctatattatacagccggcctaagtcagcttcaaatgttcattactttagcattgataatgagcttgaatatgaaaatttttacgccgacttcggtccgcttaacctggctatggtgtatcggtactgttgtaaaatcaacaagaagctgaagagtataacaatgctcaggaaaaaaatagtgcactttacgggctcagaccagaggaagcaagctaatgccgcatttttggtcgggtgttacatggtgatctacctcggccgaacccctgaagaggcataccgcatcctcatatttggagagacctcctacattccttttagagatgcagcctacgggagttgcaatttttacatcacgctgcttgactgtttccatgccgtcaagaaggcaatgcagtacggatttctgaatttcaattcattcaacctcgatgagtatgagcactacgagaaagcagagaacggggacttgaactggatcatccccgacagattcattgctttctgtggaccccactccagggctagactggaatctgggtaccatcaacattccccggaaacttacatacaatattttaagaaccataacgttaccaccatcataagattgaataagcgcatgtacgatgccaagcgttttactgacgctggatttgatcatcatgaccttttctttgctgatggatctactcccacagatgctattgtgaaggagttcctagatatttgtgagaacgcagagggggccattgcagttcattgtaaagccgggctggggcggaccggcacgttaatagcatgttatatcatgaagcattatcggatgaccgccgcagaaaccattgcttgggtgaggatctgtcggcccgggtcagtgattgggccacagcagcagttcttggttatgaaacagactaacctctggttggagggagactatttccgacagaagctgaaggggcaggagaatggacagcaccgagcagccttttcaaaactgctctccggagtcgacgacatcagcataaatggcgtggaaaatcaagaccaacaggagccggagccgtattctgatgacgacgaaatcaatggagtgactcagggcgacaggctccgtgccctcaagtcccggcgacagtccaagacaaatgcaatccctctcacatgtccgttggctgtccttaccagtgcgctttgtagcgtggtcatctggtggattgtttgtgactatatactgcctatccttctgttttgtctcgatggattcaggacccagtag

SEQ ID NO: 182281 - DNA, 5346 bp, Artificial Sequence
  Description of Artificial Sequence: Synthetic coding sequence
atgagcggcgaggtgcggctgcggcagctggagcagttcatcctggacggccccgcacaaactaacgggcagtgcttcagtgtagagactttgcttgatatattaatctgcttatacgacgaatgtaacaactcaccattgaggagggagaaaaatatcctggaatatctggagtgggcgaagccatttacttcaaaagtgaagcagatgagactccaccgcgaggactttgagattctaaaggttataggcaggggggccttcggcgaggtcgctgtagtaaagctgaaaaacgccgataaagtttttgccatgaagattctgaacaagtgggaaatgctcaagagagctgaaacggcctgttttcgggaagagcgcgacgtgttggtcaacggggataacaagtggatcaccacactgcactatgcttttcaggacgataacaacctctatttagtgatggactactacgtgggcggggacctgctgacgctgctgtcaaagttcgaggataggctacccgaggacatggcccggttctatctcgctgagatggttattgcaattgatagcgtacatcagctacattacgtacacagagacataaaaccagacaatatacttatggacatgaacggtcatattcgtttggctgactttggctcatgtctcaagctgatggaagacgggactgtgcagtccagcgtggcagtgggcacaccagactacatttccccagaaatccttcaggccatggaggatggtaaggggcgctatggaccagaatgtgattggtggtctctgggggtgtgcatgtacgaaatgctctatggggagactcctttctatgccgaatccctcgtcgaaacctacgggaagatcatgaaccataaagaacgcttccagttccctgcacaggttacggacgtgagcgagaatgcgaaggatctaattcgaagactgatctgttcaagagagcaccggctcggccagaatgggatcgaggactttaagaagcatccattcttcagcgggatcgattgggacaacattcggaattgtgaggccccgtacatccccgaggtttcctcccccacggatacctccaattttgatgtggacgatgattgtttgaagaactccgaaacaatgccaccaccaacccacacggcattctccggccatcatctgccgtttgtgggatttacctatacaagcagctgtgtgttgagcgataggagctgtttgagagtgacagccggcccaacctctctcgacttagatgtaaatgtccagcgcacattggacaataatctggccaccgaagcatatgaaagacgtatcaaacgactagaacaggagaaactggagctgagtcgcaagttgcaggaatctacccagactgtgcaggccttacagtattccaccgtagatggtccgttgacagcaagtaaagacttggagatcaagaacctcaaggaggaaatagagaagctgagaaagcaggtgacagagtccagccaccttgagcaacagctcgaagaggcgaacgctgtgagacaggagctcgacgacgctttccgccaaattaaggcgtacgagaaacaaattaaaacgctgcagcaggaacgcgaggaccttaataaggagcttgtgcaggcgtccgagcgtctgaaaaatcagtcgaaggagctgaaagatgcacattgtcagagaaaattggctatgcaagaatttatggagatcaacgaacgccttactgaactccacacgcagaagcagaaactggcccgtcatgtgcgtgacaaggaggaggaagtggatcttgtgatgcagaaagtagaatctctcagacaagaactgcggcgtaccgagagggcaaagaaagaactggaagtgcataccgaagctctggccgccgaagccagcaaagatcgcaagctacgagagcagtctgaacactatagcaagcagttagagaatgagctggagggactgaaacagaaacagatcagctactcaccgggtgtgtgttctatcgaacaccagcaggagataaccaagctgaagacagatttggaaaaaaagtctatcttttatgaagaagagctctccaaacgtgaagggattcacgccaacgagataaaaaatcttaaaaaggaactgcatgattcagagggtcagcagcttgctttaaataaagagattatgatcctgaaagacaagctcgagaagactcgccgtgagtcccagtctgagcgggaggaatttgagagcgagtttaaacagcaatatgagagggagaaggttctcctgacagaggagaacaaaaaactaacctccgagctagataaactgacaacgttgtacgagaatcttagtatccacaaccagcagctggaggaggaggtgaaggatttggcggacaagaaggaaagcgtggcccactgggaagcccaaatcaccgagatcatccaatgggtgtctgacgagaaggacgcccgtgggtatctgcaggcactcgcatctaaaatgacagaagagctggaagctctgcgaaattcctcattaggtactagggctacagatatgccctggaaaatgcgccggtttgccaaactcgacatgtcagcacgcctggagctgcagagtgccttggatgctgagatcagggccaagcaggcgatccaggaagaactcaataaagtgaaagcgagcaacattatcaccgagtgcaagcttaaggattctgaaaagaaaaatctcgagctcttgagtgaaattgagcaactcatcaaagacacagaagagttacggtcagaaaagggcattgaacatcaggatagtcagcatagtttcctagcctttctgaatactcctactgatgccctggaccagtttgagaccgttgattccactcccctctctgtgcacacccccacccttcggaaaaaaggctgcccaggatctacaggatttcctccaaaacggaaaacgcaccaattcttcgttaaatctttcacaacaccaaccaaatgtcaccagtgcacttctttgatggtgggactcattcgtcaaggctgcagctgtgaagtgtgtggtttttcctgtcatatcacatgtgtgaacaaagcccccacaacatgccctgtgccgcctgagcagacgaagggccctcttggaatcgaccctcagaaagggattggcactgcctacgaaggacatgtgcgtatcccgaagccagctggcgttaaaaaggggtggcagcgggccctggcgattgtctgtgactttaagttgtttctgtacgacatagccgagggcaaagccagtcagccttctgtagtgatttcccaggtgattgatatgagggacgaggagttcagcgtgtcaagtgtgctggcctccgacgttatccacgcctcccgaaaagacatcccatgcatcttccgcgttacagcctcgcagctgtcagccagcaataataaatgctctattctgatgctggccgacactgagaatgaaaaaaacaagtgggtgggcgtgctttctgagctgcacaagatcttgaaaaagaataagtttagagaccgcagcgtgtacgtgcctaaagaggcttacgatagcactttgcctctaatcaagaccacgcaagctgctgcaataattgatcacgagcgcatagcactaggaaatgaagaaggactgttcgtggtgcacgtaactaaagacgagataattcgcgtaggggacaataaaaagatccaccaaatagaactgatccctaacgatcagcttgtagccgtcatttctgggcggaatagacatgtcagactgttccccatgagtgccctggacgggagggagacagatttttataagctgagtgaaaccaagggctgccaaactgttacgtctggcaaggttcggcacggagctcttacttgtttgtgcgtggctatgaaacgacaagtgttatgctatgagctgttccagagcaaaacacggcaccggaagtttaaggaaattcaagtaccgtataatgttcagtggatggcgatcttctctgaacagctatgtgtagggtttcagtctgggttcctgaggtatccccttaatggagaaggtaatccatacagcatgttgcactcgaacgaccatacactgtccttcattgctcaccagccaatggatgcaatctgtgcagttgagatttcatctaaagagtacttgctgtgctttaactctatcgggatctacacagattgtcaaggcaggcgctcaagacagcaagagctcatgtggcctgccaatccctctagctgttgttataatgccccatatctttcagtctattccgagaatgccgtcgacattttcgacgttaacagtatggagtggatccaaaccctgccgctcaaaaaggtccgccctcttaataacgagggcagtctcaatttgctgggcctcgagaccattcgattgatctatttcaaaaataagatggctgagggcgacgaattggttgtcccagagaccagtgataattctcgtaagcagatggtccgtaacatcaataacaagcgtcgctattctttccgagtacctgaagaagaacgaatgcaacaaagacgcgagatgctcagggaccctgaaatgcggaacaagttgatatctaatccaactaacttcaatcacattgcccatatgggaccaggagacggcattcaaatcttgaaagatctgcccatgccggggttcccgtatcctagcccccatcatcacagtggcttaatttcctcccctattaacttcgagcatatctaccacatgaccgtgaactcagccgaaaagttcctatcacctgactccatcaatcccgaatattcacctagcctgagatctgtgcctggcaccccgtccttcatgaccctgagaaatccccgacctcaggaatctcgtacagtctttagcggtagtgtgtctatcccttcaattaccaagtctcgcccggaacctggacgatccatgagcgcatcctcgggcctgagtgcacgctcttccgcccagaacggcagcgcacttaaacgcgaattctcaggaggcagctattctgcgaaaagacagccaatgccaagtccatcagagggctcgctgagttcaggggggatggaccaggggagcgatgcccctgctagggatttcgatggggaagattctgattcacctcggcattcaacagcgagtaacagtagcaatctcagctcgccaccaagccccgcctcaccacgaaagaccaagagtctttccctcgaatccactgatcgcgggtcttgggacccatag

SEQ ID NO: 182282 - DNA, 2457 bp, Artificial Sequence
  Description of Artificial Sequence: Synthetic coding sequence
atgatcctgaaggacaagctggagaagacccggcgggagagccagagcgaacgggaagaatttgagtctgagtttaagcagcaatacgagcgtgagaaggtgcttctcacagaagaaaataagaaactcacttctgagcttgacaaattaacaacattatacgagaatctttccattcacaaccaacagctcgaagaggaagtcaaggatctggccgacaagaaggagagcgttgcacattgggaagcacagataacggagatcatccaatgggtgtccgacgagaaggatgcccgcggatatcttcaggcattagccagcaagatgaccgaggagctcgaggccctgcggaattcctcgttggggaccagagccactgatatgccctggaagatgcggagatttgccaagttagacatgagtgcccggcttgagcttcagtcagcactggacgccgagatccgagcgaaacaggccattcaggaagagctgaacaaggtgaaagcaagtaacattatcactgaatgcaagttaaaggactcagagaagaagaatttggaacttttatcagagatcgagcagttgatcaaagataccgaggagcttcgaagtgagaaaggcattgaacatcaagattcccagcattctttcttagcattcctaaacacaccgacggacgctctcgatcagtttgaggactctttcagttcttcgagctctagcctgattgatttcctggatgataccgatccagtggaaaatacgtacgtctggaatccgagtgttaagttccatatccagtcccgttcaacttcccccagcacttctagcgaagcagaacctgtgaagacagtggactccacacccttaagtgtgcatactcctaccttgcggaagaagggatgcccaggcagtacgggattccctcctaaacgaaagacacatcagttctttgtcaagtcctttactactccaactaagtgtcaccaatgtaccagcctgatggtggggctgatcaggcagggctgcagttgcgaagtgtgtgggtttagctgccatattacatgtgtgaacaaggcaccgacgacatgtccagtgccaccagagcagacaaaaggtcccctgggtatcgaccctcaaaaaggcattggaacagcctatgagggacacgtgcgaatcccgaaacctgccggcgtcaaaaaaggctggcagagggccttggctattgtgtgtgattttaaactctttctgtatgacattgccgagggcaaagcttcccagccatctgtggtgatcagccaggtaatagatatgagagacgaagaattcagtgtgagctcagtcctcgcttctgacgtgattcacgctagtagaaaggatataccttgtatatttcgagtcactgcctcacagctctctgcctccaataacaaatgtagcatactgatgctggcggatactgaaaatgagaaaaacaagtgggtgggcgtcctgagcgaactgcacaaaattctgaagaaaaataaatttcgggatagatcagtatacgtgccgaaggaagcctacgactcaactctcccgttgatcaagaccactcaagcggccgcaatcattgatcacgagaggattgccctcggcaacgaagaagggctgttcgttgtgcacgtgacaaaggatgaaatcattcgggtgggcgacaataagaagatccaccaaatcgagctgatcccgaatgatcaactggttgccgtcatctctggcagaaatcgacacgtgaggctttttccaatgtcagccctggatggcagagaaaccgacttctataagctgtccgagacaaaaggatgtcagaccgtgacgtcaggaaaggtccgtcatggcgcactcacatgcctgtgtgtggccatgaaacggcaggttttgtgctacgagctctttcagtctaaaacccgacatcgaaaattcaaagagattcaggtgccctataacgtccagtggatggccattttctctgaacagttgtgcgtaggattccagtcaggattcctgaggtatccattgaatggggaaggcaacccctacagcatgctccatagtaacgaccacacgctcagtttcattgcccatcagcccatggacgctatttgcgccgtagagatttcctctaaagagtacctgttgtgctttaatagcatcggaatttacaccgattgtcagggacgcagatccagacagcaggagcttatgtggccagccaacccctcttcttgctgctataacgccccttacctgtctgtgtactccgaaaatgctgtggacatcttcgacgtaaattcgatggagtggatacagaccctacccctgaagaaagtgaggccattgaacaatgagggaagtttgaacctcctggggctagaaactattcggttgatatattttaaaaataaaatggcttag

SEQ ID NO: 182283 - DNA, 5076 bp, Artificial Sequence
  Description of Artificial Sequence: Synthetic coding sequence
atgagcggcgaggtgcggctgcggcagctggagcagttcatcctggacggacccgctcagactaatggacaatgtttttccgtggagacacttctggacatcctgatatgtttgtatgatgaatgtaataattcacccctgcgccgggagaaaaacatcttagagtatttagaatgggcgaagcccttcacctcaaaggtgaaacaaatgcgactgcacagagaggattttgaaattctcaaggtcataggacgtggcgcttttggcgaggttgccgtggtgaagttgaaaaatgccgacaaggtctttgccatgaaaatccttaacaagtgggaaatgcttaaacgtgcggaaaccgcctgttttcgagaagaaagggatgtccttgtcaatggggataataagtggatcacgacactgcactacgcctttcaagacgacaataatttgtacctcgtgatggattactatgtgggcggcgacttgctgacactcttgtcgaagtttgaagatagactgcccgaggatatggctaggttctacctggctgagatggtgatagccattgattctgtccaccagctgcattatgttcaccgcgatataaagccggacaatatactcatggatatgaatgggcacatccggttggctgattttgggagttgccttaagctgatggaagacggtaccgttcagagcagcgtggcagtgggaacacctgattacataagtcccgaaattctccaggccatggaagatggcaagggccgatatggccctgagtgcgactggtggtccttaggagtatgtatgtacgagatgctgtacggggaaacccctttctacgccgaaagtttggtggagacgtacgggaaaatcatgaaccataaagagcgatttcagttcccagcacaggttacggacgtttctgagaacgcaaaggatctgattcgtcgcttgatctgctctcgcgagcacagactcggtcagaatggaatcgaggatttcaaaaagcatcccttcttctccggcattgactgggataacattagaaactgtgaggccccatacattcctgaggtgtcctcgcccacagatacaagtaactttgacgtggatgatgattgcttgaagaactcagaaactatgcctcctcccacccacacggctttctccggtcaccacctcccctttgtgggctttacgtacacatcttcctgcgtgctctctgaccggtcttgcctccgagtcacagcgggccccacctcgctggacctggacgtgaacgtgcaaaggacccttgataacaatcttgccacagaagcatatgagagacggattaaaagactagagcaagagaagctggaactcagccggaaactgcaggaaagcacccagactgtccaggcactgcagtattccacagtagatggccccctaacagctagcaaggacctggaaataaaaaacctcaaggaggagatcgagaaattgaggaagcaagtgacggaatcctcccatctcgagcagcagttggaggaagcaaatgccgtgcgtcaggagcttgacgatgcattccgtcaaatcaaggcctatgagaagcagatcaaaactctccagcaggagcgcgaggatctgaataaagagctagttcaagcaagcgaaagactgaagaaccagtcgaaagaacttaaagacgcccattgccagcgcaaattggccatgcaagaatttatggaaattaacgaaagactgactgagctgcacacacagaagcagaagctcgcacgacacgtgcgagataaggaagaggaggtggatctggtgatgcaaaaggtggagagcttgcggcaggaactgcggaggactgagcgagccaaaaaggagttggaggtgcatacagaagcactggctgccgaggcctccaaggaccggaagctcagggaacaatctgagcactacagcaagcagttagagaacgagctagagggtctgaaacagaaacaaataagttatagtccaggggtgtgttcaattgagcaccagcaggagattacaaagttgaaaacggacctggaaaaaaagtccatcttctatgaggaagaactgagcaagcgggagggaatacacgccaacgagatcaagaacctgaaaaaagagctgcatgactccgagggacaacagcttgcactgaataaggaaattatgatcctgaaagacaagctggaaaaaacgagacgagagagtcagagcgagagggaggagttcgagtctgagtttaagcagcagtatgaacgcgaaaaagtgctgttgacggaggagaacaagaagcttacttctgaactggataagctcacgaccctctacgaaaatttatccatccacaatcagcaacttgaggaggaggttaaggacctagccgacaagaaggagtcggttgcccattgggaagcacagattactgagataatccaatgggtgtcagatgaaaaagatgctcgggggtacctccaggctcttgcatcgaagatgactgaagagctggaggccttaaggaatagctctcttgggacacgcgccactgatatgccctggaagatgcgaaggttcgccaaactcgacatgtctgctaggttggaactgcaaagcgccctcgacgccgagatccgcgcgaagcaggctatacaggaagagctgaataaagtgaaagcatctaacatcatcaccgagtgcaagttgaaggactcagagaagaagaatttagagctgctgtctgaaattgagcagctcataaaggacaccgaggaactcagaagtgagaagggaatagaacaccaggattcccagcattctttcttggcttttttgaatactccaaccgacgccttggatcaatttgaacgcaagacccaccagttcttcgttaaatcctttacaactcccacgaagtgccatcaatgtacaagcctgatggtggggctcatcaggcagggatgctcatgtgaagtgtgcggcttcagctgccacataacttgcgtgaacaaagcacctaccacctgcccagttcctcccgagcaaacaaagggacccctaggaatcgacccccagaaaggaatcgggacagcatatgaggggcacgtccggatccccaagcccgccggtgtgaagaaaggctggcaacgtgcgttggccatcgtttgcgacttcaagttatttctgtacgatattgccgagggtaaagcctcacagccaagtgtggtgataagccaagttatagacatgcgcgacgaagaattctccgtctcctcagtgctggccagtgatgtgatccacgccagtcgaaaagatatcccttgcatttttcgagtgactgctagccagctcagcgccagtaacaataagtgtagcattctcatgctggcagataccgagaacgagaagaataaatgggtgggagtcctgagtgaactccataaaatcctgaagaagaacaagttcagagatcggtcagtgtacgtgcccaaagaggcatatgactcgacactgccattgatcaagaccacgcaagccgccgctatcatcgatcatgagcggatcgccctcgggaacgaggaaggcctgttcgtcgtccacgtgactaaggacgaaatcataagggtcggagacaacaagaaaatccaccagatagagcttatcccgaatgatcagctggtcgcggtcatcagtggacgaaaccgccacgttcgcctgtttccaatgtccgccctagacgggcgagaaactgatttttacaaactttcagaaacgaaggggtgtcagaccgtcacctctggaaaagtgagacatggagctctgacttgcctgtgcgttgctatgaagcgtcaggtgctctgttatgagctttttcagagcaagacccggcaccgcaaattcaaagaaatccaagtgccctataacgtgcaatggatggctatttttagcgagcagctctgcgtaggattccaatcaggattcctcaggtatccccttaacggtgaaggcaatccttactccatgctccacagcaatgatcatactctctcttttattgcacaccagcctatggacgcgatctgtgcagtcgaaatttcttctaaggagtacttactgtgctttaacagtattgggatatacactgactgtcagggacgacggtcgcgccagcaggaactgatgtggccagccaatccctcgtcctgctgttacaacgccccctacctgtctgtgtactcagagaacgccgttgacatcttcgacgtcaattccatggaatggattcaaactctgcccctgaagaaggtgcgacccctgaacaacgaggggagtctgaacctgctcggcctcgagactattagactgatctatttcaaaaacaagatggctgagggcgacgagttggttgtgccggagaccagtgacaactctaggaagcagatggtccgtaatattaacaacaaacggcggtattcttttcgcgtccctgaagaggaacgcatgcagcaacggagagaaatgcttcgagatcccgagatgcggaacaaactcatatcaaaccccaccaattttaaccatatcgcccatatgggccccggggatggaatccaaatcctgaaggaccttcccatgaacccacggccacaggagagccgcaccgtgttttcgggttccgtgagcatcccgtccataacaaagagccggcccgagccaggcagatcaatgtctgcttcttcagggttgtctgccaggtcctctgcccagaatggcagcgctctgaaaagagaattctctgggggatcgtattccgccaagcgacaacccatgcccagtcctagcgagggcagcctctcatctggaggtatggatcaagggtcagatgcccctgctagagacttcgatggtgaggactcagactctcccagacactccaccgcatccaacagcagtaatcttagtagcccacctagcccagctagcccgaggaaaaccaaaagtctgagcctggaaagtaccgaccgcggcagttgggacccatag
